United States Patent 12,569,549 (FLAVIVIRUS VACCINE) - sequence listing, part 68

SEQ ID NO: 23466 - RNA, 9873 nt, synthetic construct
  misc_feature 1..9873: note = derived and/or modified CDS sequence (opt6) from DENV-3__EU482455__SS-prME
  source 1..9873: mol_type = other RNA
acatcgctttgtttaatgatgatgcttccagcaacattagctttccatcttactagccgagatggtgaacctcgaatgatagtggggaaaaatgaaagaggaaagagcttgctttttaaaacagcatcaggaataaatatgtgtacacttatagctatggacctcggagaaatgtgcgacgatacagtgacgtataaatgtccattggtcgcagaagtagaaccagaagatatagattgttggtgtaacttaacaagcacttgggttacatacggaacgtgtaaccaagccggagaacacagaagagataagcgatcagtagcattagcaccgcacgtgggaatgggtctagatacgcgtacgcaaacatggatgagcgcagaaggagcctggagacaagtagaaaaagtagaaacttgggctttgcgacacccagggttcactatattggccttgttcctagcacattatatcggtaccagcttgactcaaaaagtcgtaatattcatattactcatgctagtaacgccaagtatgactatgcgatgtgtcggtgtaggaaatcgggatttcgtcgaagggctatcaggagcaacgtgggttgacgtcgtgctcgaacatggtggatgcgtaacgacaatggccaaaaataaaccaacattagacatagaactacagaaaactgaagccacacagcttgctacacttagaaaattatgcatagaaggaaaaattactaatattacaactgacagtaggtgtccaactcaaggtgaggccatactgccagaagaacaggaccaaaattatgtgtgcaaacacacttacgtcgataggggctggggtaatggatgtggattattcggtaaagggagtctcgtaacgtgcgcaaaattccaatgtctagagcctatagaaggaaaagttgttcagtatgagaatttaaaatatacagtcataataactgttcatacaggagaccaacaccaggttggcaatgatacgcagggggtaactgtggaaattacaccacaggcatctacagtagaagcagtattgccggaatacggcacgttaggtctggaatgcagcccacgcacaggactggattttaatgaaatgattctactgacaatgaaaaataaagcatggatggtgcaccgacaatggtttttcgatcttccgctaccgtggacaagcggagctaccactgaaacaccaacgtggaacaagaaagaactattagttacatttaaaaatgctcacgccaagaaacaagaggttgttgttctaggcagccaagaaggagctatgcatacagcattaaccggggcaacagaaattcaaaactcgggaggaacatctatcttcgccggtcatctcaaatgtcgtctaaaaatggacaaacttgagcttaaaggaatgagttatgctatgtgcctaaatacgtttgtattaaagaaagaggtaagtgaaacacagcatgggacaattctgattaaagtagaatacaaaggagaagacgctccatgcaaaatccctttttcaacagaagatggacaaggtaaagctcataatggtagactcataacagcaaacccagttgttacaaagaaagaagaacccgtaaatatagaggcggagccaccgtttggagagagtaacatcgtaattggtataggagataaagcattaaaaataaactggtataagaaaggcagctcaattggtaaaatgtttgaggcaactgctagaggagcgcgtcgaatggcaatattaggagataccgcatgggactttggaagtgtaggaggggtgttaaactccttaggcaaaatggtacatcaaatattcggaagcgcttacacagccctattttccggggtgtcatggataatgaaaattgggatcggcgtattgcttacatggatcggactaaactctaaaaatacctccatgtcattctcctgcatagtcataggtattataacactatatctaggagctgttgtacaagcggatatgggttgcgcaataaattggaaaggtaaagaattaaagtgcgggagcgggatttttgtaacaaatgaagtgcatacttggaccgagcaatacaaatttcaagctgatagtccgaaacgccttgcaacagcgattgctggagcttgggagaacggtgtctgtggcataagaagtactacccgcatggaaaatcttctctggaagcaaatagctaatgaactgaattatatattatgggaaaataatataaaactgactgtggtggtaggggatattataggtgtattagagcagggcaagcgcaccctcactccccagcctatggaattaaagtactcttggaagacttggggaaaagcaaaaatcgtcactgcagaaacacaaaattcaagttttataattgacggcccaaacactccggaatgcccgtctgcttcacgagcctggaatgtttgggaggtagaagattatgggttcggtgttttcactacaaacatatggttaaaactgcgggaagtctatactcagtcatgtgatcaccgacttatgtccgctgcaataaaagatgaacgggcggtacatgcagatatggggtattggatcgaatctcaaaagaatggaagctggaagctggagaaagccagctttatagaagtaaaaacatgcacttggcccaaatcacatacattatggtccaatggagttttggagagcgatatgataataccgaaaagcctagcaggcccaataagccagcacaaccacaggcctggatatcatacacaaacagccgggccctggcatttagggaagctagagttagattttaattattgcgaaggtacaacagtagtaataactgaaaactgtggaacccgagggccatctctacgaacgacgacagtttcgggtaaattgattcatgaatggtgctgtagatcatgtacgttgcctcccctacgatacatgggagaggatggatgctggtatggtatggaaatcaggccaattaatgaaaaggaagagaatatggtgaaaagtctagtttcagcagggtctggcaaggtcgataacttcacaatgggggtcctttgtcttgcaattctattcgaagaggtgatgcgggggaaattcgggaagaaacacatgattgccggcgtactttttacttttgttctgctcttatccggacaaatcacttggcgagatatggcacacaccttaatcatgataggatcaaacgcttctgaccggatgggaatgggagtcacttatttggctctgatagccacatttaaaattcaaccatttttagcattaggatttttcttgaggaaactaaccagccgagaaaacttattactaggtgtcgggctagctatggcaacgacactacaactcccggaagacatagaacaaatggcgaacggtattgctctgggcttaatgactcttaaactaattacacaatttgaaacctaccaactgtggacagcattagtatcgttgacttgttcaaatactatttttacactaacggtagcatggagaactgccactttaattttagcgggagtttcccttttacctttgtgtcaaagtagctcgatgaggaagactgattggttacctatgacggtcgcagcaatgggagttccaccacttcctctatttatatttagtttaaaagacacaccaaaaagacgaagttggccactaaatgagggagttatggccgtcggattagtctcaatactcgcatcatcattacttagaaatgacgtaccgatggcaggcccactcgttgctggaggattacttatagcttgttatgtcataactggaacaagtgctgatctcacagtagaaaaggcggcagacgtcacttgggaagaagaagctgaacagactggagtttcacataacttaatgatcactgtggatgacgatggcacaatgagaataaaagacgatgaaacagaaaacattttgactgtattactaaaaactgccttgttaatagtaagtggcattttcccatattctatacccgctaccttactcgtatggcatacatggcagaaacaaactcagaggagtggcgtcctatgggatgtcccaagtccacccgaaacgcagaaggcggaactagaggagggagtctacagaatcaaacaacaaggaatctttggtaaaacgcaagttggagtaggagttcaaaaagagggagtatttcatacaatgtggcatgtcacaagaggagcagtgttaacacataatggaaaaagactagaacctaattgggcttcagtgaagaaagatctcatctcatacggaggagggtggcgactatctgcacagtggcaaaagggcgaagaggttcaggtaattgcagttgagccaggcaaaaatcccaaaaactttcaaacgatgccgggtatattccaaactacaacaggagaaataggtgcaatagccctcgatttcaagccaggtacaagcggttcgcctattattaatagggaagggaaggttgttggtttatatggtaacggcgtagtaaccaaaaatggaggatatgtgtcaggaatagcacaaactaacgcagaacctgacggaccaacaccagaactagaggaagaaatgttcaagaaaaggaaccttacaataatggatttacacccgggatctggtaagactagaaaatatttgccagcgatcgttcgagaagctatcaaacgacggttacggaccttaattctcgccccaacacgcgtggtggcagcggaaatggaggaggcattaaaaggcctgcccataagatatcaaacgaccgccacaaagtcggagcacacaggcagagaaatcgtagacctaatgtgccacgctacattcactatgcgactactctcaccagtaagagtaccaaactataacttaatcattatggatgaggcacattttacagatcctgcatcaattgcagcacgaggttacattagcactagagttggaatgggagaagcagcagcaatttttatgacggcaacaccccctggtacggcagaagcgtttcctcaaagtaacgcaccgattcaggacgaagaacgcgatataccagagagatcttggaacagtggcaacgagtggataacagatttcgtcggtaaaacagtttggtttgttccaagtataaaagcgggtaatgacattgccaactgccttaggaaaaacggaaagaaagtgatacaattgagccgaaagacatttgacacagaatatcaaaagactagattaaacgattgggacttcgtggtaaccacggatattagtgagatgggggccaactttaaggcagatcgcgtaattgacccaagacgttgtttgaaaccagtaatactgactgatggccctgaacgagtaattctagccggaccgatgccagtaaccgctgcttcagcagctcaaaggagaggaagggttggaagaaatccccaaaaagaaaacgatcaatatatattcacaggtcaaccccttaacaatgatgaagatcacgctcattggacggaggcaaaaatgctactcgataatattaatacgccagagggtattataccagccttattcgaacctgagcgagagaagagtgcagctattgacggtgaatatagacttaaaggcgaaagccgtaagacttttgtggaactaatgagacgcggagaccttcctgtgtggttagcacacaaagtagcctcagaagggataaaatatacagacagaaagtggtgtttcgacggagagagaaataatcaaattttagaagaaaacatggacgtagaaatatggacaaaggaaggggaaagaaagaaactacgacctaggtggctggatgcaaggacgtactcggaccccttagctctgaaagagttcaaggacttcgcagcgggtcgaaagagtatagcatttgatctagtaaccgaaattggacgcgttccctctcatttagcctatcgcacaaggaatgccctcgataatctcgtcatgctacatacatcagaacacggaggtagggcttatcgacacgcggttgaagaacttccggaaactatggaaactttactactcctaggccttatgatactccttacaggtggggcaatgttattcttgatttccggcaagggaatagggaagacatctatcggcttaatatgcgtaattgttagcagtggaatgttatggatggcagacgtacctctgcaatggattgcaagcgctatagtgctcgagtttttcatgatggtccttcttataccggagcctgaaaaacaaagaactccgcaggataaccagctggcctatgtagtcataggaatattaacattagccgccattgtagctgcaaacgagatgggattgctagaaactacgaagagagatttaggaatgagtaaagagccaggtgtcgttagtccaacatcgtatctcgatgttgatctacaccctgcatcggcatggactttatacgcagtagctaccacggtaataacaccaatgttacgccatacaattgaaaatagcacggccaatgtaagtttagcagcaatagcaaatcaagccgttgtactgatgggactagacaaaggatggccaatctcaaaaatggacttaggtgttcctttgcttgcattagggtgttacagccaagtaaaccccctcacgttaaccgcagccgtcttactattagtaacacattatgcaattataggtccaggccttcaggcgaaagcaacgagggaggcgcaaaagcgtacggccgctggtataatgaagaatccgacagtagacggaataatgacaatcgacctagatccagttatttatgatagtaagtttgaaaaacaacttggtcaagtaatgctgcttgtattgtgtgcagtccaacttctgttaatgaggactagctgggcgctatgtgaagcactaacgctagcaaccggccccattacgacattgtgggaaggaagtcctggtaaattctggaacactacaatcgccgtaagtatggctaacatttttagaggaagctatttggcaggagcagggctagcatttagcattatgaaatctgtaggaataggtagacggggaactggaagccagggggaaaccctaggggaaaagtggaagaagaaattgaaccaacttagtcgaaaagagttcgatttatataagaaaagcggaataactgaagtcgatcgaacagaagcgaaggaggggcttaagcgaggagaaaccacacaccatgccgtcagccgggggtcagcaaaattacaatggttcgttgaaaggaacatggtaatacctgaaggaagagtaatcgacttaggatgcggacgaggaggttggtcatattactgcgccggattgaagaaggttacagaagttagagggtacaccaagggtggacctggacatgaagaaccggttcctatgagcacgtacggatggaatatagtgaagctgatgtctggaaaagatgtgttttatctgcctccagaaaaatgcgacacattactatgcgacataggggagtcatcgccttcgccaacagttgaggagtctaggacaatacgggttttaaagatggtagagccatggctcaaaaataatcagttttgtatcaaagtcctaaacccgtatatgccaactgtaatagaacacttggaacgtctccaaagaaagtacggtggtatgctggtaaggaacccactaagtcgcaattcgacacatgaaatgtattggataagcaacgggactggaaatattgtaagctcagtaaatatggtgagtcgtttactactgaataggtttacgatgacacataggagacccacaatagaaaaggatgtggatctaggtgcaggtacgcgtcacgtcaacgccgaaccagaaacgccaaatatggatgtaataggagaaagaataaaacgtataaaagaagaacatagttcaacgtggcattatgacgatgaaaatccatataagacatgggcctatcatggctcttatgaagtcaaagccacaggtagtgcgagtagtatgatcaacggagtagtgaagctgttaaccaaaccctgggatgtcgtgcctatggtcacacaaatggctatgaccgacaccactccatttggccaacaacgtgtgtttaaagaaaaggtagacacaagaactcctcgacccatgccagggacgcgcaaagtgatggaaatcactgcagaatggttatggcgcacactgggtagaaataagaaaccacgcttatgtacacgggaagagttcacgaagaaggtcaggaccaatgcagcgatgggtgcagtgtttactgaagagaaccaatgggatagcgccagggcagccgtagaagatgaggaattttggaaattagtcgaccgcgaacgtgaactgcataagttaggaaaatgtggttcttgtgtatacaatatgatgggtaagcgcgagaaaaagttaggagagttcgggaaagctaagggatcacgagctatatggtatatgtggctcggagcaagatatctcgaatttgaagcgttagggtttttgaatgaagaccactggttttcaagagaaaattcatattccggagttgaaggagaaggactccacaaattaggatacatattaagagatatatctaagatacccggcggtgctatgtacgctgacgacactgcaggttgggatacgagaattacagaagatgatttacacaatgaagagaaaataacccaacaaatggatccagagcatagacagttagcgaatgcaatatttaaacttacataccagaacaaagtagttaaagtacaacgtccaactccaaaaggtactgtcatggatattataagtagaaaagaccaaaggggatcagggcaagttggaacgtacgggttaaatacctttactaacatggaagcacaacttgtaagacaaatggaaggagaaggtgtgcttagtaaagcagaccttgaaaatccacatcttctagagaagaaaattacacaatggttagagactaaaggggtagaacggctaaaacgtatggcaatatctggagatgattgtgtcgttaagccaatagatgaccgatttgctaacgctctgttagcgttaaatgatatgggaaaggtcaggaaagacattccccaatggcagccatctaagggctggcacgactggcaacaagttccattttgcagtcaccattttcacgaactcattatgaaggacggaagaaagttggtagttccatgtcggccccaagatgaattgattggccgggccagaatcagccaaggcgcaggatggtcgttaaaagaaacggcatgtcttggaaaggcttacgcacaaatgtggtctctcatgtattttcatagacgagatctacgtttggcatctaatgcaatttgtagcgccgttccagtacattggattcctaccagtcgaacaacatggagtatacatgcgcatcaccaatggatgacaacagaagacatgcttaccgtatggaaccgtgtttggatcgaggataacccttggatggaagacaaaactccagtaacgacatgggaggacgtcccctatttagggaagcgtgaagatcaatggtgtgggtctctaatcggattgacgagtcgcgcaacctgggcacaaaacattttaactgcaatacaacaggtgagatctttaattggagacgaggaatttttagactacatgccgagcatgaaaagatttagaaaagaagaagaatcagaaggagcgatctggtag

SEQ ID NO: 23467 - RNA, 9873 nt, synthetic construct
  misc_feature 1..9873: note = derived and/or modified CDS sequence (opt6) from DENV-3__EU482456__SS-prME
  source 1..9873: mol_type = other RNA
acttctctatgtctaatgatgatgttaccagccacactagcctttcatctcaccagtagagatggagaaccaaggatgattgtcggcaaaaatgaacgaggtaaatcacttttattcaaaaccgcttctggaataaatatgtgtactctgattgcgatggacctaggcgaaatgtgtgatgataccgttacatataaatgcccgttaattgcagaagtagaaccagaagacatagactgttggtgtaatttaacgtcaacatgggtaacgtacggtacatgcaatcaagcaggcgaacatcgaagagataaaagatcagtggcgttagcaccacatgtgggaatggggttggacactcggacgcaaacgtggatgtctgctgagggagcttggcgacaagttgagaaagtggaaacttgggctctaagacacccaggatttacaatattagcgttatttttagcgcattatataggaacttccttaacacaaaaagtggtcatttttatcctcttaatgctggtcacgccaagtatgaccatgcgatgtgtaggcgtaggaaatagagatttcgttgagggtttatcaggtgctacgtgggtagacgtggtgttagaacatggaggatgtgttacgactatggcgaaaaataaaccaacattagatatagaattacagaaaacagaagcaacacaattagctactttgagaaaattatgcatcgaaggcaaaataacaaacattacaaccgattccaggtgtccaacacagggagaggccatcttgccggaagaacaagaccaaaactacgtatgcaaacatacgtatgttgataggggttggggaaacggatgtggactattcggaaaaggaagcctagttacttgtgcgaaatttcaatgtctggaaccaatagaagggaaagttgtgcagtatgaaaatcttaaatatacagtaatcataaccgttcatactggtgatcaacatcaagtaggcaatgatactcaaggtgtaaccgttgaaataacaccacaggcaagtactgttgaagcggtcttgcctgaatacggcaccctaggattagagtgtagtcctagaactggcctagactttactgagatgatactactgactatgaaaaacaaagcgtggatggttcatagacagtggtttttcgatctaccgctgccgtggacaagtggggcaaccacagaaacacctacgtggaatagaaaagaactactggtgacctttaaaaacgctcatgctaagaaacaggaagtagttgtcttggggagtcaagaaggagcaatgcatacggcattgacaggcgcaacagaaatacaaaatagtggtggaacaagtatattcgcgggtcacctaaaatgccgactaaaaatggataaactagaattgaaagggatgagttacgcaatgtgtttaaacacatttgtacttaagaaagaagtttcggaaacccaacatggaaccatacttattaaagtcgaatataaaggagaagatgcgccatgtaaaataccttttagtacggaagacggacaaggtaaagcacacaatggcagattaattacagccaatccagtggtaacaaagaaagaagaaccagtaaatatagaggctgaaccaccatttggagaatcaaacattgtaattggaataggagataaagcattaaaaatcaattggtataagaaaggaagctctattggcaagatgtttgaagcaaccgctaggggagcaaggcgtatggccatacttggagatacagcatgggatttcggcagtgttggtggtgtattaaattcattaggtaagatggtccaccaaatatttggttctgcatatacagcattattttctggagtaagctggataatgaaaattggcatcggggtgctgctcacgtggataggactaaacagcaaaaacacaagtatgtccttctcatgtatagtgataggaataattactttatatctaggagctgtagtccaagcagacatgggatgtgtaattaactggaaaggcaaagaactcaaatgcggtagtggaatatttgttactaatgaagttcatacatggactgaacagtataaatttcaagcggactcgccaaaacgattggccactgcaattgcaggagcgtgggaaaatggagtttgcggaattagaagcaccaccaggatggagaatttattatggaaacagattgccaacgaattaaattacatattgtgggaaaacaacattaagctgacagtggtcgttggggatacgataggggtactagaacaaggtaagcggacactgacacctcagccgatggagctgaaatatagctggaaaacatgggggaaagcaaagatcgttaccgctgaaacgcagaactcctcattcattatagatggacctaatacgccggaatgcccatcagcaagccgggcctggaacgtgtgggaagtcgaagactatgggtttggtgtgtttactacaaatatatggctcaaattacgggaggtatatacacaaagttgcgatcatagattaatgagtgcagcaataaaggatgagcgagctgtacatgcagacatgggctattggatcgagtcccagaagaatggtagctggaaactagaaaaagcatcttttatagaggtaaagacttgtacatggccaaagtcccacaccctatggtctaatggagtattagaatctgacatgataattccgaaatcattggctgggcccatcagtcaacacaaccataggccaggataccatacccaaacggcgggaccatggcacttgggtaaactagaattagatttcaattactgtgaagggacgactgtagtgataacagagaactgtggaacacggggtccctccctaagaaccaccacggtatcaggtaaattaatacacgaatggtgttgtcggtcatgtaccttgcccccactacgatacatgggcgaggacggttgttggtacggcatggaaattcgaccaattaacgaaaaagaggaaaacatggtaaaaagtttagtttctgcaggtagtggaaaggtggacaattttactatgggcgtactttgtctagccatactatttgaagaagtgatgcgaggcaaatttggaaagaaacacatgatagctggagtcctctttacgttcgtactacttttaagtggccaaataacttggagagatatggcacatactttgatcatgattggtagcaatgcaagtgatagaatgggtatgggcgtaacctacctagcgcttatagccactttcaaaattcagccatttttagctctaggattctttctaaggaaattaacatccagagaaaaccttctgttaggtgtaggactagcaatggctacaacattacaactcccagaagatatcgagcaaatggcaaatggaatcgcgcttggtttaatgacactgaaattaataacccaatttgagacataccagctatggaccgcacttgtttcacttacttgctcgaatactatatttactctaaccgtggcttggagaacagctacattgatacttgccggagttagcctcctacctctatgccaatctagttccatgaggaaaactgattggctaccgatgacggtagctgcgatgggtgtaccgccactaccgcttttcatattctcgctaaaagacactccgaaaaggagatcgtggccacttaatgaaggtgtaatggctgtaggtctagttagcatcctagcatcatcgttgttaagaaatgacgtcccaatggcagggcctctagttgcgggtggtctactgatcgcttgttatgtaattacaggcacttcagcagatctgactgttgagaaagccgcagacgttacatgggaggaagaagccgaacaaacgggcgtaagccacaatttaatgatcacagtagatgatgacggcacgatgcgaatcaaagatgatgagacagaaaacatcttgactgtccttcttaaaacagctctattaattgtgagcggaatttttccttattcaataccagcgacgttgctcgtgtggcatacatggcagaaacaaacccagcgttcgggagtactatgggacgtaccttctccacccgaaactcaaaaagcagaactagaggaaggtgtctacagaattaaacaacaaggcattttcggaaaaacacaagtaggtgttggagtgcaaaaagaaggagtgttccacacaatgtggcatgtgacaagaggagcggtacttactcataacggaaaaagactagagccaaattgggccagtgttaaaaaggaccttattagctacggagggggatggcgtctttctgcacagtggcaaaaaggggaggaggtccaagtcattgccgttgaaccaggcaaaaaccccaaaaatttccaaacaatgcctggtatctttcaaacaacgacgggcgagataggagcaattgctctcgactttaaaccagggacctccggatcacctataatcaacagagagggaaaagttgttggactctatggcaatggagttgtaacgaagaatggcggctatgtaagcggaatagcacagaccaacgcagaacccgatggtccaacaccggagcttgaagaagagatgtttaaaaagagaaatctgacgataatggacctgcacccaggttctggcaaaactcgaaaatacttaccagcaattgtaagggaggcaataaaaagacgactcagaaccctcatattagctccaacaagggttgtagcagccgagatggaggaggctttaaagggtctccctattagatatcaaacgacagctacaaaatccgaacacacaggtcgggaaatagtcgatctgatgtgtcatgctacttttacaatgcgcttgctctctccagttcgagtacctaattataatttgatcataatggacgaagcccattttaccgaccctgccagcattgccgccagaggttatatttccacaagagtcggaatgggagaagccgcagcgatattcatgacagccacacctcctggtacagcagaggcatttccccaaagtaatgcccccatacaagacgaggagagggatataccggagcgcagctggaactctggtaatgaatggattacggacttcgttggtaagacagtatggttcgtcccgtctataaaggcagggaatgatatagcaaattgtttaaggaaaaatggcaagaaagtgattcaacttagcagaaaaaccttcgacactgagtatcagaaaaccagattaaacgactgggattttgtagtgacaacagacatatcggaaatgggtgcaaattttaaagcggatagagtcattgatccacgacgatgtcttaaaccagtcatattgacggatggacctgaacgagtaatcctagccgggcctatgccagttacggcagctagcgccgctcagagaagagggcgagtaggtagaaatccacaaaaagaaaacgatcaatatattttcactggccaaccactaaataatgatgaggaccacgctcattggactgaagcaaagatgttattagataatattaacactccagaagggatcataccagcgttattcgaaccagaacgtgaaaagagcgcagcaatagatggcgaatacaggctcaaaggagaaagtagaaagacattcgtcgaactaatgcgtagaggggatcttccagtatggttagcgcacaaggtcgcttctgaaggcatcaaatataccgatcgtaaatggtgtttcgacggcgagagaaataatcaaattttggaagaaaatatggacgtagaaatatggacaaaagaaggagagcgaaagaaattaagacctagatggctcgatgcgcgaacctactcagaccccctagctttgaaagagtttaaggattttgcagctggcagaaaaagcatagcattggatctcgtcacagaaatcggacgggtgccatcccatttagcctatcgtacacgaaatgcgctagataatttagttatgctacatacatctgaacatggaggaagggcctacagacatgcagttgaagagttacccgaaacaatggagacactattactcttggggttaatgatcctgcttaccggtggtgctatgctatttttgatatcgggaaaaggcataggaaagacctctataggtttgatatgtgttattgtctcaagcggaatgctctggatggctgatgttccattacaatggatagcctctgccatcgtattagagttctttatgatggtactattaataccggaaccagaaaaacaaaggacaccacaagataatcagttggcgtatgtggtcatagggattttaacacttgctgcaatagtggcggcaaacgaaatgggtttgctcgagacaacgaaacgggacctgggaatgagtaaagaacctggagttgttagtccgacgagttatctggacgtagacctgcatcctgctagtgcttggacgttgtacgcggtggccactacagttataacccctatgctaagacatacaatagaaaacagtacagcaaacgtcagcctagctgccattgcaaatcaagctgtagtacttatgggactggacaaggggtggccaataagcaaaatggacctaggagtaccccttcttgccctaggatgctactcccaggttaaccctctaacattaacggctgctgtactactccttgtaacacattatgccattatcggcccgggtttacaagcaaaagcgacaagagaagctcaaaaacgaacagcagcaggtataatgaagaatccaactgttgacggaataatgacaatagatctggaccctgttatttacgattctaagtttgaaaaacaattgggtcaggtaatgcttcttgtcctctgcgctgtacaacttctccttatgcgtacatcctgggccttgtgcgaagcactcaccttagcaaccgggcctattacaacgctatgggaagggtcaccaggaaaattttggaacactacaatcgctgtaagtatggcgaacatattcagaggatcatatttagcgggcgctgggttagcattttcaataatgaagtcagtaggcacaggtagaagaggtacaggcagtcagggggaaaccttaggtgaaaaatggaagaagaaattgaaccaattatctagaaaagaatttgatttatacaagaaaagtggaatcacagaagtagacagaacggaagcgaaagagggattaaaacgtggggagacgactcatcatgcagtatcacgaggaagtgcaaaactacagtggttcgttgaacgaaatatggtcatcccagaaggacgggtaattgacctcggatgtggccggggaggttggagttattactgcgcagggctcaagaaagttaccgaagtgcggggatacaccaaaggcggacctggacacgaagaaccagtcccgatgtcaacatatgggtggaatatcgtaaaattgatgtcagggaaagatgtattttatttaccaccagaaaagtgtgatacccttttgtgcgatataggggaaagctcaccaagcccgacagtagaggaaagccgaacaatcagagtattaaaaatggttgaaccctggctcaaaaacaatcagttctgtattaaagtattaaatccgtatatgccgactgtcatcgaacatcttgagagactgcaaagaaagtatggaggcatgttagtaagaaatcccctgagtagaaatagcacacatgagatgtattggatttcgaacggtaccggtaacatagtgtccagtgtgaatatggtatctaggttgttattgaatagattcacaatgacacatagaagaccaacgatagaaaaggatgtagacttaggagcaggaactagacatgttaacgctgaacccgaaacaccaaatatggacgtaataggggaacgtataaaaagaattaaagaagaacacagttccacctggcattatgacgacgaaaacccatacaagacatgggcttaccatgggagttacgaggtaaaggctacaggttcagcaagcagtatgataaacggagtcgtaaaattattaacaaaaccgtgggacgtggtccccatggttacgcagatggcaatgactgacacaacacccttcggtcaacagagagtttttaaagaaaaagtcgatactaggacgccaagaccgatgcctggtacacgtaaagtaatggaaataaccgctgaatggctatggagaacgttggggcgaaacaagaaaccaaggctctgtacgcgggaagaatttaccaagaaagtcagaaccaatgctgctatgggagctgtattcacagaagaaaatcagtgggactcagctagagcagcagtagaggatgaagagttttggaaattagtggaccgggaaagagaattacataaactcggtaaatgtggaagttgtgtgtataatatgatgggaaagcgcgagaagaaattgggggagtttggaaaagcaaaaggaagcagagccatttggtacatgtggttgggagccaggtatcttgagttcgaagcactgggatttttaaacgaagatcattggtttagcagggaaaacagctacagtggggtcgaaggggaagggctgcataaactcggttatattttacgagacatctccaaaattcctggcggggcaatgtatgccgacgacacagctggctgggacacgaggataacagaggatgacttacataacgaagagaaaataacccaacaaatggacccagagcataggcaactagcaaatgccatttttaagctaacataccagaataaagtggtaaaagtacaaagacccactcctaaagggacggtaatggatataatatcacgcaaggatcaaagaggctctggtcaggttgggacttacggtcttaatacctttaccaacatggaagcgcaattagttcgccaaatggaaggagaaggagtactgagcaaagcggatttagaaaatccgcacttattagaaaagaaaatcacacaatggttagaaacaaagggtgttgagagattaaagcgaatggcaattagtggggatgactgcgtagttaaaccaatagatgaccggttcgcaaatgcattactagctttaaatgacatgggtaaagttagaaaggatataccccaatggcagccaagcaaagggtggcatgattggcaacaagttccattttgttcacaccatttccacgaacttattatgaaggacgggcggaaattagttgtgccatgcagaccacaggacgaattgattggtcgtgcaagaatctcgcaaggagcggggtggtctttaaaggaaacagcgtgcctaggaaaagcatacgctcaaatgtggtcattaatgtattttcatcgacgtgacttacgattagccagcaatgctatatgtagcgcagtaccggtacattggatccctaccagcagaaccacctggtcaatacacgctcaccaccaatggatgactaccgaagacatgttaacggtatggaacagagtatggattgaagacaacccctggatggaagataaaaccccagtgacaacttgggaggacgtaccgtatctcggtaaaagagaagatcaatggtgtggttcactaattggattaacaagccgtgccacatgggcacaaaatatactcacggcaatacagcaagtccgcagcttaatcggtgatgaagagtttcttgactatatgccgagtatgaagaggtttagaaaagaagaagaaagcgaaggagccatttggtaa

SEQ ID NO: 23468 - RNA, 9873 nt, synthetic construct
  misc_feature 1..9873: note = derived and/or modified CDS sequence (opt6) from DENV-3__EU482457__SS-prME
  source 1..9873: mol_type = other RNA
acatcattctgtttaatgatgatgctacccgcaaccctagcttttcatttaacctcccgagacggtgaacctcgaatgatagtgggcaaaaatgaacgcgggaaaagtcttttgtttaaaacagcaagtggtataaatatgtgtacacttatcgcaatggacttgggggaaatgtgcgacgatactgtcacatataaatgcccacttatagcagaagttgaaccagaagacatcgattgttggtgtaatttaacatctacttgggtgacatacggcacatgtaatcaagccggtgaacatcgaagagacaaacgttccgttgctctcgcaccacatgtgggtatgggtcttgacacacgaactcaaacgtggatgtcggcagaaggtgcatggcgacaagtagaaaaagtagaaacctgggcactacgacatccgggcttcacgatacttgcactctttcttgcacattatataggaaccagcttaacacaaaaagtagttatatttattttactgatgctcgtaactccatcaatgacaatgagatgtgttggggtaggcaatagagattttgtagaagggctgtctggcgcaacttgggtagacgttgtacttgaacacgggggttgcgtaactaccatggccaaaaataaaccgactttagacatagaactacagaaaacagaagcaacacaattagctacactaagaaaactttgtatagaagggaaaatcacaaatattacgactgattccagatgtccaacacaaggagaagctaccctcccggaggaacaagaccaaaactatgtgtgtaaacacacctacgtagatcggggttgggggaatggatgcgggctctttggtaaaggcagcctagtaacttgtgcgaaatttcaatgtttagaacctatcgaagggaaagtcgtccaatatgagaacctaaaatatactgtaattatcacagttcacactggtgaccaacaccaagttggtaacgacactcaaggggtaacagttgagattacaccccaggcttctacagtagaagccgtcctaccagaatatggcatcttgggacttgaatgttccccgcgaacgggactcgatttcaatgaaatgattttactaacaatgaaaaacaaggcttggatggtgcacaggcaatggttcttcgacttacctttgccttggacgtccggtgccacaaccgaaacacccacttggaacagaaaagaactacttgtcactttcaaaaacgcgcacgcaaagaaacaggaagtggtcgtcttgggaagccaagaaggagcgatgcatacggcgctaacaggtgcaactgagatacaaaacagtggaggaacgtcgattttcgcgggacaccttaaatgtaggctaaaaatggatcgcttagaacttaaaggaatgagctatgcaatgtgtcttaataccttcgtgttaaagaaagaggtatcagaaactcagcatggcacaatactaataaaagtagaatacaaaggagaagatgcaccatgcaaaatacccttcagcaccgaggatggacaagggaaagctcataacggacgtttaatcacagcaaatccagtagttacgaagaaagaagaacccgtaaatattgaagcggagccacccttcggggaatcaaacatcgtaatcgggataggagataaagcattgaaaataaactggtataagaaaggttcatctataggcaaaatgttcgaagcaacagctcgtggtgcaagaagaatggccattttaggagataccgcttgggactttggtagtgtaggaggagtactgaactcactaggtaaaatggtccatcagatttttggttcagcttacactgcactttttagtggcgtaagctggattatgaaaattggaataggagtacttttaacatggatcggtctcaatagtaaaaacacatcaatgtcgttcagttgtatcgtaataggaataataacactatatctaggtgcagtggtacaagctgatatggggtgtgtgattaactggaaaggtaaagaattgaaatgcgggagcggaatattcgtgactaatgaagtacacacgtggacagaacaatataaatttcaagcagattctcctaaaaggttagccacggcgatcgcaggggcttgggaaaacggtgtttgtggtattcggtctactacaaggatggagaacttactttggaaacagattgcaaacgaactgaattatatactttgggaaaataatataaaattaacagtagtagtaggtgataccataggcgttctagagcagggtaaaaggacactaactccgcagcctatggaattaaaatatagttggaaaacctggggaaaagcgaaaatagtaacagccgaaactcaaaattcttcatttatcatagacggacctaacacacctgaatgcccatccgcttcaagagcttggaatgtgtgggaagtagaagactacggtttcggggtttttactacaaatatctggctcaaactaagagaagtgtacacccagagctgcgatcaccggctaatgagtgcagctatcaaggatgagagagcagtccacgctgatatgggctactggattgagagtcagaaaaacggatcgtggaaacttgagaaggctagcttcatcgaagtgaaaacttgtacttggccaaagtctcatactctatggagcaatggagtcttagaatcagatatgattatacctaagagtcttgcggggccaatttctcaacacaaccatcgaccaggatatcacacgcagacagctggcccttggcatctaggaaaattagaactcgatttcaattattgcgaaggtacgacagtcgtaataaccgaaaattgtggaaccagagggcccagtttgcgtacaacaacggtatcaggaaaattaatacacgaatggtgctgcaggagttgcactttgccacctctaagatatatgggggaggatggatgttggtatggtatggaaataagaccaataaatgaaaaggaagaaaatatggtcaagagcctggtaagcgcggggtcggggaaagttgataattttactatgggcgtactttgtcttgctatattatttgaagaagttatgcgtggtaaatttgggaagaaacacatgatagctggagtactctttacgttcgttttgcttttatctggtcagatcacatggcgcgatatggcacatactctcataatgattggcagtaacgctagcgatcgaatgggaatgggagttacttacttagcgctaatagctaccttcaaaatacaaccatttttggcactaggattctttttgagaaaactaacatctagagagaatctactccttggtgtaggattggcaatggccacgacacttcaattaccggaggatattgaacaaatggctaacgggatagctcttggattgatgacgctgaaactcatcactcagttcgagacgtatcaactgtggacagccttggtgagtttaacatgtagtaataccattttcacgctaaccgttgcgtggaggactgctacactgatattagctggtgtatctctactaccattgtgccaaagctcaagtatgagaaaaacagactggctacctatgacagtggctgcgatgggcgtacccccattgcccttattcatattttccttgaaagacacacctaagcggagatcgtggccgctcaacgaaggcgtcatggcagtgggcttggttagtatactcgcatcgtctttattgaggaatgatgtaccaatggctggtcccttagtggcagggggactattaatagcatgttatgtaataactggtacttcagcggatttgaccgtagagaaggcagccgatgttacctgggaagaggaagccgaacaaacgggggtgtcgcacaacttgatggttactgtagatgatgatggcacaatgaggatcaaagatgacgaaacagaaaacatattaacagtactactgaaaaccgcactattaatagtttccgggatattcccgtatagtataccagcgacattactggtatggcacacttggcaaaaacagacgcaacgttcaggggtcctatgggatgtgcccagcccacccgaaactcaaaaagctgagttagaagagggggtataccgaataaaacaacaaggaatcttcggtaagacacaggtgggtgtaggcgtgcaaaaagaaggtgtattccacacaatgtggcatgttactcgcggagcagtcttaactcacaatggaaagagattagaaccaaattgggcatcagtgaagaaagatctaatcagctatggagggggatggcgcttaagtgctcaatggcaaaaaggggaagaggttcaagttatcgccgtagaacccgggaaaaaccctaaaaattttcaaacaatgccagggatattccaaacgacaacgggcgaaataggcgccattgctctagattttaaaccgggcacgagtggaagccccattattaatagagaaggtaaagtagtaggactttatggaaatggcgtagtgacaaagaatggcggatatgtatctgggatcgcccaaaccaacgcggaacctgacggaccaacaccagagttggaagaggaaatgttcaagaaacgtaacttaacaatcatggacttacacccgggatctgggaaaacaagaaaatacttgccggcaatagtacgagaagcaatcaaaagacgtctaagaacactaattttggcgcctacccgagttgttgcagcagaaatggaagaggctttaaaaggtcttcctattcgttatcagaccactgcaaccaagagtgagcataccgggcgggaaatcgtcgacttaatgtgtcatgccacatttactatgaggctacttagcccagtaagagtgccaaactataacctaattataatggatgaagctcactttactgatcctgcatcaattgcagccagaggatacataagtacgagagtagggatgggagaggcggccgctatatttatgactgcaaccccaccaggaacggcagaagcattcccgcaaagcaacgctccaatccaggatgaagaaagggacattcccgagagaagttggaactcgggcaacgaatggattacagacttcgtagggaaaacagtctggtttgtaccttcaataaaagcaggcaatgatattgctaattgtttaaggaaaaacggtaagaaagtaatacaactcagcagaaaaaccttcgatacagagtatcagaaaacacgtctaaacgattgggattttgttgtaactactgatatatctgaaatgggagctaactttaaagctgatagagtaatagatccaagacgctgcctaaaaccagtgatcttgacagacggaccagagagagttatattggcaggacccatgccagtgactgcggcaagcgcagcccagagacgcggacgagtgggaaggaatcctcaaaaagaaaatgatcaatacatattcaccggtcaaccgctcaataatgatgaagatcatgctcactggacagaagccaagatgcttttagacaatataaacactccggaggggattatcccagccttatttgggcccgaaagagaaaagagtgctgcaatagatggggaatatcgactaaaaggagaaagccggaaaacatttgtcgagttgatgcggcgaggcgacctacccgtttggttagcgtacaaagtcgccagcgaaggtattaaatataccgaccgtaagtggtgtttcgacggtgaacgaaataatcaaatattagaagagaatatggatgtagaaatttggacaaaggaaggtgaaagaaagaaattaagacctcgttggctagatgccaggacctatagtgatccattagccttaaaagagttcaaggactttgcagccggtagaaaatccatagcgctcgatttagtaactgagattggtagagtaccttctcacctggcacacagaacacgaaacgcattggacaatctagtgatgttacatacatcagagcatggtgggagagcctatcggcatgcagtagaagagttaccagaaacaatggaaacgcttttactcttaggcttaatgatattactaactggtggggcaatgttatttttgataagtggtaaaggaatagggaagacaagtataggactcatctgtgtgatagttagttctggcatgttatggatggctgacgtccctctccaatggattgcaagcgctatagtattagaatttttcatgatggtgttactaataccagaaccagaaaagcaaagaaccccgcaggataatcaactagcctatgtagtcataggaatactgactttagctgccatcgtagcagcgaatgaaatgggattgcttgaaacaacgaaacgagatttaggaatgtcaaaagaaccaggggttgtatctcctacaagctacctagatgtcgatttacatccagcttcagcatggacattgtacgctgtagcaacaactgtaattacacctatgttgaggcacactatagaaaattctacggcaaatgtgagtttagccgcgatcgcgaatcaggctgttgtactaatgggcctcgataaaggatggcccatttctaagatggatttaggtgtacctcttttagctctgggatgttactcgcaagtaaatccgctaaccttaactgcagctgtgctcctattagttacacattatgcgataattggacccggtctgcaagcaaaagcaacacgtgaggcacaaaagagaacagcagctggaataatgaaaaacccaacagtggatggaataatgactatagatctggaccccgttatctatgattctaaatttgaaaagcagttgggacaagtcatgctattagttctatgcgcggtacaactactgttaatgagaacctcgtgggcactgtgcgaagcattaactttagctactggcccaattactactttgtgggaaggatccccaggcaaattctggaacacaaccatagcagttagtatggcaaatatctttaggggaagctatctcgcaggcgccggactggcgttcagcataatgaaaagtgtcggtaccggtagaaggggtacgggatcccaaggagaaacactaggtgaaaaatggaaaaagaaattaaatcaattgtcccgaaaagagtttgatttatacaagaaaagtggaattacagaggtggatagaacagaagcgaaagaaggattaaaaagaggtgagactacacatcacgctgttagtcgtggatcagccaaactacaatggtttgtagaaagaaatatggtcattccagaaggacgagtcattgatctgggttgtggacggggtgggtggagttattattgtgctggacttaagaaagtgactgaggtgagaggttacacaaaaggaggaccgggacatgaagaaccggtgcctatgtcaacttatggctggaacatagtaaaactcatgtctggaaaagatgtattttatttaccacccgaaaaatgtgatacactgctttgcgacatcggcgagagttctccctcaccaaccgtggaagaatctagaacaatacgcgttttgaagatggtagaaccctggctgaaaaataaccaattttgcattaaagtactaaacccatatatgccaacagtaatcgaacacttggaacgtcttcaaagaaagtatggaggtatgcttgtaagaaatcctttaagtagaaatagtacgcatgagatgtattggatttcaaatggaacagggaacatagtatcaagtgtcaatatggtttcaaggctattgttgaaccgttttacgatgacacatagacgtcctacaatagagaaagatgtcgacttaggagcaggcacgagacacgtcaacgcagaacctgaaacaccgaatatggacgtaattggcgagaggataaaaaggataaaggaagaacactcatcaacatggcattatgacgacgagaatccttataaaacctgggcttaccatggatcatatgaagttaaagctacaggcagcgcgagtagtatgataaatggagtggtaaagttactgaccaagccttgggacgttgtacccatggtcacacaaatggctatgaccgacacaacaccgtttggtcaacaaagagtattcaaggaaaaagttgatacacggacgcctcgtccgatgccaggtacgagaaaagtaatggaaataacagccgaatggttatggcggacattaggaagaaataagaaaccgcgattatgcacaagggaagaatttacgaagaaagttcgaactaatgctgccatgggagcagtatttacggaagagaaccaatgggacaacgccagagcagctgtcgaggatgaagaattttggaaattagttgatagagaaagagaactacacaaactaggaaaatgtggcagttgcgtatataacatgatgggaaaaagggagaagaaattaggtgagtttggtaaagcaaaagggtctcgggcaatatggtatatgtggttaggagcgagataccttgaatttgaagctctaggatttttgaatgaagaccattggttcagtagagaaaattcttatagtggtgtggaaggtgaagggttgcataaactaggatatattttaagagacatttcgaaaataccaggaggggcaatgtatgccgatgataccgcgggatgggacacgcggataacggaagatgaccttcataacgaagagaaaattacacaacaaatggatccagaacaccggcaattagcaaacgcaatttttaaattaacctatcagaacaaagtcgtgaaagtccaaaggccaacacctaaaggaactgtcatggacatcatttcgagaaaagatcaacgtggatctggacaggtagggacatatggtttgaatacgtttacaaatatggaagcacagctagtaagacaaatggaaggtgaaggggtactatcgaaagcagacttagaaaatccgcatttacttgagaagaaaattactcaatggttggaaacaaagggtgtagaacgattaaaaagaatggcaatctcaggagatgattgcgtggttaagcccatagatgataggtttgcaaacgcattattagcactcaatgacatggggaaagttagaaaagacatacctcagtggcagccatcgaagggatggcatgactggcaacaagttcccttctgctcccatcactttcatgagctaataatgaaagacgggagaaagctagttgtaccatgtcgaccccaagatgaattaataggcagagcaagaattagtcagggagccggttggtccctaaaggaaacagcttgcttaggtaaggcgtatgcacaaatgtggagtttaatgtatttccaccgcagagatttaagactagcctcaaatgcaatctgttcggcagtcccggtgcattggatccctacctcacgaaccacatggtctatacatgcgcatcatcagtggatgaccacagaggacatgttaacagtatggaatagagtctggatcgaggataatccatggatggaggataaaacgccggtaacgacctgggaagacgtgccgtacctaggtaaacgagaggaccaatggtgcggatctctaatcggcttgacatcacgtgcaacgtgggcacagaacattctgacagcaattcaacaagtcaggagtttaatcggggacgaggaatttttggattatatgccgtcaatgaaaagatttcgaaaagaagaagagagcgaaggagcgatttggtaa

SEQ ID NO: 23469 - RNA, 9873 nt, synthetic construct
  misc_feature 1..9873: note = derived and/or modified CDS sequence (opt6) from DENV-3__EU482458__SS-prME
  source 1..9873: mol_type = other RNA
acttcgttgtgtctaatgatgatgctgcccgcaacattagcgtttcatctgacttcgcgcgacggcgaaccgcgaatgatcgtagggaaaaatgaaagggggaaaagtttgctgtttaaaacagcgtcaggtatcaacatgtgtacgttaatcgctatggatttaggtgaaatgtgtgatgacactgtcacgtacaaatgtccattaatcgccgaagtcgaacccgaagatattgattgctggtgtaatttgacatctacatgggtaacatatggcacttgcaatcaagccggagaacaccggagagacaaaagatcagtagcgttggctccacatgtaggaatgggcctagatacgagaacgcaaacgtggatgtcagcggaaggagcgtggagacaggtggaaaaagtagaaacatgggccctacgacaccctgggtttacaatattagccttgtttctcgcacactatataggcacaagtctgacgcaaaaagtagttatatttatattacttatgttagttacacctagtatgacaatgagatgtgttggagtagggaacagagattttgttgaaggactatccggggccacatgggtagacgtcgttctagaacatggcggatgcgttacaacaatggccaaaaacaaacccacattagatatagaacttcagaaaaccgaagcgacacaattggctacgctcagaaaactatgtatcgaaggaaaaataacgaatatcaccacagactcaagatgcccaactcaaggcgaagcaattttacccgaagaacaagatcaaaactatgtgtgcaaacacacttatgttgacaggggctggggtaatggatgtggtctctttggaaaagggtccctagtcacatgtgcaaaatttcagtgtttagaaccaatcgaaggaaaagtggttcaatatgaaaatctaaaatatacagtgattattacagttcatactggagaccaacaccaggttggaaatgatacacaaggcgttacagtagaaataactcctcaagcgtccaccgttgaagcagtgctaccggaatatggtacacttggtttagagtgttcaccaagaacaggtttagactttaacgagatgattctactgacgatgaaaaataaagcatggatggtacatcgtcaatggttctttgatctccccttaccctggacatctggtgctacgaccgaaacacccacatggaacaggaaagaattattaaccacatttaaaaatgcacatgctaagaaacaagaagtagttgtcttaggaagtcaagaaggagctatgcatactgcactgactggcgcaactgaaatacaaaattctggtggaacatctatcttcgccggacatctaaaatgtagattaaaaatggacaaacttgagttaaaaggaatgagttatgcaatgtgcttgaatacgtttgtgctaaagaaagaagtttctgaaactcaacacggcactatcctcataaaagttgaatataaaggagaggatgccccttgtaaaattcctttctccaccgaagatggccagggtaaagctcataacgggcgccttattaccgccaacccagtagtgaccaagaaagaagaaccagtaaatattgaagctgaaccaccgttcggggaatccaatatagtaataggtatcggcgacaaggctttaaaaatcaattggtataagaaaggtagttccataggaaaaatgttcgaagcaacagcgcgtggggcaaggagaatggccattcttggagatacagcatgggatttcggatcagtcggcggagtcctaaacagtttaggaaaaatggtccatcaaatatttggatcagcatacactgcgttatttagcggcgtgtcatggatcatgaaaatcggcatcggagttcttctaacttggataggtctaaatagcaaaaatacatcaatgagcttcagctgcatcgttatcggtattatcactctatatcttggagctgtagtacaagcagacatgggatgcgctatcaactggaaaggtaaagaattaaaatgtggatcaggaatctttgttacaaatgaagtacatacctggactgagcagtacaaatttcaagccgactcgccaaaaagactagccacagctattgcgggtgcatgggagaatggcgtatgtggaatcagatcaacaacgaggatggagaatctcctttggaaacaaatcgcaaacgaattgaactacatattgtgggaaaacaatatcaaacttaccgtagttgtaggtgatataattggagtactagagcagggaaaaaggacattaacaccacagccgatggaattaaaatattcatggaaaacatggggtaaagctaaaatagtgaccgcagaaacccaaaacagctcctttataattgatggccccaacacaccagaatgcccgtctgcaagtcgagcttggaacgtctgggaggtagaagattatgggttcggtgtctttactaccaatatatggttgaaacttagggaagtgtacacacaatcttgcgatcatagattaatgtctgcagccataaaagacgaaagagccgtccacgcagatatgggctattggatcgaatcccagaaaaacggttcctggaaattagaaaaggcttcattcatcgaggtcaaaacatgcacgtggcctaaatcacataccctatggagtaatggcgtactcgaatcggatatgatcatcccaaaatcacttgctgggcctatctcacagcataaccaccgccctggatatcatactcagacggcgggaccatggcatttgggaaagttagaattggacttcaactattgtgaaggaacaactgtagttataacagaaaactgcggaatgcgaggaccttcactacgaactacgacagtgagtggtaaattaattcacgagtggtgttgcagaagctgtacactgccaccattaagatatatgggagaagacggatgctggtacgggatggagatacggccaataaatgaaaaagaagaaaatatggttaaatcattagtaagtgccggatcaggtaaagtagacaatttcacgatgggagttttatgcttggctatcttattcgaagaggtcatgcgaggtaaattcggaaagaaacatatgatagcgggagtgctatttacgtttgtactgctattgagcggtcaaatcacttggcgtgacatggcccatacattgataatgatcggttcgaacgcatcggatagaatggggatgggagttacatatttagccttgatagcaacctttaaaatacaaccgttcttggctttaggattctttctaaggaaactgacatcgagagaaaacttgttgttgggagttggtttagcaatggctaccaccctgcaactgccggaagatattgaacagatggctaatggcatcgctttaggtttaatgaccctaaaattaataacacaatttgaaacctaccagttatggacagccctcgtcagcttaacatgctctaatacaatctttaccctaacagtagcttggagaaccgcgacgctaatattagcaggggtttccttgctaccgctatgccaatcaagtagcatgagaaaaactgactggcttccgatgacggtcgccgcaatgggggtgccaccgttacccttattcatattttcactaaaagacacaccaaaaaggagaagttggcctttaaatgaaggagttatggctgttggactggtcagcatattggcatcatcccttctacgaaatgacgtaccgatggctggcccactggttgccgggggcctactgattgcctgttacgtgataacaggcacctccgctgatttaacagtagaaaaagcggcagacgtgacgtgggaggaggaggcggaacaaacgggagtatcccataacctgatgataaccgtagatgatgatggcacaatgcgaattaaagatgatgaaactgaaaacattctcacggtcttgttaaaaactgcccttcttatagtaagtgggatattcccatactctatacctgccacactattagtatggcatacgtggcaaaagcaaacacagagatcaggagttctatgggacgttccatccccacctgagactcaaaaggcagaactagaagaaggagtttaccggataaaacaacaaggaatatttggcaaaactcaagttggtgtaggcgtgcaaaaggaaggtgtctttcacacaatgtggcatgtaacaaggggagcagtacttacacataacgggaaaagattagaaccaaactgggcgtcagtcaagaaagatttgataagctatggtggaggatggcgactaagtgcgcaatggcaaaaaggagaagaggtacaagtaatcgctgtcgaacctggtaaaaatcctaaaaactttcaaacaatgcctggaattttccagacaacaacgggggagataggtgcaatagccctagactttaaacccggtacatcgggatcacccatcataaatcgtgaaggaaaagtagtcggcttatatggcaacggcgtagtcaccaaaaatggaggctatgttagcggcatagcgcaaacgaacgcagaacctgatggaccaacaccagaattggaagaggagatgtttaaaaagcgaaacctaaccataatggatctgcatccaggctctggtaaaacaaggaagtacttaccagctatagtgagagaagctataaaacggaggttaagaacccttatattagccccgacaagagttgtagcagctgaaatggaagaagcacttaaaggtctacctattcgataccaaacgacggctaccaagtctgaacataccggaagggaaatcgtagacctgatgtgtcacgcgacgtttacaatgagattacttagtcctgtgagggtgccgaactacaatttaataataatggatgaggcccattttaccgaccctgcttcaattgcagctagaggctatataagtaccagggtaggcatgggggaagcggcagcaatattcatgactgcaaccccgcccggaacagctgaagcatttccccagagcaatgctcctattcaagatgaagagagagatattccggagaggtcttggaatagcggaaatgaatggattacggactttgtgggcaaaactgtgtggtttgttccttcaataaaggcagggaacgatattgctaattgtctacggaagaacgggaagaaagtaatacaactttctaggaaaacatttgacacggaataccaaaagacgcgactcaatgattgggattttgttgtaacgaccgatatctcagagatgggagcgaacttcaaagctgacagagttatagatccaagaagatgtctaaaacccgtaattctcaccgatggaccggaaagggtaatcttggcagggccaatgcccgtaactgcagcaagcgcagcgcaaaggaggggaagagtgggaaggaatccacaaaaggagaacgatcagtatatcttcacaggtcaaccactaaacaatgacgaggaccatgctcactggactgaagcaaagatgttgctagataatatcaacacgccagaaggaatcataccggcgctgttcgaaccagaaagagagaaatctgcagccatcgatggagagtatagacttaaaggggaaagtcgaaaaacttttgtggagctaatgaggcgaggtgatctcccggtatggctggcacataaagtggctagcgagggtatcaaatatacggatagaaaatggtgtttcgatggggaacgcaataatcaaatattagaggaaaatatggacgttgagatatggactaaagaaggcgaaagaaagaaattgcggccaaggtggctcgatgcaaggacgtatagcgacccattagccctcaaagagtttaaggactttgcagctggaaggaaaagcatagctctagatcttgtcacagaaataggtagagtaccatctcatttggcgtatcgaacgcgtaatgcattggacaacctagtaatgttacacacttctgaacatggtggaagggcttatcggcacgcagtagaagaactaccggaaactatggagactttgcttctgcttggactaatgatactacttaccggaggagcaatgcttttcctcatatctggaaaaggaattggaaaaactagcatcggactaatctgtgtgatagtgtcttctggtatgttatggatggctgacgtacctttacaatggattgcaagcgcaattgtcttagaatttttcatgatggtcttgttaattcctgaaccggagaaacaaaggacgccccaagataatcaactcgcttacgttgtaataggcatactaacgctggcagccatagtcgctgcgaatgaaatgggattacttgaaaccacgaaacgagatttaggaatgtcaaaggaacctggagttgtatctcctacgagttacttagacgttgacctgcacccagctagtgcatggacactctatgcagtggccacaacagtaattacacccatgctaaggcacacgatagaaaacagcacagcgaacgtatcattggcagccatagccaatcaagcggtggttttaatgggtctagacaagggatggccaattagtaaaatggatttaggtgtaccattgttagcattaggctgttattctcaagttaatccattaacactaacggccgcggtattattattagtcactcattacgctataattggaccaggattacaagccaaggcaacaagagaagcgcaaaagcggacagctgcagggataatgaaaaatccaacggtggatggtattatgacaatagaccttgaccccgttatatacgacagtaagtttgaaaagcaacttggacaagtcatgctcttagttctttgcgctgtccagctcctattgatgagaacgtcgtgggcgttatgcgaagccttaactttggcaacaggaccaattactacactgtgggaaggatctcctggaaagttttggaacaccacaatagctgtaagcatggctaacatatttcgaggttcatacctagcaggcgcaggtttagcattttccattatgaaatctgttggcacggggagacgaggtacaggatcacaaggagaaactctcggggaaaaatggaagaagaaacttaatcagttatcaaggaaagagttcgacttatataagaaaagtgggatcacagaggttgatcgcactgaggctaaagagggattgaaaagaggggaaacgacacaccacgcggtcagtaggggatcagctaaactacaatggttcgtagagagaaacatggtaataccagaaggtagggttattgatctaggttgcggacgcggagggtggtcttactactgtgcaggtttaaagaaagtaaccgaagtgagagggtacacaaaaggaggacctgggcacgaagaacctgtgccaatgtcaacctacggatggaacatagttaagctaatgagcggaaaggatgttttctatctaccacctgaaaaatgtgatactctgttatgtgacatcggtgaatcttcaccatctccaactgttgaagaaagtagaacaatacgtgtattaaagatggtcgagccatggctcaaaaacaaccagttctgtattaaagttttaaacccctacatgccaacagtcatcgaacacttggaaaggctccaaagaaaatatggcggaatgcttgtacgaaatcccttatctagaaactcaacacacgagatgtattggatatccaatggaactggtaacatagtcagcagcgtaaacatggtaagcagattactacttaacaggtttacaatgacgcatcgtcgaccaacaattgaaaaggatgtagacttaggggccggtactaggcacgtaaatgcggagccagaaacaccaaacatggatgtaatcggagaacgaataaagagaataaaggaagaacactcaagcacatggcattacgacgacgagaatccatacaaaacgtgggcatatcatggctcttacgaggtaaaagcaacagggtctgcatcctcaatgataaacggggtggtaaagttattgacaaagccatgggatgttgtcccaatggtgacacaaatggctatgacggacacaacaccatttggacaacaacgagttttcaaagaaaaggttgatacgcgtactccaagacccatgccgggcactagaaaggtcatggaaattacagctgaatggttatggagaacactaggcagaaataagaaacctcgtttatgtactcgtgaagaatttactaagaaggtcagaactaatgctgcaatgggcgctgtctttaccgaagagaatcaatgggatagcgcaagagcagccgtagaagatgaggagttctggaagttggttgaccgtgagagagaattacacaaactcggaaaatgtggatcatgcgtatataacatgatgggaaaaagagagaagaaattgggggagttcggcaaagccaagggttccagggcaatatggtacatgtggctaggtgcgagatacctcgagttcgaagcattaggatttttaaacgaagatcactggttctcaagagaaaatagctatagcggggtagagggtgaaggtctacacaaattaggatacatattaagagatatctctaagatccccggaggcgcgatgtatgctgatgatactgctggctgggacactcgtatcactgaagatgatttacacaatgaagaaaagatcacgcaacagatggatccggagcatcggcaattagccaacgcaatattcaaattaacataccagaacaaggtggtcaaagttcagagaccgaccccaaagggtacagtaatggatataatttcacggaaagatcagcgaggaagtggtcaagtcggtacatacggcttaaatacattcactaatatggaagcccagctcgttaggcagatggaaggggaaggggtcttgagcaaagccgatctagaaaatccacatctattagaaaagaaaataacccaatggttggaaactaaaggagtcgagagacttaagcgaatggcaatatcaggggatgattgtgtagtaaagcctatagatgatagatttgccaatgcattgttagcattaaacgacatgggtaaagttagaaaagatatcccacagtggcagccgagtaaaggttggcatgactggcaacaggtaccattttgttcacatcatttccacgaactgataatgaaggacggaagaaaacttgtagttccttgcaggccccaggacgaactaatcggtagagcacggatatcacaaggagctggatggagcttaaaagaaactgcatgtttaggtaaagcgtatgctcaaatgtggtcactcatgtatttccatcgacgtgacttgcgtcttgcaagtaacgcgatttgttcagcagttcctgtacactggattcccacatcccgaacaacatggagtattcatgcgcaccaccaatggatgaccacggaggacatgctaacagtctggaatagagtatggattgaagacaatccttggatggaggataaaacaccaattactacatgggaagatgtaccatatcttggcaaacgagaagaccagtggtgcggttcattaattggtcttacctcgagagctacttgggcacaaaacatactgacagcaatacaacaagtaagatcgttaatcggggacgaagaatttctggactatatgccgtccatgaaacgatttagaaaagaggaggaatctgaaggagcgatttggtga

SEQ ID NO: 23470 - RNA, 9873 nt, synthetic construct
  misc_feature 1..9873: note = derived and/or modified CDS sequence (opt6) from DENV-3__EU482459__SS-prME
  source 1..9873: mol_type = other RNA
acaagcctttgtctaatgatgatgttaccggcaacattagcatttcaccttacttcgcgcgatggagaacccagaatgatagtaggtaaaaacgaaagaggaaaatctttattattcaaaactgcaagcggaatcaacatgtgcactttaattgcaatggatcttggggaaatgtgcgatgacactgtgacatataaatgtcctctaatagcagaagtagaacccgaagatattgattgctggtgtaacttaacaagcacttgggtaacatacggtacttgtaatcaagcgggagaacatcggcgcgacaaaagaagtgttgcactagcaccccatgtcggtatggggctagacacacgcacacaaacatggatgagtgctgaaggagcgtggcgtcaagtagaaaaagtggaaacctgggcacttcgtcacccaggattcacaatactagcactattcttagctcattatatagggacaagtttaacgcaaaaagtagtcatcttcatactattgatgctagtaactcccagtatgacgatgcgatgcgtgggcgtaggtaacagagactttgtggaaggtctaagtggggccacatgggtcgacgtcgttttggaacacgggggctgcgtaacaactatggcgaaaaataaacccaccttggatatcgaattacagaaaactgaagcaacacaactagctacacttcgcaaattgtgtatagaaggtaaaatcacaaatattactacggattcgagatgtcctactcaaggggaagccattctaccagaagaacaagatcaaaattatgtttgcaaacacacgtatgtggatcggggttggggaaatggctgcggactgtttggtaagggttcgttagtcacttgtgctaaatttcaatgccttgaacccatagaaggaaaggtagtgcagtacgaaaacttgaaatacactgtaatcatcacagtgcatacaggggatcaacaccaggttgggaacgatactcagggagttacggttgaaataactcctcaggcttcgacagtagaagcagtcctacctgaatacgggaccctaggtttggaatgctcacctagaaccggcttagactttaatgaaatgatcttgctcaccatgaagaataaagcatggatggtacatagacagtggttctttgatttaccattgccatggacttcaggtgccaccacggaaactccaacatggaatcgaaaagaactattagtcacattcaaaaatgcacatgccaagaaacaggaagtagtcgttctaggaagccaagaaggagccatgcacacggccttgactggtgctacagagatacaaaactcgggaggtacatcgatcttcgcaggacaccttaaatgcagactcaaaatggataaactagagttaaaaggtatgtcctatgccatgtgcttaaatacattcgtacttaagaaagaagtatcagagactcaacatggaacaatccttattaaagtggaatacaaaggagaagacgcaccatgtaaaattcccttcagcaccgaggatggtcaaggcaaagcacataatggaagattaataacggcaaatcccgtagttaccaagaaagaggaaccagtaaacattgaagctgagccacccttcggagaaagcaacattgtcataggaattggagataaggcgcttaaaatcaattggtataagaaaggcagttccataggaaaaatgttcgaagccacagcgaggggagcgcgacgaatggcaatactgggggatacagcatgggatttcggatcagtaggcggtgtattaaatagtttagggaaaatggtacaccagatattcggatcagcatacactgcactattttccggggtaagctggataatgaaaatcgggataggagtacttttaacatggatcgggctaaatagcaaaaatacaagtatgtctttctcctgcatcgtaataggaataataacactatatttgggagcagttgttcaagcagacatgggctgcgcgataaactggaaagggaaagaattaaagtgcggatcgggaattttcgttactaatgaagttcatacatggacagaacaatacaaatttcaggcagatagtccaaaacgattagctacagcaatagccggtgcgtgggagaacggagtatgtgggattcgaagcacgactagaatggaaaatcttctctggaaacaaatcgcgaacgagctcaattatatactatgggaaaacaacataaagttaacagtggtagttggcgatataataggagtactagagcaggggaaacgtacacttacgccacaaccaatggaactaaaatacagctggaaaacttggggtaaagcgaagatagttactgctgaaactcaaaactcttcatttatcatcgacggccccaataccccagagtgtccgtcagctagcagagcttggaacgtttgggaagtcgaagattatggtttcggagtcttcaccacaaatatatggttaaaacttcgcgaagtgtatactcagtcttgcgatcaccgtctcatgtcagcagctataaaagacgaacgagccgtccatgcggatatgggatactggatcgaatctcagaaaaatgggagctggaaattagaaaaggcatccttcattgaagtaaaaacttgcacatggcctaaatcgcacactttatggtcaaatggggtgctggaaagcgatatgataatcccgaaatcgttagctggccccattagccaacacaatcacaggcccggctatcacactcaaacagcagggccatggcatctagggaaactagaacttgattttaattactgcgaaggaaccactgttgtaataacagaaaactgtgggacgagaggaccttccctccgaacaactacggtctcaggtaaactgatacacgagtggtgctgtagaagctgtacccttcctccgcttagatacatgggggaagacggttgctggtacggcatggaaatcagacctattaatgaaaaagaagaaaatatggtgaaatcgctggtcagtgctggcagcggcaaagtagataattttactatgggtgtcctctgtcttgctatattattcgaagaagtcatgcgaggaaaattcggtaagaaacatatgatagcaggagtcttgttcacctttgtgctcctattgtcaggacagataacatggagagacatggctcataccttaataatgataggttcaaacgcctcagatcgcatgggtatgggtgttacctatctggctttaatagcgacattcaaaattcaaccgtttctcgccttaggattctttttgagaaaattgacgtctcgggaaaatctattactcggagtcggcttagctatggcaaccacactacaacttccagaagacatagaacaaatggctaacgggatagcattgggactgatgacacttaaacttatcactcaatttgagacttaccaactatggacagctttagtgagccttacgtgtagcaatacaatatttacactgactgtcgcatggcgtacagcaaccctaatattagctggggtatccttgctgcccctatgtcaatcaagtagtatgcgtaaaaccgactggctaccaatgaccgtggcagcaatgggtgtcccgccattaccgctattcatattttcactaaaagacacacccaaacgacgaagttggccccttaatgagggcgtaatggcagtgggtctggttagcatcttagcatcttcgcttttaagaaatgacgtccctatggcaggaccactcgtggccggtggtttgctaatagcatgttacgtaatcactggcacatcagccgatctgactgttgaaaaagcagcagacgtaacgtgggaagaagaggctgagcaaactggagtctctcacaaccttatgatcacggttgacgacgatggcactatgcgcatcaaagatgacgagaccgagaatatattaacggtgctgttaaaaaccgcgttactgatagtatcaggaatatttccgtattctattcccgcaacgctcttggtctggcatacctggcaaaagcaaactcaaagatcaggtgtattgtgggatgtgccttcaccacccgaaacacaaaaggctgagttggaagaaggggtatatcgtattaaacaacaaggtatatttgggaaaacacaggtcggtgttggcgtacaaaaagagggggtatttcatactatgtggcatgtaacaagaggcgcagttttgacacacaatggaaaaagacttgaaccaaattgggcatcagtaaagaaagacttaatttcatacggcggcggatggagactatcagcacaatggcaaaaaggagaagaagttcaagttatagcagtagaacccggcaaaaaccctaaaaacttccaaacgatgcctggaatatttcagacaacaacaggcgagataggcgcaatagcattagattttaagcctggaaccagcggatctcccattattaaccgagaaggaaaggtcgtaggtttatatgggaatggcgtagtcaccaaaaatggtggatatgtttccgggatagcccagacaaatgcggagccggacgggcctacgcctgaattagaagaagagatgttcaagaaacgtaacctcaccataatggatttacatcccggctcagggaagactcgaaaatatttgccagccattgtaagggaagctatcaaaaggcgattaaggactttaattttagcaccaacccgcgtagtggcagcagaaatggaagaagcacttaaaggtctccccataaggtatcaaacaacggcaacaaaatctgagcatactggaagagaaatagtagatctaatgtgtcatgctacatttacaatgcgactattgtcacctgtaagagttcccaactacaacttgattattatggacgaggcacatttcaccgatccagcaagtatcgccgcacgtggttatattagtactcgcgtgggcatgggtgaagctgcagctatcttcatgactgcaacacctcccggtactgctgaagcgttccctcaatcaaatgcccccatccaggacgaagaaagagacattcccgaaagatcgtggaactccggaaacgaatggattactgactttgtgggaaaaactgtgtggttcgttccaagcataaaagcaggaaatgatatagctaattgcttgaggaaaaatggtaagaaagtcattcaactgagtcgaaagacattcgatacggaatatcagaagactcgactaaatgattgggactttgtagtaacaacggatatatcagaaatgggcgcaaattttaaagcagacagagtcatagatcctaggagatgtttaaaaccagttattcttactgatggaccagaaagagtaatcctagctgggcctatgccagtaactgcagccagtgcagcgcagcgacgtggtcgagtaggtagaaaccctcaaaaagagaacgatcaatatatctttacaggtcaacccttaaataatgacgaggatcatgctcattggacggaagcgaaaatgttgttagataatattaatacgccggagggtattatacccgcgttatttgagccggaaagagagaaaagtgcggccatagacggcgaatacaggttaaaaggggagtcaagaaaaactttcgtagaattaatgagacgaggagatctgccagtctggttagcacacaaggttgcaagtgaaggaatcaagtatacagatagaaaatggtgttttgatggcgaacgtaataaccagatactagaagaaaacatggatgtagaaatttggactaaagaaggcgaaaggaaaaagctaaggccaagatggctcgatgcccgaacctatagcgatcctctcgcactaaaagaatttaaagattttgctgcgggaagaaagtcaatagcgctggatctagttacagaaataggaagggttccatcacacctcgcatatagaacccgaaatgcactagataatctagtaatgctacatacaagcgaacatggaggcagagcgtaccgacatgcagttgaggaattaccagagacaatggagacactattactactcggactcatgattttattaaccggcggagcgatgttattcctgatttccggcaaaggcattgggaagacaagtattggcctaatatgtgtaatagttagctctggtatgctatggatggccgacgtaccattacaatggatagcatccgcgatagttctcgaatttttcatgatggttttactgattccagaaccagaaaagcaaagaactccgcaagataaccaactagcttatgtcgtgatagggatactcacattagcagcgatcgtggctgctaatgaaatgggtctgctcgaaacaaccaagcgcgacctagggatgtctaaggagccaggggtagttagcccaacgtcatacctagatgttgatttacaccccgcatcagcatggacgctctatgccgttgctactacagtgattacaccaatgttaagacataccatagaaaatagcacagctaacgtcagcttagcggccatagcaaaccaggctgttgttctgatgggcctggacaagggatggccaatatcaaaaatggacctaggagttccactactagcactagggtgctactctcaagtaaacccactaacactaaccgcggccgtattattactcgtgacacattatgccataatcggaccgggattacaagcgaaagcgacaagagaggcacaaaaacgaactgctgcaggaataatgaaaaacccaaccgtagacggtataatgactattgatttagaccctgtaatatatgactctaagtttgaaaaacagctggggcaagtcatgctcctagtgttatgcgccgtccaactattactaatgcgaacctcgtgggcattatgcgaggcattgaccctagctacaggaccaataacaactttatgggaaggatctccaggtaaattctggaatacgacaattgctgtttctatggctaacatatttaggggaagttacttagcaggggcaggactcgcattctctataatgaaaagtgtaggaacaggcagaagaggtacaggttctcaaggagagacgttaggagaaaagtggaagaagaaacttaatcaattatcgcgcaaagaatttgatctttataagaaatcgggaataactgaagtagatcggacggaagccaaagaaggcctaaaaagaggagagacaactcaccacgccgtttcacgtggttcagcaaaactacaatggtttgtagaaagaaatatggtaataccggaggggcgtgtcattgatctaggatgtggaagaggtgggtggtcgtactattgcgctggactcaagaaagtaacagaggtacgcggatatacgaaaggcggtcctggacacgaagaaccagtaccaatgtccacatatggatggaatctagtgaaattaatgagtgggaaggacgtattttacctcccgcccgaaaaatgcgataccttactatgcgatataggcgaatctagtccaagtcccacggtcgaagaatcgcgaacaatcagagttctaaaaatggtagaaccctggctcaagaataaccaattttgtattaaagtcctaaacccatacatgccaacagttatcgaacatttggagcgtttacaaagaaaatatggcggaatgcttgtaagaaacccactatcgaggaactcaacacacgaaatgtactggatttcgaacggcacaggtaatattgtgtcaagcgttaatatggtctcacgcttattgctgaataggtttacaatgacacatcgtcgccctactattgaaaaggacgtagatttaggagcgggtacacgccatgtcaatgccgagcccgaaacaccaaatatggacgtgataggggaaagaataaaacgaattaaagaagaacacagtagcacatggcactacgatgacgaaaatccatataaaacctgggcctaccacggcagttacgaagtaaaggctacgggttccgcatcatctatgattaatggagtagtaaaattgctaacaaaaccctgggacgttgttccaatggtgacccaaatggctatgactgacaccactcctttcgggcaacaacgtgtatttaaagaaaaagtagacactagaacacctaggccaatgcccggaactagaaaggtcatggaaataactgcagaatggctatggcgaacactcggacgcaacaagaaaccgagactatgtacaagggaagaatttaccaagaaagttagaacaaacgctgctatgggagcagttttcacggaagaaaatcaatgggattcagcacgagcagcagtagaggatgaagagttctggaaacttgttgatcgagagcgcgaactacataaacttggtaaatgcggtagctgcgtctacaatatgatggggaaaagagagaagaaattaggtgaatttggtaaagcaaaaggttcccgtgcaatatggtatatgtggttaggtgcaagatatttagagttcgaagctctcggctttctaaatgaagatcattggttttcaagagaaaatagctactcaggggttgaaggagaaggtctacacaaactcggttatatactaagagatataagcaaaatacctggaggtgccatgtacgcggacgacacagcaggttgggatactagaatcacggaagacgacttgcataatgaagagaaaattacgcaacaaatggatcctgaacaccgacaattggcaaatgcgattttcaaacttacttatcaaaacaaggtagtaaaagtacaaagaccaacacctaaaggaacagttatggacataatcagccggaaagaccagagagggagcgggcaggtaggaacctatggcttaaatacattcacaaatatggaagcccaattggtacggcagatggagggtgaaggtgttctgtcaaaggcagatttagaaaatccgcatttattagagaagaaaattacccaatggttggaaacaaaaggtgtagaacgattgaaaaggatggccatatcgggggacgattgcgtagtgaaaccaattgatgaccggtttgcaaacgctttattagccttgaatgacatgggcaaagtacgcaaagatattccgcaatggcagccttcaaaaggttggcacgattggcaacaagtgccattttgttcacaccactttcatgaactaattatgaaagatggcagaaagttagtagtcccatgtcgcccccaggatgagttgataggacgtgcaagaatctcgcaaggtgcaggctggagcttaaaagaaacggcatgtttagggaaggcctacgcccagatgtggtcgcttatgtactttcatcgacgtgacttacgtttagctagtaatgcaatatgttcagccgtcccggtgcattggatacccacaagtcgtacgacatggagtatacacgctcatcatcaatggatgacaacagaggacatgcttacagtatggaatcgggtatggattgaagacaatccatggatggaagataagacgcctgtcactacttgggaagacgttccatatctaggaaaacgagaagatcaatggtgcggcagccttataggacttacaagccgcgcaacttgggctcagaatatcctaactgccattcaacaagtaagatccctgataggcgacgaggaatttctagattatatgccatcgatgaaacgttttaggaaagaagaagaatctgagggtgctatttggtaa

SEQ ID NO: 23471 - RNA, 9873 nt, synthetic construct
  misc_feature 1..9873: note = derived and/or modified CDS sequence (opt6) from DENV-3__EU482460__SS-prME
  source 1..9873: mol_type = other RNA
acatcactctgtctgatgatgatgctacctgcgacctttgcttttcacctgacttcaagagacggtgaacctcgcatgatagtgggcaaaaacgaaagaggtaaaagtctactattcaaaactgcatcagggataaacatgtgcacgctcatagcgatggatttaggagaaatgtgcgacgacactgtaacctacaaatgccctttaatagcagaagttgaacctgaggacattgactgttggtgcaatctcacgagcacatgggtcacgtacgggacctgtaatcaagcaggggagcacagacgtgacaaacgatccgttgctctagcaccacacgtcggaatgggactagatacacgaacgcaaacttggatgtcggcggaaggagcgtggcgccaagtagaaaaagtcgaaacatgggcattacgacacccaggttttactattctagcgctattccttgctcactatatcggaacgtcattaacccaaaaagttgtaatctttatcttactcatgttagtaactcctagtatgacaatgcgatgtgtgggagttggaaaccgagacttcgtagaaggtttaagcggggcaacttgggtggatgttgtccttgagcacgggggatgcgtcacaactatggctaagaataaaccgacacttgatattgagttacagaaaactgaggctacgcaactagcaacattgcgaaaattatgcatagaaggtaaaataaccaatataactacagactcaagatgtccgactcagggtgaagctatactacccgaagaacaagatcaaaattatgtatgcaaacacacgtacgtagacaggggatggggaaacggttgtggactatttgggaaaggcagcctagtaacatgcgctaaattccaatgcctagaacccatagaaggtaaagtagttcaatacgaaaatctaaaatatacagtaattattacagtacataccggggatcaacatcaagtcggtaacgatacccagggtgttacagtagaaataacaccacaggccagtacggtagaggcagtcctcccggaatatgggacattaggactagagtgctcaccaagaactggtctggatttcaacgagatgattttattgactatgaaaaataaagcctggatggtacatcgtcagtggtttttcgacttgccacttccatggactagcggtactacaactgagactcctacatggaatcgaaaagagctattagttactttcaagaatgcacatgctaagaaacaagaggttgtggttctcgggtcgcaagaaggtgcaatgcacactgccttaacaggtgcgaccgaaatacaaaactcaggtggcacttcgatatttgctggtcatttaaaatgtcgactaaaaatggacaaattagaactaaaaggaatgagctatgcaatgtgcttaaatacattcgtgctaaagaaagaagtgtccgagactcaacatggcacaatacttataaaagtggaatacaaaggagaagatgccccttgtaaaatacccttttctacagaagacggacaaggcaaagcgcataatgggaggctgattaccgcaaacccagtagtaacgaagaaagaagaacctgtcaatatcgaggccgagccaccatttggagaaagtaacatagtgataggaatcggcgataaagctcttaaaattaattggtacaagaaaggctcgtcaattggaaagatgttcgaggcaactgcaagaggtgcacgtcgtatggctattcttggagatactgcatgggacttcgggagcgttggcggggtccttaatagcctaggtaagatggtccaccagatcttcggtagcgcatacactgcgttatttagtggagtgtcatggattatgaaaatcggtattggtgtattactaacctggataggattaaatagtaaaaacacttccatgtcatttagctgcatagtaatcggaataattactctttacttaggcgccgttgtacaagctgatatgggttgtgcaattaattggaaaggtaaagaacttaagtgcggttcaggaatatttgtcacaaatgaagtacatacctggacggaacaataccgatttcaagcggattcacccaaaagattggctacggcaattgctggagcttgggagaatggtgtatgtggaatacgttccaccacaagaatggaaaaccttctttggaaacagatagccaacgagttgaactacatattgtgggagaataatataaaacttacagttgttgtgggggatatcataggagtattagagcaagggaaacgagcacttgccccacaaccaatggaactaaagtactcttggaaaacctggggaaaggctaagatcgttaccgcggaaacccaaaatagttcatttatcatagacggaccaaatactccggaatgtccatcagcttctagagcttggaatgtatgggaagtggaggattatgggttcggagtgttcaccacgaacatatggctaaagctgagggaagtctacactcaatcctgtgatcaccgactaatgagtgccgctataaaagacgaaagagcagtacacgccgatatgggttattggattgaaagtcagaaaaacgggtcatggaaattagaaaaggccagctttattgaagtaaagacgtgtacatggcctaaatctcacacgctctggtcaaacggagtcttagaaagtgatatgataattcctaagagcctagcaggtcctatatcgcaacataatcaccggccaggttaccatactcaaactgcgggtccgtggcacctgggcaaactagagcttgatttcaactactgtgagggtacaactgtagtaatcaccgaaaactgcggtaccagagggccctcacttaggaccacgactgtatctggcaaactaattcatgagtggtgctgtcgctcctgtacattgccaccgctaagatatatgggagaggatggctgctggtatggtatggaaattaggccaataaatgaaaaagaggaaaacatggttaaatccctcgtatctgcagggtctggaaaggtcgataactttaccatgggtgtactatgtttagccattcttttcgaagaagtaatgcgtggaaaatttggaaagaaacatatgatagcaggagtcctattcacatttgttttgcttctctctggccaaatcacctggcgtgatatggcacacacactcattatgataggttcaaatgcctcagacagaatgggtatgggtgtcacatatcttgcactcattgctacattcaaaatacaacctttccttgcgctcggattctttttacgaaaattgacctctagagaaaacttattattaggtgtggggttggcaatggcaacgacacttcaactcccagaagacatcgaacaaatggcaaacggaattgcactcggcctaatgaccttaaaactaataacacaatttgaaacctaccaactctggaccgcacttgtgtcactaacatgctcaaataccatttttaccttgacagtggcatggcgaaccgccactcttattttagccggtgtatctttattaccgctatgccaatcctcttcaatgcgaaaaacagattggttaccgatgacagtagccgcaatgggagtcccgcctctacctttatttatattcagcttgaaagatactccaaagcggcggagctggcctctaaatgaaggagttatggctgttggactggtaagtatactggcatctagtttactaagaaatgatgttcctatggccggtcctctagttgcagggggcttactaattgcatgctatgtcataacaggtacatcagcagatctgacggtcgagaaagctgctgacgttacttgggaagaagaagcagaacaaacaggtgttagccacaatctaatgataaccgtagatgacgacgggactatgcgaataaaagacgatgaaactgaaaatatcctgacagtattattaaagaccgcgctattaattgtgtcgggcatatttccttatagcatacctgcaaccttgctcgtctggcacacatggcaaaaacaaacccaaagatctggggtcttgtgggatgtcccaagcccacctgaaacccaaaaagccgaactggaagaaggcgtctatcgtataaaacaacaaggaatttttggaaaaacgcaagtaggagtgggagtccaaaaggaaggcgtatttcacacaatgtggcacgtaacacgaggtgctgttctgacgcacaatggaaaaagacttgaaccaaactgggccagcgtaaagaaggatttaatcagctacgggggaggatggagactgtccgcgcagtggcaaaagggagaggaagttcaagttatagccgtagagcccggaaagaatccgaaaaacttccaaacaatgccaggaatctttcaaacgactatgggagaaatcggggcaattgcactagattttaaaccaggaacttcaggaagtccaattattaacagagaggggaaagtggtcggattatacggaaatggagtagttactaaaaatgggggttatgtttccggtatagctcaaacgaatgctgaaccagacggaccgacaccagaattagaagaagaaatgtttaaaaagcgtaatctcacaataatggatttacatccgggaagcggcaaaacaaggaagtaccttcccgctattgtgagagaagcaataaaaaggcgactgcgaacgcttatattagcgccaacgcgtgtagtagcagcagaaatggaagaggctttaaagggattaccaattaggtaccagactaccgctaccaagagtgagcacactggaagagaaatcgtagatttgatgtgccacgccacatttacaatgagattgctttcgccagtgagagtccctaattataatcttataattatggatgaagctcatttcacagatccagcatccatcgccgcaaggggatatataagcacccgtgtaggtatgggcgaagcagctgcaatattcatgactgctaccccgccaggtacagcagaggctttccctcaatcaaatgctccaatacaagatgaggagagagatataccagaacgctcatggaactcaggaaatgaatggataacagattttgtaggaaaaaccgtgtggttcgtaccatcgataaaagcaggaaacgatattgcaaattgtctgaggaaaaatggcaagaaagtgatacaattatctcgtaaaaccttcgacaccgaataccaaaagactcgattgaatgactgggatttcgtagtaacaactgatatctccgaaatgggcgcaaacttcaaagcagacagagtaattgacccaagaagatgtttaaagccagttattttaactgatggcccagagagggttatacttgctggtccaatgccggttacagcggctagtgctgcacaaagacgaggaagagtaggcaggaaccctcaaaaagaaaacgatcagtatatattcacagggcagccacttaataatgacgaagatcatgctcattggaccgaggcaaaaatgcttcttgacaatataaatactccagaaggaattataccagctctctttgaacccgagagggaaaagtccgcggctatagacggagaatatcggctcaaaggcgaatcacgcaaaacattcgtagaactaatgagacgtggtgatctaccagtgtggctagcacataaagtcgcatcggaagggataaaatacactgacaggaaatggtgtttcgatggagagcgcaataatcaaatcctcgaagaaaacatggatgtggaaatatggactaaagaaggcgaacgaaagaaattaagaccaagatggctagacgcccgtacgtattcagacccactcgcacttaaagaatttaaagatttcgcggccggtcggaaaagtatcgcgctagatctagtcactgagataggtagggtgccttcacatttagcatacagaaccagaaacgccttggataatctggttatgttacatacaagtgaacatggaggcagagcctataggcatgcggtggaagaattaccagaaacaatggagacactgcttttgcttggcttgatgatattattgacaggtggagctatgctattcttaatatctggaaaaggcataggaaaaacttccataggtttaatatgcgtaatcgtaagctcagggatgctgtggatggccgacgtaccacttcaatggattgcttcagcaattgtactcgagttctttatgatggttttattaataccggaaccagaaaaacaaaggactccacaagataaccagctcgcatacgtggttatcggtatattgacactcgccgccattgttgcagcaaatgaaatggggttactagaaacaacaaaacgtgacctaggcatgtctaaagaacctggtgtagtaagtcctaccagctatcttgatgttgatctacatccggcctcagcatggacactgtacgctgtagctactacagttattactccaatgctaaggcacacaatagagaactcgactgcaaacgtctcgttagccgctattgccaatcaggccgtagtattgatgggactagacaaaggatggcctataagtaaaatggaccttggagtcccacttctggcattgggttgctattcccaagtaaacccattaacgcttactgcagccgtactgctcctggtcactcattacgctatcataggtcctgggttacaagctaaagcaactcgcgaagcacaaaaacgcacagctgcgggtatcatgaaaaatccaacagttgatggaattatgacaattgatctagatcctgtgatttacgatccaaagttcgagaaacaactgggacaagtaatgcttttagttctatgcgccgtacaacttttattaatgagaacttcatgggccctttgtgaggcattaaccctggcaacaggtcctataacaacactctgggagggctcaccaggtaaattttggaacacgacaatagctgtctctatggccaacatatttagaggatcctatctcgccggtgcaggattggctttttctataatgaaaagtgtagggaccggcaggagaggcacaggcagtcagggagagacgctgggggaaaaatggaagaaaaagctgaaccaactcagtaggaaagagtttgatctatataaaaagtctgggattacggaagtcgacagaacggaagcgaaggagggactaaaaagaggtgaaacgacacaccacgcagtctcacgaggaagtgcgaagttacaatggttcgtcgaaagaaacatggtgataccagagggaagagtaattgatcttggctgcggtcgtggtggatggtcttactactgcgcgggattaaagaaagtgacggaagttaggggttatactaaaggaggtccaggacacgaggaacctgttcccatgtcaacttacggatggaatatagtcaaattaatgtcaggaaaagatgtattttacctacctcctgaaaaatgtgatactctattgtgtgacataggagaatcttcgccatcaccaactgtagaggaatcaagaacaatacgcgttctcaaaatggtagagccttggctcaaaaacaaccaattttgcatcaaagtattaaatccatatatgccaacagttatcgaacatttagaaagattgcagagaaaatatggaggtatgttagtccgaaaccctctaagtcgcaattcaacgcatgagatgtactggatcagcaatggtaccggaaacatagtgagctctgtaaacatggtgtcaagactactcttaaatcgatttacgatgacccacagaagacccaccattgaaaaagacgtagacctcggtgcaggaaccaggcatgtaaacgccgaacctgagacgccaaatatggacgtgataggagaacggatcaaaaggattaaagaggaacactcgagtacatggcattatgacgatgagaatccatacaaaacctgggcctaccacggttcttacgaggttaaggctaccggtagcgccagctcaatgataaatggagtggttaaactactaactaagccttgggacgtggtaccaatggtcacgcagatggcaatgaccgatacgactccatttggccaacaaagagtgtttaaagaaaaagttgacacgaggactccgcggccaatgccagggactaggaaagtgatggaaatcacagcggaatggctctggagaactctcggcagaaacaagaaacctagattatgtacgagggaagaatttacaaagaaagtccggacaaatgcagctatgggagcggtattcacagaggaaaatcaatgggatagcgctcgagctgcagtagaggacgaggagttttggaagctagttgacagagaaagagaactacataaacttggcaagtgtggatcttgtgtatataacatgatgggaaagagggagaagaaattgggagaatttggtaaggcaaagggatctagagctatatggtacatgtggttaggtgctcgatacctagaatttgaagctcttggattcttaaatgaagatcattggttcagtcgagaaaattcctacagtggagttgagggagagggtctacataaactaggttacattctaagagacataagtaagatccccggcggagcgatgtatgcagacgacacagcagggtgggacacacgaattaccgaagatgacttacacaacgaagagaaaatcacacagcagatggaccccgagcacagacaattagcgaacgcaatattcaaattaacatatcaaaacaaagtagtaaaagtacagagaccaacgccaaaaggcacagtgatggacatcataagcaggaaagatcaacgaggtagtggtcaggtaggaacatatggacttaatactttcacgaacatggaagcacaactggtaagacagatggagggcgagggtgtgttgtcaaaggccgatttagaaaatccacacctcctagagaagaaaatcactcagtggctcgaaactaaaggtgtcgaaagattaaaacggatggcaataagcggggatgattgcgtcgtaaagccaattgacgatcgcttcgcgaatgcattattagcgctgaatgacatgggaaaggttcgaaaggacatcccgcagtggcaacctagcaaagggtggcacgattggcaacaagttcctttctgttcacaccactttcacgaattgataatgaaggacgggagaaagttagtagtaccctgtcgaccacaggatgaattaataggtagggctagaattagccaaggtgcaggttggtcactgaaagagacggcatgcttaggtaaagcatacgcgcaaatgtggtctttgatgtattttcacagacgtgacctgcgattagcgtcgaacgcgatttgcagcgcagtcccagtccattggataccaacatcaaggaccacatggtcaatacatgcacaccatcaatggatgacgactgaagatatgttaacagtatggaatagagtctggattgaagacaacccatggatggaagataaaacgcctgtaacgacctgggaggatgtgccatatttgggaaaacgagaggaccaatggtgtggcagcttaatcggtttaaccagtcgggcaacctgggcacaaaatatactaaccgcgatacaacaagttagaagtttgattggtgatgaagagtttcttgattatatgccctccatgaaaagatttagaaaagaagaagaaagtgaaggagctatatggtaa

SEQ ID NO: 23472 - RNA, 9873 nt, synthetic construct
  misc_feature 1..9873: note = derived and/or modified CDS sequence (opt6) from DENV-3__EU482461__SS-prME
  source 1..9873: mol_type = other RNA
acatcgctttgcttaatgatgatgttgccagcgacattggcatttcacctaaccagtagggatggggaaccaagaatgatagtaggtaaaaatgaaaggggaaaaagtctactatttaaaacagctagcggtattaatatgtgtacattaatagctatggatctaggtgaaatgtgtgatgatacagtcacctataaatgtcctttaatcgcagaagttgaaccggaagatatagactgctggtgtaatttgacatcaacatgggtgacttacggaacctgtaatcaagctggtgaacatcgaagagacaaaaggtccgtagcattagcaccgcacgtggggatgggcttagatactcgaactcagacatggatgagtgcagaaggagcgtggagacaggtggagaaagtagaaacctgggcattaagacatcccggatttactatactggcattatttttagctcattatattggaacctctctaacacagaaagttgtgatatttatattattaatgctagttactccatctatgactatgcgctgtgttggcgtcggaaaccgtgatttcgttgagggtttaagcggagcaacttgggtggatgttgtcttggaacacggaggatgtgtaacgaccatggccaaaaataaaccaacattggacattgagctacagaaaacagaagctacacaattggcgacacttagaaaattatgtatcgaaggaaaaatcacgaacataaccacagatagtcgatgtccgacacaaggagaagcaatattaccagaagaacaagatcagaattacgtatgcaaacacacatatgtagacagagggtggggaaatggttgcggactattcgggaaaggatctttagtaacttgcgctaagtttcaatgcctagaaccaattgaaggtaaagttgtccaatatgaaaacttaaaatatacagtaataataacagtccataccggagatcaacatcaagttggaaatgatacccaaggagttacagttgaaattactccccaagccagcaccgttgaagcagtattaccagagtatggtacactgggtcttgaatgcagccccaggacaggattagatttcaacgaaatgattctattaacaatgaagaacaaagcctggatggtccaccgacagtggttctttgacttaccattaccgtggacatcgggagcaaccacggaaacgccaacatggaatcgtaaagagctgttagtgacatttaaaaacgcccacgctaagaaacaagaagtagtagtattagggtcacaagaaggggccatgcatacggctcttacaggggcgactgagattcaaaacagtggaggtacttcgatatttgcaggtcatctaaagtgtcgattgaaaatggataagctagagctcaaagggatgagttacgccatgtgcctaaacacttttgtcctcaagaaagaagtatcagaaacacaacatggaactatattaataaaagtcgaatataaaggagaggatgctccatgtaaaataccatttagtaccgaagatgggcaaggtaaggcccacaacgggcgacttataactgccaatccagtagtcactaagaaagaagaaccagtgaatattgaagctgaaccaccatttggcgaaagcaatatagtaattggaattggggataaagccttaaagataaactggtataagaaaggctcatcaattgggaaaatgtttgaggcaacagcaagaggggcgaggaggatggccatactgggtgacactgcttgggattttgggagcgtaggtggggtgctaaattctttaggcaaaatggtacaccaaatattcggaagcgcatatacagccttattttcgggtgtgtcgtggatcatgaaaataggaattggggttctattgacatggatagggttgaatagtaaaaatactagcatgtcttttagctgcattgtaattggtatcataacattgtatctgggggctgtagtacaggcggacatgggatgtgcaataaattggaaagggaaagaactcaaatgtggatctgggatatttgtgacgaacgaagttcacacatggactgagcaatacaaatttcaagcagattctccaaagagattagctactgctattgccggtgcatgggagaacggcgtctgtggaataaggtccaccacaagaatggagaatctactctggaaacaaattgctaatgaattaaattatatcttatgggaaaataacataaaattaacggttgtagtaggcgatataattggtgtccttgaacaaggaaagaggacattaactccacagcctatggaactcaaatatagctggaaaacttggggaaaagccaaaattgtaactgcagagacacaaaacagctcattcatcattgacggccccaacacgcccgaatgtccgtcagcatcaagagcctggaatgtatgggaggtagaggattatgggtttggcgtcttcactaccaacatctggctaaagttaagagaagtttacactcaaagctgcgatcaccgactcatgtcggcagctatcaaggatgaaagagcggtccatgctgacatgggttactggatagaatcccagaaaaatggttcttggaaattggagaaggcatccttcatcgaggttaagacgtgtacatggccaaagagtcacactttatggagtaatggtgtattagaatctgacatgataattccaaagtccttagcaggcccgataagtcaacacaaccatcggccgggttatcatacacaaactgcagggccttggcacctaggaaagttagaactcgattttaattattgtgaagggacgacagtcgtgataactgaaaattgcggtacccgaggtccatccttaagaacgaccactgtatcaggaaaactaatacatgagtggtgttgccgcagttgtaccttaccacctttaagatacatgggcgaagatggctgttggtatggaatggaaatacgaccaatcaatgagaaggaagaaaacatggtaaagagcttagtcagtgctggcagtggtaaagttgataattttacaatgggtgttctttgtctagctattctttttgaagaagttatgcgtggaaaatttgggaaaaagcacatgatagccggggtactctttacatttgttcttctattaagtggacaaataacatggagagatatggcacacacactaatcatgataggctcaaacgcctctgatagaatggggatgggcgttacgtacctagcattgattgctacgttcaaaatacagcccttccttgcactaggattctttctcagaaaacttacttctagggaaaatctcttgttaggagtaggattagcaatggcaaccacgttgcaacttcctgaagatatagagcaaatggctaacggcatagctctaggtttaatgacacttaaattaataacccaatttgagacataccaactatggacggccctagtatcactaacgtgctcgaataccattttcacattgacagttgcctggagaaccgcaaccttaatacttgcgggagtctcgctattgccactgtgtcaatcttcctcgatgcgtaagactgattggttaccaatgactgttgccgcaatgggagtacctccattacccctatttatattcagcttaaaggatacacccaagcgtagaagttggccgttaaatgaaggcgttatggccgtcgggttagtatcaatattggcttcttcacttttaagaaacgacgtaccaatggctggacccctagttgcaggagggttattaattgcatgttatgtaataaccggaacatcggcggatttaactgtggaaaaagcagctgatgttacatgggaggaggaagcagaacagacaggagttagtcataaccttatgatcacagttgacgatgatggaactatgcgaataaaagacgatgaaacagaaaacattctcactgttctccttaaaacagcacttctgatagtctcaggaatattcccctacagcatacccgctaccctcttagtatggcacacatggcaaaagcagacgcaacgttcaggcgtgctttgggacgttccaagtccaccagaaactcaaaaagccgagttagaagaaggagtgtatcgaatcaagcagcaagggattttcggaaaaactcaagttggcgtcggtgttcaaaaggaaggagtctttcatacaatgtggcacgtaactagaggagctgtgctaacacataatggaaaaagattagagccaaattgggcctccgtcaagaaagatctaatttcgtatggaggtggatggagactttccgcacaatggcaaaaaggagaagaggtgcaagtcatagcagtcgagcctggcaaaaatccgaaaaattttcaaacgatgccaggcatttttcagaccactacaggtgaaataggcgcaatcgcactcgactttaaaccgggtactagcggatcaccaatcataaatcgtgaaggcaaggtcgttggtctatacggcaacggagttgtaactaaaaacggaggttatgtatcaggtatcgcacagaccaatgcagaaccagatggaccaacacctgaattggaagaagaaatgtttaaaaagagaaatctcacaattatggatttacaccccggtagcggaaaaactcgtaaatatttacctgcaatagtcagagaagccattaaaagacgtctacgaacgttaatactggctccaacaagagtagtagcggcggaaatggaagaagcccttaaggggctaccaatacggtaccaaactactgcgactaaatctgaacatacaggtagagagatagtagacttgatgtgtcatgcgacattcacaatgagacttttatcacctgtgagagttccgaattataatctagtaattatggatgaagcacactttacagaccctgcatctattgcggctcgaggctacataagcacgagagttggaatgggagaggctgcagctattttcatgacagcgacaccacctggaaccgcagaagcatttccacaaagtaatgcgccaatccaagacgaagaacgagatataccagaacgatcatggaactcaggaaatgagtggattacggatttcgtagggaaaacggtctggttcgttccgtcgattaaagctggaaatgatatagccaattgtctcagaaagaatggaaagaaagtgattcaactaagcagaaaaacttttgacacagaataccagaaaacacgcctaaatgattgggacttcgtagtaacaacagatatatcagaaatgggtgcgaatttcaaagctgaccgggttattgaccccagaaggtgtttaaaacccgtgatcttaacagacggaccagaacgagtcattctggccggtcccatgccagtaacagcggccagcgcagcacagaggagaggacgagtaggacgaaaccctcaaaaagaaaatgatcagtatatctttacgggccaaccgctcaataatgatgaggaccacgcgcactggaccgaggcgaaaatgttactagacaacataaacactccagaaggaattattccggcattatttgaaccagagcgtgaaaaatccgctgctattgatggtgagtacaggttaaaaggtgagtcacgaaaaacatttgtagaattaatgagaagaggggatctgcctgtatggttggcccataaagtcgcttctgagggtataaaatacaccgaccggaaatggtgtttcgatggagaaaggaacaatcaaatactcgaagagaatatggatgtagaaatctggaccaaggagggtgagcggaagaaattaagaccaaggtggctggatgctagaacgtattcagaccctttagctttaaaagagttcaaagacttcgcggcagggcgaaaaagtatcgctttagatttagtaacggaaattggacgggttccatctcacttagcctatcgaacgagaaatgctctagacaatcttgttatgttgcatacgagtgagcatggaggcagagcttatcgacacgcagtagaggagctaccagaaacgatggaaactctattattacttggactgatgatattgttaactggcggtgctatgctttttcttatttcaggtaaaggaataggcaaaacaagtataggtttaatttgcgtcatagtttcaagtggtatgctatggatggcggatgtaccattgcaatggatagccagcgcaatcgttttagagttctttatgatggtacttctgattccagaaccagagaagcaaagaactccgcaagacaatcagttagcctatgttgtcataggaatcttaacactcgccgcaattgtagctgcgaacgaaatgggtcttctagaaactaccaaacgtgatttgggcatgtctaaggaaccaggagtagtcagtccaacatcatatctagatgttgatctgcatccggcatcagcctggactttatatgccgtagcaacaacagtaattactcccatgttacgacacactatagaaaacagtaccgccaacgtatcattagcagcaatagccaaccaggctgtcgttctgatgggtctggataaagggtggccgatcagcaaaatggacttaggagtgccactgttggcattaggatgctattctcaagtcaaccccttaaccctcacagccgccgttttattacttgttactcattatgcaatcattggtccaggattacaagctaaggctacccgagaagcgcagaaacgcacggcagcaggcataatgaaaaacccaaccgtagatggtattatgaccatagatttagatcccgttatatatgacagcaaattcgaaaaacaactaggccaagttatgttattagttctgtgcgcagtccagctattacttatgagaacttcatgggcattatgcgaagcattaacacttgctacaggacctatcactacattgtgggaaggatcacctgggaagttctggaataccacgatagcagtatccatggcaaacatatttaggggttcttacctagcaggggcaggtttagccttctccatcatgaagagtgttggtaccggaagacggggcaccggaagtcagggcgaaaccctgggtgaaaagtggaagaagaaactaaatcaactatcacgtaaagagttcgatctatacaagaaatcgggaataactgaagtagatagaactgaagcaaaagaagggttaaaaagaggtgaaacgacacatcacgccgtgagtagaggcagtgcgaaactacagtggtttgtggaaaggaacatggtaataccggaaggtagagtgatagacctcggttgcggacgtggcggttggtcttattactgcgcgggcctaaagaaagtcactgaagtacgcgggtacacaaaaggagggccaggtcacgaagaacctgtgccgatgagtacgtatggatggaatcttgtaaagctaatgagcggcaaggacgtcttttatctgccaccagaaaaatgtgatacgctgctgtgcgacattggggaatcctcaccatcaccaaccgttgaggaatcgaggacgataagagtactaaagatggtcgaaccatggttgaaaaataatcagttctgtataaaagttctaaatccgtatatgcccactgttattgagcatttagaacgtctgcaaagaaaatatgggggtatgttagttcgaaatccactttcaagaaatagtacgcatgaaatgtattggattagtaatgggactggaaacatagtctcttccgttaacatggtgtctagattactattaaacagattcactatgacacaccgacgcccaacaatcgaaaaagacgttgatctaggggccgggacacgacatgtgaatgcagaaccggaaacaccaaacatggatgtcattggtgagcgaataaaaagaataaaagaagaacattcaagtacatggcattacgatgatgaaaatccctataaaacgtgggcttatcatggaagttatgaagttaaagcgaccggctccgcatcctcaatgataaatggtgttgttaaactcttaactaaaccatgggacgtagtgcccatggttacgcaaatggcaatgacggacacgacgccgtttgggcaacaacgtgtattcaaagaaaaggtcgatacgcgaaccccgaggcctatgcccggaacgcgaaaggttatggaaattactgccgagtggttgtggagaacattaggacgtaataagaaacctcgattgtgtacaagggaagagttcacaaagaaagtcagaactaatgcagcaatgggagccgtttttactgaagaaaaccaatgggattcagcaagagcggcggtggaagatgaagaattttggaagctagttgatagagagagagaactccataaattgggaaagtgtggcagctgtgtctataatatgatggggaagagagagaagaaactaggagagttcggaaaagcaaaaggttcgagggcgatatggtacatgtggctcggcgcgagatacttggagttcgaagctctaggatttttgaatgaggatcactggtttagtagagaaaatagttattcaggggtagaaggagaaggcttacataaactaggctatatactacgagatatctctaaaattccaggtggtgccatgtatgcagatgacacggccggatgggatacgagaataacagaggatgaccttcacaacgaggaaaagattacacaacaaatggaccccgaacatcgacaactagccaatgctatattcaaactgacttaccagaataaagtcgtaaaagttcagcgtcccacacccaagggaaccgttatggatattatatctagaaaggatcaacgaggatccggacaagtaggaacatatgggctaaatacatttactaatatggaagcacagttagtgcggcagatggaaggagaaggagttttaagcaaagctgatctagaaaaccctcacctattagaaaagaagataacacaatggctggaaacaaaaggtgttgagagattgaagagaatggcaatttctggagacgactgtgttgtgaagcccatcgatgatcgtttcgccaatgcactactagcactaaacgacatgggtaaggtgcgtaaagatataccacaatggcaaccgagtaaaggttggcacgactggcagcaggttcccttttgttctcatcactttcatgagctgatcatgaaagacggcagaaagttagtagtgccatgtagaccgcaagatgaattgattggacgcgcaagaataagccagggcgccggttggtctttaaaagaaactgcctgtcttggaaaagcatatgcacaaatgtggagtctaatgtattttcatcggcgagacctaaggttggcttctaacgccatatgttcagcagtaccagtacattggattccgacaagccgtactacatggagtatacacgctcatcaccagtggatgactaccgaagatatgcttacagtttggaatcgtgtttggatcgaagataatccatggatggaggacaagacaccggtcacgacatgggaagatgttccatatttagggaaaagagaagatcaatggtgtggtagcttgatcggattaacatcccgagcgacatgggctcaaaatatattgactgcaatccaacaagtccgctcgctaataggcgatgaggaatttctagattatatgccctcaatgaaacggttcaggaaagaggaagaaagcgaaggcgccatatggtaa

SEQ ID NO: 23473 - RNA, 9873 nt, synthetic construct
  misc_feature 1..9873: note = derived and/or modified CDS sequence (opt6) from DENV-3__EU482462__SS-prME
  source 1..9873: mol_type = other RNA
acgagcttatgcttaatgatgatgctacctgcgactctagctttccacttaacaagccgagatggggaaccaaggatgattgtaggaaagaacgagaggggcaaatcgctactattcaaaacagcgagtgggataaacatgtgcaccctaatcgcgatggaccttggtgagatgtgcgacgacacggttacctacaaatgccccttaattgcagaagttgagccagaagatatagattgctggtgcaatctcacaagtacttgggtcacgtatggaacatgcaaccaggccggcgagcatagaagggataaacgcagtgtagccttagctccacatgtcggaatgggactagacacacgtacccaaacgtggatgtcagcagaaggcgcgtggcgccaagtcgaaaaagtagaaacatgggcacttaggcaccccgggtttactatattagccctcttcttagcacactatattggtacttcattaacgcaaaaagttgtaatatttatactattaatgctagttacgccatcaatgaccatgcgatgcgtcggcgttggtaatcgagattttgttgagggcctctcaggagcaacatgggtagatgtcgttttagaacatggaggctgtgtcacaaccatggcacggaataagccaaccctagatatagaactccaaaagacggaagccacacaattagcaacgttgagaaagttatgcatcgaaggtaaaattactaacatcaccacagatagcagatgcccaacacaaggagaagcaattctcccggaagaacaagatcaaaattatgtttgcaaacatacttacgttgacaggggttggggaaacggatgtggattatttggcaaaggctcgttagttacatgtgcaaagttccaatgtcttgaacctatagaaggcaaggtagtgcaatatgagaatttaaaatatactgttataattacggtccacacaggtgatcaacaccaagtaggaaacgatacccaaggagttacagtggaaataactccacaagcttcgacggtagaagccgttttgcctgaatacggcacgctggggctagagtgcagtccgcgaacaggactcgatttcaacgagatgatactactaactatgaaaaacaaagcatggatggtacaccgccaatggtttttcgacctccctttaccctggacctcgggtgccacaaccgaaacaccgacttggaataggaaggaactattagtgacatttaaaaacgcacacgcgaaaaaacaggaagtcgtagtgcttggcagtcaagaaggggccatgcatacggctttaaccggcgcaactgaaatacaaaattcggggggcacatctatattcgcaggacatctaaaatgcaggttgaagatggacaaattggaactcaaaggaatgtcgtacgctatgtgtctgaacacattcgtcctaaaaaaggaagtatcagaaacccaacatggaacaatcctaatcaaagttgaatataaaggcgaagacgcaccatgtaaaattccgtttagcacagaagacggacaaggtaaagcacacaatggacggctcataaccgcaaatccagttgttactaaaaaagaagagcctgttaatatagaggcagaaccgcctttcggagagtccaatattgtaataggaattggtgacaaggcattaaagataaactggtacaagaaaggctcatcaattggtaagatgtttgaagcgacagccagaggagcaagaagaatggctatactaggagacacggcttgggatttcgggtctgtaggaggagttttaaattcactaggaaaaatggttcaccaaatcttcggttcagcgtatacagcgttattctcaggcgtttcatggattatgaaaattggcataggagttctacttacatggattgggcttaattccaaaaacacatcgatgagcttctcctgcatcgtaattggaataattacactttacttaggagcagttgttcaagcagacatggggtgcgcaattaattggaaagggaaagaactcaaatgtggaagcggtatttttgtaaccaacgaggttcatacctggacagaacaatataaattccaggcagactcacctaaacgattagcgactgctattgctggagcttgggagaatggagtctgtggaatcagatcaacgacgagaatggaaaatttattatggaaacaaatagcgaacgaattaaactatatactctgggaaaacaatataaaattaactgttgtcgtaggcgatataatcggagtattagagcaaggcaaacgaacgctcacaccacagccgatggatcttaaatatagctggaaaacgtgggggaaagccaaaatagtgactgctgagacgcaaaattcatcgtttatcatagatggtccgaacaccccagagtgtcccagcgcctcacgagcatggaatgtatgggaggtagaagattatggattcggtgtctttacaacaaacatatggcttaaactgagagaggtatatactcaatcatgtgaccacagattaatgagtgccgcaatcaaagatgaaagggctgtacatgccgatatgggttattggatcgaatcgcaaaaaaatggatcgtggaaattagaaaaagcctctttcatagaggtaaaaacatgtacctggccaaaaagtcatactttgtggtctaatggggtactagagtcagatatgataataccaaaaagtttagccgggccaatatcacaacacaatcatcgtcctggttatcatacacaaacagctggaccttggcacctagggaagttagagttagactttaattactgtgaaggtactacggttgttatcaccgaaaattgcggaacacggggaccaagcctcagaacaacgacagtctcaggcaagttaatccatgaatggtgttgtagatcatgtacactgccacctctcagatatatgggagaagatggttgctggtatggaatggagataaggccaatcaacgaaaaggaagaaaatatggtaaaatctttggtcagcgcgggtagtggtaaggtcgataatttcaccatgggagtactctgtttagcaatactgttcgaagaagtaatgcggggtaaatttggtaagaaacatatgatcgcaggagtattatttactttcgtacttctcctatcaggacaaataacatggaaagacatggcacacacttttataatgattggatcaaacgctagtgaccggatgggaatgggtgttacgtatctggctctcatagcaacatttaagatacaacctttcttggcgctggggttttttctgaggaaattgaccagtcgtgaaaatctgttactaggggtaggcctcgcaatggccaccaccttgcaactccctgaggatattgagcaaatggcaaacggtatagcattaggactaatgactctcaaattaattactcagttcgagacgtaccaactttggacagcattagtgagtctaacctgcagcaatacaatcttcacgttaacagtagcttggcggacagccacgctggttcttgcaggagtttcccttcttcccctttgccaatctagttccatgcgtaaaacagactggctaccgatgacggtcgcagcaatgggtgttcccccgttgccactttttatttttagtcttaaagatacaccaaagcgccgatcttggccactaaatgaaggcgttatggctgtaggactggtatcaattctagcatcctcactactccgaaatgacgtaccgatggctggcccactcgtagcaggaggacttcttattgcgtgctacgttattacaggaactagcgctgatcttactgttgaaaaagcagcagatgtaacttgggaagaggaagcggaacagaccggagtctcacacaatctgatgatcacggtagacgatgatgggactatgagaattaaagatgatgaaaccgaaaatattctaacagttcttttgaaaacagccttactaattgtgtcaggaattttcccatatagtatccctgccacactgctagtttggcacacttggcaaaaacaaactcaacgaagcggggtgctttgggatgtgccctcaccaccagagacgcaaaaagcagaactagaggaaggtgtatatcggattaaacaacaaggaatttttggcaagacgcaggtgggcgtaggtgtacaaaaagaaggagtattccatactatgtggcatgttacccgaggcgcagttctgacacataatgggaaacggctcgagcccaattgggcctcggttaaaaaagatctcatatcatatggcggaggttggcgattatccgcacaatggcagaaaggtgaagaagtacaggtaatagcagtcgaaccgggaaaaaacccaaagaattttcaaacaatgcctggaatttttcaaactactacaggagaaataggagccattgcactcgattttaaacctggcactagcggctcacccattatcaatcgagaaggcaaggtagtagggttgtacggtaatggtgtagtaaccaagaatggaggatatgtatcgggaatcgcacaaaccaacgcagaaccagatgggcccactccagagttagaagaagaaatgtttaagaaacgcaacctaactataatggatttacatccaggatccggaaaaactcgaaaatatttacccgcaatcgtacgcgaagctataaagagaagactacgaacgttaatcctggctccaacaagggtcgttgcagctgaaatggaagaggctctgaaaggtttaccaatcagatatcaaacaacagctacgaagtcagagcacactggccgagaaatagtggacttaatgtgtcacgcgacatttaccatgcgtttactaagtccggtacgggttccaaactataacttaattataatggatgaagcacacttcacggaccctgctagtattgccgcaagaggctatattagcactagggtaggaatgggagaagccgccgcaatattcatgaccgccacccccccagggacagcagaagcttttccacaatcaaatgcaccaatacaggatgaggaaagggacatcccagagagaagctggaattctggaaacgagtggattacagactttgtgggaaagacagtatggtttgtcccatcaatcaaggcgggaaatgacattgctaactgtctccgaaaaaacgggaaaaaggtaatacaattgtccagaaagacgttcgacacagagtatcaaaaaacacgactaaacgattgggacttcgtggtaaccaccgatatcagcgaaatgggggcaaatttcaaggcggatagagtcatagatcccagaaggtgtctaaagccagtcatattgactgacggaccagaacgagtcatactagccggacccatgcctgttactgccgccagcgctgcgcaaagaagaggtcgtgtaggccggaatccacaaaaagaaaatgaccaatatatattcacaggtcaaccgctaaataacgacgaagatcacgcacattggactgaagcgaaaatgctattggacaacataaataccccggaaggaataataccggctctattcgaacctgaacgtgaaaaatcggctgcaatagatggggaataccgcttaaaaggggaaagtcggaaaaccttcgtagaattaatgcgaagaggagacctacccgtatggttagcacacaaagtggctagtgaagggataaaatatactgatcgaaagtggtgtttcgacggagaacgtaataaccagattctagaagagaacatggatgtagaaatatggacgaaagaaggagaaagaaaaaaactccgcccacgatggttagatgcccgcacttattccgacccactcgcgctgaaggaatttaaagattttgctgcaggaagaaaaagtatagcattggatttagttactgaaataggaagggttcccagtcacttagcttaccgaacccgaaatgctctggacaatctagtaatgttacacacaagtgagcacggaggaagagcatatcgccatgctgttgaagaattgcctgaaacgatggaaaccttgcttcttttgggactaatgatattacttactggtggagccatgctatttctaatttcgggaaagggaattgggaaaacaagcattggtttaatatgtgttatagtgagctctgggatgttatggatggctgatgtcccgctacaatggatagcgagtgcgattgtactagaattctttatgatggtactactcattcctgagccagaaaagcagagaactccacaagacaaccagctagcttatgttgtcataggaatactgacccttgcagcaatagtggccgccaacgagatgggcctactagaaactacaaaacgtgacctaggcatgtccaaagaaccaggcgtagttagccccacttcatatcttgatgtggacttacatccggcatcagcttggaccctttatgcagtagcgactaccgtcataacacctatgctgcgacatacgatagaaaatagtacagcaaatgtctctctagcggccatcgcaaaccaggcagtagtactaatgggactagataaagggtggcccatatccaaaatggatttaggtgtacccttattggcactcggatgttattctcaggttaacccattaactttaacagccgcagtactacttttagtaactcattatgcaataattggacccgggttacaagctaaagcaaccagagaagcccaaaaacgtaccgcagccggaataatgaaaaatccaaccgtcgatggaattatgacaatcgacttagatcccgtaatatacgacagtaagtttgaaaaacaattagggcaggttatgctacttgtattatgcgctgttcaattgctcttaatgagaacctcttgggctctatgcgaggcattaacattggcaacaggcccaatcacgacactttgggagggctctccagggaaattctggaatactacaatagcagtttccatggcaaacattttcaggggaagttatttagcaggggctggcttagctttttcgataatgaagtcggtaggtacaggaaggaggggaaccggaagccagggagaaacacttggggaaaaatggaagaaaaaattgaatcaactttctcgtaaagagtttgacctatataaaaaatcaggaatcacagaggttgatagaaccgaagctaaagaaggcttaaaaagaggggagacaacgcatcacgcggtaagtagaggaagtgcaaaactacaatggtttgtagaacgtaacatggtaataccagaaggacgtgtaatagacctaggatgcggccgaggtggctggtcttattattgcgccggacttaaaaaggtgaccgaagtaagaggatacactaaaggaggacctggacatgaagaacctgtacctatgagtacgtacggttggaacattgttaaactgatgtcagggaaagacgttttttatttgcctccagaaaagtgcgatacattgctatgcgacataggtgaaagctctccatcacccacagtcgaggagtcgaggacaataagggtactcaaaatggttgaaccctggttaaagaataatcaattttgtataaaggttttaaatccctacatgcccacagtgatagagcatctggagagattacagaggaaatatggtggaatgctagtacgtaatccgttaagtaggaattccacacatgaaatgtactggatctcgaatggtacggggaatatagtaagttcggtcaacatggtaagtcgtttactgcttaatcgattcacaatgacgcacagacgcccgactatcgaaaaagatgtagacttgggggctggtacacgccatgtaaatgcagaacctgaaacccctaacatggatgtcataggggaaaggattaaaaggattaaggaggagcatagcagtacgtggcattatgatgatgaaaacccatataagacatgggcgtatcatggtagttatgaagtaaaagctactggaagtgcttcaagcatgattaacggagtcgtcaaattactaacgaaaccgtgggatgtagtgccgatggtaactcaaatggcaatgacagacaccacacccttcggccaacaaagagtttttaaagaaaaagtagatactagaacaccgagaccaatgcctggaacacgaaaagtaatggaaattacggcagaatggttatggagaactttaggacgtaataagaagccaaggctctgcactcgtgaagaattcactaaaaaggtcaggacaaatgcagcaatgggagcggtatttactgaggaaaaccaatgggattctgcgagagcggccgtagaggatgaagaattttggaaactagtggacagggaaagagaactacataaacttggcaagtgcggtagttgcgtatacaacatgatgggaaaaagagaaaaaaaattaggtgaattcggaaaagccaaaggcagccgagccatatggtacatgtggctaggggctaggtacttagaatttgaggcactaggcttcttaaatgaagatcattggttttctagagaaaattcctattcaggggtcgaaggggaaggtttacacaaactcgggtatatactcagagatatttcgaagataccgggtggggcaatgtatgccgatgataccgctggttgggatacgaggatcacagaagacgacttacataatgaagaaaagataactcagcaaatggatccagagcatcgccagctcgcaaatgctatttttaaattgacctatcaaaacaaagttgtaaaagtacaaagacctacgcccaaaggcactgtaatggatattataagtcgtaaagatcaaagggggtcaggccaggtgggcacatacggtttgaatacctttaccaacatggaagctcaactcgtacgtcaaatggaaggcgagggagtactaagtaaagcagatcttgagaacccgcatctgctcgaaaaaaagataacacagtggctcgaaacaaaaggggtagaacgcttaaagagaatggcaatttcaggagatgactgtgtagttaaaccgatagatgaccggtttgcaaatgcacttctggcgctcaatgatatgggaaaagtaagaaaagatataccccagtggcagccctctaaaggatggcatgattggcaacaagtacctttctgcagtcatcactttcacgaactaattatgaaagacggaaggaaactggtggttccatgtcggccccaagacgaattgatagggcgcgcaagaatttcacaaggcgcaggctggtcacttaaagaaaccgcgtgcctcgggaaagcatatgcacaaatgtggtcattgatgtatttccataggagggatttacgtctggcttcaaacgcaatatgctccgctgtgccggtacattggatcccgataagtagaacaacctggagcattcatgcgcatcaccagtggatgacgacagaggacatgttaacagtgtggaatcgagtatggatcgaagataacccatggatggaagacaagacacccgtaactacatgggaagatgtaccgtatttagggaaacgcgaggaccaatggtgcggaagtctcataggcctaacgtcaagagcaacgtgggcccaaaatatcctgacagctatacaacaagtaagatcattaattggtgacgaagaattcttagactatatgccaagtatgaagaggtttagaaaagaagaagaatctgaaggggctatctggtaa

SEQ ID NO: 23474 - RNA, 9873 nt, synthetic construct
  misc_feature 1..9873: note = derived and/or modified CDS sequence (opt6) from DENV-3__EU660407__SS-prME
  source 1..9873: mol_type = other RNA
acaagtctttgcttgatgatgatgttaccagcaacacttgcatttcatttaaccagtcgagacggagaaccgagaatgatcgtagggaaaaatgaaagaggcaaatcgctattgttcaaaaccgcttcgggtatcaatatgtgtacgcttattgcaatggatctcggggaaatgtgcgatgatacagtgacatacaaatgtccactcatcgcggaagtggaaccggaagacatcgattgttggtgtaatctaacaagcacttgggtgacgtatggcacttgtaaccaagcaggcgaacatagacgagataaaagaagcgtagcattggcgccacatgtcggtatgggtttggacactcggacgcaaacatggatgagtgcagaaggtgcatggagacaagtcgaaaaagtagaaacatgggcactgagacatcctggatttaccatcctagcactctttcttgcacattatattggaaccagtctaacgcagaaagtggtaatatttatactactcatgttagtcactcctagcatgacgatgagatgtgtaggtgttggcaatagggatttcgtcgaaggactatccggagctacatgggtagatgttgtcctcgaacatgggggatgtgtaacaacaatggccaaaaataaaccaactctagacatagaattgcagaaaaccgaagcaacccaattagcaacactacgaaaattatgtatagaaggtaaaatcacgaatattacaacagattcacgttgtccaactcaaggagaagcaatactgcctgaagaacaagaccaaaactatgtctgtaaacatacatacgttgatagagggtggggaaatggctgcggactctttggcaaagggtcactggtaacgtgtgcaaaatttcaatgtctagaaccaattgaagggaaagttgtccagtacgaaaacttaaaatacactgtgatcataaccgttcacacaggagatcaacatcaagttggcaatgatactcaaggagtaacggtagaaattactcctcaagcaagtactgtcgaagcagtccttcctgaatatgggactctcggactagaatgtagtccaagaactgggttggactttaatgaaatgattttgcttaccatgaaaaacaaggcttggatggtacatcgacaatggttctttgatttacctttaccgtggacatcaggggctacgaccgaaacaccaacttggaaccgaaaagagcttctagtaacctttaaaaatgcacatgccaagaaacaagaagttgtagttcttgggagccaggaaggcgcaatgcatacagcacttacaggggctacagaaattcaaaatagtggcgggacgagtatattcgcaggtcacctaaaatgtcgattaaaaatggacaaactggaactaaaagggatgtcttatgcaatgtgtctgaatacattcgtacttaagaaagaggtgtccgaaacacagcatggaacaatattgataaaagtagaatacaaaggggaggacgcaccatgtaaaataccttttagcaccgaagacggacagggaaaagctcataatggtagactgataactgcaaatccggtagtaaccaagaaagaagaaccagtgaatatcgaagccgagccaccttttggagagtcgaacatagtgataggtataggggacaaagcattgaaaattaactggtataagaaaggatctagcattggaaaaatgtttgaggcaacagcccgcggtgctagaaggatggctatactcggagatacggcatgggactttgggtccgtaggcggggttttaaattcgctaggcaaaatggttcaccagatatttggatccgcatacacggcattgttcagtggagttagttggattatgaaaataggaataggagtcttgctaacgtggataggtttgaatagcaaaaatacatctatgagtttctcctgtatcgttattggtattatcactttatatctcggagcagtagtacaagctgatatgggatgtgtcataaattggaaggggaaagagttaaaatgtgggagtggtatatttgttaccaatgaggtccacacttggactgaacaatataaatttcaagctgatagtccaaaaagactagctacggcgatagcaggagcatgggaaaatggcgtttgcggcataagatctacaacacggatggaaaatctattatggaaacaaatagctaatgaacttaactacattttatgggagaataatataaaattaacggttgtagttggggatattataggggtgttagaacaaggaaagcgaacactcacaccacagccaatggaattaaaatacagctggaaaacttggggtaaagcaaaaatagttacggcagagacccaaaactcctcattcataatcgatggaccgaatacaccagaatgtccttcggcgagtagggcatggaatgtctgggaggtagaagattacggttttggtgtatttacgacaaacatatggctgaaactacgagaagtatacactcagagttgtgatcatcgattaatgtcagcagctattaaagatgaaagggcagtgcatgctgatatgggttattggatagagtctcagaaaaatgggtcttggaaacttgaaaaagcatcgtttattgaggtaaagacgtgcacatggcctaaaagccatacgctctggtctaatggcgtgttagagaacgatatgataattcctaagagcttggcaggaccaatatcgcaacataatcatagaccaggatatcacacgcaaacagcaggaccatggcatctagggaaattagaactggactttaattattgcgagggaactacggtggtcatcactgagaattgtgggacgcggggtccatccttacgaactacgacagtgtcaggaaaattaatacatgaatggtgctgtagatcctgtacattacctcctttaagatatatgggagaagatggttgttggtacgggatggaaataaggcctataaatgaaaaggaggaaaatatggttaaaagtctagtatcagctggcagcggaaaagtggataactttactatgggagttttgtgccttgcaatactattcgaagaagttatgagaggtaagttcggcaagaaacatatgatagccggtgtgctatttactttcgtacttcttttgtcgggacagattacttggagagatatggcacatactttaattatgataggaagtaatgcttccgaccggatgggtatgggggttacttatctagcactaatagcaacttttaaaattcaaccattcctagccttaggattctttttaagaaagttaacgtccagagaaaatcttctgttaggagtgggtcttgctatggctactaccttgcaactaccagaagatatagaacaaatggcaaacgggatcgcactaggattgatgaccttgaaactaatcacccaatttgaaacatatcaactttggaccgcattagtatctctaacttgtagcaatactatatttacgcttactgttgcgtggcgcacggctactctcatcttagcgggggtgagcttgttacccttatgtcagagctcgtcaatgcgaaaaaccgactggttgccgatgacagttgccgctatgggcgttcctccattacctttattcatattttcactgaaagatacgcctaaacgtcgtagttggccgttgaatgaaggggtaatggctgtagggctagtgagtatcttggctagtagccttctgagaaacgatgtgcccatggctggccctctagttgctggtggactactaatagcgtgctatgtgatcaccggaacctcagccgacctcactgttgaaaaagccgcggacgtaacgtgggaggaggaagcggagcagactggagtatcacacaatttaatgataacagttgacgatgatggaactatgcgtataaaagatgacgaaaccgagaacatcttaacagtactccttaaaactgctttgttaattgttagcggtatatttccatactcgataccagcaacattattagtttggcacacctggcagaagcaaacacagagaagcggagttttgtgggacgtcccatcaccgccagaaactcaaaaagcagaactagaagagggagtctaccgaattaaacaacaagggatatttggtaagacacaggtaggagtaggtgtgcagaaagaaggcgttttccacactatgtggcacgtcactcggggtgcagtcctcacacacaatggtaaacgacttgaacccaactgggcaagtgttaagaaagacttgattagctacggtggtggatggcgactcagcgcccaatggcagaaaggagaagaagtccaagttatagcagttgagcctggtaagaatcccaaaaactttcagacaatgccaggaatttttcaaacaactaccggtgaaataggagcgattgctcttgattttaagcccggtacatccgggagccctataattaatcgagaaggaaaagtcgtcgggctatatggaaatggggtagtgactaagaacgggggatatgtatcaggaattgcacagactaacgccgaacctgacggacctactccagaattagaagaagagatgtttaagaaacgtaacttaactataatggatctacacccaggatcagggaaaaccagaaaatatctaccagcgatagtacgggaagccattaaaagacgtttaagaaccctaatcttagcgcccacacgagtagttgcagcagaaatggaggaagcattaaaaggtcttccgattcggtaccagacgactgcgacaaaatccgagcatactgggagggagattgtcgacctaatgtgccacgcaacattcacaatgcgactgttatcacctgtaagagttccaaactacaatctaataatcatggatgaagcacactttacagaccctgctagcatagcagcacgcggatatataagtacaagagtagggatgggggaggctgctgcgatatttatgaccgcgactccgccgggaacggcagaggcgtttccccaaagtaatgcgccaatacaagatgaggagcgagatataccagaacgatcctggaactcaggtaacgaatggataacagatttcgtgggaaaaacagtctggttcgtaccatcgatcaaagcaggaaatgatatagcaaactgcttaaggaaaaatggcaagaaagttatacaactatcgcgaaaaacgtttgatactgaataccagaaaacaaaacttaatgactgggatttcgttgtaactacggatatcagcgaaatgggcgcgaactttaaagcggatcgagttattgaccccagacgatgcttgaaaccagtcattttaaccgatggacctgaaagggtaatacttgcaggcccaatgccagttacagcagctagcgcagctcaaagacggggacgagtgggaagaaatccccagaaagaaaatgatcaatatatatttacaggtcaacccttaaataatgacgaagatcatgcccattggacagaagcaaaaatgttgcttgacaacattaatacccccgaaggaattattccagcattattcgaaccagagagagaaaagtctgctgctatagatggagaatatcgactgaaaggcgaatctcgaaaaacttttgtagaactaatgagacgaggcgatttacctgtttggcttgcacacaaagtggctagtgaaggtatcaaatatactgataggaaatggtgctttgatggagaaagaaacaaccagatcctagaagagaacatggatgtagaaatctggacaaaggagggcgaaaggaagaaactgagaccaaggtggcttgacgctcgtacatactcagatccactcgcattgaaagaatttaaagactttgcagctggaagaaaatcaatagcattagatcttgtaactgaaattggtcgagtgccgagtcatctagcatatcgtacacgaaacgctttagacaatctagttatgttacatacgagcgaacacggcgggagggcctacagacacgctgttgaggaactcccagaaaccatggaaacccttctgttattaggattaatgatactacttaccggaggtgctatgctctttttaatatcgggcaaaggtataggaaaaacctctataggtcttatttgtgttattgtttcaagcggaatgctctggatggctgacgtgccactccaatggatagcctcagcaattgttttagagttcttcatgatggtactattaattccagaacccgaaaagcagcgcactccgcaagataatcagttagcctacgtggttataggaattttaacacttgccgcaatagtcgccgcgaacgaaatgggtcttttggagacgactaaaagagatctaggaatgtcaaaagaacccggagttgtctcaccaacatcatacttagatgtagacctgcaccctgcatcagcttggaccttgtatgccgtagccacaacagtcataactccaatgctaagacacacaattgaaaactcgacagcaaatgtttcacttgcagctatagcaaatcaagcggtcgtgttaatgggactcgacaaaggatggccaatatccaaaatggatctaggtgtacctctactggcattaggttgctacagccaggtgaatcctttaacactgacagctgcggttttactactcgttacccattatgctatcataggacccggtctacaagctaaagctacacgagaggcccaaaagcgaactgcagcaggaattatgaaaaatccaactgtagatggcattatgacaatagatctggacccagtcatttatgatagtaaattcgaaaaacaattgggacaagttatgttactcgttttgtgtgcggtccaactactactaatgagaacatcctgggcactatgtgaggcactaacattggctacgggtcctataacaactctttgggagggctctccgggaaagttctggaatacaactatcgcagtttcaatggcaaatatcttcaggggatcatatttagcaggcgcaggattagctttctcgataatgaaatcagttggtacgggtcgaagaggaacgggatcccagggagagaccctaggagaaaaatggaagaagaaacttaaccaattgtccagaaaagaatttgacctgtacaaaaagtccggtataacagaagtcgatagaaccgaggcgaaagaaggactaaagcgtggagaaacaacccaccacgcagtatccaggggctcagctaagttgcaatggtttgtggaacgtaatatggtgattccagagggtagagtaattgatcttggctgcggacggggcggttggagttattactgcgccggtcttaaaagagtcactgaggtaagaggatatacaaaagggggaccaggtcatgaagaaccggtacccatgagtacatatggttggaatattgtaaaattgatgtcaggtaaagacgtattctatctacctccagagaaatgtgatacattactgtgcgatattggggaatcctcgccgagcccaactgtagaagagagcaggacaattagagtgttaaagatggtagaaccttggttaaagaacaaccaattttgtattaaggtattgaatccatacatgccaacagttatagaacacctagaacgactccagcgaaaatatggaggtatgttggtaagaaatccattaagtagaaattcaacacacgagatgtattggataagtaatggtacaggaaatattgtatctagtgttaacatggtgagtagactactgctaaacagatttacaatgacacaccggaggcctaccatagagaaagatgttgacttgggagccgggactcgtcacgtaaatgccgaaccagagacgcccaacatggatgtaatcggggaaaggataaagaggataaaagaagaacattcttcgacgtggcactatgatgatgaaaacccatataagacatgggcgtaccatggatcttacgaagtcaaagctactggatcagcatcctctatgataaacggtgtcgtcaaattactaactaagccatgggatgtggtcccaatggtgacacaaatggctatgacagacacaactcctttcggacaacaacgcgtgttcaaggaaaaagtagatactagaacaccgcgtccaatgcctggcaccagaaaagtaatggaaattaccgccgaatggttatggcgaaccctgggacgaaacaaaaagcccagactctgtacgagggaagagttcaccaagaaagttcgaacaaacgcagctatgggggcggtgtttacagaagaaaaccagtgggattcggcaagggccgcagtcgaagatgaggagttctggaagctcgtagatagggaacgagaactccataaactcggaaaatgcggtagctgcgtatacaatatgatgggaaaacgagagaagaaacttggggaatttggaaaagcgaaagggagcagagcaatatggtatatgtggctcggagccagatacctagagttcgaagccttgggatttctgaacgaagatcactggtttagcagagagaactcctatagtggagtggaaggagaagggctacacaaattgggatatatcttgcgagacatttcaaagataccaggaggagccatgtacgctgacgatactgcaggatgggatactaggataactgaagatgatctacataatgaagagaaaatcacccaacaaatggaccctgaacaccgacaattagcaaatgctatcttcaaattgacataccaaaacaaagttgtgaaagtacaacgtcccacacctaaaggcacagtaatggatattatatcaaggaaagatcaacgaggtagtggacaagtcggcacctacggtcttaacacttttacaaatatggaagcacagctagttaggcaaatggaaggagaaggtgttttaagtaaagcagatctagaaaaccctcacctcttggagaagaaaataacacagtggctagaaactaagggggtggagcgattaaaaagaatggcaatatcaggcgatgattgcgtggtaaaacccatcgacgatcgttttgcaaatgcgcttttagcccttaatgatatggggaaggttagaaaagatatcccacaatggcagccatcaaaaggatggcacgactggcaacaggttccgttctgcagccatcattttcacgaattaataatgaaagacggccgtaagctcgtcgtaccgtgtcggcctcaagacgaattaataggacgcgctcgtatcagccaaggagcaggttggtcacttaaagaaacagcatgcttaggaaaagcctacgcacaaatgtggagtctaatgtacttccataggagagatctaagactagcttctaatgctatctgtagtgcggtacctgtgcattggatccctacaagtcgcactacatggagcatacatgcccaccatcaatggatgacaacggaggacatgttgacagtatggaacagagtctggatagaggataacccttggatggaagataaaactcccgttacaacgtgggaggatgtaccgtatttaggtaaaagggaagatcagtggtgtggatctttaataggattaacaagtcgagcaacatgggcccaaaacattttgacggctatacaacaagtgcgatctcttatcggagatgaggaatttcttgactacatgcccagtatgaaaagattccgcaaagaggaggaatctgagggagcaatatggtga

SEQ ID NO: 23475 - RNA, 9873 nt, synthetic construct
  misc_feature 1..9873: note = derived and/or modified CDS sequence (opt6) from DENV-3__EU660409__SS-prME
  source 1..9873: mol_type = other RNA
acgagtctctgtttaatgatgatgttaccagcaacccttgcattccatctaacttcaagagatggggaaccaaggatgattgttggtaaaaacgaacgagggaaatcattactgtttaaaactgcatcaggaattaatatgtgcactttaatagcaatggacctaggggaaatgtgcgacgataccgttacgtacaaatgtccattaattgctgaagtcgaacctgaagatatcgattgctggtgcaacttgacgtcgacttgggtaacctacggaacctgcaatcaagccggtgaacaccgtagggacaaacgatctgtagcattggcaccacatgtagggatgggtctcgacacgcgaacgcaaacgtggatgtccgcagaaggggcgtggagacaggtagaaaaagttgaaacctgggcattgcgtcatccaggatttacgatcctcgctttattcctagcgcattatattggcacaagtctaacgcaaaaagtagtaatatttatactcttgatgttggtgacacccagtatgactatgcgctgcgttggagtgggcaatcgggattttgtagaagggttatcgggggcaacatgggttgatgtagtattagaacatggcggatgtgttacaacaatggctaaaaacaaaccgacgttggacatcgaactacagaaaactgaagcaacacgactagcaacattacggaaactgtgcattgaaggaaaaataacaaatataacaactgatagccggtgcccaacacagggagaagcaatattacccgaggaacaggaccagaattacgtgtgtaaacatacttatgtggatagaggatggggcaatgggtgtgggcttttcggaaaagggtctctagtaacttgcgcaaaatttcagtgtctagaattaattgaaggtaaagttgttcaatatgaaaaccttaaatatacggtaataataacagtacatactggtgatcagcatcaggttggaaacgatacacagggcgcaaccgtagaaattacaccacaggcttcaacagtcgaagcggtgctaccggaatacggaacactaggattagaatgttcaccaagaacgggcttagacttcaacgaaatgatacttttaacaatgaaaaacaaggcttggatggtacatcgtcaatggttctttgatctacctctcccctggaccagcggagcgacaacggagacacccacctggaatagaaaagagctcttggtcacttttaaaaacgcacatgctaagaaacaagaagtagtagttttaggatcacaggaaggagcaatgcacacggcactaactggtgctactgaaatccaaaacagtgggggaacaagtatatttgcaggacacttaaaatgtagattgaaaatggataaattagaattgaaaggaatgagctatgcaatgtgcttaaatacattcgttttaaagaaagaagtatcagaaactcaacacggaactatactgatcaaagtggagtataaaggagaagatgcaccttgtaaaatcccatttagcacagaggatggacaaggaaaagcgcacaatggacgactaataacggcgaaccctgtagtaacgaagaaagaggaaccagttaatatagaagctgagccgccattcggtgaatcaaatatcgtaataggaatcggagataaagcactcaaaattaattggtataagaaaggttcatcgatagggaaaatgtttgaagcaacagcacggggcgcaagaagaatggcgattttgggggacactgcatgggattttggctctgtaggaggagtattaaactccttaggaaaaatggtacaccaaatttttggttccgcgtatacagcactgtttagcggcgttagttggattatgaaaatagggataggcgtacttctcacttggataggattaaattctaaaaatacatctatgagctttagttgtatagctatagggataataacactatatttaggtgcagtcgtacaagctgatatgggttgtgttataaactggaaaggtaaagaattaaaatgtggctctggtatattcgtcacaaatgaagtacatacatggacggaacagtataaatttcaagcggattcgccaaaacgactagcgacagcaattgctggggcatgggaaaatggagtctgtggtataaggtccactacgagaatggaaaacttactgtggaaacaaattgctaacgaattaaactatatattatgggagaataacataaaattaaccgtcgtggttggagacattataggtgttctagagcaagggaaacgaaccctcactccacagccgatggaattaaaatattcgtggaaaacctggggaaaagctaaaatcgtaactgcagaaactcaaaattccagtttcatcatagatggccctaataccccggaatgccctagcgccagccgcgcttggaacgtgtgggaagttgaagattacggatttggtgtatttacaactaacatctggttaaaactccgcgaggtttatacgcaatcctgcgatcatagactgatgagcgctgcaataaaagatgagagagcagtacacgctgacatgggctactggatagagtctcagaaaaatggcagttggaaactagaaaaggcttcattcatcgaagtgaaaacctgcacttggcctaaaagtcacacactgtggtcaaatggagttttagaaagtgatatgataatcccaaaatccttggcaggacccatttcacaacataaccatcggcctggctaccatacgcaaactgcagggccttggcatctagggaaactcgagttagactttaattattgtgaggggacgaccgtggttattacagaaaattgcgggacccgtggtcctagcctgcgaactaccacagtctcaggaaagctaatacatgaatggtgctgcagatcatgtactttacccccattgagatatatgggagaggacggttgttggtatggtatggagatacgtcctattaacgaaaaagaagaaaatatggttaagtcccttgtcagtgctggaagtggtaaagtagataatttcacgatgggggccttatgcctggcgatactgtttgaggaagtgatgaggggtaagtttggcaagaaacatatgattgcaggagtactgtttacatttgtactgcttctatcaggacaaatcacgtggcgtgatatggcacatacgttgattatgataggatccaacgcttctgacaggatgggtatgggtgtgacatatttggcccttattgccacgtttaaaatacaaccctttctagctctaggattctttctccgcaagttaacaagccgggaaaatcttttgctaggtgtgggactagccatggcgacaaccctgcaattaccggaggacattgaacaaatggcaaatggtattgcactaggcttaatgacacttaaattaatcactcaattcgaaacatatcagttgtggactgccctagtatcgttgacctgtagcaataccatcttcacgttaacagtagcttggagaacggctaccctcattttggcaggggtgtcgttgcttccattatgccaatcaagtagtatgcggaagacagattggctaccgatggcggtggcagcaatgggagtacccccactaccgcttttcatattttcattgaaagatactccaaaaaggcgaagttggccactaaatgaaggagtaatggctgtcggactcgttagtatacttgcaagttcgttactgagaaacgatgtaccaatggcaggtccgttagtcgccggtggtttactaattgcttgttatgtaattacaggaaccagcgcagacctcactgttgaaaaggttgctgatgtgacatgggaagaagaggcagaacaaactggggttagtcacaacctaatgataacagttgatgacgatgggacaatgcggataaaagacgatgagactgaaaacatattaactgtactgttaaaaacagccttattaattgttagcggcatattcccttatagtataccagcgacacttctagtatggcacacctggcagaaacaaacacaaaggtcaggagtactttgggatgtaccaagtcctcccgaaacacagaaggcagagctcgaagaaggcgtgtatcgtataaaacagcagggtatattcggaaagacacaggtgggagtgggcgtacaaaaagaaggcgtatttcatacaatgtggcatgttacacgcggtgccgtactgacccataacggtaagagactcgaaccaaattgggcatcagtcaagaaagatctaatatcatatggagggggttggagactttctgctcagtggcagaaaggtgaggaggtccaggttatagcagtagaaccaggaaagaaccctaaaaactttcaaacaatgcctggaattttccaaaccactacaggtgaaataggagcgatcgctttagactttaagcctgggacaagtgggagtccaataataaacagagaaggtaaagttgtaggcttatatgggaacggtgttgtgacaaagaacggaggttatgtaagtggaatagcacaaacaaatgctgaaccagatggtccgacgccggaattagaggaggaaatgtttaagaaaagaaaccttacaatcatggatctgcaccccggatcgggtaagacccgtaaatatttacctgcaatagtaagagaagctattaagcgtcgcctccggacattgatacttgcacccacacgagttgtagcagcagaaatggaggaggctttgaagggattgccaatccgctaccaaactacagcaactaaatcggaacacacaggaagggaaattgtagatttgatgtgccatgctacgttcacaatgagactgctctcacctgttcgtgttccaaattataacttaatcattatggacgaagcacacttcactgatcccgcgtcgatcgcagcaagaggctacatatctactcgtgtagggatgggagaagcggcagcgatattcatgacagcgacaccacctggcaccgcagaagccttcccacaatctaatgctccgattcaagatgaagaacgagacatcccggagagaagttggaactctggtaacgaatggataaccgatttcgtaggaaagacagtatggttcgttccatcgattaaagctggaaacgacatagctaactgcctcaggaaaaatggtaaaaaggttatccagctatctcgaaagacttttgatacagaatatcagaaaaccagactaaatgattgggacttcgttgtaacaaccgatatttcggaaatgggagctaacttcaaagcagatagagtcattgatcccaggagatgcttgaaaccagtaattcttacagatggccccgagagagtcattcttgccgggcccatgccagtgactgctgcgtcggcggcgcaacgtcgaggacgagtcgggcgaaatcctcagaaggaaaacgaccaatacatttttaccggccaaccacttaacaacgatgaggatcacgcacattggaccgaagctaaaatgttacttgataacataaacactccggaaggcataatacccgcactattcgaacctgaaagagaaaaatctgcggctattgatggggaataccgccttaaaggggaaagcagaaaaacgttcgtagaattaatgcgtcgaggggacctgcccgtatggctagctcataaggtcgcttcagaaggaattaaatacacagacagaaaatggtgttttgatggagaacgaaataaccaaatcctagaagagaatatggacgtagaaatctggactaaagaaggggaaaggaagaaactaaggccaaggtggttagatgcgaggacttacagtgacccgcttgcacttaaagaatttaaagactttgcagcaggacgtaaatcaatagcgctagatctggttactgaaataggcagggtacctagtcacttagcataccggactcgcaacgcactagacaatttagtaatgcttcatacaagtgagcatggtgggagagcctataggcatgcagttgaagaactgcctgaaactatggaaactctcttattattaggcttaatgatattactaactggaggggctatgctattccttattagtggaaaaggaataggcaagacgagtataggacttatatgtgtgacagtgagtagtggaatgttgtggatggcagacgttccactgcaatggatcgcctctgcaattgtcttggaatttttcatgatggtgttgctgataccggaacctgagaaacaaagaacaccacaagataaccaactagcctatgtggtaatcggtatactgacgctagcagcaatagttgcagcaaacgaaatgggtttacttgaaacaacaaagagagatctaggtatgagcaaggaaccaggtgttgtttcgcccaccagctatctagatgtagaccttcaccccgcatcggcgtggacactatacgcagttgctaccacggtaataactcctatgcttcgacatacgattgaaaattccacggcaaatgtttcactggcggcaatagcgaaccaagcagtggtattaatgggactggataaaggatggccaatatcaaaaatggacttaggagttcccttactcgctttaggatgctactcccaagtaaatccgttaaccctgacagctgcagtactacttctcgtaacccactacgcaataataggtccaggactacaggcaaaagccactcgtgaggctcagaaaagaacagcagcgggcataatgaagaatccaaccgtggatgggattatgactatcgaccttgatccagtaatctacgactcaaaatttgaaaaacaattaggtcaagtgatgttattagtcttatgtgctgtccaactactactaatgaggaccagttgggcgttatgtgaagctctaactttagcgactggccctataacaacactttgggagggcagccccgggaaattttggaatactacaatagcagttagtatggctaatatttttcgaggtagttatctagccggagcaggtttagcgttttcaataatgaaatcagtaggaactggtcgaaggggaactggttcccaaggcgaaacactaggcgaaaaatggaagaagaaattaaatcaactaagccgtaaagaatttgatttatataaaaagtctggtattactgaagtagaccgaactgaagcaaaagaagggctaaagcgaggcgaaacgacccaccatgctgttagtagaggatcagctaagttacagtggtttgttgaaagaaatatggtcatacccgaaggtcgtgttatagatctcggatgtggacgaggcggctggagttactactgtgccggtctaaagaaagtaaccgaagtacgaggctacaccaagggtggacctggccacgaagaaccagtaccaatgtccacatacggatggaatatcgtaaaattgatgtctggaaaagatgtgttctacttacccccggaaaagtgtgatacgttgctctgtgatatcggtgaatcgagtcctagcccaacggtagaagaatcgaggacaataagagttcttaaaatggttgaaccttggcttaaaaataatcaattctgtataaaagtactgaatccttacatgccgaccgttatagaacatttagagagattacaaagaaagtatggaggaatgctagttcgtaaccccttatctagaaactccacacatgagatgtactggataagcaatggcaccgggaacatagtctcaagcgtaaatatggtctccagattattgctaaatagattcactatgacccacagacgaccgactatcgagaaagacgtagatctgggtgccgggacgagacacgtcaatgccgaaccggaaacgccaaatatggatgtaataggagaaagaatcaaaagaattaaggaagaacacagcagtacatggcattacgatgatgaaaatccatacaaaacctgggcgtatcacggttcgtatgaggtcaaagccactggttcggcctcttcaatgataaatggcgttgttaaattattgaccaaaccatgggatgtagttccaatggttacgcagatggctatgacagacactactccctttggtcagcaaagagtatttaaagaaaaggttgacacaagaacccctagaccaatgcccggaactagaaaagttatggagataactgcagaatggctctggaggactttagggaggaacaagaaacctcgtctctgtactcgggaggaatttacgaagaaagtacgaacaaatgcggcaatgggagcagtgttcactgaggaaaaccaatgggattctgccagggcagcagtcgaagacgaagagttttggaagttggtagacagagaaagagagttacacaaactaggtaagtgtggatcttgtgtatataatatgatggggaaacgagaaaagaaactcggagagttcgggaaagcaaaggggagtagagctatatggtacatgtggctaggcgcacgctatttggaatttgaggcactaggctttcttaatgaagatcattggttttcgcgggagaatagttattccggagtggaaggagaaggactacataagttaggatacattctcagagatatatcaaaaatcccgggtggagcgatgtacgcagatgatacagctggatgggataccagaatcaccgaagacgatttgcataacgaagagaaaatcactcagcaaatggatccagaacataggcaattggcaaacgctatttttaaacttacatatcaaaataaagtagtcaaagtacaaagacccaccccgaagggaactgtgatggacattatcagcagaaaagatcagaggggttcgggtcaggtaggcacttacggactgaatacatttacgaatatggaagcccaactcgtaagacagatggaaggagaaggtgtattatcaaaagctgacttagagaatccccatctattggagaagaaaatcacacaatggctagagactaaaggcgtagaacgactaaagcgaatggccatttcgggcgatgattgtgtggttaaacctatagacgatcgcttcgccaatgcactcttagccctaaatgacatggggaaggtaaggaaagatattccgcaatggcagccaagtaagggttggcacgattggcaacaagtgccgttctgcagtcatcattttcacgagctaattatgaaagacggtagaaagttagtcgttccctgccgtcctcaagatgaattaataggacgggcacgaatatcacagggagcaggttggtccctaaaggaaaccgcctgtctggggaaggcatatgcgcagatgtggagtctaatgtatttccataggagagatttgagattagcttcaaatgcaatatgttcggcggttccagttcactggattccgacgagtagaacaacgtggagcatccacgcacatcatcaatggatgacgactgaagatatgctaacggtatggaaccgtgtttggatcgaagataatccatggatggaagataaaaccccggttacgacttgggaagatgtaccatacctgggaaaacgagaagaccaatggtgtggatcactaataggtctgacttcaagggcaacatgggcacaaaacattttgactgcaattcaacaagttagaagtctgataggagacgaggagttccttgactatatgccgtcgatgaagagatttaggaaagaagaggaatcggaaggtgctatatggtga

SEQ ID NO: 23476 - RNA, 9873 nt, synthetic construct
  misc_feature 1..9873: note = derived and/or modified CDS sequence (opt6) from DENV-3__EU660410__SS-prME
  source 1..9873: mol_type = other RNA
acaagtttatgccttatgatgatgttacccgcaactcttgcgttccatctaacaagtcgagacggggaaccaagaatgatagtcggtaaaaatgaaaggggaaaatcactgttatttaaaaccgcgagcggaatcaatatgtgcactttaatagctatggatctaggggaaatgtgtgatgatacagtaacatataaatgtcccttaattgcagaagtggaacctgaagacatagattgctggtgtaatctaaccagtacttgggttacctatggaacatgtaaccaagctggtgaacacagacgagataaaagaagcgtcgcccttgctccgcacgttggaatgggtttagatacaagaacccaaacctggatgtccgctgaaggagcgtggcgacaagttgaaaaagtagaaacatgggcattacgacacccaggtttcacgatccttgcgctctttttggcccattacattggaacaagtctaacacaaaaagtagtaatatttatattattaatgttagtaacaccttctatgactatgcgctgtgtcggcgtgggaaacagggatttcgtagagggattgtcaggagctacttgggtcgatgtagttctggaacacggcggatgcgttaccacaatggcgcggaacaaacccactttagatattgaattgcagaaaaccgaagcaacccaactggcaaccctgagaaaactatgcatcgaaggaaaaattacgaacataaccactgattcacgttgtcctactcaaggtgaagctatactacctgaggagcaagaccaaaattatgtatgcaaacatacctacgttgatagagggtggggtaatggatgcggactatttggtaaaggcagtctcgttacatgcgcgaaattccaatgcttagaacctatagaaggaaaagtcgtccaatatgaaaatttaaaatataccgtgatcataacagtgcatacgggagaccagcatcaagtaggaaacgatacccaaggagtcacagtagagattaccccacaagcaagtaccgtagaagcagtacttccagagtacggtacattgggcttagaatgcagtccaagaaccggacttgacttcaacgaaatgatactcttaacgatgaaaaacaaagcatggatggtacacagacaatggttctttgaccttccccttccttggacgagtggtgcaactactgaaacccccacatggaatagaaaagagctattggtgacattcaaaaatgcccatgcgaagaaacaagaagttgttgttttaggctcacaagaaggggcgatgcacaccgcattaacaggggcaacggagatccaaaactctggcggaacgtcaatttttgcgggccacctaaaatgtcggctcaaaatggataaactagaattgaaaggtatgtcttatgcaatgtgtttaaatacatttgttttaaagaaagaagtatctgaaactcaacacggtactattcttattaaagtagaatataaaggagaagatgccccttgtaaaatccctttttcaacagaagatggacaaggaaaagctcacaacgggcgtttaataaccgcaaaccctgttgtcactaagaaagaggagccagttaatatcgaagcagaacctccgtttggcgaatccaatattgttataggaataggagataaggccttaaaaattaattggtataagaaaggatcttcaattggtaaaatgtttgaggccaccgcacgtggagcccgcagaatggctattctaggcgacactgcatgggacttcggatcagttggtggagtcttaaattctcttggaaaaatggtccaccaaatatttggaagtgcatatactgctctgtttagcggagttagctggatcatgaagataggcattggggtactactcacgtggatcggcttgaatagcaaaaatacaagtatgtccttttcatgtatagtaataggaataattacactttaccttggagccgttgtacaagctgacatgggatgtgcgattaactggaaaggaaaagaattaaagtgtgggtcgggaatatttgtaactaatgaagttcatacttggactgagcagtacaagttccaggcggattcaccaaaacgtttggctacggccatagccggtgcatgggaaaatggagtttgtggaataagatccactactcgaatggaaaatctactgtggaaacaaatagcgaacgaattaaattatatactttgggaaaacaatattaaactaactgttgttgttggagatataataggagtcttagaacaaggcaaacgcacactaactccacagcccatggagctaaagtactcatggaagacctggggcaaagcaaaaatagtaacggcagaaacacaaaattcatcattcatcatagatggacctaacactcccgaatgtccttcagcgtcaagagcgtggaatgtatgggaagtagaggattatggtttcggggtttttacaactaacatctggctaaaactaagggaagtctatacacaatcttgtgatcatagattaatgtccgccgccataaaagatgaaagggcagtacatgccgacatgggctattggatagaatcacagaaaaatggaagctggaagttagaaaaagcgtcgtttatagaagtaaaaacgtgtacgtggccgaaatctcatacgttgtggtcaaatggagtacttgaatctgatatgattatacccaagagcttagcgggaccaataagtcaacacaatcatagaccagggtatcatactcagaccgctggcccgtggcacttaggtaaactagaacttgattttaattactgtgaagggacgacggtagtgattactgagaattgcggcacccgaggaccatccttacgaacaacaaccgttagtggtaaactgattcatgagtggtgttgtagaagctgcactttgccccctttacgttatatgggagaagatggttgttggtatggcatggaaatcaggccaataaacgagaaggaagaaaacatggtgaaaagcctagtaagtgcaggatcaggtaaggtcgacaatttcacgatgggggtactttgtctagcgatcttatttgaggaagtaatgaggggcaaattcggcaagaaacacatgatagcaggcgtccttttcacattcgtattactattatccggccaaataacatggagagatatggcgcatactttcataatgattggctctaatgcctcagacagaatgggaatgggcgttacatatttagccctaatagctacattcaaaatacaaccatttttggcactaggattctttctccgaaaattaacttcaagagaaaacctactattgggagtagggctcgctatggcaacaacactacaattacccgaagacatagaacagatggccaacggcattgctcttggtcttatgacattaaaactaataacgcaattcgagacatatcagctgtggactgcattggtttcattaacatgttcgaataccatattcacactaacagtagcgtggagaacagcaacccttgttctcgccggtgtttcccttctcccactatgtcaaagttcgagtatgcgtaaaactgactggttaccgatgacagtagcagcaatgggggtaccacctttaccattgtttatattttcacttaaagacaccccaaaaagaagatcgtggcccttgaatgaaggcgttatggctgtgggcctagtcagtatattagcttcgagtcttttacggaacgatgtgccgatggctgggccattagtggccggtggtctcttaattgcttgctatgttataacaggtacatctgcggatctcaccgtggaaaaggcagctgacgttacatgggaagaagaagcagaacaaacgggagtatctcataatttaatgattacagtagatgatgacggcactatgagaatcaaagatgatgagacagaaaatattttaacagttttattgaagactgccctgttgatagtctccggaatatttccatacagtattcctgctactctcttagtgtggcatacttggcaaaaacaaacacagaggagtggagtcctttgggacgtaccatcaccgcctgagacccagaaggcagaactggaagagggcgtatatagaataaaacaacaaggaatattcggcaaaacacaggtaggagtcggagttcaaaaggaaggtgtcttccacacaatgtggcatgttactagaggagcagtattaacgcacaatgggaaaaggttagagccgaactgggcttctgtgaagaaagaccttattagctatgggggtggatggcgattaagcgctcagtggcaaaaaggagaagaagtacaagttattgcagtggaacccggcaaaaaccccaaaaatttccaaaccatgcctggaatctttcaaacaacaacaggagaaatcggggcgattgcactggatttcaaaccaggtacatcaggttcgcccattataaatagggaaggcaaagtcgtaggtttgtatgggaatggcgttgtaactaaaaacggaggctatgtgagcggcatagcgcagactaatgcagaacctgacggcccaacgcccgaattagaagaggagatgttcaagaaacgaaacttgacgattatggacttgcacccgggatcgggcaaaactcgtaaatacttgccagccatagttagggaagctataaaaagaaggttaagaacattaatattagccccaacgagagtagtcgctgcggagatggaagaggcattaaaagggttacctataaggtaccaaacaacagctactaaatctgagcatactggaagagaaattgtggatctcatgtgtcacgctaccttcacaatgagattactatccccagttagagtaccaaactataatttgataattatggacgaagcgcactttaccgatccagcttcaatagccgcaagaggatatatatctacacgcgttggaatgggcgaagcggcagcaatcttcatgacagcgacgcctcctgggacagcagaagcgtttccgcagagtaatgcacccattcaagacgaggagcgtgacatacctgaaagaagctggaacagtggaaatgaatggataactgacttcgtaggaaaaacggtatggttcgttccctcgataaaagcaggtaatgatattgcgaactgtctccgcaaaaatggaaagaaagtcatacaactaagtagaaaaacatttgatactgagtatcagaaaactagattgaacgattgggactttgtagttacaacagacatttcagaaatgggcgcaaactttaaggcagacagggtcattgatccaagacgttgcctcaaaccagtaatcctaacagatggtccagaacgagttatattagccggacccatgccagtaaccgcagcttcagcagctcaacggagaggccgggtaggaagaaacccccaaaaggaaaacgatcagtacatatttacaggtcaacccttaaataacgatgaagaccatgcacattggacggaagcaaaaatgttattagacaacattaacaccccagagggaataataccggctctttttgaaccagagagagagaaaagtgcggccatagatggtgaatatagactaaaaggtgagagtcgaaaaacttttgttgaactgatgagaaggggcgatttacccgtatggctagcacataaagtcgcaagtgagggaataaaatacacagaccgaaaatggtgcttcgatggtgaacggaataatcaaatattagaagaaaacatggatgtagaaatctggactaaagagggtgagcgaaagaaattgagacccagatggttagacgctaggacatattcggatccgctagcgttaaaagagtttaaggatttcgcggcgggcaggaagtcgatcgcgttagacctagtaacagaaatagggagagttccatctcacttggcatatagaacacgaaatgcacttgataacttggtgatgttacacacaagcgagcacgggggaagggcttacaggcatgctgttgaggaattacccgagactatggagactttattattattaggattaatgatattattaacaggaggagcaatgctctttcttattagtggaaaaggtattggtaaaacaagcatagggctaatatgcgtaatagtgtcgtcgggaatgctatggatggctgatgtaccccttcaatggattgcgagcgcaatcgtattagagttcttcatgatggtattattaataccggagccagaaaaacagagaacaccccaagacaatcaacttgcatatgtcgttattggtattcttacactagctgccatcgtcgctgcgaacgaaatggggcttctcgaaacgacgaaaagagaccttggaatgagtaaagaaccgggtgtagtatcaccaacgagctatttagatgttgaccttcaccctgcatcagcatggacattatatgcagtggctacaacagtgataacacctatgctgaggcacactattgaaaatagcaccgccaacgtttcattggccgccatagctaaccaggctgtagtacttatgggactagataaaggatggccaatcagtaagatggatctaggagcacctttactagctctaggatgttactcccaagttaaccctctaacattgacagcagcagtgttattactggtaactcattacgctataataggacctggattacaagcgaaggcaactcgagaggctcaaaaacgtacagcagcaggaataatgaagaatccgacagttgatggaataatgactatagatttggacccagtaatttacgattctaaatttgaaaaacaattaggtcaagtcatgctattggtcttatgtgcggtgcaactcttactaatgagaacatcttgggcattatgcgaagcactaacgctcgctacaggcccaattaccactctttgggaaggttcgcccggcaaattttggaacactactatagccgtgagcatggccaatatcttcagaggtagttacttagccggcgcaggccttgctttttccattatgaaaagtgtaggaacgggtaggagagggacaggatcccagggagaaacactcggcgaaaagtggaagaagaaactaaaccagctctcaagaaaagaatttgatctctacaagaaatcaggaattacagaggttgatcgaactgaagctaaagagggattgaagagaggagagaccacacatcatgcggttagtcgcggttctgccaaactccaatggttcgtcgaaaggaatatggtaatacccgaaggtagggtcatcgacttaggttgcggacgaggtggttggtcatattactgtgcaggactaaagaaagtaactgaagtacggggatatacaaaaggaggaccaggacacgaagaaccagttccaatgtcgacatacggctggaacatagttaaactaatgagcggaaaggatgtattttacttaccacctgaaaagtgtgatacactgttatgtgatattggagaaagttctccatctccgacggttgaagaatcccgaactatacgcgtgctgaagatggtagagccttggctcaaaaataaccagttttgtataaaagtcctaaacccttatatgcctaccgttatagagcatctggaaagactacaacgaaaatacgggggcatgctagtccggaacccattgagccgaaacagtactcacgagatgtattggattagtaacggaaccggaaacattgtaagttccgtaaacatggtctcgcgacttttattaaatagatttaccatgactcatcggcgacccacgatagaaaaggacgtagacctgggagcaggaacccggcacgtgaatgcggaaccagaaactccgaacatggatgtgatcggagaacgaataaaaaggataaaagaagaacacagctcgacatggcattacgatgacgaaaatccatataaaacatgggcctatcacggatcatatgaagtcaaggcaaccgggtcagcgtcaagtatgataaacggagtagtaaaattattaacaaaaccttgggatgtcgttccgatggttacgcaaatggctatgacagatacaacacctttcggccagcaacgtgtctttaaagagaaagttgatacaagaacgccaagacctatgccgggaacaagaaaagtaatggaaattaccgcggagtggttgtggaggactttaggacggaataagaaaccaaggctttgtacacgggaagaatttacgaagaaagtacgaaccaatgctgcaatgggtgccgtatttacagaggaaaatcaatgggacagcgctagagctgctgttgaggatgaagaattttggaaactggtagacagagaaagagagctccataaactgggtaaatgcggatcatgtgtttataatatgatgggaaaacgcgagaagaaactaggagagttcgggaaagcaaaaggctcaagagctatatggtacatgtggctaggagcacgttatctagagtttgaagccttaggctttttgaatgaggatcactggtttagtagagaaaactcgtattcgggcgtcgagggggaaggcctccataagctaggatacattttaagagatataagtaagataccaggcggtgctatgtatgcagatgatacagcggggtgggatacacggataacagaagatgacctgcataatgaagagaaaatcacacagcaaatggatccagaacatagacaactggctaatgctatctttaaacttacatatcaaaataaagtggtcaaagtccaacggcccacgccaaaaggaacagttatggatatcatcagtcggaaggaccaaaggggttccggacaagtgggaacatacggtctgaacacttttacaaacatggaagcacagcttgtaagacagatggaaggcgagggtgtattgtcaaaagcggatctagaaaacccacatctattggagaagaaaatcactcagtggctagaaacaaaaggagtagagcgactcaaacgcatggctatatccggcgacgactgcgttgtaaagccgatcgatgatcgcttcgcaaacgccttgctcgcattgaatgacatgggaaaggtgcgaaaagatataccacaatggcaacctagtaaaggttggcatgattggcaacaggtaccattttgtagccatcacttccacgaattaatcatgaaagacggaagaaagctcgtagttccatgtcgccctcaagatgaattaattgggagagctagaataagccaaggagcaggatggtcgcttaaagagacggcatgtttagggaaggcttatgctcaaatgtggagtctaatgtactttcacaggagagaccttcgcctagctagtaatgcgatctgttccgcagtaccagttcactggatccctatatcacgtacgacatggagtatccatgcccatcatcaatggatgacaacagaagacatgttaacagtatggaatagagtttggattgaagacaatccgtggatggaggataagacaccggtaacgacgtgggaggatgttccatacttgggcaaacgagaggaccagtggtgcggttccttaataggattgactagcagagcaacatgggctcagaatatattgaccgcaatccagcaagtcagatcattaattggtgacgaagagttcttagattatatgccttcaatgaagagattccgcaaagaagaggaatctgaaggagcaatatggtaa

SEQ ID NO: 23477 - RNA, 9873 nt, synthetic construct
  misc_feature 1..9873: note = derived and/or modified CDS sequence (opt6) from DENV-3__EU660411__SS-prME
  source 1..9873: mol_type = other RNA
accagtctctgcctgatgatgatgctacccgcgaccctagcctttcacctaacgtcaagagacggggaacccagaatgatagtcggaaaaaacgaacgtggtaagtctttgctatttaagacagcatcaggtatcaacatgtgcactttaattgcaatggacctaggtgaaatgtgtgatgacaccgtaacttacaagtgtcccctaatcgccgaagtggaaccagaagacattgattgttggtgtaatctaacttcaacatgggtaacttacggaacctgtaatcaagcgggagagcataggagagacaaacggtcagtggcccttgcgccacacgttggaatggggttagataccagaacacaaacttggatgagcgccgaaggagcgtggcgccaagttgaaaaagtagaaacatgggcgttaaggcatccaggttttacaattttagcactttttttagctcattatatcggaacaagtttaactcaaaaagtagtaattttcatcctactcatgttagtaactcctagcatgaccatgcgatgtgtcggtgtaggaaatcgggattttgtggaaggattgtcaggcgctacatgggtggacgtagtcctggaacacggaggatgcgtaacgactatggctaaaaacaaaccaacacttgatatagagctacagaaaaccgaagcaacacaattggccaccctacggaaactatgtattgagggaaagattaccaacattacaacagattcccggtgcccgacacaaggggaggctattctaccagaagagcaggaccaaaattatgtatgtaaacacacttatgtcgaccgtggatggggtaacggatgtggtctctttggcaaaggttcgctagtcacatgtgcaaaattccagtgtttagagcctattgaaggcaaggtagtccagtatgaaaatctaaaatacaccgtgattataacagttcacaccggtgatcagcaccaagtaggtaatgacactcagggcgttacagtagaaatcactccccaggcatcaacggtcgaggccgtactcccagaatacggtactctggggttagagtgttcgccaagaacagggttagactttaatgagatgatattactgacaatgaagaataaagcttggatggtccatagacaatggttcttcgatttaccattgccttggacatcaggagcaacaactgaaacaccaacttggaatcgaaaggaattactagtcacttttaaaaatgcccatgctaaaaaacaagaagtagttgtgcttggctctcaagaaggggcaatgcacaccgcattaacaggcgcaactgaaattcagaactcaggagggacttcaatctttgcagggcatctgaaatgtaggctaaagatggataagttagaacttaaaggaatgagctatgccatgtgcttgaatacgttcgtattaaaaaaagaagtttcggaaacacaacatggcacaatccttataaaagtagagtataaaggagaagatgcgccatgcaaaattccgttttccacagaagatggtcaagggaaagcacacaatggaagactaataacggccaatccggttgtaaccaaaaaggaggaacccgtgaacatagaagcggaacccccgtttggggaatctaacatcgttatcggaataggtgataaagccttgaaaattaattggtacaagaagggttcgtcgataggaaaaatgttcgaagccactgctagaggagcgagaagaatggcgattttgggtgacaccgcatgggactttgggtctgtgggtggggttctcaacagtttaggcaaaatggttcaccaaatatttggttcggcttacaccgcactattctctggagtatcctggataatgaaaatagggataggagtccttctcacttggataggactgaactctaaaaatacgtctatgagcttctcgtgtattgttatcggaataattactctttatcttggtgctgttgtccaagcggatatgggatgtgtcattaattggaaaggtaaagaactaaaatgtggatccggaatatttgttacgaatgaagttcatacgtggacagaacagtataaatttcaagctgactcacctaagcgtctggctaccgcgatagcgggcgcttgggaaaatggggtgtgtggtatccgatcaactacacggatggaaaatcttctttggaaacaaatcgccaatgagcttaattatatattatgggaaaataatataaaattgacagtagtggttggcgatataatcggagtacttgaacagggtaagagaacattaacgccccagccaatggaattaaaatattcctggaaaacatggggaaaagccaagatagtaacagccgagactcaaaacagttcattcataatcgacgggcccaatacacctgagtgtccatccgcaagtagagcttggaatgtatgggaggtcgaagattatgggtttggagtattcacaaccaatatatggttaaagctgcgagaagtatacacacaatcatgcgaccatagactgatgagcgcagccatcaaagacgaacgggctgtccatgccgatatggggtactggatagagtcccaaaagaatggaagctggaaattagagaaagcaagtttcatagaagtcaagacgtgtacttggccaaaatcacacactttatggagcaacggagtattagaaagtgatatgataatacccaaaagtctagccggccctataagtcagcacaatcataggcccggctaccatacacaaactgcaggcccatggcatttaggtaaactggagttagattttaactattgtgaagggacaaccgttgtaataacggaaaactgtggtacacgtggtccctcattacgcacaacaactgtctctggtaaattaattcacgagtggtgttgcagaagttgtacacttcccccacttaggtatatgggtgaagacggctgttggtacggtatggagatcaggcccataaatgaaaaggaggaaaacatggtaaaaagcttggtgtcagctggatcggggaaagttgacaattttacaatgggtgtattatgtcttgcaattctattcgaagaggtcatgagaggtaaattcggcaaaaaacacatgatagcaggtgtactatttacttttgttctattactatcaggtcaaatcacttggcgggatatggcacatactttgatcatgataggatcaaatgcttcagaccggatgggaatgggagtaacatacctggcattaatagctacatttaaaattcaaccattcttagcccttggcttttttctccgaaagttaacctcccgagagaatctgctcctaggggtaggtttagcaatggccacaacactacagcttccagaagacatagaacagatggcgaatggtatagcactgggacttatgaccctcaaattaattacccaatttgagacataccaactatggacagcactagtctcactgacatgttccaacacaatatttacacttacagtagcgtggagaactgcgacattgattttggcaggagtaagtcttttgcctttgtgtcaatcttctagcatgcgaaagactgattggttaccaatgacagtagcggcaatgggagtccctccactacccttatttatattctctctgaaagacactccaaaacgtagaagctggccactgaatgagggtgtaatggcagtcggcctagtatctatattagcatcatcattgcttagaaatgatgtcccaatggccggacctctagttgcgggaggtctcctgatagcttgttatgttataaccggtacctcagcagacttaactgttgaaaaggctgcagacgtaacctgggaagaagaagctgaacaaacaggagtctctcataatttaatgattacggttgacgatgatggtaccatgcgaataaaagatgacgaaacagaaaacatcttaacagtactactcaagaccgcgttactcattgttagtggaatctttccttattcaattccagcgactctgttagtttggcacacttggcagaaacaaactcaaagatcgggagtcttatgggatgtaccatcgcctcctgaaacccaaaaggcagaacttgaagaaggggtttatagaataaaacaacaaggaattttcggtaaaacccaagtaggggtgggggtgcaaaaagaaggagtctttcatacgatgtggcatgtgacacggggagcagtactaacgcacaacggtaagaggctagaacccaattgggcgagtgtaaaaaaagatctaattagctacggtggtggctggagattgtcagctcaatggcaaaaaggtgaggaagtgcaagtcatagcggtggaaccaggaaaaaacccaaaaaactttcaaacaatgccggggatattccaaactactacaggcgaaattggtgcaatagcacttgattttaaaccaggaacaagtggaagtccaattattaaccgtgaagggaaaatagttggattatacggtaacggagtcgttaccaagaatggcggatatgtgtcaggcatcgcacaaacgaatgcagagccggacggccctaccccagaattagaagaagagatgtttaaaaaacgaaatctaacaatcatggacctacatcctggttctggaaagactaggaaatatttaccggctatcgtacgagaagctataaaaaggagattacgaacacttatattggctccaactcgagtagttgcagctgagatggaggaagcattgaagggactcccgatacgttatcagacgactgccataaaaagcgaacatactgggagagaaattgtcgacctaatgtgccatgcgactttcactatgagactattgtcaccagtccgcgttcctaattataatttaattatcatggacgaagcccacttcactgatccagcctcgattgctgccaggggatatatctctacgcgggtcggcatgggagaagcagctgccatctttatgacagccacaccgccggggaccgcagaagcattcccgcaatcaaacgcacctattcaagacgaagaaagagacatacccgaaagatcatggaattcgggcaatgaatggatcaccgactttgttggaaaaacagtatggtttgtaccctcaataaaggccggtaacgacatagctaactgtctgcgaaaaaatggtaaaaaagtaatacaactttctagaaaaacatttgatacagaataccaaaaaacccgattaaacgactgggatttcgtagtgacaactgatatatcagaaatgggtgcaaattttaaagctgatagagtcatcgatccgcgccgatgcttaaagccagtaatactcaccgatggtcctgagcgcgtaattttagcaggacccatgcccgtgacggcagccagcgctgcgcaaagaagaggacgtgtagggcgaaacccacaaaaagaaaatgatcagtacatcttcacaggccaaccattgaacaatgatgaagatcatgctcattggacggaggctaaaatgcttttagataacattaatacccctgaaggcataatacccgctctttttgaacctgaaagagaaaaaagcgccgcaattgatggagagtaccgacttaaaggagaaagccgtaaaacttttgtagaattaatgagacgtggagatctaccagtctggttagcacataaagtagctagtgaaggaataaagtacactgatcgcaaatggtgttttgacggagaaagaaataatcagattttagaagaaaacatggacgtcgaaatctggactaaagaaggggaacgaaaaaaattacgccctagatggctagacgcgcggacttacagcgacccattagcattgaaagaattcaaagatttcgcagcaggaaggaaatcaattgcactagacttggtcactgagataggacgtgtaccgtcccatttagcatacagaactagaaatgccttagataacctcgtaatgctccatacttccgaacatggtggacgagcgtatcggcacgccgtggaggaactaccagagactatggaaacattactactgctaggattaatgattctactaaccggcggtgcaatgttgttccttataagcggcaaaggaataggcaaaacgtccatagggcttatctgcgtcatagtttcgagcggaatgttgtggatggcagatgttcccttacaatggatagcctcagccatcgtactcgaatttttcatgatggtcctactaataccagaaccagaaaaacaacgtacacctcaagataaccaattagcgtatgttgtcattggcattttaactcttgctgccatagttgccgcgaacgaaatgggtttgcttgaaactacaaagagagatctagggatgtcaaaggaaccaggtgtcgtctcacctacatcatacctagatgtagacctccatccagcaagcgcttggacgttatatgctgtcgcgactacggtcatcactccgatgcttagacacactatcgaaaactcaactgctaacgtctcacttgctgcaattgcaaatcaggcggtagtattaatggggttagataaaggatggccaattagtaaaatggatctaggcgtaccgcttttggctctcggctgctattcccaagtcaaccctctaacactaacagctgcagttctattattagtcacccattatgccatcataggccctggtctccaagcgaaagccacaagggaggcccagaaaagaacagcagcgggcatcatgaaaaatcccactgtagatggaattatgacaatagatcttgatccggtaatttacgacagtaaattcgaaaaacaacttggacaagtaatgcttcttgtactgtgtgcagtgcaattgctactaatgagaacaagttgggcgttatgcgaagccctaaccttagccaccgggccaattactacattatgggagggtagccctggtaaattttggaacacaaccatcgcagttagcatggccaatatttttcgtggctcgtacttagctggcgcagggttagctttttcaataatgaagtcagttggcaccggtagaagggggacaggatcacaaggcgagacactcggtgaaaaatggaaaaagaaattaaatcaacttagccggaaagagtttgatctttataaaaaatccggaattacagaagtggacagaacagaagctaaagaaggcttgaaacgaggcgaaactacccatcacgctgtatctagaggtagtgcgaaattgcaatggtttgtcgaacgcaatatggtgattcccgaaggacgtgttatagatctcggctgtggcagaggtggatggagctattattgtgcaggacttaaaaaagtaacggaagtaagaggctacacgaaaggcggacctgggcatgaggagccagttcctatgtcgacttacggatggaatatagtaaaactaatgtccggaaaagacgtcttttacttacctccagaaaagtgtgatacattattatgtgatataggtgaatcatccccaagtccaacagtcgaagaaagccggactatacgcgtattgaaaatggttgagccttggctgaagaacaatcaattctgcattaaggttttgaacccatacatgccgacagttatcgaacatttagaacgcttacagcgtaaatacggcggaatgttggttaggaacccgcttagtcgtaatagcacgcatgaaatgtattggatatcaaacggaacaggaaatattgtgtcaagtgtcaatatggtttctcgcttactgctgaatagatttactatgacacatcgaagaccaactatagaaaaagacgtagacttgggtgctggaactaggcatgtaaacgcggaaccggaaaccccaaatatggatgtgattggtgaacgaatcaaaaggattaaagaggagcattcctctacctggcactatgacgacgagaacccatataaaacatgggcatatcacggatcgtacgaagtaaaagcaaccggttcagcttcctctatgattaacggagttgtgaaactattaactaaaccatgggatgtcgtccctatggtgacccaaatggcaatgacggacacgactcctttcggacagcaacgtgtttttaaagaaaaggtagatacccggaccccaagacctatgcctgggacccggaaggtcatggaaataactgcagaatggctatggcgcacactgggaagaaacaagaaacccaggctgtgtacccgtgaagaatttaccaaaaaagtaagaaccaacgccgcaatgggagctgtatttacggaagagaatcaatgggatagtgctcgtgcagctgttgaagacgaagaattctggaaactagtagaccgggaacgggaacttcataagttaggaaagtgtgggagctgtgtctacaatatgatgggcaagagagaaaaaaaacttggagagtttggaaaggctaaagggtcaagagcgatctggtacatgtggctcggtgcccgatatctagagtttgaagcattaggattcctaaacgaagaccattggtttagtcgtgaaaattcttattctggagttgaaggagaaggactccataaattaggttatatattacgcgatatatcaaaaataccgggcggtgctatgtacgcagatgatactgcaggatgggacacgagaatcaccgaagatgacctacataatgaagagaaaatcactcaacaaatggaccccgaacaccgacagctagcgaacgcaatatttaaattaacatatcaaaacaaagtagtaaaggtacaaagaccaacacccaaaggaacggtaatggatatcatttcaagaaaggatcaaagggggagcggacaagtaggaacatatggattgaatacatttacaaacatggaagcccagttagtgagacaaatggagggagagggcgtcctatccaaagccgacttagaaaatccacacttactagaaaaaaaaataacacaatggttagaaacgaaaggagtagaacgtttaaaacggatggcaatatcgggtgatgattgtgtagttaaaccaattgatgatcgtttcgccaatgctttattagcgctaaacgacatgggaaaagtcagaaaagatatcccacagtggcaaccatcgaaaggctggcacgattggcaacaggtcccattttgttcgcaccacttccatgaattgatcatgaaggatgggcgaaagctagtcgtcccatgtagaccccaagatgaacttatcgggagagcgagaatcagccagggagcaggctggagcctaaaggaaacagcatgcctgggaaaagcgtatgcacaaatgtggtcgttaatgtactttcatcgtagagatttaagattagcctctaatgccatctgcagcgctgttcctgtacattggattccgacttctagaaccacatggtctatacacgctcaccaccaatggatgacaacagaagacatgttgacagtctggaatagagtatggatagaagataacccctggatggaagataaaacaccggtaacaacctgggaagatgttccttatctaggtaaacgagaagatcagtggtgcggatcactaattgggttgacgtcacgagcaacatgggctcaaaatatattgacggccattcaacaggtacgatcgttgataggtgatgaagaatttctagattacatgccaagtatgaaaagatttaggaaagaagaagaaagtgaaggagctatttggtga

SEQ ID NO: 23478 - RNA, 9873 nt, synthetic construct
  misc_feature 1..9873: note = derived and/or modified CDS sequence (opt6) from DENV-3__FJ432722__SS-prME
  source 1..9873: mol_type = other RNA
acatcattatgtttgatgatgatgttgcccgcaacacttgcgtttcacttgacatcaagagatggtgaacctcgaatgatagtaggtaaaaatgaacgaggaaaatcgctgctattcaaaacagcatccggaattaatatgtgtactctaattgctatggatttaggtgaaatgtgcgacgacacagttacatataaatgcccactaattgctgaagtagaacctgaagacatcgattgttggtgcaatttaacaagtacatgggttacatatggaacgtgtaatcaagcaggagaacacagacgagacaaacgaagtgtggcgttggcgccgcacgttggcatggggctagatacccgtacgcaaacatggatgagcgcagaaggggcttggagacaagtagaaaaagttgaaacttgggctttgaggcatccaggatttacaatactagcactgtttttagcgcattacataggcacgagtttaacccaaaaagtagtaatcttcatattactcatgttagttacgccgagtatgacaatgcggtgtgtgggggtaggcaatagagactttgttgaaggattgtcaggggcgacatgggtggacgttgttttggaacacggtggatgcgtgactacgatggcgaaaaacaaaccaactcttgatattgaattacagaaaacagaagcaacccaattagcaacactaaggaaattatgtatagaaggtaaaattactaatataacgaccgattctagatgtccgacacaaggcgaagctatcctacccgaggaacaagatcaaaattacgtctgcaaacatacttacgtagacagaggctggggaaatggatgcggactctttggtaaaggatccctcgtaacttgcgctaaatttcaatgcttagaacctatagaaggcaaagtagttcaatacgagaatcttaaatataccgttataataacggtccatactggtgatcaacatcaggtaggaaatgatacacaaggcgttacagtcgagattacaccacaagcgagcaccgttgaagcagtacttccagaatacggaacattagggttagaatgctccccaagaacagggttagattttaatgaaatgatcctattaaccatgaaaaacaaagcatggatggtacatagacaatggtttttcgacctcccgttgccatggacctccggcgctacgactgaaacacctacctggaacagaaaagagctgttagtaacttttaaaaacgcgcatgctaagaaacaggaagtcgtagtactaggaagtcaggaaggagctatgcacaccgctttaactggagccaccgagatacaaaacagtggagggacgtctatcttcgcaggtcacttaaaatgtaggttgaaaatggacaaacttgaactaaaagggatgagttatgctatgtgtcttaatacctttgtactaaagaaagaggtatctgaaacccagcacggtacaatattgatcaaagtggaatacaaaggagaagatgcaccctgcaaaataccattttcaacagaagatggtcaaggaaaagcgcataacggaagactcattactgccaatcccgtagttacaaagaaagaagaaccggtgaatatagaagcagaacccccattcggagaatccaacatagtaatcggaataggtgataaagcactgaaaataaattggtataagaaaggatcatccatcggaaaaatgttcgaagcaacagctagaggagcacgtaggatggcaatcctgggtgatacagcgtgggatttcggtagtgtaggcggggtcttaaattccctcggaaaaatggtacaccagatatttggaagcgcatatacggcactattcagcggagtgtcttggatcatgaaaatagggataggagtattattaacatggatcggtctaaattctaaaaatacgagtatgtcattcagttgtatagtgataggtataattaccctctatctaggggccgttgttcaggctgatatgggttgtgtaataaactggaaaggcaaagaattgaaatgtggatcgggtatatttgttaccaatgaagtacatacttggacagagcaatacaaatttcaggctgacagtcccaaaaggcttgcaacggccatagccggtgcatgggagaacggtgtatgtggtattagatcaacaaccagaatggaaaatctactatggaaacagatagcaaatgaattgaattatattttgtgggagaacaatataaaactgactgtagtagtgggcgatataataggagtattggagcagggtaaaaggacactaacgccacaaccgatggaattaaaatatagctggaaaacgtgggggaaagctaaaatcgtaacggctgaaacacaaaacagtagcttcattattgatggaccgaatacgccggaatgccctagtgcatcaagggcatggaatgtatgggaagtagaagactatggcttcggggtgtttacaacaaacatatggcttaaattacgtgaagtatacacacaatcatgcgaccatagactaatgtctgccgctataaaagatgaaagggccgttcatgcggatatgggatattggatcgagtcacagaaaaatggctcatggaaattagagaaggcttcttttattgaagttaaaacatgcacatggccgaaatcacatacattatggtccaatggtgttctagagtctgacatgattataccaaaaagtttagcgggtccaatatcacaacataaccatcgcccaggataccatacacaaaccgccggcccgtggcatttgggcaaacttgagttagacttcaattattgcgaggggactacagtagttataacagaaaattgcggaactcgcggtccaagtcttcgtacaaccactgttagcggcaagctcattcatgagtggtgttgccgatcatgtactttaccaccattaaggtatatgggggaggatggatgttggtatggtatggaaatacgtccgatcaatgagaaagaagaaaatatggtaaaaagtctagtatccgcaggttccggaaaagtagataattttaccatgggtgtcctatgtctcgccattttatttgaagaagtgatgagaggtaaattcggaaagaaacatatgatagccggtgtgctatttacatttgtcctacttttaagcggacaaataacatggcgcgacatggctcatacactgataatgatagggtccaatgcatccgatcgcatgggtatgggagtaacatatttagcactgatagccacattcaaaatacaaccatttctagctctgggattcttcctgcgaaaactaacctcccgagagaatttacttctaggcgttgggttggcaatggcgacaacactgcaacttcctgaggacatagaacaaatggcgaatggcatcgcactaggactaatgacattaaagctaatcacgcaatttgaaacatatcaactttggaccgcgttagtcagcttaacatgctccaatacgatttttacgctaacagtggcatggcgaactgccacgttaatattggcgggggttagtcttcttccactttgccaatcaagtagtatgagaaaaactgattggttaccgatgacggttgcagcaatgggtgttcctcccctacccctatttatattcagcttaaaagatacgcctaaaagaaggagttggccattgaacgaaggagtaatggcagtaggattggttagtatactcgcatctagcctgcttagaaatgacgtgcccatggcaggtcccttagtagcagggggtctattaatagcatgttacgtaatcactggtacgagtgcagacttaacagtggagaaagcagcagacgttacatgggaagaagaggcagaacaaacaggcgtatctcataatttaatgataactgtagatgatgacggcactatgaggataaaggatgacgaaactgaaaacatattaactgttttattaaaaactgcactgcttattgtaagtggcatatttccatattctattccagcgactctgttggtttggcatacctggcaaaagcagacccaacgtagtggtgtgttgtgggatgtaccgagtccgcctgagactcaaaaggcagagcttgaggagggagtataccgtataaaacaacaaggaatattcggaaaaacgcaagttggagtaggcgtacaaaaagaaggcgtattccatacaatgtggcacgtgacgagaggagctgtcctaacacacaacggtaagcgtttagaaccaaactgggcaagtgtgaagaaagacctaatatcctatggtggaggatggaggcttagtgctcaatggcaaaagggcgaagaagtacaggttatagctgtagaacctggtaaaaacccgaaaaactttcaaacaatgccggggatattccaaacaaccactggagagataggagctatagccttagacttcaagcctggtacttcaggttctccaattataaatagggagggaaaagtggttggattatatggtaatggagttgttactaaaaatggcggctatgtctctggaatagcacaaacgaacgcagaaccagatggtccgacaccggagctcgaagaagaaatgtttaagaaaaggaaccttacaattatggacttacacccaggtagcggaaaaacgagaaaatatctacccgcaatagttcgagaagctattaaacgaagactgaggaccttaattctagcaccgacccgtgtagttgccgcagaaatggaagaagctcttaagggcttaccaatacgttatcaaaccaccgctacaaaaagcgaacataccggaagagaaatagtcgatcttatgtgtcacgctacatttacaatgagactcctctcaccagttcgcgtccccaattataacctaataataatggatgaggcacatttcacagatccagcctcaatcgccgctagaggctacatttcgacacgagtaggaatgggagaggcggcggcaatatttatgactgctacaccaccaggcacagcagaagcgtttcctcagtcaaacgcgccaattcaagacgaagaacgggacatacctgagcggtcttggaactcgggaaatgaatggatcacagactttgtaggaaaaacagtgtggtttgtaccaagtataaaggcgggaaatgacatagcgaattgcctacgcaaaaatgggaagaaagtgattcaattgagcagaaaaacgtttgatacggagtatcagaaaacgaaattaaatgattgggactttgttgttacgacagatatttcggaaatgggagcaaactttaaagccgatcgagtaatagatcctagaaggtgcttgaaaccagttatactcacagatggtcctgaacgtgtaattctcgctggtccaatgccagtcaccgctgcctccgccgcacaaagacgaggcagagtagggaggaaccctcagaaagaaaacgaccaatatatatttacaggacagcctttaaataacgacgaggatcacgcgcattggaccgaagcaaaaatgttacttgataacatcaatactccggaagggataattcccgccctatttgaaccagaaagagagaaaagtgcagcaatagatggggaatatagactaaaaggcgagagtcgcaagacctttgtcgaactaatgcgcagaggtgacctccctgtgtggttggctcacaaagtagcaagcgagggaataaaatatactgacagaaaatggtgttttgatggcgagagaaataatcagatattggaagaaaatatggatgtagaaatttggaccaaagaaggcgaacgaaagaaattacgaccgagatggctagatgcgcgcacttacagcgatccactagcactaaaggaatttaaggactttgctgccggtaggaaaagcattgctttagatcttgttacagaaattggaagagtgccttcacatttggcttatcgaactcgtaacgcattagataacctagtgatgcttcatacgtcagaacacggcggacgggcctatcgacatgcagtagaagaattaccagaaactatggaaacgcttctgctattgggattgatgatactgttaaccggaggagctatgttgttcttgatatctgggaaaggtataggtaagacatcaattggacttatatgtgtcatcgttagtagtggaatgctctggatggctgatgttccattgcaatggatagcgagcgccatcgtgttagagttcttcatgatggttctactgataccagagcctgagaaacaacgcacgccccaggataatcaattagcttatgtagttattggtatcttaacgctagcggctatagttgcagcgaacgaaatgggactactagaaacgaccaaaagagatctggggatgagtaaggaaccaggcgttgtttctccaacctcatacctagacgtagatctccatccggcatctgcttggactttatatgccgtagccacgactgttataaccccaatgctcagacacacaatagaaaattctaccgcgaacgtctcactagcagccatagccaatcaggcagtggtcctaatgggactcgataaaggctggccgatatctaaaatggatttaggcgtgcctctactggcactagggtgttactcacaagtaaatcctttaacgctaacagcggcggtcttgctcttagttactcactatgcaataataggcccaggacttcaggcaaaggcaacaagagaagcacaaaagagaaccgcagcaggcatcatgaaaaacccaacagtagatggcattatgactatcgatttggaccctgtaatctacgattctaaatttgagaaacaactgggtcaagtaatgttgctcgttttgtgcgcagttcaattactactaatgagaacgagctgggctctttgtgaagcattgactttagccacaggcccaataacgacgctttgggaaggaagtcctggtaagttctggaatacgacaatcgcagttagtatggctaatatatttcgaggatcttatctagcaggcgctggattagcattttctatcatgaaaagcgtcggaacaggtcgtaggggtacggggtctcaaggcgaaacgctcggagaaaaatggaagaaaaagctaaatcagctttcacgtaaggagttcgacctttataagaaaagcgggatcacagaagtcgatcgtactgaggcaaaagaggggttgaaacgtggtgagactacgcatcatgccgtttctagagggtctgcgaaattgcaatggtttgtggaaaggaacatggtaatccccgagggccgagtcatagatctcgggtgtggtcggggaggatggagttattattgtgccgggctgaagaaagtcacagaagtgaggggatacactaaaggaggaccaggacatgaagaaccggtcccaatgtcaacatacggatggaatatcgtaaaattgatgtcgggaaaagatgtattctacttacctcccgagaaatgtgatacacttctgtgtgacatcggggaatcatcaccgtcacccacagtagaggagtcgcgaactatacgggttctaaaaatggtggaaccatggttaaagaataatcaattttgtataaaggttttaaatccgtacatgcctactgtaattgaacacctagaacgactacaaagaaaatacggaggtatgctcgtacgaaacccattatcaagaaactcgacacatgaaatgtattggataagtaacggaactggaaacattgtgagttctgttaacatggtaagccgcttgttactaaaccgatttactatgactcacaggagacctaccatcgaaaaggatgtcgatttaggggcgggtactcgacacgtaaacgcagaaccagaaacacccaatatggatgtaattggggaaagaatcaagaggataaaagaagaacattcgtcaacttggcattacgatgatgaaaatccatataaaacctgggcataccacggctcttatgaggtaaaagcaactggatctgcaagcagtatgataaatggcgtggtaaagctactaacaaaaccgtgggatgtagtaccaatggtgactcagatggcaatgacagatacaactccatttgggcagcaacgagtcttcaaagaaaaagtggatacacgtacccccaggcctatgcctggaacaagaaaggtaatggaaattaccgccgagtggctctggagaaccttgggcagaaataagaaaccacgactttgcactagggaagaatttaccaagaaagtaagaactaatgcggctatgggtgcagtgtttacagaagaaaaccaatgggatagtgccagggcggcagtagaggacgaagagttctggaagttagttgacagggaacgtgaactccataagctggggaaatgtggaagttgtgtatataacatgatgggtaaacgtgagaagaaactaggtgagtttgggaaagcaaagggatcgcgtgcaatttggtatatgtggctcggggcccgatatttagagtttgaagccctaggtttcttgaatgaggaccattggttcagtagagaaaactcatacagcggggtcgaaggggaaggactccataagctaggatacattcttcgggacatctccaaaattccaggaggagctatgtatgcggatgacactgcgggctgggacactaggattacagaagacgatctacacaatgaagaaaagataacacaacaaatggacccggaacatcgacaactcgcaaatgctattttcaaacttacttatcaaaacaaagttgttaaagtacaaagaccaactcctaaaggaactgtaatggacatcatttcccgcaaagatcagcgagggagcggtcaggtaggaacatacggacttaatacttttacaaatatggaagcacaactcgttaggcagatggagggtgaaggggtactatcgaaagcagatctagaaaatccgcatctactggagaagaaaataactcaatggctagagaccaaaggtgttgagcgtttaaaacgaatggcgatttcgggcgatgactgtgttgtaaagccaatagatgaccgatttgcaaacgcattattggctttaaacgatatgggtaaagtcagaaaagacataccacaatggcagccctcaaaaggttggcatgattggcaacaggtgccgttttgctcacaccattttcacgaattaataatgaaagatggacgaaaactcgttgtcccttgccgtccgcaagatgaactgataggacgagcacgaataagtcaaggagccggttggagcctcaaagaaactgcttgccttggaaaagcatatgcccaaatgtggtctctcatgtactttcaccgaagagatctacgtctagcttcgaacgcaatatgcagtgccgtccctgtccactggatcccaacatctcgaacgacttggagcattcatgcacaccaccaatggatgacgacggaagatatgctcacagtctggaatagagtctggatagaagacaatccctggatggaagataaaacaccggtcacaacatgggaagatgttccatacttgggaaagcgggaagatcaatggtgcggaagtttgatcggtctaacatcaagagcaacttgggcacaaaacattcttactgcgatacaacaagttcgttccctcataggggacgaagaatttcttgactacatgccaagcatgaaacgattcagaaaagaagaagaatcggaaggagtcatatggtag

SEQ ID NO: 23479 - RNA, 9873 nt, synthetic construct
  misc_feature 1..9873: note = derived and/or modified CDS sequence (opt6) from DENV-3__FJ432728__SS-prME
  source 1..9873: mol_type = other RNA
acctccttatgcctaatgatgatgctcccagctactttagcctttcatttaacttcaagagatggggaacctcggatgattgtggggaaaaatgaaagagggaaatcattactgtttaaaactgcatcaggtattaatatgtgcaccctaatagctatggatctgggagaaatgtgtgatgatacagttacatataaatgccccttgattgccgaagtagaacctgaagacatagattgctggtgcaacctcacgtctacttgggtaacatatggaacttgtaatcaagcaggagaacacagaagggacaaaaggtctgttgcattagctccccacgtgggtatgggactggacactcgaactcaaacgtggatgtcggctgaaggggcgtggcgtcaagttgaaaaagtcgaaacctgggcattgaggcaccctggatttacaattctagcgttattcttggcacattatatcggaacatcattaacgcaaaaagttgttatttttatattgttgatgctggtaacaccttcaatgacaatgaggtgcgtcggagtgggtaatcgagattttgtcgaagggttatccggagctacatgggttgatgtagtcttagaacacggaggctgtgtcacgacaatggcgaaaaacaaacctacacttgacattgaattacagaaaaccgaagcaacacaactggctactctaagaaaattatgtatagaaggaaaaataactaatatcacgaccgattcaagatgtcctacacaaggagaagcaatattaccagaagaacaagaccaaaattatgtatgcaaacatacgtacgtcgacaggggatggggaaatggatgtgggctttttggaaaaggaagcctagtaacatgtgctaaattccaatgtcttgaacctatcgaaggcaaagtcgtccaatacgaaaatctgaaatatacggttattataacggtacacacgggggaccaacatcaagtgggaaacgatacgcaaggagtaacagtggaaattacaccccaagcgagcacagtagaagcggttctacccgaatacggtacattggggttagaatgctctccgcgaacaggacttgacttcaatgaaatgatcctactaacaatgaaaaacaaggcatggatggtgcaccggcaatggttcttcgacctaccattaccgtggacctccggtgctacaacagaaacgccaacatggaacaggaaagaactcttagttacttttaaaaatgcacacgctaaaaagcaagaagtagtagtactaggatctcaagaaggagcaatgcacactgctttaactggagcaactgaaatacaaaattccggaggtacaagtatctttgcgggccacttgaaatgtcgattgaagatggataaacttgagctaaagggtatgtcctacgctatgtgcttaaatacatttgttttaaagaaggaggtttctgagacccaacatgggacaatcttaatcaaagtagaatacaaaggagaggacgcgccttgtaaaattcctttcagtactgaagatggacaaggtaaagctcataatgggagattgataacagccaaccccgtagtaacaaagaaagaagaacccgtgaatattgaagcagagccgccctttggtgaatcaaacatcgtaataggcataggggacaaagcacttaagatcaactggtataaaaagggaagtagtattggtaagatgtttgaggccaccgctcgaggtgcaagaagaatggccattctaggagatacagcctgggatttcggatcagttggtggggtcctcaattcccttggtaaaatggtccatcagatatttggcagtgcttacaccgcattattctctggcgtcagttggataatgaaaataggaataggtgtcctcctcacgtggattggtcttaacagcaaaaacacatcgatgtcattttcttgcatagtcataggaattataacgctatatttaggagctgtagtccaagcggacatggggtgtgcaatcaactggaagggcaaagagctaaaatgtggttccggtatctttgtaaccaacgaagtccacacgtggacagaacaatacaaattccaagcagattcgcccaaaagattagctacagccattgctggtgcttgggaaaacggcgtttgcggaatcaggtccacaacacgcatggaaaatctcttatggaaacaaatcgcgaacgagcttaactacattctatgggaaaacaacataaaattaacagttgtcgtcggcgatatcataggagtcctggaacaaggcaagagaaccttaacaccacaaccaatggaattaaaatactcatggaagacttggggaaaggcaaaaatagtaacagcagagactcaaaatagttcttttataatcgacggcccaaacacacctgagtgtcctagtgcgtccagagcatggaacgtctgggaagtggaagactacggttttggagtatttactacaaacatctggctaaaactcagagaagtctatacacaaagttgtgatcatagactcatgtcggcagccataaaggacgaacgagcggttcatgctgatatgggctattggatcgagtcacagaaaaatggttcatggaagctagaaaaagcatcatttatcgaggtaaaaacatgcacatggccaaaaagccacaccctttggtcaaatggcgtacttgagagcgatatgattatcccaaaatcattagcaggtccaatcagccaacacaatcacagaccaggataccatactcaaacagctggaccatggcacttaggaaaattagagttagattttaactactgtgaagggacgactgttgtgataacggaagactgtggcacaagaggcccatcactaagaacaacaacagtctctggaaaattaattcacgaatggtgttgccgaagttgcacgctacccccgcttcggtacatgggagaagatggatgttggtatggaatggaaattcgtccaataaatgagaaggaagaaaacatggtaaaatcacttgttagtgctggatcaggtaaagtggataattttacaatgggtgtgttatgccttgccatattattcgaagaagtgatgagaggaaaatttgggaagaaacatatgatagcgggggttttatttacattcgttctacttttgagtggtcagatcacatggagagatatggcacacactctaatcatgataggatcaaatgcgtccgatagaatgggaatgggcgtgacgtatttggcgctgattgccacgtttaaaattcagccctttttagcacttggattctttctacgaaagttaacatctcgagaaaacctactactgggagtgggattagcgatggcaaccacactccaattacctgaggatattgaacagatggcaaatggcatagctcttggtctcatgacccttaaattgataacacaatttgagacataccaactgtggacagcgctagtctcgttaacgtgttccaatactatatttacattaactgtagcatggagaacagccacgttgatactagcaggagtatccttattaccgctctgtcaaagctctagcatgcggaaaacagactggctacctatgacagtcgcagcaatgggagtaccccctttaccactcttcatctttagcttaaaggatacaccaaagcggagatcctggcctcttaacgagggcgtaatggcggttggccttgtatctattctagcatcttccctactgcgaaatgacgtgcctatggctggcccgttagtagctggtgggttacttatagcttgttacgtcattactggaacaagtgcagatcttacggtcgagaaagccgcggatgttacttgggaagaagaagcggaacaaacgggcgtaagtcataacttaatgataactgtagatgacgacggtacaatgagaattaaggacgatgagactgaaaatatcttaaccgttttattaaaaacagcattattaatagtgagtggcatctttccatacagtatccccgccacgctactggtttggcacacatggcaaaaacagactcaacgcagtggcgtcctgtgggatgtacctagcccgccagagacacaaaaagcggaattagaggaaggcgtatatcgaataaaacaacaggggatttttggcaaaacacaagtaggcgtaggcgttcaaaaagaaggagtatttcatacaatgtggcacgtaacacgtggcgccgtgttaacgcacaacgggaaaaggctagaaccaaattgggcatcagtcaagaaagatttgatctcatatggagggggatggagattatccgctcaatggcaaaaaggtgaagaagtccaagtcatcgccgtagagccgggcaaaaaccccaaaaattttcaaacaatgccaggcatattccaaaccacgaccggcgagataggtgctattgccttagactttaaacctgggacctcaggcagtccaataattaacagagaaggcaaagttgttggattgtatggtaatggcgttgtaacgaagaatggaggttatgtaagtggaatagcgcaaacaaatgctgaacccgacggaccaacaccagaactcgaagaagagatgtttaagaaaagaaatttaacaataatggacctacatcctgggtccggtaaaacgagaaaatacttgccagccattgtaagagaagcgatcaagcggaggttacgcacattaattttggccccaacaagagtagtcgccgccgaaatggaagaagccctgaaaggactacctattagatatcaaacaaccgcgacaaaatctgaacatactgggcgtgaaatagttgacttgatgtgtcatgcaactttcacaatgagactccttagtccagttcgcgtaccaaattacaacctcataatcatggacgaagcacactttactgacccagcatctatagcagcaagaggctatatttctacacgagtaggaatgggagaagcagcagccattttcatgacagcgacaccaccgggaacagcagaagcatttcctcaatcgaacgcccctattcaagatgaggagagagatatacccgagcgatcttggaacagcggcaacgagtggattactgacttcgttggaaaaactgtttggtttgtacccagtataaaagcaggaaatgacattgcaaattgtttgagaaagaacggtaagaaggtcatacaactgtcacgtaagacattcgatacagaataccaaaagacaagacttaatgattgggattttgttgttactaccgatataagcgaaatgggtgccaattttaaagccgaccgggtaatagatccgcgtcgttgcctgaaacctgtaatactcaccgacggaccagagagagtaattttagcaggaccaatgcccgtaactgctgcaagcgccgctcagagaagggggagagtgggacgaaaccctcagaaagaaaatgatcaatacatatttacaggtcaacctctcaacaatgatgaggatcacgcgcattggacagaagctaaaatgttactcgataacatcaatactccagagggtatcataccagcactgttcgaacctgaacgagagaaaagtgcggcaatagacggggaatatcgacttaagggtgaatctcgaaagacgtttgtagaactaatgcgccgtggtgacttaccagtatggttagcgcacaaagtggcatccgagggtataaaatacactgacagaaaatggtgtttcgacggagaaagaaataatcagatacttgaggaaaatatggatgtcgaaatatggaccaaagagggcgagaggaagaaattgagacctcgatggttagacgccaggacctatagtgatcctctagcattaaaagagttcaaagactttgcagcgggacgaaaatctatagctctagatttagtaacagagattggcagagtgccatctcatttagcataccgaaccaggaacgctctcgataacttggtcatgttacatacaagcgaacatggcggacgggcgtatagacacgcagtcgaagaactgcccgaaactatggagactctcctcctactaggtctaatgattttgttgaccggaggagctatgcttttcttaatttcaggtaagggaattgggaaaacaagcattggacttatatgtgttatagtatctagcgggatgctatggatggcagatgtgcctctacaatggattgcatcagcaatcgtgttggagttcttcatgatggtattgttgatccctgaaccagaaaaacagcgcactccgcaagacaaccaattagcttatgttgtcattggcatacttacgttggcggccatagtcgctgcaaatgaaatggggctcttagaaactacaaaaagagatttgggtatgtccaaagaacctggagtagtttcgcctacatcatatctcgatgtagatcttcatcctgcatcagcatggacactttatgcagtagctacgaccgtaataacacccatgctccgacatacgattgaaaattctacagcaaacgtttccttagcagcaattgcaaatcaagctgttgttctcatgggtttagacaaaggttggccgatctcgaagatggaccttggtgtaccccttttggcgcttggatgctatagccaagttaatccattaacgttaacagcagcagtattactcctagttacacattacgccataatcggcccaggtttacaagctaaagcaaccagagaagctcaaaaacgaacagcggccggaataatgaaaaatccaacagtggatggtatcatgacgattgacctagatcccgttatatatgattccaaatttgagaaacagctaggccaggtgatgttattggttttatgcgcagtacaattactcttaatgagaacatcttgggcattgtgcgaagcgttaaccttagcgacgggacctatcacaacactatgggaagggagtcctgggaaattttggaacactaccatcgctgtctcaatggctaatattttcaggggatcctacttggcaggggcgggtctcgcatttagtataatgaagtcagtaggtacaggaaggcgtgggaccggatcacaaggcgaaacactcggggaaaaatggaagaagaaattaaaccaactgagtagaaaagagtttgatttgtacaagaaaagcggtattacagaagtagatagaacagaagctaaagaaggactaaagaggggtgaaacaacacaccatgccgtctcaaggggttctgctaaacttcaatggtttgttgaaagaaatatggtcatacccgagggtagagtaatagacttaggctgtgggaggggagggtggagttattactgcgctggactaaagaaagtaacagaagttcggggttatactaaaggaggtcccggccacgaggaacccgtacccatgagtacttacggatggaacttagtcaaactaatgtccggaaaagatgtattttatctaccccctgagaaatgtgacacattgctatgtgatataggtgaaagcagtccaagtccaacagttgaagagagtagaacaataagagttttaaaaatggttgaaccgtggctgaaaaacaatcagttttgtattaaagtcctgaatccttacatgcccacagtaattgaacacttagaaaggttacaaagaaaatatggtggaatgttagttagaaatcccctgagccggaatagtacccacgaaatgtattggataagcaatggtacagggaatattgtaagcagtgttaatatggtatctaggcttctattgaacagatttactatgactcatagacgaccaactattgaaaaagatgtagacctgggagcaggaacaagacatgttaatgcggaaccagaaacccctaatatggacgtaattggagaaagaataaaaagaattaaagaagaacattctagtacttggcattacgacgatgaaaatccgtacaaaacatgggcctatcatggttcttatgaggttaaggctacaggttcagcctcaagtatgattaatggagtcgttaaactactgactaaaccttgggacgttgttccgatggtaacacaaatggctatgactgataccacgcctttcggtcaacagagagtatttaaggaaaaagttgacacaaggacgccaagaccaatgcccggcacacgtaaggtcatggaaattacggccgaatggttatggcgcactctcgggagaaacaagaaacccaggctgtgtacaagagaagagtttactaaaaaggtcagaactaatgcagcgatgggcgctgtttttacggaagaaaatcaatgggacagtgcacgtgccgcagtcgaagacgaagagttctggaaattggtagatcgagaacgagaactgcacaaactgggaaagtgcgggtcgtgtgtgtataatatgatgggaaaacgagagaagaaattaggagagttcgggaaagcgaagggaagtagagcaatctggtacatgtggctaggggcccgctacctagagtttgaagcccttggtttcctaaatgaagatcactggttcagtcgagaaaactcttactcaggcgtggaaggagaaggccttcataaattaggctatattcttcgcgacataagtaaaataccaggtggagccatgtacgcagatgacactgcaggttgggatactcgtataaccgaggatgatctacataatgaagagaagataacgcaacaaatggatcctgagcacagacaactggccaatgcaatttttaaattgacatatcaaaataaagtggtaaaagttcaaagaccaacgcccaagggcaccgttatggacataatatcaaggaaagaccagaggggcagtgggcaggtcggcacatacggactcaacactttcacaaatatggaagcgcaattggtacgacaaatggagggagaaggtgtactaagcaaagctgatcttgaaaaccctcaccttcttgagaagaaaattacacaatggttagaaacaaaaggtgtagaaaggcttaaacgaatggccatttctggcgatgactgcgtcgtaaaacctatagacgatagatttgcaaatgcactacttgcgctaaacgatatgggaaaagtcaggaaagacattccgcaatggcagccaagcaaaggctggcatgactggcagcaggtcccgttttgcagtcaccacttccacgaactaataatgaaagacggtagaaaattagtagtaccctgcagacctcaagatgaactcataggtagagccaggatttcccaaggtgccgggtggtctttgaaggaaacagcatgtctcggtaaagcatatgcgcaaatgtggtctttgatgtattttcaccgacgggacctacgcctcgctagcaacgcgatctgctcagccgtgccagtacactggattcctacatccaggacgacttggtctattcacgcgcaccatcagtggatgactacagaagatatgttgactgtttggaaccgggtctggattgaagacaacccatggatggaggataagacgccggtcacaacttgggaggatgtcccatacctaggaaagagagaagaccaatggtgcggctctttaataggcttgacatcacgtgctacctgggcacaaaacattctgaccgctattcaacaagtaagaagcctcatcggagacgaagagttccttgattacatgccttcgatgaaaaggtttagaaaggaggaagaaagcgagggagcaatttggtaa

SEQ ID NO: 23480 - RNA, 9873 nt, synthetic construct
  misc_feature 1..9873: note = derived and/or modified CDS sequence (opt6) from DENV-3__FJ432731__SS-prME
  source 1..9873: mol_type = other RNA
acttcactctgtctaatgatgatgttaccagcaaccctagcatttcaccttacaagtagagacggtgaaccaagaatgatagtgggtaaaaatgaacgcggaaaatctctattatttaaaactgctagtggaataaatatgtgtactttaattgcgatggatctgggagaaatgtgtgatgacactgtaacttacaaatgcccgcttattgcagaagttgagccagaagatatagactgttggtgtaatctgactagcacatgggtcacttacggcacgtgcaatcaagccggtgaacaccgacgagataaacggtcagtggcattggcccctcatgtcgggatgggcctagacacaagaacacaaacatggatgagcgcagaaggagcttggagacaagttgaaaaagtagaaacatgggccttacgacaccccggatttactatactcgcattattcttggcacattatataggtacaagtttaactcaaaaagtcgttatatttatattattaatgttagtcacaccttcaatgactatgagatgtgtaggagttggaaatcgtgacttcgtagaaggattatcgggagcaacatgggtagatgtggtgcttgaacatggaggttgtgttacaaccatggctaaaaacaaaccgactttagatatagaattacagaaaaccgaagctacacaactggcaaccctcagaaaactatgcattgaaggcaaaatcactaatattaccacggattcgagatgccctacacaaggagaagctatattgcccgaagaacaagaccaaaactatgtatgcaaacacacgtatgtagacagaggttggggcaatggatgtggcttattcggaaaaggtagcttggtgacctgcgcaaaatttcaatgtctcgaacctatagaaggaaaagtagttcaatacgaaaatctaaaatacacagtcataataacggtccacactggcgaccaacatcaagtgggtaatgatacccaaggggtaacagttgaaataacccctcaagccagcacagtcgaggcagtgctgcctgaatatggaacattaggcttagaatgctctcccagaacgggattagacttcaatgagatgatcctcctgaccatgaaaaataaagcatggatggtacaccgacagtggttctttgatctacccttaccttggacgtctggagctactaccgagacgccgacctggaaccgtaaagaattattagtgacatttaaaaatgcgcacgcgaagaaacaggaagtagttgttctaggttcgcaagaaggggcgatgcatactgcccttactggtgcaacagaaatccaaaacagtggcggaacaagtatattcgcaggccatctaaaatgtcgattaaagatggataaattggaactcaaaggtatgtcatacgcaatgtgcttgaacacgtttgtgctcaaaaaggaagtcagtgagactcaacatggtacaatcttaataaaggtggaatacaagggtgaagacgcaccatgtaagataccattctcgacggaggatggtcaaggaaaagcacataatgggcgactgataacagctaaccccgtcgtcaccaagaaagaagaacctgtcaatattgaagcagaaccaccctttggagagtctaatatagttataggtattggcgacaaggccctcaaaattaattggtacaagaaagggtcatcgattgggaaaatgtttgaagcaacagcacgaggagcaagaagaatggcaatacttggtgacaccgcatgggatttcggaagcgtgggaggcgtccttaatagtttaggtaaaatggtccatcaaatttttggttccgcatacaccgcattattttcaggtgtttcatggattatgaagataggaattggcgttttgctaacctggataggactaaatagtaagaacacgtcaatgtccttttcgtgcattgtaatcggtataataactctataccttggtgctgttgtgcaagcagacatgggttgcgcgataaactggaaaggcaaggagctaaaatgcgggtcaggaattttcgtaactaatgaagtgcacacttggacagaacaatataaatttcaagcagacagcccgaaaaggttagcaacggcaatagccggcgcgtgggagaacggagtatgtggtatacgatcaaccacaagaatggaaaatctattatggaagcaaatcgcaaacgaattaaactacattttgtgggaaaataacataaaactcactgtggtagttggagacattataggagtattagaacaaggtaaacgtactttaaccccacaaccgatggagttaaagtattcttggaaaacatgggggaaagcgaaaatcgtcacagcagaaacacaaaacagtagctttatcatagatggaccgaatactccagagtgtcccagtgcgtcgagggcatggaatgtatgggaggtagaagactacggatttggagtgttcactaccaacatatggttgaagctgagggaagtatacactcagagctgtgaccacagattaatgtcagccgcgattaaggacgaacgagcggtacacgccgatatgggatactggatagaatcccaaaagaatggatcatggaaattagaaaaagcctcctttattgaagttaagacttgcacttggccaaagtcacataccttatggtcgaatggagtactagaaagtgacatgatcatacctaagagtcttgcaggaccgatatcacagcataatcatcgcccgggatatcacacacaaactgcaggtccatggcatttaggaaagttagaactagattttaactattgtgagggaacaactgtcgttataacagaaaactgtggaactaggggaccatcacttagaacaaccactgtatccggtaaattgatacatgaatggtgctgtcgcagttgtacacttccacccctcagatacatgggtgaagacggctgctggtatggaatggagatcagaccaataaacgaaaaggaagaaaacatggtcaaaagtctagtatcagcagggtccggtaaagttgacaattttacgatgggtgtcctctgtctcgcaattttgtttgaagaagttatgagaggaaaatttggaaagaaacacatgatagcaggagttctctttatgtttgtacttttattaagcggacaaataacttggagagacatggcacaaacgttaataatgataggctctaatgccagcgacagaatgggaatgggtgtgacatatttagctttaattgctacatttaagatccaaccattccttgcactaggcttctttctacgaaaattgaccagtagagagaatctattattaggtgtgggattggcaatgacaacgacattgcaactcccggaagatatagaacaaatggccaatggaatcgctcttggcctaatgaccctaaagctgataacacaatttgaaacataccaactttggacagctcttgtatcattaacttgctctaatacaatatttacattaactgtcgcctggcgaacagctacactaattttagctggtgtaagcctattaccactatgtcagagctcctccatgcggaagacagattggctgcccatgacagtagctgcgatgggcgtgccacctttacccttatttatcttctcactaaaagacacaccaaagcgaagatcatggcctctcaatgaaggagtgatggctgtcggattagttagtatattagcaagtagcttgttacgaaatgacgtaccaatggctggacctctagttgctggaggacttttaatagcttgttatgtcataaccggtacctcagctgacctgaccgtcgaaaaggcagctgacgtaacatgggaagaggaagccgaacaaacaggggtaagtcacaatctcatgattaccgtagatgatgacggcacgatgaggataaaggatgatgaaacggagaatattctaacagtattactaaaaacagcattactaattgtaagtggtatctttccttatagtattcccgcgactcttctagtctggcatacttggcagaagcaaactcaaaggagtggagtcctatgggatgtaccgtcccctcctgagacccaaaaggcagagttagaagaaggcgtgtataggattaaacaacaaggaattttcggcaaaacacaggttggtgtaggggtacagaaggaaggagtttttcatactatgtggcatgtaacaagaggcgcagttctaactcataatggtaaacggctggaaccaaattgggcgtccgtcaagaaagatttaatatcttatggaggtggttggaggttaagcgcacaatggcagaaaggggaagaggtacaagtcatcgctgttgaacctgggaaaaatcccaaaaattttcaaacgatgcccggaatattccaaactaccacaggtgaaataggcgcaattgctcttgattttaagcctggaactagcggttctccaataattaatagagaaggaaaagtcgtgggcctttatggcaacggcgttgtcactaaaaatggcgggtatgtaagtggaattgcccaaacaaatgcagagcccgatgggccaactcccgaactagaagaagaaatgttcaagaagaggaacttaactataatggaccttcaccctggtagcggtaaaacgagaaaatatcttcccgcgattgtacgtgaggcaatcaaacgccgtctccgaacattaatcttagccccgacaagggtcgttgcagctgagatggaagaagcgctaaagggtcttccgatcaggtatcagaccacagcaaccaagtctgaacatacggggagagaaatagtagatttaatgtgccacgctacgtttacgatgcgccttttatctccagtgagagtgcccaattacaatctaattatcatggacgaggcgcacttcacagaccccgcctcgatcgcggcgagaggttatataagtacgcgcgtaggaatgggcgaggccgccgccatattcatgacggctacacctccgggtacggcagaggccttcccccaatcgaacgcaccaatacaagatgaagaacgagatatacctgaacgttcttggaactctgggaacgaatggataactgatttcgtaggaaaaaccgtgtggttcgttccgagtataaaggcgggaaatgatattgctaattgcctcaggaaaaacggcaagaaagtgatccaattgtcacgtaaaacatttgacacagaataccagaaaaccagactgaatgactgggatttcgtagtaactacggacatttccgaaatgggtgctaatttcaaggctgatcgtgtaatagacccacgaaggtgtctaaaacctgtcatactcaccgatgggcccgagcgcgtaattttagcagggcctatgccagtaactgcagccagtgccgcgcaacggagaggcagagttggtaggaatccccagaaagagaatgaccaatatatatttactggacaaccccttaacaatgacgaagatcatgcccattggacagaagcaaaaatgctcctggataacattaatacaccagagggaatcatacctgccctctttgaaccagagcgagagaaatcggcagctatagacggtgaatatcgtttaaagggggaaagcagaaaaacatttgtcgaattaatgagaagaggtgacctgcctgtgtggttagcccataaagtggcctctgaagggataaagtatactgacaggaagtggtgcttcgacggcgaacgaaataaccaaattttagaggaaaacatggacgtcgaaatctggacaaaagaaggcgaacggaagaaacttagacctcgatggcttgatgcaagaacttattcagacccgttagccttgaaagaatttaaagattttgcggcaggccgaaaaagtatagcactcgatcttgtgactgaaataggacgggtcccaagtcacctcgcttacagaactaggaacgcactggacaatttagtaatgttgcatacttccgaacacggtgggcgtgcatacagacacgcggtcgaggagttaccagaaacgatggaaactcttttattgttgggtttaatgattttattaactggtggagcaatgctctttctgatctctgggaaaggcattggcaaaacaagtattggtttaatctgtgtgattgtgagtagtggaatgttatggatggccgacgtaccattgcagtggatagcttcggcaattatattagagttctttatgatggtcttacttattcccgagccggaaaaacaaagaacaccacaagacaaccagttggcatatgtcgtaatagggattctgaccttagccgcgattgtagctgcaaatgaaatgggactattagagacaaccaaacgagacctaggtatgagtaaggaaccaggagtagtgtctcctacttcctatctagacgtagatttacatcccgccagcgcgtggacactgtatgcagttgctactacagtcatcacaccaatgttacgtcacacaatagaaaatagtactgcgaatgttagtctcgcggccatcgcaaatcaagctgtagtattaatgggattagacaaaggttggcctatatcaaaaatggatctaggtgtgcccttattggcgctaggatgttacagtcaagttaaccctttgaccttaactgcagcagtcttactattagtaacgcattacgcaatcattggcccaggattacaagccaaagcgactcgggaggcgcaaaaacgaaccgcggccggaataatgaagaatccaacggtagacggaataatgactattgaccttgaccccgttatttatgattcgaaattcgagaaacagctcggacaggtgatgctattagtactttgcgcggtacaattgctgcttatgagaacctcatgggcactttgtgaagccttaaccctagcaaccggccctataactacactgtgggaaggatcaccaggaaaattctggaatacgaccatagcagtcagcatggcgaacattttccgaggcagctacctagctggcgcagggttggctttctccattatgaaaagtgttggcactgggagaagaggaacaggcagtcaaggagaaacactaggagaaaaatggaagaaaaagctcaatcaattatcccgaaaagaatttgatctctataagaaatccggaataacagaggttgaccggacagaagctaaagagggcctaaaaagaggtgagactacgcaccacgccgtgtcacgaggctctgcaaaactccaatggtttgttgagagaaatatggtcatacccgaaggacgggtaattgatttgggttgcgggcgtggtggttggtcatattattgtgcaggtctaaagaaagtaacagaagtccgtgggtatactaaaggagggccaggtcatgaagaaccagttcctatgtcaacttacgggtggaacctcgtcaaacttatgagcggtaaagatgtgttttatctgccccctgaaaaatgcgacactttgctttgcgatattggtgagtcctcacccagtccaactgttgaggagtctaggacaattagagttctcaaaatggtggagccatggcttaaaaataaccaattttgtatcaaagtacttaacccttacatgccaacagtaatagaacatctagaaaggctacaacggaaatatggaggaatgctagttagaaatcccctaagtagaaactcaacacatgaaatgtattggattagcaacggaactgggaatattgtgtcatcagtgaacatggtttcacgccttttactgaatcgttttaccatgacacacagacgtccaactatagaaaaagacgtagacttgggagcaggaactcgacatgtaaacgcggagccagaaacgccaaatatggatgtcataggagaaaggattaaaagaataaaagaagaacacagctctacgtggcattacgacgatgaaaatccgtacaaaacatgggcatatcatgggtcatacgaagtcaaagcaacaggttcagcaagcagcatgataaatggagtggtaaaactcctaactaaaccatgggacgttgttccgatggtcacacaaatggccatgacagatacaaccccgtttggtcagcaacgtgtttttaaagaaaaggtagatacacggactccacgaccgatgccagggactaggaaagtcatggaaatcacagcggaatggttgtggcgtacacttggtcgaaataagaaaccacgcctgtgtacacgagaagagtttacgaaaaaggtaaggactaatgcggcaatgggtgcagtattcacggaagaaaatcaatgggactctgcaagagcggcagtggaagatgaggagttctggaaattagtagaccgagaacgcgagcttcataaactcggcaaatgcggatcatgtgtctataatatgatgggaaaaagagagaaaaagttaggagagttcggtaaagcaaaaggaagcagagctatttggtacatgtggcttggtgcaagatacttggagtttgaggcattggggttcctcaatgaggatcactggttttcgagagagaacagctacagtggtgtagaaggagaaggcttacataaactgggatacatactgagggatattagtaaaataccaggtggagccatgtacgcagacgatacggcaggctgggacacacgtataaccgaagatgatttacacaacgaagagaaaataacacaacagatggatcccgaacatagacaacttgctaatgccatatttaaattaacctaccaaaacaaagttgtgaaagttcagaggccaactcccaagggtacagtaatggacatcatatctcgaaaagatcagagaggttccgggcaagtaggaacgtacggactgaacactttcacaaatatggaagcgcaacttgtaagacaaatggaaggagaaggggtattaagtaaagcggatttagaaaatccccatttgcttgaaaagaaaataacacaatggttagaaacaaaaggagtagaaaggcttaagagaatggcaatatcaggagatgattgcgtagttaagccaatagacgataggttcgccaacgccttattagcgttaaatgacatgggtaaagttcgtaaagatattccccagtggcagccatccaaaggctggcatgactggcaacaagttcctttttgtagtcatcatttccatgaactcataatgaaagatggacgaaaacttgtagtcccgtgtaggccgcaagacgaacttattggtcgagcaagaatatcacaaggggctggatggtcacttaaagaaactgcttgtttaggaaaggcgtatgcacagatgtggtcgttaatgtattttcacagaagagatttaaggcttgcaagcaatgccatatgcagtgctgtgcctgtgcattggataccaacttctagaactacttggtcaatccatgcacatcaccaatggatgactacggaggacatgctcaccgtctggaacagagtctggattgaagacaatccttggatggaggataagactcctgttaccacatgggaagacgtaccatatttaggaaaacgtgaagaccaatggtgtggatcccttattggattgacaagtagagcaacgtgggcgcaaaatattctaaccgccatccaacaggtaagaagtctgattggagacgaggaatttctagattatatgccctcaatgaaaagatttagaaaagaggaagagagtgaaggtgcaatatggtaa

SEQ ID NO: 23481 - RNA, 9873 nt, synthetic construct
  misc_feature 1..9873: note = derived and/or modified CDS sequence (opt6) from DENV-3__FJ562097__SS-prME
  source 1..9873: mol_type = other RNA
acgtctttatgtctaatgatgatgttacctgccactctagctttccatttgacttccagagatggagaacctagaatgattgtaggcaaaaatgaaagagggaaaagcctgctgtttaaaacggcctctggaattaatatgtgcacactaatagctatggatcttggagaaatgtgtgacgatacagtaacatataaatgtccgctaattgccgaagtggaaccagaagatattgactgctggtgtaatctcacttccacttgggttacatatggaacgtgtaatcaagcgggtgaacaccgccgagacaaaaggagtgtagcactggccccacatgtaggaatgggactggacacacgaactcaaacatggatgagtgcagaaggagcttggcgacaagtagaaaaagtggagacatgggctttaagacacccggggtttacaatcttggcactatttctagcacattatattgggacatcactcacgcaaaaagtcgtgatcttcatattattaatgctcgttacccccagtatgactatgcgttgcgtgggagtcggaaacagagatttcgtagaaggattgagtggagcaacttgggtcgacgtagtcctcgaacatggaggttgtgtcacaactatggcgaaaaataaaccgacgctggacattgagctacagaaaactgaagcaacgcaactggcaacgttgagaaaattatgcatagaaggtaaaataacaaacataactacagattcacgatgtcctactcaaggagaggcgatacttcctgaagaacaagatcaaaattatgtgtgtaaacacacttacgtagaccgaggatggggaaacggatgtggattatttggaaaaggtagtttagtcacttgtgcaaaattccaatgccttgaacctattgagggaaaagtagtccaatatgaaaacttaaaatataccgttataattactgtgcacacaggagaccaacatcaagtaggtaacgatacacaaggagtaaccgtggagatcactccacaggcttcaacggtagaagcggtgctaccggaatacggaactttaggattagaatgcagccctcggaccggactcgattttaatgaaatgattctgcttacaatgaaaaacaaagcatggatggtccacaggcaatggtttttcgatcttccactaccttggacatctggagctaccaccgaaacaccaacttggaatagaaaagaactattagtgacatttaaaaacgcacatgccaagaaacaggaggttgtagttttaggatcacaagagggtgccatgcacactgctttaaccggagcgacagaaattcaaaattcagggggaacctctattttcgccggacatctcaaatgtaggcttaaaatggataaattggagttgaaaggaatgagctatgctatgtgcctcaatacattcgtcctcaagaaagaagtttctgaaacccaacacggaacaatcctgataaaagtagagtacaaaggggaagacgctccatgtaaaataccgttctctacagaagatgggcaaggaaaagcccataatggccggttgatcacagccaacccggttgtaacaaagaaagaagaaccagtgaacatagaagcagaacctcctttcggagagtctaacattgtaatcggcataggcgataaagcactaaaaataaattggtataagaaaggcagctcaataggaaaaatgttcgaagctacggcgaggggcgcgcgaagaatggctatattaggcgacactgcctgggattttggaagcgtgggaggagttttgaactcactaggaaaaatggtacaccaaattttcggaagcgcctacacagctttattcagtggagtatcgtggatcatgaaaattggtataggcgtgctcctaacatggataggactcaacagcaaaaatacctcaatgtccttctcttgcattgttattggtatcataaccctctatttaggcgctgtggtccaggcagacatggggtgcgtaataaactggaaaggaaaagaattgaaatgtggaagcggtatatttgtgacaaacgaggtacatacctggacagaacaatataagtttcaggccgactctcccaaacgacttgctacagctatagcaggagcctgggagaacggagtctgcggcatacgtagcacaaccaggatggaaaacttactttggaaacaaatcgcaaacgaactaaactatattttatgggaaaataatataaagctgacagtagtagtgggtgacattataggcgtgttggaacaaggcaaaagaacgctaacacctcagccaatggaattaaagtattcatggaaaacatggggtaaagctaaaatagtcacagcggaaactcaaaactcaagttttataatagacggacccaacacaccggaatgtccaagtgcctctcgagcgtggaacgtatgggaggtggaagattacggttttggcgtattcacaacaaacatatggcttaaactaagagaagtttatacgcagtcatgcgatcatagactgatgtccgccgcgatcaaagacgaaagggcagtacatgcggacatgggatattggattgaaagtcagaaaaatgggagttggaaattagaaaaggcctcatttatagaagtaaaaacctgtacgtggccgaaatcacatacactgtggagtaatggggtactcgagagtgatatgatcataccaaaatcactagcaggaccaatttcacagcacaatcaccgccctgggtatcatactcaaaccgcaggtccctggcatctaggaaagctagaactagactttaactattgcgagggaacaaccgtagtgatcacagagaattgtggaacacgcggaccttccctgcgtacaactacagtatcgggcaagttaatacatgaatggtgttgtagatcatgtacattaccccctttacggtatatgggtgaagatggatgttggtatggaatggagattcgcccaataaacgagaaagaagaaaatatggttaaaagtctagtctccgctggatccggtaaggttgataatttcacaatgggcgttctctgtttagcgatactatttgaagaagtgatgcgtggcaagtttggcaagaaacatatgatagcgggtgtactctttacgtttgtgctactactgtcaggtcaaatcacgtggcgagatatggctcatactcttattatgataggatctaatgcttctgaccggatgggaatgggtgtgacttacctagctcttatagccactttcaaaatacaaccatttctggcgttaggattctttttaagaaaactaacatctagggaaaatttactccttggagttgggctagcgatggcagctaccttacaattacctgaagacatagagcaaatggccaatggtattgccctcggtttaatgactcttaaattaatcacgcaatttgaaacatatcaactttggacggcacttgtaagtttaacatgttcgaatacgatatttacactaacagtagcatggcgtacagcgaccctgattttagcaggagtatccctcctacctctatgccaatcaagttcaatgcgtaaaactgattggcttccgatgacagtcgcagcaatgggagtacctccgcttcccctatttatattttcattaaaagatactccgaaaagaagaagctggccactcaatgagggagtgatggccgtaggattagtgtcaattctagcttcgtctttgctacgaaacgatgttcccatggcaggccctctagtggcagggggtctattaatagcgtgctacgtaattacaggaacatctgcagacttgacagtagaaaaagcagccgatgtaacctgggaagaagaggctgaacagacaggtgtaagtcataacttaatgataaccgtagacgatgatggaactatgcgaataaaagatgatgaaacggaaaacatcctaaccgtgctcctcaagacggcgctattaattgtgagtggtgtatttccatattcaattccagcaactctactcgtatggcacacatggcaaaagcaaacacaacgatccggggttttatgggatgtaccatcaccaccagaaactcagaaggccgaattagaagaaggtgtatatcgaatcaagcaacagggcatcttcggtaagactcaagtgggagtcggcgttcaaaaggaaggtgtatttcataccatgtggcatgtgactagaggtgccgttcttactcataacggcaaaagattagaaccaaactgggcttccgtcaagaaagacttaatttcgtacggaggtggatggcgactatctgcgcaatggcaaaaaggggaggaagtacaagttatagccgttgaaccaggcaaaaaccctaaaaattttcaaacaatgcctggcatattccaaacaactaccggggaaataggagcaatagctcttgattttaaaccaggaacatctggatcacccataataaatcgagaaggaaaagttgtaggtttgtatggtaacggagtagtgaccaaaaatggcggatacgtaagtggtatcgctcaaactaacgcggagccggatgggccgacacccgagcttgaggaggaaatgttcaagaaacgtaatctaacgataatggatctacatccgggctccgggaaaactagaaaataccttccagcaatagttagagaggccataaaacgacgactccggacactaatcttagcaccaacccgagtggtcgcagcagaaatggaagaagcactgaaaggtttacctatacgataccaaactacagccactaaatccgagcatactggtcgcgagatcgtagacctaatgtgccacgctacttttacgatgcgactattaagccccgtaagagttcccaactataacttaatcattatggatgaagcgcacttcacagatccagcatcgattgccgcacgaggctatatcagcacgcgcgttggaatgggagaagcggcagctatctttatgacggctacgcccccgggcacagcagaggcgtttccccaatcaaatgcaccaatccaggacgaagaacgggatattcctgaaaggtcgtggaactccggtaacgaatggataactgattttgtgggcaaaacagtttggttcgttccatcaataaaagcagggaatgacatagcaaattgcctaaggaaaaatggtaagaaagttatacaactaagtcgaaaaacctttgacacagaataccagaaaactaaattaaatgattgggacttcgtagtaacaacagatattagtgaaatgggagcgaattttaaagcagatcgcgtaatagatcctcgcagatgcctaaaaccagttattctaaccgatggcccagagagagtaattcttgcaggcccgatgccggtcaccgcagcttcggcagctcaaagaagaggccgtgtaggacgaaatccacaaaaggaaaatgaccaatatattttcactgggcaacctctaaacaatgacgaagaccacgcgcactggacagaggcgaaaatgttactcgataatattaatacaccggaagggattattccggccctattcgaaccagaacgcgaaaagtccgcggccatagatggagaataccgattaaaaggtgaatcaaggaaaacttttgtagagttaatgcgaagaggagatcttccagtgtggctagcccataaagtagcaagtgaaggtatcaaatatacagatcggaaatggtgcttcgacggggaaagaaataaccaaattctagaagaaaacatggacgtcgagatatggacaaaagagggtgaacgcaagaaattgagaccacgctggttagatgcaagaacttacagtgatcctttagcgcttaaagagtttaaagatttcgcagcggggcgtaagtccattgctttggaccttgttaccgagattgggcgcgtaccttcccatctagcttacaggactcgtaatgcactagacaatctggtaatgttacatacctctgaacatggtggtcgagcgtaccggcacgcggtagaagaactccctgagacaatggaaacgttgttgttgttaggactcatgatactactgacaggaggtgcgatgctttttcttatctcaggtaaaggaattggaaaaacgtcaatcgggttaatttgcgtaattgtttctagtggtatgttatggatggcagatgttcctttgcaatggatagcatccgcaatcgtcttggagttctttatgatggttctgcttatcccagagcctgaaaaacaaagaacaccacaggacaatcaattagcctacgtagtaataggcattcttacattagcagcaatagtagcagcaaatgaaatgggccttctggagacaacaaaaagagacctaggcatgagtaaagaaccaggtgttgtttctccaacatcatacctcgacgtagatcttcacccagcatcagcatggacactatacgccgtagcaacgaccgttataacacctatgttacgacacactatagaaaatagtacggcgaatgtatccctagccgcgatcgcaaatcaagctgtagttctaatgggtttagataaagggtggccaatttctaaaatggatctaggagtaccacttttagcactcgggtgttattcacaggtcaatccacttacattgacggcggctgttttattgctagtgacgcattatgccattataggtccaggactacaagcaaaagcgacaagagaagcacaaaaacgaacggccgcaggcatcatgaaaaatcctactgtagacggaataatgacaatagatttggaccctgttatatatgattcaaaatttgaaaaacagcttggacaagtaatgcttctcgtattatgtgcagtacagcttctactcatgcgtacgtcgtgggcattgtgtgaggctttaactcttgcaaccggaccaataacaacattgtgggagggaagtccgggtaagttttggaatacaactatagccgtaagcatggcaaacatctttcgaggttcttatttagctggggctggtttagctttttcaattatgaaatccgtaggcacaggccgtcggggaacagggagccaaggggagacattaggagaaaaatggaagaagaaactgaaccaattgagtaggaaagagtttgatttgtataagaaatccggaataaccgaggtggacagaacggaagcaaaggagggtttaaagagaggcgaaaccacgcatcatgccgtctccaggggcagtgcaaaattgcaatggtttgttgaaaggaatatggtcatccctgaaggccgcgtaattgatttagggtgtgggaggggaggctggagttattactgcgccggactcaagaaagttaccgaagttcgcggatacacaaagggcggaccaggacatgaagaacctgtcccaatgtcaacatacggttggaacatcgtaaaattgatgagtggtaaagatgtgttctatctacctcctgagaaatgtgatacactactatgcgatataggtgaatcctcaccaagtccaactgtagaagaatcaagaactatacgcgttttaaaaatggttgaaccttggttaaagaataaccaattttgtatcaaagtattgaacccttatatgccaaccgtaatcgagcatcttgagagacttcaaagaaaatacgggggtatgttggtaaggaatccgctttcccgcaactcaacacacgaaatgtattggataagtaatggtactgggaacattgtcagtagcgttaacatggtgtcaagactactactgaatagatttaccatgactcatagaagacctacgatagaaaaagatgtagatctgggtgccggtacacgacatgtaaacgcggaacccgaaaccccaaacatggacgtcataggagaaagaattaagagaattaaagaagaacactcatccacttggcattacgatgacgaaaacccatataaaacctgggcttaccacggttcctatgaagtaaaggcgactggtagtgcgtcatcaatgataaacggtgtcgtgaagttattgacaaagccatgggatgttgtgcctatggtaactcaaatggctatgacagatacaactcctttcggacaacaaagagtttttaaagaaaaagtagatacacgtacgccgagaccaatgccaggaactcgaaaagtcatggaaattaccgcggaatggctttggcgcacgctcggaagaaataagaaaccaaggctgtgtacacgggaagagttcacaaagaaagttcgaacgaacgcagcgatgggcgcagtctttacggaagagaaccaatgggattccgcaagagcagccgttgaagatgaagagttctggaagctagtagaccgtgaacgggagttacacaaattaggaaaatgcggatcgtgcgtctataacatgatgggaaaaagagagaagaaattaggcgagttcggcaaagcgaaaggaagtagagcaatatggtatatgtggttaggggcaagatatttagaatttgaagcgcttgggtttctaaatgaagaccattggttcagtagagaaaattcttactcaggagtagagggggaaggactgcacaaattaggatacatcttaagggatatatcaaaaataccaggaggcgccatgtatgctgatgacacggcagggtgggatacacgtataactgaagatgaccttcataatgaagagaaaatcacacagcagatggatccagaacatagacagctagctaatgcgatatttaagttaacctaccaaaacaaggtcgtgaaagttcagcgcccaacccccaaaggaactgtgatggacataataagtcgcaaggaccagcgaggaagcgggcaggtcggaacgtacggtctaaacacatttacaaatatggaagctcagctagtgagacaaatggaaggcgagggtgtattatccaaggcagacttagaaaatccacatttattagagaaaaagataacacaatggttagaaacaaaaggagtagaacgcttgaaaagaatggccatatcaggagacgattgtgtcgtcaaacctatagatgatagattcgccaacgcacttttagctttgaacgatatgggaaaagttcgtaaggacattccacaatggcaaccaagtaaaggatggcatgattggcaacaggttcctttctgttcccatcacttccacgaactaataatgaaagatggacggaaacttgttgttccttgtagaccacaggatgaactaattgggcgggcaaggataagtcaaggagccggctggtcgctcaaagaaactgcttgcttaggaaaggcctacgcacagatgtggtcgctgatgtactttcatagaagagaccttcgcttagcttcaaatgcgatttgtagcgctgttcctgtacactggataccaacctcaagaacaacttggtcaatacacgcgcatcatcaatggatgacgaccgaagatatgttaacggtttggaatagagtatggatcgaagataatccatggatggaggataaaaccccagtaacaacctgggaagacgtaccttatttaggcaaacgagaagatcagtggtgtgggtcgttaatcggattgacgtctcgagccacctgggcacaaaacattttaacggcgatccaacaagtacgtagtttaattggcgacgaagaatttttagattatatgcctagtatgaagaggttcagaaaggaagaagaatcggaaggtgccatatggtag

SEQ ID NO: 23482 - RNA, 9873 nt, synthetic construct
  misc_feature 1..9873: note = derived and/or modified CDS sequence (opt6) from DENV-3__FJ432741__SS-prME
  source 1..9873: mol_type = other RNA
acctctctatgcttaatgatgatgctacccgcaacattagctttccatctaacaagccgggatggagaacctagaatgatagtgggcaaaaacgaaaggggcaaatcacttctatttaaaactgcatcaggcataaatatgtgtacgctaatagcaatggacctcggtgaaatgtgcgacgatacagtcacgtacaaatgccccctcattgcggaggtagaaccagaagacatcgactgttggtgcaatctgacgagtacttgggtcacttatggtacatgcaaccaagcgggtgaacacagaagagacaaacggtcagtagcactagctccccatgtggggatgggactagacacacggacacaaacttggatgtcagcagagggtgcgtggagacaagtagaaaaagtcgaaacctgggcattaagacatccagggtttacaattttagcgctttttcttgcacattatattggaacctcactgactcaaaaagttgtaattttcatattactcatgttagtgacgcctagcatgacaatgcgttgcgtaggagtagggaacagagattttgtcgaaggtttgagtggtgctacctgggtagacgtcgtattagaacatggagggtgcgtgacgacgatggccaaaaacaaacccacattagatatagaattacagaaaacagaagcaactcaattagctacgttacgaaaactatgcatagaaggcaaaataaccaacattacgacggactcaaggtgtccgactcagggagaagcaatactaccagaagaacaagatcaaaactacgtatgcaaacatacatatgtagatcgcgggtggggaaacgggtgtggtctgttcggcaaaggatcactggtcacttgtgcaaaattccaatgtttagaaccaatcgaaggaaaagtggtacaatacgaaaatttgaaatacacagttatcattacagtacacacaggtgaccaacatcaagtaggaaatgatacacaaggtgttacggtggaaataacaccccaggcttcgacggtagaagcagttctgcccgaatatgggacgttgggactagagtgttcccctagaactggattggatttcaatgaaatgatattgttaacaatgaaaaacaaggcttggatggtacatcgtcaatggttctttgatctacctttaccttggacctcaggagcaacaactgaaactccgacctggaacaggaaagagctcctagtgacattcaaaaatgcgcatgctaagaaacaagaagttgttgtattaggctcacaagaaggagcaatgcacacagcgctaaccggcgcgaccgaaattcaaaactcaggaggtactagcatatttgcaggacatttgaaatgtcgcttaaaaatggataaattggagttaaaaggcatgagctatgcgatgtgtctaaacacatttgtcttgaagaaagaagtgagcgagacccaacatggaactatattgataaaagtcgaatataaaggcgaagatgctccatgtaaaattcctttcagtacagaagatggtcaaggtaaagcacacaatggtcgtctaataacagcaaatccagtggtagccaagaaagaagaaccagtaaacattgaagcggaaccaccgtttggcgaatcgaacatcgttatcggaataggagataaagcacttaaaattaattggtataagaaaggtagttccattggaaaaatgtttgaagcaacagcaagaggcgctagaagaatggcaattttaggtgataccgcatgggactttgggtcagttggtggggtacttaactcattaggtaaaatggttcaccaaatattcggttctgcatacactgcactcttttctggtgtctcctggatcatgaaaatcggaataggagtgctattgacttggattggcttaaactctaaaaatactagcatgagcttcagttgtatagtgataggtataatcacattatatcttggcgcggtggtacaagcagacatgggctgcgcaataaattggaaaggtaaagaattaaaatgtggatcgggaatttttgtaacgaatgaagttcatacctggacggaacaatacaaatttcaagcagacagtccaaaaagattagcaaccgcaatcgcaggagcatgggagaatggcgtttgcggcatcagatcaacaacacgaatggagaatctgttgtggaaacaaatcgcgaatgaattgaattacatattatgggagaacaatatcaaactgacagtggtcgtgggtgatataatcggggttttggaacaaggcaagcggacgctgactccacaacccatggaattgaaatatagctggaaaacttggggcaaagctaagatcgtaaccgctgaaacacaaaactcttcgttcattatcgatggaccgaatacaccagaatgtccgagtgcctcgagagcatggaacgtctgggaagtagaagattatggctttggagttttcaccactaatatatggctcaagctgagggaagtacacacacaaagttgtgaccatcgactaatgagtgcagcaatcaaagatgaacgtgcagtgcatgctgatatgggctattggattgagagtcagaaaaacggatcttggaaactcgaaaaggcctctttcatcgaagtaaaaacttgtacgtggccgaagtcgcatacactgtggtcaaatggcgtgctcgagtcagatatggttattcctaaaagtttagccggccctataagccaacataatcaccggcctggatatcatacgcaaacagcaggaccttggcatttaggaaaactcgaattagatttcaattattgtgagggaacaacagtagttataactgaaaattgtggaaccaggggaccatcattacgaacgacaactgtaagcggaaaattaatacatgaatggtgctgtcgatcgtgtacgttacctccgctacgatatatgggagaggatggctgctggtatggcatggagattcgcccaattaatgaaaaagaggagaatatggtaaagtcgctggtatccgcgggttctggaaaagtcgacaatttcacaatgggcgtgttgtgtttagcgatattattcgaagaagtaatgagaggaaaatttgggaagaagcatatgatagccggtgtgttatttacgttcgtacttctgttgtcaggtcagatcacctggcgtgatatggcacacactctgataatgattggaagcaatgcatctgatagaatgggaatgggagttacataccttgcactaatagcaacctttaaaattcaaccgttcctcgccttaggatttttcctaaggaaactaacatcgcgagaaaacctcctcctcggtgtcggcctagctatggctaccactctacagttacccgaagatattgaacaaatggcaaatggaatagcgttggggttaatgacattaaaattgataacacaatttgaaacatatcaactatggacagcattagtttcgttgacctgttcaaatacaatttttactttaaccgtagcgtggaggaccgcaacactaattctagccggagtttcattgctacccctttgtcaatccagcagcatgaggaaaacggattggttaccaatgacggttgctgcaatgggtgtaccaccactacccttatttatcttttcattaaaagacactcctaagcgacgtagttggccccttaatgagggcgttatggccgttggtctagttagcatacttgcctcaagtttactacgaaatgatgtacccatggcaggtccactggttgccggtggactgttaattgcatgctacgtcattacaggaacatccgcagatttaacggttgagaaagctgccgatgtaacatgggaagaagaagcagagcaaaccggagttagtcataatttaatgattactgtagacgatgacggaacaatgcgcattaaggatgacgaaactgaaaatatactcacagtacttttaaagacggcacttctgattgtgagcggaatatttccctattcaattcccgctacattattagtatggcacacatggcagaaacagacacagagatccggggtcttgtgggatgtccccagtcccccggagactcagaaagcagaactcgaggaaggtgtttacagaataaaacaacagggtatattcgggaaaacgcaagtaggcgtaggtgtgcaaaaagagggtgttttccacacaatgtggcacgtaactcgtggagcagtgttaacgcacaacggaaaaagacttgaacctaactgggcctcggttaagaaagacttaataagttacggcggcgggtggaggttaagcgcacaatggcaaaaaggggaagaagtgcaagtaattgctgtagaaccgggtaaaaaccctaaaaattttcagacaatgccgggaatattccaaacaaccacgggagagataggagcgatagcgctagactttaagccgggaacttctggcagccctattataaaccgcgaagggaaagtagtaggtctctatggaaatggagtggtaactaaaaatggaggttatgtctctggtatcgcgcaaacaaatgccgaaccggatggaccaacccctgaattagaagaagaagtgttcaagaagagaaatctcacaataatggatttacaccccgggtccggtaaaacacgaaaatatctacctgcaatagtccgtgaagctataaaaaggagacttcgcaccttaatactagcgccaacaagagtagttgctgcggagatggaggaagcactgaaaggtctacctattagatatcaaactacagctaccaaaagtgaacacactggaagagaaattgttgaccttatgtgtcacgcgacctttactatgagattactatctccagttagagtacccaattataatctaataataatggatgaggcacactttaccgacccggcatccattgcagctcggggctacatttctacgcgagtaggaatgggcgaggcggctgctatattcatgacagctacacctcctggaacagcggaagcgtttccccaaagtaacgccccaattcaagatgaggagcgagatataccagaaagatcatggaactcaggaaatgagtggataacggattttgtcggcaagacagtctggttcgttccatcaataaaggcagggaacgacattgcaaattgcttacgtaaaaatggtaagaaagttatccaactaagtagaaagacgtttgataccgaatatcagaaaacacgcttgaacgactgggacttcgtcgttactacggatatatcagaaatgggggcaaattttaaagcggaccgagttattgatccgcgaaggtgccttaaaccagtcatattaacagacggcccagaacgtgtgatacttgccggaccaatgccggttacggcagcaagtgcggcacagaggaggggcagagttggacgtaatccacaaaaagaaaacgaccaatatattttcactggacagccacttaacaacgacgaagaccacgcacattggactgaggcaaagatgcttctagacaacattaatacacccgaaggaatcataccggcattatttgagccagaaagagagaagtctgccgctatcgatggggaatacagattgaaaggggagagtcgcaagacattcgtagaattgatgcgtcgcggagaccttcctgtatggctggcccacaaagtagctagcgaaggtatcaaatatactgatcgcaaatggtgctttgatggtgaaagaaacaatcaaatactcgaagagaatatggacgtagaaatatggaccaaagaaggggagcggaaaaagctaagaccaagatggttagatgcgagaacatactcagatccattggctttaaaagagttcaaagattttgcagctggtcgaaagtcaatagcgttagacctcgttacagaaatcggaagagtaccctctcacttagcttatcggacgagaaacgccttagacaatttggttatgctacacacgtcggaacacggtggtagggcatacaggcacgccgtagaagaactcccagaaactatggagacactgttgttgttaggactaatgatcctactaacaggcggtgccatgctattcctaatctcaggcaagggaataggtaagacaagtataggattaatctgcgtaatcgtcagtagtggaatgttatggatggccgatgtacccttacagtggatagcctcggcgattatattagagttctttatgatggtactattaatcccagaacccgaaaagcagagaacaccacaagataatcaacttgcctatgtagtaataggtatattaacattggctgcaatagtagctgcaaatgaaatgggattgctggagacaactaagagggatcttggtatgagcaaagaaccgggagtagtcagccctacaagctacctcgatgtcgatctacatccagccagcgcttggactctgtacgctgtagcaactacagtaatcacacctatgctacgtcatactatagaaaacagtaccgcaaacgtatcactggctgccattgctaaccaagctgtagtattaatgggtctcgataaaggttggcctatatctaaaatggatttaggcgtaccattattggcactaggatgttatagtcaagttaacccgcttactttaactgccgccgtcttactactcgtaacacattatgcgataatcggcccgggtcttcaagctaaagccacaagagaagcgcagaaaagaacagcagctggcataatgaagaatcctacagtagatggcataatgactatagacctagatccggtaatttatgactctaaattcgagaaacaattaggtcaagtaatgttattagtactctgcgccgtacagctactcctaatgcgtacaagttgggcactgtgtgaagcgctgacccttgccacaggtccgattactacgttatgggaggggtctcccggaaaattctggaacacaacgattgctgtttcaatggcgaatatatttagaggaagttacttagccggtgcaggattagcgttctcgattatgaaatcagttggaacaggaagacgtggcacaggaagccagggagaaacacttggggaaaaatggaagaagaaactaaaccaattaagtcgcaaagaatttgacctatacaagaaaagtggaataaccgaagttgatagaacagaagcaaaagaggggctaaaaagaggggagactacacaccatgctgtcagtcgcggatctgctaaactgcagtggtttgtagagcgaaacatggtaatacccgaaggccgcgtaatcgacttgggctgcggtaggggaggatggtcttattattgcgctggtctgaagaaagtcaccgaagtcagaggttatactaaaggtggtcccggacatgaggaacctgtgcctatgtcgacttatggatggaacctagtaaaattgatgagcggaaaagacgtcttctatctacccccagaaaaatgtgacacactgctgtgtgatataggcgagtcgagcccgtcaccaaccgtagaagaatctaggacgatacgcgtactgaaaatggtcgaaccgtggttaaagaacaatcaattttgcattaaagtcttgaatccatatatgcccacggtaattgaacatcttgaaaggctacagcgaaagtatggagggatgctagtacgaaatcccctatcccggaatagtacccatgagatgtattggattagcaatggaacaggcaacatcgtatcatctgtaaacatggtaagtagactacttctcaatagatttaccatgacacaccgacgacccacaattgagaaagatgttgacttgggcgcaggcacccggcatgttaacgcagaaccagagactcctaacatggatgtgataggtgaaagaattaaacgaatcaaggaagaacacagctctacctggcattatgatgatgagaatccctataaaacatgggcataccatggatcatatgaagtcaaggctaccgggagtgcatcaagcatgataaacggagttgtaaagttacttacaaaaccctgggacgtagtcccaatggtaacgcaaatggctatgacagacacaacaccatttggacaacagcgagtattcaaagaaaaagttgatacaaggaccccacgacctatgccaggcacgcgaaaggtaatggagataacagccgaatggctgtggagaacactcgggagaaataagaaaccaagattatgtacgagagaagaatttactaagaaagtgagaactaacgcggctatgggagccgtatttacggaagaaaaccaatgggattctgcaagggccgcggtggaagacgaggagttttggaagctagtggacagagaaaggaagttgcacaagttaggaaaatgtggatcttgcgtgtataatatgatggggaaacgcgaaaagaaactaggggaatttggcaaagcaaaaggaagtagagcaatctggtatatgtggttaggtgcacggtatcttgaatttgaagcccttggatttctcaatgaagaccattggttcagtagagaaaactcatattcaggagttgaaggagaaggacttcataagttaggatatatactacgggacattagtaaaatacctggaggagcaatgtacgcggatgacacagcaggttgggatactcgtataactgaagatgatttacataatgaggagaaaataactcagcagatggaccccgaacatagacaacttgctaacgccatctttaaattgacatatcaaaataaagtagtaaaagtacagaggcccaccccaaaagggacagttatggacattatttccagaaaggatcaacggggaagcggacaagtgggtacatatggtcttaacacatttacgaacatggaagcacagctagtaagacaaatggaaggagaaggggtgctgtctaaagcggatctcgagaatccacaccttctagagaagaaaattacgcagtggctagaaacaaaaggagtggaacgcctcaaacggatggctatcagcggtgatgattgcgtcgttaaacccatagatgacagattcgctaatgcattattagccctgaatgatatgggaaaggtaagaaaggatataccacagtggcaaccctccaaaggatggcatgattggcaacaagtaccattttgctcgcaccattttcatgaattaataatgaaagacgggcgaaaactcgtagtgccatgcagaccgcaggacgagctgataggacgagcacgtataagccaaggggccggatggtctttgaaggaaacggcgtgcttaggaaaggcttatgctcagatgtggtcattgatgtactttcacagaagagaccttagacttgcctctaacgcgatatgtagtgcagttccagtgcactggataccaacgtcgagaaccacttggtctatacacgcacatcatcagtggatgactacggaagacatgctgaccgtttggaatagggtatggattgaagataatccttggatggaagacaaaactcccgttacaacgtgggaggacgtaccatatctgggaaaacgtgaagatcaatggtgtggaagtctaattggtctaacatcacgggctacttgggcacaaaacattctgaccgctatacagcaagttagatcgctgatcggagatgaagaatttttggattatatgccaagcatgaaacgtttcaggaaggaagaagaatctgagggagcaatatggtaa

SEQ ID NO: 23483 - RNA, 9873 nt, synthetic construct
  misc_feature 1..9873: note = derived and/or modified CDS sequence (opt6) from DENV-3__FJ562099__SS-prME
  source 1..9873: mol_type = other RNA
actagcctgtgtctaatgatgatgcttcctgcaacattagcgttccatttgacgtcacgagatggagaacctagaatgatcgtagggaaaaatgaacgcgggaaatctttactttttaaaacagcgtcaggaataaatatgtgcacactgatagcaatggacctaggagaaatgtgtgatgatacagttacatacaaatgcccactcatagcagaagttgaacccgaagacatagattgttggtgtaatctcacaagcacttgggtgacgtatggtacttgtaatcaagctggggagcatcgacgagataaacgaagtgtagcattagctccacatgttggaatgggactggatactagaactcaaacatggatgtcagctgaaggtgcatggcgacaagtagaaaaagtagaaacatgggctctgagacatcccggatttactatcctggcgttatttttggcgcactacataggaacctctctcacacaaaaagtggtaatattcattctattaatgttagttaccccctcaatgacgatgcgttgtgtaggggtaggtaaccgtgactttgtcgaaggccttagcggtgcgacttgggttgatgtcgtattagaacatggagggtgtgtcactacgatggccaaaaacaaaccaacgcttgatattgagctgcagaaaacagaggcgacacaattagctaccttgcgtaaattatgcatagaaggaaaaattacgaatatcaccacggatagtagatgtcctacacaaggggaagccattctaccagaggagcaagaccaaaattatgtatgcaaacatacctatgtcgaccgaggatggggcaacggttgtggcctctttggtaaaggatcattagtcacttgtgcgaaatttcaatgtctggaaccgatagaaggtaaagtagtacaatacgagaatctaaaatatacagttataattacagtacacacaggagaccaacaccaagtagggaacgacacacaaggagtaaccgttgaaattacaccacaggcttcgaccgttgaagcagttttgccagaatacggaactttgggtttagaatgcagtccccggaccggtttagatttcaatgaaatgattctattaaccatgaaaaataaggcttggatggtacatcgacaatggttctttgatttgccacttccatggaccagtggggcaaccacagaaacccctacctggaatcgaaaagaattattagtaacctttaaaaatgctcatgccaagaaacaagaggtcgttgttctcggaagtcaagaaggagcaatgcacaccgctctgacaggagctaccgaaattcaaaacagcggcggtacatcaatcttcgctgggcatctgaaatgcagacttaaaatggataaactagaattaaaaggtatgtcatatgcaatgtgtctaaacacattcgtccttaagaaagaagtgagtgagacgcaacacggtacaatactaataaaagtggaatataaaggtgaagacgcgccctgcaaaattccatttagtaccgaagacggacaaggaaaagcgcacaacgggcgacttataacggccaatcctgtagtcacgaagaaagaagaaccggtaaacatcgaggcagaaccaccctttggagaaagtaatattgtcataggtattggcgacaaagcgttaaaaatcaactggtacaagaaaggttccagtattggcaaaatgtttgaagctacagccagaggagctagaagaatggctatattgggtgatacggcttgggatttcggatcagttggtggagtattgaacagtctaggaaaaatggtacatcaaatttttggatccgcatacacagctctgttctcgggggttagctggatcatgaaaattgggatcggagtgctattaacatggattgggctaaattcgaaaaatacatcaatgagttttagttgtatagttatcggaataataacgctttatctgggtgcagtagtacaagccgatatgggatgcgtgattaactggaaaggaaaagagttgaagtgcggttcaggtatttttgtgaccaacgaagtacacacctggacggaacaatataaattccaagcagacagtccaaaacgtctggcaaccgcaatagccggggcatgggaaaatggcgtctgcggaataagatccaccactagaatggaaaatttattatggaaacaaatagccaatgaactaaattacatactctgggagaataatattaaactaacggttgtagtaggggatataataggagtcctcgagcaaggaaaaagaacgctaaccccacaaccaatggaactgaaatatagctggaaaacgtggggaaaggctaaaatagttactgcagaaactcaaaactccagttttattatagatggtcccaacacacctgaatgtccaagtgcttctagagcatggaatgtgtgggaagtcgaagactacggatttggagtctttaccaccaatatatggttaaaactacgagaagtatacacacaaagttgtgatcaccgcctgatgtcagcagcaattaaagacgagcgagccgtacacgccgatatgggttattggatagaatcacagaaaaatggatcgtggaaattggagaaggccagctttattgaagttaaaacatgtacgtggccaaaatcacatacgttgtggtcaaacggagtactcgaatccgacatgattattccaaaaagtctagctggcccgatatctcaacataatcatagaccaggatatcatacacagaccgctggaccctggcaccttgggaaattagaattggacttcaattattgcgagggaaccactgtagttattactgaaaattgtgggactcgaggtccaagtctcagaacaacgactgttagtggcaaactaatccatgaatggtgctgtaggtcatgcacacttccaccattacgatacatgggtgaagatggttgctggtatggaatggagatcaggcctatcaacgagaaagaggagaatatggttaaatctttggtgtcagcaggctcaggcaaggtagataatttcactatgggtgtcctatgtcttgccatcctatttgaagaggtaatgcgtggcaaattcgggaagaaacacatgatcgccggtgtactatttacattcgttcttctgctaagtggacagattacttggagggatatggcacacactctaataatgattggctctaacgccagtgatcgtatgggaatgggagtaacgtatcttgcgctaattgccacctttaaaatacagccgttcctagcgttagggttctttcttagaaagctaacctctcgggaaaatttgttattgggcgtaggactcgcaatggcaacaactctacagcttccggaagatatcgaacaaatggcaaacggtatagcgctaggattaatgactctcaaactaattacacaatttgagacatatcaattgtggacagcattggtgtcgcttacatgtagtaatacaatttttactttaacggttgcatggcgaacagctacacttatccttgcaggggtgtcactactaccactctgccagtcaagctcgatgcgaaaaacagattggctaccgatgacagtagctgccatgggagtaccacctctacctttgtttatcttctcgttaaaagataccccgaaaaggaggagctggcctctcaacgagggagtaatggcggtaggcctagttagcatacttgcatcttccctcctgagaaacgatgtccccatggcaggcccgcttgtcgctggtggattactgattgcctgctacgtaataactggcacgagtgcggatctgaccgtggagaaagctgctgacgtcacatgggaggaggaagcggaacaaacaggtgtcagccataatctgatgataacagtggatgatgacggtacaatgaggataaaagatgatgaaactgaaaacattcttacggtattactaaaaacagccttactgatagtcagtggggtattcccatattcaatacccgcaactctactcgtatggcatacgtggcaaaaacaaacccaaagatcaggagttctatgggatgtgccgagtccgcctgaaacgcaaaaagcagaactggaggaaggagtatatagaataaaacaacagggcatattcggaaaaacacaagtcggcgttggcgtacagaaagagggtgtattccatacgatgtggcatgtaacacgtggagctgttttaactcataatggcaaacgcttagaacctaattgggcgagtgtcaagaaagatctcatatcctacggtggtggatggcgactctctgcgcaatggcaaaaaggcgaggaagtacaagttatagctgtagaacccgggaaaaaccccaaaaactttcagacaatgcctggaatatttcagacgaccaccggcgaaataggagcaatagccctagattttaagccaggtacttccggctcgccgatcataaatcgtgaggggaaagtagttggcttatacggaaacggagtcgtaacgaaaaatggaggctatgtttcaggtatcgcacaaacgaatgcggagcctgacggaccgactccagaactagaagaagaaatgttcaaaaagagaaacctcacgatcatggaccttcatccagggagcggaaagacaagaaagtacttgcctgcaatagtcagggaagcaataaaaagaagactaaggactttaattttagcacctaccagggtagtagctgcagagatggaagaagccttaaaagggttgccgatcagataccaaacgactgcaacgaaatctgaacataccggaagagaaatcgtagatcttatgtgtcacgccaccttcactatgcgcttattaagtccagtaagggtgccaaattacaacctaattataatggatgaggcacactttacagacccagcatcgattgcagcaagaggatatatttcaacccgcgttggtatgggtgaggcagcagcaatatttatgacggcaactcctcctggcaccgcagaggcttttcctcaatcaaacgcgccaatacaggatgaagaaagggatataccggaacgatcgtggaactctggcaatgaatggataactgactttgttggaaaaacggtttggtttgtaccatcgataaaagcaggcaacgacattgcaaactgtttaaggaaaaatggaaagaaagttatacagttaagtcgaaaaacatttgatacagaatatcagaaaacaaaactaaatgactgggacttcgtagttacaactgatatttcagaaatgggggcaaattttaaagcagatcgggttattgatccccgcagatgtctaaaaccagtgatcctgacagatggtcctgaacgggttatattggctgggcccatgccagtaactgccgcctctgccgcacagcgcaggggaagggtcggaaggaatcctcaaaaagaaaatgatcagtatatatttactggccaaccattgaacaatgatgaagatcatgctcattggactgaagccaaaatgctacttgataatattaacacaccagaaggaataattcccgctctgtttgaacccgaaagagaaaaatccgctgccatcgacggagagtacagattaaaaggggaatccagaaaaacgttcgtagaacttatgaggcgcggcgatctaccagtatggttggcacacaaggttgccagcgaaggtattaagtataccgatcgaaagtggtgtttcgatggtgagcgcaacaaccaaatactagaggaaaatatggatgtagagatatggacaaaagaaggtgaaagaaagaaactacgaccgaggtggttagacgcccgaacatattccgacccattagcgctgaaggaatttaaggattttgcagcagggaggaaaagcatagcactggacctagtaacggagattggcagagtaccctctcatctagcttacagaactagaaacgcgctagataaccttgttatgttacacacgtcagaacatggaggccgtgcttatagacatgctgttgaagaactaccggagaccatggaaacacttcttctgctgggtctaatgatcttattgacaggaggtgccatgttgttcttgatctcaggaaaaggcatcggaaaaacttcaattggtttaatatgtgtcattgtaagttcagggatgttatggatggcagatgtgcctttacagtggatagcaagcgctattgtattagagttctttatgatggttcttctgatcccagaacctgaaaagcaacgaacacctcaagacaaccaactggcgtacgttgttattggaattttaacactagctgcaatagtggctgcaaacgaaatgggattgttagaaacaacaaaacgcgatctaggaatgtcgaaagagccaggggtggtatcccccacgtcctacttagacgtagacttacatccagcttcagcttggacattgtatgccgtagcaactactgtaataacgccgatgctaagacatactatagaaaattcgactgcaaatgtctcgttagcagcaatagcaaaccaggcagtcgttttaatgggtcttgacaagggatggcccattagtaaaatggatcttggggtaccattgttggctctgggatgttacagtcaggtcaatccactcacgttaactgctgcggtcttactactggtcactcactatgcaataattggtcctggactacaagcgaaagcgacccgagaagctcaaaagcggacggcggcaggaataatgaaaaatccgacagtagatggaattatgacgattgatctcgaccctgtaatttacgattccaagtttgaaaagcaattgggtcaagtaatgttacttgtattgtgtgccgtacagttattgctcatgagaacgtcctgggcactgtgtgaggctcttacactagctacggggcccataacaactttgtgggaaggatctccaggcaaattttggaatacaaccatagcagtctctatggccaacatatttaggggctcttatttagctggtgcaggattagcattttcaataatgaaatcagtaggtacaggtcggagaggaacaggatcccaaggagaaacattaggagaaaagtggaagaagaaattaaaccaactgtcacgtaaggaatttgacctatacaagaagagtggcataactgaagtagatagaacggaagctaaagaaggacttaaaaggggagagactacacatcatgcagtctcaaggggatctgcaaaattacaatggtttgttgaacggaatatggttatacctgagggtagagttatagaccttggatgtggaagaggtggatggtcatattactgtgctggacttaaaaaggtaacggaagtaagaggatacaccaaaggtggaccaggtcacgaagaacccgtaccaatgtcaacttacggttggaatatcgtaaagttaatgagtgggaaagatgttttctatctaccacccgaaaaatgtgatactcttctttgtgacataggagagtccagtccgtcccccacggtggaagaatctcggacgatacgagtactaaaaatggtagaaccttggcttaagaacaaccaattttgtattaaagttttgaacccttacatgccaaccgtaatagaacatctggaaaggctacagcgtaaatacggtggaatgttggtgagaaaccctttgtctcgaaacagcacgcatgaaatgtactggattagtaatggtacggggaacattgttagtagcgtaaatatggtgtcaagattattgttgaataggtttacaatgactcacaggcgacccacaatagaaaaagatgttgatttaggggcgggtacaagacacgtcaacgcggaacctgagacgccaaatatggacgtaattggcgaaagaataaaacgaataaaagaagaacacagttcaacatggcattacgacgacgaaaatccatataagacatgggcttatcatggaagttacgaagtaaaagcgactggtagtgcctcaagtatgattaacggagtagtaaaactattgacaaagccctgggatgtagtaccaatggtgacgcaaatggcaatgacagacaccactccttttggtcaacaacgagtcttcaaggaaaaagtagacacccgcacaccaagaccaatgcccggtacaagaaaagtaatggaaattacagccgagtggctttggaggacgttaggtcgaaacaagaaacctaggctatgcactagagaagaatttacgaagaaagtccgaactaatgctgctatgggtgccgtattcacagaagagaaccagtgggattctgctcgagcggcggtagaagatgaagaattttggaagctggtggacagagaacgagagttacacaaattaggcaaatgtggaagttgcgtatataacatgatgggcaaaagagagaagaaactgggagagttcggtaaagctaaaggaagccgggcaatttggtatatgtggttgggtgctagatatctagaatttgaagctctcgggtttttgaacgaagatcattggtttagtcgggaaaattcatatagtggagtagaaggagaaggattacacaaattagggtacattttgagagacataagcaaaataccaggtggagcaatgtacgctgatgacacagctgggtgggacactaggataacagaagacgatttacacaacgaagagaagatcactcaacaaatggatccggagcatagacaattagcaaatgctatatttaaattaacataccaaaataaagtcgtaaaagtacaaagacctactccaaaaggtactgtaatggacattataagcagaaaagatcaaaggggatcaggtcaagtaggaacatacggtctaaacacctttaccaatatggaagcacagctagtacgtcaaatggagggagaaggagtccttagcaaggcagatttagaaaatccgcaccttcttgagaagaaaataactcagtggcttgaaaccaagggggtcgagagattgaaacgaatggctatatcaggtgatgactgtgtagtaaaacctatcgacgaccgatttgcgaatgcgttactggcactaaatgatatgggaaaggtaagaaaagacataccacaatggcaaccaagcaaaggatggcatgactggcaacaagtaccattttgttcgcaccattttcatgaattgattatgaaagatggacgaaaattagtagtcccttgtcgacctcaggatgagttgatcggtagagctaggatcagccagggagcgggttggtcattaaaagaaaccgcatgcttggggaaggcatacgcccaaatgtggagccttatgtattttcatcgtcgggatttgcgtctagcgtcaaacgccatatgctctgcagtccccgttcactggattcctacaagtcgaaccacatggagtatacacgcacaccatcaatggatgaccactgaagatatgctaacagtctggaacagagtgtggatagaagacaacccttggatggaagataaaacaccagtgacaacttgggaagatgttccctatttaggtaaacgcgaggatcaatggtgcggaagtctcattggcctcacttcacgtgcaacatgggcgcaaaatatattaacggcgatacagcaggtaaggagtttaattggtgatgaagaatttctagattacatgccgtctatgaaacgttttagaaaagaagaagaaagtgaaggtgctatctggtaa

SEQ ID NO: 23484 - RNA, 9873 nt, synthetic construct
  misc_feature 1..9873: note = derived and/or modified CDS sequence (opt6) from DENV-3__KF955457__SS-prME
  source 1..9873: mol_type = other RNA
acctcactatgccttatgatgatgctacccgcaacgttggccttccatttaacgtcccgagatggagaacctagaatgattgtaggcaaaaatgaacgcggaaaatcattattattcaaaactgcaagtggaattaatatgtgtaccctaatcgctatggacctaggagaaatgtgcgacgacactgtaacctacaaatgcccattaatagctgaagtagaacccgaagatattgattgttggtgtaatctaacgagtacttgggttacatacgggacgtgcaaccaagccggagaacatagaagggacaaaagatccgtagcgttagcaccacatgtaggaatgggtctggacactcgtacacagacttggatgtccgcggaaggagcatggaggcaagtagaaaaagtagaaacatgggcgttaaggcatcctggtttcactatattagctctatttctagcgcactatattggcaccagtttaactcagaaagtcgttattttcattttactaatgctcgttactcctagcatgactatgaggtgcgtcggagtaggtaatcgcgactttgtcgaaggactatcaggcgccacgtgggtggatgtcgtccttgaacatgggggttgtgtcacgacgatggccaaaaacaaaccaactttggatatagaattacagaaaactgaagcaacacaactagcaacactaagaaaactatgtatagaggggaaaataacaaatataactactgattcgaggtgcccaactcaaggcgaagcaattctacccgaagaacaagaccaaaactatgtatgtaaacatacttacgttgacagaggttggggtaatggatgtggactgttcgggaaagggtctttagtaacatgcgcgaaattccagtgtctagaaccaatagagggaaaagtagttcaatatgagaatttaaaatacactgtcatcataaccgtacatacgggagaccaacaccaagtaggtaatgacactcaaggtgctacggtagaaatcactccacaggcttcaactgtcgaagcagtacttccagaatatggaacattgggcttagaatgcagccctaggaccggtctcgactttaatgaaatgatattattaactatgaaaaataaagcctggatggtacatcgccaatggtttttcgacttaccgttgccatggacttctggagcaacaacagagacaccaacatggaatcgtaaagaactattggtcacgtttaaaaacgcacatgccaagaaacaggaggtagtggtattaggatcacaagaaggtgcaatgcatacggcgcttacaggagctacagaaattcaaaatagcggtggaacgagcatttttgcagggcatctaaaatgtcgattaaaaatggacaaactagagctaaaaggtatgtcatatgcaatgtgtcttaatacatttgtactcaagaaagaggtatcagaaacccaacatggaaccatcctaataaaagtggaatataaaggtgaagacgcaccgtgtaaaatacccttttctactgaagatggacaaggaaaagcacataatggtcgattaatcactgcaaacccggtcgttacgaagaaagaagaacccgtaaatatcgaagccgaacctccatttggggaatccaatattgtcatcggtattggggataaggctttaaaaattaactggtacaagaaaggatcaagcattggtaaaatgtttgaagctacagcgcgtggggccaggcgaatggcaatccttggtgacactgcatgggattttgggtcagtaggaggagtcctaaactccttaggtaaaatggttcaccagattttcggttccgcctatacggctttattcagcggagtttcatggattatgaaaatcgggatcggggtgctattaacgtggataggactgaacagcaaaaatacaagtatgagctttagttgtatagtcattggtatcataactctatatttaggcgcggttgtacaagccgacatgggctgtgcaataaattggaaaggaaaagaattaaaatgtggaagcggtatatttgtaacaaacgaagtccatacttggacagaacaatacaaatttcaagccgattcaccaaaacgactcgccacggctatcgccggagcctgggaaaatggagtatgcggaataagaagtacaacacgaatggaaaacttgttatggaaacaaatagcgaatgaactcaattacatactatgggaaaacaatattaaactgacagttgttgttggcgacattataggggttttagaacaaggaaaacgaacattaacgccacaaccgatggaactaaaatacagctggaaaacttggggaaaagcaaaaattgttacagctgagacgcaaaacttcagttttataatagatggaccaaatacccctgaatgtccaagtgcatcgagagcgtggaatgtgtgggaagtggaagattatggcttcggagtttttacaacgaatatatggctgaagttacgtgaagtctatacccaaagttgcgaccaccgtcttatgagtgcagcaataaaggatgaaagagcagtacatgcagatatgggttactggatagaaagtcaaaagaatggttcatggaagttggaaaaagcgagtttcatcgaagtgaaaacttgcacgtggcccaagtctcatactttatggagtaatggtgtactggaaagcgacatgatcattccaaaatcacttgccggtcctatctctcaacataaccataggcccggatatcacacccaaaccgcaggtccatggcatttaggtaaattagaactagacttcaactactgcgaaggaacaacagtagtcattacggaagattgtgggacacgaggaccaagtttaagaactactaccgtaagtggcaaactaattcatgaatggtgctgccgctcatgcacattacctccacttagatatatgggtgaagacggttgctggtacggaatggaaattagaccaatcaatgaaaaagaagaaaacatggtaaagagcttagtgtcagcgggttcggggaaagttgataacttcacaatgggcgtactatgcttggcaattttatttgaggaagttatgagaggcaaattcggcaagaaacatatgatcgcaggagtactatttactttcgtactcctactttccggacaaatcacatggcgagatatggctcacacccttataatgattggaagcaacgcatcagatcgaatgggtatgggtgtaacatatctggctttaatagcgacgtttaaaatacagccgttcctagctttaggtttctttttacgaaaactgacaagccgtgaaaatttactattaggagttggattggccatggcgacgacattacaactacctgaagatattgaacaaatggcgaacggaatagccctaggtcttatgactttgaaattgattacacaatttgaaacttatcagctttggacggccctagtatctttaacatgttcaaacacaatattcactctgacagtagcatggcgtaccgctactctaatactggcaggagtatcacttctaccactttgccaaagcagttcaatgcgaaagactgattggcttccaatgaccgtagccgcaatgggtgttcccccactccctttatttattttctccctaaaagacacccccaaacgaagaagctggccattaaacgaaggtgtaatggcagttggattagttagtatactggcaagttcacttctcagaaatgatgtcccgatggcgggtcctttagtagccggaggattactaatcgcctgttatgtcataacaggaacttctgcagacttgactgtggaaaaagctgccgatgtcacgtgggaggaagaagcagagcaaactggtgtcagccataatctaatgataacagttgatgacgacggcacgatgcgaattaaggacgatgaaacagaaaatatactcactgttcttctaaaaaccgctttattgatagtgagcggaatattcccatattctattccagcaacattattagtctggcatacgtggcaaaagcagacccaaagaagtggggtattgtgggacgtaccttcaccaccggaaactcagaaagcggaattagaggaaggggtatacaggatcaaacaacaaggcatatttggaaaaactcaggtcggcgttggtgtacaaaaagaaggggtatttcacacaatgtggcatgtaactagaggcgcggtattaactcacaacggaaaaagacttgaaccgaactgggctagtgtcaagaaagatctaataagttacggcggtggatggaggctgagcgcacaatggcaaaaaggcgaagaggtacaagtcattgcggtagagccaggcaaaaatccgaaaaatttccaaaccatgccagggattttccaaacaacaactggagaaattggagctattgctctggatttcaaaccaggtacatccgggagccccattatcaatagagaaggaaaagtggtaggtctatatggcaatggcgtggtaacaaagaatggcggatacgtatcgggaatagctcagaccaatgcagaacccgatggaccaacaccagaactagaagaagagatgttcaaaaagagaaaccttaccataatggacctgcaccccggcagtggcaaaactcgaaaatatttacccgctattgttcgagaggcaataaagcgaagactccgaacacttatattagcccctacaagggtagtagccgccgaaatggaggaagccctaaagggcttacccatacgatatcaaaccactgcgaccaagtcggaacatacaggtagggaaatagtagatcttatgtgccacgccacatttactatgcggcttctaagccctgttagagtacctaactacaatttgattataatggatgaagctcactttactgacccagctagtatagccgcgagaggttacatatcgacgcgagtaggtatgggcgaagctgccgctatctttatgacagcaactccacccgggactgcagaggcttttccccagtcaaacgcacccatccaggatgaggaacgagacatcccggaaagaagctggaactcagggaatgaatggattactgatttcgttggtaaaaccgtctggttcgtaccgtcgattaaggctggaaacgatatagctaattgtttacgcaagaacggcaagaaagttatacagttaagccgcaaaactttcgatacggagtatcaaaagaccagactaaatgactgggattttgtagtaacaacagatatatctgaaatgggagccaatttcaaagcggacagagtaatagaccccagaagatgcctgaagcctgtgatcttaacagatggacccgagcgagttatacttgctggtccaatgccagttacggcagcatctgcagcccagagaagaggcagagtgggtaggaatccccaaaaagagaatgatcaatacatattcacaggacagcccctaaataacgacgaagatcatgcacattggactgaagcaaaaatgcttctagacaatatcaatactccagaggggatcattcctgccctctttgagccagaaagagagaaaagtgcggccatagacggtgagtataggttgaaaggcgaaagcaggaaaacttttgttgagttaatgcgacgaggagatttacctgtatggcttgcacataaagtagcttcggaaggtatcaaatatacagatcgtaaatggtgttttgacggagagcgcaataaccaaatattagaggagaatatggatgtggagatctggacgaaggaaggtgaaaggaagaaactgagaccaagatggttggatgctcgaacatattctgaccctttagcgctaaaggaatttaaggactttgcggcgggtagaaaatcaatcgcattagatctggtaaccgaaattggaagggtgcctagtcatctggcatacagaacccggaatgcgttggacaacctagttatgctccatacaagtgaacacggcggccgagcttacagacatgcagtagaagaactcccagaaactatggagactttactgttgctcggacttatgatattattgactggcggtgccatgttatttctaattagtggaaaaggcatcggaaagacgtcgataggattaatatgcgtaatagtaagttcaggtatgctttggatggcagacgtaccattacaatggatagcaagtgcaattgtcctggagttctttatgatggtgttactcatacccgagcctgaaaagcaaagaacaccacaggataatcaactagcatatgtagtaataggtattttaactttagcagccattgtagcagccaatgaaatgggtctactagaaacgacaaaaagggatctaggcatgagtaaagaacctggggtagtttctccaacaagctatttggatgtagacctacatccggcaagtgcgtggacactatacgctgtcgcgactacagtaataaccccaatgctacggcataccattgagaacagtaccgcaaacgtatcactagcagctatagcaaatcaggctgtagtgctaatgggactagacaaaggatggccaataagcaaaatggatctaggtgtcccattactcgctctagggtgttactcacaagtaaatcctctaacactaaccgcagctgtactccttctggttacccattacgctattataggaccagggcttcaggcgaaagctacccgcgaagcccaaaaacgaacagctgctgggatcatgaaaaatcccacagtagacggaattatgacaatagatctcgaccccgttatatacgactcgaaatttgaaaaacaattaggtcaagttatgctcctagttttatgtgctgtgcaacttttattaatgaggacttcttgggcgctctgtgaggcacttaccttagcaacgggaccaatcacgacattgtgggaaggcagtccaggtaaattttggaatacaacaatagctgtttcaatggcaaacatatttagaggctcttaccttgcgggcgcagggctagctttctccatcatgaaatccgtgggcacaggccgaagaggaaccggatctcaaggtgaaactttaggggagaagtggaagaagaaattaaaccaattaagcagaaaggagtttgatttatataagaaaagtggcataacggaagtagatcgaacggaagctaaagagggactaaagcggggagaaacgacacatcacgctgtgagcagaggaagtgcaaaacttcaatggttcgtggacagaaatatggtaattccagaaggaagagtaatagacctaggttgtggacgaggtggctggagctattattgtgcgggactaaagaaagtaacagaggtacggggttatactaaagggggacccgggcacgaagaaccggtgcctatgagtacctatggatggaatctagtgaaactcatgagcggtaaagatgtcttttatcttccgcctgagaaatgtgacactctcctgtgtgacatcggagaatcctctccgtctccaacagttgaagaaagtagaacgatacgggtattaaaaatggtagagccatggttaaagaacaatcaattctgcattaaagtacttaacccatatatgcctacagtaatagaacatctcgaacggttgcagcgcaagtacggcggcatgctagtgcgaaacccactttctagaaattctacccacgaaatgtactggatctctaatggaacaggaaatatagttagttcagttaatatggtatctagattgttattaaacagattcacaatgactcacagaaggccaaccatagaaaaagacgtggacctcggagccggaacacgacacgtcaacgcagaacccgaaaccccgaacatggatgtgataggagaacgaattaaaaggatcaaagaggaacactcctcgacttggcattatgacgacgagaatccgtataaaacctgggcgtatcacggtagttatgaagtaaaagctactggatctgcaagttcaatgattaacggtgttgtaaaactccttaccaaaccctgggatgttgttcccatggtaacgcaaatggcgatgactgatactacaccattcgggcaacaaagagtctttaaagagaaagtagacaccaggactcctagaccaatgccaggaacacgaaaggtaatggaaattacagcagagtggctttggagaacgttaggtagaaataagaagccccgactctgtacccgagaggagttcaccaagaaagtaagaaccaacgctgctatgggtgcagtcttcactgaagaaaaccagtgggacagcgccagagcagctgtagaggatgaagaattttggaagctagtagatagagaacgagagctacataaactcgggaaatgcggctcatgtgtttataacatgatgggtaaaagggaaaagaaacttggtgaatttgggaaagcaaaaggcagtagggccatctggtatatgtggctcggcgcaagatacttagaatttgaagctctggggttcttaaacgaagatcattggtttagtagagaaaattcatattcaggagtggaaggggagggcctacataaactaggctatatactacgagacatatcgaagattcctggaggagcaatgtacgctgacgacactgcaggctgggatactcgtataacagaagatgacttacataacgaggagaagattacccaacaaatggatccagagcatagacaactagccaatgctatttttaagctcacttatcaaaataaagtggtaaaagttcaacgaccaactcctaaaggaacagtcatggatattataagtagaaaagatcagcgcgggagtgggcaggtaggtacttacggattaaatacatttacaaatatggaagctcaattagtgagacagatggaaggtgaaggagttttatcgaaagcggacctcgaaaatccccatctactagagaagaaaattactcaatggttggaaacaaaaggggtcgaacgtctcaagaggatggctatttctggggacgactgtgttgtaaaaccaattgatgaccggtttgcgaatgccctattagctctcaacgatatgggaaaagtaagaaaggatataccccaatggcaaccctccaaaggctggcacgattggcagcaagtgcccttctgttcacatcacttccatgaactcataatgaaagacgggagaaaattagttgtaccctgtaggccgcaagatgagcttattggtcgcgcacgaataagccaaggagcaggatggagtcttaaggaaactgcctgtttaggtaaagcgtacgcgcaaatgtggtcattaatgtatttccataggcgcgatcttcgactagcaagtaatgccatttgtagcgcagtaccagtgcactggataccaacaagtagaacaacttggtcaatccatgcgcatcatcagtggatgacgacagaagacatgttaacggtttggaatagagtatggatagaagataacccatggatggaggacaaaacacctgtgacaacctgggaagatgtcccatatttagggaaacgtgaagatcaatggtgtggctcactaataggattaacatccagagcaacatgggctcaaaacatcttgacagcaatacaacaggtaagaagtctcataggggatgaagaatttcttgactacatgccctctatgaagagatttaggaaagaagaagagagcgagggcgctatttggtaa

SEQ ID NO: 23485 - RNA, 9873 nt, synthetic construct
  misc_feature 1..9873: note = derived and/or modified CDS sequence (opt6) from DENV-3__FJ562100__SS-prME
  source 1..9873: mol_type = other RNA
accagtctctgccttatgatgatgctccctgcaactttagcatttcacttaaccagtcgggatggagaacctcgaatgattgtaggtaaaaacgaaaggggaaaatccttattattcaaaactgcctcaggaataaatatgtgtactctgatagcgatggatcttggcgaaatgtgtgatgatacggtcacgtataaatgtcctttaatagctgaagttgaaccagaagacattgattgttggtgcaatttaacatcaacttgggtcacttatggcacgtgtaatcaagcaggagaacatcgtagggataaacgttcggtagctctagccccacatgtaggaatgggcttggatactcggacgcaaacttggatgtctgcggaaggggcgtggcgacaagtagaaaaagttgaaacatgggctttaaggcatcctgggtttacaatattagctcttttcctggcgcattacattggtaccagtctaacccaaaaagtggtaatattcattctgttgatgttagtaacacctagtatgacaatgaggtgtgtaggagtaggcaaccgcgattttgttgaaggactctcgggagcaacttgggttgacgtggtgcttgaacacggaggatgcgttactacgatggccaaaaataaaccaacgttggatatcgaattgcagaaaaccgaagccacccaactagctacacttagaaaattatgcatagaaggtaaaataactaatataacaacagactcacgctgccccactcaaggcgaagccattcttccagaagaacaagatcaaaattatgtctgtaaacatacttatgtagatagagggtggggtaacggctgtggactgttcggaaaaggaagtctggttacctgcgcaaaatttcaatgccttgaaccgatagaagggaaagtagtccaatatgaaaatctgaaatacaccgttatcattacggttcatactggagaccaacaccaagtaggcaacgacacacaaggcgttacagtggaaattacaccacaagcgagtactgtggaagcaatattaccagaatatggtacattagggttggaatgttcgcccaggacaggactggacttcaatgaaatgatattactaacaatgaaaaataaagcatggatggttcatagacaatggttctttgatttaccactgccctggactagcggcgctacaaccgagactccaacttggaatcgtaaagaattattagtgaccttcaaaaacgcccacgccaagaaacaagaggtagttgtgctaggatcgcaagaaggcgcgatgcacacagcacttactggcgcgacggaaatacaaaatagtggcggtacttccatattcgcaggacatttaaaatgcagattaaaaatggacaaattagagctcaaaggtatgtcctatgctatgtgtttgaatacatttgtactaaagaaagaagtttctgaaacccagcatggtacgatattaattaaagtggaatataaaggagaagatgcaccttgtaaaattccatttagtacggaagatggacagggaaaagcccataacggacgcttaattacggcaaacccagttgtaacgaagaaagaagaaccagtaaatatcgaagctgaacctccattcggggaaagtaatatcgttatcggtataggcgacaaggctttaaaaataaattggtataagaaaggtagttctatcggtaaaatgtttgaagcgacagcaagaggggctcgcaggatggcaatcctcggggacaccgcatgggactttggatctgtgggaggcgtattaaattctttaggaaaaatggtacaccaaatattcggttcagcgtatactgctctatttagtggagtgagctggataatgaagatcggaataggagtattattgacgtggataggcttaaactctaaaaacacaagcatgtcgtttagttgtatcgtaatcgggattattactttatatttaggagctgttgtgcaggcagatatgggctgcgctataaactggaaggggaaagaactaaaatgtggaagcggtatatttgttactaatgaggtacatacatggactgaacaatataaattccaagctgactcccctaaacgactcgccactgctatagccggtgcgtgggaaaacggggtttgtggtataagatctactactcgaatggaaaatttgttatggaagcaaatcgccaatgagttaaattatatattatgggaaaacaatataaaactgactgtagttgtcggagatattattggtgtgttggaacaagggaaacgtaccttgacacctcagccgatggaattaaaatattcttggaaaacttggggtaaagccaaaattgtgaccgccgaaacacaaaattcatcctttataatagacggtccaaacaccccagaatgcccttccgcttccagagcctggaatgtatgggaagtagaagactatggatttggagtgtttacaacaaatatttggttaaaacttagggaagtctacactcaaagctgcgatcatcgccttatgtctgcagctattaaggatgaacgtgcggtccatgctgacatgggttattggatagaatcgcagaaaaatggatcatggaaactagaaaaggcatcgtttatcgaagtaaaaacatgcacatggccaaaatctcataccctgtggtctaacggagttttagagtccgatatgatcataccaaaatccctagcagggcctattagtcaacataaccacagaccaggatatcatacacaaaccgctggtccgtggcatcttggcaaattagaactggattttaactattgtgaaggtacaaccgtggtcatcacagaaaattgtggaacaagaggcccaagcctacgcacaactacagtgtcagggaagttgatccatgagtggtgttgtcgatcatgtacattgccacccctcagatacatgggagaagatgggtgctggtatggaatggagatccgaccaatcaatgaaaaagaagaaaacatggtaaagagcttagtatccgcgggatcagggaaggtggataattttacaatgggagttttgtgcttagctatattatttgaagaagttatgagaggaaaatttggaaagaagcatatgatcgccggagtattgtttaccttcgtattgttattatcaggtcaaatcacgtggcgtgatatggcccataccttaattatgatagggagtaacgcttcagatcgaatggggatgggagttacatacctagcactgatagcaactttcaaaattcaacccttcctagcacttggctttttcttaagaaaattgacaagtcgagagaacttattattgggtgtgggactagctatggcgacaacactacagcttcccgaagacatagaacaaatggccaacggaatcgcattagggctgatgacgttgaaacttattactcaatttgaaacatatcaattatggacagctttagtctccctaacgtgctcaaacactatatttactctaactgttgcttggcgtacggcaactcttatccttgcaggagtatctctattacctctctgccaatcctcctccatgcggaagactgactggctaccgatgactgttgcagctatgggagttcctccgctaccactatttatattttctctcaaagatacaccaaaacgcagatcctggccactcaacgaaggtgtaatggcagtaggccttgtttcaatactagcctcaagccttctcagaaatgatgttccgatggcaggacctttagtcgccggcgggctactaatagcatgctatgttataactggcactagcgccgatctaactgtcgaaaaagccgcagatgtgacgtgggaagaagaagcggaacaaactggtgtgtctcacaacctaatgatcaccgtggatgatgacggcaccatgcgtatcaaagatgacgaaacagagaacatattgacagtacttttaaagaccgcgttactgatagtctcaggtatctttccatactcaatcccggctacgttactcgtatggcacacatggcaaaaacaaacacagagatcaggtgttctatgggacgtaccatctccgcccgaaacacaaaaggctgaactcgaggagggggtatatcgaataaaacagcagggcattttcggcaaaacacaagtcggggtaggggtccaaaaagagggtgtatttcacacgatgtggcatgtgacacgtggtgctgtgttaacacacaacggtaaaagactcgaacccaactgggcgtcggtaaagaaagatttaatatcatatgggggaggatggcggctctcggcacaatggcaaaaaggtgaagaagttcaggtaatagcagtagaaccgggcaagaatcccaaaaattttcaaaccatgccgggaatctttcaaactaccacaggcgaaatcggtgcaattgctcttgattttaaaccaggtacaagtgggtcacccataatcaatagagaaggaaaagtcgtaggattatatggaaatggggttgttactaagaatggaggatacgtttctggaattgcacaaacaaatgcagaaccggatgggcccaccccggagttagaggaagaaatgttcaaaaagagaaacttaacaattatggacttgcaccctggtagtgggaaaacacggaaatatctgccggcaatagtaagagaagccataaagagaaggttgagaactttaatacttgccccgactagggtcgtcgctgctgagatggaggaggctttgaaaggtctgccaatcagatatcaaacaactgctacaaaatccgagcatacaggacgtgaaattgtagatcttatgtgtcatgcaacatttactatgcgacttttatcaccggttagagtaccaaactacaatctgattatcatggacgaagcccacttcacggacccggcaagtatagcagcacgtggatacattagtaccagggtagggatgggagaggctgctgccatcttcatgactgcaacaccaccaggcaccgccgaagcatttccccagagcaatgcgcccatacaggacgaggaaagggatatacctgaaaggagttggaatagtggaaatgaatggattaccgattttgtaggaaaaactgtgtggtttgttccatctataaaagcaggaaatgacatcgctaactgcctaaggaaaaatggtaaaaaggtgatacagctcagtagaaagacattcgatacagaatatcagaaaactaggttaaatgactgggattttgtggtaactacggatatttcggaaatgggagcgaattttaaggctgaccgtgtgatagacccgcgaaggtgtctaaaaccagttatcttgacagacgggccagaaagagttattctagctggcccgatgccagtaactgcagcctcagctgcacagagaagaggtagagtaggccgaaatccacaaaaggaaaatgaccaatacatatttaccggtcaacctctgaataatgatgaagaccacgcccactggacagaggctaaaatgcttcttgataatataaatacaccagaagggattatcccagctttgtttgaacctgaaagggagaagtcagcagccatagacggggaatataggttaaagggagagtctcgtaagacttttgtagagttaatgagaagaggagacctacctgtctggctggctcataaagtggcatcggaaggaataaaatacaccgatagaaaatggtgttttgacggcgaacgaaacaatcagattttagaagaaaacatggatgtagaaatctggactaaagaaggggagcgtaaaaagttaaggccaagatggcttgatgctagaacctattctgaccctttagctcttaaagagttcaaagatttcgctgctggtcgaaaatcaatagcattagaccttgtaaccgaaattggccgggtaccctctcatctagcttataggacaagaaatgcgctagataatttagtaatgctacatacgagtgaacatggaggaagggcatatagacatgcagtagaggaactaccggaaactatggaaactctcctactattggggcttatgatactactaaccggtggagcaatgttatttttgatctctgggaaagggataggaaaaacaagtatcggattaatatgcgtaactgtctcatcgggaatgttatggatggcggacgtccctctccaatggatcgcatctgcaatcgttctagagttctttatgatggtacttcttattcctgagcctgagaagcaaagaacaccccaagacaaccagttagcgtacgtagttatcggcattctcacacttgcagctatagtagcagcgaatgaaatgggtttattagagacaacgaaaagggatctaggaatgagtaaggaacctggcgtagtctctccaaccagttatctggatgtcgatttacatcctgcatccgcctggacattgtatgcagtagccacaaccgtaataacgcccatgctaaggcacactattgaaaatagtacagccaatgtatcattagctgctatagcaaatcaagcagtagttctaatgggattagacaaaggctggcctataagtaaaatggatttaggagtccccctactagcattaggttgttactcacaagttaacccacttacactaacggcagccgtattactcttagttacccattacgccataattggacctggtttacaagcaaaagctacacgtgaggcccagaaaaggactgccgctggaattatgaaaaatcctacggtagatggtattatgactatagatttagatccagtcatctatgactcgaaattcgagaaacaacttggacaagtaatgctcttagtactatgtgcagtccaattgttattaatgcgcacgtcatgggcactttgtgaggcacttaccctagcgacggggcctataacaactctgtgggaaggttcgccagggaagttttggaacacaacgatagcggtaagcatggctaatatatttcggggatcatacttggcaggcgcaggactagccttttctattatgaaatcagtgggcacggggcggagaggcacaggttctcagggagaaacgcttggtgaaaagtggaagaagaaattgaatcagttatctagaaaagagttcgatttgtacaagaaatcaggcattaccgaagtggataggacagaagctaaagagggtttaaagcgcggtgagaccacacatcatgcggtgtctagaggtagcgcaaaactccaatggttcgttgaacggaacatggtaattccggaaggaagagtaatagatttaggctgtggacgtggtggttggtcttactactgtgcaggattaaagaaagtgaccgaggtacgaggttatactaaaggaggtccaggacacgaagaaccagtacccatgagtacatacggatggaatctagtaaaactaatgtctgggaaagacgttttctatctgccaccggaaaaatgtgataccctactttgcgatataggtgaaagttctccaagccctacagtagaagaatctcggaccataagagtcttaaaaatggtagagccctggttgaaaaataaccaattctgcatcaaagtgttgaacccgtacatgcccactgttattgaacatttagaacgtctccaaagaaaatatgggggaatgctagtacgaaatccactttcaaggaatagtacccacgagatgtattggatatcgaacgggacaggtaatatagtgagtagcgtaaatatggtaagtagactccttctaaaccgctttactatgacacacaggcggccaacaattgaaaaagatgtcgacctcggcgccggaacacgccatgttaacgccgaaccagagacacccaacatggatgtgataggcgaaagaataaaacgcataaaggaagaacacagctcgacctggcattatgatgacgaaaatccgtacaaaacatgggcgtaccatggatcgtatgaagtcaaggctacaggtagtgcttcttcaatgattaacggggtcgtaaaattacttacaaaaccatgggatgtagtgcctatggttacacaaatggcaatgacagatacaacaccattcggacaacagcgcgtatttaaagagaaagtcgacacccgcacaccgcgaccgatgccaggaacaaggaaagtaatggaaataacagcagaatggctctggcgaacattgggcagaaataagaaaccaagactgtgcacaagagaagaatttactaagaaagtaagaactaatgccgcaatgggtgctgtttttacggaagaaaaccagtgggacagtgctcgagctgcagtagaagatgaagagttctggaagctagtggatagagagcgtgagctccacaaattaggtaaatgtggatcgtgcgtatacaatatgatgggtaaacgtgagaagaaactcggtgagttcggaaaggctaaagggtcaagggctatatggtatatgtggttgggggcaaggtaccttgaatttgaggcgctagggttcttaaacgaagaccattggttcagcagggaaaattcctattcgggcgttgagggggaggggttacacaaattaggatatatattgagggatataagtaaaataccaggtggtgccatgtatgccgacgacacagcaggatgggataccagaataactgaggatgacctacataacgaggaaaagataacacaacaaatggatcccgaacatcgtcaattagctaatgcgatatttaagttaacctaccaaaacaaagttgtaaaagtacagagaccaactccaaaaggaacggttatggacataatttctaggaaggatcaaaggggcagcggtcaggtcggaacttatggcttaaatacttttactaatatggaggcgcagttagtaagacagatggagggtgaaggagtactttcaaaagccgacctcgaaaaccctcacctacttgagaagaaaattacacaatggttagaaactaaaggagtggaaaggttaaaaagaatggcaatatccggggatgattgcgtcgtcaaaccaattgatgatagattcgcaaatgccttactagccctcaatgacatggggaaagtcagaaaggatatacctcaatggcaaccatcaaaaggctggcatgactggcaacaagtcccattctgttcccaccatttccatgaactcataatgaaagatggtagaaagttagttgtgccatgcagacctcaagatgagttaataggtagggcacgcataagtcagggcgctggctggagtctaaaagaaactgcttgcttgggtaaagcatatgctcaaatgtggtccttgatgtactttcaccgtagagaccttcggttagctagtaacgcgatatgcagtgcagttccagtacactggataccaacgtcaaggacaacatggagcatacacgcacatcatcaatggatgacaacagaggacatgttgactgtctggaacagggtgtggatagaggataacccctggatggaagacaagacaccagtgacaacatgggaagatgtcccatatcttggaaaaagagaagatcaatggtgcggaagtttaattgggttaacaagtagagccacatgggcgcaaaacatcctcacagctatacaacaggtaaggagtctgataggggatgaagagttcctagattacatgccatctatgaaacgcttcagaaaagaggaagagtcagagggcgcaatatggtaa

SEQ ID NO: 23486 - RNA, 9873 nt, synthetic construct
  misc_feature 1..9873: note = derived and/or modified CDS sequence (opt6) from DENV-3__FJ547062__SS-prME
  source 1..9873: mol_type = other RNA
acatcattgtgtctaatgatgatgttaccagctactttggcatttcacttaactagccgagatggagaaccgagaatgattgtagggaaaaacgaacgtggaaaatcccttttattcaaaaccgctagcggaattaatatgtgtactttaatagcaatggatcttggcgaaatgtgcgatgatacagtgacatacaaatgtccgcttatagcagaagtcgaaccagaagatatcgattgctggtgcaacctaacatcaacctgggtcacgtacggtacctgtaaccaagcaggggaacacagacgagataaaagatctgtagcgttggccccacatgtaggaatgggactagatactagaactcaaacctggatgagtgcagaaggcgcatggagacaagtagaaaaagtagaaacatgggcactcagacacccaggttttacaatacttgcattattcttagcgcattacatctcaacttcacttacgcaaaaagtggttatcttcattctactcatgttagtaacgccatcaatgactatgaggtgcgtaggagtaggaaaccgggattttgtcgaagggttatcaggcgcaacctgggtagatgtagtattagagcatggaggctgcgtaacaactatggccaaaaataaaccgacactggatatagaactccagaaaacggaagcaacgcaattagccacactacgtaaattatgcattgaggggaaaataacgaatataacaacagattctcgatgtccaacacaaggtgaggcaattttacctgaagaacaagatcaaaattatgtctgtaaacatacctatgtagatagagggtggggcaatggttgcggattgtttggaaaaggaagcctagttacttgtgctaaattccagtgtttagaaccgattgaaggcaaagtagtacaatatgaaaatttaaaatacacagtaatcatcactgtccataccggagatcaacatcaagtgggaaatgatacccagggcgttacggtagagataacaccacaagctagcactgttgaagctatcttgccagaatacggtacgctaggattagaatgttcacctcgcacaggtctagacttcaatgaaatgattcttttgacgatgaaaaataaagcatggatggtccatagacaatggtttttcgatcttccgctgccatggacatcaggagctacaactgaaacccctacctggaatagaaaagaactgctagtaaccttcaaaaatgctcatgcaaagaaacaagaagtggtggtactaggttctcaagaaggtgccatgcatacggcgttaaccggagccactgagatacaaaattcgggtggtacatctattttcgcgggacatttaaaatgccgattaaaaatggacaaattagagttaaaaggtatgagttacgctatgtgtcttaataccttcgtactcaagaaagaagtctcggaaacacaacatggaacaatattaattaaagtagaatataagggagaagatgccccctgtaaaataccgttttcgacggaggacggacaaggtaaagcccacaatggacgtttaataacagcaaacccagttgtgaccaaaaaggaagaacccgtgaatattgaagcagagccaccgtttggagaatctaacattgtgataggaataggcgataaagccttaaagataaactggtacaagaagggaagttcaataggcaagatgtttgaagcaacagctaggggagcacgacggatggcaatcttaggcgatacagcatgggattttgggtcagtagggggtgtactaaattcattgggcaaaatggttcatcaaatattcggtagtgcatatactgcattatttagtggcgtttcttggataatgaaaataggtataggtgtgttattaacctggattgggttaaatagcaaaaacacatcaatgagctttagttgcatagtaataggtatcataacattataccttggagctgtagttcaggcagacatggggtgcgcaataaactggaaagggaaagagttgaaatgtggttccgggatattcgtaacgaatgaggtacatacctggacggaacaatacaagtttcaagctgactcaccaaaaagattagcgacagcaatagcaggggcatgggagaatggagtctgtggaattaggagcacaacaagaatggaaaacttactttggaaacaaatagcaaatgaattaaactatatactctgggagaataacataaaactaacagtggtagttggggatattataggagtactcgaacaaggtaaacgaacgctcaccccgcagcctatggaactgaagtattcctggaaaacttgggggaaagccaaaatagtaacagcggaaacacaaaattcgtctttcataatagatggacctaatacccctgaatgcccatctgcatcccgtgcatggaacgtatgggaggttgaggattatggatttggtgtatttactacgaacatttggctcaaattgcgcgaggtgtatacccaatcctgtgaccacagattaatgtctgcagctataaaagacgaaagagctgtacacgcagacatgggttactggatagaaagtcaaaagaatggtagttggaaactggaaaaagcatctttcatagaagtcaaaacctgtacgtggccgaaatctcacacactatggagtaatggcgtattggagtctgatatgattatcccgaaaagtctagcaggaccaatatcacagcacaaccaccgccccggttaccatacacaaacagcaggtccttggcatctgggtaaacttgagttagactttaactattgcgaagggacaacggtagtaattacagaaaattgtggaacaagaggaccatcactgaggacaacaactgtatctggtaaacttatacatgaatggtgctgccgatcgtgcacattacctcctctccgttacatgggggaagacggatgttggtatgggatggaaatcagacctatcaatgaaaaagaggagaatatggtaaaatccttagtcagcgcaggtagtggtaaggttgataattttacaatgggtgtgctatgcttagcaattctgtttgaagaagtaatgcgcggcaaattcggcaagaagcatatgatagccggagtactctttacatttgtcttactgctctcaggtcagatcacttggcgggacatggcgcacaccttaataatgatcggcagcaatgcttctgatagaatggggatgggcgttacatatttagctctaatagctacctttaaaatacagccgtttctagctttaggcttcttcttaagaaagttaacttcgagagagaatttactacttggtgtaggtttagcaatggcaacaacattgcagttacctgaagatattgaacaaatggccaacggaattgcattgggtcttatgaccctaaagctgattacacaatttgagacatatcagttatggacagcgttggtttcattgacatgcagtaataccatattcacattgacagtcgcgtggcgaacggcaacattgatacttgccggagtgtcattactacctctatgccaaagttcctcaatgcggaaaaccgattggttaccgatgacagtagccgcaatgggagtaccgccactacctctatttattttcagtttaaaggatacacctaaaaggcgcagttggccattaaatgaaggagttatggctgttggcctcgtaagtatattagcttctagtctattacgaaatgatgtacctatggccggacctttggtagcgggaggtcttctaatagcatgctatgtaataactggtacgagcgcagatctaacggtagaaaaggcagccgatgtcacatgggaagaagaagctgaacaaaccggagttagccataatctaatgataacagttgacgatgatggaactatgcgcattaaagacgatgaaaccgaaaatatactcacagtattgttgaagaccgcattattaattgtaagtgggatcttcccttattctattcctgcaacgctattagtatggcatacgtggcagaaacaaacacaaaggtccggagtgttgtgggatgtcccttcacccccagaaacgcagaaagctgaattagaagaaggtgtatatagaataaaacaacaaggaatattcggaaaaactcaagttggggtcggagtacaaaaagaaggagtattccacactatgtggcacgtcacgagaggagcagtcttaacgcacaatggcaaaagattagagccaaactgggctagtgttaaaaaggatctgatatcgtatggcggaggatggagactatctgctcaatggcaaaaaggagaagaagtccaagtgatagcagtcgaaccaggcaaaaatccgaaaaattttcaaacgatgccaggcatttttcaaaccacaacgggtgaaatcggagctatagctttagattttaaaccgggaacatcgggaagtcccataataaaccgagaggggaaagttgtgggtctttacggtaatggggttgtaactaaaaatggagggtatgtatctggcatagcacaaacaaatgccgaacctgatggtcctactcccgaacttgaagaagaaatgtttaagaaaagaaacttaacaataatggatctacaccctgggagcggaaaaacaaggaaataccttcctgctattgttagagaagccataaaaagacggctacgaaccctaatactagcgcctactagagttgtcgcggcagaaatggaagaggctctaaaaggactaccaatacgttatcaaacaacagcaacaaagtcagaacacacaggtagagaaattgtggacctaatgtgtcatgcaacttttacaatgcgcttactaagtcctgttcgagttccgaattataaccttataattatggatgaggctcattttaccgatcctgcaagcatagccgcacggggttatataagtacacgcgtaggcatgggggaagcggctgcaatattcatgacggcaacaccacccggaaccgcggaggcgtttccacaatctaatgcgcccatacaggacgaagaaagagacatcccagagcgaagttggaactcggggaatgaatggatcacagatttcgtagggaaaacagtctggtttgtaccttcaattaaagccggaaatgacattgctaactgtttaaggaaaaatggcaagaaagttatccagttatccagaaagacttttgacacagaatatcagaaaactagactgaacgattgggatttcgtagtaacaacggatatatcagagatgggcgcaaactttaaagccgatagggtaatcgatcctcgaagatgcttgaaaccagttatcttaactgatggtccagaaagagttatactagctggaccaatgccggtaacagcggcgtcggcagctcaaagaaggggtcgagtagggagaaatccacaaaaagagaacgatcaatacatattcacagggcaacctttaaacaatgacgaagaccatgcccattggacagaggcaaagatgcttcttgataatataaatacaccagaagggatcattcccgccctatttgagccggagagagaaaaatcagccgccatagacggagaatatcggcttaaaggtgaatcgagaaaaacatttgtagaactcatgcgacgaggcgatctgcccgtatggctggcacataaagtggcatcagagggaataaaatatactgacaggaagtggtgcttcgatggtgaaagaaacaatcaaatactcgaagaaaatatggatgtggaaatctggactaaggaaggagaaaggaagaaattacggcctcgttggctcgatgcaagaacttactcagatcccctagcattgaaggaatttaaagattttgcagccggaagaaaaagtatcgcactagacctggtaacggaaataggtcgagttccttcacatcttgcatatagaacaagaaatgcactcgataacttagtaatgctacacacgtcagagcacgggggccgagcatatagacacgcagttgaagaactacccgaaacgatggagacattattactgcttggactgatgatacttttaactggcggtgcaatgctatttctaatatcgggaaaaggaatcggaaaaacttccataggtcttatttgcgtaattgtaagtagcggaatgttgtggatggcagacgtaccactacaatggatagcgtcagcaatcgttttagaatttttcatgatggttttactgatacccgaacctgaaaaacaacggacacctcaagataatcaattagcatacgtagtcattggaattttgactctagcggctatagttgctgctaacgaaatgggactactagaaacgaccaagcgagatctgggtatgagtaaggaacccggggttgtctcaccaacaagctatcttgatgttgatcttcaccctgcatctgcctggacattgtacgcagttgcaactacagtaataacaccgatgctacggcatacaattgaaaattcgacagcaaatgtctccttagctgcaatcgcgaatcaggctgttgtactgatggggttagataaaggttggccgatttccaagatggatctaggagtgccattgttagcgctcggttgttatagtcaggttaatcctctcaccttaacagcagcagtactactattggtaacacattatgcgataattgggcctggtttacaggccaaagccactcgagaagcacaaaagcgaaccgcagcgggaattatgaaaaatcctacggtggatggaataatgacaattgatttagatcctgtaatctacgactcgaaatttgaaaaacaattgggccaagtaatgttacttgtcttatgcgctgtacaattgttattaatgcggacaagctgggctttatgtgaagcgctaacgctagcaaccggtcccataacgacgctctgggaaggcagtccaggaaaattctggaatacaacaatagcggtaagtatggcaaacatttttcgaggttcatatctagccggtgcaggtctcgctttttcgatcatgaaatcggttggtacgggaagacggggaaccggcagtcagggcgagactctaggtgaaaaatggaagaagaaactaaaccaattatcacgcaaagagttcgacttatataaaaagagtggtatcactgaagtagacagaacagaggcaaaagaggggctaaagagaggcgagactacccatcatgcagtatccaggggaagcgctaaactccaatggtttgttgagcgtaatatggtaatacccgaaggaagagttatagatttaggttgcggtagaggaggatggtcttactactgcgcgggactcaagaaagttacagaggtaagaggttataccaagggtggacctgggcacgaggaacccgtaccgatgagcacatatgggtggaacctagtaaaattgatgtcaggaaaagacgtattctatttacctccggagaaatgtgatactcttctctgcgatataggtgaaagttccccatccccaaccgtcgaagagagtagaacaatccgcgtcctgaagatggtagaaccatggcttaaaaataatcagttctgcatcaaagtactaaatccatacatgcccacagtaattgaacacttggagcggctacagcgaaaatatgggggaatgcttgttcggaatccactttctagaaacagtacccacgaaatgtactggattagtaacggaacaggcaacatagtaagtagcgtaaatatggtttcacgtctattactgaacagatttacaatgacccacagacgacccacaatagaaaaagatgtagatctaggagctggtactcgccatgtaaacgccgagccagaaacacctaatatggacgtaattggggaaagaatcaagagaatcaaagaagaacatagcagtacttggcactacgatgatgaaaacccctataaaacctgggcgtatcatggttcctatgaagtaaaagcgacagggagtgcttctagtatgataaacggagtagtaaaacttcttactaaaccgtgggatgtagtaccaatggtcacgcaaatggcaatgacggatacaacaccgttcggacagcaaagggtgttcaaagagaaggtagatacacgtacccctcggcccatgcctggcactagaaaggttatggagataacagccgagtggttatggaggactttgggacggaataagaaaccacgcttgtgcacaagagaagaatttacgaagaaggtcagaaccaacgccgcaatgggagctgtattcacagaagaaaatcaatgggattcagcgagagctgccgttgaagacgaggaattttggaaacttgttgatagggaaagagagttacacaaattaggtaaatgtgggtcatgcgtttataatatgatgggaaaaagagagaagaaattgggtgagtttggaaaggctaaaggatcaagggctatatggtatatgtggttaggcgcccgttacttagagttcgaggccctgggctttctcaatgaagaccactggttctcaagagaaaacagttactcgggtgtcgagggtgaaggcttacacaagttaggctatatattacgagacatctctaaaattcctggtggcgcaatgtatgctgatgatactgctggttgggatacacgcatcacagaagatgatttacataatgaagagaaaataacccagcaaatggaccctgaacatagacaattagcaaatgccatcttcaaactcacctaccaaaataaagtagtaaaagtacaaaggccaacccccaagggcacggtaatggatataatatctagaaaggaccagagaggttcaggacaggttggcacatacggcctcaatacattcacaaacatggaggcacagctagttaggcagatggaaggggagggtgtacttagtaaagctgacctagaaaacccacatctattagagaagaaaataactcaatggctagaaactaaaggggtggaaagattaaaaaggatggcgatttctggggacgactgcgtagtcaaaccgatagacgataggtttgcaaatgccctattggccttaaatgacatgggtaaagttcgaaaagatatacctcaatggcaaccttctaagggatggcacgactggcaacaggtccctttctgtagccatcactttcacgaactaattatgaaggatggtagaaagctagtcgtaccgtgtagacctcaagatgagctgataggtcgggcaagaatatcacaaggggctgggtggtctttaaaagaaactgcttgtctggggaaagcatatgcgcagatgtggagtttgatgtactttcacagacgagatttaaggcttgcaagtaatgcaatctgcagcgcagttcccgtccactggattcctacatcgcgaacaacatggtccatacacgcccatcaccaatggatgaccaccgaagatatgctaactgtatggaatcgggtgtggatcgaggacaatccatggatggaagataaaacacctgtgacgacctgggaagacgtcccctatttgggaaaaagagaagatcaatggtgcgggtccctcattgggctaacgtctcgtgcaacttgggcacaaaacatcctgacagccatacaacaggttagatcattaattggtgatgaagaatttttggactacatgccgtctatgaaacggttccgcaaagaagaagaatctgagggagcaatttggtga

SEQ ID NO: 23487 - RNA, 9873 nt, synthetic construct
  misc_feature 1..9873: note = derived and/or modified CDS sequence (opt6) from DENV-3__FJ461322__SS-prME
  source 1..9873: mol_type = other RNA
acttccctatgtctaatgatgatgctacccgcaacgttagcattccatttaacttctcgcgatggtgagccccgaatgattgttgggaaaaatgaacggggtaaatctcttttattcaaaacggccagcggtattaacatgtgtactcttatagcaatggacttaggggagatgtgtgatgatactgtcacgtacaaatgccctctcatcgccgaagtcgaacccgaagacattgattgttggtgcaatctaacttcaacttgggttacatatgggacatgcaatcaagcgggagaacatcgccgagacaaaaggagtgttgctttagctcctcacgtaggaatgggcttagatacccgaacccaaacctggatgagcgctgaaggagcctggcgacaagtcgagaaagttgaaacttgggcactccgccatccggggttcacaatattagcactatttttagctcactacatcgggacgtcattgactcaaaaagttgtgatattcattcttctgatgttggtgacaccatcaatgacaatgcgttgcgtaggagtaggtaatcgagattttgttgaaggactaagcggcgcaacctgggttgacgtagtacttgaacatggcggttgtgtaacgactatggctaaaaacaaaccaacattagatattgaactacagaaaaccgaagcgacacaattagcaactttgagaaaattatgtatagaaggaaaaattactaacataactactgattcacgttgccccacgcagggggaagccattctaccagaagaacaagatcagaattatgtgtgcaaacacacatatgtggacagggggtggggcaatggctgtggattatttggtaaaggcagcttagtcacctgtgcgaaatttcaatgtctagagcccatagaaggtaaagttgttcaatatgaaaacctaaaatatactgtaataataaccgtccatacaggcgatcagcatcaggtaggcaatgacacacagggtgtaacagttgaaataacgcctcaggcatctacagtggaggcggttctcccagagtacggaacactaggtctagagtgttcgcctcgcaccggactagactttaatgagatgatattgttaactatgaaaaacaaggcttggatggtccatagacagtggttctttgacctgccactcccatggacaagcggcgctaccacagaaaccccaacgtggaatagaaaagaactattagttacctttaaaaacgcccatgccaagaaacaagaggtagtagtactaggatcacaagagggggcaatgcataccgcattaacaggcgctacagaaatacaaaattctggtggaacaagcatttttgctggccatttgaaatgtaggttaaaaatggacaaattggaattaaaaggaatgagctatgccatgtgtctaaacaccttcgtacttaaaaaggaagtttccgaaacacaacatggcacaattttaataaaagtcgaatacaaaggagaagatgcaccgtgcaaaatcccattctcaactgaagacggccaaggtaaagcacataatggaaggttaatcaccgcaaatcctgtagttactaagaaggaggaaccagttaacatcgaggcagagccaccgttcggagagtctaatatagtaataggaatcggcgacaaagcacttaagataaattggtacaagaaaggaagcagcataggaaagatgttcgaagcaacagcaaggggagctagacgtatggcaatcctgggggacacagcgtgggactttggatcagtaggtggagtgttaaattcattaggtaaaatggtccaccaaatattcggatcggcgtatacagcactcttcagcggcgtctcgtggatcatgaaaattggaattggagtattattgacgtggataggtttaaactctaaaaatacaagtatgtcattctcctgtatcgtaataggtattataaccctttacctaggtgccgtggtgcaagcagatatgggttgcgcaataaactggaaagggaaagagctaaaatgtgggagcggaatattcgtcaccaatgaagtccatacctggacggaacaatataagtttcaggctgactcaccaaagcgattagcaacagcaattgctggagcctgggaaaatggggtctgcggaataagatcgactacacgcatggaaaatttactatggaaacaaattgcaaatgagctaaattacattttatgggaaaataacatcaaacttaccgtcgttgttggtgacataattggagttttagaacagggaaagagaactctaacaccacaaccaatggaattgaaatactcttggaaaacgtggggaaaagctaaaatagtaaccgcagagacacaaaattcttcgtttattatagatggaccaaacacaccggaatgtccgtcagcatccagagcatggaacgtctgggaagtcgaagactatggttttggagtctttaccacaaatatttggctaaaacttcgagaggtatatactcagtcatgcgaccacaggttaatgagcgccgcaataaaggatgaacgtgcagttcatgccgacatgggatattggatagaaagtcagaagaatggaagctggaaattagaaaaagcgagctttatagaggtcaagacgtgtacatggcccaagtcccatactctatggagtaatggagttctagaaagtgatatgataataccaaaaagcctcgcggggccaataagtcaacacaatcacagaccgggatatcatacgcaaacagctggaccatggcatctaggaaaactagagttagacttcaattactgtgagggtaccactgttgtcataacagaaaattgtggaacaaggggaccttctttaagaactacaaccgtatcaggaaagttaatccacgaatggtgttgcaggtcgtgcactttaccaccactacgctatatgggggaagacgggtgctggtacggtatggagataagacctatcaacgaaaaagaagagaacatggtaaagagcttagtgtcagctggaagtgggaaggttgacaattttactatgggtgttctttgcctagccatactttttgaagaagtgatgaggggaaagtttgggaagaaacacatgatagcaggcgtgctttttacttttgtcttgctattatcaggccaaattacatggagagatatggcgcatactctcataatgataggcagtaatgcgagcgatcgaatgggaatgggagtaacttatttagcattaatcgcaacttttaaaatacagccatttttagcattaggattctttctaaggaagttgacaagcagagaaaatcttcttcttggagtaggtttagctatggcaaccacgttacagttgccagaagatatagaacagatggcaaatggcatcgcattaggtctaatgaccctaaaattaattactcagttcgaaacttaccaattatggacggcattagtttccctaacttgtagcaatactatctttaccttaaccgtcgcatggagaacagcaacgctaatattagcgggagtgagtcttttacctttatgtcagtccagtagtatgagaaaaacagattggctaccgatgactgtggcagcaatgggcgtccctccattaccactttttatattctcattgaaagatacaccaaaacggagaagttggccattaaacgaaggcgtaatggctgtagggttagtctcaatactagctagctccctattacggaacgatgttcccatggcaggacctcttgtagccggaggtctattaattgcctgttatgtcataacagggacctctgcagatcttacggttgaaaaagcagcggatgtaacatgggaagaagaagcagagcagacgggagtatcacataatctcatgataactgtggatgatgatgggacaatgcgaattaaggacgatgagacggagaacattttaaccgtcttactaaaaacggccttgcttatagtaagtgggatcttcccctatagcatacctgcaactctcttagtatggcacacatggcaaaaacaaacacaaaggagtggagtcctttgggacgtccctagccctcctgaaacccaaaaagctgagctagaagaaggcgtctatagaataaaacagcaaggaatctttggaaaaacgcaagtgggagtcggggtccaaaaagaaggagtctttcacaccatgtggcatgtaactcgcggtgctgttctgactcacaacggtaaaaggctagaaccgaattgggcctcggtgaaaaaggatctaatttcgtacggaggagggtggagattgtcagcgcagtggcaaaaaggagaagaggtacaggtgattgcagtagaacccgggaaaaatccgaagaattttcaaacgatgcccggtattttccaaaccacaacaggagaaataggagccatagcactagattttaaaccagggacatcaggaagcccaatcataaacagggaaggaaaggtagtaggcctatatggcaacggggtcgtaactaaaaatggaggatatgtatccggaatagctcagacaaacgctgaaccggacggaccaactccagagttagaagaggagatgtttaagaaaagaaacctcactatcatggatttacacccaggttctggcaaaacacgaaagtatttgccagcaattgtccgtgaggcgattaagagacgattgagaacgctcatattagctcctacaagagttgtggctgcagaaatggaagaagcactcaagggacttccaatcagataccagactaccgcaacaaaaagtgagcatacgggaagagaaattgttgatctgatgtgccacgcaacattcactatgcggctactatcaccagttagagtacctaactataatctaataattatggatgaggcacatttcacggacccagctagcattgcagcacgagggtacattagcacacgtgttggcatgggggaagcagccgcaatatttatgacagctactccaccaggcaccgctgaggcttttccccaatccaatgcaccgatacaagatgaagaacgtgacatcccagaacgaagctggaactcaggcaatgaatggattacggattttgtgggaaaaactgtatggtttgtacccagtattaaggctggaaatgacatagcaaactgtttacgtaaaaatgggaagaaggttatacaactatcaagaaaaactttcgataccgaatatcagaaaacacgcttaaatgattgggatttcgtagtaacaactgatataagcgaaatgggagcaaatttcaaagcggaccgggttatagacccccgaagatgtttaaagcctgtaatactaacggatggaccagaaagagttattttagcaggcccaatgccagtaactgcagcaagtgcagcccagcgaagagggagggtaggtcgaaatcctcaaaaagaaaatgatcaatatatcttcacaggccaaccactcaataatgatgaagatcatgctcattggacagaggctaaaatgttacttgataatattaataccccggaagggataattccagccctgttcgaacccgaacgtgagaaatcagctgcaattgatggcgaatataggctaaaaggggaatcccgcaaaacgttcgttgaattgatgagaagaggagatttacccgtttggctggcgcacaaagtagcatctgaggggatcaaatatactgaccgaaaatggtgctttgatggtgaaagaaacaatcagatactggaagagaatatggacgttgaaatatggacgaaagaaggcgagcgtaaaaagctaaggccaagatggctagatgcaaggacatatagcgaccctttagcacttaaggagtttaaggacttcgcagccggacgtaaatccattgcactggacttagtgaccgaaataggaagagtccctagccatctggcatatagaactcgtaacgcattagacaatctggtaatgctacatacaagtgagcatggaggtagggcttatcgtcacgcagtagaagaacttccagaaaccatggagacgctacttcttttaggtctcatgatcttattaactggaggcgccatgctttttctaattagtggcaaaggtataggaaaaacatctatagggctcatctgcgtaatagtatcctctggaatgctctggatggcggaagtgccgctccaatggatagcaagtgcgatagtcttggaatttttcatgatggtattattaataccggaacccgaaaaacaaagaaccccgcaggataatcaactcgcatacgtagttatcggtattttaacgcttgctgctatcgttgctgcgaacgaaatggggctactagagaccactaaaagagatttgggaatgagcaaagagccgggtgtcgtgtccccaacgtcgtatttagacgtagaccttcatccagcatccgcatggacactatacgccgtggctacaaccgtaatcaccccaatgcttagacatactatagaaaactccaccgccaacgtatcactagcagctattgccaaccaagccgtagtacttatggggttagacaagggatggccgataagcaaaatggatctaggtgtaccacttctggcactaggatgttattctcaagttaatcccttgactttaactgcagccgtgttgttgctcgtcactcattacgcaataattgggcctggcttacaagctaaagcaactagagaggcacagaaaagaaccgccgccggtataatgaaaaatccaaccgtagatggaataatgaccatagaccttgacccggttatctatgattctaaattcgagaagcagctaggacaagtaatgctcttggtcctttgtgctgttcaattgttgcttatgcgtacatcgtgggcactatgcgaagcactcacattagctactggacccataaccacattgtgggaaggttcacccggcaagttctggaacaccacgatagctgtatccatggctaatattttcaggggcagctacttagctggagccggtttagcattctctataatgaaatctgtaggcaccggcagacgaggaaccggctcacaaggagaaacgttaggggaaaaatggaaaaagaaactaaaccagctcagtcgaaaagaatttgatctctacaagaaatcgggtataacggaagttgatcgaacagaagcgaaggaaggcctaaaaaggggagaaacgacacatcacgcggtttctcgaggaagcgcaaaactacaatggttcgttgaacgtaatatggtcattcctgaaggacgggttatagacctaggatgcggacgcggaggttggagctactactgcgcaggccttaagaaagtcaccgaagtcagaggttacacaaagggaggacccggtcacgaagaacccgtcccaatgtccacctatggttggaatatagttaaactcatgtcgggcaaagacgtattttatctaccacccgaaaaatgtgatacgttactgtgcgacataggagaaagtagtccaagcccaacagtagaagaatcacgcacaattagggtgctaaaaatggtagaaccatggttaaagaacaatcaattctgtataaaagtacttaatccttacatgcctacagtgatagaacacttggagagactacaacggaaatatggtggaatgctagtgagaaatccgttatcccgaaactctacccacgaaatgtactggatcagcaatggaacgggtaacattgttagtagtgtgaatatggtttcacgtctactattgaatcgatttaccatgacacatagaagacccacaatagaaaaagatgtcgacctaggagcgggaacacgccatgttaacgccgaacctgaaactcctaacatggatgtcatcggggaaaggattaaacgtataaaggaggaacacagttcaacgtggcattacgatgatgaaaacccttacaaaacgtgggcatatcacggatcttacgaggttaaagctactggtagcgcctcgagcatgataaatggagtcgtaaaactactcacaaaaccatgggatgtcgtaccaatggtcacccaaatggcaatgacagatacaacgcccttcggacagcaaagagtattcaaggagaaagtcgacacccggacaccacgccccatgcctggaacgaggaaagtaatggaaataacggcagaatggttatggagaactctgggacgtaacaagaaacctaggttatgtactagggaagaatttactaagaaagtgcgaacgaacgcagcaatgggtgcagtgttcactgaagaaaatcaatgggatagtgcgcgagcggccgtagaagatgaggagttctggaaacttgttgaccgcgaacgggaattacataaactcggaaaatgtgggagctgtgtatacaatatgatgggcaaaagagaaaagaaattaggagaatttggaaaagctaaaggttcgagagcgatttggtatatgtggttaggtgcaaggtacttagaatttgaggcactcggcttcctgaatgaagaccattggttttctagagaaaattcctattctggagttgaaggggaagggttacacaaattaggctatatactgagagatatatctaaaattcctggtggggccatgtatgcagatgatacagcaggatgggatacacgaataactgaagacgatctgcataatgaagagaaaataacccaacagatggacccagagcatagacaactcgctaatgcaatattcaaactaacgtatcagaacaaagttgtaaaggtacaaagacccacacccaaaggaactgtaatggatattattagccgaaaagaccaacgaggaagtgggcaagtggggacatacggtctaaacacgttcacaaatatggaggcccaactggttagacaaatggaaggggaaggggtattgtcgaaagcagatctagaaaacccacatctcctagagaagaaaataacacaatggctagaaaccaaaggtgttgagcgactaaaacggatggccatatcaggagacgattgtgtggtaaaaccaatagatgatcgattcgcaaatgcactattagcattgaacgatatgggaaaagtacgcaaagatataccccaatggcaaccttcaaagggatggcacgactggcagcaagtccctttctgttctcaccacttccatgaattgataatgaaggacggaagaaagctagttgtgccttgtagaccacaagacgaactcataggtcgagcacgcatctcccaaggagcaggatggagtctcaaggagacagcctgtctgggaaaagcctatgcacagatgtggtctctaatgtactttcatcgaagagatctcagacttgcctctaatgcgatttgctcggctgtacctgtacattggattccaacgtcacgaacaacttggtcaatccatgctcaccaccaatggatgacaactgaggatatgctaacggtttggaaccgagtatggatagaagacaatccttggatggaagataaaacccctgtcaccacgtgggaagacattccatacttaggtaagcgagaggatcagtggtgtggatcactaataggtttaacgtctagagccacttgggcacaaaacatattaaccgccatccaacaagttagatcacttataggagacgaggaatttctagattatatgccaagcatgaaacgatttagaaaagaggaagaatctgagggggcgatttggtaa

SEQ ID NO: 23488 - RNA, 9873 nt, synthetic construct
  misc_feature 1..9873: note = derived and/or modified CDS sequence (opt6) from DENV-3__KF955458__SS-prME
  source 1..9873: mol_type = other RNA
acgtcgctatgcttaatgatgatgcttcctgcaacattagcattccatcttactagcagagatggggaaccacgaatgattgtaggcaaaaatgaacgcggaaaaagcctactatttaaaactgcgtcaggaatcaacatgtgtaccctaatagctatggatctcggagaaatgtgtgatgatacagtaacctataaatgcccactaatagctgaagtagaacccgaagatatcgattgttggtgcaacttgacgtctacatgggttacgtatgggacttgcaatcaagctggcgaacatagaagggacaaacgaagcgtagctcttgctccccatgttgggatgggattagatacacgaacacaaacatggatgtccgcggaaggggcgtggcgacaagttgaaaaagttgaaacatgggcactcaggcaccccggttttactatacttgcgctatttctcgctcactatataggcacaagcctaacacagaaagtggtaatattcatactacttatgttagtcaccccgtcgatgacgatgaggtgcgttggagtagggaatcgagactttgtggaagggttgtctggagccacatgggttgatgttgtactagaacacggcggatgcgtaaccactatggctaaaaataaacctactctggatattgaactccagaaaacggaagccacacagctagcaacgctgcgaaaactctgtatagaaggaaaaataacaaatataactacagactcgagatgtccaactcaaggtgaggcgatattgcctgaggaacaagaccaaaattatgtatgtaaacatacatatgtggatcgtggctggggcaacggctgtggtctctttggtaaaggatctttggttacgtgcgcaaaattccagtgtttagaaccaatcgagggcaaagtagtacaatatgagaacctgaaatacaccgtaatcataacggttcacacgggtgatcagcatcaggtgggcaatgacacgcaaggggtaactgtagaaattactcctcaagcaagtaccgtagaagcagtattaccagaatacggaacgttaggattagaatgttctcctcgcaccggccttgattttaacgagatgatcttattaacaatgaaaaataaagcatggatggtgcacaggcagtggtttttcgatctaccattaccatggacatcaggggctacaacggaaactcctacatggaatagaaaagaattacttgtaacgttcaaaaacgcacacgccaagaaacaagaagttgtcgttttagggagccaggaaggtgcaatgcatactgccctaactggtgcaacggaaatacagaactctggtggtacttcgatcttcgcgggtcatttaaaatgccgtcttaaaatggataaactcgagctgaaaggaatgagctacgccatgtgcttaaatacatttgttctaaagaaagaagtttccgaaacacaacacggaaccatattaataaaagtcgaatataaaggagaagatgcaccttgtaaaatacctttttccaccgaagacggacagggaaaagcacacaacggtagattgataacggctaaccctgtagtgacgaagaaagaagaacccgtgaatatcgaagcagagcctccatttggtgaaagcaacatagtgattggtataggtgacaaggctttaaaaataaattggtacaaaaagggcagttcaataggaaaaatgttcgaagccactgctagaggtgctcgaagaatggcaatcttaggagatacagcatgggattttggctcggtcggaggggttcttaatagtctaggaaaaatggtacaccagatatttggaagcgcctacactgctttgttcagtggagtatcatggatcatgaaaataggaattggagtactgttgacctggataggattaaatagcaaaaatacaagtatgtcgtttagttgcattgttattggaattattacattatatttaggagcagtagtccaggccgacatgggatgcgctataaattggaaaggcaaagaactaaagtgtgggtcaggcatttttgtgaccaacgaagtacacacatggactgaacagtacaaatttcaagctgatagtcccaaacgtcttgccacagcaatagcaggagcttgggagaatggcgtttgtgggatccgtagtactacaagaatggaaaatctgctatggaaacagatcgcaaatgagctaaattatattttatgggaaaacaatataaaattaaccgtcgtagttggcgacataataggcgtgttagagcaggggaagcgtaccttaacaccccaaccaatggagctcaaatacagttggaaaacctggggcaaagcgaaaattgtaaccgctgagacgcagaatagcagcttcataatagacggcccaaatacacctgaatgtccgagtgcttccagagcatggaacgtatgggaagtcgaagattacggattcggtgtatttaccactaatatatggctgaagctgagggaagttaatacgcagtcatgtgatcaccgtctaatgagtgctgcaataaaagatgaacgcgccgtacatgccgacatgggatactggatcgaatcccagaaaaatggctcttggaaattagaaaaggcctcatttatcgaagtcaaaacgtgtacctggccaaaaagtcacaccctgtggtcaaatggggtcttagaatctgatatgatcatacctaagtcattagcgggacccatatcccaacacaaccatagacctggatatcacacacaaacagcagggccgtggcacctaggcaaacttgaattggatttcaactattgcgaaggcaccacggtcgttataacggaaaactgtggaaccagaggtccatctctacgaacaaccaccgtatcaggtaaattaatccatgaatggtgttgccggtcttgcaccctacccccactgcgatatatgggagaagatgggtgttggtacgggatggaaatacgccccataaacgagaaagaagaaaatatggtcaagtcattagtatcagcgggttcgggaaaggtagacaattttaccatgggagtactgtgtctggctattttatttgaagaagtaatgcgaggtaagttcggcaagaaacacatgattgctggggtattatttacttttgttctccttctaagtgggcagatcacatggagagacatggctcatacgttaataatgattggctccaacgctagcgatcgcatgggaatgggcgttacctatctagctctaatagcgacgtttaaaattcaaccttttctagcactcggattctttctaagaaaattgacaagtagagagaatctattgctgggcgtaggccttgcaatggcaacaactcttcaactccctgaggatatagaacaaatggctaacggtattgcattagggctcatgacactaaaattgataacccaattcgaaacatatcagctatggactgctctcgttagtttaacctgttcaaatacaatatttacactaacagtagcgtggagaactgctacattaatacttgctggagtttcgctactacccttatgtcaaagttcgagtatgaggaaaacggattggcttccaatgacagtagcagcaatgggagtacctccattaccattatttatattttcattaaaagatacaccgaaaagaagaagctggccgctaaatgaaggagtaatggcggttggtctagtctcaatacttgcgtcctcattattaaggaatgacgtacctatggcaggacccctcgtcgcagggggattattgatagcgtgttatgtgataacggggacttcagcagatctaaccgttgaaaaagcagcggatgtaacatgggaagaggaggcagaacaaacaggggtttcacacaacctgatgataacagtagacgatgatggaacaatgcgcatcaaagatgatgagacagagaacattctaaccgtattgctgaagacagcactactcatagtttctggtatattcccgtatagcatacctgctacgcttcttgtatggcatacctggcagaaacaaacacaaagaagtggagttctttgggacgtgccttcgcctccagaaactcaaaaagcagagttggaagaaggtgtttaccgaattaagcaacaggggatatttggaaaaacacaagtaggagtcggcgttcaaaaagaaggagtatttcacacaatgtggcacgtcacgagaggagccgtccttacacataatggaaaacgtctagaacccaactgggcctcggtaaagaaagatttgatatcgtatgggggaggctggaggctcagcgctcagtggcaaaagggagaggaagtgcaggttattgcggtcgaaccaggcaaaaatcctaaaaactttcaaacaatgccaggcatctttcaaactactacaggagagattggagcgatagccttagattttaaacctggaacaagcggaagtccaataataaatagagagggaaaagttgttggtttatacggtaatggagtagtaactaaaaacggaggctacgtatcaggaatcgcgcagacaaatgcggaaccggatgggccaacgccagaactagaggaggagatgttcaagaaaagaaatctaactataatggatttacaccccggatctggaaaaactcgaaaatacctcccagctatcgtacgtgaggcaataaagagaagattacgaacattgattttagcaccgacacgcgtagttgcagcagagatggaagaagccttaaagggattacccatcagataccaaactacagctacgaaatcagagcataccggaagagagatcgttgacctaatgtgccatgcaacttttaccatgagacttctatcgccagtacgagttccaaactacaacttaatcatcatggatgaagcgcacttcacagatccggcaagtattgccgctcgggggtacatctcaaccagagtaggaatgggagaagcggcggcaatatttatgactgcgacaccgcctggcacagcagaggcatttccacaatcgaacgcgccaatacaagatgaggaaagggatataccggaaaggtcatggaactccgggaacgagtggattacagatttcgtaggaaaaactgtatggtttgtaccaagtataaaggctgggaatgatatcgcgaattgtcttaggaaaaacggcaagaaagtaattcagttaagtaggaagacttttgataccgaataccagaaaactcgcttaaacgattgggattttgtagtaacgacagacattagtgaaatgggagcgaatttcaaggcagaccgggtgattgatccaagaagatgcctcaaaccagtcatcctaaccgatggtcctgaaagagttattctagcgggcccaatgcccgttacagcggcctcagccgctcaaagacgaggacgcgtcggccgaaatccgcagaaagaaaatgatcaatatatttttactggtcaaccattaaataatgacgaagaccatgctcactggacggaagcgaaaatgcttttagacaatatcaacactccggaaggtatcatacccgccctattcgaaccagagagagaaaaatctgcagcgattgacggtgaatatcggcttaagggtgagagcaggaaaacttttgtagaactcatgaggagaggtgatctcccagtgtggttggcacacaaggtagcaagtgaggggataaagtatacggacagaaaatggtgttttgacggagaaaggaataatcaaatacttgaagaaaacatggatgtagaaatctggacgaaggaaggtgagcgaaagaaacttagaccgagatggcttgatgctcggacatactcagatccgctcgccctcaaagaatttaaagacttcgcggcaggccgtaaatcaatagcattagatctggtaacagagatcggccgagtaccttctcatctagcgtatcgcacaagaaacgcattagataatctaatgatgttacatacgtctgaacacggcggacgagcgtataggcatgcagtagaggaactacctgaaacgatggaaactttactactgttaggtctaatgattttattaacaggaggagcaatgttatttcttatctctggaaaaggaataggtaagacatccattggtttaatctgtgttatagtatcaagtggtatgttatggatggctgatgttccactacaatggatagcatctgcaatcgtacttgagtttttcatgatggtattactgatacctgagccggaaaaacaaagaacaccacaagacaaccaattggcctacgttgtaattggtatcctaactcttgcagccatcgtcgctgccaatgagatggggcttttggaaacaactaagcgcgacctaggaatgtcaaaagaaccgggcgtggtcagtccaacttcctacctagatgtagatttgcaccctgcgtcagcatggactctatacgcagttgcaacaacggtaataacaccgatgctgagacacacgatagaaaacagtacagcaaatgtttcgctggcagcaattgcgaaccaagctgttgttttaatggggctagacaaaggatggcctattagtaaaatggatttaggtgtaccattacttgccctgggatgctatagtcaagtaaatcccttaacactaacagcagctgttcttctgttagttacgcattacgctataattgggcctggactccaagcgaaagcgactagagaggcacaaaagcgaacggcagctggaataatgaaaaatccaactgtcgatggtataatgactatagatcttgatccagtaatttacgatagcaagtttgaaaagcaattagggcaggtaatgctattagtactatgcgcagtgcaactgcttctgatgcgtacctcctgggcactctgcgaagctctaacattagcaacagggcccataacgacactctgggaaggatcaccaggaaaattctggaatacgacaatcgcagtatctatggcaaatattttcagagggtcctacttagccggcgcaggtttggccttcagcattatgaaatcagttggtacaggtcgtcgtggtaccggaagtcagggtgaaacacttggggaaaaatggaagaagaaactcaatcaattgtcacgaaaggagttcgacctttataagaaatcaggaataacagaggtggaccgtacagaggctaaagaaggtcttaagagaggtgaaacaacacatcatgcagtcagtcggggttcagccaaattacaatggtttgtagagagaaacatggtaattcccgaaggccgcgttatagatcttgggtgcggtagaggtggatggagctattattgtgctggattaaagaaagttacagaagtacgtggttacacaaaaggagggccaggacatgaggaaccagtaccaatgtcaacctatggttggaatctagttaaactaatgagcgggaaagatgtattctacctaccaccagaaaagtgtgataccctcctatgtgatatcggcgagtctagtccatcaccaacagtagaagaatcacgaacaatcagagtgttaaaaatggttgaaccatggctcaaaaacaatcaattttgcataaaagtattgaacccatatatgccgacagttattgagcatctggaaagattacagcgaaagtatggaggcatgttggtaaggaacccattaagcagaaattcgacccacgaaatgtattggatatccaacggtacagggaacatagtgagcagtgtcaatatggtaagcagattactcctgaatagatttactatgactcatcgacgtccgacaatcgaaaaagatgttgatcttggagcagggactagacacgtgaacgcggagccagaaactccaaatatggacgttatcggagaaaggataaaacgtataaaagaagaacactcgtcaacgtggcattacgacgatgaaaacccatacaaaacatgggcatatcatggttcatacgaagtaaaagcgacgggaagtgcatcttctatgattaatggagttgtcaaactattaaccaaaccatgggatgtagtaccgatggtcacacaaatggcgatgacagacacaacaccctttggtcaacaaagagttttcaaagaaaaagtagacacccgaactccaagaccaatgccaggcacacgaaaagtaatggaaataacagcggaatggctctggagaactctgggtcgtaataagaagcctcgactctgtactagagaggagttcaccaagaaggtacgtacaaatgctgcaatgggtgcagtattcaccgaggaaaaccaatgggattcagcccgagcagcagttgaagatgaagaattttggaaattagtagatagggaaagagagttacataaattaggtaaatgtggtagctgcgtatataatatgatgggaaaaagagagaagaaattaggagagttcgggaaagcaaagggatcacgagccatttggtatatgtggttaggagctagatacttagagttcgaggctttaggattccttaatgaagatcattggttctcaagagaaaattcatatagtggggtagaaggggaaggtttacacaaactaggatatattttacgagacataagtaaaatacctggtggtgccatgtatgcagacgacacagccggttgggacacaagaattacagaagatgatttacataatgaggaaaagatcacccaacaaatggatccagaacataggcaattagctaatgcaatttttaaattaacttatcaaaacaaggtagtaaaggttcaacgcccgacaccaaagggaaccgtaatggatattataagtcgcaaagatcagcgaggttctggacaggtcgggacatatggacttaatacatttactaacatggaagctcaattagttcggcaaatggagggggagggtgtgcttagtaaggcggatctcgaaaatccgcatcttctggagaagaaaattacacaatggcttgagacaaagggggtagagaggcttaagaggatggcaatatcaggtgatgattgtgttgtaaaaccaatagatgatcggtttgctaacgcgttattagcattgaacgatatgggaaaggttaggaaagacataccacagtggcagccatcaaagggatggcatgattggcaacaagttccgttttgtagccaccacttccatgaattaattatgaaggatggtcggaaattggtggtcccctgccggccacaggacgagcttattggcagagcacgtatatcacaaggtgcaggttggtcgttaaaagaaacagcatgtttaggcaaggcttatgctcaaatgtggtccctcatgtactttcacaggcgggaccttcgactcgcgtcaaatgcaatttgttccgcggtccctgttcactggataccaacgtcacgtacaacatggtcaatacatgcacatcaccaatggatgactaccgaagacatgttgacagtatggaatcgagtatggatagaagacaatccatggatggaagacaaaacgcccgtaactacttgggaggatgttccatatctaggtaagcgcgaagaccaatggtgcgggtcattaataggccttacctcgcgagcaacatgggcacagaacatcctaacggcaatccaacaggtaagatcattgatcggggacgaggaatttcttgactatatgccctctatgaagcgattcagaaaagaagaagaatcggagggagccatatggtaa

SEQ ID NO: 23489 - RNA, 9873 nt, synthetic construct
  misc_feature 1..9873: note = derived and/or modified CDS sequence (opt6) from DENV-3__FJ562102__SS-prME
  source 1..9873: mol_type = other RNA
acgtctctatgtctaatgatgatgcttcccgcgaccctagcgttccatctaacatccagagatggtgaaccgcgtatgatagtaggtaaaaacgaacgaggaaaatcgcttctatttaaaaccgcatcaggtatcaacatgtgcacactaatagccatggatttaggagagatgtgtgacgataccgtaacctataaatgtccgttaatagcagaagttgaacccgaagacatagattgctggtgtaacttaacgagtacatgggtcacttatggtacatgcaaccaagcaggggaacatagaagagataaacgttctgtagctttagccccacatgttggtatgggattagacacaagaactcaaacttggatgtccgcagaaggagcctggcgacaggtcgaaaaagttgaaacgtgggctttaagacatccgggattcactatacttgctcttttccttgctcactatataggaacaagtttaacgcaaaaagtagtaatattcatactactcatgttagttacgccgtccatgactatgcgttgtgttggagttggaaatagagatttcgtcgaaggtctaagtggagcgacttgggtcgatgtagtgctggagcatggaggttgcgtgacaactatggctaaaaacaaacccactctcgacattgaattacagaaaactgaagcaacgcaacttgcaacactgcgaaaactgtgcattgaaggaaaaatcacgaatataactactgatagtcgatgcccaacacagggagaggcgatattaccagaagaacaagatcaaaactatgtatgtaaacatacatatgtagaccgcgggtggggcaatggatgcggattatttggaaaaggttctctcgttacatgtgcaaaatttcaatgcctcgaacctatcgaaggaaaagtggttcagtatgaaaacttaaaatacacagtaataataactgtgcataccggggatcaacaccaagttggcaatgacacacaaggcgtcacggtcgaaataacacctcaggcatcgacggtcgaggctgttttaccagaatatggaacgttaggtttagaatgttcacccagaacaggacttgacttcaacgaaatgatccttctgacaatgaaaaataaggcttggatggttcatcgccaatggttctttgatttaccacttccgtggacgagtggggcaaccaccgaaacaccaacttggaacagaaaagaacttctagtaacatttaaaaacgcacacgccaagaaacaagaagttgtagttttaggcagccaagaaggagctatgcacacagcattgaccggcgctactgagatccaaaattctggaggcacatcgatatttgcaggtcacttaaaatgtcgccttaaaatggacaaattggaattaaaaggtatgagttacgcaatgtgtctgaacacattcgtactcaagaaagaagtttcagagacacaacacgggaccatactcataaaagtggaatacaaaggggaggatgccccgtgcaaaattccattttctacagaggacggacagggaaaagcccataacggacggcttataacagccaacccagtggtaaccaagaaagaagaacccgtgaatatagaagctgagcctcctttcggtgaaagcaatattgtaattggtataggtgacaaggcactcaaaataaactggtataagaaaggcagttctatagggaaaatgtttgaggctaccgcaagaggtgcacgcaggatggcaattttaggcgataccgcatgggattttggatctgtaggcggtgtacttaattcacttggaaagatggtacaccagatttttggctcagcctacacagccctattttcgggagtatcatggataatgaaaataggtattggagtactcctgacctggataggactcaattccaaaaatacatcaatgagctttagttgtatagtaattggaattataactctgtatcttggcgcggtagttcaagcagatatgggatgtgccattaattggaagggcaaggagttaaaatgcggtagcggtattttcgtgactaatgaagttcatacatggacagagcaatataaatttcaggctgactcacctaaaaggcttgcgactgctatagctggtgcatgggagaacggtgtctgtggtataagatcaactacgagaatggagaatctactgtggaagcagattgccaacgaattgaactacatattatgggaaaacaatataaaattaactgtcgtagtgggggatattataggtgtactagagcaaggaaaaagaacactaacgccccaacccatggaattaaagtatagttggaaaacctggggtaaggctaaaatagttacggccgaaactcaaaattcaagttttataattgatggcccgaatacacctgagtgtccgtcagctagcagagcttggaatgtatgggaagtcgaggattatggatttggagtgtttacaacaaatatatggttaaagctgcgggaggtttatactcaatcctgtgatcatcgactcatgtctgctgcaattaaagatgaaagagctgtccacgctgacatgggatattggattgaatcgcagaaaaacggctcatggaagttggaaaaagcgagttttattgaagttaaaacttgtacgtggccgaagagtcacacactctggagtaatggagttttagagtccgacatgataattccaaaatcgctcgcgggacctatctcacaacataatcatagacctggataccacacacaaactgctgggccatggcacttaggtaaattagagttagacttcaattactgtgaaggcaccacggttgttataacggagaactgcggaacacggggtccctcgttaagaaccactactgtatctggcaaacttattcacgaatggtgctgtaggagttgtacgttaccgcccttgcggtatatgggtgaagatggatgttggtatggaatggaaattcgaccaattaatgaaaaagaagaaaatatggtgaagagtctagtaagtgctggctcaggtaaagtagataatttcacaatgggcgttctatgtctagcaatattattcgaagaggttatgagaggaaaattcgggaaaaagcatatgattgccggtgtactctttaccttcgtcctattactaagtgggcaaataacatggagggatatggcgcacacttttattatgataggctccaacgcaagcgataggatgggcatgggagtaacctatctagcgttaatcgcaacttttaaaatacaaccctttttagccctaggattctttttaaggaaacttacaagtagggaaaacctacttttaggtgttggattagcaatggccacaacgcttcaattgcctgaggatatagagcaaatggctaatgggatcgcgctcggtctgatgactttgaaacttataacacagtttgaaacgtatcaattatggacagcattagtctcacttacctgcagtaatactatttttactttaaccgttgcgtggcgcaccgcgactttaatactagccggggtatccttattaccgctatgtcaatcaagtagcatgagaaaaacggattggctcccaatgacagtagctgccatgggagtcccgcctttgcccctttttatcttttctttaaaagatactcctaaaaggaggagttggcccttaaatgaaggtgtaatggcagtcggtctagtttcaatacttgcgagctcattacttagaaacgacgtgcccatggcaggacctctagtggctggtggattattaattgcatgctacgtaatcactggaacgtccgcagatctcacggtagaaaaggcagcagatgtcacttgggaagaagaagcagaacaaacaggggtaagccacaatctaatgataaccgtagacgatgatggcacaatgcgcataaaggacgatgaaacagaaaacattttgactgtactacttaaaaccgctctacttatagtatcaggaatcttcccatatagtatacccgcaaccctcctagtctggcatacatggcagaaacaaacacaaagatccggcgtgctatgggatgttccttcaccaccagagacccaaaaagctgagttagaggagggagtataccgaattaaacagcagggaatctttggaaagactcaagttggagtcggagtacagaaagagggagttttccacacaatgtggcacgtaacaagaggggctgttctaacacataatgggaagcgtttagaacccaactgggctagtgtcaagaaagatctgatttcatatggaggtggttggaggctctctgctcaatggcaaaagggagaagaggtacaagtcatagccgttgaaccgggcaaaaaccctaaaaatttccaaactatgccgggcatttttcaaacaaccaccggtgaaataggagcaatcgctctagattttaaacctggcacaagcgggtcaccaatcataaacagggaaggcaaagtagtaggactatatggtaatggcgtcgtaaccaaaaatggaggatatgtttccggtatagcccagacgaacgctgaaccggatggtcctacgcctgaattagaagaagaaatgtttaaaaagagaaatctaacgataatggatctgcacccggggtcaggtaaaactcggaaatacttaccagcaatcgtcagagaggcgatcaaaagaaggctcaggacgcttatcctagcaccaactcgcgtcgtcgcagcagaaatggaggaagcattaaaaggacttcctatccgctatcaaaccactgctacaaaaagcgaacacactggaagggaaatagtagacttaatgtgccatgcaactttcacgatgagactattatctccagttagagttccaaattataacttaattataatggatgaagctcatttcacagacccggctagcatagctgctagaggatatatctcaactagggtgggaatgggggaggccgcggctatttttatgacagccaccccacctggtaccgcagaagcgtttccacagtcgaatgcaccaatccaagatgaagaacgagatatccccgaacgtagttggaactcaggaaacgaatggataacagacttcgtaggaaaaacagtctggtttgttccgagtataaaagctggaaatgatatagcaaattgcttacgtaaaaatggcaagaaagtaatccaattaagtcgtaaaacctttgataccgaataccagaaaacaagactaaatgattgggacttcgttgtaacaacagacattagcgagatgggagctaatttcaaagctgaccgagtaatagacccacgcagatgtctaaaaccggtaattcttacagatggacccgaaagggtaatattagccggtccaatgccggttactgccgcctcagcagctcaaagaaggggaagagtaggacggaatcctcaaaaagaaaatgatcagtacatctttacaggccaacccctaaacaatgacgaagatcatgcgcattggacagaagctaaaatgttattagataacataaacactccagaaggcataatacctgcattatttgaacctgagagagagaaatcggcagcaatagacggagaatatagattaaaaggtgaaagtagaaaaactttcgtggaacttatgcgacgtggcgatctcccagtatggctagcccacaaagtagcctcagaagggattaaatacacggacaggaagtggtgttttgatggagaacggaacaatcagattttagaagagaatatggacgttgagatctggacgaaggaaggagaaagaaagaaacttagaccaagatggttagatgcacgaacctatagtgaccccttagccttaaaagagtttaaagattttgcagcgggaagaaaaagcattgctctcgatctagtgacggaaataggaagagtaccttcgcatttagcatataggactagaaacgctttggataatttagtaatgttacatacgtcggaacacggcggacgagcatacagacatgcagtagaagaactcccggaaacaatggaaaccttgctcctgctcggtttaatgatcctattaaccggcggagcgatgctatttcttatatctggtaaagggataggtaaaacaagtataggactgatctgtgtcattgtaagtagtggaatgttatggatggctgacgtacctctacaatggattgcaagcgctataatactggaatttttcatgatggtcttgttgataccagagccagagaaacagcggactcctcaagacaatcaactggcctatgtggttatcggcatcctgacactcgcagcaatagtcgcagcaaacgagatgggtttattagaaacgacaaaaagagatctaggtatgtccaaggagccaggcgtagtctcaccaaccagttacttagatgtcgatttgcatcccgcctcagcatggacattatacgctgtcgcaaccacagtgattactccgatgctacgccatactatagagaatagcacagctaacgtgtcactagccgcaatagcgaatcaagctgtagtgttaatgggtctagacaaagggtggcccatatcgaaaatggatctaggagtaccactcttagccttaggatgctatagtcaggtgaacccattgacactcaccgctgccgtattgctgcttgtaacacactatgctatcataggaccaggcctgcaagctaaggcaaccagagaagcacaaaagagaaccgcagcggggataatgaaaaaccccacagttgatggaataatgaccatagacctagacccagtaatatacgattcgaaatttgaaaaacagttaggtcaagtgatgttgttagtgttgtgtgcagttcaactattactcatgcgaacttcttgggcgctttgcgaggccttgacattagcaaccggtcccattacaacgttatgggaaggaagcccaggtaaattctggaacaccacgatagcagttagtatggctaacatttttcgagggagctatttagcaggagcaggactcgcgttctccattatgaaatctgtaggaacagggcggcgtggaacggggtcacagggagaaacactgggagaaaagtggaaaaagaaacttaatcaactatctcgaaaagaatttgatctctacaagaaatcaggaatcaccgaagtagatagaacggaagctaaagaaggcctaaaacgaggagaaacgactcaccatgcagttagcagaggctctgcaaaattgcaatggttcgtggaacgcaatatggttataccagaagggcgcgtcatagatttaggatgtggaagaggcggatggtcatactattgtgctggactaaagaaagtcacggaagtgagaggctatacaaaaggtggaccgggacatgaggagccagtaccaatgtcaacctatggttggaatctagtgaaactcatgagcggtaaagatgtattttatctaccgccggaaaaatgcgatacattactatgcgacataggagaaagcagtccgtccccaacagtggaggaatcaagaaccattagagtcctaaaaatggtcgaaccctggctcaaaaataatcaattctgcattaaagtcctcaacccatatatgccaacagtaattgaacacttggaaagattacaacggaaatatggtggaatgctcgttaggaacccattaagtcgaaactcaacgcacgagatgtactggatctctaatggcacaggtaatattgtatccagtgtgaacatggtaagtaggctgcttcttaatcggtttacaatgactcaccgtcgaccgaccatagaaaaagatgtagatttaggagctggaacacgacacgtaaatgctgaaccagaaactccgaatatggacgttataggagaaagaataaagagaataaaagaggagcattcctcgacgtggcactacgacgatgaaaacccatacaagacatgggcgtatcacggaagttatgaggttaaagccacgggttcagcaagttccatgataaatggtgtcgtgaaattactcacgaaaccatgggacgttgttccaatggtgacacaaatggccatgacggacacaactccatttggacagcaaagagtcttcaaagaaaaagtcgacacccgtactccaagaccgatgccaggtacaagaaaagtaatggagataacagcagagtggctctggcgcactctaggtagaaataagaaacccagattgtgtactcgagaagagttcactaagaaagtacgcaccaatgccgctatgggagccgtattcacagaagagaaccagtgggacagtgcaagggcagcagtggaggacgaggagttctggaaacttgtcgatcgtgagcgagaattacataaattaggtaagtgcggaagctgcgtgtacaacatgatgggaaaacgtgagaagaaacttggagagttcggcaaagctaaaggcagcagagcaatctggtacatgtggttgggagctaggtatttagaatttgaggcactaggctttttaaacgaggatcactggtttagtcgagaaaatagctactcgggagttgagggggaaggattacacaagctaggatatatattgcgggatatttcgaagataccagggggtgcaatgtacgcggacgacactgcaggttgggacacgagaataacagaagacgaccttcataatgaggagaaaataacacagcagatggatcctgaacataggcaattggcgaacgcgatattcaaattaacctatcaaaacaaagttgttaaagtacagcgacctacaccaaaaggtacagtaatggacattataagtaggaaggatcaaagggggtctgggcaagtgggaacgtatggcctaaacacattcaccaatatggaagcacagttagtaagacaaatggaaggcgaaggagtcttatctaaagctgatttagaaaacccacatctacttgaaaagaaaattacgcagtggctagaaactaaaggagtagaacgcttgaaacgaatggcaatatccggagacgattgtgtcgtgaagcctatcgatgatagattcgcaaacgcattactagcactcaatgacatgggaaaagttagaaaggatattccgcaatggcaaccgtccaaagggtggcatgattggcaacaagttccgttttgtagtcatcactttcatgaattgatcatgaaagatggaagaaagttggtggtaccgtgcagaccccaagatgagcttatcggtagagctcgaattagccagggggccgggtggtctctcaaagaaaccgcctgtttgggaaaggcttacgcacaaatgtggagccttatgtactttcatcggcgagatctacgtctagcgagtaatgcaatatgcagcgcagtccccgtgcattggattcccacttctcgaactacctggagcattcatgcacaccatcagtggatgactacagaagatatgttaacggtttggaatagggtctggatagaggacaatccgtggatggaggacaaaacccctgtcactacctgggaagatgttccatacctaggaaagagagaagatcagtggtgcggcagcttaataggtctgacatctcgcgcaacttgggctcagaatatcttgactgctatacaacaagtccggtcactaatcggagacgaggagttcctcgactatatgccgagcatgaaaaggttcagaaaagaagaggagtccgagggagctatatggtaa

SEQ ID NO: 23490 - RNA, 9873 nt, synthetic construct
  misc_feature 1..9873: note = derived and/or modified CDS sequence (opt6) from DENV-3__FJ410229__SS-prME
  source 1..9873: mol_type = other RNA
acgagcttgtgtttaatgatgatgctacccgccacactcgcttttcatttaacatcgagggacggggaaccgaggatgatagtgggcaaaaatgaaagagggaaaagcctcctgtttaaaacggctagtggaataaatatgtgcacacttatagccatggatttaggcgaaatgtgtgacgatacggttacgtataaatgcccgctgatagctgaagtagaaccagaagatattgattgttggtgcaacctaacatcaacgtgggtaacatatggtacatgcaatcaagctggcgaacatcgacgagataagagaagcgtagccctagctccacatgtaggaatgggactagatacaaggactcaaacctggatgtccgcagaaggggcgtggagacaagtcgaaaaggtggaaacgtgggcacttagacaccctggattcactatattagcgttatttttagctcactatattggaactagcttgacacaaaaagtagtaatttttatacttctcatgctagtcactccaagcatgaccatgagatgtgtaggagttggcaatagagactttgtagaaggcttaagcggagcaacatgggtagatgtggtattggaacacggcgggtgtgtgacgacaatggcgaaaaacaagccaaccttagatatcgagttgcagaaaacagaagcaactcaactggccactctacgtaaactatgtatagaagggaaaataacaaacattacaacagactctcgttgtcccacacagggtgaggcaattctccccgaagaacaagaccaaaattacgtctgcaagcatacctatgtagatcgcggttggggtaatggttgtgggttatttggaaagggtagcttggtaacgtgtgcaaaatttcaatgtctagaacctatcgagggaaaggtagtacaatacgagaatttaaaatatacggtaatcattactgtgcatacaggtgaccaacaccaagtcggaaatgatacacagggcgtgacagtcgagataacaccacaggcctcgaccgttgaagcagtattgccagaatatggaactttagggttggaatgcagtccacgaacagggctggacttcaacgaaatgatcttattgacgatgaaaaataaagcctggatggttcacagacaatggttctttgatctccccttaccgtggacgtcaggcgcaaccactgagacaccgacgtggaacaggaaggaactcttagtaactttcaaaaatgcacatgcgaagaaacaagaagttgttgtacttgggagtcaagaaggagcaatgcataccgctttgactggagcaacagaaatccaaaatagtggaggaaccagtatctttgccggacatctaaagtgcaggttaaagatggacaaattagaattgaaaggcatgtcttatgccatgtgtttaaacactttcgtgcttaagaaagaggtgagcgaaactcaacatggaacgattctaattaaagtcgaatacaaaggggaggatgcgccttgtaagataccgttttcaacagaagacggacaaggtaaagcgcacaatggtagacttataactgcaaatccggttgttacaaagaaagaagaacccgtaaacatagaagcagaaccgccctttggtgagtccaatattgttatcggaataggtgataaagctctaaaaattaattggtacaaaaaggggagctcaataggaaaaatgttcgaagcaacagctaggggagcccgtagaatggcaatattaggggatacggcttgggactttgggagtgtaggaggtgtattaaacagtctaggaaaaatggtccaccagatctttggtagtgcatacactgcattattctcaggtgtgtcctggatcatgaaaattggaataggagtgcttttgacgtggattggcctaaacagcaaaaacaccagtatgtctttctcctgtatagtcataggcatcataacactctatcttggagcagtcgtacaagcagacatggggtgtgctataaattggaagggaaaagaattaaaatgtgggtctggaatattcgtaaccaacgaagtacacacatggacagaacagtataagtttcaggcggattcgccaaaacgactagcaacagcaatagctggagcatgggaaaatggcgtttgtggtatcagaagtacaactagaatggagaacctcttatggaaacaaatagctaatgaactaaattacatattgtgggaaaataatataaaattaacggttgtagtaggagatatcatcggtgtcttagaacaaggaaaacggacactaactccccagccaatggaactaaaatattcttggaaaacatggggaaaagcgaagattgtcactgcggagacacaaaattcatcattcattattgatgggccaaatactccagaatgcccctcagcatcacgagcctggaacgtatgggaagtcgaagactacggatttggcgtttttacgactaatatctggttgaaattaagagaggtttatacacaaagttgtgatcacagactaatgtcagcagcaatcaaagatgaacgggctgttcatgcagatatgggatactggatagaaagtcagaaaaatggatcatggaaattggaaaaagcgtcatttatagaagtaaagacttgtacttggcctaagagtcatacgctatggtctaatggtgttttagaatcagatatgatcattccgaaaagcctagccggaccaataagtcaacacaaccacaggcccggatatcacactcagactgctgggccatggcatttaggtaaactagagctagattttaactattgtgaaggtacaacagtagttataactgaaaactgtggtactcgaggaccatcgttgagaacgacgacagtatcagggaaacttattcatgagtggtgctgcagatcttgtactttaccacctttgcgatatatgggcgaggatgggtgctggtacggtatggagataaggcccattaatgaaaaagaggagaacatggtaaaaagtctagtaagtgcaggcagcggtaaggtggataactttacgatgggcgtattatgcttagcaatcttatttgaagaagtaatgagaggcaaatttggtaaaaagcatatgatagctggtgtgttatttaccttcgtgctgttgttaagtggccaaattacatggagagatatggcacacactttaataatgattgggagcaatgcttccgacagaatgggaatgggagtgacttacttggcattgatcgccactttcaaaatacaaccattccttgctctaggattctttttacggaaacttaccagccgtgagaacctactactgggagtgggacttgctatggccacaactcttcaacttcctgaagacatagaacaaatggctaatggaattgcattaggcctaatgacattaaaacttataacacagtttgaaacatatcaattatggactgcgctagtttcattaacatgttcaaacacgatttttacactgacagttgcatggcgcaccgccactttaatactcgccggcgtctcactacttccattatgtcaaagtagttctatgcgaaaaaccgattggttacctatgacggtagctgcaatgggagtacctccactaccactattcatattttccttaaaagatacaccgaagcgaaggagctggccactaaatgaaggtgtgatggccgtagggttggtgtccatattagcttcctcactactaagaaatgacgtgcccatggcaggaccgttggtagcagggggattgctcattgcatgttatgtaatcacaggaacctcagcagacttaacagtcgaaaaggcagctgacgtaacatgggaggaagaagcagagcaaacgggtgtatcgcataaccttatgatcacagttgacgatgacggcacaatgagaataaaagacgacgagacagagaacatcttgacggtcctcctcaaaacagcattattaatagtatccggaatatttccctatagcataccagcaacactgctggtttggcatacttggcagaagcaaactcaaagatccggggtattatgggatgttcctagtcctccagaaacccagaaagccgaattagaagaaggcgtatacaggataaagcaacaaggtatcttcggtaaaacacaagtcggtgtgggagtccaaaaagaaggagtgttccatactatgtggcatgtaacaagaggggccgttttaacacataacggtaaacggttggaaccgaactgggcttctgtcaagaaagatctaataagctacggaggagggtggagactttctgcacaatggcaaaaaggtgaagaggtgcaagtaatagcagttgaacctggcaaaaaccctaaaaatttccaaaccatgccaggaatcttccagaccacaaccggagaaatcggagcaattgcactagatttcaaaccaggaacatcaggatcaccgatcattaatcgtgaaggtaaagtcgtaggattatatggaaacggcgttgtcacgaaaaacggcggctatgtttccggaattgcgcagactaatgctgaacctgacggtccaactccggagttagaggaagaaatgttcaagaaaagaaatctaacaattatggacttacaccctggctcaggcaagacaaggaagtatttacccgcaattgtacgagaagcgataaaaaggagattacgaacgttaatacttgccccaactcgggtagtcgcagcagagatggaagaagcactaaaaggattaccaatcagataccaaactacagctactaaatctgaacacacaggaagagagatagtagatttgatgtgtcatgccaccttcacaatgcgacttttgtcaccagtccgagtaccaaattacaatttaataatcatggatgaggcgcattttacagatcccgcttcaatcgcagctagaggctacatctctacccgggttggaatgggagaggcagcagcaatttttatgacagctacaccacccggaacggccgaggctttcccacaaagcaacgcacctatccaagatgaagaacgtgacattcccgaacgttcttggaactcgggtaatgaatggataacggattttgttggcaaaactgtatggtttgtaccaagcataaaggccggcaatgatatcgcaaattgcttaaggaaaaatgggaagaaggtcatacaactatctagaaaaacttttgatacagagtaccagaaaacaagactcaacgattgggatttcgttgtgacaacggatataagtgagatgggagcaaactttaaagcagacagagtcattgatccaagacgatgtctaaaacccgttattctaacagacggtcctgagcgagttattctcgcaggaccgatgccagtcacagcagcgtcggccgctcagagaaggggtagagttggtagaaatccacagaaggaaaacgatcaatacatcttcacaggacagcctcttaacaatgatgaagatcatgcacactggacggaagccaaaatgttgctagataatatcaacactcctgaaggaataatacccgcgctattcgaacccgagagagagaaaagtgcagctatagatggcgaatatagattgaaaggtgagtcacggaagacattcgttgaattaatgcgtcgcggggatctcccagtatggctagcacataaagtcgcatctgagggtataaaatatacagatagaaaatggtgcttcgatggtgaaagaaacaatcaaatactcgaggaaaatatggatgtcgaaatatggactaaagaaggtgaacggaaaaagttacgaccaagatggctggatgctagaacatattcagaccccttggcgttgaaagaatttaaagactttgcggcaggtagaaaatcaatcgctctcgacttagtgactgagatagggagagttccttcacatcttgcataccggacaaggaacgcccttgataacttagtaatgctacacacgtcagaacatggcgggcgagcttatcgacatgccgtagaagaactcccagaaacaatggaaactttgcttctattaggattaatgatcctgcttaccggaggggcgatgcttttcttaatttcaggaaaaggtataggcaagacaagcatagggctaatatgtgtaatagtatcatccggaatgttatggatggctgatgtacccttacagtggatagccagtgcaataatactcgaatttttcatgatggttttgcttatccccgaaccagaaaagcaaagaacaccacaagataaccagctagcctatgtagtgatagggatattaactttagcagcaatagttgcagccaatgagatgggcctattggaaacaacaaaaagagatctaggaatgtctaaagaacccggagtagtgagtcctacgtcgtatctagatgtggatctgcatccagcatccgcctggacactttatgcggtcgcaaccactgtcattaccccaatgcttagacacacaatagaaaattcaaccgccaatgtatcgttggcagccattgccaatcaagcagtagtcctcatggggttagataaagggtggccgatctcgaaaatggatctaggagttccgttattggccctgggatgttacagtcaggtcaatccactcactctcacagccgccgtgcttctcctagtcacacactatgcaataataggtccaggattacaggcaaaggcgacaagagaagcgcaaaaacggaccgcagcaggaatcatgaaaaatccgacggttgacggaataatgactatcgatcttgacccagtaatatacgactcaaaatttgaaaagcaattaggtcaagttatgctattggtgctatgcgcagtgcaactattgctgatgcgtacttcttgggcattatgtgaagcgctgacacttgccacgggaccaataactaccctctgggaaggctctccgggcaagttttggaacacaaccattgcggttagtatggcaaatatttttagagggtcatacttggctggagctggacttgccttttccataatgaaaagcgtaggcacgggacgaagaggcacaggttcacaaggagagaccttaggtgaaaaatggaaaaagaaattaaaccagctgagccgaaaagagttcgatttatacaagaaaagcggcataaccgaagtcgacagaacagaagcaaaagaaggattgaaaagaggggaaactacccatcatgcagtatctcgaggcagcgctaaacttcagtggtttgtcgaacgaaatatggtaatcccagaaggtagggttatagatttgggctgtggacgaggcggctggtcatattattgcgcgggtctcaagaaagttacggaagtacgcggttataccaaaggcggcccgggtcacgaggaacccgtgccaatgtcgacttatggttggaatctagtcaaacttatgtcaggaaaagacgtattttacctgccacctgaaaaatgcgatacgttgctatgtgacattggtgaaagtagtccctctcctacagtagaagaaagtcggaccatacgagtcctgaaaatggtagaaccatggcttaaaaataatcagttctgcataaaagtacttaacccatatatgccaacagttatagagcatctagaacgactgcaaagaaagtacggtggtatgttagttagaaacccactatctagaaattcgacacatgaaatgtattggatttcaaacggaacgggaaatatagtatcctcagtgaacatggtctcaagattattactgaatagattcacaatgacacacagacgcccaacgatagaaaaggatgtggacttaggagcgggtacgagacacgtcaatgctgaacccgaaactccgaatatggacgtaattggtgaaagaataaaacgaataaaggaagaacatagctctacttggcattatgatgacgaaaacccatacaaaacatgggcataccacggcagttatgaggttaaagcaactggatcagctagtagtatgataaacggggtagttaaactgctcacgaagccttgggatgtagttcctatggttactcagatggcgatgacggacactactccctttggtcagcaacgggtcttcaaagaaaaagtagatacacgtactccccgtcctatgcctggcaccagaaaggttatggaaataactgcagaatggctttggcgtactcttggaaggaacaagaaaccaagattatgcacgcgagaggagttcacaaagaaggttaggaccaacgcggcaatgggcgccgtgttcaccgaggaaaatcaatgggattcagcaagggcagctgtagaagacgaggagttttggaaattagttgacagagagagagagcttcacaaattggggaaatgtggttcatgcgtatacaatatgatggggaagcgagagaagaaactgggagaatttggaaaggccaaagggagtagagctatttggtatatgtggctaggagcaaggtatcttgagttcgaggcactggggttccttaatgaagatcattggttctcgcgtgaaaactcctattcaggcgtagaaggcgaaggtttacacaagttgggatatatactaagagacatatcaaaaatcccaggaggagcgatgtacgcagatgacaccgcaggatgggatacgagaataacagaagatgacctacataatgaagagaaaatcacgcaacagatggatccagaacatcgccaactagcaaatgcgatatttaagctaacatatcaaaataaagttgttaaggtccaacgacctacgccgaagggtactgtaatggatattatctccagaaaggaccaacgggggagtgggcaagttggcacatatgggttaaacacttttacaaacatggaggcgcaattagtcagacagatggaaggcgagggcgtactgagtaaagctgaccttgaaaatcctcatttattagagaagaaaataacccagtggctagaaacaaaaggagtagaaaggctcaagagaatggcaattagcggcgatgactgcgtagtgaagccgatagacgacagatttgcaaacgccctccttgcactgaatgacatgggaaaggtacgaaaggacattccacagtggcaacctagtaaaggatggcacgattggcaacaagtacctttttgctcacatcacttccacgaattgatcatgaaagacggaagaaagctagtagtgccctgcagaccacaagatgagttgataggtcgggcgagaatctcacaaggggcaggctggtcattaaaggaaacagcctgcttgggtaaggcctacgcccaaatgtggtcacttatgtatttccacagaagagatttgaggttagcaagtaatgcaatatgctcagctgtcccagtacactggatacctacgagccgtacgacctggagcatacatgcacatcatcaatggatgacaacggaggatatgcttacggtttggaacagagtgtggatagaagataatccatggatggaagacaaaacaccggtcacaacatgggaagacgtaccctatttagggaaaagagaagatcaatggtgcggatcattaataggcttgacaagtagagctacctgggcacaaaatatcctaacagcaatacaacaagtaaggagtttaatcggtgatgaagagttcttagactacatgcccagtatgaaacggtttaggaaagaagaggaatcagagggtgctatatggtaa

SEQ ID NO: 23491 - RNA, 9873 nt, synthetic construct
  misc_feature 1..9873: note = derived and/or modified CDS sequence (opt6) from DENV-3__FJ461326__SS-prME
  source 1..9873: mol_type = other RNA
acttctttatgccttatgatgatgcttccagcaacgctcgcatttcatttaacttcccgagatggggaacctaggatgatagtcggtaaaaatgaaagaggaaaaagtttactattcaaaactgcaagtggtataaatatgtgtacactgattgcaatggatttaggagaaatgtgcgatgataccgtaacttacaaatgtccattaattgcagaagtggaaccggaagatatagattgttggtgtaatcttacaagcacatgggttacctacgggacatgtaatcaagctggagaacataggcgcgataaaagatccgtagctctagcacctcacgtgggaatgggattggataccagaacacaaacctggatgtccgcagaaggagcatggcggcaagtggaaaaagtcgaaacatgggcattgcgacatcccggatttacaatactcgctctattcttagcgcattatatatcgacctcactgacacaaaaagtagtaatcttcatacttcttatgcttgtcactccatcaatgacgatgcgttgcgtaggcgtaggcaatcgtgattttgttgaaggtttaagtggagcaacatgggtcgacgtcgtgttagaacatggagggtgtgttactacaatggcaaggaacaaaccaacattagatattgaattacagaaaacggaagccacgcaattggctacactcagaaaactgtgtattgaaggaaaaattaccaacattacaacagatagtcgttgtccaactcaaggagaggcaatccttccagaagaacaagatcaaaactatgtctgtaaacatacatacgtggatagagggtggggaaatggctgcggtttattcgggaaaggttctttggttacatgcgcgaaattccaatgtctagaaccgattgaaggaaaagtagtacaatacgaaaatctaaaatatacagttataattacagtccataccggagaccaacatcaagtagggaacgatacacaaggagtcacagtggaaattacaccacaagcgtctacggtggaagcagtattaccggaatacggaacgcttggtctagaatgcagtcccagaactggcttagattttaatgaaatgatactattgactatgaaaaataaagcatggatggttcatagacaatggtttttcgatctgccactgccttggacaagtggggctacgactgaaaccccgacctggaatcgaaaagaactattagttacgtttaaaaatgctcatgctaagaaacaagaagtcgtagtattaggatctcaagaaggtgccatgcacacagcgttaactggtgcgacagaaattcaaaatagcggaggcacgagcattttcgcaggacacctaaaatgtcgcttaaaaatggataaattggagttaaaaggaatgagttacgcaatgtgtctaaatacatttgtattgaagaaagaagtctcagaaactcaacatggaacgatcttgattaaagtggaatataaaggcgaagacgctccgtgtaaaatcccattttctacagaagacggtcaaggaaaagcccataatggcagattaattacagctaacccagtagtgaccaagaaagaggaaccagtcaatatagaggctgaaccaccctttggagaatcaaatattgtaattgggataggggacaaagctctaaaaataaactggtacaagaaaggatcatctatcggaaaaatgtttgaagcgacagcaagaggagcaagaagaatggcaatcttaggcgacactgcgtgggattttggatcggtcggtggcgtcttaaattcattaggcaaaatggtgcatcaaatatttgggtctgcatacacagctctgttttccggtgtatcctggataatgaagataggaataggagtactactgacatggattggtcttaattcgaagaacacaagtatgtcattttcatgtattgtcattggtatcattacgttgtatttaggagcggtagttcaggcagatatgggttgtgctattaactggaaggggaaagaactaaaatgtggatctggaatttttgtaactaatgaggtacacacttggactgagcaatacaaatttcaagcagattcgccgaaaagacttgccacggctatagccggtgcttgggagaatggggtttgcggcatcaggtccacgaccagaatggaaaacctactttggaaacagatagcaaatgaattaaattatatactgtgggaaaataatattaaattaactgttgtagtgggagatatcattggcgtcttagaacaaggcaaaagaacgttaacaccacaaccaatggagctaaaatattcatggaagacatggggcaaagcaaaaatagttactgcagaaactcaaaactccagcttcataatcgacggacctaataccccagaatgtccaagcgctagccgggcatggaatgtatgggaagtcgaagattatggcttcggagtatttacaacaaatatatggctaaaattgagagaagtatatacacagagttgcgatcatagattaatgtcagctgcaatcaaagatgaacgggctgtacatgcggacatgggatattggatcgaatcgcagaaaaatgggtcttggaaactcgagaaggcatccttcatagaagtgaaaacatgtacgtggccaaaaagtcatactctgtggtcaaatggagtgcttgaaagcgacatgataattcctaaatctctagcaggacctatttcgcaacacaaccaccgcccaggataccatacacaaacagcaggaccgtggcatttaggaaaattggaattagattttaattattgtgaaggcaccactgttgtcattacggagaattgcggcacgcgaggacccagcttaaggacgacgacagtaagcggtaagctaatacacgagtggtgttgtagaagttgtacattacccccgcttcgatatatgggagaagacggatgttggtatggtatggaaatccgaccgattaatgagaaagaagaaaacatggtaaagagcttggtgtcagctggctccggcaaagtagacaattttacaatgggcgtattgtgtcttgctatattgttcgaagaagtcatgagaggaaaatttggcaagaaacatatgatcgcaggagtattattcacttttgtactgttattatcaggacaaatcacatggcgtgatatggcgcatactttaattatgattggcagtaacgctagtgaccggatgggtatgggagtaacttacctagcattaatcgccacattcaaaattcaaccatttctcgcgttagggttctttttgagaaaactcacatctagagaaaatctactgcttggagttggcctcgccatggcaacgacattacagttgccagaagacatcgagcaaatggctaacggaattgctctgggtcttatgaccttgaaattaataactcaattcgaaacataccaattgtggaccgcattagtttcattaacgtgctcaaatacaatcttcacacttacagtagcatggaggacagcaaccttaatattagcgggagtgtctttactacccttatgtcaaagttcaagcatgagaaaaacagactggttacctatgacagtagcagccatgggagtgcccccactaccgctttttatatttagtttaaaagatactcccaaacgacggagttggccccttaacgaaggagtcatggcggtcggattagtgtcaatactagcgtcaagcctacttcggaatgatgtccccatggcgggaccacttgtcgctggcggattactaatagcatgttatgtgattaccggaacttcagctgaccttaccgtcgaaaaagcagccgacgtcacgtgggaagaagaggccgaacaaactggggtttcacacaacctaatgataacagttgatgacgatggtacaatgcgtattaaggacgatgaaaccgaaaatattctgacagtattacttaagactgcattattgatagtttcgggcatattcccttactcaattcctgccacacttctagtatggcacacgtggcaaaaacagacccaacgatcaggggtattatgggacgtgccgtcgccacccgaaacgcagaaagcagagttagaagaaggagtatacagaatcaaacaacaaggaatattcggcaaaacacaagtgggggtgggggtacaaaaagaaggagttttccatactatgtggcacgtcacacgaggtgcagttctaactcataatggaaagagattagaaccgaattgggcatcagttaagaaagacttaattagctatggaggcgggtggaggctttcagcacaatggcaaaaaggggaagaagtacaagtgatagccgttgagccaggcaaaaatcctaagaactttcaaaccatgccaggtatctttcaaactacaactggagaaataggcgcaattgcactagattttaagccaggtacgagcggaagtccaattataaaccgcgaggggaaagtagtagggctatatggaaacggtgtagtcacaaagaatggcggttacgtgtctggcatagctcaaactaacgcagagccagatggaccaacaccggagttagaggaagaaatgtttaagaaaaggaacttaacaataatggatttacatccgggttcgggtaaaactagaaaatatttgcccgccattgttagggaagcaattaaaagacgtctaagaacattaatcctcgcacccactagggtggtagcagctgaaatggaggaagccctaaaaggattaccaatacgatatcaaacgacggctactaaatcagaacacactggtcgagaaatagtagatctaatgtgccatgcaacctttaccatgagactactctcacccgtaagggtacctaactataatttgattataatggatgaagcccattttacagatccagcaagcatcgcagcacgcgggtatatcagtacacgtgttggcatgggagaggctgctgcaatctttatgactgcgacgcctcctggtacggccgaggcattcccacaaagtaatgcaccgatccaagatgaagaaagagacataccagaaagatcttggaactcaggcaatgaatggattacagacttcgtaggaaagacagtttggttcgttccgtctataaaggcaggtaatgacatcgcgaactgtttaaggaaaaatggtaagaaggtcatacagctctcacggaagacatttgatacagaatatcagaaaacgcgattaaacgactgggattttgttgtcacaacagatatctccgaaatgggggcaaatttcaaagctgatcgtgtgatcgatccaagaagatgtctaaagcctgttatattaacggacggacccgaaagagttatactagccggtcccatgcctgtaacagccgccagcgcggctcaaagaaggggtcgagttggacgtaaccctcaaaaagagaatgaccaatatatttttacaggtcagccactcaacaacgatgaagatcatgctcactggacagaggcaaaaatgctgctagacaacataaacacaccagaaggaattataccagctctttttgaaccggaaagagagaaaagcgctgccatagacggtgaatatcgcttgaaaggagaatccaggaaaaccttcgtagaattgatgcgaagaggggatttaccggtctggctagcgcacaaagtagctagtgagggaattaaatatactgacagaaaatggtgtttcgatggtgaaaggaataaccaaattctcgaagaaaacatggacgtcgaaatttggacaaaagagggagagcgcaagaaattaaggccaagatggctagacgcaaggacatatagcgatcctctggcattaaaggagttcaaggactttgctgctggtcgtaagagcatagctctggacctagtcactgaaattggtagagtaccgtctcatctagcgtatcgaacacgtaacgcattggacaatttagtcatgttacacacaagtgaacatggaggcagagcatatagacatgcggtggaggaactacctgaaactatggaaacactactactacttggtctaatgatactcctgaccggtggagcaatgttattcttaattagtggaaaaggtatcggaaagacaagcataggattaatctgcgttattgcgtcgtcaggaatgctatggatggcagatgttccactacaatggatagcctcggcgatcatactggagttcttcatgatggttctactaatacccgaacctgaaaaacagagaactccacaggataatcaattagcttatgtggtgataggtatcctgacgcttgcggccatagtggctgctaatgaaatgggtcttcttgaaacgacgaaaagggatttaggtatgagcaaagaaccgggtgtcgtctccccaacatcctacctagacgtagacctgcaccctgcgagtgcatggacactttatgccgttgcaacaactgtaataacgcctatgcttaggcatactattgaaaatagcacagctaacgtatcactagccgctatcgccaaccaagcagtagtcctaatgggcttagataaaggctggcccatatctaaaatggaccttggggtaccactactcgctctaggatgctactctcaagtaaatccactaactctaacggcggcggtcttactattagttacgcattacgcaatcattgggcccggattacaagcaaaagcgacacgtgaggcacagaaaaggaccgcagcgggaataatgaaaaatccaaccgtagatggaatcatgacgatagacttagatcccgtgatctatgattcgaagttcgagaaacaattaggtcaggttatgttgcttgtcttatgtgctgttcaactactcctaatgcgtacatcgtgggcattgtgtgaagcattaacattggcgaccggccctattacgacactatgggaaggtagccccggtaagttttggaatacgacgattgccgttagtatggctaatatatttagaggatcatacttagctggagcaggactagcattcagtataatgaaatctgtaggaactggtagacgcggaacgggtagccagggggaaactctaggagagaagtggaagaagaaattaaatcagttatctcgtaaagaatttgatctttataagaaatctggaataacggaagttgaccgcacagaggccaaagaaggactaaaacgcggtgagacaactcatcacgctgtaagtcgtggttcagccaaattgcagtggttcgttgaaagaaatatggtgattcccgagggcagagtgatagacttaggttgtggccgagggggttggtcgtactattgtgctggactaaagaaagtaacagaagttcgtggatacacaaaaggtggaccgggacatgaggaacctgtacctatgagtacatatggatggaatcttgtcaaattgatgagcggaaaagatgtcttctaccttccaccagaaaaatgcgacactttactgtgcgacattggcgaatcgagcccatcgccaacagtcgaagaaagccgaactattagagtactaaaaatggtagaaccctggcttaaaaataatcagttctgcattaaagtcctaaatccttatatgcccactgtaattgaacatttagaaagactacaacgaaaatacggcggaatgctagttagaaatcctctgagtcgtaattcaactcatgaaatgtattggatttcaaacggaaccggtaatattgtatctagtgtaaatatggtttcgcgattgctccttaatcgattcaccatgacgcatcgtcgaccaacaatcgaaaaagatgtcgacttaggagcgggaacaagacacgtaaacgcggaaccagagacaccaaacatggacgtcattggagaaaggattaaacgcataaaagaggaacactcatcaacttggcactacgatgacgagaatccatataaaacatgggcatatcacggtagttatgaagtaaaagctacagggagcgcttcatcaatgataaacggagttgtaaaattattaacaaagccttgggacgtcgtaccgatggtaacccagatggctatgactgataccacgccttttgggcaacaaagagtctttaaagagaaagttgatactcgtacgcctaggcctatgccgggaacgagaaaagttatggagattactgcagagtggctttggaggactttaggtaggaacaagaaaccgaggttatgtactagagaagaatttacgaagaaagtgcgaacgaatgctgccatgggggctgttttcactgaagagaaccaatgggattcagccagagctgccgttgaagacgaagaattttggaagttagtcgatcgtgaacgagaattacataagctgggtaaatgtggatcatgtgtttataatatgatgggaaaaagggagaagaaattaggggaatttgggaaagccaaagggagtagagcaatatggtatatgtggctgggggcacgctatttggagttcgaagcactcggattcctaaatgaagatcattggttcagtcgagaaaattcgtattccggtgtagaaggtgaaggactacataaacttggatatatattacgagatatttcaaaaatcccaggcggggcaatgtacgcagacgacacagcaggttgggacacacgaattacagaagatgatctccacaacgaagagaaaattactcagcaaatggatccagaacatagaaaactagctaacgcaattttcaaattaacataccaaaataaagtcgtaaaagttcaacgacctacgcccaagggtactgtaatggatataatatctcgtaaagatcagagaggaagcgggcaggttggcacatatggacttaatacattcacaaatatggaagctcagctagttcggcaaatggaaggggaaggcgtactttcaaaagctgatctagaaaatcctcatcttctggagaaaaagattacacaatggctagaaacaaaaggggtagagaggctaaagagaatggcgatttctggcgacgattgtgtggttaaaccaattgatgatagattcgcgaatgcgttactagcattaaatgacatgggtaaagtaagaaaagatattcctcaatggcaaccatccaaagggtggcacgattggcaacaagttccgttctgtagtcatcattttcatgaattaatcatgaaagatgggcgtaagttggtcgtaccgtgcagaccgcaggatgaacttattggacgagcacgtatcagccagggcgcaggatggtcgttaaaggaaacagcttgtttagggaaggcttatgcacaaatgtggtccctaatgtattttcaccgccgggatcttaggcttgcctcgaacgccatctgttccgccgtacctgtacattggatcccaacttcacgaacgacgtggtccatacacgctcatcatcaatggatgactactgaagacatgttaacagtttggaatagggtctggatagaggataacccatggatggaggataaaacgccagtgacgacatgggaagatgtcccgtacttaggaaaaagagaagatcaatggtgcggaagtctgattggtttgactagccgtgcaacatgggcacaaaacatattaacagctattcaacaagtacgttctttaatcggagacgaagagttcctagactacatgccatcaatgaagcgattcagaaaggaagaggaatcggagggggcaatatggtaa

SEQ ID NO: 23492 - RNA, 9873 nt, synthetic construct
  misc_feature 1..9873: note = derived and/or modified CDS sequence (opt6) from DENV-3__FJ461329__SS-prME
  source 1..9873: mol_type = other RNA
accagtttatgtttgatgatgatgttacctgcaaccctagcattccatctgacctcaagagacggcgaaccaagaatgatagtaggtaaaaacgaaagaggtaaaagtttactgtttaaaacagcgagcggaataaatatgtgtacattaatagctatggatctaggagaaatgtgcgatgataccgtcacgtataaatgcccactaattgcagaagttgaaccagaagatatagattgttggtgcaatttaacttcaacatgggtaacatacggtacatgtaaccaagcgggtgaacatcgacgggacaaacgatcagttgcattagcacctcatgtcgggatgggtttagacacaagaactcaaacgtggatgtcagcggaaggtgcgtggcggcaagtggagaaagtggaaacatgggctttacgccacccaggattcacaatactagcattattcttagctcactatattgggacttcgttgactcaaaaagttgttatctttattctattgatgctagttacgccaagtatgacaatgcgatgtgttggcgtaggcaatagagattttgttgaaggcctatccggtgcaacttgggtagacgtcgttcttgaacatggaggttgcgtaacgacaatggctaaaaataaaccaacattagatatagaattgcagaaaacagaagcaactcaattggccacgctgcgtaaactttgtatagaaggaaaaatcactaatattacaacagactcaagatgtcctacccagggagaagcaatcttacctgaggaacaagaccaaaactatgtatgtaaacatacgtacgttgatagaggatggggtaatggatgtggcctatttggcaaagggtccctggtcacgtgcgccaaatttcaatgtttagaaccaattgagggcaaagttgtacaatacgaaaatttaaaatatactgtgataataacagtccacaccggtgaccagcatcaagttggaaacgacacgcaaggagtaactgtcgagataacgccacaggcttcaaccgtagaagcagtattgccagagtacggcacattaggtttagagtgcagtccaagaactggtctagacttcaacgaaatgatacttttgacaatgaaaaacaaggcttggatggtacatagacagtggttctttgatttgccattaccatggacgtcaggagcgacaacagagacacctacatggaacagaaaagaacttttagttacgtttaaaaacgctcatgccaagaaacaggaagtagttgttttaggaagtcaagagggtgccatgcatacagcattaacgggtgcgaccgagatccaaaatagtggagggacctcaatttttgcaggtcacctgaaatgccgattaaaaatggataaactagaattaaaagggatgagttatgcaatgtgtctcaatacttttgttctgaagaaagaggttagcgagacacagcatggaactatattaataaaagttgagtacaaaggagaagatgcaccttgtaaaataccattctccacagaggacggtcaaggaaaagcgcataatggccgcttaataacagcaaacccagtagttactaagaaagaagaacccgtcaacatagaagctgaaccaccgtttggagaaagtaatatcgtaataggaatcggagacaaagcacttaaaattaactggtacaagaaaggctcaagtatcggaaaaatgtttgaagctaccgctcgtggagctcgaagaatggctatattgggagatactgcatgggattttggaagtgttggaggagtacttaacagcctaggtaaaatggtacatcaaattttcggttcagcatacacagcgcttttctcaggtgtatcatggatcatgaaaataggtatcggcgtactattaacttggatcggattaaatagcaaaaacacttcaatgagtttctcgtgcatagttataggtataataactctctatttgggtgcggtcgtacaggcggacatgggatgtgcaattaactggaaagggaaagaacttaaatgtggatctggaatatttgtgacaaatgaagttcatacatggaccgaacaatataaatttcaagcagattcaccaaagaggcttgcaacggcaatagcgggagcatgggaaaatggtgtatgcggaataaggtcaacgacccgcatggagaatttgctttggaaacagatagcaaacgaactcaattatatcttatgggagaacaatattaagttgacagtcgttgtcggcgatattattggagtgcttgaacaagggaaaaggaccttaacaccccaacctatggaattaaaatattcttggaaaacctgggggaaagctaaaatagtaacagcagaaacccaaaattcttcctttattattgatgggccgaatacaccagaatgtccaagtgcatctcgggcatggaatgtttgggaagtagaggattatgggttcggagtatttaccacaaacatttggttaaaactacgagaagtctacacacaaagttgcgatcacaggcttatgtccgcagctataaaagatgaacgtgccgtacacgcggatatgggctactggatagaatcacagaaaaatggaagttggaaattagaaaaagcatcatttattgaagtaaaaacatgtacatggccaaaaagccataccttgtggtctaatggcgtattagaatcagacatgataatacctaagagtttggctgggccgatatcccaacacaatcatagaccaggataccatacacaaactgcaggaccctggcacttgggcaagttagaactagatttcaactattgtgaaggtacaactgttgttatcacagaagattgtggcaccagaggaccatcattaagaacaacgacagtatcgggtaaattaatacacgaatggtgttgtcggtcgtgcacactgccaccattgcgatacatgggagaagatggttgctggtatggaatggaaataagaccaataaatgaaaaagaggaaaacatggtcaaatcgcttgtgagtgcaggcagcggtaaagtggataattttacaatgggtgtactctgtttggccatactatttgaggaggtaatgagaggtaaatttggaaagaaacacatgatagctggtgttttatttacatttgtccttttattaagtgggcaaataacatggcgcgatatggctcatactctgatcatgattggaagtaacgcatccgatagaatggggatgggtgtaacttacttagcgttaattgcgacattcaaaattcaaccttttctagcattaggatttttcctgagaaaactcacttctagagagaacttactcttaggagtcggattggctatggccaccactttacagctccccgaagacatagaacagatggctaatggaatagcattggggttaatgacactgaaactgataacacaattcgaaacatatcaactatggacagccctagtatctttgacctgttctaataccatattcacactgaccgtagcatggagaacagcgactctaatattggctggggtaagcctactgcctttgtgccaaagttcatcaatgcgtaaaaccgactggctacctatgacggtcgcagcgatgggcgtaccgcccttaccgcttttcattttcagtttaaaagatactccgaaacgaagatcttggcctttaaacgagggagttatggctgtcggcttagtttcaatattagcatcatctctgctacgcaacgacgtaccaatggcaggacctctagttgctggcggcttgctaatcgcctgttacgtaatcacgggtaccagcgcagacttgactgttgaaaaggccgcagatgtcacttgggaagaagaagctgaacaaactggagtatcccacaacctgatgattactgttgatgatgatggcactatgcgaattaaagatgatgagacagaaaacatcctgacagtcttactgaaaacagcacttttgattgtctcaggtatctttccatacagcatcccagctacactcctagtctggcacacatggcagaaacagacgcaacgttctggcgtcctttgggatgtcccaagtccaccagagacacaaaaagccgaactggaagaaggggtgtacaggattaaacaacaaggaatatttggtaagacacaggtcggggtaggcgtccaaaaagaaggcgtatttcacacaatgtggcatgtaacacgtggcgcagtgttaactcataacggcaaacgattagaaccgaactgggcttcagtcaagaaagacttaatctcctatggcggaggatggcgcctcagtgctcaatggcaaaaaggggaggaagtacaggtaatagccgtagaacctgggaaaaatcccaagaatttccagactatgccgggtatattccaaactaccacgggcgagataggagctattgctttagattttaaaccaggaacgagtggttcgccgattataaatcgagagggaaaagtagtgggcttatacggcaatggcgttgtgaccaaaaatggaggctatgtgtcaggaattgcgcaaactaacgcggaaccagatggaccaacaccggaactagaagaagaaatgtttaagaaaagaaatttgaccataatggatctccaccctggatcaggaaaaacaaggaagtaccttccagcgatagtgagggaagcaatcaaaagaaggttacgaacactaatcctagcacccacacgagtggttgctgcagaaatggaagaagcattaaaaggcctacctattaggtaccagacaacagccacaaaaagtgaacacacgggacgagaaatcgttgatttgatgtgtcatgcgacattcacaatgcgccttttaagcccagtgagggtaccaaattataatctcatcattatggacgaagctcatttcaccgatcctgcatccatagcggcgaggggatatattagtacacgagtaggcatgggggaggctgctgctatttttatgactgcaacaccaccggggactgctgaagcattcccgcaatcaaacgctcctattcaggatgaagaaagagatattcctgaaaggagctggaactccggtaacgagtggataaccgattttgtaggaaaaacagtctggtttgtcccatcaattaaagccggtaacgatattgcaaactgccttaggaaaaatggcaaaaaggtaatacaactatcaaggaagacatttgatacagaataccagaaaaccaggttgaacgattgggattttgttgtaacgaccgatatatcagagatgggcgcaaattttaaagctgatagggttatcgatcctcgtcgatgcctcaaaccggtgattctaacagacggtccagaacgcgttattctagctggtcctatgcccgttacggcagccagtgcggctcaacgtagaggaagagttggaagaaatccccaaaaagaaaacgaccaatacattttcactggtcaaccactcaataatgatgaagatcatgctcattggacggaagctaagatgttattagataacataaacaccccagagggcataattcccgccttgtttgagccagagagagaaaagtccgcagcaatcgatggagaatataggctaaaaggggaatcacgaaaaacgtttgtcgaattgatgcgaagaggagacctcccagtatggctcgcccataaggtggcttctgaggggataaaatatacagacagaaaatggtgttttgatggcgaaagaaacaaccaaattttagaagaaaacatggatgtagagatatggacaaaagagggggaaaggaagaaattacgtccacgatggctagacgcaagaacatattcagatccactagcgcttaaggaatttaaagactttgcagcgggtcgaaagtcgatagcccttgacctcgtgacggagataggccgtgtcccctcacatttagcatacaggacacgaaatgcattagataacttagtaatgctccatacgagtgaacatggaggacgcgcatacaggcatgcagttgaagaattacccgaaacaatggaaacgttgcttttattaggcttaatgatattacttactggaggagcgatgttatttttaatttcagggaaaggtataggaaaaacgtcgatcggactgatatgtgtaatagtctcatcgggaatgctatggatggcggatataccgctgcaatggatcgcaagtgcgatagtccttgagttctttatgatggtactattaatacctgaacccgaaaaacaaagaacaccacaggacaatcaattagcctatgtagtgatcggcatattgactttagcagcgattgtcgcagctaatgagatgggactattagaaacaacaaaaagagatctcggcatgtcgaaagaaccaggtgtagtgtctccaacctcgtatttggatgttgacttacacccagcatccgcatggaccttatatgctgtagcaacgacagtaataacaccaatgctaagacacactatagaaaatagtaccgcaaatgtctccctcgcagctattgcgaaccaagctgtagtattaatggggcttgataaaggatggccaatatcaaagatggacttaggtgttccccttttggcgctaggctgttattcccaagtcaatccgctaaccttgacagccgcagttttactactcgtgacgcattatgcaataatcgggcccggacttcaagctaaagctacgcgtgaagcacagaaaagaacggctgctgggataatgaaaaatccaacagttgatggtataatgacaattgatctagaccccgtaatatatgattctaagtttgaaaaacaactgggtcaagtgatgttattagtcttatgtgcagttcaattgctgcttatgcgtacatcttgggccctatgcgaggctcttaccctcgcaaccggacccataactacactttgggaaggctcacccggtaagttttggaatacaacgattgctgtcagcatggcaaacatctttaggggatcgtacctcgcgggtgctggattggcattttcgattatgaaatccgttggcactggtagaagaggtacaggatcgcagggcgagaccttgggcgagaaatggaaaaagaaactaaaccaattatcgagaaaagaatttgacctatacaagaaatcaggaattacagaagtagacagaaccgaagccaaagagggactgaaacggggagagactacccatcacgctgtttcaaggggttccgctaaactgcagtggtttgtagaaagaaacatggtaattcccgaagggagagtgatagacctgggctgcggacgcggcggatggagctattactgcgcgggcctgaagaaggtcactgaagtgaggggatacacgaaagggggcccgggccacgaagaacctgttccaatgagcacctatggttggaacctagttaaattgatgagtggaaaagatgtattttacttaccaccagagaaatgcgatactctactatgcgatataggagaatcatcacctagcccgaccgtagaagaatcaaggacgatccgagtgctaaaaatggtggaaccgtggctgaaaaataaccaattctgtataaaagttctaaatccgtacatgccgacggttatcgaacatctagaaaggttgcaaaggaaatatggtggcatgcttgtcagaaatccgctaagtagaaattctactcatgaaatgtattggatctccaacggtactggtaatatcgtgagcagtgtcaacatggtctcgcgactactattaaacagattcaccatgactcataggcgccccaccatagaaaaagacgtagacttaggggctgggactaggcatgttaatgctgaaccagaaacaccaaacatggatgttataggagaacggataaaacggataaaagaagaacattcatctacatggcactacgatgatgaaaatccatacaagacatgggcatatcatggcagctacgaggtcaaagcgaccggttcagcatcgagcatgataaacggggtagtgaaattactcacgaagccgtgggatgtcgttcccatggtcacacaaatggccatgaccgataccacaccgtttggacaacaacgtgtcttcaaagagaaagtcgacacgaggacaccgagaccaatgccagggactcgtaaggtaatggaaatcactgcagaatggctatggagaacactaggcagaaataagaaaccacgtttgtgcactcgggaagagttcaccaagaaagtcagaacgaatgctgcgatgggagcagtattcacggaagagaatcaatgggattcagcaagagctgcagtggaagacgaggaattttggaaattagtcgaccgggagcgcgaattgcataaattaggcaaatgcggtagttgtgtctataatatgatgggaaaacgagagaagaaacttggggaatttggaaaagcaaaagggtcacgggctatctggtacatgtggctaggagcgcgatatttggaatttgaggctttaggattcttgaatgaagatcactggttctccagagaaaatagttattcgggtgtcgaaggcgagggattgcataaattgggatatatacttagagacatttcaaaaattccaggcggagccatgtatgcagatgatacagcaggatgggatacacggattacagaagatgacttacacaatgaagagaaaataacacagcaaatggatccggaacatagacagcttgcaaatgcaatattcaaattgacttatcaaaacaaggttgttaaagtacaaaggcccacaccaaaaggtacagttatggacataatctcacgaaaagaccaaagaggaagtggacaagtaggaacatatggattgaacacatttactaatatggaagctcagttagtcaggcaaatggaaggagaaggagtgctttctaaagctgacctagaaaatccacatctcttggagaagaaaatcacacaatggctagaaacaaaaggggttgaacggttaaaacggatggcaatctcaggcgatgattgtgtggtcaaacccatagatgatcgatttgctaatgcgttactggcgctaaacgatatgggaaaagtgcgcaaagacataccacagtggcaaccttcaaaaggctggcatgattggcaacaagtccctttttgttcccatcattttcatgagctaattatgaaagatgggagaaagctagtagtaccatgtagaccccaagacgaactgattgggagggcaagaatctcacagggagctggttggagtttaaaggaaacagcctgccttggtaaggcatatgctcaaatgtggtcgttgatgtattttcacaggagagatcttcgacttgcatccaacgctatatgctccgctgtgcctgtccattggatccccacgtcacggacaacctggagcatacatgcgcaccaccaatggatgacaacagaggatatgctgaccgtatggaaccgtgtttggatagaagataacccgtggatggaagataagaccccagtcacaacttgggaagatgtaccgtatttggggaaaagggaggaccaatggtgcggatccttaatcggtctaacatctagggcaacttgggctcaaaatatcctaactgctattcaacaagttagaagcctcataggaaacgaagaatttctggattacatgcctagtatgaaacgatttaggaaggaagaagaatctgagggagcaatctggtga

SEQ ID NO: 23493 - RNA, 9873 nt, synthetic construct
  misc_feature 1..9873: note = derived and/or modified CDS sequence (opt6) from DENV-3__KF955459__SS-prME
  source 1..9873: mol_type = other RNA
actagcttatgtttaatgatgatgcttccagctactctagcatttcacttgacctcaagagatggagaacctagaatgattgttgggaaaaatgaacgaggaaaatcactattattcaaaaccgccagcggaattaatatgtgtaccttgatagcaatggatcttggagaaatgtgtgatgataccgtcacgtataaatgtcccctcatcgctgaagtagaaccagaagacatcgactgttggtgtaatctaacctcaacctgggtcacatacggaacatgtaatcaagccggagaacatagaagagataaacgaagtgtagccctcgcacctcatgtaggtatgggtttggatacacgaacgcaaacatggatgagtgcagaaggggcgtggaggcaagtcgaaaaagttgaaacctgggccttaagacatcccgggttcacgatattagctttattcttagctcactatatagggacttcactaacacaaaaagtagttatttttatactattaatgctagtaaccccctctatgacaatgaggtgtgtaggtgttggtaatcgggactttgtcgaaggactgtcaggagcaacatgggttgatgtcgttctcgaacatgggggatgcgttacgacaatggctaaaaataaacccacgctagacattgaactccagaaaacagaagctacacaactagctaccctaaggaaattatgtatagaaggaaaaataacaaatataacgacggattcgcgatgtccgacacaaggagaagcaatattgcccgaagaacaggaccaaaattatgtttgtaaacatacatatgttgaccgcggctggggcaatggttgtggactgtttggaaaaggttctctcgtaacctgcgcaaaatttcagtgcttagaacctatagaaggaaaagtagtacaatatgaaaatctgaaatacacggtaataattacagttcataccggggaccaacatcaggttggaaatgacacacaaggagtaacggtagaaatcacccctcaagcgtcaactgtcgaagccgttcttccggaatatggtacgcttggtctggaatgctcacccagaacaggactggatttcaacgaaatgatattattaaccatgaaaaacaaagcatggatggtgcataggcaatggttcttcgacctcccacttccgtggacatctggagcaaccactgaaacgcccacctggaatagaaaagaactcttagtaacgttcaaaaatgcacatgcaaagaaacaagaagtcgtggtattaggtagtcaagaaggggcaatgcatacagcgctcacaggtgcaacggaaatacagaatagcggaggtaccagcatctttgctggacacttaaaatgcagattaaaaatggacaaattagagcttaaagggatgagctatgcaatgtgcttaaatacatttgtcctaaagaaagaagtatctgaaacacagcacggaactatcttaataaaagtcgagtataaaggagaagatgctccatgcaaaataccttttagcactgaggatggacagggtaaagcacataatggacgtttgataacggcgaatccagttgtcaccaagaaagaagaacccgtgaacatcgaagctgagccaccctttggtgaaagtaatatagtaataggaataggcgacaaagcccttaaaataaactggtacaagaaaggctctagtattggcaaaatgttcgaagccaccgctagaggtgctagacgaatggcaattttaggagacactgcatgggatttcggatcggtcggtggggttttaaactccttaggcaaaatggtccatcaaatattcgggagtgcatataccgcactgttctcgggtgtatcctggataatgaaaataggcatcggtgttctccttacatggatcgggttgaactccaaaaacactagcatgagtttttcttgcatagtaataggcattattaccctatatctcggcgctgtagtccaagcagatatgggatgtgccattaactggaaagggaaagaattaaaatgtggaagtggcatattcgtaacaaatgaagtccatacttggacggagcaatacaaattccaggctgacagcccaaaaagattagccacagcgatagctggagcgtgggaaaatggagtctgtgggattaggtctgcgacacgaatggaaaatttattatggaaacaaatcgccaacgaattaaactatatattgtgggagaataatatcaaattaaccgtggttgtgggtgacattattggagtgttagaacaggggaaacgaacgcttacaccccaacccatggaactaaaatattcctggaaaacatggggtaaagctaaaatcgtcacagccgaaacccaaaactcgagctttataatagacgggccaaatacccctgagtgtccgagtgctagtcgcgcttggaatgtttgggaagttgaggactacggctttggagtgttcacaacaaacatatggttaaaactaagagaagtttacacacaatcatgcgaccatagattaatgtcggcagcgataaaagatgaaagagcagtccacgccgatatgggatattggatcgaaagtcagaaaaacggttcttggaaactcgagaaagcatcctttatagaagtaaaaacttgcacatggccaaaatcgcacaccttgtggagcaatggcgtcttagaaagtgacatgataatcccaaagagcttggccggacctatatcacaacacaaccaccgcccaggttaccacacacaaacggcaggcccttggcacctaggaaaactcgaactagacttcaactactgtgaagggacgacagtggtaataacggaaaattgtggaacacgcggcccgtcattaagaacaacgactgtgagcgggaaacttatacatgaatggtgctgccgaagttgtactctaccgccacttcgatatatgggagaagacggttgttggtacggtatggaaatcaggcccataaatgaaaaagaagagaacatggttaaatcattagtatcggcgggatcgggaaaagtcgataattttacaatgggtgtcttatgtttggcaatcctattcgaggaagttatgagaggaaaatttggtaagaaacacatgatcgcaggcgtactattcacttttgtattactcctgagcggacagataacttggcgagacatggcacatactctaattatgataggcagtaatgccagtgacaggatggggatgggagtaacctatttagctcttatcgctactttcaaaattcagccctttctggctttagggttcttcctaagaaaacttacatcaagagaaaatctgctactaggcgtgggcttagcaatggcaacaaccttgcaattacctgaggacatagagcagatggcaaatggtattgcattaggcctcatgacattaaagctaatcacacaatttgaaacatatcaattgtggaccgcacttgtaagtcttacttgtagtaacacaatctttaccttaacagtagcttggaggacagctaccctaatcttagcaggggtttcattacttccactttgccagagtagtagcatgaggaaaacggactggttaccgatgacggtcgcggcgatgggagttccacctcttccgctctttattttcagtctaaaggacacaccaaaacggagatcatggccacttaacgaaggcgtaatggctgtaggcctagtttctatattagcgagttcactactcagaaatgacgttcctatggcagggcctttagtagcaggcggcttattaattgcttgttatgtgatcacaggaacttcagctgatttaacagtcgaaaaggcagctgacgtcacatgggaagaagaagcagaacagactggggtgtcgcacaacctaatgatcactgtggatgatgatggaactatgcgcattaaggacgacgaaacagaaaacatattaacagtattactaaaaacagctttactgatagtgagtgggatttttccgtactcaatccctgcgactcttctggtatggcacacatggcaaaaacagacgcagagaagcggagtactatgggacgtaccctcgccaccagagactcaaaaagcagagttggaggagggagtatatagaattaaacagcaaggtatattcggtaaaacacaagtcggtgtcggggttcaaaaagaaggcgtttttcacacaatgtggcatgtaacccgtggggctgtacttactcacaatgggaaaagacttgagccgaattgggcatctgttaagaaagatctaatttcctatggaggaggctggcgactatcggctcaatggcaaaaaggtgaggaagtgcaagtaattgcggtcgaaccgggcaagaaccctaaaaactttcaaactatgcctggaatattccaaaccactacaggcgaaataggagcaattgccctggactttaaaccaggtacttcaggttcaccaataataaacagggagggaaaagtagtcggtttgtatggaaatggtgttgtaacgaagaatggaggttatgtatcggggatagcacaaacaaacgcagagccagatgggccgacaccggagctagaggaagaaatgtttaagaaaagaaaccttaccataatggatctacaccctggttccggaaagacgaggaaatatctacctgctatcgtacgagaagcaatcaagagacgtttacgtactttaatactggctcctaccagagtagtagccgcagagatggaagaagctctaaaaggattgcctatccgatatcaaacaactgcaacgaagagtgaacacacaggtagagagattgtagacttaatgtgccatgccaccttcacgatgcgactactcagtcctgtaagggttccgaactataatttaattattatggacgaagcacatttcacggatccagcgagcatagctgcacgaggttatatcagtacgagggtgggaatgggtgaggctgccgcaatatttatgacagctacaccgcctggaacggcggaagcattccctcaaagtaatgcgccaatacaagacgaagaaagagacatcccagagcgaagttggaactcaggtaatgagtggattactgatttcgtagggaaaacagtctggtttgtcccgtcaataaaggctggaaatgatatcgcaaattgcttgcgcaagaatggtaagaaagtcatacaactatctcgaaaaacctttgatacggaataccaaaagaccaggttgaatgattgggactttgtagtcaccaccgatatatcagaaatgggtgccaacttcaaggctgatagagtaattgatccaagaaggtgtcttaagccagtcatattaacagatggtcctgaaagggtcatcctagcaggtccgatgccagtaacggccgcatctgctgcgcaaagaagaggtagggttgggagaaatccacaaaaagaaaacgatcaatatatatttacaggccaacctctaaataatgatgaagaccacgctcactggacagaagcaaaaatgttactggataacattaatactcccgagggtataatccctgcactgttcgagccagagcgtgagaaaagtgccgcgattgatggtgaatatagacttaagggcgaaagtagaaagacgttcgttgaactcatgagaagaggagacttacccgtatggcttgcacataaggtagcgagtgagggcatcaaatatacagaccgcaagtggtgctttgacggagaaagaaataaccaaattttggaagaaaatatggatgttgaaatttggacaaaggagggtgagaggaagaaattgaggccccgatggcttgacgccagaacatattccgatccgttagctctaaaagagttcaaggacttcgctgctggtcggaagtcaattgcgttggatctagtaacagaaatcgggagggtgccatcccatttagcttatagaacgaggaatgcactcgacaatctagttatgttgcatacttccgaacatggaggacgtgcatacagacatgctgtcgaagaactaccggaaaccatggaaacattactattactaggtctgatgatcttactcacaggtggggcaatgttgttcttaatctcaggtaaaggcattggaaaaacgtctattggattaatctgcgttatcgtgtccagtggaatgttatggatggctgacgtcccgttacagtggatcgcaagtgcgattatcctagagttctttatgatggtattactaatccccgaacctgaaaaacaaagaacaccgcaagataatcagttggcatacgttgtaatcggcatcctaacactagctgctattgtagcagcgaacgaaatgggactacttgaaactacaaaaagagatctagggatgtcaaaagaaccgggcgtagtatcacccactagctatttagatgttgacttacatccagcatcagcatggacactctatgcagtggcgacaactgtcataacccctatgctgaggcacactatagaaaacagtactgctaacgtatcattagccgctatagcaaaccaagcagtggtccttatgggacttgacaagggttggccaatcagcaaaatggatttaggtgtgcctttgctcgcactgggatgctacagccaagtgaatcccttaacactcacggcagccgtattattactggtcacacactacgctataataggaccaggcctacaggctaaagcgactagagaggcacagaaaagaaccgcagcaggcataatgaagaacccgactgtagacggtatcatgactattgacctggatcccgttatatacgattcaaagtttgaaaagcagttaggacaagtaatgctattggtactctgtgcagtacaactactactaatgagaacatcctgggccttgtgcgaagcgttaactttggcaacaggcccgataaccactctatgggaaggttcaccaggtaaattctggaatacaaccattgctgtctccatggcgaatatcttcagaggaagctacttagccggagcaggacttgcgtttagtataatgaaatccgttggtaccggaaggcgtggtacgggcagtcaaggtgaaacattaggagaaaaatggaagaaaaagctcaaccaactaagcagaaaggagtttgatctttataagaaaagtggaattacagaggtcgataggacagaagcgaaagaaggcctaaagagaggtgaaacaacgcatcacgctgtgtcaaggggatcagccaaacttcaatggtttgtagagcgaaatatggtcataccagaaggccgggtgatagatctagggtgcggacgaggtggttggagttattactgcgccggacttaagaaagtaactgaggtaaggggatacacaaaaggaggccctggccatgaagaaccagtacccatgtccacatatgggtggaatttagttaaattaatgagcggaaaagatgtattttatttaccgccagaaaaatgtgatacacttctatgtgatataggagaatctagtccttcaccgacagtagaagaaagtagaactattagggtattaaaaatggtagaaccatggcttaaaaataaccagttttgtataaaagtattaaatccttatatgcctaccgtaatcgaacacctcgaaagattacagcgtaaatacggtggtatgttagtcagaaatcccttatctagaaatagtacacacgaaatgtattggatatctaacggaactggtaatatcgtaagctctgttaacatggtttctagattattactgaatcgtttcactatgacacatcgccgtccgacaatagagaaagatgttgatttaggggcgggcactagacatgtcaatgcagaacctgaaaccccgaacatggatgttataggtgaaagaattaaacgaataaaggaagaacatagtagtacatggcattatgacgatgaaaatccatataaaacatgggcataccatggttcgtatgaagtgaaagcgacaggatcggcatcatcaatgattaacggcgttgttaaactccttacaaaaccctgggatgtagtacccatggtgacacaaatggctatgactgatactaccccctttggacaacaacgagtttttaaggaaaaagttgatacacgaacacctagacccatgccagggacacgcaaagtcatggagataacagcggaatggttatggaggactttgggaagaaataagaaaccccggctctgtacaagggaggagtttaccaagaaggtgcgaacaaacgctgcaatgggagctgtatttacggaagagaatcaatgggacagtgccagggcagctgttgaggatgaagagttctggaaattagtagatagagagagggaacttcataaactaggaaaatgcggatcttgtgtctataacatgatgggcaaaagagagaagaaactaggtgagtttggaaaggcaaagggaagtcgagctatatggtatatgtggcttggagcaagatatctcgagttcgaagcacttggctttttgaacgaagaccattggttttctagagaaaattcatacagtggtgtcgaaggcgaagggttacacaaacttggttacattctaagagatatctcgaaaatccctggtggagctatgtatgcagatgatacggcaggatgggatactagaataactgaggatgatctacataatgaggaaaagattacacaacaaatggacccagagcataggcaactcgctaatgcaatctttaagctaacctaccaaaacaaagtagtaaaggtacaacgtccaacaccaaaaggaacagtgatggacatcatctctcgaaaagaccaaagaggtagcggacaagtagggacatacggattgaacacattcactaatatggaagcgcaactcgtaagacagatggaaggtgaaggtgtgctaagtaaagccgacttagagaatccacaccttctagagaagaaaattacacaatggttagagacaaaaggagtagaaagactaaaacgaatggcaataagtggagatgattgcgtcgtgaaacctatagatgatcgtttcgctaatgcacttcttgctcttaacgatatgggaaaagttaggaaagacatcccacaatggcaaccatcaaaaggctggcacgattggcaacaagttcccttctgcagtcatcatttccatgaacttataatgaaagacggaagaaaattagttgtaccctgtagacctcaagacgaattaataggtcgggcaagaattagtcagggtgctggatggtcattaaaagagacagcatgcctggggaaagcgtatgcccagatgtggtccctgatgtattttcaccggagggatcttagactagcgtcaaacgctatatgttcagcggttcccgttcactggataccaacaagtagaacaacttggtcaatacacgcacatcaccaatggatgactacagaggatatgttgactgtatggaacagagtttggatcgaagacaacccgtggatggaagataagactccagtaaccacgtgggaggatgtgccttatctaggcaaaagagaagatcaatggtgtggatccttgatcgggttgacgagcagggctacatgggcacagaacatactgactgccatacaacaagttagaagtttgattggagatgaagaatttcttgattacatgccatccatgaaacgtttccgcaaggaagaggaatcagagggagcaatctggtaa

SEQ ID NO: 23494 - RNA, 9873 nt, synthetic construct
  misc_feature 1..9873: note = derived and/or modified CDS sequence (opt6) from DENV-3__FJ547066__SS-prME
  source 1..9873: mol_type = other RNA
acaagcctctgccttatgatgatgttacctgcgaccttagcattccacttaactagcagagacggcgaaccgagaatgatagttggcaaaaatgaaagaggcaaatcgcttttattcaaaacagcatcagggattaatatgtgtacacttattgcaatggacttaggagaaatgtgcgatgacaccgttacatacaaatgtccgcttatagcagaaatggaaccagaagatatcgactgctggtgtaatctaacgtctacatgggtcacatatggaacgtgtaaccaagccggtgaacaccgccgagacaaacgctctgtcgcattggctccacatgttgggatgggactcgacacaagaacacaaacctggatgagcgcagaaggggcctggagacaagttgaaaaagtagaaacatgggcactaaggcatccaggctttacaatactagcattgttcttggcacactatatcggaacttctttaacccaaaaagttgtaatattcatattactaatgctggttacaccaagtatgaccatgaggtgtgtcggagttggcaacagggactttgtagaaggtttgtcaggagcaacatgggtagacgttgtcctagaacatggtggttgtgtaactacaatggcgaaaaacaaaccaactctagatatagaattgcaaaagacggaggctacgcaattagctacactccgcaaactatgtatagaaggtaaaataacaaatattactacagacagcagatgccccactcaaggagaggcaattctgcccgaagaacaagatcaaaattatgtttgcaaacatacatacgttgatcgaggttgggggaacggctgtggcttgttcgggaaaggcagtttggtaacgtgtgccaaatttcaatgtctggaaccaatcgagggaaaagttgttcaatatgaaaacttaaaatacaccgtaataatcactgtccatactggggaccaacatcaagtaggtaatgatacccaaggcgtaactgtcgaaataacaccacaggcttccacggttgaggcagtactgccagagtacggcacactaggtcttgagtgcagtccaaggacgggactagattttaatgaaatgattttattaaccatgaaaaacaaggcttggatggtacacagacaatggttcttcgatctgcctttaccatggacaagtggagcgaccacagaaacccctacatggaatagaaaagagttgctagttacttttaaaaacgcacacgccaagaaacaagaagtcgtagttttagggtcacaagaaggagcaatgcatacagccttaacgggagcaacagaaatccaaaactctggcggcacgagcatattcgctggccatcttaagtgtcgactgaagatggacaaattagaattaaagggcatgtcttatgccatgtgtctaaacacttttgtattaaagaaagaagtcagtgaaactcaacatggaacgatactgattaaagtagaatacaagggtgaagacgcaccatgcaaaatcccattctcgaccgaagatggacaaggtaaagcacataatggtagattaattactgcgaacccagttgtaaccaagaaagaggaaccagttaacatagaggcagaaccacctttcggggagagtaatattgtaataggtataggggacaaagccctaaaaattaattggtacaagaaaggtagttcaataggaaaaatgtttgaggccacagctaggggcgcaagaaggatggcaatactgggtgatacagcctgggattttggaagcgtaggaggggtgctaaactctcttggaaaaatggtccaccagatatttggttcagcctataccgcactgtttagcggagtatcctggattatgaaaatcggcattggagttcttttgacatggatcggtctaaatagcaaaaacacaagtatgtcgtttagttgtatagttataggaataataactctttacctcggtgccgttgtacaagccgatatgggatgtgcgatcaattggaaagggaaagaactaaaatgcggctcagggattttcgtcacaaatgaagtccatacctggactgaacaatacaaattccaagctgactcccctaaaagactagcgacagccatagcaggggcatgggaaaatggagtttgtggtataagaagtacaacaaggatggagaatttgctctggaaacaaattgctaatgagctgaattatatactttgggaaaataatattaaactaacggtcgtagtaggagacataatcggagtattagagcagggtaaacgaactctgactccccaaccaatggagttgaaatattcatggaaaacttggggtaaagcgaaaatcgtcaccgcggagacacagaactcttcttttattatcgacggacctaatactccagaatgcccgagcgcctctcgtgcatggaatgtgtgggaagttgaagactatggcttcggtgttttcacaacaaatatatggcttaaactaagagaggtgtacacgcaaagctgtgatcaccgtctcatgtctgcagctataaaagatgaaagggcagttcatgcagacatgggttactggattgaatcacagaaaaatgggagttggaagctcgaaaaagcatcatttatagaagtcaaaacttgcacatggcctaaaagtcacactctatggtcaaatggagtacttgagtctgatatgataatcccaaaaagtctagcaggaccaattagccaacataaccataggccagggtatcacacccaaactgctggaccatggcatttgggtaaacttgaactcgacttcaactattgcgaaggaacaactgtagtaatcacagaaaactgcggtacacgaggaccaagcctgagaacaacaacagtttcgggaaaattaattcatgaatggtgttgccgcagttgcactctaccgccgttaaggtatatgggagaagacggatgctggtatggaatggaaataaggccgatcaacgaaaaagaagagaatatggttaaatctttagtatcagctggttcgggcaaagtcgacaacttcactatgggggtcttgtgcctagccatcctctttgaagaagtaatgcggggaaaattcggtaagaaacatatgatagctggcgtcctcttcactttcgttcttctccttagtgggcaaattacatggcgtgatatggcacatactctcattatgataggaagcaacgcatctgatcggatgggtatgggcgttacatatctagcgttgattgcgacttttaaaattcagccctttttagccctgggattctttttaagaaagctaactagccgagaaaacttattactaggggtcgggctagcaatggctacaacgttgcagctacccgaagatatagaacagatggcaaacggaatcgccttgggattaatgaccttaaaattaataacacaattcgaaacatatcaattatggaccgctttagtgagcttgacatgttcaaatacaatattcacactaaccgtggcatggaggacagcaacattaatattagctggagtctcactgttaccattatgccaatcatcgtccatgagaaaaactgattggctacccatgaccgtagccgcaatgggtgtacctcctcttccactctttatcttcagcttaaaagacactcctaaaagaagaagttggcccctaaacgaaggcgtgatggcggtaggtcttgttagtatcttagcaagtagtctattacgaaatgatgtccccatggcaggacctctcgtcgccgggggcttattaatcgcctgttatgtaattacgggtacatcagcagatctcactgtcgaaaaggcggcggatgttacatgggaagaagaagctgaacaaactggagtctctcacaacttaatgatcacagttgatgacgatggtacgatgagaattaaagacgatgagactgagaatatacttacggttcttttaaaaacagcactactaatagtcagtggaatatttccctatagtattccagcgaccttgctagtttggcatacatggcaaaaacagacgcaaagaagtggagtgttgtgggatgtgccctcgccacctgaaacgcaaaaagcagaactagaggagggtgtttatcggattaaacagcaaggaatctttggtaagacacaagtgggagttggagttcaaaaagaaggtgtatttcataccatgtggcatgtgactagaggagctgttctaacccataacggaaagaggttagaaccaaattgggcctcagtaaagaaggacttgatatcatacggaggaggatggagattgtccgctcaatggcaaaaaggcgaagaagttcaagttatagcagtagaaccaggtaaaaaccccaaaaacttccaaacaatgccaggaatatttcaaacaacgacaggtgagataggtgcaattgcacttgattttaagcccgggacgtctggtagccctattataaatcgcgaaggtaaagttgttggtttgtatggtaacggggtagtaactaaaaatggagggtacgtatccggaattgcacaaacaaacgcagaaccagatggtcccactcccgaactagaggaggaaatgtttaagaagcggaacttaacaataatggacttgcatccaggatccggaaaaacccgaaagtatttaccggcgattgttagagaagcaattaaacgacgtttgagaacactaatcctagcccctacacgagtagtagcagcagaaatggaagaagccctaaaaggattgcccattcgataccagactaccgctactaaaagcgaacacacgggccgcgaaatcgtcgatttaatgtgccacgccacatttacaatgcgcctcttaagtcccgtccgagttccaaattataacttgatcataatggatgaagcgcattttaccgaccctgcgagcattgctgcaagaggctacatttcaacgcgtgtaggcatgggagaggcggccgctatatttatgaccgcaacaccacctggaaccgctgaggcttttccacaatcaaacgcacccatacaggatgaagaaagagatattccagaacgttcatggaacagcgggaatgaatggataactgattttgtcggcaaaacagtatggttcgtgccatcaattaaagctggaaatgatattgccaattgtttgaggaaaaacggaaagaaagtgattcaattaagtcgtaaaacattcgatactgaataccagaaaactaggttgaatgactgggactttgtcgtcacaacggatatttcagaaatgggagctaactttaaagcagatagagtgatagatccgcgaagatgtctaaaaccagtaattttaacagacggcccagagcgggtcatcttagcaggacctatgcccgtcacagccgcatctgccgcgcagagaagaggtcgagtaggaaggaacccgcagaaagaaaacgatcaatacatattcacaggtcagcccttaaataatgatgaggaccatgctcattggacagaagcaaaaatgctattagataacataaatacaccagaagggataattccagcattgtttgaaccagaacgtgaaaaatcggctgcaatcgacggagaatatcgactaaaaggtgaaagcaggaaaacgttcgtagaactaatgagacgcggagaccttcccgtgtggttggctcataaagtagcctctgaaggaataaaatataccgatcgtaaatggtgcttcgatggggaaagaaataaccaaatattggaggaaaatatggacgtggaaatttggacaaaagaaggagaacgtaagaaactacgaccaagatggctagatgcgagaacttatagtgaccccctagcactaaaagagtttaaggattttgcagcaggtcgtaaatcaatcgcgttggacctagtaacagaaattggacgcgttcctagtcatctagcatacagaacaagaaatgcacttgataacttagttatgctacatacgtcagaacatggagggagagcatacagacatgcagtcgaggaattaccagaaacgatggagactttgttattgcttggattaatgatcttacttacaggtggagccatgctgtttttaatatctggtaaaggaattggaaaaaccagcataggattaatatgtgtcatagtatctagcggtatgttatggatggctgatgtaccgttgcaatggattgcatctgcaattatacttgaatttttcatgatggttctgttaattcctgaaccagagaaacaacgtacgcctcaggataaccagttagcctatgtagtaattggcatattgacactagcggctattgttgctgccaatgaaatgggtcttttagaaacaactaaaagggacctagggatgagtaaagagcctggggtagtatcgccaacatcgtacctggatgttgacttacacccagcctctgcatggacattgtacgcagtggcaacaacagtaataactcctatgttgagacatactatagaaaactccacagcgaacgtcagtcttgcagccatcgctaaccaggcagtagttcttatgggtctggacaagggttggcccatttctaagatggatcttggcgtaccacttcttgctttgggatgttatagccaagtaaatccattgacattgaccgcggcggtcctactactcgtgacacactatgcaataatcggaccgggattacaagcaaaagccactagagaagcccaaaagagaaccgctgcgggtataatgaagaacccgaccgtagacggaattatgaccattgaccttgatccagttatttacgacagtaaatttgagaaacaacttggtcaggttatgctactcgtattatgcgcagtgcaacttctactgatgaggacatcttgggcgttatgcgaagcattaaccctggctacaggacccattactacactctgggaggggtctcctggaaaattctggaatacaacgattgccgtatcaatggcaaatatcttccgcggttcatacctggcaggggcgggactagcatttagcattatgaaaagcgttggaacaggtcggcggggcaccggtagtcagggggaaacattaggcgaaaaatggaagaagaaattgaatcaacttagtagaaaagagttcgatctatacaagaaatctgggattacggaagtggatcgaaccgaggcaaaagaaggcttgaaacgaggagagacgacccaccatgctgtttctcgagggtcagctaaactacaatggtttgttgaacgtaatatggtcatcccagaaggacgtgtaattgatctaggatgcggtcgcggtggatggtcatattactgtgcaggattgaagaaagtgacagaagtacgaggatacacgaaaggtggtccaggtcatgaagaaccagtgccaatgagtacttatggatggaatcttgtaaaactgatgtctggaaaagacgtattttacttaccgccagaaaagtgcgacacattgttatgcgacattggagaatcatcaccaagtcctacggttgaggaatcaagaacaattagagtactaaaaatggtagaaccctggctgaaaaataatcaattttgcataaaagttctaaacccatacatgcctactgtcattgaacatttagaacgcctccagcgaaaatatgggggaatgctcgtaagaaatccactctcaagaaatagcacccatgagatgtattggataagtaatgggacgggcaacatagtaagttctgtcaatatggtatctcgactcttattaaaccgattcaccatgacccaccgtcgtccaacgatcgaaaaagatgtggatctaggtgcaggtacaaggcatgtaaacgcagagccagaaacccccaacatggatgtcatcggcgaaagaattaaaagaataaaagaagaacactcatcgacgtggcattacgacgatgaaaatccctataaaacatgggcatatcacggttcttatgaggtaaaggcgactggaagtgcgtcctcgatgataaatggagtagtcaagttactaactaaaccatgggacgtagttcccatggtgacgcagatggctatgactgataccacgcctttcggtcaacaaagagtattcaaagaaaaagttgatactagaacacctagaccgatgccaggtacaagaaaagtaatggaaataacagcggaatggttatggagaacattgggacggaataagaaaccgcgactctgcacaagagaggaatttacgaagaaagtgcgaacaaatgctgccatgggggcagtattcaccgaagagaatcaatgggatagtgcacgagctgcggtagaggatgaaggattttggaaactggtggaccgtgagagagaattgcataaattagggaagtgcggatcttgtgtatataacatgatggggaaacgggagaagaaactgggtgaatttggaaaagcaaaagggagccgagctatatggtacatgtggctaggggcaaggtaccttgagttcgaagctcttgggttcttgaatgaagaccattggttttcacgggaaaactcatactcaggggtagaaggagagggactacataagctcggttacatattaagggatatatctaagataccaggaggagctatgtatgctgacgatactgcaggttgggatacacgaatcacggaggatgacttgcataatgaagagaaaatcacacaacaaatggaccctgaacatcgacagctagcaaacgcaatatttaaacttacttatcaaaacaaggttgtgaaagtgcagcgaccaacacctaaaggaactgtaatggatatcatatccagaaaagaccaaagaggttccgggcaagtaggtacttatggacttaatacatttactaatatggaagcacaattagtcaggcaaatggagggagaaggggttctgtctaaggcagatttagaaaatcctcatctactggaaaagaaaattacacaatggttagaaaccaaaggtgtagaacgtctgaaaagaatggcaattagcggagatgattgcgtggtaaaaccaatcgatgatagatttgcgaacgcgttattagctcttaacgatatgggcaaagtaagaaaagacattcctcagtggcagccatctaaaggctggcatgactggcagcaagtacctttctgttcgcatcactttcacgaattgattatgaaagacggaagaaaacttgttgtgccctgccgtccccaagacgaattaattggcagagcccggatcagtcaaggagccggttggagtctaaaagaaaccgcctgcctaggtaaagcatatgcccaaatgtggagccttatgtactttcatcgccgagatttacgcttagcatccaacgcaatatgttcggcagtccccgtacattggataccaacaagcagaaccacatggtccatacacgcgcatcatcaatggatgacaacagaagatatgcttactgtttggaaccgtgtgtggatagaagataatccgtggatggaagataaaactccggtgacaacatgggaagatgtgccgtatctaggtaagagggaagaccaatggtgtggatcgctgattggtttgacgtcgcgggcaacatgggcacagaacattcttaccgcaattcaacaggttagatctcttatcggtgatgaagaatttttagattatatgccaagtatgaaacgctttagaaaggaggaggaaagtgaaggtgctatatggtaa

SEQ ID NO: 23495 - RNA, 9873 nt, synthetic construct
  misc_feature 1..9873: note = derived and/or modified CDS sequence (opt6) from DENV-3__KF955460__SS-prME
  source 1..9873: mol_type = other RNA
acatcactttgcctaatgatgatgttgccagcgacactagcatttcacctaacgtcaagagacggagaacccaggatgatagtagggaaaaacgaacggggaaaatcactactgttcaaaacggcaagcggaatcaatatgtgtacactcattgcaatggatttgggagaaatgtgcgatgacactgtaacctacaaatgtcctcttatagcggaagtagaacctgaagacatagattgttggtgcaacctcactagcacatgggttacatatggaacttgcaatcaagcaggagaacatagacgggacaaaaggtccgtagcacttgcacctcatgtgggaatgggactcgacaccaggacccaaacatggatgtccgcagaaggtgcatggaggcaagtcgaaaaagtagaaacatgggcactaaggcatccaggattcactatattagcattgtttctggctcattacatcgggacttccttgactcaaaaagttgttatatttaccctactcatgttagttacaccgtcgatgactatgagatgtgttggagtaggaaatcgggactttgtggaaggattatcaggagcaacctgggtagatgttgtattggaacacggaggttgtgttactacaatggccaaaaacaaacctacattggatattgaattgcagaaaacagaagcaacacaactcgctactctccggaaactctgtattgaaggtaaaattacaaacattaccacagattctagatgccccacgcaaggtgaagctattttacccgaagaacaagaccagaactacgtctgtaaacatacatatgtagaccgaggatggggcaacggttgtggactatttggcaaaggaagcctagtgacgtgtgctaaatttcagtgcttagaaccaatcgaaggtaaagtagtacaatatgaaaatttaaaatataccgttataattacagtccacactggtgatcaacatcaagttggtaatgacacacagggagtaacggtagaaataacaccgcaagctagcactgttgaagcggtacttccagaatatggtacattaggactggaatgttctcctcgcacaggtctagattttaacgaaatgattttactaactatgaagaataaggcttggatggttcacaggcaatggttctttgacttaccattaccatggacaagcggggccacaacagaaacccctacctggaatcgtaaagagctcttagtgacattcaagaatgcgcacgctaagaaacaagaggtcgtcgtattgggctcacaagagggagctatgcataccgcgttgactggcgccacggaaatacaaaactcaggaggaacatctatctttgcaggacacttgaaatgccgtttaaaaatggataagctagaattgaagggtatgagttatgcaatgtgcttaaatacattcgtactgaagaaagaggtaagtgagacacaacacggaacaattttgattaaagttgaatataaaggggaagatgcgccctgtaagattccattcagtacggaagatggtcaaggcaaggctcacaatggaaggttaatcacagccaacccagtagttaccaagaaagaagaacccgtcaatatagaagcggaaccaccttttggtgaaagcaatatcgtgataggtattggcaacaaagcattaaaaattaattggtacaagaagggttcatcaattggaaaaatgtttgaagctacagccagaggtgcgaggagaatggccattctaggagatacagcctgggattttggcagtgtgggaggagttctcaatagtttaggaaagatggttcaccaaatatttggaagtgcatatactgcattgttttccggtgtgtcctggattatgaaaataggcattggtgtgttactaacatggattggtctaaacagcaaaaatacatccatgtccttcagttgtatagttattggaatcattacgttatatcttggagcagtggtacaggctgacatgggatgtgcaattaactggaaaggtaaggagctaaaatgcggaagcggtatattcgtcacgaatgaggttcatacttggactgaacaatataaatttcaagcagatagcccgaagcggcttgcaacagcgatcgctggagcatgggaaaatggggtatgcggcattcgttcaacgacacgaatggagaacctgttgtggaagcaaattgccaatgaattaaactacatactttgggaaaacaacataaagctgacagtcgtagtaggcgacataataggggttctggaacaaggtaaacgtacattaacaccccaaccaatggaactgaagtattcgtggaaaacgtggggcaaagctaaaatcgttactgctgaaacccagaactcaagtttcattattgacggacctaatacgccggaatgcccatccgcttcacgagcatggaatgtatgggaagtagaagattacggttttggagttttcactaccaacatatggcttaaattaagagaagtgtacactcaatcttgcgatcacagattaatgagtgcagccattaaagacgaaagagcggtacatgcagatatgggatactggatagagtcacagaaaaacggatcttggaaactagagaaggcttccttcattgaagtaaaaacatgcacatggcctaaatcacacactttatggagtaatggagtattagaaagcgatatgataattcccaaaagtcttgcgggtcctatcagccaacacaatcacagacctggttatcacactcaaacagcggggccctggcacctaggtaaattagaattggatttcaattattgcgaaggcacaactgtcgttataactgagaattgcggaacacgaggcccatcactaaggaccacaactgtaagtggaaaattaattcacgaatggtgttgtagatcatgtacgttgcctccgcttagatatatgggagaggatggttgttggtatggtatggaaataagacctatcaatgagaaagaagaaaatatggtaaagtcgcttgtatcggcaggatcaggcaaagttgacaacttcacgatgggagtcttatgtttggctattttgtttgaagaagtaatgcgaggtaaattcggtaaaaagcatatgattgcaggagtgttgttcactttcgttttattactgtcaggccagataacatggagagatatggcgcacacattaataatgataggaagtaacgcatcagacagaatgggaatgggggtaacatatctagcattaatagctaccttcaaaatacagcctttcttggcactaggctttttcctaagaaagttaacctcacgcgaaaatttgctactaggggtaggactggcaatggccactactcttcagttgcccgaagatatagaacaaatggcaaatggtatagcgcttggtctaatgacacttaaattgatcacgcaattcgaaacttatcaactttggacagcattagttagcctcacgtgtagtaatacaatttttacattaacagtagcatggcgaacagctacactaatcttagccggtgtaagtttactgccactgtgccagtcgtctagcatgcgaaaaaccgactggcttcctatgacggtagcagcaatgggggttccgcctctccctttattcatcttcagcctaaaggatactcctaaacgcaggtcatggccactaaatgaaggagtcatggccgtaggactggtaagtatactagccagctctctactaagaaacgatgtaccgatggccggaccactggtcgctggaggattgttaattgcatgctatgtgatcaccgggacaagtgccgatctaacagtagaaaaagccgccgacgtaacctgggaggaagaagcagaacagacaggcgtaagccataacctaatgataacagttgatgatgatgggacgatgaggataaaggatgatgagactgaaaatatactcactgtactactaaaaactgccttactgatagtcagtggtatatttccatactcaatcccggcgacgctactggtgtggcatacatggcagaaacaaacacagagaagtggagttttatgggacgtaccgagtccccctgaaacacaaaaagcggagttggaagagggagtataccgcatcaaacaacaaggaatattcggtaaaacacaagtcggggttggagtacagaaggaaggtgtattccacacaatgtggcacgtaacaagaggagcagttcttacgcataatgggaaacgattagaaccgaactgggctagtgtaaagaaggacttgatttcatacggcggtggatggcgactaagtgcccaatggcaaaaaggcgaggaagtgcaagtcattgccgtagaaccagggaagaatcccaaaaacttccagacaatgccaggaatctttcaaacaaccacaggtgaaattggggcaatcgccctggacttcaaaccagggacgtccggatccccaataataaacagagaaggtaaggtagtgggcctttatggaaatggagtagtgacgaaaaatggtgggtacgtatcgggaattgcccaaacaaacgctgaacctgatggcccaactcccgagctcgaggaggaaatgttcaagaagcgaaacttaacaataatggacctccatccgggatcggggaaaacaagaaagtatttgcctgctattgtacgagaagccattaaacgccgactgaggactctaatattagcaccaaccagagttgtagctgcggaaatggaagaagcgctcaaaggtttacctattcgataccaaacaactgcaacaaaaagtgaacatacgggtagagaaattgtagatctcatgtgtcatgctacattcacgatgcggctactatcaccggtaagagtaccgaactataatctaataatcatggatgaagcgcactttactgatccggcctcaatagccgcaagagggtatatatctaccagggtaggtatgggggaagctgcagcgatatttatgacagctactccgcccggaactgcagaggcattccctcagagtaacgcaccaattcaagacgaggaaaaggacatacccgaaagaagctggaacagtggaaatgaatggatcacagattttgttggaaaaaccgtctggtttgtaccatctattaaagctggaaacgacatcgccaattgtctgcgaaagaatggtaagaaagtaattcagttaagtcgaaaaacctttgatactgaataccagaaaactcgattaaacgactgggactttgtcgtaacgaccgatatctccgaaatgggagcgaacttcaaggccgatcgcgtaatagatccaaggcgatgcttaaagccggttatcttaactgacggaccagagcgggttatcttggcaggaccaatgccggtaactgcagcatcggctgcacaaagaagaggccgagtggggaggaacccacagaaagaaaacgatcaatatatatttacaggtcaaccactcaataacgatgaagatcacgctcactggacagaagccaaaatgttattagataatataaatacacccgaggggataatcccggctttatttgaacctgaacgcgagaaatccgctgctatagatggagagtatagattaaaaggagaatcacgtaaaacttttgtggagctaatgcgtcgcggagatcttcctgtgtggttagctcataaagttgcctctgaaggaataaaatatacagacagaaaatggtgctttgatggggaaaggaataatcaaatattagaagaaaatatggacgttgagatatggactaaagaaggggaacgtaaaaagctacggccaagatggctagacgcccgaacttattcagatccattagcactaaaagagtttaaagattttgcagcaggtagaaaaagtattgccctggacctagtaactgaaattggaagggttccgtcacatttggcttatcgaactcgtaatgctttggacaatttagtaatgctgcatacctccgaacatggtggtagggcgtatcgacacgcagttgaagaattaccggagacaatggagactcttctgctgctcggtttgatgatattattgacaggcggcgctatgctatttctaatatctggtaaagggatcggcaaaacgagtattgggttaatctgtgtgatcgtgtcatcgggtatgttatggatggcagatgttcctcttcagtggattgcgtctgcaatagttctagagttctttatgatggttttacttataccggaacctgaaaagcaacgtactccgcaagacaatcagttagcatacgttgtgataggaatattaactctcgctgctatagtcgcggcaaatgagatgggtttacttgagaccacaaaacgcgatctaggtatgagtaaagagccaggtgtcgttagcccaacatcgtatttagacgttgacctacatccagccagcgcctggactctctatgccgttgcaacaactgtaattacacccatgctaaggcacacaatagaaaactccaccgcaaatgtgtcgctagccgcgattgcaaaccaggccgtagtattaatgggactagataaaggctggcccatcagtaaaatggatctaggggtacctctattagctctaggttgttatagccaagtcaatccattgacattaactgcagccgtactactcctagtaactcattatgcaataattggaccaggcctacaagcaaaagcaactagagaagcgcagaaaaggacggcagctgggattatgaaaaatcccacagtagatggcataatgacaatagaccttgatcctgtcatctatgactcaaaatttgaaaaacaattaggacaagtaatgctacttgtactatgtgctgttcagttgctcctaatgaggacttcatgggcactatgcgaagcattgacattagctactggcccaattaccaccctctgggagggatctcccggaaagttctggaacacaactatagcggtcagcatggcaaacatctttcgtggcagctacctggctggagctggtctagcatttagtatcatgaaaagtgtcggtacaggaagaagaggtacaggaagtcagggcgaaacactaggtgagaagtggaagaagaaactaaatcagttgtcccgtaaagagttcgatctatacaaaaagtctggaataacagaggtggatagaactgaagccaaggagggactcaaacggggtgagactacgcaccacgcagtatctcgtggaagtgcgaaactccaatggttcgtagaaaggaacatggtgataccggaaggaagagtaatagacctaggttgcggaagaggaggctggtcatactattgtgcaggtttaaagaaggtcacagaggtaagaggctacacgaaaggaggtcctggtcatgaggaacctgttccgatgtcaacatatggctggaacatagtaaaacttatgtccggtaaagatgtcttctaccttcccccagaaaaatgcgacacactattatgcgatatcggagagtcgtcaccttctcccacagttgaagaatctaggactattcgagtcttgaaaatggtcgaaccatggctaaagaacaatcagttttgtataaaagtattaaacccttatatgccaacggtaattgaacacttggaaagactccagagaaaatacggcggaatgcttgttcgcaatccactaagtagaaattcgacacatgaaatgtactggatttcgaatggtacaggaaatatcgtaagctccgttaatatggtctcaagattattattaaaccggtttacaatgacgcacagaagaccaacaatagagaaagacgttgatctgggcgcaggaacaagacacgttaatgcagaaccagagactccaaacatggatgtaataggtgaacgaataaaacgaataaaagaagaacactcatctacgtggcactacgacgacgaaaatccttacaaaacatgggcatatcacgggagttatgaagtgaaagctactggttcagcatcatccatgataaatggggtagttaagttacttactaaaccatgggacgtagtacccatggtcacccaaatggctatgaccgacacgactccgttcggtcagcaaagggtattcaaagaaaaagtagacacacgaacaccccgaccaatgcccggtacgagaaaagtcatggagattactgcagaatggctctggaggacactagggcgcaataaaaagccgagattatgcacacgtgaagagttcaccaagaaagtcagaacaaatgcagcgatgggcgcagtattcacagaggaaaatcagtgggattccgcacgtgcagccgtagaagacgaagagttttggaaattagttgatcgggagcgtgaactacacaagttagggaagtgcgggtcttgtgtatacaacatgatgggcaaacgggagaagaaactgggtgaatttggaaaggcgaaaggttcccgcgccatttggtacatgtggctaggcgcacgctatttggaatttgaagcattaggttttctcaatgaggatcattggttttcacgagaaaattcttacagcggagtagagggagaaggactacataaacttggttacatactgagagatatatcgaaaattcctggtggtgcaatgtacgcagatgacactgcaggatgggataccaggattacagaagatgatcttcataatgaagagaagataactcaacaaatggatccggaacatagacagctcgccaacgccatattcaaactgacttatcagaataaagttgtaaaagtgcaaagacctacaccaaagggaactgttatggacataataagcagaaaagatcaacggggatcaggtcaggtagggacatacggtctaaacacatttactaatatggaagcacaacttgtgcgtcaaatggaaggagagggtgttttgtcaaaagcagatcttgaaaacccgcacttgctagagaagaaaataactcaatggctagaaacaaaaggggtagagagacttaaaagaatggctatttcgggggacgactgcgtggttaagcctattgacgatcgatttgccaatgcactactagcactcaacgacatgggcaaggtaagaaaggacattccacaatggcagccttcaaaaggatggcacgattggcaacaagttcctttttgcagccatcattttcacgaacttatcatgaaagatggtaggaagctagtggttccatgtagaccacaggacgaattaataggcagagcacggattagccaaggagctggttggagcttgaaagaaacagcatgtttgggaaaggcttacgcacaaatgtggtcactcatgtattttcaccggagagatttaagattagcatcaaacgcaatctgctccgcggtaccggtgcattggatacccacctcgagaacgacatggtcaatccacgcccatcatcaatggatgaccacggaagacatgttgacggtctggaatcgggtatggatagaagacaatccgtggatggaggacaaaacacctgtcacaacctgggaagatataccttatttaggaaaaagagaagatcagtggtgcggcagcttgataggtttaacaagtagagccacatgggcccaaaacatactaactgctattcaacaagtacgatcgttaatcggtgatgaagagttcttagattatatgccgtccatgaaacgcttcagaaaagaggaggaatcggaaggggcaatatggtaa

SEQ ID NO: 23496 - RNA, 9873 nt, synthetic construct
  misc_feature 1..9873: note = derived and/or modified CDS sequence (opt6) from DENV-3__FJ461334__SS-prME
  source 1..9873: mol_type = other RNA
acaagtctatgtctgatgatgatgctaccagctacgttagcatttcacttaacatcgcgggacggggagccgcgaatgattgtcggcaaaaatgaacggggtaaatcccttttatttaaaacagcatcagggataaatatgtgcacattaatagcgatggatttaggagagatgtgcgacgacactgttacatacaaatgtcctctcatcgctgaagtagaaccggaagacattgattgctggtgtaatctaacaagtacttgggtaacatatgggacttgtaaccaagctggagagcacagaagagacaaaagatcggtggctttggccccacacgtcggaatgggcttagacactcgaacacaaacttggatgagtgctgagggggcgtggcgacaagtggaaaaagtagagacatgggcattacgacacccaggctttaccatcctagcattattcttggctcactacatcggcacctcgctaactcaaaaagttgtaatattcatattactaatgctagtgactccatcaatgacaatgagatgtgtaggtgtcggcaatcgggattttgttgaaggactctcaggagcaacgtgggtggacgtggttttagaacatggaggatgcgtaacgaccatggccaaaaacaaaccaaccctcgatattgagttacagaaaactgaggcaacccaattagccactctccgtaaactgtgtattgaaggaaaaataaccaacattactaccgactcacgatgtccaacacaaggcgaagccatactaccagaagaacaagaccaaaattatgtgtgtaaacatacttacgtagatagaggatggggtaacggatgtggtttgtttggaaaagggagcttagtaacctgtgcaaaattccaatgccttgaaccaatagaaggaaaagtagtacagtacgaaaatcttaaatacactgtaatcattacagtacacacaggtgaccaacatcaggtagggaatgacactcaaggcgtaacagtagagatcaccccgcaggcttcaactgtagaagcagtattaccagaatatggtacactaggtttagagtgctctccgaggactggattggattttaatgagatgatcctactaacgatgaaaaacaaagcatggatggtgcatcggcaatggttctttgatctgcctcttccttggactagcggtgctacaaccgagacgccgacctggaatcgtaaagaattactggtgacgtttaaaaatgctcacgctaagaaacaagaagtagtggtcctcggttcacaagagggtgcaatgcataccgctttaacaggtgcgacagagatacagaacagcgggggaaccagcattttcgctggtcacttaaaatgccggctgaaaatggacaaactcgaactaaaaggaatgtcctatgccatgtgcctaaatacttttgttctcaagaaagaagtgtcggagacacaacatggaactattctaattaaagtggaatataaaggcgaagatgcaccatgtaaaataccgtttagcacagaagacgggcaaggaaaagctcataatggaaggttaataactgccaacccagttgtgaccaagaaagaagaacctgttaatatagaggcggagcccccatttggggaatcaaatatagtgatcggtattggtgataaggcactcaaaattaattggtacaagaaagggagctcaataggtaaaatgttcgaggcgacagcccgaggggcaagaagaatggccattctaggagatacagcatgggacttcggtagtgtaggtggggtattaaatagtttaggaaaaatggtacatcaaatatttggaagtgcttatactgctctgttcagcggcgtttcctggatcatgaaaattggaataggcgtacttctcacttggatcggccttaacagcaagaatacatcaatgagcttctcctgtattgtaatcggtataattaccctatatcttggggctgtcgttcaagcagatatgggctgtgctattaactggaaaggaaaggaattaaagtgtggatcgggaatatttgtaacaaatgaagtccatacatggacagaacagtataaatttcaagccgactcaccaaaaagactagccaccgcaatagcgggggcatgggagaatggggtctgcggaatacgatctacgacacgaatggaaaacttactttggaaacaaattgcaaacgaactcaactatatcctttgggaaaataatattaaactaacagtggtggtaggagacattatcggcgtacttgaacagggaaagagaacacttactccgcaacctatggaactgaagtactcgtggaagacttggggaaaagccaaaattgtgacagcagaaactcaaaattcaagttttataatagatggaccaaatactccggagtgtccaagcgcaagtcgagcctggaacgtttgggaggttgaggattatgggttcggtgtgtttacaactaacatttggctcaaattacgagaagtgtacactcaatcttgtgaccacagacttatgtctgcagctattaaagatgaaagggcggttcatgcagatatgggctactggatagagtcacagaaaaacggaagttggaaattagaaaaggcatcttttattgaggttaaaacatgcacatggcctaagagtcacacattatggagcaacggagttttggagagcgacatgattatccctaagtccctagctggaccaatatcacaacacaatcatcgtccgggctatcacacccaaacggcaggtccctggcacttagggaagttagaactagattttaattattgcgaaggcacgacggtagttattaccgagaattgcggtacacgaggccccagtttgcgaacaacaactgtgtcgggaaagctaatacatgaatggtgttgcaggtcatgtactctacctcctctaagatacatgggcgaggacggatgttggtatggaatggaaatacgtccgataaatgaaaaagaagaaaatatggttaagagcttagtgtccgcaggttcgggcaaagtagacaatttcactatgggtgtactatgtttagctatactttttgaagaagttatgaggggaaaatttgggaagaaacacatgattgcaggcgtattattcacatttgtcctacttttatcagggcaaattacatggcgtgatatggcgcatacactaattatgattggttcaaacgcgagcgacagaatgggaatgggggtaacatatttagcgttaatagccacgtttaaaattcaaccatttttagcattaggattctttttaaggaaacttacttcccgtgagaatctgctcttaggcgttggattagcaatggctacaactctacaattacccgaagatatagaacagatggcaaatggaatcgcccttgggctaatgaccttaaaattaataacccagtttgaaacgtaccaactttggacagcgcttgtaagcctaacgtgttcaaataccatattcactttaactgttgcttggagaacagcaacgctaattttagctggtgtttcgctacttcccttatgccagtcaagtagtatgagaaaaaccgactggctaccgatgacggtcgcggcaatgggtgttccaccactacctctgttcatattcagccttaaagacacacccaaacgccggtcctggcccctcaatgaaggagtgatggctgtgggacttgtatcgatactggcaagtagcttgttgagaaacgacgttcctatggcaggtcctctagtagccggtggtttactaattgcatgctatgtaattacaggaacaagtgcagatttaacggtcgaaaaagcagccgatgttacatgggaagaggaagcagagcaaactggagtgagccataatctcatgataacagtagatgacgacggaaccatgcgaattaaagatgatgagaccgaaaacatactcacagtacttctaaaaacagctttattaattgtatcagggatttttccctatagcattcctgctaccctattggtttggcatacgtggcaaaaacaaacacaaagaagtggcgttttatgggatgttcctagtccacccgaaacgcagaaagcggagttggaagaaggggtttacagaatcaagcaacaaggtatctttggaaagacgcaagtgggggtaggagtccagaaagagggtgtattccatacaatgtggcatgttactcgaggagcagtattaactcataatggaaaacgcttagaacccaattgggcatctgtgaagaaagatttaatctcatatggaggaggatggagactatctactcaatggcaaaaaggcgaagaggttcaagttattgcagtagaacccgggaaaaatcccaaaaattttcaaaccatgccgggtatattccaaaccacaacaggcgagataggagctatagccttagactttaaacccgggacttccggctctccaatcataaatcgcgaaggtaaggtagttggattgtacggaaatggagtagttactaaaaacggaggctacgtgagtgggatagctcaaacaaatgctgaacctgatggacccactcctgaacttgaggaggaaatgtttaagaaaaggaatcttactattatggacttgcatccgggttcaggaaagacaagaaaatatcttccggcaatagttagagaggcaataaaaagaaggctacgtactttaatacttgcaccaacacgtgttgtagcagctgaaatggaagaggctttaaagggattgccgatacgatatcaaacgactgcaactaagagtgaacatactggaagagagatcgttgatcttatgtgtcacgccacttttacaatgcgacttctgagtcccgtaagagtcccaaactataaccttataataatggatgaagcacatttcacagatccagcaagtatagctgcaaggggttatatatctacaagggtaggtatgggcgaagcggctgcaatatttatgactgcaacacctccgggcaccgccgaggcgttcccacaatcaaatgctccaatccaagacgaagaaagagatattccagaaagatcctggaactcaggcaatgaatggatcacagatttcgtcggtaaaacggtatggtttgtcccgtcgattaaggccggcaacgacatcgctaattgcttaaggaaaaacggtaagaaagttatacaactatcaagaaaaactttcgatacagaataccagaaaacacggttaaacgattgggattttgtagtaacaacagatataagtgaaatgggtgcaaattttaaggccgatagagtgattgaccccagaaggtgcctaaagcctgtgattctaaccgacgggccagagcgagtaattctcgccgggccgatgcctgttacggcggcgtcggccgcacagaggcgaggaagggtgggtcgaaacccacagaaggagaatgatcaatatatcttcacgggacaacctcttaacaatgacgaagatcacgctcactggaccgaagcaaaaatgttactggataacataaacactccagaaggaatcattcccgctttatttgaaccagaaagggaaaaatccgcagctatcgacggagaataccgattaaaaggagaatcacgaaagacttttgtagaacttatgagaagaggtgatctacctgtttggctggcacataaagtggcatccgaagggatcaaatatacagatcgcaagtggtgctttgatggcgaaaggaacaaccaaatccttgaagaaaatatggatgttgaaatttggacaaaagaaggagaacgcaagaaacttcggccacgttggttggatgcaagaacctattcggatccactagctctgaaagagttcaaggacttcgctgcgggaaggaaaagtattgcactcgaccttgtgactgagattggacgcgtgccttcacacctggcctaccgtacacgaaatgccttagataaccttgttatgttgcacacaagtgaacacggaggaagggcataccgtcacgccgtggaagaattgcctgaaacgatggaaacgctacttttattaggattaatgatattgttgactggaggcgcaatgctattcctaatctcaggcaaaggaataggaaaaacttccataggattaatatgcgtaatcgtttcctcaggaatgctgtggatggccgacgttccattgcaatggatcgcgtctgcaataatattagaatttttcatgatggtactgttaataccagagccagaaaaacaaagaacaccgcaagataaccaattagcatacgtcgttataggtatactcactttagcggctattgtcgcggccaatgaaatgggcctgctagaaacaacaaaacgcgacctaggcatgagtaaagaacctggagtagtatcgcctacctcataccttgatgtagacttacatccagcatcggcgtggactctatatgcagtagctacaactgtgattacacctatgttgcggcatactatagaaaatagtaccgcaaatgtgtcactagcggccatcgcaaaccaagcggtggtccttatgggattggacaaaggatggccaatcagtaaaatggacttaggtgttcccttacttgctctaggttgttacagccaggtgaatccattaacactcaccgctgcagttctcttattagtgacccactatgcaatcattggtcctggtctacaagctaaagcaaccagagaagcgcaaaaacgtactgcagcaggaataatgaagaacccaactgtcgatgggattatgactattgacctcgacccagtcatatacgattcaaaatttgagaagcaattaggtcaagtaatgctacttgttctatgtgccgttcaacttcttctcatgaggacatcgtgggcgttatgcgaagcattaacgttagctacagggcccatcacgaccttatgggagggttcaccgggcaaattttggaatactaccatagcggtgtccatggctaacatttttcgagggtcatacttggccggtgcaggattagcattctcaataatgaagtccgtaggtacaggaagacggggcacaggaagtcagggagagaccttaggcgaaaaatggaagaagaaactgaatcaactatcacgtaaagaatttgatctttataagaaatcaggaataaccgaggtggacagaacagaagcaaaagaggggcttaaacgtggagagacgactcatcatgcagtatcaaggggcagtgctaaactacagtggttcgtagaaagaaatatggtaataccagaaggaagagtgatagatttggggtgcggtcgtggaggatggtcatactattgcgctgggctaaagaaagtcacagaggtgaggggatatacgaaaggaggtccgggacacgaagaaccagtaccgatgtctacatatgggtggaatttagtcaaacttatgtcagggaaggatgtgttttacctcccgccagaaaaatgtgacactcttttatgcgatattggggaatcatctccctcacctacagtagaagagagcagaacaattagggtattaaaaatggtagagccgtggttaaagaataatcaattttgtataaaggtattaaacccgtatatgcccacagttatagaacacctggaaagactacaaagaaaatatggaggcatgcttgtgaggaacccactatctcgcaattcaacacatgaaatgtattggataagtaacggaactggtaatatagtatcatcagtgaatatggttagtcgtctcttattaaaccgcttcacaatgactcacagaagacctacaatagaaaaagatgtggatctcggggcaggaacgcgtcatgtgaacgccgaaccagaaaccccaaatatggacgtaatcggtgagcgaatcaaaagaatcaaagaagaacattcaagtacatggcattacgacgacgaaaatccatacaagacatgggcctatcatggtagttatgaggtcaaagcaacaggttctgcttcatcaatgattaatggagttgtcaaactattaacgaagccatgggatgtagtgcctatggtgacacaaatggcaatgactgatacaactcctttcggacaacagagggtttttaaagaaaaagttgatacccgaacacctcgccccatgccgggtacacgaaaagttatggagataacggccgagtggttatggaggactttaggccgaaacaagaaacctagattatgtactagagaagagttcaccaagaaagtccgtactaacgcagccatgggagccgtatttacagaagaaaaccaatgggattcagctcgcgcagccgtagaggatgaagaattttggaagctggttgatcgggagagagagttacacaaattgggcaagtgcggttcatgtgtatacaatatgatgggcaaaagggagaagaaactaggagaatttggaaaagcgaaaggatcacgagctatatggtatatgtggttgggggcaagatatctagagttcgaggcactgggatttttaaatgaagatcactggttctcacgcgaaaattcctatagcggggtggaaggagagggattgcacaaactcggttacattctacgtgacattagcaaaatacccggaggagcaatgtatgctgatgataccgcaggttgggacacacggattactgaagatgatttacataacgaggagaaaataacgcaacaaatggacccagaacaccgccaattagccaatgctatatttaaactcacataccagaacaaagtggtaaaagtacaaagaccgacgccgaaagggacagtcatggatatcattagcagaaaagatcagagaggatcggggcaagtaggtacgtacggcctcaacacttttacaaatatggaagctcagttggtacgacaaatggaaggtgaaggtgtattgtcaaaagctgacctggaaaaccctcatctactggagaagaaaataacgcaatggttagaaacaaaaggtgtagaacgactaaagaggatggcgataagtggtgatgattgtgtcgtgaagcctatagatgatcgattcgctaatgcccttttggcactcaacgacatgggtaaagttcgcaaagatataccacaatggcaaccctccaaaggatggcatgattggcagcaagtaccgttctgttctcatcatttccatgaactgataatgaaggatggtagaaagttagttgtaccgtgccgaccacaagatgaattaatcggtagagcaaggatttcacaaggggccggatggagtctcaaagaaacagcttgcctgggaaaagcatacgcacaaatgtggtctttaatgtacttccatagaagggatctaagattagcaagcaacgcgatatgctccgcagtgcccgtacactggataccaacatctagaactacatggtcaattcacgctcaccatcagtggatgaccactgaagacatgctaacggtctggaatcgagtttggatagaagacaatccctggatggaagacaaaactccggtaacaacatgggaggatgtaccatatctaggaaagagagaagaccaatggtgtggaagcctaataggtttgacttcgagagcaacatgggcacaaaacattctgacggctatacagcaggtccgttctttgattggtgacgaagagttcctcgactacatgccctccatgaagcggttcaggaaagaagaggaaagcgaaggtgccatatggtga

SEQ ID NO: 23497 - RNA, 9873 nt, synthetic construct
  misc_feature 1..9873: note = derived and/or modified CDS sequence (opt6) from DENV-3__FJ461337__SS-prME
  source 1..9873: mol_type = other RNA
acatcattgtgtttaatgatgatgctcccagctacattggcgtttcatctcacttcgcgtgacggggaaccaagaatgatagtagggaaaaatgaaagaggtaaaagtttactatttaaaactgcttcgggtatcaacatgtgcacactcattgccatggatttgggtgaaatgtgcgatgacacagtaacgtacaaatgtcccctaatagcggaagtggaaccggaagatattgattgttggtgtaacttaacaagtacttgggtcacttatggcacttgcaatcaagcgggagaacatcgtagggacaaaagaagtgtcgccttagcgccgcatgtaggcatggggctcgatacgcgtacccaaacatggatgagtgcagaaggggcgtggaggcaagttgaaaaagttgaaacctgggccctaaggcacccaggattcactatattagcattatttctggcacactacataggcacctcactaacgcaaaaagttgtgatatttatattactaatgttagttactccttcaatgacaatgagatgtgttggagtgggaaacagggattttgtagaaggcctatcaggagcgacatgggtagatgtagttttagaacatggtgggtgtgtaacaactatggcgaaaaacaaacctactttagatatagaactgcagaaaactgaagcaacacaacttgcaaccttaaggaaactttgtatcgaaggtaaaataaccaatatcacgacagattcacgatgcccaacgcaaggtgaagctatactaccagaggaacaagatcagaattacgtctgtaaacatacatatgttgaccgcggatggggtaatggttgtggtctatttggaaaaggaagtttagttacatgtgcaaaatttcaatgcttagagccgatcgaaggcaaagtagtccagtatgaaaatttaaaatacacagtaatcataaccgtacacactggggatcaacatcaagtgggaaacgatacgcaaggcgtgactgtcgaaattacgcctcaagcgagcactgttgaagctgtattaccagaatatggaacacttgggctcgaatgcagtcctagaacgggtctagattttaatgaaatgattttattaactatgaaaaacaaagcatggatggtgcacagacaatggttcttcgaccttcccctaccatggacgtcaggcgccacgaccgaaacgcctacttggaatcgaaaagagttactcgtaacatttaaaaacgctcatgcaaagaaacaagaagttgttgtactaggatcccaggaaggcgccatgcacacggcacttacaggcgcaacagaaatccaaaattcaggtgggacaagtatattcgcaggccaccttaaatgtcgcctgaaaatggacaaattagaattaaaaggaatgtcatatgcaatgtgtctaaatacgtttgtactcaaaaaggaagtgagtgaaacacagcatggtacaatactaataaaagtggaatataagggagaggacgccccgtgtaaaatcccatttagtacagaagatggacaaggcaaggcacacaacggtaggctcataacagcaaacccagttgtaactaaaaaggaagaaccagttaacatagaagctgaacctccatttggagaatcgaatatagtaatcggaattggagacaaagccttaaagattaattggtacaagaaaggatcttcaatagggaaaatgtttgaggccacggcaaggggtgcaaggcgaatggcaatattaggagacactgcatgggatttcggctccatgggaggcgtgcttaattcgttgggtaaaatggtgcatcagattttcggatctgcttatacagcactatttagtggagtaagttggataatgaagataggtatcggtgttttactaacttggattggcctaaatagcaaaaacacatccatgtctttttcttgcattgtgataggaataatcaccttgtatctcggagccgttgtacaggcggatatgggttgtgcgattaattggaaggggaaagaattgaaatgcggcagtgggatattcgttacaaacgaggtccatacttggactgaacagtacaaatttcaagcagatagtcctaagcggctagccacagcgatagccggggcatgggaaaatggtgtatgcggaataagatcaaccacccgaatggaaaatttactgtggaaacaaatcgcaaatgaactgaactatatactttgggaaaataacataaagctcacagtagtagtaggtgatataataggtgtattggaacaagggaagagaactctgactccgcaaccaatggaacttaaatatagctggaaaacatggggaaaagcgaaaatagtaacggcggaaacccaaaattccagcttcataattgatggaccaaatactcccgaatgtcccagtgcttcccgagcatggaatgtttgggaagttgaagactacggatttggcgtgttcacgactaacatctggttaaagctaagggaagtttacacacagtcatgtgatcataggctaatgtcggctgctataaaagatgaacgagctgtccacgccgatatgggctattggattgaatctcagaaaaacggatcttggaaactagaaaaagcgagctttattgaagtaaaaacttgtacatggcctaaatcacatacattatggagtaacggggtgttagagagtgatatgataatcccaaagtccctagcaggaccaatctctcaacacaaccatagacctggatatcacacacaaaccgccgggccctggcacttaggtaaactagaattagactttaattactgcgaaggtactaccgtagtaatcacagaggattgcggaacaagaggtccatcgctgagaactacgacagtgtcaggcaagctaatacacgaatggtgctgtagaagctgcaccttacctccactgaggtacatgggagaagatggttgctggtatggtatggaaattagacctatcaatgaaaaagaggaaaatatggtaaaatctctcgtatcagctggatcaggaaaggtagataactttacgatgggagtcctctgcttagccattttatttgaggaagtcatgagggggaagtttggtaagaaacacatgattgcaggagttcttttcacttttgtattacttctatcgggccaaataacatggagagatatggcgcatactctgattatgattggaagtaacgcatctgacagaatgggaatgggagtgacctatttagctctaattgctacatttaaaatacagccattcttagcactcggctttttcttacgaaaactaacgtctagagagaatcttttattgggagtcggtttggctatggcaaccactctccagttaccggaggacatagagcaaatggcaaatggcattgccttgggtctaatgactttaaaactaataacacaattcgaaacttaccaactttggaccgcgctcgtttctttaacatgtagtaacacaatttttactctcacggtagcatggaggactgcaaccctaatactagccggggtctctttactgcctttatgtcagtcttcatcgatgaggaaaacagattggttaccgatgacagtggcagcgatgggtgttccaccactacccttatttatatttagcttgaaagatacaccaaaaaggagaagttggcctctaaatgagggtgtcatggctgtaggactcgtgtcaatactagcatcttcactcttgaggaacgatgtcccgatggctggtccattggtagcgggaggtctactaatcgcttgttacgtaattacaggaacatccgccgatctaactgtagagaaagccgcggacgtaacatgggaagaagaagctgaacaaacaggcgtttcccataatctgatgataactgtggacgacgatggaactatgcgtattaaagatgatgaaacagagaatatacttacggtactattaaaaacggctctactgattgtttcaggaatttttccctacagcataccggctacgttactcgtctggcatacttggcaaaaacaaacacagcgatcaggggtcttatgggatgtgccctcacctccagaaacgcaaaaagcggaattggaagaaggcgtttataggataaagcaacaaggcatattcgggaaaacccaggttggagtcggtgtacaaaaagaaggggtatttcatactatgtggcacgtgactcgcggcgctgtactaacacacaacggcaaaagattggaacccaattgggcaagtgttaagaaagatcttataagctatgggggagggtggcgactctctgctcaatggcagaaaggagaagaagtacaggtaatcgctgtcgaacctggaaagaaccccaaaaatttccaaacaatgcccggaatatttcaaacgactgcaggcgaaattggtgctatcgccctagatttcaagccaggcacatcaggttccccgataataaatagagagggaaaagtagtgggactctatggtaacggagttgtaactaaaaacggaggttacgtttccggaatagcacaaacaaacgcagaaccggatggcccgaccccggagctagaagaagaaatgtttaagaaacgaaatctcactatcatggaccttcacccaggttctggaaagacacgaaaatacctcccagcaatagtacgcgaagcaataaaaaggagattacgaacactaattctcgcccccacaagagtagtagctgctgagatggaggaggctttaaaggggcttccaataaggtaccaaacaacggcaacaaagtctgagcatacagggcgggagatagtcgatttaatgtgtcacgcaacttttactatgcgcttattgagtccggttagagtaccaaactacaatttaataataatggatgaagcgcattttacagatccggcatcaatcgctgctagaggatacatatcaacacgtgtaggtatgggggaagcagcagccattttcatgacggccacccctccgggaacggccgaagcgtttccgcaatcgaacgcacctatccaagatgaagaaagagacataccggagagatcatggaactccggaaatgaatggataaccgattttgtgggaaaaactgtgtggtttgtcccctctataaaggcgggaaatgacatagcaaactgtcttcgtaaaaacggtaaaaaggtaatacagttgagtagaaagacctttgatactgaataccagaaaaccagactcaatgattgggatttcgtcgttacgactgacatatctgagatgggagcgaattttaaagccgaccgagtgatcgatccaagaaggtgtttaaaaccggtcattctaactgatgggcctgaaagagtaatacttgccggccccatgccagttacggcagcaagtgcagctcagcgtcgaggtcgagttggacgtaacccacaaaaagaaaacgatcaatacatcttcaccggacagccactcaataacgatgaagaccatgcacattggaccgaagccaaaatgttattggataatatcaatactcctgaaggtataatacctgcgcttttcgagcccgagagagagaagagtgccgctattgacggagaatatcgcctaaagggagaatccagaaagacatttgtagagctaatgaggcggggagatcttccagtatggttggctcataaggttgcttcggaagggataaaatatacagataggaaatggtgttttgatggagaacgaaataatcaaatattggaagaaaacatggatgtagagatatggaccaaagaaggagaaagaaagaaacttagaccacggtggctagacgctcggacgtactctgacccgcttgctttgaaagaatttaaagattttgcagccggtaggaaaagtatagcgctagatttagtaacggaaattgggagagtaccatcccacttagcatatcgcaccaggaatgctctagataacttagtcatgcttcatacatcagaacacggcggacgtgcatacagacatgcagttgaagaattgcctgaaacaatggagacattattattgttaggactaatgatattgttaacgggtggggccatgttgtttctaatcagcggtaaaggtatcggtaaaacatcaattggactaatatgtgttatcgtgtcaagtggaatgttgtggatggcagatgttcctctgcaatggatcgcttctgcaattgtgcttgagttctttatgatggtattgctgatcccggaaccagaaaagcaaagaaccccacaagacaatcaattagcttacgtggtaattgggatcctcacactagcagcaatagttgcagccaatgaaatggggctactcgaaacaaccaaaagagatttagggatgtcaaaagagccaggagtagtgagtcctacatcttatctcgatgttgacttacatcctgcctctgcctggacactatatgcagtagccactactgtaatcactccaatgcttcgacatacaatcgaaaacagcacagcaaacgtctccctggctgctatcgccaaccaagctgtcgttttaatgggattagacaaaggatggccaatatccaagatggatttaggtgttcctctgctcgcactaggttgttatagtcaggtaaatcctcttactctaaccgccgccgtattactattagtaactcactatgcaattataggaccgggcttacaagcaaaggctaccagagaggctcaaaaacgaacagcagcaggcatcatgaagaacccgacagttgacgggatcatgacgattgatctagatccagtaatttatgactcgaagtttgaaaaacaattaggtcaagtgatgctcctagttttatgtgctgtacaattgttgttaatgcgaaccagttgggcattatgcgaggctttaacactagccactggtcctatcacaacgctatgggaaggatcgccaggaaagttttggaacactactatagccgtttccatggcgaacatatttagggggtcatacctagcaggagcgggattagctttcagtataatgaagtcagtcgggacaggacgaaggggtacgggtagccaaggagaaacccttggagaaaagtggaaaaagaaactaaatcagttatcaagaaaagaatttgacctatacaagaaatcaggaataacggaggtagataggaccgaggcaaaggaaggacttaagaggggtgagaccactcatcacgcagtgagtcgaggatcggcaaaactgcagtggtttgtggaaagaaatatggttatacctgaaggaagggtaatagatcttgggtgtgggcgaggtggatggagctattattgtgcaggtcttaagaaagtaactgaagtgagaggttataccaaagggggaccaggtcatgaggaacctgtacccatgtcaacttacgggtggaatctagtcaaactgatgagtggaaaagatgtcttttatttaccacccgaaaaatgcgacaccttgctatgtgacataggcgaatcctcaccttcaccaaccgtagaagaaagtcgcacaataagagttttaaaaatggttgaaccatggctgaaaaataatcaattttgtataaaagttttaaacccttatatgccgactgtaattgagcatttggaaagactacagcggaaatatgggggaatgttggtcagaaatccgctatccagaaactctacgcatgaaatgtattggatcagcaacggaacgggaaatatagtttcgtccgttaatatggtatctcgattactattaaacagattcactatgacccaccgacgaccgacgatagagaaggatgttgatttaggcgcaggtacacgacacgttaatgcagaacccgaaacacctaatatggatgtaattggggaaagaattaagagaatcaaagaggaacacagttctacatggcactatgatgacgagaatccgtacaaaacctgggcttatcatggatcctatgaagttaaagcaacaggaagtgcaagttctatgataaatggggtggttaaattactaacaaaaccatgggacgtagtacctatggtaactcaaatggcaatgacagacacgacgccttttgggcaacaacgtgtatttaaagagaaagtcgatacacgcacaccccgacctatgccaggaactcgcaaagtcatggagataacagcggagtggttatggcgtaccctaggacgaaataagaagcctagattatgcactagagaagagttcactaagaaagttagaacgaatgctgctatgggagcggtatttacagaagaaaaccagtgggattcagcgcgagctgcagtagaagatgaagagttctggaagttagttgatagggaacgtgaattacacaaattgggcaaatgcggttcatgtgtgtataatatgatgggaaaacgagagaagaaacttggcgaatttgggaaggcaaaaggttctagagcaatatggtacatgtggttaggagcaagatacttggagtttgaagccttaggatttctgaatgaagaccattggttttctcgcgaaaatagctactcaggcgtggaaggagaaggtctccataagctgggatacatactacgagacatatcaaagattccgggtggtgcaatgtatgcagatgatacggcaggatgggacactagaataaccgaagatgacctacataatgaagagaaaatcacacaacaaatggatccggaacataggcaactagcgaatgcaatattcaaattgacttatcaaaataaggtcgtaaaagtacaacgacctacaccaaaaggaacggtgatggacataatctcaaggaaagatcagcgtgggagtggacaagttggaacatatggtctaaatacatttaccaatatggaagcgcaacttgttagacaaatggaaggagaaggtgtcctttcgaaagcagacttagaaaatccccatttacttgaaaagaaaattacccaatggttagaaaccaagggagttgaacgcctaaaacgaatggcgataagcggtgacgactgtgtggtaaagcctattgatgatagattcgcaaatgcgctgctagcccttaacgatatgggaaaagttaggaaagatataccacaatggcaaccgtcaaaaggatggcatgattggcaacaggtaccgttttgtagtcatcacttccatgaactgatcatgaaggatgggcgcaaattggtagtaccgtgtagaccgcaagatgaattgataggcagagcgagaatatcacaaggagcagggtggtcgctgaaagaaactgcttgtttgggaaaagcctacgcgcagatgtggagcttgatgtacttccacaggcgtgacctaagactagctagtaatgccatatgcagcgccgttcctgtacattggataccaacatcacggaccacatggtcgatacatgcacaccaccagtggatgacaactgaagatatgctaacggtctggaatagggtatggatagaagacaatccatggatggaagacaaaacgcctgtcacgacttgggaagatgttccatacctcggcaagcgagaggatcaatggtgtggatcattgattggactgactagccgggcaacctgggctcagaacattttaacggcaatacaacaagttaggagcttgattggcgatgaagaatttttagactacatgccatcaatgaaaagattcagaaaagaggaagaaagtgaaggcgcaatttggtga

SEQ ID NO: 23498 - RNA, 9873 nt, synthetic construct
  misc_feature 1..9873: note = derived and/or modified CDS sequence (opt6) from DENV-3__FJ461338__SS-prME
  source 1..9873: mol_type = other RNA
acgtccttatgtctaatgatgatgcttcctgcaacactagcttttcatcttactagccgtgacggagaaccaagaatgattgtcgggaaaaacgaaagaggtaaatcattactattcaaaacagcaagtggtataaacatgtgtacccttattgcaatggacttaggagaaatgtgtgacgacacagtaacctataaatgccccctagtagcagaagtggaaccagaagacattgattgctggtgtaatctaacttcaacctgggttacttatggtacgtgcaatcaagctggtgaacatagaagagacaaacgttcagtagctttggcaccacatgtcggaatggggctagatactcgaacacaaacatggatgtctgcagaaggtgcatggcgacaagttgaaaaagtagaaacttgggctctaagacatccgggatttactatcctggccctatttctagctcattatatcggaacttcattaacccaaaaagttgtaatatttatcttactcatgttagttactccatcaatgacaatgagatgtgtaggggtaggaaatcgtgattttgtagaagggctttcgggtgcaacttgggtagatgtggtattggaacatggaggatgtgttacaacaatggccaaaaataaaccgaccctcgatatcgaacttcagaaaacagaagcgacacaactagctacactaagaaaactttgtatagaaggaaaaattacaaacataacaaccgatagtcgttgtccgacccaaggagaagctattctacctgaagaacaggaccagaattatgtatgtaaacatacatacgttgatagaggctggggcaacggatgcggactatttggaaaaggaagtttggtaacatgtgccaaatttcagtgcttagaaccaatcgaaggaaaagtagttcagtatgaaaatttaaaatatacagtaataattacagttcatacgggggatcagcaccaagtagggaacgatacacaaggagtgacggtggaaatcactccacaagcgtcaactgtagaagcagtactaccagaatacggaacattaggtcttgagtgctcaccgcgcactggcctagattttaacgaaatgatcctgcttacgatgaaaaataaagcatggatggttcacagacaatggtttttcgatttgccgttgccatggacatcaggagcaacaaccgaaactccgacctggaataagaaagaattactcgttacattcaaaaatgctcatgcgaagaaacaggaagttgtagtgttaggatcgcaagagggcgctatgcatacggcgttaacgggtgcaacagaaattcaaaacagtggcggtacatccatctttgcggggcatctaaaatgccgtttgaaaatggacaaactcgaattaaaaggaatgtcatatgcaatgtgtttaaatacattcgtactcaagaaagaagtttcagagacccaacacggaacaattttgattaaagtagaatacaaaggagaggatgccccatgtaaaattccgttctcaacagaagatggacaaggaaaagcccataatggacgattaattactgctaacccagtagtcactaagaaagaagaaccagttaatatagaagctgaaccgccgtttggagagtccaatatcgtgattggaataggggacaaagccctgaaaataaactggtacaagaaaggctcaagtataggcaaaatgtttgaagcgacagctaggggagcaaggcggatggcgattttgggggacacagcgtgggactttggaagtgtgggaggagtattaaactctttagggaaaatggtacaccaaattttcggtagtgcttataccgcactgttctccggtgtgtcgtggataatgaaaatcggcataggcgtactcttgacttggattggtcttaattccaaaaacacgagcatgtcattttcatgtatcgtaataggtattatcaccctataccttggtgcagtagtccaagcagatatggggtgtgccattaattggaaaggaaaagaattaaagtgtggaagcggcatcttcgttaccaacgaagttcacacatggacagagcaatacaaattccaagcagactcacccaaaagactagccactgccattgcgggtgcgtgggagaacggagtatgtggcattcgtagtacgaccagaatggagaatctgttgtggaaacaaattgcaaatgaattgaattacatactatgggagaataatatcaaactaacggtagtggtaggagatatcataggagttctagagcaaggaaagcgcaccttaacgccccaaccaatggaattaaagtatagttggaaaacatggggaaaagcaaaaatcgtaactgctgaaacacagaactcctcatttatcatagatgggccaaatacgcccgaatgtccatcagcgtcgagggcttggaatgtttgggaagttgaagattatggatttggcgtctttactacaaacatatggttaaagctaagagaggtctacactcaaagttgtgatcatcgtttaatgtcagctgccataaaagacgagcgggctgtgcatgccgatatgggatattggatagaatcacagaaaaatggaagctggaaactggaaaaagcatcatttatagaagttaaaacttgtacttggccaaaaagccatacactctggagcaatggcgtgttggaatctgacatgattataccgaaatcgctggcaggtccaatctcacagcacaatcacagacctggataccacacccaaaccgcaggaccatggcatttgggaaaacttgaattagacttcaactattgcgaaggaactacagtagtaattacagaaaactgcggaacaaggggtccgagcttgcgtactaccaccgtaagtgggaaactgatccatgaatggtgctgtagaagctgcactctcccacctctgcgatacatgggcgaggatggatgctggtacggcatggaaattagaccgataaacgaaaaggaagaaaatatggttaaaagtctagtttcagcgggttcggggaaagtagataattttacgatgggtgtcctatgcttagcaatattatttgaagaggtaatgcgaggaaagtttggcaagaaacatatgattgcgggtgttctttttacttttgttttattattatcaggtcaaataacctggagagatatggcgcatactttgataatgattgggtctaatgcatctgatcgaatgggtatgggagtgacatatttggcattaatagcaaccttcaaaatccaaccctttttagcactaggatttttcctaaggaaattaacttcacgggaaaacctactactcggagtagggctagccatggcaacaacactacaactcccagaagacattgaacaaatggctaatggaatagctctcggcctaatgacgctgaaacttataacacaattcgaaacttatcaactgtggacagctcttgtcagcttaacttgctctaatacaatatttacactaacggtcgcatggaggaccgctacacttattttggcaggggtatctttactccccctatgtcaaagcagtagtatgaggaagacagattggttaccaatgacagttgcagcaatgggagtacctccactaccactattcatattctcattaaaagatactccaaagagaagaagttggccgcttaatgaaggagttatggccgtgggattggttagtatactagcgtcatcattactgcggaacgacgtaccgatggcaggaccgttagtagccggaggtcttttaatagcgtgctacgttatcacaggtacctcagcagatctaacggtcgaaaaagctgctgacgttacgtgggaagaagaggcggaacaaaccggagtgagccataatctaatgataacagttgatgatgatgggacaatgcggattaaagatgatgaaacagaaaatatcttgacggtgttgctgaagacggcgctgctgatagtaagtggtatatttccatattcaatccctgccaccctcttagtatggcacacgtggcaaaaacagacacaacgatcgggagtgttatgggatgttcctagccctccagaaacacagaaagctgaactagaagagggagtctacagaataaagcaacaaggtatattcggaaaaactcaagtaggggttggagtacaaaaagaaggagtattccacacaatgtggcatgtgacaagaggagcagtactaacacataatggaaaacggttggaacccaactgggcctcagtaaagaaagacttaatatcctacggtggtggttggagactttcagcacaatggcagaaaggtgaagaagtccaagtaatcgctgtagagccaggcaaaaatcccaaaaattttcaaacaatgcccggaatttttcaaacaactacaggcgaaatcggtgcaatagctcttgacttcaaacctggcacgagtggaagtccaattataaatagagagggcaaagtagtcggtctatacggcaatggagtagttaccaaaaacggtggctatgtaagcggaatcgcccagacgaatgctgagcccgatggtccaactcccgaattggaagaggaaatgtttaagaaaagaaatttaaccatcatggacttacaccctggctcaggaaagactagaaaatacttacctgccatagtgagagaagctattaagagacgtttgagaacacttatacttgcgccgacacgtgtagtagccgctgaaatggaagaagccttaaaaggattacccataagatatcaaaccacagccaccaagtcagagcatactggacgtgagatcgtcgatcttatgtgccacgcaacatttactatgcgattacttagcccggtgcgagtacctaactacaacctaattattatggacgaggcgcacttcactgatcctgcttcaatagcagcacgaggatatataagcaccagagtcggcatgggtgaggcagccgcaatctttatgaccgctacgccgcccggaactgctgaagcgtttccgcaatcgaatgccccaatacaagacgaagaacgggatatacctgaaaggtcgtggaactctggtaatgaatggattactgactttgttggaaagacagtatggttcgtaccatctataaaagctggaaatgacatcgctaattgtttaaggaaaaacggcaagaaagttatacagctgtccagaaaaactttcgacactgagtatcaaaagacccgattaaatgactgggattttgtagtcacgacagacatctctgaaatgggagccaatttcaaagctgatcgggttattgatcccagaagatgtttaaaaccagtcattttgacagacggacctgaaagagtgatattggcaggacccatgcccgttacagccgcaagcgcagcacaaagaagggggcgtgttggaagaaatcctcaaaaagagaatgaccaatacattttcaccggccagccgctcaataatgacgaagatcacgcacattggactgaagcaaaaatgttattggacaatattaacactccagagggaattatacctgcactgttcgagccggagcgagagaaaagtgccgctattgatggagaatatcgacttaaaggcgagtcgcgtaaaacatttgtggagctaatgcggagaggagatctacctgtgtggttggcccataaagtggcaagtgaagggataaaatatacagaccgtaaatggtgctttgatggtgaacgtaataaccaaatattggaagaaaatatggacgtcgagatatggacgaaagagggcgagcgaaagaaacttcgtccgcgttggttagatgctagaacctattcagatccgctcgctttaaaggaatttaaggacttcgctgcaggaaggaaatctattgccctcgatttagttacggagatcggacgtgtacctagtcacctagcatacaggactaggaacgccttagacaatctagtaatgcttcacacatcagaacatggcggcagagcatacaggcatgcagtagaagaactcccggagacaatggaaactttattactcttaggtttaatgattttattaacaggaggggcgatgctattcctgatatcaggtaaagggattggtaaaacatctatagggttgatatgtgtaatagtatcgagtggaatgctatggatggcagatgtaccacttcaatggatagcttcggctatagttcttgagttctttatgatggttttattaatacccgaaccagaaaaacaacgcactccccaagacaatcaattagcttatgtcgtcatcggaatcttgaccttagctgcaatagttgcagcaaatgaaatgggtctgttggaaacaacgaaaagggacttaggaatgtccaaagagcccggcgtcgtaagcccaacgtcctacttagatgtagacctacatcctgctagtgcgtggacattatatgcagtggcaaccacagtgattacacctatgctcaggcataccatcgaaaattccactgctaatgtgtcgctcgccgcgattgcaaaccaggcagtagtcctcatgggtttggacaaaggatggcctataagcaagatggatctaggcgttcccctgctggcactaggatgttattctcaagtgaatccactaacattgactgccgcagtattgcttttggtaacgcactacgctataatagggccgggattgcaagccaaagcaactagggaagcgcagaaaaggactgcggcagggataatgaaaaatccaacagtcgacgggataatgactattgatttagatcccgtaatttacgatagcaaatttgagaaacaattgggacaagttatgttactggtgctttgtgccgtacaattactattaatgagaacaagttgggcactgtgtgaagctctaacactagctacaggaccaataacaacgttatgggagggaagtccgggaaaattttggaacacaacaattgcagtttcaatggcgaatatatttagaggttcctatcttgcgggggccggattggcatttagtataatgaagtctgtaggtactggtagaagaggaactggttctcaaggcgaaactctcggcgaaaaatggaagaagaaactcaaccagcttagtcgaaaagagttcgatttatataaaaagtcgggaataactgaagtcgatagaacggaagcaaaggaaggattaaaacgaggtgaaactactcaccacgcagtttccaggggatctgcaaagttacagtggttcgttgaaaggaatatggtgataccagagggaagagtgattgatctgggctgtggtcgcggtggatggagctattactgtgccggcctcaaaaaggtcacagaagtaagaggatacacgaaaggaggcccagggcacgaggagccagtgccaatgtcaacttatggttggaacatagtaaaattgatgtccggcaaagatgtcttctacctaccaccagaaaaatgtgatactttgctatgtgacataggagagtcatcacctagtccaactgtggaagagtcaagaacaataagggttttaaaaatggtagaaccatggttgaaaaataaccaattttgtattaaagtattaaacccatacatgcctactgtgatagaacacctagaacgacttcaaagaaagtatggtggtatgctagttagaaatcccctatctaggaacagcacacatgaaatgtattggataagcaatggtacaggtaatatagtaagctcagtcaatatggtgtctagactcttactaaacagattcactatgactcatagaagaccaacaatagaaaaagacgtcgatttgggagcgggcactaggcatgttaacgcagagcctgaaacaccaaatatggatgtaataggagaacgcattaaacggataaaggaggaacattcgtctacctggcactatgatgatgagaatccttacaaaacatgggcttatcacggaagctatgaagtgaaagctacgggtagtgcatcgtccatgatcaatggtgtagtcaaattactaaccaaaccctgggacgtagttcctatggtcacccaaatggctatgacagatactacgccatttgggcagcaacgcgtttttaaagagaaagtagatacaagaactccgcgaccaatgcctgggacacggaaagtaatggaaattacagctgaatggttatggagaacacttgggcggaataagaaaccaagactttgcactagggaagaatttacgaaaaaggtaagaactaatgcagctatgggtgctgttttcacggaggagaatcaatgggattcagctcgggctgcagttgaggacgaggaattttggaaactcgtcgacagagagagagagcttcataaactcggaaagtgtggtagctgtgtgtacaatatgatgggcaaacgtgagaagaaactcggagagtttggaaaagcaaaaggtagtcgcgcaatatggtacatgtggttgggggcaaggtatcttgaatttgaagcacttggatttttgaacgaggatcattggttttccagagaaaactcctactctggagtcgaaggagaaggtttacataagttaggttatatcctacgagatatctctaaaatacctggaggtgctatgtatgcggatgacacagccggctgggatacacgaattactgaagacgatctccacaatgaagagaaaattacgcaacaaatggatcctgagcatagacaattggctaatgcgatatttaaacttacataccaaaataaggtagtcaaagttcagcgaccaactccgaaaggaactgttatggatatcatatcacgaaaagaccaaagaggatcagggcaagtcggaacctatggattaaacacttttacaaacatggaggcgcaattggtaaggcaaatggaaggtgaaggagttctatcaaaagctgacttagaaaatccacacctcctcgagaagaaaatcacgcaatggttagaaacaaaaggtgttgaacgactcaaacgaatggcgatatccggagatgattgtgtggttaaacccatagatgatcgatttgccaatgcattgctagctcttaatgacatgggtaaggtaagaaaggacataccacagtggcagccaagtaaagggtggcacgactggcaacaagtaccgttctgtagccaccactttcacgagttaataatgaaggatggccgaaagctagtagtcccatgtcgcccccaagacgaactcatcggcagagcaaggatcagccagggagcgggatggtctctcaaagagacagcatgcctaggtaaggcttacgcacaaatgtggagcctaatgtatttccaccgacgcgaccttcgattggcatctaacgctatttgcagtgccgtcccagttcattggattccgacaagtcgaacaacttggagtatacatgcacaccatcaatggatgactacagaagacatgcttacagtctggaaccgtgtatggatagaggacaacccatggatggaagacaaaactccagtaaccacttgggaagatgttccttatctagggaagcgcgaggatcaatggtgcggatcactgataggcttgactagccgagcaacctgggcgcaaaatattttaacagcaatccaacaagtccgctctttaataggtgatgaagaatttcttgactacatgcctagcatgaagcgtttccgaaaggaagaggaatccgagggagctatatggtaa

SEQ ID NO: 23499 - RNA, 9873 nt, synthetic construct
  misc_feature 1..9873: note = derived and/or modified CDS sequence (opt6) from DENV-3__FJ562103__SS-prME
  source 1..9873: mol_type = other RNA
acttctctatgcttaatgatgatgctaccggcaacgctagcctttcatttgaccagtcgagatggagaaccgaggatgattgtcggtaaaaacgaaagaggaaaatccttactgttcaaaactgccagtggcataaatatgtgtactcttatcgcaatggacctaggggaaatgtgtgacgacactgtaacgtataggtgtccattaatagcagaagtcgagccagaggatattgattgctggtgcaacttgacctccacatgggttacatatggtacctgtaaccaagcgggcgaacataggcgagataaaagatcagtagcactagcacctcatgttggaatgggcttggatacgagaactcaaacgtggatgtcggctgaaggtgcctggcgacaagttgagaaagtcgaaacttgggcactacgtcacccaggtttcacaatccttgcacttttcctggcacattatataggtacctcactaacacaaaaagtcgtcatttttacattattgatgctagtcacgccaagtatgacaatgagatgtgtcggagtcggtaatcgagattttgtagaaggactctctggagcaacttgggtagatgtcgtacttgagcacggaggatgcgtcactaccatggctaaaaataagccaactctagatatagagcttcaaaagactgaagcaacgcaacttgccacattacgaaagttgtgtatagaggggaagattacaaacataacaacagatagtagatgcccgacgcagggcgaagcaatcctaccagaagaacaagatcaaaactatgtctgtaaacatacctatgtggacagaggctggggtaatggctgtggactctttggaaagggaagtttagtaacctgcgctaaattccaatgcctagaacccatcgaaggtaaagtcgtacaatacgaaaatttaaaatacactgtcataatcactgttcatacgggagaccaacaccaagtgggaaacgacacacaaggagtaactgtagaaataacgcctcaggcctctactgtggaagcagtactgccggaatatgggactctaggactggagtgtagtcctaggactggtttagatttcaatgaaatgattttactaactatgaaaaacaaggcttggatggtccaccgacaatggttcttcgatttacctttgccttggacaagtggagcgactacagaaacaccgacgtggaacagaaaagaactcttagtaacattcaaaaacgctcacgccaagaaacaagaagtagttgtgcttgggagtcaagagggagccatgcataccgctttaacgggggcaacggaaattcaaaatagcggcggcacaagtatattcgcgggccatttgaaatgtcgactaaaaatggataaattagagttgaaaggtatgagctatgccatgtgtctaaatacgttcgtactcaagaaagaagtctcagaaacacaacatgggacgatactgattaaagttgaatacaaaggagaagatgcaccatgtaaaataccatttagtacagaagacgggcaaggcaaagcacataatgggagattgataacagctaatcctgtagtgacaaagaaagaagaaccagtaaatatagaagctgaaccaccttttggggaatccaatattgtcataggtataggtaacaaagcgttaaaaatcaattggtataagaagggaagcagcataggaaaaatgtttgaagcaactgcaagaggggcaagaaggatggccatcctgggagatacggcctgggattttggatcagtgggtggggtcttaaatagtttaggtaagatggtacatcaaatttttggatctgcatatactgcattgtttagcggcgtatcatggataatgaagatcggaattggcgtattattgacttggataggattaaattccaagaacacctcgatgagtttttcctgtatagtaattggaattattacattgtatttaggcgcagttgtacaggccgatatgggttgtgcaataaactggaaaggtaaagagctaaaatgcggctcgggaatattcgtcacaaacgaagtccacacatggacagagcaatataaatttcaagccgactctccgaagagacttgcaaccgctatagctggagcatgggaaaatggggtttgcggcataagatcaacaacaagaatggaaaacttactatggaagcaaatagcaaatgaattgaattacatattatgggagaataacataaaattaacagtagtggtaggggatataatcggagtgttagagcaaggaaaaagaacgttaactccgcagcctatggagctgaagtatagttggaaaacatgggggaaagcaaaaatagttacagcggaaacacaaaattcctcatttataatcgatggtccaaatacaccagaatgcccctcggcctcacgggcttggaacgtatgggaagtagaagactacggatttggggtatttaccacgaatatctggttgaaactcagagaggtctatacccaatcctgtgatcatagattaatgtctgccgccattaaagatgagagggccgtacacgcagatatgggttactggatagaaagccagaaaaatgggtcatggaagctagagaaggccagctttattgaagtcaaaacctgtacatggcccaaatcgcatactctatggtccaatggagttctagagagtgatatgataatacctaaatccctagcaggccctattagtcagcacaaccatcgtcctggttatcacacccaaacggcaggaccatggcatctaggaaaattagaattggattttaactactgtgagggaacaactgtagtaataacagaaaattgtggaacacgagggccctcgctgcgtactactactgtaagcggaaaacttatacatgaatggtgttgccgatcatgcaccctgccacccttaaggtatatgggagaagatggatgttggtatggaatggaaatccgcccaatcaatgaaaaagaagaaaatatggtaaaaagtctagtatcagccggttcaggaaaagttgataacttcaccatgggagtcttatgcttagcaattctcttcgaagaagttatgagaggaaaatttggcaagaaacatatgatagcaggagtgctttttacatttgtattattattaagcggccaaattacctggcgagacatggctcacacattaataatgattggtagtaatgcaagtgaccgaatggggatgggagttacgtacttagcattaattgcgacctttaaaattcaaccattccttgcactaggattctttctacgaaaacttaccagcagagaaaatctcttattaggagtcggactagccatggcaacaacattacagctaccagaagacattgagcaaatggcaaatgggatcgcgttaggattaatgacactcaaattaataactcagtttgaaacttaccaattgtggacagcattggtatccctaacatgtagtaatactatcttcactttaacggtagcatggcgtactgcaacattaatcctcgctggtgtgtcactgttacctttatgtcagtccagcagtatgagaaaaacggattggctacctatgaccgtggctgcgatgggggtaccgcccttgcccttgtttatatttagcttaaaagatacaccgaaaaggagatcttggcctttaaatgaaggagttatggcagttggtttggtatctattctagcgagtagtttacttagaaacgatgtccctatggcaggcccgttggtagccgggggacttctaatagcttgctatgttataacaggcacatccgcagatctaacagtggaaaaagccgccgacgttacttgggaagaggaagcagaacagacaggggtgtctcataacttgatgataactgtcgatgatgacggtactatgcgcataaaggatgatgagacagaaaacatattgacagttctcctgaaaacagctttactaatagtcagtggaatatttccctacagtatacctgccactctgttggtttggcacacatggcaaaaacaaacacaacgatctggagtactttgggatgtaccttctccacctgagacacaaaaagccgaattagaagaaggggtatacaggataaagcaacaaggaatattcggcaaaacacaggtaggggtgggagtacaaaaagaaggggtatttcacacaatgtggcatgtaacgagaggcgctgttttgacacataatggaaaacgacttgaacccaattgggcgtctgtcaagaaagatttaattagttatggtgggggttggagactatcagcacaatggcaaaaaggagaggaagtgcaagtgattgctgtcgaaccagggaaaaacccgaaaaacttccagactatgcctgggattttccaaaccactacaggtgaaattggggctattgcattagatttcaaaccgggaacgtcaggcagtccaataatcaacagggagggaaaagttgtaggattgtacggcaatggggttgttactaagaacggaggttacgtctccggaatagcacaaacaaacgcagagccagatggacctacaccagaattagaagaagaaatgtttaagaaaagaaacctgactattatggatcttcacccaggttctggtaaaacgagaaagtatcttccggccatagttcgtgaagcgatcaaaagacgtctaagaacattaatactggcaccaacacgagtcgtagcagcagaaatggaagaagcactaaaaggattgccgatcagataccaaaccacagcgaccaaatcagaacatacaggaagagaaatcgtagatctaatgtgccatgccacctttacaatgcgacttctaagtccagtaagagtacctaattacaacctaataatcatggatgaagcacactttactgacccggcttcgattgctgcacgaggatacatctctactcgcgtgggaatgggagaagcagcggctatattcatgactgccacgcctcccggcacagctgaggcttttccacaatcgaatgcgcctatccaagacgaagaaaaagacataccagaaagaagttggaactcaggcaacgaatggataacggatttcgtggggaagacagtatggttcgttccaagcattaaagcaggcaacgacattgctaactgccttagaaagaatgggaagaaagtcatccaattatccaggaaaaccttcgatacagaataccagaaaactcgattgaacgattgggactttgtagtaacaactgacatttcggagatgggagcaaatttcaaagcagatagggtaattgaccccagacgttgtttgaaaccagtcattctgaccgatggcccagaaagagtaatcctagctgggccaatgcccgtcactgccgcatcagccgcacaaaggcggggtagagtaggacgcaatccgcaaaaagaaaatgaccaatatatctttacaggacaacctttaaataacgatgaggaccatgcacactggacagaagcaaaaatgctattagataacattaacacgccagaaggcataatacctgctctgtttgaacccgagcgtgaaaaatccgctgcaatagatggagagtacaggttgaaaggagaatcgaggaagacctttgtagaattaatgagaagaggagatttgcccgtatggctagcacacaaagtagcatcagaaggtataaaatacaccgaccgcaaatggtgcttcgatggcgagcgaaataaccaaattctggaggagaacatggacgtagaaatctggacaaaagagggagaacggaagaaattaaggcctcgatggttagatgcgcgtacttattcggatccactagctttaaaagaatttaaagactttgccgcaggcaggaagtcaattgcgctcgatctcgtgacagaaataggccgcgtaccaagccacctcgcttacagaacacgaaacgctttggacaacttagtgatgttacatacttcagaacatggaggcagggcgtataggcatgcagtggaggaacttccagaaacaatggaaacgctccttctcctaggcttaatgattttattaactggaggcgctatgttattcctcatatcagggaaaggtataggcaaaacaagtataggacttatatgtgtaattgtctcatcaggaatgctttggatggcggatgttcccctgcaatggatagcgtcagcaatagtcttagagtttttcatgatggtgctactcatacccgagccggagaaacaaaggacaccgcaagataatcagcttgcatatgtcgtgattggaatccttacactcgcagccattgttgctgccaacgaaatgggcctcctagaaacaacaaaaagagatttgggaatgtccaaagagccaggcgtagtgtcaccaacaagttatctggatgtagatcttcatccagcatccgcatggactctatatgcagtggcaacaacagttataacacctatgctaagacacacaatcgaaaatagtacagcaaatgtgtcactagccgctatcgctaatcaagcagttgtactaatgggtttagataaaggctggccaatatctaaaatggatttaggtgttcccttattagcccttggatgttactctcaagtaaacccattaacgctcactgccgcagtcctattgctagtaacccactatgccatcataggacccggcttacaggccaaagcaacaagggaagcgcagaaaaggaccgcagcgggtataatgaaaaatcctacagtagatggaattatgactatcgacctcgacccggttatatacgattcaaaatttgaaaaacaattggggcaagtaatgttactggtattatgtgccgtacaactgttactaatgagaacatcatgggcgttgtgtgaagccctgacattagctaccggaccaataacaacattatgggaaggtagtccagggaaattttggaataccacaatagctgtgagtatggctaacatttttcgcgggagctacttggctggtgcaggattggctttcagtattatgaaatcggtgggtaccggtcgtaggggtacaggatcacaaggcgagactttaggagaaaagtggaagaagaaattaaatcaactttcgcgcaaagaatttgatttatacaaaaagagtggcatcaccgaagtggataggacggaagcaaaggagggtcttaaaaggggagaaacaacgcaccatgctgtgagtagagggagcgcaaaactccaatggtttgtggaaagaaatatggtaatcccagaaggtcgagtaatagacctaggctgtggtcgaggaggctggtcttattactgtgccggcctaaagaaagttacagaagtacgaggatataccaagggcggtccaggccatgaggaaccagtacccatgagcacttatggatggaatatagtcaaactaatgagtggaaaagacgtattttatctgccaccagaaaaatgtgatacgttattatgtgatataggcgaaagtagtccttctccaacagttgaggaatcacgaacaattcgagtccttaaaatggtagaaccttggttgaaaaataaccaattttgtattaaagtgttaaatccgtacatgcctacagtaatagaacatctcgagcggcttcagcgtaaatatggtggaatgcttgttaggaatcccttgtcccgtaatagcacgcatgagatgtattggataagtaatggaactggcaatatagttagcagcgtgaatatggtatcaagattgctcttaaaccgatttacgatgacacacagacgtcctactattgaaaaggatgtcgatttgggagctggaactagacatgttaatgcagaaccagagacgcctaatatggatgtaataggtgagcgaataaaacggattaaagaagaacatagctctacgtggcactatgatgacgaaaacccgtacaaaacttgggcatatcatggatcctacgaagtaaaggcaaccggaagcgccagttcaatgattaacggggtagttaagctactgaccaagccatgggacgtggtgccaatggtgacccagatggctatgaccgatacgactccgtttggtcaacagagagttttcaaggaaaaggttgatacaagaacaccaagaccaatgcctggaacaaggaaagtaatggaaattaccgctgaatggttatggcgaaccctaggacgaaataagaaaccaaggctatgcacgagggaagaatttaccaagaaagtaaggacaaacgcggctatgggtgctgtattcacagaggagaatcaatgggactcagctcgagccgcagtggaagatgaagaattttggaagttagttgatcgagaaagggagctccataagctagggaagtgtggcagctgtgtctataatatgatggggaagcgggaaaagaaattaggtgagttcggtaaagcgaagggatcaagagcgatctggtacatgtggttgggagcgaggtatctcgaatttgaggcattgggttttctaaacgaagaccattggttctctcgcgaaaactcatacagcggggtcgaaggagagggacttcacaaacttggatatatcttaagggacatatcaaaaattccaggaggagcaatgtacgctgatgacaccgctggatgggatacacgtattacagaggacgatctacacaatgaagagaaaatcactcaacaaatggacccagaacacaggcagctggctaacgcaatttttaagctaacgtaccagaataaagtcgtgaaagtacagagaccgactccaaagggtacggtaatggatattatctccaggaaagaccagcgtgggagcgggcaggttggtacgtatgggctcaatacatttaccaacatggaagcacagttagtgagacaaatggaaggggaaggcgtcctaagtaaagccgatctagaaaatccccacttattagagaagaaaataacgcaatggttagaaaccaagggtgtggaacgcttaaaaagaatggcaatatccggagacgactgtgtggtgaaacctatcgatgatagatttgcaaatgcattgctagcattaaacgacatgggaaaggtacgaaaagatataccacaatggcaacctagcaaaggatggcatgattggcagcaagtccctttctgctcccatcattttcatgaattaataatgaaggacgggagaaaacttgtagtgccatgtcggccacaagatgaacttataggtagggcaagaataagccaaggggcagggtggtccttaaaggaaaccgcttgtctaggcaaggcatacgcccaaatgtggagtttaatgtatttccataggcgcgatctaagattagcgtcgaacgcaatctgtagtgctgttccagtgcactggatacctacaagcaggacgacatggtcaatacacgcgcaccatcagtggatgactacagaagatatgctcactgtatggaaccgtgtatggatagaggacaacccgtggatggaagacaaaacacctgtgacaacttgggaagacataccgtatttaggaaagcgtgaagaccaatggtgcgggagtttaataggacttacaagtagagctacttgggcacaaaatatattaacagcaatacaacaagttagatcattaataggtgatgaggagttcttagattatatgcctagcatgaaacgatttagaaaggaagaagaaagtgaaggtgcaatttggtaa

SEQ ID NO: 23500 - RNA, 9873 nt, synthetic construct
  misc_feature 1..9873: note = derived and/or modified CDS sequence (opt6) from DENV-3__FJ898456__SS-prME
  source 1..9873: mol_type = other RNA
acttctctatgtttaatgatgatgcttcctgctactttagcttttcacttaacaagtcgcgatggtgaaccacggatgatcgtaggcaaaaatgaacgaggaaaatcactgctatttaaaacggcatcaggcataaatatgtgtaccctgatagctatggatttgggagaaatgtgtgatgatactgtaacttataaatgcccactcataaccgaagtagaaccagaagacatagattgttggtgcaacctcacctcaacctgggtcacatatgggacttgtaatcaagcaggagaacacagaagagataaaagatcagttgcacttgcaccacacgtcggtatgggattggacactcgtacacaaacatggatgtcggcagaaggagcctggagacaagtagaaaaagttgaaacctgggctttccgtcatccaggctttacaattctcgcattatttcttgcccattatattggcacgtcattgactcaaaaagttgtgatatttatcctgcttatgttggtgactccatcgatgacaatgcgctgcgtgggggtagggaatagagatttcgttgaaggattatccggggcaacttgggtggacgtagttttagaacacggcggttgcgtaacgacgatggccaaaaataaaccaacattggatatcgaacttcagaaaactgaagccacacaactggcaaccctaagaaaactctgcatagaaggtaaaattacgaacgtaacgacggatagtagatgccctacacaaggggaagctatcttacccgaagaacaagaccaaaattatgtctgtaaacatacatatgtggacagaggctggggaaacgggtgcggattattcggaaaaggctctttagtaacctgtgccaaatttcaatgtcttgaatcaattgagggcaaagcagtacaacacgaaaaccttaaatacacagtcataattaccgtacacactggagaccaacatcaagttggaaatgagacgcaaggagtaaccgcggaaataactccccaagcaagcacagtagaggctatactccccgaatatggaacgctaggacttgaatgttcaccaagaactggcttagattttaatgaaatgatcctcttaacgatgaaaaacaaggcttggatggtacacaggcaatggttcttcgatttgcccttaccttggacaagcggtgctactacggaaacacccacatggaacaagaaagaattattggtaacatttaaaaacgcacatgccaagaaacaagaggtcgttgttttggggagtcaagagggtgcaatgcatacggcgttgacaggcgcaaccgagattcagacgtctggaggaacgagcatatttgcaggacatctcaaatgtagattaaaaatggataaattagaacttaaaggcatgagttatgcaatgtgcttgaatgcttttgtattaaagaaagaagttagtgaaacccaacatggaaccatcttgattaaagtcgagtataaaggagaggacgctccatgtaaaataccatttagcacagaagacggacaaggaaaagctcataatgggaggttaattacagccaaccctatagtgactaagaaagaggaaccagtgaacatagaagctgaacccccatttggagaatcaaacatagtgataggaataggcgataaagcactgaaaattaactggtataagaaaggatcatccataggcaaaatgttcgaagcaacggcaagaggagctaggagaatggcaatccttggagacactgcatgggatttcgggagtgtcggaggggtactgaactcgcttggaaaaatggttcaccaaattttcggtagtgcatataccgctctattctctggggtgagctggataatgaaaattggtataggcgtgttactaacatggattggtttaaactccaaaaatacctcgatgtcgttctcctgtatagtaataggaattataacattataccttggagcggtggtgcaagcggacatgggatgcgttatcaattggaaaggcaaagaattaaaatgtgggtcaggaattttcgtgaccaacgaagtacatacctggacggaacaatataaatttcaagctgacagtcctaaaagattagcaacagctatagcaggagcatgggaaaacggcgtctgtggcatcagaagtacgacacgtatggagaatttactttggaaacaaatagctaacgaactcaattatattttatgggagaacaatataaaactaaccatagtagtgggggatgtgattggaatactcgaacaaggaaaacgaacgttaacaccacaacctatggaacttaaatacagttggaaaacctggggaaaggctaaaatagtaactgccgaaactcagaatagtagttttattatcgatggtccaaacacgcccgagtgcccgtcagcatcgagagcgtggaacgtttgggaagtagaggactacggcttcggcgtatttacaactaatatatggctaaaacttagggagatgtacacacaactatgcgatcacagattaatgagcgcagcagtcaaggatgagcgagctgtccacgcagatatgggttactggatagaatcacagaaaaatggctcatggaaactcgaaaaagccagtctaatagaggtcaaaacttgtacatggcctaaaagccatacattatggagtaatggtgtgctcgaatccgacatgattataccaaaaagcctagcgggaccaatatcacaacacaattatagacctgggtatcatacgcaaacagccggaccgtggcatctaggtaaattagaattagatttcaattattgcgaaggaactacggtagtaatcaccgagaattgtggtacaaggggccccagcttaagaacaacaacagtatcaggcaaactaattcatgaatggtgctgccgatcatgcacattaccaccactgagatatatgggggaagacggttgttggtatggcatggaaatacgaccaatcaacgagaaggaggaaaatatggtaaaatctctggttagtgcgggcagcggcaaagcagataacttcacaatgggcgtgctatgtctggcaatattctttgaagaggtcatgaggggcaaatttgggaagaaacatatgatagctggcgcgctatttacatttgtattactgctatctggacaaataacctggagagatatggctcacacacttataatgatcggatcgaatgctagtgatcgaatgggaatgggagtaacatatttagctctaattgcaacgttcaagattcaaccgtttctagcattgggcttctttctcagaaaattaacgagcagagaaaacttattactcggtgtaggcctggcgatggccacgaccctgcagctacctgaggatatagaacagatggccaatggcatcgcattaggactcatggccctaaaacttataacacaatttgaaacttatcaactatggacagcgttagttagccttatgtgttccaacactatttttacattaaccgttgcctggaggactgcgacccttatacttgcggtgatttcactgctaccagtttgtcaatcgagtagtatgcgtaaaactgactggctacccatgacggtcgccgcgatgggagttcctagtttgccgttattcattttctccctaaaggatacacttaaaagaagaagttggcctcttaatgaaggcgttatggcagtcgggttagtttctatattagcctcctcatttttgcgtaatgatgtacccatggctgggcccctcgtagcgggaggattacttattgcttgttatgtgattacaggaacaagtgccgatttgactgtagaaaaagcagctgacgtaacgtgggaagaagaagcagaacaaactggagtatcacacaacttaatgattactgtcgacgacgacgggacaatgaggattaaagatgatgagactgaaaacatcctcaccgtcttgctcaaaactgcattacttatagtgtcaggcatctttccttatagtatccctgcgaccctactcgtgtggcatacttggcagaaacaaacgcaaaggagcggcgtcttatgggatgtgccctccccgccagagactcagaaagcagaattagaagaaggggtatatcgcatcaaacaacaagggatatttgggaagacacaagttggagttggagtccaaaaggagggtgtattccatacaatgtggcatgtgactagaggagccgtactaacccataatggaaaaaggctagaacctaattgggctaatgtaaagaaagacttaatatcatatggcggcgggtggaaacttagcgcacagtggcaaaaaggtgaagaagtgcaagtaatagctgtagaacctgggaaaaacccaaagtcattccaaactatgccagggattttccaaacaacgaccggagaaatcggtgccatcgctctggattttaagccaggtacatctggctcacccattataaatcgtgaaggaaaggtagtagggttatacggtaacggagtagttactaaaaatggtggctatgtaagtggaattgcacaaacaaatgcagaacctgatgggccaaccccagagttagaggaagaaatgtttaagaaacgtaacttgacaattatggacctgcatccgggctcaggcaaaacacgaaaatatctcccggcaatagttagagaggcaattaaacggagactccgcacgctcatactagcaccaactagagtagttgctgcagaaatggaagaagcactgaaaggattacccatacgttaccaaacaactgctacaaaatctgagcatacaggtagggaaatagtcgacctaatgtgccatgctacattcacaatgagattactaagcccggtgcgagtgccaaactataacctaattgttatggatgaagctcatttcaccgatcctgcatcgatcgctgcaagaggatatataagtactcgagtgggtatgggtgaagcagcagcgatatttatgacggccaccccaccgggtacagcagatgcattcccacaatctaacgccccgatacaagacgaggaacgagatatccccgaacgctcatggaacagcgggaacgagtggattacagacttcgcgggaaaaacagtatggtttgtaccctcgataaaggcaggtaatgatatcgcaaattgtttgaggaaaaatggcaagaaagtaattcaactttcgagaaagacttttaacaccgagtatcagaagactaagttgaatgactgggactttgttgtcacgacagacatttcagaaatgggagccaattttaaagctgatcgggtaatcgacccgagaagatgtctaaaacctgtaatactaacagacggacctgagcgagttatattagcggggcctatgcctgtgacagttgcctccgctgcacaacgcagaggtagagttggccgaaatccgcaaaaagaaaatgatcagtacatttttactggtcaacctctcaataacgatgaagaccacgcacactggaccgaggctaagatgctcctagataacatcaatacacctgaaggtattattcccgcccttttcgaacctgaaagagaaaagtcagctgcaattgacggcgaatatcgtctgaaaggtgaatcaagaaagacatttgtggaattaatgagaaggggagatctcccggtctggttagcacacaaagttgcaagtgagggtattaagtacactgatcgtaaatggtgttttgatggagaaagaaacaatcaaattctggaagaaaatatggacgtggaaatatggaccaaagaaggtgaaaagaagaaactaagacctagatggttggacgcaagaacatactctgacccactagcgctaaaggaatttaaggactttgccgctgggcgaaaaagtatagctctagacctagtgacagaaattggaagagtcccatcacatctagctcatagaacgagaaatgcgttagataaccttgtaatgttacatacatcagaacacggaggtcgagcctatagacacgcagtagaagaactccccgagacaatggagacattactcttattaggactaatgatcctattaacaggaggggccatgctgttcctaatctcgggaaaaggaataggcaaaactagcataggactaatatgtgtagttgcgtcttcgggtatgctctggatggctgatgtcccactgcaatggattgcctcagccatagtcctagagttctttatgatggttttgttaatccctgaaccagaaaagcagcgtactccgcaagataaccaacttgcgtatgtcgtgatcggaatactaacactagcagcgattgtggcagcaaatgaaatgggcttattagaaacgacaaaaagggatcttggaatgtcaaaagaaccgggagttgtatctccaacaagttatcttgatgtagacctccatcctgcttcagcttggaccttatatgctgtagcaacaaccgttataacgccaatgttacggcatacaattgaaaacagcacggcaaacgtcagcttggctgcgattgcaaatcaagctgttgtactcatgggcctcgataaaggatggcctattagtaaaatggatctgggtgtacccttattagctctaggatgttactcacaggtaaacccattaacactaacagcagctgttctgctgttagtaactcactatgccattataggacctggactccaggcgaaggctacaagagaagcgcaaaaacggactgcggcgggaattatgaaaaatcccacagttgatggcattatgacaattgatttagatccagttatctacgactcaaaatttgaaaaacaattaggacaagtcatgctgctagtgctatgtgcagtacaacttcttctcatgcgtacttcatgggccttttgcgaagcacttacattagcaaccgggcccattacaactttgtgggaaggatcgccaggtaagttttggaataccactatagcagtttccatggcaaatatctttagaggttcctatcttgccggagcaggtcttgcgttttcaatcatgaaaagtgtagggacaggaaaaagaggtactggtagccaaggagagacattgggggagaaatggaagaagaaattaaaccaactgtctaggaaagagttcgatttatataagaaaagcggaataactgaggtagagcgaacggaagcgaaagaaggactaaaaagaggtgagataactcatcatgcggtttcaagaggttcagccaaactacagtggtttgtagaacgaaatatggtgatacccgaagggagagtaatcgacttgggctgtggtcggggaggctggagctactattgtgcaggtctcaagaaagtaactgaagtaagaggttatacaaaagggggtcctggccatgaggaaccggttccgatgagcacatatggatggaacattgtgaaactcatgagcggaaaagacgtattttatcttcctccagagaaatgtgacacgcttttgtgtgacattggggaaagctctccaagcccgacagttgaggagagtagaacaataagagtcctaaaaatggttgaaccatggctcaaaaacaaccaattctgtataaaagtactaaatccgtatatgcccacagtgatagagcatctagaaaggttacagagaaagcacggtggcatgttagtacgtaaccctctaagtcggaactctactcatgaaatgtactggatttcaaatggaacgggaaatatagtaagtagtgttaatatggtatcccgacttctgctaaatagattcacaatgacgcatagacgccctacaatcgaaaaagatgtagacctaggcgcaggtacaagacatgttaatgcggagccagagacaccaaatatggatgttatcggtgaacggataagacgcataaaagaagaacatagctctacgtggcattatgatgacgaaaacccttataagacgtgggcttaccatggaagctatgaagtgaaagcaacaggtagtgcatcaagcatgataaatggcgtagtaaagctgttaacgaaaccgtgggatgtcgttcctatggtaactcagatggctatgacagatacaacaccattcggacaacaaagagtcttcaaagaaaaagttgatacaagaacgccacggccaatgccgggaacccgaaaagtaatggagattacagccgagtggctctggcgaaccctaggaaggaataaacgaccaagactctgcacgcgagaagaatttataaagaaagtcagaactaatgccgctatgggagctgtatttacagaagaaaatcaatgggacagtgcacgcgctgccgttgaagacgaagagttttggaagctcgtggaccgcgaaagagaattacataagttaggtaaatgcggcagttgcgtctataatatgatgggtaaaagagagaagaagttgggagagttcgggaaagcaaaaggatcacgggcaatttggtatatgtggctaggagcccgatatttagaatttgaagctctcggattcttgaacgaagatcattggttctcgcgagaaaattcgtactccggagtggaaggtgaaggactacacaaattggggtacatactacgtgacatcagtaaaataccgggcggagcaatgtatgctgatgatacagctggatgggacacacgtatcacggaagatgatcttcacaacgaagagaaaattacacaacaaatggaccccgaacacagaaggctagcgaacgctatttttaagttgacatatcaaaacaaagtggtaaaggtacaaaggcctacacctaaaggaacagtcatggatattatttcgcggaaagatcaaaggggaagcggacaagttggcacatacggtcttaatacttttacaaatatggaagcccaactaattagacagatggagggcgaaggtgtgctgagcaaggctgatctagagaacccacacctcttagagaagaaagtaacacaatggctagaaacaaaaggagtagagaggctcaaaaggatggctatctcaggagatgactgcgttgttaaaccaattgacgacagatttgcaaatgcattattagcattaaatgatatgggtaaagtaaggaaagatatacctcaatggcagccatcgaaaggatggcatgattggcagcaggtaccattttgttcacatcattttcatgagttgataatgaaagatggacgaaagctagttgttccatgccgtccacaagatgaacttattggaagggctagaatttcccaaggagcagggtggtcgctacgcgaaacagcatgtctaggaaaggcatacgctcaaatgtgggctttaatgtacttccaccgacgagacttgaggctagcatccaacgccatttgttcagcagttccagtacactgggtacccacaagccgtactacatggtccattcacgctcatcaccaatggatgacaaccgaagatatgcttacagtatggaatagagtatggatagaagataatccctggatggaggataaaactcctgtgactacgtgggaagatgtaccttatctaggtaagcgcgaggatcaatggtgcgggtcgctcatcggactggcatcacgggccacgtgggctcaaaatatactaacagcgattcaacaggtcagaagcctcataggtaacgaagagttcctagactatatgccatctatgaagagattccgcaaagaagaagaatcagagggtgcaatatggtaa

SEQ ID NO: 23501 - RNA, 9873 nt, synthetic construct
  misc_feature 1..9873: note = derived and/or modified CDS sequence (opt6) from DENV-3__JN697379__SS-prME
  source 1..9873: mol_type = other RNA
acgtcactatgtcttatgatgatgttaccagcaacactagcattccatttaacaagccgagacggtgaacctcgaatgatagtagggaaaaatgaacgaggaaaatcacttttgtttaaaactgcctctggcattaatatgtgtacattaatagccatggacttaggtgagatgtgcgacgacactgttacttacaaatgtccgcacatcacagaagtagaaccagaagatatagattgctggtgtaacctcacatccacttgggtgacatatggaacgtgcaaccaggctggtgagcatagacgggataaaaggtctgtagcactcgcaccccatgttggcatgggactcgacaccagaactcagacgtggatgtcagcggagggcgcttggagacaagtggaaaaagtagagacttgggcactgagacatccaggatttacaatacttgctctgtttctagcacattacattggaactagcctcactcagaaagtcgtaatatttatcttgttaatgttagttaccccttctatgacgatgagatgtgttggggtcggaaatcgggatttcgtagagggtttaagtggagccacgtgggtggatgtagtattggaacacggggggtgtgtgacaacaatggccaaaaacaaaccaacactagatattgaactacagaaaacagaagcgactcaattagccacactcagaaaactatgcattgaggggaagataacgaacataaccacagattctcggtgcccgacgcaaggagaggcaatattgcctgaagagcaagatcaaaactatgtatgcaagcatacttatgtggatcgagggtggggaaacggatgcggcctcttcggcaaagggagtttggtaacgtgtgccaaatttcagtgtctggagagtattgaaggaaaagttgttcagcacgagaatttaaaatataccgtaattataaccgtacacaccggggatcagcatcaagtaggtaatgaaacacagggcgtaactgcagagataacctctcaagcttcaaccgctgaagtcattctgccagaatatggaactttaggtcttgaatgctcacctcgaaccgggctcgattttaatgaaatgattttacttacaatgaaaaacaaggcgtggatggtacacagacaatggttcttcgacctccctctgccttggacatcaggagccaccacagagacacccacatggaatagaaaagaattgctggtaacctttaagaatgctcacgctaaaaagcaggaagtagtagtattaggatcacaggaaggtgcgatgcatacggccctaaccggagctactgagattcaaacgagcggcggcacaagtatctttgcaggacacctgaagtgtcgtctgaaaatggacaaacttaagttaaaaggtatgtcgtacgcaatgtgcttgaataccttcgttttaaaaaaggaagtcagtgaaacacaacatggtactatactaattaaggttgaatataaaggggaagacgctccctgtaaaattccgtttagtacagaggatggacagggaaaggcacataatggaaggcttataactgctaatcccgttgtaacaaaaaaagaagaaccagtaaatatagaagcagaaccgccatttggagaatccaacatagtaattggcatcggagataaagccttaaaaatcaattggtatcgtaagggaagttccatagggaagatgttcgaagcaacagcgcgaggagctcgaagaatggctatcttaggtgatactgcttgggacttcggctctgttggaggagtcctcaattcactgggaaagatggtacaccagatatttggtagtgcatacacagcattattctctggtgtaagctggattatgaaaataggtataggcgttctcctcacatggattggtttaaattctaaaaatactagtatgtcattcagctgcatagcaataggtataataacactttatttaggcgttgtggttcaggcggatatgggttgcgtaataaactggaagggcaaagagctaaagtgtggcagtggaatctttgtcacaaacgaagttcacacatggacagagcaatacaaatttcaagcggacagtccaaaaagacttgcgactgcgattgcaggtgcttgggaaaacggggtatgtggcattagatctacaacacggatggagaatcttttatggaaacagatagcaaatgaattgaactatatattatgggagaataatattaaacttacagtcgtagtgggcgatataacaggagttttagaacaaggaaaaagaaccttaacacctcaacctatggaactaaagtactcatggaaaacatggggaaaagcaaagatagtaaccgccgaaacgcaaaatagctcatttataatagacggcccatcaaccccagagtgtcctagcgccagccgagcatggaacgtgtgggaggtggaagattacggttttggagtctttactacaaacatttggctaaagttacgagaagtttatacgcaattatgcgatcatagactaatgtcggctgcagtgaaagacgaaagagctgtacacgcggacatgggatattggatagaatcacaaaagaacggatcttggaagttggaaaaggcaagtctcattgaagtgaaaacttgtacttggcccaaatcacacacactttggtcaaacggagtccttgagtcagacatgataatcccaaagtctcttgctggcccaatctcacaacataatcatcggccaggctaccatactcagactgccggtccctggcatttaggaaaacttgagctagattttaactattgtgaaggaacaactgtcgtaatttcagagaattgtggtacaagaggaccaagcttgagaactaccaccgtctccggaaagctcattcacgagtggtgttgtcgtagttgcacgttaccacctttacgatatatgggggaggatggatgttggtatggaatggagatcagaccaataaatgagaaagaggaaaacatggtcaaatcgctagcgagtgccgggtcgggcaaggtagataactttacaatgggggttctatgtctggcaatattattcgaagaggttatgagaggaaagttcggtaaaaagcacatgatagctggtgtcctgttcactttcgttctgctattatcaggacaaattacatggcgtgacatggcgcacacgctgatcatgatcggttcaaacgtcagcgacagaatgggtatgggagtcacttatctggctcttattgcgacttttaaaatacagccatttctagctttaggcttttttttgaggaaactgacctctagagaaaatctattattaggggtcggcttggcgatggccgcgacgttaagactaccagaagacatcgaacaaatggccaacggaatagcacttggtctaatggccctgaaactgatcacccagttcgaaacttatcaactatggactgcattagttagccttacttgtagcaacacaatttttacattaacagtcgcttggaggactgctaccctaatattagcaggcataagtctattgcccgtttgtcaatcttcatcaatgaggaaaacggactggctacccatgactgtagcagcgatgggtgtaccaccgctaccattatttatattcagtctaaaagataccttgaaaaggcgctcctggccactaaacgaaggtgtgatggcggtcggtctagtgagtatactagcctcatcactcttgcgcaacgatgtccccatggctggacctctagtcgcaggcggattattaattgcttgctacgtcataaccgggacctcggcagacctcacggtagaaaaggccgctgacgtaacctgggaagaagaggcggagcaaacaggtgtgtcacacaacttaatgataacagtcgatgacgacggaactatgcgtattaaagatgacgagacggaaaatatattaacagtgctactcaaaaccgccttgctgatcgtttcgggtatattcccctacagtattccagctacacttcttgtatggcacacatggcaaaaacagactcaaagatcaggtgttttatgggacgtaccatcccccccagaaacccagaaagccgaactagaggaaggagtatatagaataaaacaacaaggcatatttggtaaaacccaggtgggagtaggagtacaaaaagaaggagtctttcatacaatgtggcacgtaacacgaggggctgttctaacacataatggaaagcggttagaacctaactgggcaagtgtaaagaaggatcttatcagctatggtggcgggtggcgactatcagcacaatggcaaaagggcgaggaggtacaagtaatagctgtagaacccggcaagaatccaaaaaatttccaaacgatgccaggtatctttcaaacaactacaggagagataggagccattgcacttgattttaaacctggcacatcaggatccccaattataaatagagaaggaaaagtggtaggtctatacggtaatggggtagtcacgaaaaatgggggttacgtaagtggaatagctcaaaccaatgcagagccagatggaccaacaccggaattagaggaagagatgttcaagaaacgtaatttgacgataatggatttacatccaggctcaggcaagacacgcaaatatctaccagcaattgttagagaagctataaaaagacgattacgaacgctgatactagcaccaacacgagttgtagctgctgagatggaggaagcattaaaaggtctgccaataagatatcaaacaacagcgaccaaatcagaacatacgggcagagaaatagttgatctaatgtgtcatgcaacatttacaatgagattgctaagccctgtcagagtaccaaattataatctgataataatggatgaagcacatttcacggacccggcaagtatcgcagcacgtggctacatctcaacaagagttggaatgggcgaggcagcagcaatctttatgactgcgacacctcccggcactgctgatgctttccctcaaagcaatgctcctatacaggatgaggaaagagatatcccggaaaggagctggaactcaggaaacgaatggataactgattttgtggggaagacagtatggtttgtaccgtccataaaggcaggaaatgatatagccaactgcttacgaaaaaacggaaaaaaagtaatccaattgtcgagaaaaacatttgataccgaatatcaaaaaacgaaactcaacgactgggattttgtcgttaccacagatatctctgaaatgggagctaactttaaagcggatagagtaatagatccgagacgatgcctaaaaccggtaatattaacagatggacccgaacgagtaatattggcaggtcctatgcccgttactgtggcatctgccgcacaacgccgcggaagggtaggacgaaacccccaaaaagaaaacgaccagtatatatttatgggacaacctcttaacaacgatgaagaccacgcacattggacagaggcaaaaatgttattagataacatcaatacgcctgaggggattatacctgcacttttcgaacctgaacgagaaaagtccgccgctatagacggagaatatagactgaagggagaatctagaaaaaccttcgtggaactaatgaggagaggagaccttccggtttggttggcacataaagtagcatcggagggcataaaatacacagatcgcaaatggtgcttcgacggggaacggaacaaccaaatactagaggaaaatatggacgtcgaaatctggacaaaagagggagaaaaaaaaaaactaagaccacgatggcttgatgcaagaacatattcagatccattggctttgaaggaattcaaggacttcgctgcagggagaaaatcaattgctttggacttggtgaccgaaataggtagagtcccaagccacttagcacatagaacaagaaatgcgcttgataaccttgtaatgcttcatacatcagaacatggagggcgagcgtatcggcacgcggtagaagagttaccggaaacaatggagaccctgttacttttgggactgatgatcttattaaccgggggagccatgctctttttaatctcagggaaaggtataggaaaaacaagtataggactcatatgcgtcattgcatcctcaggaatgctctggatggcagacgtaccactacaatggatagcatcggctatagttttagaatttttcatgatggtactcctaattcctgaaccggaaaaacagagaacaccacaagacaatcagttagcatacgttgtaattggaattcttacgttggcagcaatagttgcagcgaacgaaatgggtttgcttgaaacaacgaagcgagatttgggaatgagcaaggagcctggagtagtttctccgacaagttatctagatgtagacctccacccagcaagtgcgtggactttatatgcagtagctacgacagtaataacaccaatgctaagacataccatcgaaaatagtactgcaaatgtatccttggcagcgatagcaaatcaagcagttgtattaatgggtctcgacaaaggctggcccatatccaaaatggatttgggggtacctttactcgccctaggatgttatagtcaggttaatccgctaacattggccgccgctgtcctactcttggtaacgcactatgcgatcataggcccagggttgcaagccaaagctacaagggaagcacaaaaaagaacagcagccggtatcatgaaaaatcctactgtagacgggataatgacaatagatttagatccggttatatatgattcaaagtttgaaaagcaacttggccaagtaatgttattggtactttgtgcagtacaattgttattaatgaggacatcttgggcgttgtgcgaggtgctaacactggcgacgggtccaattacaacactttgggagggtagcccaggaaagttttggaacactaccattgccgttagcatggcaaatatcttcagaggctcatatttggctggagccggccttgcgtttagtattatgaaaagtgtaggaacaggaaagagaggaacggggagtcagggagaaaccttgggggaaaaatggaaaaaaaagttaaaccagcttagtagaaaagaatttgacttatacaaaaaaagcggaattacagaagtggaccgtacggaagctaaagagggtctaaaacgtggagaaattacacatcatgctgtatctaggggatcagcgaaattgcagtggttcgtagaaaggaacatggtaatacctgaaggacgtgtaatagatctcggatgtggtagaggagggtggagctactactgcgcaggtctcaagaaagttactgaagttaggggatatactaaaggagggcctggtcatgaagagcctgttcccatgtctacatacggatggaatatagtgaaattgatgtctggaaaagacgtcttctatctaccaccagaaaaatgtgatacactgttatgtgatatcggcgaatcatcaccatcacctacggttgaagagtcgcgtacgataagagtacttaaaatggtagaaccttggttgaaaaataaccaattttgtattaaagtattaaacccttatatgccgaccgtgatcgagcacttagaacgactacaaagaaaacacggaggtatgctggtgagaaatccgctctcgagaaatagtacccacgagatgtactggatctccaacggaacaggtaatatagtcagttcggtcaacatggtatcaagactcttactaaatcgcttcacaatgacacatagacgacccaccattgaaaaagatgtagatttaggagctggcacaagacatgtaaacgccgaaccagaaacaccgaatatggacgtcataggcgagcgtattaagagaataaaggaagagcactcaagtacttggcattacgacgatgaaaacccctacaaaacttgggcttatcatggcagttatgaagtcaaggcgactggcagcgcctcatcaatgatcaatggtgtagtcaaattgctcacaaaaccctgggatgtcgtcccaatggttactcaaatggcaatgacagacacgactccattcggtcaacagcgtgtatttaaggaaaaagtagatacgcgtacgcccagacccatgccaggaacaaggaaggtcatggaaattaccgccgaatggctctggcgtactctgggccgtaataaaagaccccgactatgtacaagggaggaattcacaaaaaaagtcagaacgaatgctgcaatgggagccgtattcacagaagagaatcaatgggattctgcacgggccgcagtagaagacgaagaattctggaaactcgtagatagagaaagagaattacataagttaggtaagtgcggatcatgcgtgtataatatgatggggaaacgcgagaaaaaactaggagaattcgggaaagcaaaaggttcaagagccatttggtatatgtggttaggagctcggtacctagaattcgaagcccttggattcctcaatgaagaccattggttttctcgggaaaatagctacagcggggtagaaggtgagggtttgcataaactaggttatatcttaagagatatatcaaaaatacccggaggtgccatgtacgcagacgacaccgctggatgggacacgcgtataactgaagacgacttacataatgaagaaaaaatcactcaacaaatggacccagaacatagacagttagctaatgccatctttaaattaacatatcaaaataaagtcgtaaaggtgcaaagaccgacacctaagggaacagtaatggatataatttcccgtaaagatcaaagagggagtggccaagtcgggacatatggattaaatacgtttaccaatatggaggcccaactaattagacaaatggagggagaaggtgtactttctaaagcagacctagaaaatcctcacccacttgaaaaaaaaattacacaatggctagaaactaaaggagtggaacgcttaaaacgcatggctattagtggggatgactgcgtggtgaaacctatcgatgataggttcgcaaatgccctactagctttaaatgatatgggaaaagtaagaaaggatataccgcaatggcaaccgagtaagggatggcacgactggcagcaggtacctttctgcagccatcattttcacgagcttataatgaaagacggacggaaattagtagttccatgcagacctcaagatgaattaattggtagagcgcgaatttcacaaggggctggctggtccttaagggaaactgcgtgcctagggaaggcgtatgcgcagatgtggacactaatgtatttccacaggagagatctgagactcgcatctaatgcgatatgctcagccgtccctgtccattgggtaccaacctctagaacaacgtggtcgattcatgcacaccatcaatggatgacgactgaagatatgttaacagtatggaatcgggtctggatagaagataatccttggatggaagataaaacaccagttacgacctgggaagatgtcccgtacttaggaaaacgagaggaccaatggtgtggatccctaataggattaacgtcccgtgcaacctgggctcagaacatccttactgctatacagcaagttcgaagtttaattgggaatgaagaatttcttgactacatgccttctatgaaacgtttccggaaagaggaagaatcagaaggagctatttggtaa

SEQ ID NO: 23502 - RNA, 9873 nt, synthetic construct
  misc_feature 1..9873: note = derived and/or modified CDS sequence (opt6) from DENV-3__JQ045687__SS-prME
  source 1..9873: mol_type = other RNA
acaagcctgtgcttaatgatgatgttaccagcaacattagcgttccatctaacatcacgagatggagaacctaggatgatagtcgggaaaaatgaacgtggaaaaagtcttttattcaaaacagcttctggcattaatatgtgtacacttatagcgatggacctgggggaaatgtgcgatgacacagtaacatacaaatgtcccttagttgcggaagtagaacctgaagacatagactgctggtgtaatcttacatcaacttgggtgacttacggtacgtgtaatcaagccggtgaacaccgacgagataaaagaagtgttgcacttgcccctcacgtgggaatgggattggacacccgaacccaaacttggatgagtgctgaaggtgcctggcgacaagttgaaaaagttgaaacatgggcattacgacatccaggatttaccatactagctttatttttagctcactatatcggtacttccctgacccaaaaagtcgtgatttttatactcctgatgcttgtgacaccatctatgactatgcgttgtgtcggagttgggaacagagactttgtagaaggactatcgggtgcaacttgggttgatgtggttctagaacacggtggttgcgtaactactatggccaaaaacaaaccgacacttgatattgaattgcagaaaacggaagcaacgcaactagcaacgctacgtaaactctgcattgaaggtaaaataactaacattacaacagattcaagatgtcccactcaaggagaagcaatattaccagaagaacaagatcaaaactacgtctgtaaacatacatacgtcgatcgcggatggggtaatggttgtggcttgtttggcaaaggctcgttagtaacctgtgcgaaatttcaatgcctcgagccaattgaaggaaaagttgttcaatatgaaaaccttaaatatacagtaataataacagtacacacaggggatcaacatcaggtagggaatgatacacaaggtgtgaccgtcgaaattacgccacaggctagcaccgtagaagccgtactaccggagtacggaacactaggattagaatgctctccgcgaactggattagatttcaacgaaatgatactcttaacgatgaaaaacaaagcatggatggtacatcggcagtggttctttgatcttccgttaccttggactagcggcgcaacaacggagacacccacctggaataagaaagagctgctggttacttttaaaaacgcccatgctaagaaacaagaggtagtcgtattgggctctcaggaaggagcaatgcacaccgcgttgacgggagctactgagattcaaaattcgggtggcacatcgatattcgctggacatcttaaatgtcgattaaaaatggataaactagaactcaaaggaatgtcgtacgccatgtgtttaaacacatttgtcttaaagaaagaagtctcggaaactcaacatggtactatattaattaaagtagaatataaaggagaagacgcaccttgcaaaattccattcagtacggaagatggacaagggaaagcacataacggaagattaataacagcaaatccagtcgtaaccaagaaagaggagcctgtaaatatagaagctgagccgccgtttggagaatcaaatatcgtaattggaataggtgataaagcgttgaaaattaactggtacaagaaaggcagttcaataggcaaaatgtttgaagctacagctcgcggtgctagaagaatggcgatcctaggagatacagcctgggactttggcagcgtagggggagtattgaatagccttggaaaaatggtacaccaaatattcggctctgcatatactgcgctattctctggagtaagttggataatgaaaattggaattggtgttctattgacatggatcggactgaatagtaagaatacgagcatgtctttctcctgcatagttattggaataattacattatatttaggtgctgtagtacaagcagatatgggctgcgcaataaattggaagggaaaagaactcaaatgtggctcaggtatatttgtaacgaatgaggttcatacctggactgaacaatataagtttcaagcggacagtcctaaaagactggcaacagcaatagcaggagcttgggaaaacggtgtttgcgggatccggagtactacaagaatggaaaatttgttgtggaaacaaatagcaaacgaacttaactacatcttatgggaaaataatattaaattgaccgtcgtggtgggtgatatcatcggcgtattggagcagggtaaacgaaccttgactccacagcccatggagttaaagtattcctggaaaacctggggaaaagccaaaatagtaacagcggaaacccaaaacagcagctttattatagatgggccgaatacacctgaatgtccttctgcgagccgggcatggaacgtctgggaggtagaagattatgggtttggggtcttcacgacaaacatttggctaaaacttagagaggtatacacgcaatcctgtgatcaccgtctaatgtctgctgcaatcaaagatgaaagggccgtgcatgccgatatgggctattggatagaatcacagaaaaatggctcgtggaaacttgagaaggcttcatttattgaagtcaaaacatgcacttggccaaaatcacacacactgtggtcaaatggtgtattagagtctgatatgattatacctaagtcactagctggaccaatatcccaacataaccatagaccaggataccacacacaaaccgcgggaccctggcacttaggaaagttagaattagattttaactactgcgaaggcacaacagtggttataaccgagaattgtggaactaggggcccatccttgagaaccactactgtatccgggaaacttatacacgaatggtgctgcagaagctgcactttgccgcccttacgttatatgggggaggacgggtgttggtatggcatggaaatacggcccataaacgagaaagaagagaatatggtcaaatccttagtttctgctggttctggcaaggtggacaatttcacaatgggagtattatgcctcgcaattctattcgaagaggtaatgagaggaaaatttggcaagaaacatatgattgctggagtcttatttacgtttgttttgttattgtcaggacaaattacatggcgagatatggcgcataccctaatcatgattggatcaaatgcctcagacagaatggggatgggtgtcacatatcttgcccttattgcaacttttaaaatacaacccttcttagcattaggctttttcctacgaaaactaacctcgcgtgagaatcttctattaggagtcggcttagctatggcaactactctacagctacccgaagatatagaacaaatggcgaatggcatagcgttgggactaatgactctaaaattaatcacccagttcgagacatatcaactatggacggcacttgtttcattaacctgttcaaatacaatttttacattgacggtcgcatggaggacagccacacttatattagctggcgtttcactattgccgctgtgtcagtcttcgtcaatgcgaaaaacagattggttaccaatgactgttgcggcgatgggagtccctccactaccgttatttatattttcactgaaagatacacctaaaagacgaagttggccattaaatgaaggagtaatggctgtcgggttagtttcaatattagcatcatcactgctgcgtaacgatgtaccaatggcgggacccctagtagctgggggacttttaatagcttgttacgtaatcaccggaacgagtgctgacttaactgttgaaaaggcagcagatgtaacttgggaagaagaggcagaacaaactggagtctcacataatcttatgataacagtagatgatgacggaacaatgcgaattaaagatgatgaaacagagaacatcttaacagtattattaaaaacagccctacttatagtgtcaggaatctttccttactccatacccgcaacgcttttagtgtggcatacctggcagaagcaaacacagcgttcaggagtcctgtgggatgtaccatcaccaccagaaacacaaaaagctgagttagaagaaggtgtatatagaattaagcagcaaggaatattcgggaagacacaagttggtgttggcgtccaaaaagaaggtgtatttcatacaatgtggcatgtcacacggggtgctgtactcacacataacggcaaacgtttggaacctaattgggcgtcggttaagaaagatcttatcagctatggtggaggatggaggttaagcgcacaatggcaaaaaggagaggaagtgcaagttatcgccgttgaaccaggcaaaaatccaaagaattttcaaaccatgcccggaatattccagactacaacaggagaaatcggtgccatagctttggattttaaaccaggtacaagtggcagtcctataataaaccgagagggtaaggtagtcggtttgtacggaaatggtgttgtgactaaaaatgggggatacgtatcgggcatagcccaaacgaatgctgagcccgacggacctacccctgagttagaagaagaaatgtttaagaaaagaaacctcacgacaatggatcttcatccaggttcaggtaagacaagaaaatacctaccagccatcgtaagagaagccataaagagaagacttagaacattaatcttagcgccaaccagggtggttgcagcggaaatggaggaagcgcttaaaggccttcctatccgttaccagactactgcgacaaaaagcgaacatacaggaagagagatagttgaccttatgtgccatgcgacatttacaatgcggttgctatcaccagtaagagtaccaaactataatcttataataatggacgaggcacactttacagatccggcctctattgcagcaaggggatatattagtacacgagtcggtatgggtgaagctgctgctatattcatgactgctactccacctggaacagcagaggctttcccacaaagtaacgcccctatacaagatgaagaacgagatatacccgagagatcgtggaactccggaaacgagtggataacggattttgtgggaaagacagtctggtttgtgccatcaataaaggctggtaacgacatcgccaactgtttaagaaagaatggtaagaaagttatacaactcagccgtaagacctttgataccgagtatcagaaaacaagattaaatgactgggactttgttgttacaacagatatatcggaaatgggagcgaattttaaagcagacagagtaattgatccccgaagatgcttgaaacccgtcattctaactgacggtccagagcgggtaattctagcaggacctatgccagtaacagcagcctcagccgcacaacgccgagggcgggtaggacgaaatccacaaaaagagaacgatcagtatatatttacaggtcaacctttgaacaatgacgaagaccatgcacactggacagaggcaaaaatgctgcttgacaatataaatactcctgaaggaattattcctgcactgtttgagcctgagagggagaaaagtgcagctatcgacggtgaataccggctgaaaggcgaatcgaggaaaacattcgttgaattaatgagacggggagacttaccagtttggttggcacacaaggtggctagcgaaggtataaaatacactgatcgtaagtggtgctttgatggggaacgtaacaaccagatactcgaagagaacatggatgtggaaatatggacaaaagagggtgagcgtaagaaattaagacccagatggttggatgcccgaacatatagcgatcctttagctctcaaggaatttaaggatttcgcagcggggcgtaagtcaatagcactagacctagtaacagagataggaagagtgccaagccacttagcatacaggacacgaaatgcattggataacttagtaatgttacacacttcagaacatggaggtagagcctatcggcatgccgtcgaggaattgccagaaactatggaaacacttcttttgttaggtctaatgattctgctgacaggtggagccatgttattcttaattagtgggaaaggtataggaaaaacctcaatcggtttaatctgtgtaatagtgagcagtggaatgttatggatggctgatgtgccgctacaatggatagcaagcgctatagttttagagtttttcatgatggtactcttgatcccagaaccagaaaagcagaggactccacaggataaccaacttgcgtacgtggttatcggaatactcacacttgcagcaatagtagccgctaatgagatgggacttctagaaacgacaaaacgcgatttgggaatgtcaaaggagccgggggtagtcagccccacctcctatcttgacgtggatttacatccagccagcgcttggacgttatacgctgtagccaccactgttataaccccgatgctaagacatacgatagagaactccactgccaatgtatcattagccgccatcgccaatcaagccgttgtactcatgggattagataagggttggccaatatctaaaatggacttaggagtacccttattagccctcgggtgctattcacaagtgaatcctttaactttgacggcagcggtgttgctcttagtaactcattatgctattataggtcccggtttacaagccaaagcaacccgagaagcccagaaaaggacagcggctggaatcatgaaaaatcccacagttgacggtattatgaccattgatcttgaccccgtcatatatgacagcaaattcgaaaaacagctcggacaagtaatgcttctagttctatgcgctgtacaattattattaatgagaacatcatgggcactttgtgaggctttgactttagcaaccggtccgattaccactctgtgggagggtagtccaggaaaattttggaacacaactatagccgtaagtatggcaaacatcttcaggggaagttatttggcaggggcaggattggcattttcaatcatgaaatcagttgggacgggaaggagaggtacaggatcacagggtgaaactctaggagagaaatggaagaagaaattaaatcaactaagtagaaaagagttcgacctttacaagaagtcaggtataacggaagtcgatagaacggaagccaaagaaggacttaaacgtggggagacaacacatcatgcagtcagcagaggttccgcaaaattacaatggttcgtcgaaagaaatatggtaattcctgaaggtcgtgtaattgatctaggctgcgggcgtggagggtggtcatattactgtgcggggttgaagaaagtgacggaagtgagaggatataccaagggcggaccgggtcatgaagaacctgtccctatgagcacatacggttggaatattgttaagctaatgtcaggaaaagatgttttctacttgccacctgaaaaatgtgacacattactgtgtgatataggcgagtcctcaccatctccaaccgtcgaggaatcaagaactattcgggtattgaaaatggtagaaccctggctaaagaacaatcagttctgtataaaggttctaaacccttatatgccaacagtaatcgaacacttggaaagactgcagcgtaaatatggtggtatgttagtcagaaatccattatcacgaaatagtacacacgaaatgtactggataagtaatggcaccggaaacatagtctcttccgttaacatggtttccaggttactactcaacagatttactatgactcatcgaagaccgactatcgaaaaagatgtagatcttggtgcaggaacaaggcacgtgaatgcggaaccagaaacaccaaacatggacgtcataggtgaacgaattaaacgaataaaagaagaacactcatctacgtggcattatgatgatgaaaatccgtataaaacttgggcatatcacggaagctacgaagtaaaagctacaggcagtgcttcgagcatgatcaacggagtagttaagctactcactaaaccttgggacgtggtaccaatggtcacacaaatggctatgactgatacgaccccatttggacaacaacgcgtttttaaggagaaggtcgatactagaactcctagacccatgcccggaaccaggaaagtcatggaaatcaccgcagaatggctatggaggactttgggtcgcaataagaaaccacgattatgtactcgtgaagagttcaccaaaaaggttaggactaatgccgctatgggagcagtgtttacagaagaaaaccagtgggacagtgcgagagctgcagtcgaagatgaagaattttggaaacttgtcgatcgagaaagagaactacacaagttaggaaaatgcggttcatgtgtatataatatgatgggcaaaagggagaagaaactaggagaatttggcaaagcaaaaggaagcagggcaatatggtatatgtggttaggagcgagatatttggagttcgaggccttgggtttcttaaacgaggaccactggtttagtcgagagaactcttatagtggagtagaaggagaaggccttcacaaattggggtatattctcagagacattagtaagattccagggggagcgatgtacgcagatgacacggcgggttgggatactagaataacggaagatgatctacacaatgaagagaaaattacacaacaaatggatcctgaacataggcaactcgcgaatgcaatttttaaattaacataccaaaacaaggtggtgaaagtacaacggccaacaccgaaagggacagtaatggatataataagtaggaaagatcaaagaggcagtggccaggtaggaacctacggtctgaatacattcactaatatggaagctcaattagtaagacaaatggaaggagaaggagtactcagtaaagcggatctagaaaaccctcatttgttggaaaagaagattacccaatggttagaaaccaagggcgttgagcgcttaaaacgaatggcaatatcaggggatgattgtgtcgttaaacctattgacgacaggtttgcaaatgcattacttgcattaaatgatatgggcaaagtaaggaaggatatacctcaatggcaaccttcgaaaggttggcatgactggcaacaagtccctttctgttcccatcatttccatgagctcatcatgaaagatggcagaaaattagtcgtgccatgcaggccacaggatgaactaattgggagagcacggatatcgcaaggtgctggttggagtttaaaggaaactgcatgtctaggtaaagcatatgctcaaatgtggtcactaatgtatttccatcgcagagatttacgtctggcaagtaatgctatatgtagcgcggtgcccgttcactggattcccacgtcaagaacaacatggagcatacacgcacatcatcaatggatgactaccgaggacatgttaacagtctggaaccgtgtatggattgaagacaatccatggatggaagataaaactcccgtgacaacatgggaagatgtaccctatttaggaaagcgcgaagaccagtggtgtggttctctgataggcttaacctccagagcaacatgggcgcaaaatattttaactgcaatccaacaagttagaagcctaatcggggacgaggaatttctagattatatgccgtctatgaagcggttccgaaaagaggaagagagtgaaggagccatttggtaa

SEQ ID NO: 23503 - RNA, 9873 nt, synthetic construct
  misc_feature 1..9873: note = derived and/or modified CDS sequence (opt6) from DENV-3__JQ045689__SS-prME
  source 1..9873: mol_type = other RNA
acctccttatgcttaatgatgatgttacctgcaactctagccttccatttgacttcgagagacggagaacctagaatgatcgttggtaaaaatgaacggggaaaaagtctactttttaaaactgcatcaggaataaatatgtgcaccttaatcgcaatggatctaggcgaaatgtgtgatgataccgtgacttacaaatgtcccttaattgcagaagtagaaccggaagatattgactgctggtgcaatcttacatcaacctgggtcacttatggaacatgtaaccaagccggtgaacacagacgagacaaaagatctgtggcgttagcgccgcatgttggaatgggactcgacacaaggacacaaacttggatgtctgcagaaggggcgtggcgccaatttgaaaaagtagaaacgtgggccttacgacacccagggttcacaattttggcactgtttctagcccattatataggaacatctctaacacaaaaagtagtcatctttattctcctaatgcttgtcaccccctcaatgacaatgagatgtgtcggagttggcaatcgtgactttgtcgaaggtttatcaggagcaacctgggtagacgtagtattggaacacggcggatgcgttaccacaatggcgaaaaataaaccaacattagatatagaactacagaaaacggaagcaacgcaattagcaactttacggaaactatgtattgaaggtaaaataactaatatcactactgacagccgatgccctacacaaggagaagcgatccttccagaagaacaagatcaaaattatgtatgtaaacatacttacgttgaccgtggatggggaaatgggtgcggactattcggtaaaggaagcctagtaacatgtgcaaaattccaatgcctagaacctattgaaggaaaagtggtacaatacgaaaacttgaaatatactgtaattataactgttcacactggggatcaacatcaggttggaaacgacacccaaggagtaacagtagaaatcacaccgcaggcttctacggtggaagcagtgcttccagaatacggaacactagggttagaatgtagcccgcgcactggtttagattttaacgaaatgattttgcttacaatgaaaaataaagcatggatggtccatcgtcaatggttctttgatctccctcttccgtggacaagcggagcaactacagaaacgcctacttggaatagaaaagaactcctagttacatttaaaaatgcccatgctaagaaacaagaagttgtggttctaggttcgcaagaaggggcgatgcatacggctcttacgggagcaactgaaatccaaaacagcggaggaacctcgatctttgcgggtcatttaaaatgccgattaaaaatggacaaactagaattaaaaggaatgtcgtatgctatgtgtttgaacacattcgtcttaaagaaagaagtgagtgaaactcaacatggtacaatcttaattaaagtagaatacaaaggagaagacgccccatgtaaaataccattcagcacggaagacggccagggcaaagcgcacaatggtaggcttattacagctaaccccgtcgtaacgaagaaagaggaaccagttaatatagaagccgagccgccatttggcgaatcaaatattgtgataggtataggtgataaagctctgaaaattaattggtataagaaaggttcttctataggcaaaatgtttgaggccactgctagaggggctagacggatggccatattaggagataccgcatgggatttcggaagtgtaggtggagtattaaatagtctaggtaaaatggtgcaccaaatatttggaagtgcttatacagcacttttctctggtgtaagttggataatgaaaattggtataggcgtattactaacctggataggcttgaatagtaaaaacacatctatgtcttttagctgtattgttataggtattattactttataccttggggcagtagtccaggcagacatgggttgtgcaattaattggaaaggaaaagaacttaaatgtggcagcggaatatttgttacgaatgaagttcatacctggactgaacaatataaattccaagcggattctccaaaacgattggctacagccatagctggagcatgggaaaatggagtttgtggcatccgcagtaccaccaggatggaaaatttgctatggaaacaaatcgccaacgaacttaattatatcctatgggagaataacataaaactcacagtagtggttggggatatcatcggggtactggaacaaggtaaacgaacgctcactccacagccgatggagttgaaatatagttggaaaacgtggggaaaagcgaaaattgtaactgcagaaactcaaaattcaagttttataatagacggcccgaacacaccggaatgccctagcgcaagtcgagcatggaacgtatgggaagtcgaagactatggattcggagttttcacaacaaatatttggttaaaactgagagaagtttacacccaaagctgtgatcaccgattaatgagtgcagcgattaaagatgaacgagcagttcatgccgacatgggttactggatcgaaagtcagaagaatggcagctggaagctagaaaaggcttccttcatcgaagtaaaaacctgcacttggccaaaatcacataccttatggtccaatggggtattagagtcagatatgattataccgaaatcacttgctggaccaataagtcagcacaaccatcgcccagggtatcacactcaaaccgctggaccttggcacctagggaaactagaactggatttcaattactgcgaagggacgactgttgttataacagaaaactgtgggacacgtgggccatccctcagaacaaccactgtatcaggaaaattgatccacgagtggtgctgccgatcttgtaccttacctccactacggtatatgggagaagacgggtgctggtatggtatggaaatacgaccaattaacgagaaagaagaaaatatggtaaaatcattagtctcagcaggatcagggaaagtcgacaacttcacaatgggagtactttgtttagcaatcctctttgaagaagttatgcgcggcaaattcggcaagaaacatatgatcgctggtgtactctttacctttgttttattactatccggacagatcacatggagagatatggcgcatacactcattatgattggttcaaatgcttcggaccgtatgggtatgggggtaacttacctagccttgatagctactttcaaaatccaacccttcttggcgttaggctttttcttacgtaaactaacgtcccgagagaacttactgttaggtgtaggacttgcaatggcaaccaccttacaattaccagaagatatagagcagatggcaaacgggatagcattagggcttatgacgttgaagttaattacacaatttgaaacgtaccaactgtggaccgcgctcgtatctctaacatgctctaataccatatttacattaactgtagcttggcgaacagcgaccctaattctcgcgggagtatcattgctaccattgtgccagtcaagtagcatgaggaaaacagattggttaccaatgacagttgcggcgatgggtgtaccgccattaccattattcatattttctctaaaagatactcccaaaagacgaagttggcccctaaacgaaggggtaatggccgtagggctggtatccattttggcttctagcctactacgaaatgatgtaccaatggcaggtcctttagtagctggtggacttctcatagcatgctatgtaatcactgggacatcagcagacctgacggtagagaaggcagccgatgtcacctgggaagaagaggcagagcagactggtgtatcccacaatttaatgataactgtagacgacgatggcacaatgagaattaaagacgacgaaacagaaaatatcttaactgtactgttaaaaactgcgttgctaatcgtgagtggcatattcccgtactcgatacctgccactctgttagtatggcatacatggcaaaaacaaacgcaaaggtcaggtgtcttatgggacgtcccaagcccaccggaaacccagaaagcggaactggaagaaggtgtctataggataaaacaacagggaatttttggaaagacccaagtcggagtaggtgtgcaaaaagaaggggtcttccataccatgtggcatgtcaccagaggagcagtactaactcacaacggaaaaagacttgaacccaactgggcttctgttaagaaagacctcatatcatatggaggaggctggaggttatctgcacaatggcaaaaaggagaagaagtccaagtaatcgcggttgaaccaggcaagaaccctaaaaacttccaaactatgcccgggatatttcagacgacgacaggtgagataggtgctatagctcttgactttaaacccggtacgtctggctcgcccataataaaccgcgagggaaaagtagttggcttatacgggaatggagtagtgactaaaaatgggggatacgtaagtgggattgcccaaacaaatgcagaaccagatggaccaacgcccgaattagaagaagaaatgtttaagaaaagaaatcttacaataatggacctacatccgggtagtggaaagacacggaagtatttgcctgctatagtacgtgaggctattaaacgtcgtctaagaacattaatattagcgcccacaagagtagtcgcggcagaaatggaagaagctctcaaagggcttccgattcgatatcaaaccacagccaccaaatcagaacacacggggagggaaatagtcgacttaatgtgtcatgctacatttacaatgcgcttactttcacctgttcgagtgcctaattacaaccttattattatggacgaagcccactttacagacccagccagtatagcagcgagaggatatataagcacaagggtagggatgggagaagcggctgccatatttatgacagcaaccccgcctggaacagctgaagcattcccacagtcaaatgcacctattcaagatgaagagagagatatcccagaacgttcatggaactcagggaatgaatggatcacagacttcgtcggaaaaacagtatggttcgtaccatctataaaagcgggaaacgatatagccaattgtttgcgtaaaaatggcaagaaagtgatacaattatcccgcaaaacttttgatacagaatatcaaaagacgcgactaaacgactgggattttgtggtgacaactgacatttcggaaatgggtgcgaatttcaaagcagatcgcgtaattgatccaagaaggtgtttaaaacctgtcattttaacagatgggcccgaaagagttatccttgcaggaccgatgcctgtaacggctgcttcagcagctcaacggagaggaagagtgggtcgtaatccacaaaaggaaaacgatcagtatatatttaccgggcaacccttaaataatgatgaagaccacgcacattggacagaggccaaaatgttacttgacaacataaatacgcccgaaggtattatacctgcgttatttgaacctgagagagaaaaatcagcggcgatcgatggcgagtaccgattaaagggtgagtcacgcaagacattcgtagaactaatgcggagaggagatctacccgtgtggttggcgcataaagtagcatcagaaggaataaagtatacagatcggaaatggtgttttgacggagagagaaacaatcaaatcctagaagaaaacatggacgtagagatttggacgaaagaaggagaaaggaagaaacttcgaccccgttggttagatgcaagaacatacagcgatcctttagccctaaaagaatttaaagacttcgctgcggggcggaaatctatcgctctagatttggttaccgagataggaagggtaccatcccatttagctcaccgtacaaggaatgcgttggacaaccttgtaatgttgcatacctcagaacatggtggacgagcgtacagacacgcagtagaggaattaccagaaacaatggagacgttattattactcgggttaatgatattattaacaggaggtgcaatgttatttttgatttcgggtaaggggataggcaagactagcataggactgatatgtgtaattgtatcatcaggcatgttatggatggcagatgttccattacaatggatagcctcagctatagtacttgaatttttcatgatggtgttactaataccagaacctgagaaacaaaggacaccccaagacaatcagcttgcatatgtcgtaattggtatactaaccctagcagcgatagtagcagccaatgaaatgggactattggaaactaccaaaagggacctcggaatgtccaaggaaccaggagtagtttcgccaacatcatacctggatgtggatcttcatcctgcctctgcctggactctgtatgccgtcgcgacaactgtaatcactccaatgctacgacacacaatagaaaattcaactgctaacgtatccttggcagcaattgctaaccaggccgtcgtgctaatgggattagataaaggatggccgatctcgaaaatggatctaggagtgccattattagcgcttggctgctacagtcaagtcaatccactaacattaacagcggcagttttattgcttgtgactcattatgcgattattggtcccggattgcaagcaaaagcgactcgggaagctcagaaacgtaccgcagccgggataatgaagaatccaacagttgatggcattatgacaatcgatttggatccagtgatctacgactcgaaatttgaaaaacaattaggacaagtcatgttattggtattatgcgcagttcaattgcttctaatgcgaaccagttgggctctttgtgaggctttaacacttgcaacaggtcccattacaacactatgggaaggatcaccggggaaattctggaatacgactattgctgtcagtatggcaaacatattcagaggtagttaccttgccggagcaggattagctttttcaataatgaagtcagtagggactgggcgtagaggtaccggttcacagggggaaacattgggagaaaaatggaagaagaaattaaaccaattatcgcgaaaagagttcgatttatataaaaagtcagggatcacagaagttgacagaaccgaggcaaaggaagggctaaagagaggcgagactacacaccatgccgtaagtagaggctccgcgaaactgcagtggtttgtagaaaggaatatggtcactccggaaggcagggtcatcgaccttggatgtggaaggggtggatggtcctattactgtgcaggtctaaagaaagtaacagaagtaagagggtatacaaagggtggcccaggacatgaggaaccagtccctatgagcacctacggctggaatatcgtaaaactcatgagtggaaaagatgtattctatttaccaccagaaaaatgcgataccctattatgtgacataggggaaagttctccctcccctactgtagaagagagccgtacgataagagtattgaaaatggtcgagccatggctcaaaaataaccagttctgcataaaggtacttaacccatatatgccaactgtcattgagcatctagagcgactgcaacggaagtatgggggcatgttagtacgaaacccacttagcaggaatagtacacatgagatgtattggatttctaatggtactggaaacattgtaagtagtgtaaacatggtctcacgactattgctaaatcgttttacgatgacccatcgccgaccgacgattgaaaaagacgttgacctaggcgcgggaacaagacatgtgaacgctgaacccgagacgccgaatatggatgtaataggcgagagaataaaaagaattaaagaagaacactcgtctacttggcactacgacgatgaaaatccatataaaacgtgggcataccatggaagttacgaagtcaaagcaaccggttcggcctcttctatgattaatggggttgtcaaactactaactaaaccatgggatgtcgtaccaatggtaacacaaatggcaatgaccgacaccacaccattcggacagcagcgtgtattcaaagagaaagttgataccaggacgcctaggccgatgcctggtacacggaaggttatggagattaccgctgaatggttatggcgaacgctaggacgtaacaaaaagcctcgtctttgtacaagagaagagttcaccaagaaagtccgaacaaatgcggcaatgggggcggtattcactgaagaaaatcaatgggatagtgcccgggcagcagtggaggacgaagagttctggaaattggttgatcgagaaagggaactccacaagctaggaaaatgtggaagctgtgtatacaatatgatgggtaagagggagaagaaattgggagagttcggcaaagccaaggggtcgcgggcaatctggtatatgtggctcggagctagataccttgagttcgaggcgctaggctttttaaacgaagatcattggtttagtagagagaactcttattccggtgttgaaggtgaagggctgcataagttaggttacatccttagagatataagtaagatcccgggtggagccatgtatgcggatgataccgcaggttgggatacaagaattacagaggatgacttacacaatgaagagaaaattacccaacagatggacccagagcacagacaacttgctaacgcgatattcaaattaacttaccaaaataaagtggtcaaagttcagagaccaacaccaaaaggaacagtaatggatataattagcagaaaagatcagcgaggaagcggacaagtgggcacttacggtttaaacacttttactaatatggaagcccagctagtgagacagatggagggagaaggtgtccttagtaaggcagacttggaaaatccacatctattagagaagaaaattacacaatggctggagacgaaaggagtcgaacgtcttaaaagaatggcgatatcaggagatgattgcgtagttaagcctatagacgatcgattcgcaaatgctttactcgcactcaatgatatggggaaggtacggaaagacattccacagtggcaaccatcaaaagggtggcacgattggcagcaagtacctttctgcagccatcattttcatgaactaataatgaaggatggacgaaaattagtagtaccatgtcgaccacaggacgagctgattgggagagcgcgaatttcccagggtgccggatggtcgcttaaagaaacagcctgcctaggcaaagcatacgcgcaaatgtggtcattaatgtatttccatagaagagatttgcgcctagctagcaatgcaatctgttcagcagttcccgtacactggatacctacatcccgcactacatggtcgatacacgcgcatcatcagtggatgacaacggaggacatgctgactgtgtggaatcgggtatggatagaagataacccatggatggaggacaaaactccagtaaccacatgggaagacataccctatttaggtaagagggaagatcaatggtgcggtagtctaatcgggctcacaagcagagccacgtgggcccaaaacatccttactgcgatacaacaagtacgaagtcttatcggagatgaagaatttttagattacatgccgtcaatgaaaagatttagaaaggaagaagaaagtgaaggtgctatctggtaa

SEQ ID NO: 23504 - RNA, 9873 nt, synthetic construct
  misc_feature 1..9873: note = derived and/or modified CDS sequence (opt6) from DENV-3__JQ045691__SS-prME
  source 1..9873: mol_type = other RNA
acgagtctctgtttaatgatgatgttacccgcaacattagcttttcatctcacatcacgagacggagaacctcgaatgatagtaggcaaaaatgaaagaggaaaatccctgttattcaaaacagcatccgggataaacatgtgcacgctgatagcaatggacttgggagaaatgtgtgacgatacagtaacatacaaatgcccgcttattgcagaagttgaaccggaggacatcgactgctggtgtaatttgaccagtacttgggtaacttatggaacatgtaaccaagccggtgaacaccggagggacaaacggtcggtggcgttagctcctcatataggaatgggtttggatacacgtacacaaacatggatgtcagcagaaggtgcatggagacaagtggaaaaagtagaaacctgggctctacgacatcctggtttcacaatacttgcactatttttagcacattacataggaacatcccttacacaaaaagtagttatattcattttactgatgcttgtaactcccagtatgactatgcgttgcgtaggagtaggtaaccgcgactttgtagagggtttatcaggtgcaacatgggtagacgtcgtcctggaacatgggggatgtgtaacaacaatggccaaaaataaacctacattggatatcgaattacagaaaaccgaagctacacaactcgccaccttacgaaaactgtgcatcgaaggtaaaatcacaaacatcacaactgactcgaggtgtccaacacaaggagaagcaattttaccggaggaacaagatcaaaattatgtttgtaaacacacatacgtagatcgtggatggggaaatgggtgtgggttatttggtaagggttcacttgtaacttgtgcaaaatttcaatgtctagaaccgattgaagggaaagttgtgcaatacgagaaccttaaatatacagtcataatcactgtgcacacaggagatcaacaccaagtaggcaatgatacgcagggtgtcacagtcgaaattaccccgcaggcatctacagtagaagctattttgccagagtatggaacattaggtcttgaatgcagcccgcgaaccggtttagactttaatgaaatgatcctgttaaccatgaaaaacaaggcttggatggtacaccgtcaatggttctttgatttgccattaccatggacaagcggagcaaccaccgaaacccccacatggaatcgaaaagaattacttgtgacatttaaaaatgctcacgcgaagaaacaagaagtagtagttctaggttcacaagaaggagcaatgcatacagctcttactggggcaacagaaatacaaatatcaggcggaacaagcatatttgctggacaccttaaatgcagactaaaaatggacaaattagaactcaaagggatgtcctatgccatgtgtcttaatacattcgtactaaagaaagaagtttcagagacacaacatggtacaatacttataaaagtagaatacaaaggtgaggatgctccatgcaaaatacctttctctacagaagacggtcagggtaaagcgcataacggtagacttattactgcgaacccagttgtaactaagaaagaagaacccgtcaatatcgaagctgagccaccctttggggaaagtaatatagtaattggaataggagataaagcattaaaaataaactggtacaagaaaggatcttccataggaaaaatgttcgaagcaaccgcacggggagccagacgcatggcaatcctaggagataccgcatgggactttggtagtgttggaggagtcttaaattctttgggaaaaatggtgcatcaaatctttggctccgcttataccgcattgttcagtggggtttcatggattatgaaaataggaataggtgtattacttacctggattggacttaatagtaaaaacacatcgatgagtttctcctgtatagtaatcggtataattaccctctatcttggagcagtagtccaggcggatatgggatgtgccataaactggaaaggtaaagagttaaaatgtggtagtggaatttttgtcacaaacgaagtccatacatggactgaacaatataaatttcaagcggactccccaaagcgattagcaacagctatcgcgggagcttgggaaaatggagtatgcggaataagatcaaccacaagaatggaaaatttactctggaaacaaatagcaaacgaattaaattatattctttgggaaaataatatcaaactcacagtagtagtcggagatattataggcgttttagaacaaggtaaaaggacgctaacgccacagccaatggaattaaaatatagttggaaaacgtggggaaaggcgaaaatagtcactgctgaaacgcaaaactcatcattcataatcgatggtccgaacacacccgaatgtcccagcgcctcgagggcatggaacgtatgggaggttgaggattatggattcggggtatttactacaaacatatggctaaaactacgagaagtatacacccaaagctgcgatcataggctaatgtcagcagccatcaaagatgaacgagcagttcacgcagatatgggatattggatagaatcacagaaaaacggcagttggaaacttgagaaagccagctttatagaggtcaaaacctgtacatggcccaaatcccacactttgtggtcaaacggtgttttagagtcggatatgatcattccgaaaagcctcgcaggaccgatttcccaacataaccacagaccaggttaccacacacaaacagccggaccgtggcatttggggaaactggaattagatttcaattattgcgaaggaacaacggtcgtaatcacggaaaattgcggtacgcgcggccccagtttgagaaccaccaccgtatccggtaagttaatacatgaatggtgctgtagaagctgtacactacctcctctaagatatatgggggaagatggctgttggtatggtatggaaatccgaccgattaatgaaaaagaagagaatatggttaagtctctagtttcggccggcagcggaaaggttgataactttacgatgggtgttctatgtctagccatattgtttgaggaggttatgcggggaaagtttggcaagaaacatatgattgcaggagtattatttaccttcgtactgcttctatctggtcaaataacgtggagggacatggcacataccttaattatgataggaagtaatgccagtgaccgtatgggtatgggagtcacttatctcgccctcatagcaacatttaaaatacagccgttccttgcgctgggattcttcttacgtaaactaacaagtagggaaaatttacttcttggcgtcggactagcaatggcaacgacattgcaattacccgaagatatcgagcaaatggcaaatggtattgctttgggcttaatgacattaaaactgattacacagtttgaaacatatcagttgtggactgcactcgtaagtctaacgtgttccaatacaatttttaccttaacagtagcatggagaactgcaacgttgatactcgcaggcgtcagccttctaccactctgtcaatcatcatcaatgagaaagacagattggttaccgatgacagtggcggccatgggtgtaccacctttaccactattcatcttcagccttaaagacactcctaagaaacgatcatggccattgaacgagggagtaatggctgttggtttagtctctatactagcgagtagccttctccgcaatgatgtccccatggctggtccattggtagcaggagggcttctaatagcttgctacgtcataactggaacatcggctgatctaacagtagaaaaagcggccgacgtgacgtgggaagaagaggcagaacaaactggtgtatcacataacttaatgataaccgtagacgacgatggcacaatgagaataaaagacgacgaaacagaaaacatcttaacagtcctattaaaaacggccttgctaatcgtctcagggatctttccatactccataccagcaacgttattagtctggcacacctggcaaaaacagactcaaaggtctggcgtcctttgggatgtaccgtcgcctccagaaacgcaaaaagctgaattggaggaaggagtttacagaataaagcaacaaggaatattcggcaaaacgcaagtcggtgttggcgtccaaaaagaaggcgtattccataccatgtggcatgttactagaggggcggtcctaacacataatggaaaacgactggaaccgaactgggcaagtgtcaagaaagatttaatctcttatggaggtgggtggcggctatctgctcaatggcaaaaaggtgaggaagtccaagtaatagcggttgaaccgggtaaaaatcccaagaactttcaaacaatgcctggaattttccaaacaaccacaggtgaaataggagcgatcgcgttggatttcaagccgggcacatcaggttcgccgattataaaccgagaaggcaaagttgtgggattatacggaaatggagtagtaactaaaaacggaggatatgtcagcgggattgctcagactaatgcagaaccggatggccccacaccagaacttgaagaggaaatgttcaagaaacgaaatttgacaataatggatttgcaccctggaagtggaaagacaagaaaatatctacctgctatagtcagagaagccataaaaagaaggttaagaacactgatattagcccccacacgcgtagtagctgccgaaatggaagaagcactaaaaggcttaccgatcagataccaaactaccgcaactaagtcagaacacaccggtagggaaatagtagatttaatgtgtcacgcaacattcacaatgagattactatctcctgttcgagtgccgaactacaatttgatcatcatggatgaagcgcattttacagatcccgcgtccatcgcagctcgcgggtatataagtacacgggtagggatgggagaagcagctgccattttcatgacagccactccaccaggaacagctgaagccttcccacaatctaacgcgccaatacaggatgaggaacgcgacataccggaacgtagttggaactctggaaatgaatggattacagacttcgtaggcaaaacagtctggtttgtaccttctataaaggcaggcaatgacatagctaattgtttaagaaagaacggcaagaaagtgatccaactttctagaaaaacgtttgacacagagtatcagaaaactaggttaaatgactgggatttcgttgtaacgacagatatatcggagatgggagcgaattttaaagcggatagagtaatagatccacgcagatgccttaaacccgtgatattaactgacggtcccgagcgggtcatacttgcaggtcctatgcctgtaacagcggcttcagccgctcaaagacgggggagggtaggcagaaatccccaaaaggaaaatgatcaatatatctttacaggccagcctttaaataacgacgaagatcatgcccactggacagaagctaaaatgcttttagataatattaataccccggaaggtataattccagctctattcgaaccagagagggagaaaagcgcagcaatagatggggaatatcgtttgaaaggtgagagccggaaaacattcgtcgaacttatgaggcgtggtgatcttcctgtctggctagcacataaagtagcttctgaagggataaaatacaccgacagaaaatggtgctttgacggtgagaggaacaatcagattttagaagaaaatatggacgttgaaatttggaccaaggaaggtgaacggaagaaattaagaccacgttggctagacgcgcggacttatagtgacccattagcactcaaggaatttaaggattttgcagcagggcgaaaaagcatagctttagacctagtcactgaaattgggcgtgtgccatcgcatctagcacaccggaccagaaacgccttagataacctcgtcatgttacatacatccgagcacggaggaagggcatatcgtcatgcagtggaagaattacctgaaactatggagacactcctcttacttgggttaatgatattacttacagggggagctatgctctttctactgtcagggaaaggcatcggaaaaacatccatagggctcatatgcgtgatagtaagtagcggtatgctatggatggcagatgtgcccttacaatggatagcctcagcaatcgtattagagttctttatgatggtactactaattccagaaccagaaaagcaacgaactccacaagataatcaattagcctatgtagtcattggtattcttacattagcagcgatagtagccgctaatgaaatgggtctcttagaaacaaccaaaagagacctagggatgagtaaagaaccaggagtagtatcacccacaagttacctcgatgtagatttgcaccctgcaagtgcatggaccttgtatgcggttgcaactaccgtgataacccctatgcttagacacactatcgagaactcgacagcaaatgtcagcttagccgcgatagctaatcaagcagttgtattaatgggattagacaaaggttggcccatatccaagatggatctgggcgtaccattgcttgctctaggctgctacagccaagttaatccactcaccttaaccgcagctgtactacttttggtaacacactatgccataataggcccagggctccaagcaaaagcaactcgcgaggcgcagaaaaggacagctgcaggcataatgaaaaatccgaccgtggatgggatcatgactattgacctagatccagtaatttatgatagtaaatttgagaaacaactcggtcaggtaatgttattggtgttgtgtgcggtacaacttctactcatgagaacatcctgggcgttatgcgaagcacttaccttagcaacagggcccataacaactctttgggaaggttcacccggtaagttctggaatacgacaatcgcggtaagcatggcgaacatattcaggggcagttacttggcgggagcagggctagcatttagtataatgaaatccgtaggtacaggccgcagaggcacgggtagtcaaggagaaaccctgggagaaaaatggaagaagaaacttaatcagttaagccgaaaagagtttgatttatataagaaaagtggtataacagaagtcgataggacggaagccaaagaaggcctaaaaagaggggagaccactcatcatgcagtaagtagaggatccgcaaaactacaatggtttgtcgaaagaaatatggtcatcccggaaggaagagttatcgatttagggtgcggaagaggtggatggtcctattactgcgcaggactaaagaaagtgacagaagttagaggatatactaaaggaggtcccggacacgaggaaccagttccaatgtcaacctatgggtggaaccttgtaaagttaatgtcgggcaaagacgtattttacttacctccagaaaagtgcgatacactcttatgtgatataggagaatcttctccttcaagcactgttgaagaatcccgaacgatacgggttctaaaaatggtagagccatggctgaaaaataatcaattctgtatcaaagtcctaaatccgtatatgccaacagtcatagaacatttagagcgactacaaagaaaatatggaggcatgctggtcagaaaccctttaagtagaaactcaacgcatgaaatgtattggatctcaaatggcacgggcaatattgtctcatcagtaaacatggtcagcaggctattattgaaccgttttacgatgacacaccgaagacccactatcgagaaagacgtagatcttggcgctggcacgcgtcacgttaatgccgagcccgaaacccctaacatggatgtaataggagagcgtataaagcggataaaagaagaacacagttctacatggcattacgatgatgaaaatccctataaaacttgggcttatcacgggtcttatgaggtcaaagcgacaggtagtgcatcgagtatgataaatggagtcgttaaacttcttaccaaaccatgggacgtagtgccaatggtcacacagatggcgatgactgatacaacaccatttggccagcaacgcgtctttaaagaaaaggtcgatactcgaacaccgagagcaatgccaggcacgcgtaaagtaatggagataactgccgagtggctatggcgcacgcttggaagaaacaagaagccccgcttgtgtacccgtgaagaatttactaagaaagtcagaacaaatgccgccatgggcgcagtgtttacagaagaaaatcaatgggattccgcccgagctgcagtagaagatgaggagttttggaaattggtggatcgcgaacgggaactgcataaattgggaaagtgtggtagttgtgtgtataatatgatgggcaaaagggaaaagaaactaggtgaatttggtaaggccaaagggtcaagggccatatggtacatgtggttaggggctcgatatctggaatttgaggcactaggctttctcaatgaagatcattggttttctagggaaaatagctattcaggggtagaaggtgagggcctacataaattgggatatattttgagagacatttctaagatacctgggggcgcaatgtatgcagatgatacagcagggtgggatacgcgaatcaccgaagatgatttacataacgaagagaaaattacacagcaaatggatccagaacaccgccagctagccaacgccatatttaaactcacatatcagaataaagtagttaaagtgcaaagaccaactccgaaaggaactgtaatggacataatctcgagaaaggatcaaaggggctcaggtcaggtaggcacatacggcctcaacacgtttacgaatatggaagcgcaattagtacggcaaatggagggagagggtgtattgagtaaagccgatttagaaaatagtcatcttctagagaagaagataactcaatggttagaaacaaaaggcgtagaacgattaaaaaggatggcaataagtggtgacgattgcgtagtgaaacccattgatgatagattcgcaaacgctctcttggccttaaatgatatggggaaagtaagaaaagatataccccaatggcaaccatcaaaaggatggcacgactggcaacaagttcctttctgcagtcaccattttcacgagttaataatgaaggacggaaggaagttagtagtcccatgtagacctcaggatgaattaataggcagagctcgaatctctcaaggagcgggttggtcacttaaagagacagcgtgtcttgggaaagcatacgcacaaatgtggtccttgatgtatttccaccgtcgcgatctacgacttgcttctaacgcgatctgctcagcagtacccgtgcattggattccaacaagtaggacaacatggtccatacacgctcatcatcaatggatgacgaccgaggacatgttaacagtatggaacagggtctggatcgaggataatccatggatggaggataaaactccggtaacaacatgggaagatgtaccataccttggaaaaagggaggatcaatggtgcggttcacttattgggttaacgtcaagagcaacctgggcacaaaacattttaacggccatccaacaagtcagatctttaatcggcgatgaagagtttcttgattatatgccaagcatgaaaaggttcagaaaagaagaggaatctgaaggtgccatttggtga

SEQ ID NO: 23505 - RNA, 9873 nt, synthetic construct
  misc_feature 1..9873: note = derived and/or modified CDS sequence (opt6) from DENV-3__JQ045692__SS-prME
  source 1..9873: mol_type = other RNA
acctcactttgtttgatgatgatgttgcccgcaactctagcctttcatctaacttcaagggacggagaacctcgtatgatcgttggtaaaaacgaaagggggaaatccttactatttaaaactgcaagcggaattaacatgtgtactcttatcgcaatggacttaggagaaatgtgtgatgataccgttacctataaatgtcctttgatcgctgaagtcgaaccggaagatattgattgctggtgcaacctaacatcgacctgggtaacgtatgggacgtgtaatcaagctggtgaacatagaagagacaaacggtcagtagcattggccccacacgtcggtatgggactagacacgagaacccaaacatggatgtcagccgaaggagcatggcgccaagtcgaaaaagttgaaacttgggctttgcgacaccctgggtttacaatacttgctctatttttagcacattacataggaactagcttaacgcaaaaagtagtaatatttattttactgatgttagttaccccctccatgacaatgcggtgtgtcggagtaggaaatcgagacttcgtggaaggtctaagtggagcaacttgggtggatgtggtcttggaacatggcggatgcgtgactacaatggctaaaaacaaaccaacactcgatatcgaactacagaaaaccgaagcaactcaattagcgactctgcgcaaactatgtatcgaaggaaaaattacgaatatcaccaccgatagccgctgtccgacgcaaggtgaagcaattttgcccgaagaacaagaccaaaattacgtctgtaagcatacatacgtagaccgaggatggggtaatggatgcggactttttggtaaaggcagcttagttacttgtgcaaaatttcaatgtttggaacctattgaagggaaagtggttcaatacgaaaatctaaagtatacagtgattattactgtacacacaggagaccaacatcaggtagggaatgatacccaaggtgttacagtagagataactccccaagcctcaacagtagaagccatactacctgagtatggcactttgggtctagaatgtagtcctcgaacaggattggattttaatgagatgattctattaacaatgaagaacaaagcatggatggtacatagacagtggttctttgacctgcccctaccttggacgtccggtgctacaacagaaaccccgacttggaacagaaaagaactattagtaacatttaaaaatgcgcatgctaagaagcaggaagtggttgtcctgggatcacaagaaggtgctatgcatacagcattaactggcgcaacagaaattcaaatctctggaggtacatcaatttttgctgggcatctcaaatgccgactcaagatggacaaattagagttaaagggcatgtcatatgctatgtgccttaatactttcgtacttaagaaagaagtatctgagacgcagcatggaacgatattaataaaggtcgaatacaaaggggaagatgcaccatgtaaaattccattctctactgaagatggacaagggaaagcacataacggacgtcttattacagcaaacccagtagttactaagaaagaagaaccagttaatatagaggctgaaccgccattcggcgaaagtaatatagtgataggtataggagataaagcactaaaaataaactggtataagaaagggagttccatcggtaaaatgtttgaagcaacagcaaggggagcacgaagaatggcaatacttggggatactgcgtgggacttcggatcagtaggcggcgtgttgaactcgctcggaaaaatggtacatcaaatattcggttcggcctataccgctctattctctggagtaagttggatcatgaagataggtatcggcgtcttgcttacctggatcggacttaatagtaaaaatacatccatgtcattctcttgcatcgttataggaataataacactttatctcggagctgtcgtacaggctgacatgggttgcgcaatcaattggaagggaaaagaactaaaatgcggatctggaattttcgtgacaaatgaagtacacacatggacagaacagtataagttccaagcggattcaccaaaaagactagctactgcaatagcaggcgcttgggagaatggtgtctgcggaattagaagcacaacaagaatggaaaacctattatggaaacaaattgcaaacgaattaaattacattctatgggagaataatataaaattaaccgtagtagtaggagacataataggagtgctagagcaaggaaaaagaacactgacgccacaacccatggaattaaaatattcctggaagacatggggtaaagcaaagattgttactgcagagacacaaaattctagctttataatcgacggaccaaatactccagaatgccccagtgcctcacgcgcatggaacgtctgggaagtagaggattatggattcggggtatttacaactaatatttggttaaaattgcgagaagtatatacccaatcatgtgaccaccgtttaatgtcagctgctatcaaagatgagcgcgctgtacatgcagatatgggctactggatagaaagccagaagaacggaagctggaaactagagaaggctagctttatcgaggtcaaaacatgtacatggcctaaaagtcatactctttggtcaaatggagtgctggaatcagacatgatcattcccaagagcttagctggacctataagtcagcataaccatcgcccgggatatcatactcaaacagcagggccatggcatctagggaaactggaacttgattttaactactgcgaaggaactacggtggtaataacggagaactgtggcaccagaggaccgagtctacgtacaactactgtatcaggaaaacttattcatgaatggtgttgtcgaagctgtaccttacccccactaagatatatgggtgaagatggatgttggtacggaatggaaataagacctattaacgaaaaggaggagaatatggttaaatccctggtttcagcggggtcaggcaaggtagacaactttacaatgggagtgctctgcctagcgatcctatttgaagaggtaatgagagggaaatttggcaagaaacacatgatcgcgggggtactgttcacattcgtactcctattgagtggccagatcacatggcgggatatggctcatacattaatcatgatcgggtcaaatgcttcagacaggatgggaatgggagtcacttatttagcccttattgcaaccttcaaaattcaacctttcttagctttaggctttttcctcagaaaacttacatcgagagaaaatctactcctaggtgttgggcttgctatggccacgacattacagctccctgaggatatagaacagatggcaaatggtattgctcttggtctaatgactctgaaactcattacgcaatttgaaacctaccaactttggacggcgctagtatcacttacatgttcaaatacgatattcacattaactgtagcatggcgaaccgctaccttaatactagctggagtatctttattgccactttgccagtcgagttcaatgcgtaaaacggactggttacctatgacagttgctgctatgggggtcccgccgttaccattattcatcttctctcttaaagacactcctaaacggagatcatggccattaaatgaaggagtaatggcagtagggttagtatcgattctggcgtctagtctattacgtaacgatgttcccatggccggacccctagtagctggaggattactcatagcatgttatgtaattaccggcacaagtgcagatctaacagtcgaaaaggcagccgatgtaacctgggaagaagaagcggaacaaacaggagttagccataacttgatgataaccgtcgacgatgacggcacaatgagaatcaaagatgacgagaccgaaaatatattgacggtactattaaaaacagcactattaattgtatcagggatctttccttattcaatccccgctacattgttagtgtggcatacctggcaaaagcaaacacagcgttctggtgtactttgggatgtaccctcacctcctgaggcacaaaaagcagaactagaggagggagtttatcgtataaaacaacaaggtatttttggcaaaacacaggtgggagtaggcgtacagaaagagggcgtatttcatacgatgtggcatgtaacaagaggagccgtattaactcacaacggtaaacgtttagaaccgaactgggctagtgtaaagaaggacctgatatcgtatgggggaggttggagactatctgcgcaatggcaaaaaggggaagaggtccaagtcattgctgtagaaccaggcaaaaaccctaaaaacttccaaactatgcccggcatattccaaacaacaacaggcgaaattggcgctatagccttggacttcaagccaggaacatccggaagtcccatcataaatagagaaggaaaagtggtcggactatacggcaatggtgtagtaactaaaaatgggggatacgttagtggaatagcacaaacgaatgctgaaccagatggcccaacacctgaactagaagaggagatgttcaagaaacgaaatttaacgataatggatctacatcccggctcaggaaagacccgaaagtatctacccgccattgtaagagaagcgatcaaacgtaggctaaggacgttgattttggcaccaactagggtagttgcagcggagatggaagaagccctaaaaggactgccaatcaggtaccagacaacagcaacaaaaagcgaacacacggggagagaaattgtagatttaatgtgtcacgccacatttacaatgagacttcttagtcccgttagagttcctaattataacttgataataatggatgaagcacatttcacggatcccgcaagtatagctgcgcggggatacataagcacacgagttggcatgggtgaggcagccgcaatattcatgaccgcaacaccaccagggacggcagaggcgtttccacaaagcaacgcccccatacaagacgaagaaagagatatcccggagcgtagctggaacagtggaaacgaatggataactgacttcgttggaaagacggtatggtttgtaccttctatcaaagccggaaacgacatagcgaattgtttacggaaaaatggcaagaaagtaatacaactgagtagaaagacatttgacacagaatatcagaaaacgagattaaatgactgggactttgtggttacaacagacatcagcgaaatgggtgctaacttcaaggcggatcgagtgatagatccaagaagatgcctaaaaccagttatactcacagacggaccagagagagtcatattggccggacctatgccagttactgccgcttcagcagctcaacggcgagggagagtaggtagaaatccacaaaaagagaatgaccagtacatatttacaggacaacctttaaataacgatgaagaccatgcccattggacggaagcgaaaatgcttttggacaacattaatactccagagggaatcattccggccctatttgaacccgagagagaaaagtcagcagcaatagatggcgagtatagattaaagggcgaaagtcgaaagacatttgtagaattaatgcggcgtggtgatcttccagtgtggctcgcacataaggtagctagtgaaggaatcaaatacacagatcgaaagtggtgctttgacggagaaagaaataatcaaatattagaagaaaatatggatgtggagatctggacgaaagaaggggaaagaaagaaattacggccacggtggttagatgctcgtacttactctgatcccttggcactaaaagaatttaaagacttcgccgctggtagaaaatcaatcgcgttggatcttgtaacagaaatcggtcgagtacccagtcacttagcgcacagaacgcgaaatgcgctagataaccttgtcatgttacatacaagcgaacatggaggacgagcttatagacatgcggtggaagaactacctgaaacgatggaaacattcctcctattaggtttaatgatattactcactggcggtgcaatgcttttcctgctatcagggaaagggataggaaaaacttcaattgggctgatttgtgtcatagtctcgagcggaatgctgtggatggcagatgtaccgttacaatggatagcgagtgcaatagtactagagttcttcatgatggtactattgatacctgagccagaaaaacaaaggacacctcaggataatcagttagcgtatgtagtaataggaatcctgacactagcagcaatagtcgcggctaatgaaatgggacttctagaaacaaccaaaagagaccttggaatgagcaaagagccaggcgtagtatcaccaacttcttacttagacgtcgacttacatccagcgtctgcttggacactctacgccgtcgccacgacagtaatcactccaatgttaagacatacaatagaaaacagcacggcaaatgtatcgttagctgccatagctaatcaggcagtcgttctaatgggattagataagggttggcccattagtaagatggatctcggcgtaccattactagcactcggatgttattcacaagtgaacccactaacattgacggccgctgtattattgctagtgacacactacgcaattataggtcccggtctacaagcaaaagcgacacgggaagctcaaaaacgaactgcagcaggcattatgaaaaatccaaccgtagacggtattatgaccattgatcttgaccctgtgatttatgatagtaaattcgagaaacagctcggacaagtaatgctactcgtgctatgtgcggttcaactcttgttaatgcgcacatcttgggccttatgtgaggctttgacattggctactgggccaatcacaaccttatgggaaggaagccccggaaagttttggaacacaacaattgcggtcagtatggcaaacatcttcaggggatcatacttagccggtgcaggcttagcattcagcataatgaaatcagtcggcacaggtagaagagggacaggttcgcaaggggagacacttggagaaaaatggaagaagaaactcaatcaactgtcacgaaaagaatttgatctatataagaaaagtggaataaccgaggtagatagaaccgaagcgaaagaaggtttgaaaagaggtgagacaacacaccatgccgtgtcaaggggaagtgctaaattacaatggttcgtagaaagaaatatggtaattccagaaggcagggtgatagacctggggtgtggaagagggggttggtcatactattgtgcaggcctcaagaaagttacagaagtgcgaggatacaccaaagggggaccaggtcatgaagaacctgttccgatgtccacttatggctggaacctggttaaattgatgtctggaaaagatgtcttttacttgccaccggagaaatgtgacactctattatgcgatataggagaaagtagtccatcatctacggtagaagaaagcagaacaataagggtattaaaaatggtagagccgtggctcaaaaacaatcaattttgcattaaagtactcaacccatatatgccaactgttattgaacatctagagcggctacagagaaagtatggaggtatgctggtaagaaatcctttaagtagaaatagtacacatgaaatgtattggatatcaaatggtacaggtaatatagtgagttctgttaacatggtctctcgattattactcaataggtttacaatgacacaccgccgtccaactatagaaaaggacgtagacttaggcgccggtacgagacatgtaaatgccgagcctgaaactcccaatatggatgtgataggagagagaataaaacggataaaggaagaacattcatcaacttggcattacgatgacgaaaacccctataaaacatgggcgtaccatggaagctatgaggtgaaagcaactggtagtgcgagttccatgattaacggtgtcgttaaattgctgactaaaccctgggatgttgtgccaatggtgactcagatggctatgactgacacgactccgtttggccaacagcgggtatttaaagaaaaagtagataccagaactcctcgcgctatgccaggtacaaggaaagtgatggaaataactgcagaatggttgtggcgcacattgggacgaaacaagaaacctcgtctatgcacaagagaagagtttacaaagaaagtccgaactaatgcagcaatgggagccgtatttacggaagagaatcaatgggactccgctagggcggctgttgaagatgaagagttctggaaactggtagatagggaacgggaattacataaactaggaaaatgcggttcttgcgtatataatatgatgggtaagcgtgagaagaaactgggagagttcggaaaagcaaaaggctcgcgtgccatatggtacatgtggcttggagcgcgttatctagaatttgaggcgttgggatttcttaatgaagatcactggttcagcagagaaaatagctatagcggggtagaaggtgaaggcttacacaaactagggtacatacttagggatatctccaaaattccaggaggggctatgtatgcagacgatactgcaggatgggacacacggataacagaagatgatcttcacaatgaggagaaaataacacaacaaatggatccggagcataggcagttagctaacgctatatttaagttaacttaccaaaacaaagtagtcaaagttcaaagaccaacaccaaagggaacggtcatggacattatatcccggaaagatcaaaggggtagtggacaagtgggcacatatggtttgaatacgttcacaaacatggaagctcaattagttaggcaaatggaaggcgaaggtgtattatccaaagcagatctggagaatccacatttactcgagaagaaaataacccaatggttagaaacaaaaggagttgaaagactcaaaaggatggcgataagcggagacgattgcgtagtgaaaccaattgacgacagatttgcaaatgcactacttgctctcaacgacatgggaaaagtaagaaaagacatcccacaatggcaaccatcgaaaggttggcacgattggcaacaagttccattctgctctcatcattttcacgagttgataatgaaagatggtaggaaattagtagtgccctgtagaccacaagatgaattgatcgggcgagctagaatctcacaaggagcagggtggtcactcaaagagaccgcttgtcttggcaaggcttacgcacaaatgtggagtctaatgtatttccatagacgagacctcagacttgcaagtaatgcgatctgcagtgctgtgcccgtgcattggatacctactagccgcacaacatggtctatacatgcgcaccatcaatggatgacgacagaagacatgcttactgtttggaacagagtgtggattgaggacaacccctggatggaagataaaactccagtaactacatgggaagatgtcccctatcttggcaaaagagaagatcaatggtgtggatccttaattggtctaacgagtagagcgacttgggcacaaaacatactgactgcgatacaacaagtaagaagtcttatcggggatgaagaatttttagattacatgccctcaatgaaacggtttcgaaaagaagaggagtctgaaggggctatatggtaa

SEQ ID NO: 23506 - RNA, 9873 nt, synthetic construct
  misc_feature 1..9873: note = derived and/or modified CDS sequence (opt6) from DENV-3__JQ045694__SS-prME
  source 1..9873: mol_type = other RNA
acgagtttatgtttaatgatgatgttacccgctacattagcattccatttaacatcacgagatggagaacctagaatgatagtgggcaaaaatgaaagagggaaaagtttactatttaaaactgcatcaggaataaacatgtgcactctcatagcaatggaccttggggaaatgtgcgacgacacagttacgtacaaatgccccctgatagcagaggtagaaccagaagacatagattgctggtgcaatctaacgtccacgtgggtaacatacggtacgtgtaatcaagctggagaacacagaagagacaaaagaagcgtcgcattagctccacatgtcggaatgggactcgacacaagaacacaaacatggatgagtgcagaaggagcatggagacaagtggagaaagtcgaaacatgggcacttagacaccctgggtttacaattttagctctattcttagcccattatataggaacatctttaactcagaaagtagtgatatttatattattaatgctcgtaactcccagcatgacaatgagatgtgtcggtgtaggaaatcgggacttcgttgagggactatcaggagcaacttgggttgatgttgtgttggaacatggtggatgtgtgactactatggctaaaaataaaccaacattggatatagagctgcagaaaactgaagccacacaattagcaacacttcgtaaactgtgtatagaaggtaaaataactaacatcactacagactctagatgtccaacacaaggcgaggctattctacccgaggaacaagaccaaaattatgtttgtaaacatacctacgttgatagaggatgggggaatggttgtggcttatttggaaaagggagcttagtaacttgtgctaaatttcaatgtttagagcctatcgaggggaaagtcgtccagtacgagaatctaaaatatactgtgattataacggtgcatactggcgatcaacatcaagtaggaaatgatacacagggtgtgacagtcgagatcacaccccaggcatcaacagtagaagctgtattaccagagtatggaaccctgggacttgaatgtagtcctagaacagggctagacttcaatgaaatgatccttttaacaatgaaaaataaagcatggatggttcacaggcaatggttctttgatttgccgttaccatggacgtcaggtgcaacgacagaaacgccaacctggaatcgaaaagaattactcgtaacttttaaaaatgcacacgccaagaaacaagaagtcgtagttttaggttcacaagaaggggctatgcatacggctctaactggtgcaacagagattcagaactcaggaggcacaagtatttttgcaggacacttaaaatgtagacttaaaatggataaattggaattaaaaggaatgtcatatgcaatgtgcctaaatacttttgtactaaagaaagaggtatcagaaacccaacatgggacaatcttgataaaagtggaatacaaaggagaagatgctccatgcaaaataccgtttagtacggaagatggtcaaggtaaggctcacaacggcaggttaattacggccaacccagtagtcaccaagaaagaggaacctgtaaatattgaagcagaaccacctttcggagaatcaaacatcgtgatcggtattggagacaaggctctaaagataaattggtataagaaaggttcaagtataggaaaaatgtttgaggcaacagcacggggtgcgagacggatggccatcctaggggacactgcttgggattttggaagtgtagggggagttttaaattccttgggtaaaatggtacatcaaatttttggttctgcgtatacagcgctattctctggtgtatcatggataatgaaaattgggataggcgtactcctaacgtggataggcctgaactccaaaaatacaagtatgtcattttcatgcatagtaatcggaataataacactttacctgggagcagttgttcaagctgacatgggatgtgccataaattggaaaggcaaggaactaaagtgtggaagcggaatatttgtaacgaatgaggtccatacgtggactgagcagtataaattccaagcagattcgccgaagagactagccactgcgatagcgggtgcatgggaaaatggagtgtgcggcatcagaagtaccacgcgtatggagaatttattgtggaaacaaatagcaaacgaattaaattacatcttgtgggaaaacaatataaagttaaccgtagtagtgggcgatattattggtgtgttggaacaaggaaagagaacactgactcctcaaccaatggaactaaagtactcatggaaaacttggggaaaagcaaaaatagtaactgccgagactcaaaattccagctttataattgacggtccaaacaccccggaatgtccgagtgctagtcgggcttggaatgtttgggaagtagaagactatggctttggtgtgtttactaccaatatatggcttaaacttcgtgaagtttatactcaaagctgtgaccatagattaatgtctgcagccataaaagacgaacgcgcagtacacgcggatatgggctactggatcgaaagtcagaaaaatgggagttggaagctagaaaaagcgtcatttatagaggtgaaaacgtgtacatggcctaagtcgcatacactgtggtcaaatggagtattagaatccgacatgattatcccaaagagtttagccggtccaatatcccaacataaccatcgtcccggatatcatacacaaactgcaggcccctggcatctaggaaagctagaattagacttcaattactgcgaagggacaactgtagtaattacggagaattgtggaactagaggaccaagtctaaggaccaccacagtttcgggtaaactcatacacgagtggtgctgccgatcatgtacactgccacccctgcgttatatgggtgaagatggatgttggtatgggatggagattcgtcccatcaacgaaaaagaggaaaatatggttaaaagtttagtgagcgctggttcgggaaaggtagataatttcactatgggtgtactgtgcctagcgatcctctttgaagaagtgatgcgaggaaagtttggcaagaaacacatgatagcaggcgtattattcacattcgtattgcttctctcaggccaaataacatggagagatatggcacatacactaataatgataggctcgaatgcttcagatagaatgggtatgggcgttacctacttagcactcatcgcgacatttaaaattcaaccatttctggcgttaggcttctttttacgcaaacttacatcacgagaaaacctcctattaggagtcgggttggccatggctaccacgttacagttgccggaggatatagaacagatggcaaatggaatagctcttggcttaatgacacttaaacttataacccagttcgaaacctatcaactatggacagctttagtttcattaacttgttcgaacacaatatttacacttacggtagcatggcgcacagcgacacttatcctggcgggtgtatctttacttccactatgtcaaagcagctcaatgagaaaaacggattggttaccaatgacagtagcagcaatgggggtaccaccgttaccactttttattttctcgcttaaagatacacccaaaaggcgatcatggcccctaaatgagggggtgatggctgtaggtctcgtaagtattcttgcttcgtctctcttaagaaacgatgtgccaatggcaggtccattagtagctggaggcttactcatagcgtgttacgttataactggaacaagcgccgatctgacggttgagaaagcagcagatgtaacatgggaagaagaagccgaacaaacgggcgtaagccataacttaatgatcacagtagatgatgacgggacaatgaggatcaaagatgatgaaactgaaaacatattgactgtcctactaaaaacagcactgctaattgtctccggcatcttcccatatagcataccagccacacttctagtctggcacacgtggcaaaaacagacgcagagatcaggagtactgtgggacgttcctagcccgcccgaaacacaaaaggcagagttagaggaaggtgtttaccgaataaaacagcaaggcatatttgggaagacgcaagtaggtgtgggcgtccaaaaggagggagtgtttcataccatgtggcacgtaacacgaggcgcagtattgacgcacaatggcaagcgactggaaccgaattgggcttctgtcaagaaagatttaattagctatggagggggttggagattaagcgcacaatggcaaaaaggagaagaagttcaagtaatagcggtagagccagggaaaaatcccaaaaattttcagacaatgccgggtatttttcagacaacgactggtgaaatcggagcaatagcgttagattttaagccaggaacttctggttctccaatcattaacagagaaggcaaagtagtaggattatacggaaatggtgtggttacaaagaacggtggatacgtgagtgggattgctcaaactaatgcagagcctgatggacctactccagaactagaagaagaaatgttcaaaaagcggaatcttacaataatggatctccaccctggaagcggaaaaacacggaaatacttgccagcaatagtacgagaagcaattaaacgcaggctaaggactttgattttagcaccgacacgagtagtggcagcagagatggaggaagctctcaaaggcttgccaatacgttatcagactaccgcaacaaaatcagaacatacaggcagagaaattgttgatcttatgtgtcatgcgactttcaccatgagactattaagtccgatacgagttcctaattataacctgatcattatggacgaagctcatttcactgatcccgcatctatcgccgcacgaggttatatatcaactagggtggggatgggtgaagcggcagccatttttatgacagctactccgcctggtacagcagaagcatttccacaatcaaacgcgcccattcaagatgaagaaagagatatacctgaacgatcttggaactcaggaaacgaatggataacagatttcgtaggcaaaacagtgtggtttgtcccaagtatcaaagcagggaatgatattgcaaattgtctaaggaaaaatggtaaaaaggtaatacagttgtcacgtaaaacattcgacactgaataccagaaaactaggctaaacgactgggacttcgttgtaactactgacataagtgaaatgggagccaattttaaagctgacagagtaattgatcctcgaagatgtctcaaacctgtaatactgaccgacggaccggagcgagtgattctagccggtcccatgcccgtgacagcagcgtcagcagctcaacgcagagggcgtgtgggtagaaatccccaaaaagaaaatgaccaatacatattcacagggcagccgctgaataacgatgaagatcatgcacactggacagaagcaaaaatgttgttggacaatataaatactccagaagggataatcccagcattgtttgaacctgagagggaaaaatcggccgcaatagatggagagtatcgtctgaaaggagaatctagaaaaacctttgttgaattaatgcgacggggcgacctgccagtctggctcgcccataaggttgcttccgaaggtatcaaatacaccgatagaaagtggtgcttcgatggagagagaaacaatcaaatactggaagagaacatggatgttgagatatggacaaaggaaggtgagaggaagaaattaagacctcgatggctcgatgccagaacttactcagatccattagcacttaaagaatttaaagactttgctgcagggcgcaaatctattgccttagacctagttacagaaatagggagggtaccatctcacttagcatatagaacgaggaatgccctagacaaccttgttatgttacatacgtccgaacacggtgggagagcgtatcgacatgcagttgaagaactacctgaaactatggaaacattgctgcttctaggactaatgatactcttgacgggcggtgcaatgttattccttatgtctgggaagggtataggtaaaacctcaattggtctaatctgtgttatagtatcctcagggatgttatggatggcagatgtaccactacaatggatcgctagtgcaatagtattagaatttttcatgatggttttactaatcccagaacctgaaaaacaaagaactcctcaagataatcaattagcgtatgtagtaataggtatactcacgttggcggcaattgtagctgctaatgaaatgggtctgctagaaacaaccaaaagagatttaggtatgtctaaagaaccgggtgtagtgagtccaacctcttatctagatgtcgatttgcatccagcgtcagcgtggacattgtatgccgtagccacgactgttattacgccaatgcttcggcacactattgaaaattcgacagctaatgtttctctggcggctatagcaaaccaagcagtggtgttgatgggacttgataaaggttggccaatatcaaaaatggaccttggagtaccgcttttggccctcggatgctattcccaagtcaatccactcacactaactgctgcggttctgttactggtcacacattatgcaattataggccctggtctacaggctaaagctactagagaagcacaaaaacgtacagcggccggtatcatgaaaaatccgacagtggatggtattatgacaattgatctggacccggtaatttatgattcaaaatttgaaaaacaattggggcaagtcatgctattggtattgtgcgccgttcagctattgttaatgagaacctcatgggcattgtgtgaggccttaacactagcaaccggaccaatcacaacactatgggaaggttctcctggaaaattctggaacaccacaatagcagtatctatggccaacatattccgaggatcatatctcgcaggcgcaggtttagcgttttcgataatgaagagtgtgggtaccggaagaagaggcacaggaccacaaggagaaacgttgggagagaagtggaagaagaaactaaaccagcttagtaggaaagagttcgacctatacaagaaaagtggtatcacagaggttgatcggaccgaagcaaaggaaggacttaaaagaggtgaaactactcatcacgccgtcagccgaggttccgcgaaattacaatggtttgtagaacgtaacatggttattcccgaaggtcgtgtaatcgatctgggatgcgggagaggagggtggagctactactgcgcaggactaaagaaagtaacagaagtcagaggatatacaaaaggcggccccggacacgaagaaccagtaccgatgtccacctacggatggaatttagttaagctcatgtcgggtagagacgtcttctatctaccgcccgagaagtgcgacacactgttatgtgacatcggagagagctccccgagcccgacagttgaagaatctcgaacaataagggttctcaaaatggtagaaccctggctcaaaaataatcagttttgcataaaagtattaaatccttatatgccaactgttatagaacacctagagcgcttacaaaggaaatacggaggaatgctcgttagaaatcctttaagccgaaactccacacacgaaatgtactggatatccaacgggacagggaacatcgtttcatccgttaatatggtaagcagacttttactaaaccgctttacaatgacacaccgtaggccaaccattgagaaagacgttgacctaggtgctgggacgcgacacgtcaacgcagaaccagaaactcctaatatggacgtaattggcgaaaggatcaaaagaataaaagaagaacatagttcaacttggcattatgatgacgagaacccatataaaacatgggcataccacgggtcatatgaagtaaaagcaactggatcagcatccagtatgattaatggcgtcgtaaaacttctaacgaaaccgtgggatgtagtccctatggtgactcagatggcaatgaccgatactacaccttttggccaacagagggtattcaaagaaaaagtggacacaagaacacccaggccaatgccaggcactaggaaggtaatggaaataaccgcagaatggctatggaggacacttgggcgtaataagaaacctcgactgtgtacgagagaagaatttaccaagaaagtacgaaccaatgctgcaatgggtgccgtctttacagaagaaaaccagtgggatagcgcaagagctgccgtagaagatgaggaattttggaaacttgtcgatcgggaacgagaactacataaacttggaaagtgtgggagctgcgtatataacatgatgggaaaacgcgagaagaaacttggtgaatttggaaaagctaaagggtctcgggccatatggtatatgtggctaggagctaggtatttggaatttgaagcattaggtttcctaaacgaagatcactggttcagcagagagaacagttattcaggagtagagggagaaggccttcataagctcggatatatactaagagatataagtaaaatcccaggcggagcgatgtatgcagatgatacagccggatgggacactagaataacagaagatgacctccacaacgaagagaagataacccaacaaatggatccagaacatcgacagcttgctaatgccatattcaaactaacatatcaaaacaaagtcgtaaaggtgcaaagacctacgcctaagggtacagtgatggacataatcagtagaaaagaccaacgcggctcagggcaagtaggcacatatggacttaacacgttcactaatatggaggcccaactcgtaagacaaatggaaggcgagggtgtgctatccaaagcagatctagaaaacccacatttgcttgagaaaaagattactcaatggctcgaaacggaaggtgtagaaagacttaaaaggatggccattagtggtgacgattgcgtcgtaaaaccaatagatgataggtttgcaaatgccctattagcactaaatgacatgggaaaagtccgcaaagatattccgcaatggcaaccatcaaaaggatggcacgattggcagcaggtcccattttgctcacatcacttccacgaattgataatgaaggacgggagaaagttagtcgtaccatgtagaccacaagacgagttgattggcagagcaagaatctcccaaggcgcagggtggtcactaaaagaaacagcgtgcctaggaaaggcttacgctcagatgtggtcactaatgtattttcacaggcgcgatttaagacttgcgagtaacgcaatatgcagtgcagttcctgtacactggattcccacttcgagaacaacttggagcatacatgctcatcaccaatggatgacgactgaagatatgctaacagtttggaatagagtctggatagaagataacccatggatggaagacaaaactccagtaaccacgtgggaagatgtaccctatcttggaaaacgagaagaccaatggtgcggaagtttaatagggctaacaagccgagcgacgtgggcccaaaacattttaacggctatccaacaagtgcggtcgcttataggagatgaagaatttctagactatatgccgagtatgaaacgttttagaaaagaagaagaatcagaaggagctatatggtaa

SEQ ID NO: 23507 - RNA, 9873 nt, synthetic construct
  misc_feature 1..9873: note = derived and/or modified CDS sequence (opt6) from DENV-3__GU363549__SS-prME
  source 1..9873: mol_type = other RNA
acttctttatgtcttatgatgatattacctgcagctttggcattccatctgacaagtcgagacggggaaccaaggatgatagtaggtaaaaacgaaagaggaaaaagcctattgttcaaaactgcatctggaataaatatgtgcacactaatagcaatggatttaggggaaatgtgcgatgacactgtaacgtataaatgtccccatattactgaagtcgaaccggaagacatcgattgctggtgcaacttgacctcaacttgggtaacctatggaacttgcaaccaagctggggaacacaggagggacaaacgatccgtagcactagcaccacacgtaggaatgggactagatacaagaacacaaacatggatgtcagcagaaggagcctggagacaagtagaaaaagtagaaacgtgggcattaagacatccaggatttacaatacttgcactctttctagctcattatataggaacttctttgactcaaaaagtcgtcatatttattctcctaatgctcgtaacaccatcaatgacaatgagatgcgtaggtgtggggaatcgagattttgtagaaggactaagcggcgctacatgggtggacgttgtgctggaacacgggggttgcgtgaccacaatggctaaaaataaaccaaccttggacattgaactccagaaaacggaagcaacacaacttgcaacattacgtaaattgtgtattgaaggtaaaattactaacatcactacagactcgaggtgtcccacccaaggtgaggcagtattaccagaagaacaagatcagaactatgtatgtaaacacacgtatgtcgatagaggatggggtaacggctgtgggttattcggcaaaggatcgttagtgacatgtgctaaatttcaatgtttagagccaatagaaggtaaagtagtacaatacgaaaatttgaaatatacagtaattataacagtgcacactggggatcaacatcaagtgggaaatgagacacagggcgttaccgcagaaatcacaccacaagccagtaccactgaagcaatccttccggaatatgggacattggggcttgagtgttctcccagaacgggactggattttaatgagatgatactgctcaccatgaaaaataaagcatggatggtccacagacaatggtttttcgatttacctttaccatggacttcaggcgctacgacggaaacaccgacatggaatcgaaaagagctcttggttaccttcaaaaacgcccacgctaagaaacaagaagtggttgtgctaggtagccaagaaggcgcaatgcatacagccttgacgggagctactgaaatacaaaacagcggaggaacgtccatttttgcgggtcatctaaaatgtcgactaaaaatggataaactagaattaaaaggaatgtcttatgcaatgtgcaccaacacattcgtactcaagaaagaagtatcagagactcaacacggaactatcctaattaaagtagaatataaaggtgaggatgctccgtgcaaaattccattctcaacagaagatgaacaaggcaaagcccataatggaaggcttatcaccgccaatccagtcgtaactaagaaagaagaacctgttaatattgaagctgaaccaccttttggagagtccaacattgttatcggaataggtgataacgcccttaaaataaattggtataagaaaggatcaagtataggaaaaatgtttgaagctacggctagaggagctcggagaatggcaattttaggcgatacagcatgggattttgggtcagtagggggagtcttaaattcattaggaaaaatggtccatcaaatattcgggagtgcgtataccgcactattttcaggcgtatcgtgggtaatgaaaattggtattggggtactcttaacgtggataggtcttaatagtaaaaatacaagcatgtcgttctcgtgtatagcgattggaattattactctatatttgggagctgttgtgcaggctgatatgggatgtgtaataaactggaaaggtaaagagctgaaatgtggcagtggtatatttgtaaccaatgaggtacatacatggactgagcaatataaatttcaggcagactcacctaaaagactagcaacagctattgccggtgcttgggagaatggtgtttgtggtatacgaagtacgacaagaatggaaaacttgttatggaaacaaatcgcaaacgaattaaattatattctttgggaaaataacataaaattgacagtcgtagtcggtgatacaatcggtgtattggaacaaggaaaacggacactgactccacaacctatggaactgaaatatagttggaaaacatggggaaaagccaagatagtcacagcagaaacgcaaaactcttctttcattatcgacggacctaatactcctgaatgtccatctgcaagcagagcatggaatgtatgggaagtagaagactatggttttggagtatttactacaaatatttggttaaaattaagagaagtctacactcagatgtgcgatcacagattaatgtccgcggccgtaaaagatgagcgagccgttcacgcagatatgggatactggatcgaaagtcagaaaaatggaagttggaaattagaaaaggcttctcttatagaggtaaaaacatgcacatggccaaaatctcatactttatggtctaatggtgtccttgaatcagatatgattatcccgaaaagtttagcaggtccgatttcacaacataactataggcccggatatcatacacagacagcaggtccctggcacttgggaaagttagagcttgattttaactattgtgaagggaccacagtagtgatcaccgagaattgtggaacaagagggccgtcgttacgaaccacgacagtaagcggcaaactaattcacgaatggtgctgtcgttcttgtactttgcctcccctccgttatatgggagaggatggttgttggtatggcatggagataagaccaatctctgaaaaagaggaaaacatggttaaaagcctagtaagtgcaggttcgggaaaagtagataattttacaatgggtgtcctctgcctagcgatactattcgaggaagtaatgagaggaaaattcggaaagaaacacatgatagctggtgtttttcttacctttatgctgcttctatcaggtcaaataacctggcgagatatggcgcatacgctcatcatgattggatcaaatgcttccgatcgtatgggtatgggggttacttatctcgctctaatcgctacatttaaaattcaacccttccttgcacttggtttctttctaagaaaattaacatctcgcgaaaatctcttgctcggagtaggcctagcaatggcaacgaccatacaattgcctgaggacattgaacaaatggcaaacggaatagctctcggattaatggctctcaaacttattacacaatttgaaacatatcaattatggacggcattaatatcgctaacttgttcaaatactatattcacattgacagtagcatggcgtacagctaccctaatcttagcaggagttagtcttttaccagtctgccaatcgagctcaatgcgaaaaactgattggttgcctatgactgtcgcggcgatgggggtcccaccacttccgttattcatattttcacttaaagatacgctaaagcgaagatcgtggccactaaacgaaggcgtcatggctgtgggtttagtaagtatcctagcttcatctctactcagaaatgatgtacctatggcaggaccactcgttgccggtgggttattaattgcttgttatgtgataacaggcacttcagccgatctcaccgttgagaaagcagctgacgtaacgtgggaagaggaggccgaacaaactggagtatcacataatcttatgatcacagtggatgatgatggaaccatgaggataaaggacgacgaaaccgaaaatattttaacagttttgctaaagactgctctactaatagtttccggtatttttccctatagtattccggcaacacttctagtgtggcatacttggcaaaaacaaacccagaggtctggagtactatgggacgttccgtctccaccagagactcaaaaagcggaactagaagagggagtatacagaattaagcaacaaggtatccttggcaaaacacaagtaggcgttggagttcaaaaagaaggagtctttcacaccatgtggcatgtaacaagaggagctgtcctaacacataacggtaaacgcttagaacccaattgggcgtcagtcaagaaagatctaatttcttatggaggagggtggcgtttgtctgcccaatggcaaaaaggagaagaggtccaggtgatcgcagtggaaccaggcaaaaaccccaaaaactttcaaacaatgccaggaacctttcaaacaacgacaggagaaattggcgcaattgccttagattttaaacccggcacttcaggcagccccatcattaacagagaaggtaaagtggttgggttatacgggaatggagtagtaaccaagaatggaggatatgttagtggaattgctcagacaaatgccgaaccagatggtccgacaccagagctagaagaagagatgtttaagaaacgtaacttaaccataatggatctacatcctggttcaggtaaaacgagaaaatatctccccgcaatagtcagagaagccataaaaagacgcctaagaaccttaattttggccccaacaagagttgttgccgcggaaatggaagaagccctcaaaggcttaccaataagatatcagacaacagctacaaaaagtgagcacactggacgcgaaatagtagaccttatgagacacgctacatttaccatgaggttactatctccagtaagagtgcccaattataatttaattattatggatgaggctcactttacagacccggcgtctatagccgcccgaggatatatctcaaccagagtcggaatgggagaggcagcagctatctttatgactgctacgccaccaggaacagcagatgcttttccacagtcaaacgcccccatacaagacgaagaacgagatatcccagaacgatcttggaacagtggaaacgaatggattacagattttgccggtaaaacggtgtggttcgtcccaagcataaaagctggaaatgatattgccaattgtctccggaaaaacggcaagaaagtcattcaactaagccgaaaaacatttgacacggagtaccaaaagacaaaactcaatgattgggacttcgtagtgactactgacatatcagaaatgggggcaaattttaaagcagacagagtcattgatccacgtaggtgcctaaagccagtaatacttacagatgggccagaacgggtaatccttgcaggtcctatgccagttacagtagcatccgccgcacaaagaagggggagagtgggaagaaatccacagaaggaaaacgaccaatatatttttacaggccaaccgcttaataacgacgaggaccacgcgcattggactgaagcgaaaatgttgcttgataatattaacacccccgaagggatcattccagcattgtttgagccagaaagagaaaagtccgcggcaatagatggggaatatcgcttgaaaggagaatcacgcaaaacttttgtcgaattaatgcgaagaggagacttgcctgtttggttagcacataaagttgcgtccgaagggatcaaatatactgacagaaaatggtgctttgatggccaaaggaataaccaaatattagaagaaaacatggatgtcgaaatctggacaaaggaaggagagaagaagaaactacgacctagatggctcgacgcccgaacatactctgatccattagcgctcaaggaatttaaagatttcgcagccgggagaaaatccatagcattagatctggttacagaaataggacgcgtaccatcccatcttgcccatcgtacaagaaacgcattggacaatttagtgatgcttcacacatccgagcacggaggccgggcgtatagacatgcagtagaggagttaccagaaaccatggaaacactacttctactaggtctgatgatactactaacagggggcgcaatgttgttcttaataagcggcaaaggcattggcaaaacatcaataggattaatttgtgttatcgcttcttctggaatgttatggatggcagaaattcccctacagtggatagcaagtgccatcgtccttgagttcttcatgatggtcctccttatacccgaaccagaaaaacaaagaacaccacaagataatcaattagcatatgtcgtgattggaatactcactttagcagcaattattgctgcgaacgagatgggtttgttagagaccaccaaacgagatctgggaatgagtaaggaaccaggtgtagtatccccaacatcgtatttggacgttgacctacatcctgcaagtgcatggacattatacgccgtcgcgactactgtgataacaccaatgctaaggcacacaatcgaaaatagtacagcaaacgttagcctggctgctatcgcaaatcaagcagtggtactcatgggactggacaaaggctggccaatcagcaaaatggatcttggtgtaccactcctcgcactaggatgttattctcaggttaaccccctgactcttacagcagcagttttactcttagtgactcattatgcaataattgggcccggactacaagcaaaagctacaagagaagcacaaaaacgcaccgcagcgggtatcatgaaaaacccgaccgtagacggtataattactattgaccttgacccagttatatacgatagtaaattcgagaaacaactagggcaggtaatgcttctagtgctgtgcgcagtgcaattactattaatgagaacgtcttgggcgctctgtgaagcgttaacattagcaactggacctataacaacgttatgggagggttctcctggaaaattctggaacacaacaattgctgtaagtatggcaaatatatttcgaggttcttaccttgcaggagctggtcttgctttttccattatgaaaagcgtaggaacgggcaagcgaggtactggatcacaaggagaaactttaggagaaaaatggaagaagaaattaaaccagttgagcagaaaggaatttgacttatataagaaatctggaataaccgaagttgaccgaacagaagctaaagagggcttaaaaagaggcgaaactactcatcacgctgtaagtcgaggatcggcaaaactccagtggtttgtcgaaagaaatatggtaattcccgaaggtcgagtgattgatcttggatgcggaagaggaggatggagttattattgtgccggactaaagaaagtaacagaagtaagaggctatacaaaaggtggacccggacatgaagaacctgtaccgatgtctacacatggttggaatatagtcaagttaatgagtggtaaagatgtattctatctgccgccagaaaaatgcgacaccctactttgcgatattggcgaatcaagtccttcacccacagtagaggaatcacgaaccattcgcgtcttaaaaatggttgagccatggctaaagaataatcagttttgcatcaaggtactaaacccttacatgccagctgtgatcgagcacttagaaaggcttcagaggaaacacggtggtatgctagttcgaaaccctttatcaagaaattcgactcatgaaatgtattggattagcaacggaactggtaatatagtaagtagtgttaatatggtaagtcgtctgcttttaaacaggttcactatgacacacaggaggccaactatcgagaaagatgtagatctcggcgcgggcactcgacacgttaatgcagagccagaaacgccgaatatggacgtaatcggagagcgaattagaaggataaaggaagaacataattccacttggcactacgatgacgaaaacccttacaagacctgggcttaccatggaagctacgaagttaaggccacaggctcagcaagctccatgatcaatggtgtagtgaaactgttaacaaaaccatgggatgtggtcccaatggtaacacaaatggcaatgacagatacgacaccatttggtcagcaaagagtatttaaggagaaagtcgatacacgcacacctcgcccaatgcccgggacccgcaaagtgatggaaataacggccgagtggttatggaggacgttaggtaggaataagaggccgaggctttgtacacgagaagaatttactaagaaagtgcggacgaatgcagcaatgggagcagtttttacagaggaaaaccaatgggattcggctaaggcggccgtagaagacgaagagttctggaaattggtagatcgggagagagagctgcataaattaggcaaatgcggctcttgtgtatataatatgatgggcaagcgagagaagaaactaggggaatttggaaaagctaaagggagccgcgccatatggtacatgtggctaggggcacgatatttggaatttgaagccctaggattcctaaacgaggatcattggttttccagggaaaatagctatagtggcgtagagggtgaaggcctgcataagttaggatatattttaagagatatatctaaaatccctggtggcgctatgtacgcagacgacacagcaggttgggatacacgtattacagaagatgatcttcataatgaagagaagataacgcaacaaatgaaccccgaacatcgattgctcgctaatgccattttcaagttaacatatcaaaacaaagtagtcaaagtgcagagacccacacccaccggtactgtaatggatataatatctagaaaagatcaaaggggaagtggtcaagttggtacctacggtttaaatacttttacaaacatggaagcgcagttggtgagacaaatggaaggtgaaggtgttctcagtaaggctgacttagaaaacccgcatcttcccgagaagaaaatcactcagtggttggagacaaaaggagtagaacgtttaaaacggatggcaatctcgggggacgactgcgttgttaaacccatcgacgaccgatttgccaatgcactactggctctcaacgatatgggaaaagtaagaaaagacataccacaatggcaaccgagtaaaggatggcatgactggcaacaagtaccgttttgttctcaccatttccacgagcttattatgaaagacggaagaaaattagttgttccatgcaggccacaagacgagttaattggacgagcgcgtatttctcaaggagctgggtggtcattgagagaaacagcctgtctcggcaaagcatacgctcaaatgtggagcctaatgtacttccatagacgcgacttacgattagcaagtaacgcaatctgttcagctgtaccggttcactgggttccaacgtcgcgcacaacctggtcaatacatgctcatcatcaatggatgaccacagaagatatgttaacggtatggaatcgtgtctggatcgaagataacccgtggatggaagataaaactccggttactacgtgggagaatgtcccatatcttggtaaaagagaagatcagtggtgtgggtcactgattggattaacaagcagagcgacctgggcgcaaaacattagtaccgcaatccaacaggtaagatctttaattggcaatgaagaatttttagattacatgccatcgatgaaaagatttaggaaggaagaagaatccgaaggagcaatctggtaa

SEQ ID NO: 23508 - RNA, 9873 nt, synthetic construct
  misc_feature 1..9873: note = derived and/or modified CDS sequence (opt6) from DENV-3__KJ622197__SS-prME
  source 1..9873: mol_type = other RNA
acaagcctatgccttatgatgatgctgcctgccacccttgcatttcatctaactagcagagatggagaacctagaatgatagttggaaaaaacgagagaggaaaatcgttattgtttaaaacagcaagtggcataaatatgtgtacactaattgcaatggacctaggggaaatgtgtgacgacacagtaacttataaatgtcctctaatagctgaagtggaaccagaagacatcgactgctggtgcaatctaacctccacatgggtgacttatggcacatgcaatcaagctggagaacatcggagggacaaacgctcagtagcgctagctcctcacgtgggaatgggattagatacgagaactcaaacctggatgtctgccgaaggagcatggaggcaagtagaaaaggtcgaaacctgggctctacgacacccggggttcacgatacttgcgttgttcctagcgcactatataggcacaagcctgacacaaaaagtcgtcatatttatcttactaatgctagtaacaccctcaatggcaatgcgatgtgttggagtgggaaacagggattttgtagaagggctgtcgggcgcaacctgggtagacgttgtattagaacatggtggttgcgtaacaactatggctaaaaacaaaccgaccttagatatagaattacaaaaaacagaggcaacacaacttgccacattaagaaaactctgtatagaaggaaaaatcaccaatattactacagattcacgatgcccaacacaaggcgaagctattctaccagaagaacaagatcaaaattacgtctgcaagcatacttatgtcgatagagggtggggaaatgggtgtgggctgtttggtaaaggctcactcgttacatgtgccaagttccagtgtctcgaaagcatcgaagggaaagtggtgcaacacgaaaatttaaaatacactgtgactattacggtacataccggtgaccagcatcaagttggtaacgacactcaaggagttacagccgaaataactcctcaagcctcaacagtagaggcaattctacctgagtacggtaccctaggccttgaatgttcccccagaactggcctcgatttcaacgaaatgattttacttactatgaaaaacaaagcatggatggttcacaggcaatggtttttcgacttaccgcttccgtggacttcaggagctattactgaaacaccaacatggaacaggaaagagcttcttgtgactttcaaaaatgctcacgcgaaaaaacaagaggtagttgtattaggatcacaagaaggagcaatgcatacagcgttaacaggagccacagaaatacaaaactcaggaggcacttccatcttcgctggacatctgaagtgtcgattaaagatggataagcttgaactgaaaggaatgtcatacgctatgtgtttgaatacattcgtcctaaaaaaggaagtatcagaaacacaacatggaacgatccttataaaagtagagtataaaggggaggacgctccgtgcaaaattccattttcgacagaggacggacaaggcaaagcgcataatgggagacttataacagcaaatccagtcgtaaccaaaaaggaagaaccggtaaacatcgaagctgagcccccatttggcgaatcaaacatagttatcggtataggggacaaggctcttaagataaattggtacaaaaaaggcagctccatcgggaagatgtttgaagcaactgccagaggtgctcgacgaatggcaatcttaggtgacacggcttgggacttcggcagcgttgggggcgtattgaatagtctaggtaaaatggtccatcaaatctttgggtctgcatatacggctttatttggaggagtatcctggataatgaaaatcggaataggtgtgttgctaacatggatagggttaaactcgaagaacacttcaatgtctttctcctgcatagtcataggaattatcacgttatatcttggtacagtcgttcaagcagatatgggttgtgtgataaactggaaagggaaagaactcaaatgtgggtcgggtatatttgtcactaacgaagtacacacttggaccgaacagtataaatttcaagctgattcaccgaaacgacttgcaacagcaatagccggagcatgggaaaacggagtttgtggcatccgtagtaccacacgcatggaaaacctattatggaaacaaattgctaatgaattgaattacattctctgggaaaataacattaaattaactgtagtcgtcggagacattatcggcgtattagaacaaggaaaaagaactcttacaccacaacccatggaactgaaatattcatggaaaacttggggaaaagccaaaattgttacagcagagatacaaaattctagtttcataatagatggcccaaacacgccagagtgtccgtctgcaagccgcgcatggaatgtgtgggaggtagaagactacggatttggagtatttacaacgaacatatggctcaaattaagagaagtatacacacagacttgtgaccatagactaatgagtgcagcaataaaagatgaaagagccgtccatgccgatatgggctattggatcgagtcacaaaaaaatggcagctggaagttggaaaaagcatcattcattgaagtgaagacatgcacctggccgaagagtcatacattatggtcaaacggtgtattagaaagtgacatgattatacccaaaagtttagcaggtccaataagccaacacaaccaccgaccgggataccatacacaaacagctggaccttggcatttaggcaaactagaattagactttaactactgtgagggaacaacagtagtaatcacggaaaattgcggaacacggggtccgagtcttcgaactaccacagtaagtggaaagttaatacacgagtggtgttgtcgtagttgcactcttcctccattgcggtatatgggtgaagacgggtgttggtatgggatggaaataagaccgataaatgaaaaagaagaaaacatggttaaatcactagtctcagcaggatcaggcaaagttgacaattttacaatgggcgtactatgtctggcaatactttttgaagaagtcatgagaggtaaattcggaaaaaaacatatgatcgcgggagtgctcttaacctttatgttactcttatcaggccagattacatggcgcgatatggcccatactttgataatgatcggtagtaatgcatcggatcgaatgggaatgggagtgacgtacctcgcgttaattgcgacatttaaaatacaaccatttttagcgctggggtttttcctaaggaaattaacttcccgggaaaacttattgttgggagttggattagcaatggcaacgactttgcaattaccagaagatatcgaacaaatggcaaacggaatagcattaggattaatggctctcaaattaataacccaatttgaaacatatcagttatggaccgcattggtaagtctaacatgttccaacacaatttttacgctcactgtcgcatggaggacagcgactttaatattagcaggtgtttctctgcttcccgtatgtcaaagtagcagcatgagaaagaccgattggctacccgtagcagtagccgcgatgggtgtccctccgttgcctttattcatattttctctaaaagatacactaaaaaggagatcatggcctttaaacgagggtgtgatggccgtaggcctcgtctccattctagctagtagcttattacgaaacgacgtcccaatggccggtccattagtggctggtggtctcttaattgcatgctatgttataacaggaacatctgcagatttaacagtagaaaaagcggctgatgtgacttgggaggaggaagcagaacaaaccggtgtaagccacaatctcatgataactgttgatgatgacggcacgatgcgaattaaagacgacgaaactgagaacatcctaactgtcttattgaagacagcattactcatagtttccggaattttcccttacagcatacctgcgacactcttagtttggcatacgtggcaaaagcagactcagcgctctggtgtcttatgggatgtcccaagtccccctgaaacgcaaaaagcggaattagaagagggagtatatcgaattaagcaacaggggatatttgggaaaactcaggttggcgttggagtgcaaaaagaaggagtcttccacaccatgtggcatgtaacccggggagctgtcttgactcataacggaaagagactcgagccaaactgggcttcagtaaaaaaggacttaatcagttacggagggggatggagattgagtgcgcagtggcaaaaaggagaagaagtacaggtaatagctgttgaaccaggacggaatcccaaaaattttcaaactatgccaggaatattccagacaacaacgggagaaatcggggcaatagcattagattttaaaccagggacgtccggtagccctattataaatcgagaaggaaaagtagttggcttatatggcaatggagtcgtaacgaagaacggaggttacgtgagtggcatcgctcaagcaaatgctgaacctgacggaccgacgccagaactagaagaggaaatgttcaaaaaaagaaatttgactataatggatcttcacccaggaagcggtaagacacgcaagtatctacccgccatcgtaagggaagctataaaaagaaggttaagaaccttgatcctagcaccaactagagtagtcgctgcagaaatggaggaagcactaaaaggattacccatccgatatcagaccacagcaaccaaaagtgagcacacgggtagggaaattgtagatctaatgtgccatgctacctttacaatgagactactctcacccgtaagagttccgaattataatcttataataatggacgaggcgcattttacagacccagctagtatcgcagctcgcgggtacatttccaccagagtcggtatgggagaagctgcggcaatatttatgacggccacgcctccaggcacggcagaagcattcccacaatctaacgcaccaattcaagatgaagaaagggacattcctgaacgaagctggaattccggcaatgagtggataaccgattttgtaggtaaaaccgtctggtttgtccctagtattaaagcaggaaatgatatagcgaattgtttgcgaaaaaatggtaaaaaggtgatacaattatcacgaaagacatttgatacggaataccaaaagactaaactcaacgattgggacttcgtagtaacgacagatataagtgaaatgggagcaaacttcaaagcagaccgagtaatagatccgcgtagatgtttaaaaccagtgatcctgactgacggtcctgaaagagttatattagctggcccaatgccggtaaccgctgcatccgctgcgcaaagaagaggtagggtgggtagaaaccctcagaaagaaaacgaccagtacatattcacaggacaacctttaaataacgatgaagaccatgcgcactggaccgaagctaaaatgctcctcgataacatcaatacgccagaaggaattataccagcccttttcgagcctgaaagggagaaatctgcagccatcgacggtgaataccgacttaaaggagaatcaagaaaaactttcgtggaactaatgagacgaggagatcttccggtttggttagctcacaaagtagcgtcagaaggtattaaatatacagataggaagtggtgctttgacggagagaggaataatcaaattctggaggaaaacatggatgtcgaaatctggaccaaagaaggtgaaaggaaaaaattgagacccaggtggctcgatgcaaggacttattcaaaccctctagctcttaaggaatttaaagatttcgctgcaggaagaaaatcgatagcacttgatctcgtgacagagataggccgagtcccaagtcacttggcccatagaacgagaaacgccttggataatctggttatgttgcatacgtctgagcatggtggaagggcataccgacatgcagttgaagaactacctgaaacaatggaaacattgcttttactagggttaatgatactgctaaccggtggagcaatgctatttttaatctcaggtaagggaataggaaaaacaagcataggactaatatgtgtgattgtctcgtcgggaatgttatggatggcagatgttccgttacaatggatcgctagtgcgatagttctagagttttttatgatggtattactcattcctgaacctgaaaaacagaggactcctcaagataaccaattggcttatgtagtgattggtatattaacattggcagccattgttgcagcgaatgaaatggggttgttagaaactaccaaaagggatctgggcatgtcaaaggaacctggtgtggtgagtccaaccagttacttggacgtagatttacatccagccagtgcatggacactttatgcggttgctactacagttattacacctatgctgcgtcatactattgaaaattctaccgctaatgtaagtcttgccgcaatcgcaaatcaagctgttgtacttatgggtctagataaaggctggccaataagcaaaatggacttaggtgtacctttattagcattaggctgttatagccaagtgaatccgctaactctaaccgctgcggtactactactcgtaactcattatgcaattataggacccggcttacaagcaaaagcgacgagagaagcccaaaagaggactgcagccggcattatgaaaaacccgaccgtagatggcataatgacaatcgatttagatcctgttatttacgatagtaaattcgagaaacaactaggccaagtaatgttattagtcctttgtgccgttcagcttctgctcatgcggacgagttgggcattatgtgaagcactaaccttagcaacaggtcccataacaacgttatgggaaggaagcccagggaaattttggaatacaacaatagcagtctccatggccaacatttttcgaggttcgtatctagcaggagcagggctagcatttagtataatgaaatcggttggtacaggaaaacgggggactggctcccagggggaaactcttggagaaaaatggaaaaaaaaactaaaccagctatccaggcgggaatttgaactttacaaaaaatcaggtatcacagaagtagaccgaacagaagcaaaagaaggccttaaacgtggggaaacaacccaccatgctgtctcaagagggagtgcgaagctccaatggttcgtcgaaagaaatatggtaataccagaaggtagagtaatcgatcttggctgcggtagaggagggtggtcatattactgtgcgggattaaaaaaggtaactgaagtaagaggatatacaaagggaggaccaggtcatgaagaaccagtgccaatgtccacttatgggtggaatactgtgaaacttatgtccggaaaagacgtcttttacttgccccccgaaaagtgcgataccctactatgtgatataggcgagtcatctccaagccccactgtggaagaatcgcgaaccattcgcgttctaaaaatggtagaaccatggcttaagaataaccaattctgtattaaagtgctcaacccgtatatgccaacagttattgaacaccttgaaaggctacaaagaaagcatggtggaatgttagtgcgaaatcctctgtcccgcaacagtacccatgaaatgtattggatatccaatgggactggaaatatagtttccagcgtcaacatggtatcccgacttttgttaaaccgcttcacgatgacacacagaagaccaactatcgaaaaagacgtagatctaggagcaggtactcgacatgtcaacgctgagccggagacccccaatatggatgtaatcggtgaacgaatcaaaagaataaaagaggaacattcgagcacttggcattatgacgatgaaaatccttacaaaacttgggcttatcacggcagttacgaggtaaaagcaacaggttcagcatcatcgatgataaatggagtagtcaaattactgactaaaccatgggatgttgtcccaatggtaactcaaatggctatgacagacacaacccctttcgggcaacaaagagttttcaaagaaaaggttgatacacgaacgccacgaccaatgcccgggactcggaaagttatggaaataacggcggagtggctatggagaacactaggaagaaacaagcgacctagattgtgtacaagggaagaatttaccaaaaaagtacgtacaaatgctgctatgggagcagtatttactgaggaaaatcaatgggagagtgctagagcagcagtggaagacgaggaattctggaaactagtaggccgagaacgcgaattacacaaattgggaaaatgtggtagctgtgtgtacaatatgatgggaaaacgtgagaaaaagctcggagaattcggaaaagccaaaggctcaagggctatttggtatatgtggttaggtgccagatatctggagtttgaggcgctaggctttttaaacgaagatcattggttctcaagagaaaatagttattcaggagtcgaaggagaaggtctgcataaactcggctatatcctaagagacatatcaaagatcccagggggggccatgtacgcggatgatacagcagggtgggacacacgaattactgaagacgacctacataatgaagaaaagataactcaacaaatggatccggaacacagacaattggcgaatgccatatttaagctaacctatcaaaacaaagttgtgaaagtgcagcgaccaacgcccaaaggtactgttatggatataatatcgcgtaaggatcagcgaggatcgggtcaggttggaacatacggactcaataccttcactaacatggaagcgcaacttataagacaaatggaaggtgaaggtgtattatccaaagcagatctagaaaaccctcatttattagaaaagaaaattacccagtggttagaaacgaaaggggtggaaagactaaagagaatggcaattagcggtgacgattgcgtagttaagccaatagatgatcgttttgcaaatgcactactagctctaaacgatatgggaaaggtaagaaaggacataccccagtggcaaccttcgaaaggttggcatgattggcagcaagtaccgttctgcagccatcactttcatgaactcataatgaaagatggacgcaagcttgtagttccttgccggcctcaggatgaactcataggaagagcgcggatatcacagggagcaggatggtctcttaaagaaacggcctgtttgggaaaagcctatgcacaaatgtggagtttaatgtattttcatagaagagatctccgtcttgcaagcaatgcaatctgtagtgctgtgcccgtccattgggtaccaacctcccgtacgacatggtcaatacatgctcatcatcaatggatgacgactgaagacatgctaactgtttggaatcgtgtatggatagaggacaatccgtggatggaggataagacgcctgtgaccacctgggaagatgtaccttacctaggtaagcgagaggaccaatggtgcgggtctctaatcggcctaacaagtagagcgacatgggcccaaaacatcttaacggcgatacagcaagtccgatcactcataggggatgaagaattcctagattatatgccatcaatgaaacgatttcgcaaagaagaagaaagtgaaggggctatttggtaa

SEQ ID NO: 23509 - RNA, 9873 nt, synthetic construct
  misc_feature 1..9873: note = derived and/or modified CDS sequence (opt6) from DENV-3__KJ622198__SS-prME
  source 1..9873: mol_type = other RNA
actagcctatgtcttatgatgatgctaccagcaacgcttgctttccatctaacgtcaagagatggtgaaccaagaatgatagtaggcaaaaatgaacgagggaaatctctattattcaaaactgctagtggaataaatatgtgcactctgatcgcaatggacttgggggaaatgtgtgacgacacagttacctataaatgtccgctaatagctgaagtagaaccggaagatatcgactgttggtgcaatctaacgtctacttgggtaacatatgggacttgcaatcaagcaggagaacatcgccgggacaaacgaagtgtcgcattagcacctcacgtagggatgggtttagatacgcgaacccagacctggatgtccgcagaaggggcatggcgtcaagtcgaaaaagttgaaacatgggcattgagacatcccggattcacgatattagcattatttctggctcattacataggaacatctctcacccaaaaagtggtaatatttattttactaatgcttgttacaccatccatggctatgcgatgtgtcggcgttggaaacagagacttcgtagaaggactatccggcgcaacctgggttgatgtggtactagaacacggaggctgtgtaacaacaatggcgaaaaataaaccgacattggacatagaattacagaaaacggaagcaacccaactagccactttgagaaaattgtgcatagaaggcaaaattacaaatatcacaaccgactctagatgtccaactcaaggagaagccatactccctgaagaacaggatcagaactacgtatgtaaacatacctatgtcgatagggggtggggaaacggctgcggactgtttggtaaaggttctctagtaacatgtgcaaaattccaatgtcttgaatctatagaagggaaagtggtacaacatgaaaatctaaaatacacggtgacaataacagtgcacaccggcgatcagcaccaagtcggtaatgacacccaaggtgtaacggctgaaataactccgcaagcaagtacagttgaagcaattctcccggaatatggaacactcggtctggaatgcagtccacgcacaggcttagacttcaatgaaatgatactcctaacaatgaaaaataaggcttggatggttcacagacaatggttcttcgatcttccactgccttggacgtcgggagccataacagagacacccacttggaatagaaaagaacttctagttacttttaaaaatgctcatgccaagaaacaagaagtagtagttttaggctcccaagagggcgcgatgcatactgctctaaccggtgcaacagaaatacagaatagtggcggaaccagcatatttgctgggcatcttaaatgccgcttaaaaatggataaactagagttgaaaggaatgagctatgctatgtgtttaaatactttcgttctcaagaaagaagtaagtgaaacgcaacatggcactatacttattaaagtagaatacaaaggagaggatgcgccttgtaaaattccattctccacagaagacggacaaggaaaagcccacaatggacgactgataacagcgaatccggtagtaactaagaaagaggaacctgttaacatcgaggctgaaccgccatttggagaaagtaatatagtcatcggtattggagacaaagctctgaaaattaattggtataagaaaggctcgagtatcggtaaaatgtttgaagcaacggcaagaggagctcgccgtatggcaatcttaggagataccgcttgggatttcgggagtgttggtggcgttctaaacagcttggggaaaatggttcaccaaatatttggatctgcatatacagctttgtttggcggtgtatcctggattatgaaaattggcattggcgttcttttaacatggataggactaaatagcaagaacacaagtatgagtttcagttgtatagtgataggtataataaccctttacctaggaacagtcgtacaggcagatatgggttgtgttataaactggaaaggaaaagagctgaagtgtgggagcggcatattcgttacgaatgaagttcatacatggactgaacaatataaattccaagcagatagccctaagagactcgcgacagctatagcaggcgcatgggaaaacggggtatgtgggatacgaagcactacaagaatggaaaacttattatggaaacaaatcgcaaatgagttaaactatatattgtgggaaaataatataaagctaacggtcgtagttggtgatattattggtgtacttgaacaaggaaaacgtacactgacgcctcagccgatggagttaaaatacagttggaaaacatggggaaaagcgaaaattgtaacggcagaaatacagaactcctcttttatcatagatggtcctaacacacccgagtgcccctcagcaagtagagcttggaatgtctgggaggtcgaggactacggattcggagtcttcacgactaatatttggttgaagctgagagaagtatatacccagacatgtgaccataggttaatgtctgctgcaataaaagacgagcgggcggtacacgccgacatgggatattggatagaaagtcagaaaaacggatcatggaaattagaaaaagcatcttttatcgaagtaaaaacatgcacttggcctaagagtcacacattatggagcaacggggttctagaaagcgacatgattataccaaagtctctggcaggtccgatatcacaacataaccacagacccggttaccacacacaaactgcaggaccttggcacctaggaaaacttgaattagattttaattactgcgaggggactacagtcgttataacggaaaattgtggtacaagaggtccatcattgcggacaacaactgtgtccggcaaattaattcatgagtggtgttgtagatcatgcacattgcctccacttagatacatgggagaagatggctgctggtacgggatggaaatccgacctatcaatgagaaagaagaaaatatggtaaaatcgttagtgagcgcgggatcaggtaaagtagacaatttcacaatgggtgtcctatgtttagctattttgtttgaggaagtaatgagggggaaatttggcaagaaacacatgatcgcgggtgttcttttaactttcatgctgctattatcaggacaaataacatggagagacatggctcatacattaataatgataggttcaaatgcctctgatcgtatgggtatgggcgtgacatatttagctttgatcgctacttttaaaatacaaccattcttagctttaggattctttcttagaaaactaacatcacgtgagaacctattattaggagttggtttggctatggcgacgaccttacagttacctgaagatatagaacaaatggcaaatggtatagctctagggttaatggccctaaaattaataacacagtttgagacctatcaactgtggacggccttagtctctctgacctgctctaacacaattttcacgttaaccgttgcctggcggacagcgacactaattttagcaggcgtatcattacttcctgtgtgccagtcatcctcgatgcgtaaaacggattggttaccagttgcagtagcggcaatgggtgtgccacccttaccactttttatattttccctaaaagatacattaaagagaagatcatggcctctaaatgaaggcgtgatggctgttggccttgtctccatcttagcaagtagcctccttcggaatgatgttccaatggctggaccactcgtggctggagggctcctcattgcctgttacgtcataaccggaacctccgcagatcttaccgtagagaaagcagctgacgtaacctgggaagaggaagcagaacaaactggagtgtcacataatttaatgatcacggtagatgatgatggaactatgcgaatcaaagatgatgagacagaaaatattttaacagttcttttaaagactgcgttacttatagtatcaggtattttcccgtactcaatcccagctactctcctagtatggcatacatggcagaaacagactcaaaggtctggcgtcttgtgggatgtgccatcaccgcccgagacacagaaagccgaactcgaggaaggagtataccgaatcaaacaacaaggaatatttgggaagacgcaagtgggtgttggtgtccagaaagaaggtgttttccacactatgtggcatgttactcgtggagcagtgttaacgcacaatggcaaaagactcgagcccaattgggcgagcgtaaagaaagacttaataagctacggaggaggatggagactaagtgcccagtggcagaaaggggaagaggtacaagtaatagcagtagaaccaggtagaaatcccaaaaatttccagacaatgcccggaatatttcaaactactacaggtgaaataggagcaatagccttagactttaaacctggaacgtcagggtctccaatcattaatagggaaggcaaagtagtcgggctttacggcaatggagttgtaacaaagaacggagggtatgtaagtggtatagctcaagctaacgcagagccggacggaccaacgcctgagcttgaggaagaaatgtttaagaaacggaacttaacaataatggatctgcatccaggaagcggaaaaacaagaaaatacttacctgccattgtgagagaagcgataaagagaagactgagaactttaatacttgcacctacaagagtcgtagcagctgaaatggaagaagctctcaaaggtttacctattaggtatcagacaactgcaactaagtcggaacacactggcagagagatagttgaccttatgtgtcatgctactttcacgatgagattactatccccagttcgtgttccaaactataatttaataataatggatgaggcgcattttacagatccagcaagtatagccgcacgaggatatataagtaccagggttggaatgggagaagcagccgccatatttatgactgcaactccccctggaacagctgaagcattccctcaaagcaatgcacctattcaggatgaggaacgagatattccggagcgttcatggaacagcggaaacgagtggataaccgatttcgtaggtaaaacagtatggtttgtaccgtcgataaaagcggggaatgatatcgcgaattgtttgcggaaaaatggcaagaaagttattcagctatcaaggaaaacatttgacacagaataccaaaagaccaaactaaatgactgggacttcgtagtaaccacggatatatccgaaatgggggccaattttaaagctgatcgtgtcatagacccgagaagatgccttaaacctgtcatactaacagatggaccggaacgcgttatcctggcaggtccgatgccagtaactgcggcctcggcggcgcaacgaagaggtagagtaggccgcaatcctcaaaaagaaaatgaccaatatatattcacgggacaaccattaaataacgacgaggatcatgcacattggacagaggccaagatgctattagacaatatcaatacaccagagggcataattccagctttattcgagcctgaaagggaaaagagcgcagcgattgatggggagtatcgactaaaaggggagtctcgtaaaaccttcgtcgaattaatgcggcgtggtgatctcccggtatggttagctcataaggttgcaagtgaagggataaaatatacggaccgaaaatggtgcttcgatggcgaaagaaacaatcaaattctagaggaaaatatggacgttgaaatttggaccaaagaaggtgaaaggaagaaattaagacctagatggttagacgctaggacctactctaatccacttgcactgaaggagttcaaggactttgctgcaggtagaaaatctatagctctggacctagtcactgagatcggcagggtaccatcacaccttgcacatagaacaaggaacgcgttagataatcttgttatgctacacacgtctgaacatggaggacgtgcctatcgccatgcagttgaagaattgcctgagactatggagactttattattattgggcttaatgattttattaacaggcggagctatgttatttttgatatcgggcaaaggaattgggaaaacctcaatagggctaatctgtgtgattgtttcaagtgggatgttgtggatggcagatgtaccactacaatggatagcatcggcgatagtgctcgagttctttatgatggttctcttaataccagaaccagaaaaacaaagaactccacaagataatcagttggcatacgtagtaataggcatattgactttagcagcaatagttgccgccaatgaaatgggattattagagactacaaagcgagatcttggaatgagtaaagagccaggagtagtgtcacctacaagttacctagatgttgacctgcatccagcctcggcgtggacgttatacgcagtggcgacaacggttattaccccgatgctcaggcacactattgaaaacagcacagcaaatgtaagccttgcagcgatagctaaccaagcagtagttcttatggggttagacaagggatggccaatatcaaaaatggacttaggagttcctctactcgccctaggatgctatagtcaagtcaatccgctaacattaacagcggctgtcctacttcttgtaacccactatgcaattataggacctggactgcaagctaaagcaacacgtgaagcccaaaagcgtacagccgccggtatcatgaaaaaccccactgtggatggaattatgactatagacctagatccggtgatttacgactctaaatttgaaaaacaactggggcaagttatgctattggtcctttgcgcagttcagctcctgctgatgagaacaagttgggcactgtgtgaagcattaacactcgcaaccggtccgataacaactctttgggaaggttcacccggaaaattctggaatacaactattgccgtatcaatggcaaatattttccgtggaagctaccttgccggtgcgggcctagcctttagcattatgaaatcagtaggtacaggtaaacgtggaacaggctctcaaggagaaacattgggagaaaaatggaagaagaaacttaaccaactaagtcgacgagagttcgaattatacaagaaaagtggaataactgaagttgatcgaacggaagcaaaagaaggactaaaaagaggagaaacaacacaccatgcagtatccagagggagtgccaaactgcaatggtttgtagaaagaaatatggtcattccagaaggacgcgtcattgatttaggatgtggtagaggagggtggtcgtactactgcgcaggactaaagaaagtcactgaagtaaggggttatacaaaaggaggccccggacatgaagaaccagtaccgatgagcacttatggatggaataccgttaaactaatgagcggaaaagatgtattctacttaccacctgaaaaatgtgataccttactatgcgacataggagagagtctcccatcacccacagttgaggaaagccgtactatccgagttttaaagatggttgagccatggctcaaaaacaaccaattttgtatcaaagtactaaatccctatatgccaacagtaatagagcatctagaaagattgcagcgtaaacatggtggcatgttagttcgaaaccctttatcacgaaactcaactcatgaaatgtattggataagcaatggaaccggtaatatagttagtagcgttaatatggtctctaggctgctgttaaacagatttactatgacacatcggcgaccaactattgagaaagatgtcgacttgggcgccgggacaaggcacgttaacgccgaacctgagactccaaatatggatgtcataggcgaaagaataaaacgtatcaaagaagaacattcctccacatggcattacgatgacgaaaacccatacaaaacatgggcgtatcacggttcttatgaagttaaagccacgggatctgcttccagtatgataaacggagtcgtcaaactacttaccaaaccttgggatgtggtacctatggttactcaaatggcaatgacagatactacaccttttggtcaacaacgtgtctttaaagaaaaagtagacacacgtactccaaggccaatgcccggcacgagaaaagtgatggaaataacagctgagtggttgtggaggacactagggcgtaacaaacgtcccagactttgtacaagggaagagtttacgaagaaagtacgcactaatgcagctatgggcgctgtctttacagaggagaatcaatgggaatcggcacgcgcggccgtcgaagacgaagagttctggaagttggtgggaagagaacgcgagctgcacaaattaggaaaatgcgggtcatgtgtttacaatatgatgggtaaaagagagaaaaagctcggtgaatttgggaaggcaaaaggtagtagagcaatatggtacatgtggctaggtgctcgatatttagagttcgaagcattaggtttcctaaatgaagatcattggtttagccgtgaaaatagttacagcggggttgaaggggaaggtttacacaagttaggttatatactcagggatatttcaaaaattccgggtggggctatgtatgcagacgacacagccggatgggataccagaatcacagaagacgacttacataatgaggagaaaatcacccagcaaatggatccagagcaccgccagttggccaatgcaatattcaaattaacctatcaaaacaaagtagtaaaggtgcaacgccctactccaaaaggaactgtaatggacataattagtcgtaaagaccaacgtggttctggtcaagttggcacctacggattgaatacttttactaacatggaagcacaactcattcgacaaatggaaggagagggcgtattatcaaaagcagatctggaaaatccacacctactagagaagaaaatcactcaatggttagaaactaaaggagttgaacgacttaaaaggatggcaatatcaggggatgattgtgtggtaaaacctatagatgatcgatttgccaatgctctactagctttaaatgatatgggaaaagtccggaaggatataccacaatggcagcctagcaaaggctggcatgattggcaacaagtgcccttctgtagtcatcatttccatgagttaattatgaaagatggaagaaagctagtagtgccatgtcgaccgcaggacgaattaatagggagagcacgtatttcacagggagcgggatggagcctaaaggaaacagcttgtcttggcaaggcctatgcacaaatgtggtctctaatgtattttcacagacgggatctaagattagcgtccaatgcaatttgctcagctgtaccagtacattgggtaccaaccagccgcacaacatggtcaatacatgcacaccatcaatggatgactactgaggacatgctaacagtttggaatagagtatggatcgaggacaatccatggatggaagataaaacccctgtcacaacatgggaagacgttccatatttaggaaaaagggaagatcaatggtgtgggtcacttatcgggctcacaagtcgagccacatgggctcaaaacatacttacagcaattcaacaagtcagaagtcttataggggatgaagagtttttagattacatgccaagtatgaagagattccggaaagaagaggaaagtgagggtgcaatatggtga

SEQ ID NO: 23510 - RNA, 9873 nt, synthetic construct
  misc_feature 1..9873: note = derived and/or modified CDS sequence (opt6) from DENV-3__KJ622191__SS-prME
  source 1..9873: mol_type = other RNA
acttcgctgtgcttaatgatgatgttacccgctacccttgcctttcacttaacatccagggatggtgaacccagaatgatagtcggtaagaatgaaaggggaaaatcactattgtttaaaactgcgtcgggaattaacatgtgcacgctaattgcgatggatttaggtgaaatgtgtgatgacaccgttacttataaatgtcctttaattgccgaagtcgagccagaagatatagattgttggtgtaatttgactagcacgtgggttacctatggtacatgcaatcaagccggtgaacaccgtcgagataaacgatccgtggcactggcgccacatgtaggtatgggtcttgacactcgaacccaaacgtggatgtcggcagagggagcatggaggcaagtcgaaaaagtggaaacttgggctttacgacatccgggtttcaccatactggccttgttccttgcgcactacataggtacatcgctgacacagaaagtggtcatatttattttactgatgttagtaacaccatcaatggcgatgcgatgcgtaggagtgggaaatcgcgatttcgtcgagggcctgtctggagcaacatgggtcgacgtcgtcttagaacatggcgggtgtgttaccacgatggctaaaaacaaaccaacacttgatatagaactccagaaaacagaagctacccaactcgccacactcaggaaattatgtatagaaggcaagataacaaatataactactgacagtagatgccccacacagggcgaggctatcctaccagaagaacaagatcaaaactacgtatgtaagcatacgtacgtagataggggctggggcaacggatgtggactttttggaaaaggttcgctagtcacctgtgcaaaatttcaatgcctagaaagcatagaaggcaaggtggtacaacatgagaatttaaaatacactgtcaccattacagttcatacaggggaccagcaccaagtaggaaacgacacacagggagtaacggcggaaatcacgccccaagcatccacagtggaagctatcttgcccgaatacggtaccctaggattagagtgttcgcctcgcaccggattagattttaatgaagtgatattattgacgatgaaaaataaggcttggatggtccataggcaatggttttttgacttgcccctcccatggaccagcggagcaataacagaaacacctacttggaatagaaaggaactcctggtaacatttaaaaatgctcacgcaaagaagcaagaagtcgtggttttgggaagtcaggaaggggccatgcatactgccttgactggagcgactgagattcaaaacagcggaggtacttcaattttcgccggtcatctaaaatgccgattaaaaatggataaattagaactaaagggtatgagctacgctatgtgcctaaatacttttgtacttaaaaaagaagtttcagaaactcaacacggaaccatcttaataaaagtcgagtataaaggagaagacgccccctgcaaaataccctttagtactgaagatggccaaggaaaagcacacaatggtcgactcattacggcaaaccctgttgtaacaaagaaggaggaacctgttaatatagaagcggaacctcccttcggagaatctaatatagtcatagggatcggagataaggcactaaaaataaactggtacaagaaaggatccagcatcggaaaaatgtttgaagcaaccgcaagaggagcccgtaggatggctattttgggggacactgcctgggatttcggcagtgtaggtggggtacttaacagtctaggaaaaatggttcatcaaatatttgggtccgcatatacagcgctgttcggcggagtttcatggattatgaaaatcggcattggtgtgttgttaacctggatcggacttaactcgaaaaataccagcatgtctttcagctgcatagtaattggtattataacgctttatttaggaacagttgtacaggcagatatggggtgtgtaatcaattggaaggggaaggaattaaaatgtggatcaggaattttcgtaacgaacgaagtacatacatggacagaacaatataaatttcaagcagatagtcctaaaaggttagcgacggctattgcaggtgcatgggaaaatggtgtctgcggaatccgaagtacaacgcgtatggaaaatcttttgtggaaacaaatcgctaatgagctgaattacattttatgggaaaacaatataaaactcacagtagtagtcggcgatataataggagtattagaacaaggtaaaagaacgttgacaccacaaccaatggaattaaaatactcatggaagacttgggggaaagctaaaatagtcacagctgaaatccaaaattcatcgttcatcatagatgggcctaacactccggagtgtccaagtgcaagtagagcgtggaacgtctgggaggtagaagattacggatttggggtttttactaccaatatatggttaaaattacgggaagtatatacgcaaacgtgtgaccatcgcctgatgtcagctgcaataaaggacgagagagctgttcacgctgacatgggctattggatagaatcacaaaaaaacggcagttggaaacttgaaaaagcttctttcattgaagtgaaaacatgtacttggccaaaaagccacacattgtggtcaaacggagtccttgagagcgacatgatcatccctaagtcgttagcaggacccatctcacagcataatcaccgacctggttatcatacacagacggctggtccatggcatttgggaaaattagaattagactttaactactgcgaaggcacgactgtggttattacggaaaattgtggaacacgagggcccagtctgagaactactacggtgtcaggtaaattaatccacgagtggtgttgtaggagctgcacactgcctcctttgaggtatatgggggaagacgggtgctggtacggcatggaaataaggcccattaacgaaaaagaagagaatatggttaagtcattagtgagtgctggttcaggtaaggtcgataatttcactatgggtgttttatgtttggcgattttgttcgaagaagtcatgaggggaaaattcggaaaaaagcacatgatcgcaggtgtactactaacatttatgttattgctatccggacaaataacatggagagatatggcacatacgcttattatgatcggaagtaatgcgagcgacaggatgggtatgggtgttacctatctcgcattgatcgcaactttcaaaatacaaccttttttagccttaggcttcttcctccgaaagttgacatcgcgggaaaatctcttactcggagtcggattagcaatggcaacaactttacagttacctgaagacatagaacaaatggccaacgggatagctttggggttgatggccttgaaattgataacacaatttgaaacttatcaactatggacggcgttagtttcgctgacgtgcagtaacacaatcttcactttaacagttgcatggcgaacggcgacccttatcctagcaggggtatcgctccttcctgtttgtcagtcgagctctatgcgaaaaacagattggctgccagtagccgtagctgctatgggcgtcccaccactaccattattcatttttagccttaaagacacattaaaacgcagatcatggccacttaacgaaggagtaatggcggtaggattagtgtcaattcttgcatctagccttttgcgaaatgatgtcccaatggctgggccgttggtcgcaggcggtctattaattgcttgttacgttattactggaacaagtgcggatctcacagtagagaaggcagcagatgttacctgggaggaagaggcagaacaaacaggagttagtcataatctcatgataaccgtggatgatgatggaacaatgcgcattaaagacgatgaaacagagaacatactaacagttcttctgaagactgcactgctaattgttagcggaatatttccttattccattcctgcaaccttattagtttggcatacctggcaaaaacagacacaaagaagtggcgtactatgggacgttccttctcctcccgaaacacagaaagctgagttggaagaaggagtataccgtatcaaacaacaaggaattttcggaaaaacacaagttggagtaggcgtacaaaaagaaggtgtcttccatacaatgtggcacgtaacaaggggggcagttttaactcataatggaaaaaggttagaaccaaattgggctagtgtcaaaaaggatttaatatcgtatggcggtggatggcggctgtctgctcagtggcaaaaaggtgaagaagtacaggtaatagcagtcgaacccggaagaaatccaaaaaatttccaaaccatgccaggaatattccaaacgacaatgggcgaaatcggagccatagcgttagattttaaaccaggaacaagtgggtctccaataataaacagagaaggaaaagtagtaggcttatatggtaatggggtagttactaagaatggtggctatgtatctggaatagctcaagctaatgcagaacctgacggccctactcccgaacttgaagaggaaatgttcaaaaaacgaaatctgaccattatggatctgcacccaggaagtggaaaaactagaaagtatctaccagcgatagttcgagaagcgataaaaagaagacttagaaccttgatactcgcaccaacccgagtagtagcagctgagatggaagaagccctcaaaggactgccaattagataccagactacagcaacaaagagtgagcacacaggaagagaaatagtagatctcatgtgtcatgcgactttcactatgagattactatcacctgttcgtgttcccaattataatttaatcataatggatgaggctcattttacggaccctgccagcattgcagcaagaggttacatctctacaagggtaggcatgggtgaagcggcagcaatttttatgacagcaactccacctggaactgccgaagcatttccacaatcaaatgccccaatccaagatgaagaacgtgacatccccgaaagaagttggaattcagggaatgaatggatcacagactttgtgggtaaaaccgtatggttcgtgccatctataaaggccgggaatgatatcgcgaattgtctgcgaaaaaatggaaaaaaagttattcagttatcgcgaaaaacctttgatacagaatatcaaaagacaaaattaaatgattgggattttgttgttactactgacatttcagagatgggagctaactttaaagctgatcgagtcatagacccccgacgttgtttaaaacccgtaattttgaccgatgggccagagagggtaatactagccgggcctatgccagtaacggcagcatccgctgcacaacgaaggggacgggtcggaagaaatcctcaaaaggagaacgaccaatacatctttaccggtcaaccacttaataatgatgaagatcatgcccactggactgaagcaaaaatgcttttagacaatattaacacccctgaaggaataatccccgctttatttgagcccgagagggaaaaatcagcagcgatcgatggtgagtatagattaaagggagaatcaagaaaaacattcgtagaattaatgagacgaggggatctaccagtgtggctcgcacacaaagtagccagtgaaggaataaaatataccgacaggaaatggtgtttcgatggagaaaggaacaaccaaatactggaagaaaatatggatgttgaaatatggacgaaagaaggagaacgcaaaaagttacggccaaggtggttagatgctaggacatattccgacccacttgcactaaaagaattcaaagacttcgctgctgggcgcaaaagcatcgctttagaccttgtaactgaaataggtagagttcctagccatctggcacacagaacgagaaacgcactagataacctggtaatgctacatactagcgaacacggaggacgtgcctaccgccatgcagtagaagagttaccagaaacaatggaaaccctcttactacttggactaatgatcttactaacagggggcgcaatgttattcctaatcagcggaaagggtataggaaaaacatcaataggactcatttgcgtaatagtgtcatcgggtatgctatggatggcagacgttccattacaatggatcgctagcgcgatagtcctggaattctttatgatggtactactcattccagaaccggaaaaacaaagaacacctcaggataaccaattagcgtatgtcgtaattggaattctaacactggctgcaatagttgcagcaaatgaaatgggtcttctagaaacaaccaaacgagatctaggtatgtcaaaagaacccggagttgtgagcccaacttcttacttagatgttgacttacatcctgcttccgcttggacattatatgcagtagccacgacagtaattacgccaatgctaagacatacaatagaaaactctacagcaaatgtcagcttagccgcaattgcgaaccaagcagtggtattgatgggtctggataaagggtggccgatttcaaaaatggatctaggtgtaccacttttagccttaggatgttacagtcaggtaaatcctttgactctaacagcagcagtgcttttattggttacacattatgctataataggaccaggcttacaagcgaaagcaaccagagaagcacaaaaacggaccgctgcgggtataatgaagaacccaactgtagacggaattatgacaattgacctggaccctgtcatttatgatagtaaatttgaaaagcaactaggacaggttatgctgcttgtgttgtgtgctgtacagttgttattaatgagaacatcttgggccttatgtgaagctctcacactggcgactgggccaataactacgctctgggaaggctcaccaggaaagttctggaacacaactatagcagtctcaatggccaacatctttcgtggcagttatctggcaggtgctggtttagcttttagtattatgaagagtgttgggacaggtaaaagaggcactggatcgcagggtgaaacattaggtgaaaaatggaaaaaaaaacttaaccaactgagccgaagggagtttgaattatataaaaaaagtggaatcacggaggtagacagaacagaagccaaggaaggacttaaacgtggagaaacaactcatcacgccgtatctcgaggatcagcaaaactgcaatggttcgttgaaaggaatatggtgatccctgaaggaagagtaatagatttaggttgcggcaggggaggatggagttattactgtgcaggtttaaaaaaagtgacggaagttcgtggttacacgaaaggtggccccgggcatgaggaaccggttcctatgagtacctatggctggaatacagtaaaattaatgtcaggaaaggatgtattttacctgccacctgaaaaatgcgacacacttctatgtgacataggggagagtagcccatctcccacagttgaagaaagccgcacgatccgagtattaaaaatggtggaaccttggctaaaaaataatcaattttgtattaaagtgttgaatccatatatgccaacagtaatagaacatctagaaagattacaaaggaaacacgggggaatgttagtacgaaaccccctatctcgaaactcgacgcacgaaatgtactggattagtaatgggacaggaaatatagtgtcaagtgtgaatatggtttcacgtctcttgttgaaccgatttacaatgacacatcgtcgaccaaccatagaaaaggatgttgatttgggagcgggaacgagacacgtaaatgctgagcctgaaacgcctaatatggatgtaattggcgaaagaataaaaagaataaaggaagaacatagtagcacctggcattacgatgatgagaacccatataaaacctgggcctatcacggctcgtatgaagtgaaagcaactggatctgcaagttcaatgataaacggggtcgtcaagctactaacgaaaccatgggatgtcgtaccgatggttacccagatggctatgaccgatacaacaccatttggccagcaaagagtcttcaaagaaaaagtagacacaagaacgccaaggccgatgcctggcactcgaaaagtaatggaaattacagctgaatggctttggagaactttgggccgaaacaaaagacctcggctttgtactcgtgaggaattcaccaagaaggtgagaacaaatgcagctatgggagctgtttttacggaggaaaaccaatgggagagtgctagagcagccgtcgaggatgaggagttttggaaattagtaggcagggaacgggaactacataaattaggtaagtgtggcagttgtgtgtacaatatgatgggtaaaagagaaaaaaaattaggggaatttggtaaagctaaaggatcacgagctatttggtacatgtggctaggagcgagatatcttgaattcgaggcattaggttttttaaatgaagatcattggttttcaagagaaaattcgtatagtggagtagaaggagaaggcttgcataaactcggttatatcttacgtgatattagcaaaatacctggaggggctatgtatgccgatgacacagcaggttgggatacacgtataaccgaagacgacctacataatgaagagaaaatcactcaacaaatggatcctgaacacagacaactagccaacgcgatatttaaattgacatatcaaaacaaagtagttaaagtccaaagaccaacacctaaaggcacggtaatggatataatatctaggaaagaccaaaggggatcaggccaggttgggacatatggactcaatacctttacaaacatggaggcacaattaatacgacagatggaaggcgaaggagttttatccaaagcggacctagaaaatcctcatcttctagagaaaaagatcactcaatggttagaaacgaaaggtgtagaaaggttaaagcgaatggcgatcagcggtgatgattgtgtggtaaaaccaatagatgatagattcgcaaatgcattgttagctcttaacgacatgggtaaagtaaggaaggatattcctcaatggcagccgtctaaaggttggcacgattggcagcaggtgccgttctgttcacatcacttccatgagttaataatgaaggatggcagaaaacttgtggtaccttgccgaccccaagatgaattgatcggtcgtgcgagaatcagccaaggtgctgggtggtccttgaaagaaacggcttgtcttggtaaagcgtacgctcagatgtggtcattgatgtactttcatagacgagacttaagacttgcatcgaatgctatttgtagcgccgtgccggtccattgggttcctacatctagaacaacatggagtattcacgcccatcaccagtggatgaccactgaagacatgttaactgtatggaatcgtgtttggatagaggataacccatggatggaagataagacgcccgttacaacgtgggaagatgttccttatttagggaaaagagaagatcaatggtgtggctcacttataggattgacctcacgggcaacatgggcgcagaatattctaactgcaattcaacaagtaagaagcctaataggcgacgaggagtttctagattacatgccttctatgaaaagattccgaaaagaggaagaaagcgaaggggcaatatggtag

SEQ ID NO: 23511 - RNA, 9873 nt, synthetic construct
  misc_feature 1..9873: note = derived and/or modified CDS sequence (opt6) from DENV-3__KJ622192__SS-prME
  source 1..9873: mol_type = other RNA
acttcattatgcttaatgatgatgttacctgctacactcgcatttcacctgacatcgagagacggggaacctcgaatgattgtaggtaaaaatgaaagaggaaaaagtttattattcaaaacagcgtcaggtataaatatgtgtaccctaatagctatggacctaggggaaatgtgcgacgatacagttacatacaaatgtccgttaattgccgaagtggagcctgaagacattgactgctggtgtaatttaacatccacctgggtaacatatggaacatgtaaccaggcgggtgaacatagaagagacaaacgtagcgtcgcattagcacctcatgtaggaatggggctcgacacccggactcaaacttggatgtcagcagaaggagcctggcgtcaagtagagaaagttgaaacgtgggcgcttaggcaccccggattcaccattttagcactgtttctagctcactatattggaacatcgttaactcaaaaagtagtaatattcattttgttgatgctagtaaccccaagtatggcaatgagatgcgtcggtgtaggaaacagagactttgtagaaggactatcaggtgcaacatgggtagacgtagtattagaacatgggggatgcgttacaacgatggcgaaaaataaacctacactcgacatagagctgcagaaaactgaagcaacgcaactcgccacactgcgaaaattatgtatagaaggcaaaataactaacattacaaccgattcaagatgcccaacccaaggcgaagccatcttacccgaagaacaagatcaaaattatgtttgcaaacacacttatgtagatcgagggtggggcaatggatgtggcttattcggaaaaggaagtctggtaacatgcgccaagtttcaatgtttggaatcaatagaaggcaaagtagttcaacatgaaaacttgaagtatacagtaacaataacagttcacacaggggaccaacaccaagtaggcaacgacacgcaaggagtaactgcagagataacaccccaagccagtacagttgaagcaattctacctgaatatggaacccttggccttgaatgttcgcctagaacgggccttgactttaatgaaatgattttattaacaatgaagaacaaggcttggatggtacacagacaatggttctttgatttgccactaccctggacaagcggcgctatcacagaaacaccaacatggaatcgtaaggaattgttggttaccttcaagaacgcacatgctaagaaacaagaagtagtagtcttaggtagccaagaaggggccatgcatacagcattgaccggtgcaaccgaaattcaaaatagcgggggaacttccatctttgccggccatttaaaatgtcggctgaaaatggataaacttgaactaaaaggtatgagttacgcgatgtgcttgaacacttttgttttaaagaaagaagtctccgagactcaacacggaacgatattaataaaagtcgaatataaaggagaggacgcaccttgcaaaataccattttcaactgaggatgggcaaggtaaagcacataacggcagattaataactgcaaaccctgtagtgacaaagaaggaagaaccagttaacattgaggctgaacccccattcggagaaagtaatattgtaatcggaattggtgacaaagctctaaaaataaactggtacaagaaaggaagcagcattggcaaaatgttcgaggctacagcacggggtgcgcgcaggatggcaatattaggagatacagcttgggatttcgggtccgttggaggagttttaaattcgctaggtaagatggtacaccaaatattcggctccgcatacactgcattattcggaggtgtatcatggataatgaagataggtataggcgtattattgacctggatagggctaaattcgaagaacacatcgatgtcgtttagttgcatagtcatagggataataacattgtatctgggtaccgtagtacaggctgatatggggtgtgtaatcaactggaaaggtaaggaactaaaatgcggttcgggtatattcgttacaaatgaagtacacacatggacggaacaatacaaatttcaagcagattctcccaaaagattagcaacagcaatagcaggggcatgggaaaatggtgtatgtgggatacgatcaacgacaaggatggagaatctactatggaaacaaatcgcgaatgagttaaattatatcttatgggagaacaatataaaacttacggtagttgttggtgacatcatcggcgtacttgaacagggtaaaagaactttaacaccacaaccaatggaacttaaatactcatggaaaacctggggtaaggcaaaaatagtaacggctgagatacaaaactcatcattcatcatagatggacctaatacccctgaatgtccttcagccagccgtgcatggaatgtatgggaggtagaagattacggatttggtgttttcactacaaatatctggctgaaacttagagaagtatatacacaaacatgtgatcaccggttgatgagcgcggcaataaaagacgagagagcagtgcatgctgatatgggttactggatagaaagtcagaaaaatggtagttggaaactagaaaaggctagttttatagaggttaaaacatgtacgtggcccaaaagtcatacactctggagtaatggtgtcctagaaagtgacatgataattcctaaatccctcgcagggccgatatctcaacacaaccacagaccaggttaccatactcaaacggcagggccatggcatttaggtaaactagagctggactttaattattgtgaaggcacaactgtagtaataacagaaaattgcgggacgcgaggaccgtcattaaggacaacgacagttagtggaaaacttatacacgagtggtgttgtagatcatgtacgttaccaccattaagatatatgggcgaagacggatgttggtatggtatggagatacgaccgattaatgaaaaagaagaaaacatggtgaagtcactggtatcagctggctcaggaaaggtcgataactttactatgggcgttctatgtctagctattttatttgaagaagtcatgcgaggtaaatttggcaagaaacatatgatagcgggtgtactactaacctttatgttgctgctatccggtcagataacttggcgagacatggctcatacgttaataatgatcggtagtaacgcttcagatcgaatgggtatgggagtgacgtatctggctctaatagcaacttttaagatacagcctttccttgcattaggattctttttaaggaaattaacaagtagagaaaacttattgctaggtgtgggtttagctatggccactacccttcaattacccgaagatatagaacaaatggccaatggaattgcgcttgggttaatggcactgaaacttattacccaatttgagacctatcaattgtggaccgcgctggtaagtctaacatgctctaatacaattttcacactgactgttgcgtggcgtaccgcaacattaatcttagcgggcgtatccctgttacccgtctgccagtcatcttcaatgcgtaagacggattggctccctgtagcggtcgcagccatgggagtaccccctctccctttatttatttttagtcttaaagatacacttaaaaggcgatcctggccactaaacgaaggagtaatggccgttggcctagtaagtattttagcgtctagtttactgcgaaatgacgtccccatggccggaccactcgttgcaggcggactactaattgcgtgttatgtaatcaccgggacttcggcagatctgactgtggaaaaagctgccgacgttacatgggaagaggaggcggaacaaacaggtgtatcccataacctgatgattaccgtcgacgatgatggaaccatgcgtataaaagacgacgaaacagaaaacattcttacagtactcctcaagaccgcactactaatagtgagcggcatatttccgtacagtataccagcgacgctattagtatggcacacatggcagaagcagacacaacggtccggtgtactttgggatgtgccatctccgccggagacacagaaagctgaattggaagagggcgtatataggataaaacagcaaggtatattcggcaagacccaagtcggggtcggagtgcaaaaagaaggcgtatttcatactatgtggcatgttacaagaggagcggtcttaacacataatggaaagagactagaacccaactgggccagtgtaaagaaagatctaatcagttacggagggggttggaggttgagtgctcaatggcagaaaggggaagaagtccaagtcatcgctgttgagccgggcagaaatccgaaaaatttccaaacgatgccaggtatttttcaaaccactacgggtgaaataggtgctatcgcacttgattttaagcctggaacatcaggctcaccaataataaatcgtgagggaaaagtagttggcctttatggtaacggcgtagtgaccaaaaacgggggatatgtctccgggatagcgcaagctaatgcggaacccgacggccctacaccagaactagaagaagaaatgtttaagaaacgaaatctaactataatggacttacatccaggatcaggaaagacaaggaaatacttaccggccatcgtacgagaagccataaaaagaagacttagaacgctcatattagcgccgactcgtgtagtggctgcagaaatggaagaggctcttaagggattaccgattaggtaccaaacaacggccacaaagtcggaacatacgggacgcgagatagtcgatctcatgtgtcacgccacatttaccatgcgattactctccccagtgagagtacccaactataatcttataataatggacgaggcacacttcacagaccccgcctcaatagcggccagggggtacatatcaacacgggttgggatgggagaggctgcagcaatattcatgacagccacaccaccgggaaccgctgaagcatttcctcaaagtaacgccccaatacaagacgaagaacgtgatataccagagcgaagctggaactcaggaaatgagtggataacagacttcgtcgggaagacagtatggttcgtaccttctataaaagcaggaaacgacatagcaaattgtctcaggaaaaatggtaagaaagtaattcaattgagtagaaaaacatttgatacagagtatcaaaagacaaaactgaacgactgggactttgtagtgactactgacatatcggagatgggagcaaacttcaaagcggacagagtaatagacccacgaagatgtctaaagcccgttatcttaaccgacggaccagagagagttatactggcaggtccgatgcctgtaactgcagcatcagcagcacaacgcaggggccgagtcggaagaaatccacagaaagaaaatgatcaatacatatttaccggtcagcctctaaataacgatgaggatcacgcgcattggactgaagcaaaaatgctcctagataatattaacacacctgaaggcataatacctgccctattcgaaccggaacgggagaagtccgctgcaatcgatggagaatataggttaaaaggtgaaagccgaaaaacatttgtagaattaatgcggcgtggggatctcccagtttggttagcgcataaagtcgcgagcgaagggataaagtacacagacagaaaatggtgttttgatggagaaagaaataatcaaatacttgaagagaacatggacgttgaaatatggacaaaagagggggaacggaaaaagctaaggcccagatggttggatgcacgcacctattcggatcccttagcacttaaagaatttaaagacttcgcagcaggtagaaaaagcatagctctagatctagtaactgaaatcggccgcgtgccaagtcacttggcgcacagaacgagaaacgctttagataacttagtaatgctacacacgagcgaacatggaggtagagcatataggcacgctgtggaagagttgccagaaacaatggagacactattacttttaggattaatgatactgttaacagggggagcaatgttgtttttaatctcaggcaaggggataggcaaaacgtcgataggacttatatgcgttatcgtgagctcaggtatgctgtggatggcagacgttcctctacagtggattgccagcgcgatagtattggagttcttcatgatggtactcctcattcccgaaccagaaaaacagcgaaccccacaagataatcaactagcctatgtggtcataggcattcttaccctcgcggcgatcgtcgccgcgaatgaaatgggtttacttgagacaactaaaagagatttgggaatgagcaaggaacccggggttgtatcacccacatcttacttggacgtggatcttcacccagcgtcggcttggaccctttatgcagtagcgacgacagttattacacctatgctgaggcatactatcgagaacagcactgccaacgtaagcctcgctgcaatagcaaaccaagcagtcgttctaatggggctcgataaaggttggccaataagcaaaatggatcttggggttccactgttagctctaggatgctattcacaagtcaacccactaaccttaacagcagcggttttgctattagtgactcactatgcaattattgggcctggattgcaagcaaaggcgactcgcgaagcacaaaaacgaacagcagccggtataatgaaaaacccaacagtcgatggtattatgacaatagacttagaccctgttatttatgattccaagttcgaaaaacagttaggacaagttatgctcttagtactttgcgcggtccaactcttattaatgagaacgtcatgggctctttgtgaggcgcttactctggctacaggaccaataacaacgctatgggaaggatcccctggcaaattttggaacacaacgatagcagttagtatggcgaacatttttaggggttcatatttagccggtgcgggattagcattttcgattatgaagagtgtaggcaccggcaagagaggtactggcagccaaggagaaactcttggagaaaagtggaaaaagaagctaaatcagttgagtagacgtgaatttgagctttacaagaaaagtggaataactgaagtcgacagaacggaagctaaggaggggcttaaaagaggtgaaacaacacatcatgctgtgtcgcgtggtagtgccaaattacaatggttcgtagaaagaaatatggtcatacctgaggggcgcgtaatagacttaggttgcggacgcggtggttggtcctattactgtgcaggcctcaagaaagtgactgaagtccgaggctacaccaaagggggaccaggacacgaagaaccagtaccaatgtcgacttacggatggaataccgtaaaactgatgtcgggaaaggatgtattttatttaccgcctgaaaagtgtgacacactactatgtgatataggtgaatcctcaccatccccaactgtagaagaaagtcggactattcgagtattaaaaatggtggaaccgtggctaaagaataatcaattttgtataaaagttttaaatccctacatgcctacagttatagagcacctcgaaagacttcagaggaaacatggaggtatgctagtcagaaatcctttatctagaaattcaactcacgagatgtattggatttccaacgggacaggaaatatagttagcagcgtaaatatggtttcgcgcttattgttaaacagatttacaatgacacaccgaagacccacgatcgagaaagatgtagatttaggtgcgggtacaagacatgttaacgccgaaccagaaactccgaatatggatgtaataggagaaaggataaaaagaataaaggaagaacacagttccacctggcattacgacgacgaaaatccatataaaacttgggcttatcatggtagttatgaagttaaagcaactggaagtgcatcctcaatgatcaacggagtcgtaaaactgctaactaagccatgggatgttgttcctatggttacacaaatggcaatgacggatactacgcctttcggtcaacagagagtatttaaagagaaggtcgatacaagaacccccagaccaatgcctggtactcgaaaagtgatggaaattacagctgagtggctctggaggacgctaggcagaaataaaagaccgagattatgcactagagaagagttcactaagaaagtgaggacaaatgcggccatgggggccgttttcacggaagaaaatcaatgggaaagtgcaagagcggcagtagaagatgaagagttttggaagctggtgggcagagaaagagaactgcacaaactgggcaaatgcggatcttgcgtatacaatatgatgggcaaaagagagaagaaactaggcgaatttggtaaggcgaagggttcacgagcaatatggtatatgtggctaggagcacgctatttagagttcgaggctttaggattcttaaacgaggaccattggttttctagggaaaatagttattcaggagtagaaggagagggcttacataaattaggttacattctgagagacatttctaaaatccccggcggagcaatgtacgcagacgacacggctgggtgggacactagaatcacagaagatgacctacataatgaagagaaaataacacaacagatggaccctgagcatagacaactagcaaatgctatattcaaacttacatatcagaataaagtagtgaaagtacaacgcccaactccaaaaggaaccgttatggacatcatatctagaaaggaccagaggggttccggccaagttggaacatatggattaaatactttcactaacatggaggcgcagttaataagacaaatggaaggcgaaggtgtcctaagcaaagctgacctggaaaacccacacctattagaaaagaagattacacagtggcttgaaaccaaaggagtagagaggttgaagagaatggctatatcaggagacgattgtgtggtaaaacctattgatgataggtttgcaaatgcgttactggcgctaaatgatatggggaaagtaagaaaagacatcccacagtggcaaccaagtaaaggatggcacgattggcagcaagtaccattctgtagccaccatttccacgaattgattatgaaagatggacgtaaacttgttgtgccatgcagaccacaagatgaacttataggcagagcaaggataagtcaaggggcagggtggagtctaaaagaaacagcgtgtctaggcaaggcttacgcacaaatgtggtctctaatgtattttcatagaagggacttaagactagcatcgaacgccatatgttctgcagtccctgtacactgggttcccaccagtagaacgacatggagcatacacgcacaccatcaatggatgacaacagaagacatgctaacagtatggaatcgtgtatggattgaagacaatccgtggatggaagacaagacgccggtcactacctgggaggatgtaccgtatttaggaaaacgcgaagaccaatggtgtggttcacttatcgggttaacgagtagggctacttgggctcagaacattctaacagcaattcagcaagtgcgatcattaataggtgacgaggaatttctggactatatgccctcgatgaagcgatttagaaaagaggaggagtcagagggagcaatatggtga

SEQ ID NO: 23512 - RNA, 9873 nt, synthetic construct
  misc_feature 1..9873: note = derived and/or modified CDS sequence (opt6) from DENV-3__KJ622193__SS-prME
  source 1..9873: mol_type = other RNA
acaagtttatgtttaatgatgatgttacctgccacacttgcttttcacctaacttcacgtgatggagaaccaagaatgatagtcggtaaaaatgagaggggtaaatcgttactgtttaaaacagcaagtggaataaatatgtgtactttaatagcaatggaccttggagaaatgtgtgatgacacagtaacctataaatgtccgcttatagccgaagtagaacctgaagacatagactgttggtgtaatcttacgagcacttgggtgacatatggaacatgtaaccaagcaggagaacacaggagggataaaagaagtgtcgctctagccccacacgtaggcatgggtctagatacaaggacgcagacatggatgtccgcggagggggcatggcgacaggttgaaaaagtagaaacatgggcattacgccatccagggttcaccatactagccctttttctcgctcattacatagggacttctttgacccaaaaagtagtgatttttatactgttaatgctggttactccctccatggcaatgagatgcgtcggtgtaggtaatagggatttcgtagaaggcttatccggcgccacatgggtagatgttgtactagaacacggtggatgtgtgacaacaatggcaaagaataaacctacgttagatattgaattacagaaaactgaggctacacaattagcgactttacgtaaattatgcatagagggaaagataaccaatataacgaccgattcaagatgcccgacacaaggcgaagcaattttgccggaagaacaagatcagaactacgtatgtaaacatacatacgtagaccgagggtgggggaatggatgcggactatttggcaagggttctttagtcacatgcgcaaagtttcagtgcctggagtctattgaaggtaaagtagtccagcatgaaaatcttaaatatacggtaacaataactgtgcatacgggtgatcaacaccaggtgggaaatgatacacagggagtaacggcagaaataactccccaagcatctactgtcgaagcaattttgccagaatacggcactcttggccttgaatgtagtccaagaacaggtttagactttaacgaaatgatattactcacaatgaagaataaggcttggatggttcacaggcaatggtttttcgacctcccactaccatggacatctggtgcgatcacagaaactccgacttggaacaggaaagaactgttagtcacctttaagaacgcgcacgccaagaaacaaggggtcgtagttctaggatcacaggagggagccatgcatacagctcttacgggtgcgacggaaatccaaaatagtggaggaacttcaatctttgccggtcatttaaagtgcagactgaaaatggacaagctcgagctcaaaggtatgtcttacgcgatgtgtttaaatacattcgtactcaaaaaggaggtatcagaaacgcaacatggaacgatattaataaaggtcgaatacaaaggtgaagacgcaccgtgcaaaatacctttctcaacagaagatggacaaggtaaagctcataatggaagactaatcacagcgaatcccgttgtaactaaaaaggaggagcctgtcaacatagaagcagaacccccgtttggagaatcaaacatagttatcggtataggagacaaagcactaaaaattaactggtataagaagggatccagtatcgggaaaatgtttgaggcaacagccaggggagccagaagaatggcgatattaggtgacacagcgtgggattttggttcagtcggaggagtcctgaactcattgggcaaaatggtgcaccaaatatttgggtcggcatacacggcactatttggaggtgttagctggatcatgaaaatcggaattggtgtcctcttaacctggataggactaaacagtaaaaatacatctatgtctttttcatgtattgtgataggaataataacattatacttaggtactgtcgtacaagctgatatgggttgcgtaataaactggaaaggtaaagagttaaagtgtggctctggcatattcgttacaaacgaagtccacacttggacggaacaatacaaatttcaagctgactcaccaaaacgtcttgctacggcaattgcaggagcgtgggaaaacggagtttgtggtatacgatcgacgacaagaatggaaaatttactctggaagcagatagcgaatgaattgaattacatactttgggaaaataacatcaaactcactgtagtagtaggggatataatcggagttttggaacaaggaaagagaacactcactccacagcccatggaattaaaatactcatggaaaacatggggaaaagcgaaaatagtaacagccgaaattcaaaactcatcatttatcattgatggtcccaacactccggagtgtccctctgcctcacgcgcgtggaatgtctgggaagtggaggattatgggtttggggtctttactaccaatatatggctcaaacttagagaggtatacacccaaacgtgtgaccatcgtctaatgtctgcagcaattaaagatgaacgagctgtccacgcagacatgggatactggatagaatcacagaaaaacggatcatggaaattggagaaggcatcatttatagaagtgaaaacatgtacttggccgaaaagccacacgctatggtctaatggcgtcttggaaagcgacatgataatacccaagtctctggcaggtcccatctctcaacataatcaccgtccgggttatcatactcagacagcgggaccatggcatttaggcaaactggagcttgattttaattactgtgaaggtactacagttgtaataaccgaaaattgtggaacaaggggcccaagcctacgaactacaactgttagtgggaagctcatccatgagtggtgttgtcgatcgtgtacactaccacctctgagatatatgggtgaagacgggtgctggtacgggatggaaatacgcccaataaatgaaaaagaagagaacatggtcaagtccttagtatcagcagggtcaggaaaagtagataattttacgatgggtgtactgtgcttagccatcttatttgaagaagttatgcgtggaaaattcggaaagaaacatatgatagcaggagtattattgacgtttatgttgttattaagtgggcaaattacttggcgagatatggcacacactctcataatgataggatcaaatgcatcagatcggatgggcatgggagtgacttacttagccttaattgcaacatttaaaatccaacccttcctcgcactcggattctttttacgaaaattaacatctcgcgagaacttactactgggagttggtttagccatggcaacaacgctacaactcccagaagacattgagcagatggcaaatggaatagctttaggcttaatggcgttaaaattgataacacagtttgagacgtatcaactctggaccgcacttgtaagtttgacttgttcaaatactatatttactctaactgtagcatggagaaccgccacattgatactggctggtgtatctctattacccgtgtgtcaaagcagtagtatgcgaaaaacagattggcttccagtagcagtcgccgctatgggtgtcccacctctccctctttttatcttctcgctaaaagatacattgaaacgaagaagctggccgttaaatgagggggttatggccgttggtttagtatcaatattggcttctagtctcctacgaaacgacgttcccatggcgggacctctcgtagctggaggccttctaatagcctgctacgttataacaggaacttctgctgatctaacagtagagaaagcggccgatgtaacctgggaagaagaagcggaacagacaggtgtatcacataatttgatgataacggtggatgacgatggtactatgcgtataaaggacgacgagacagaaaatatccttacggttttacttaaaacagctctgttaattgtgagtggaatatttccgtattctatacccgctactttgcttgtctggcatacctggcaaaaacaaacacagaggtccggggtcttatgggacgtgccatcacctccagagacacagaaagcggaattggaggaaggggtctaccgtatcaaacaacagggaattttcggtaaaacccaagttggagttggagtacagaaagagggtgtattccatacaatgtggcatgttacaaggggagctgtactgacccataatggtaaaagattagaaccaaactgggcaagtgtcaagaaagacctaatctcgtatggaggtggttggcgactctccgctcagtggcagaaaggtgaagaagtacaagtaattgccgtagagccggggcgaaacccgaaaaactttcaaaccatgcctggtatattccaaacgacgaccggagagatcggagcaatagcattagattttaagcccggtacatccggttcaccaataataaatagggagggtaaagtagtaggtttatatggcaatggagtagttactaagaatggaggctacgtaagcggtatcgcacaggctaacgctgaaccagacgggccgacaccggagctggaagaagagatgttcaagaagagaaatctaactataatggatctccatcctggttcaggaaagaccagaaagtatctcccggcaatagttagagaagccataaaaaggagactacggacgctgattttggctccgactagagtagtagcagcggaaatggaagaggcattaaaaggccttccgatcagataccaaactacagcgaccaaatccgaacatacaggaagggaaattgttgacttgatgtgtcacgcgacgttcacaatgagactgctgagtccagttagagtaccgaactataatttaatcatcatggatgaggcacattttactgacccggcaagtattgcggcaagaggatacataagcactagggtgggaatgggggaagcggcagccattttcatgacagcgaccccacctggaaccgcagaagcctttcctcaatccaatgctccaatacaggacgaagaacgtgacatcccggagaggtcttggaactcaggtaacgaatggatcacagatttcgttggtaaaactgtttggtttgtaccatccattaaagctggcaatgacatagcaaactgcttgaggaaaaatggtaagaaggtcatacaattaagtagaaaaacattcgatacagaatatcagaaaacaaaattgaatgattgggattttgtggttactactgatataagcgagatgggagctaactttaaggctgaccgcgtcatcgacccacgcagatgcttaaagcctgttattttaacagacgggccggagagagtaatcctagcgggaccgatgcctgttacagctgcctctgcggcacagagacgcggtagagttggacgaaacccacaaaaagagaatgaccaatatatttttacaggacaaccattgaacaatgatgaagaccacgcccactggaccgaagccaaaatgcttttggataatataaatactcctgaagggataataccggccctattcgaaccggaacgcgaaaaatcagcggcaatcgacggggagtacagacttaaaggcgaaagtagaaaaacgtttgttgaattgatgcgaagaggagatctaccggtttggttagcccacaaagtcgccagtgaaggaataaaatatacagatagaaaatggtgttttgatggggaacggaataaccaaattctggaagagaatatggatgtggaaatatggacaaaagaaggagaacgtaagaaactgcggccaagatggctggatgcacgaacatactcagatcctttggcactaaaggagttcaaggactttgcggcaggacgcaagtcaatagcactggatctagtaacggaaattggaagggtgccgtctcatttggcccatagaaccagaaacgcattagataaccttgtaatgctccacacatcagaacatggtggtagggcgtatcgacacgcagttgaagaattacctgaaacaatggaaacccttttattgcttggattaatgattttgttaaccggtggagcgatgctgtttttaatttccggcaagggaatcggaaaaacttcaataggactaatctgcgttatagtctcctcaggcatgctgtggatggcagatgtgccactgcagtggattgcttctgcaatagtacttgaatttttcatgatggttttactaatccccgaaccggaaaaacaaagaacacctcaagacaatcagctggcatatgtagttatcggaatactgacccttgctgcgatagtagcagcaaacgaaatgggtttattggaaacaacaaaaagagacctaggtatgtcgaaagaaccaggtgttgtaagtcccacaagttatctcgacgttgatctacaccccgcatcagcttggaccttatacgcagtagcaacgacagtaataacaccgatgttaagacatacaattgaaaattcaaccgcaaatgtaagcctagcggcaattgctaatcaagccgtagtacttatgggattggataaaggatggcctataagcaagatggacctaggagtaccactattagcgcttggatgttattctcaagtaaaccctttaactctaactgcggcagtcttattattagtaacgcactatgcaataatcggaccaggacttcaagcaaaagcaacacgcgaagctcagaaaagaacagcagctgggataatgaaaaacccaactgtagacggtatcatgactatagacttagatccagttatatacgatagtaaatttgagaaacaactaggacaagttatgctcttggtgttatgtgcggtccaattgttattaatgcgtacatcgtgggcattgtgtgaagcactcacacttgctaccggtccaataactaccctatgggaaggaagccccggaaaattttggaatactaccattgcggtgtccatggcaaacatcttcagaggaagctatttagcgggagcgggtttagcatttagtataatgaagagtgtaggtacaggcaaaaggggtacgggctcacagggcgaaacactgggtgagaaatggaagaagaaactaaaccaattaagtagaagagagttcgaattatataagaaatctggcataacagaagtagatcgaacggaagcgaaagaagggcttaaaagaggcgaaacaacacatcatgcagtaagccgaggaagtgccaaattgcaatggttcgttgaacgcaacatggtcataccggaagggagggtcatcgacttgggatgcggacgagggggttggagttattattgtgccggactaaagaaagtaacagaagtccgaggatacaccaaaggcggcccgggacatgaggaaccagttcctatgagcacatatggatggaacacggtgaaattaatgtcgggaaaagacgtcttctatctgcctccagaaaaatgtgacaccttactatgcgatattggggaatcctctcccagccctaccgtagaagagtcgagaacaattcgcgtccttaagatggtagaaccgtggctgaaaaacaatcagttctgcattaaagttctgaatccatacatgccaactgtgatagaacacttggaaagattacagcgaaaacatggagggatgctagtaagaaatcccctctccagaaatagtacccatgaaatgtattggatatccaatggtactggaaatattgtaagctcggtcaatatggtttcgcgattactgctcaacagatttacgatgacacacagaagaccaactatagaaaaggatgtcgacttaggtgcaggaactcgccacgtaaatgctgaaccagaaaccccgaacatggacgtgataggagaaaggataaagagaattaaagaggaacatagtagtacatggcattatgatgatgagaacccatacaaaacgtgggcgtatcacggtagttatgaggtcaaagctactggatccgcttctagtatgataaatggtgtagtgaaattacttacaaaaccatgggacgttgttccaatggttactcaaatggctatgacagatacaaccccttttggacaacaacgggtatttaaagaaaaggtcgatacaaggactccacgacccatgccgggcacgaggaaagtaatggaaattacggctgaatggttgtggcgtactctaggcaggaacaaaaggccccgtctttgcactcgtgaggaatttaccaagaaagtacgaacaaatgcagcgatgggagcagtttttacagaagaaaatcaatgggaaagcgcccgtgcagcagttgaagatgaagaattttggaagctggtaggtagagaaagggaacttcacaaattaggtaaatgtgggtcgtgtgtttataatatgatgggtaagcgtgagaagaaacttggtgaatttggaaaggcgaaaggatcaagggccatatggtatatgtggctcggcgcacgatatctggaatttgaagcactcggatttttaaacgaagatcattggttttctagagaaaattcgtatagcggtgttgaaggtgagggacttcataaactcggatatatattgcgcgacattagtaagattccaggaggcgctatgtatgccgatgatacggccggatgggacacaagaataacggaagatgacctccataatgaagagaaaataacccagcagatggacccagagcataggcaactagctaatgccatttttaagctcacgtatcaaaataaagttgtaaaagtccaaaggccaacaccgaagggaactgtcatggatataatcagtcgaaaagaccagaggggaagcggccaggtcggaacatatgggctaaacactttcacgaatatggaagcacaactaattcgccagatggaaggagaaggagtcctaagcaaagcagatctcgagaatccacatttattagagaagaaaataacacaatggctagaaacaaagggagtcgaaaggttaaaaagaatggcaatctcaggagacgattgtgttgtcaagcctatagatgataggttcgcgaacgccctattagctttgaatgatatgggtaaggtaagaaaagacataccacagtggcagcctagtaaaggatggcacgattggcaacaagtgccattttgttcacaccatttccatgaacttattatgaaagatggcagaaagttagtagttccatgtagaccacaagacgaattaataggcagagctcggatatctcaaggcgcaggttggtcattaaaagagactgcgtgtctagggaaggcatacgcacaaatgtggagtttgatgtatttccaccgacgggatctcagattagcatcaaatgcaatatgcagtgcagttcccgtacattgggtgccgacaagcagaactacatggagtatacacgcacaccaccaatggatgacgactgaggatatgctcacagtttggaatagagtatggatagaagataacccttggatggaagataaaactccagtaacaacatgggaggatgtaccctatttaggcaagagagaagatcaatggtgtggatctttgatagggttaaccagtagagcaacgtgggcgcaaaatatattaacagcgatacaacaagtaagaagtttgatcggagatgaggaatttttagattacatgccgtccatgaaacggtttaggaaagaagaggaaagtgaaggcgctatctggtga

SEQ ID NO: 23513 - RNA, 9873 nt, synthetic construct
  misc_feature 1..9873: note = derived and/or modified CDS sequence (opt6) from DENV-3__KJ622194__SS-prME
  source 1..9873: mol_type = other RNA
acttcattatgcttaatgatgatgttaccagctacacttgcgttccatctaacatcaagggacggagaaccaaggatgatagtggggaaaaatgaacgaggaaaaagtcttcttttcaaaacagcttctggaataaacatgtgcactcttatagcaatggatctgggagaaatgtgtgatgatacggtcacttataaatgcccactgatagcagaagtcgaaccagaagatatagattgttggtgtaatttaacatctacgtgggtcacatacggcacgtgcaaccaagctggagagcacaggagggataaaaggtcagtagcacttgcaccacacgtaggcatgggactggatacacgaactcaaacttggatgtcggccgaaggtgcctggcggcaagttgaaaaagtagaaacctgggcactgagacacccaggattcacgattttagcactctttttagctcattatataggaacatcgctaacccaaaaagttgtaatatttatcttgcttatgctagtaacccccagtatggcaatgcgttgcgtcggagttggaaatagagacttcgtcgagggcctatcaggtgctacgtgggtcgatgttgtgttggaacatggaggctgcgtaactacgatggctaaaaataaacctacacttgatatagaactacagaaaactgaggcaacacaactggcaacccttcgcaaattatgcatcgagggcaaaataacaaatattacaacggattcaaggtgccccactcaaggtgaagctatattacccgaggaacaagaccaaaattacgtctgcaaacatacatacgttgacaggggatggggaaatggatgcggcctatttggaaaaggttcgctagtaacatgtgcaaaatttcagtgtcttgaatccatagaaggaaaagttgtacagcacgagaacctcaaatacactgtaacaatcaccgtacacaccggagaccaacaccaggtgggaaatgacacacaaggtgtaactgctgagataactccgcaagcctccacagtagaagcaattttacctgaatatggaacgctggggttagaatgcagtccacggacaggcttggattttaatgaaatgattttgctgacaatgaaaaacaaggcttggatggtgcatagacaatggtttttcgatctaccacttccatggacttcgggagcaatcaccgagaccccaacatggaataggaaagaactacttgtcactttcaaaaatgcacacgccaagaaacaagaggtagtcgtcttgggcagccaagaaggagctatgcacacagctctaacgggagcaaccgagatacaaaattccgggggcacgtccatatttgcagggcaccttaaatgtcgtttgaaaatggataaattagaactaaaagggatgtcttatgccatgtgtttaaacacatttgttctcaagaaagaggtctccgaaacacaacatgggacgattctgatcaaagtcgaatacaaaggtgaagatgctccatgtaaaattcccttttcaacggaagacgggcaaggcaaagctcataatggaaggctcattacagctaacccagttgtaactaagaaagaagaaccagtcaatatcgaagctgagccaccatttggagaatcgaatattgttataggcataggggataaggctttaaaaataaattggtataagaaaggctcatctattggaaaaatgtttgaggctaccgctagaggggctagacggatggcaatattgggggatactgcatgggattttggaagcgtaggaggagtccttaactcactgggtaaaatggtacatcagatctttggcagcgcttacactgcactgtttggaggagtgtcctggatcatgaaaattggaattggtgttttattaacatggataggattgaacagtaaaaatacaagtatgagcttcagctgtatcgtaataggcataataactctctatttaggtacggtagtccaggcagatatgggatgcgtgataaattggaaagggaaagaacttaaatgcggttccggcattttcgtgactaatgaagtccatacgtggacagagcaatacaaatttcaagctgactctccaaaacgtctagccacggctatagcaggagcatgggagaacggagtttgtgggattcgaagtactacaaggatggagaaccttctatggaaacaaatcgccaatgaactaaactacatactatgggaaaataatataaaactaactgttgttgttggtgatattatcggcgtattagaacagggtaaaaggacactgacaccacaaccgatggagttaaaatactcgtggaaaacatggggtaaagctaaaatagtaacagcggaaatacaaaatagtagctttataatagatgggccaaacacgccagaatgtccatcagcgtcaagagcatggaatgtttgggaagtggaagattacggatttggagtgttcactacaaatatctggctgaaattgagggaagtatatacacaaacatgtgatcacagactcatgagtgctgcaattaaagacgaaagagcggtgcacgctgatatgggttattggatagaatcccagaaaaatggaagttggaagttagaaaaagcgtcattcatcgaagtaaaaacctgcacatggcccaagtcccacactctgtggtctaacggagtactagagtccgatatgataatcccaaagtcccttgcgggtccaatatctcagcataatcacagacctggataccacacacaaactgcgggtccttggcacctcggtaaattagaactggactttaattattgtgagggaacaacagtagttatcacagagaattgcggcacaagaggcccttcccttcgaacaacaactgtaagtggaaaactcatccatgaatggtgctgtcgctcatgcacgctacctccattgagatacatgggcgaagatggatgctggtatgggatggaaatccgacctataaacgaaaaggaagaaaacatggtcaaatcgttggtttcagcaggatcaggcaaagtagacaacttcacaatgggtgtattatgtctagctattttatttgaggaagtaatgcgagggaaattcggtaagaaacacatgattgcgggagtgctcctaacgtttatgctcttattaagtggtcagataacgtggcgggacatggctcataccttgataatgatcggaagtaatgcatcagatagaatggggatgggtgttacatatctggcgttgatagcaacatttaaaatccaaccgtttctcgctttaggattctttttaagaaaattaaccagtagggaaaatctgctactcggcgtaggtttagcgatggctactacactacagctacccgaagatatagaacaaatggcaaacggcatcgccttgggacttatggcccttaagctaatcacccaatttgaaacatatcaactatggacggctctagtttcgttaacatgctcaaatacaatttttactttaacagttgcatggcgaacagcaactcttattcttgctggtgtcagtctcctacctgtatgtcagagtagttcgatgagaaaaacggattggttgccggttgcagttgccgcaatgggtgttccaccgttaccactctttatattctcgctaaaggacaccttaaagcgacgtagctggcctctaaacgagggcgtaatggcggttggtcttgtatctatactagcatcaagtttattaaggaatgacgtgcctatggctggaccattagtagcagggggtttattaatagcctgctacgtaattacagggacatcggctgaccttacagtagagaaagccgctgatgtaacttgggaagaagaagcagaacagactggtgtgagccataatctaatgattacggtagacgacgatggtactatgcgaatcaaagacgacgagactgaaaacatcttgacagttctactcaagacagcactattaattgtctcagggatatttccatactcaataccggcaactctattagtttggcatacatggcagaaacaaactcaacggagtggcgtattatgggacgtacctagtcctcctgagactcagaaggctgaattagaagaaggtgtataccgaattaagcaacagggaatttttggcaaaactcaagttggagtcggagttcaaaaagaaggtgtatttcacactatgtggcatgttacccgaggcgcagtactaactcattcaggtaaacgtttggaaccaaattgggcgtcagttaagaaagacctaatttcatacggcggaggatggagactatcggcacagtggcaaaaaggtgaggaagtgcaagtgatagcggtagagcccggaagaaatcccaaaaacttccaaaccatgcctggaatatttcaaactaccacgggtgaaataggcgccatcgcactcgattttaaaccaggcacatccgggtctcccatcataaacagagaaggaaaggttgttggcctctacggtaatggtgtcgtaactaagaatggtggctatgttagcggcatcgcccaagcaaatgcagaaccagatgggcctacacctgaattggaagaagaaatgtttaagaaacgcaacttgaccattatggacttacatccaggatctggaaaaactaggaaatacttacctgccatagttagggaggcaataaaacgtagactgcggactctgattttagcacccacaagagtagtagctgcagaaatggaagaggccctgaaaggattgcctatacgatatcaaactaccgcaacaaaatccgagcacactggacgagaaatagtggatctgatgtgtcatgcaacttttacaatgagattgctatccccagtcagagttccgaactacaatcttattataatggatgaagctcatttcactgatccagctagtattgctgcccgaggatacataagtacccgagttggcatgggagaagccgcagctatattcatgacggcaacacctccgggaacagcagaggctttccctcagtctaatgcgccaatccaagacgaagaacgagatataccagaacgtagctggaactctggaaacgaatggataacggactttgtaggtaaaactgtgtggtttgtcccaagtataaaagcaggtaatgacattgcaaattgcctacgtaaaaatggcaagaaagttatccaattatcaagaaaaacattcgataccgaatatcagaaaaccaagctgaacgactgggactttgtagtcacgactgacatatccgaaatgggtgcaaattttaaagcagacagagtgattgatcctcgaagatgtcttaagccagttattttaacagatggtcccgaaagggtaatcttagctggaccaatgcctgtgacagctgctagtgcagcccaaaggagagggcgcgtaggacgaaacccgcaaaaagaaaatgatcaatatatttttactggacaacccttgaataacgacgaggatcatgcacattggactgaagcgaaaatgctattggacaacataaatactccagagggaataattccggcacttttcgaaccagaaagggagaaaagcgccgcgattgatggagaatatcgtttaaaaggtgagagtagaaagacattcgtagagctcatgcgacggggagatctacctgtctggttggcgcataaagtagcatcagagggtattaaatatactgatagaaaatggtgctttgatggcgaacgtaataaccaaatattagaagagaacatggacgtggaaatttggacaaaggaaggtgagagaaagaaacttagacccagatggcttgatgcaagaacttactctgacccacttgctttgaaagaatttaaggacttcgcagccggacgtaaatccatagcgttggacctagtcacagaaatcggtcgtgtaccatcccacctagcgcacagaacgagaaatgctctagataacctagtgatgttacacacgagcgaacatgggggccgagcatatagacatgcagttgaagaactacctgagaccatggaaactctcttattattagggctaatgatattgctgactggcggagcaatgctatttttgatatcaggaaaaggtattggtaagaccagcataggtctcatttgtgtaatcgttagctcaggaatgttgtggatggcagatgttccattacaatggatagcttcagcaatagtattggagtttttcatgatggttttattaataccggagccagagaaacagagaacaccccaagacaaccaactagcgtacgtagtcattggtatcctaacgcttgctgcgatagtcgccgccaatgaaatgggactgctagaaaccacaaaacgtgacttaggtatgtctaaagaaccaggagtagtatcccccacatcatacttagatgtagatcttcatccagcaagtgcttggactttatacgcggttgctacaaccgtcataacaccaatgttaagacatactatagaaaactctacagcaaatgtgagtttagccgccatagccaaccaggctgtagtcttgatgggcttagacaaaggatggccgataagtaaaatggatttaggcgtacccttacttgcccttggttgttatagtcaggtaaacccactaactttgacagcagcagtattattattagttacccattacgctataataggaccaggactacaagctaaagccactcgagaggcacagaaaaggacagctgctggtataatgaagaatcctacagtggatggcattatgacaatagatctggatcctgttatttacgattcaaaatttgaaaaacaattgggacaagtaatgttacttgtactttgtgcagtccaattacttcttatgcggacctcctgggccctatgtgaagccctgactttagcaactggacctataacaaccctttgggagggttcacccggtaaattttggaacgctacaattgctgtttcgatggccaatatattccgaggctcttatcttgcgggtgcaggactagcattctcaattatgaaaagtgttgggacgggaaagagaggcaccgggtctcaaggtgaaaccttgggcgagaaatggaagaagaaattaaaccaattatctcgtagagaatttgaattatacaagaaaagcggcatcaccgaagtagaccgaacagaggcgaaagaaggtttgaaacgaggcgaaacgacgcatcatgcagtatcacgaggaagtgcaaagttgcagtggttcgtagaacgaaatatggttatacccgaaggacgagtgatagacctcggatgtggaagaggaggatggagctactattgtgcaggcctaaagaaagttacagaagtccgaggctatactaaaggtggccctgggcatgaagaaccggtcccaatgagcacatatggctggaacacagttaaattgatgtcaggtaaagacgtcttttatcttccccctgaaaaatgtgatacacttctctgcgatattggagagtcatcaccctccccgacagttgaagagagtagaacgatacgagtgctaaagatggttgaaccgtggctaaagaataaccaattctgtattaaagttttaaacccctacatgccaacggttatagagcaccttgaaagactacaaagaaaacatgggggcatgttagttcgcaatccccttagtagaaattcaactcatgaaatgtactggattagtaatggaacggggaacattgtcagcagtgtgaatatggtttcacgcttactcttaaacagattcacaatgacccataggcgaccaacaattgaaaaagatgtcgatctaggagctggtactagacatgttaacgcagaaccggaaactcctaatatggacgtaatcggtgaacgcatcaaacggataaaggaggagcatagctcgacctggcactatgatgatgaaaatccatataagacttgggcgtatcatggttcgtacgaagtaaaggctacagggtcagctagttctatgataaatggggtagtaaaattattaacaaaaccatgggacgtagtaccaatggtgacacagatggctatgactgataccacaccttttggccaacagcgtgtctttaaagaaaaagtggataccagaacgcccagacctatgccgggaacacgcaaggtaatggaaataacagctgaatggttgtggcgaactttaggacgcaacaaacgaccaagactatgcacaagggaagagttcacaaagaaggtcagaacgaacgctgcaatgggcgctgtatttactgaagaaaatcagtgggaatcggcacgagcagctgtagaggacgaagaattttggaaattagtgggtagagaaagagaattacataaacttggaaaatgtggttcatgtgtatacaatatgatgggtaagagggagaagaaactaggtgaatttggtaaagcaaaagggtcgagggctatatggtacatgtggttaggagcccgctatctagagttcgaagcgctgggtttcttaaatgaggatcactggttctctcgagagaacagttacagtggagtcgaaggagaagggctacacaaattaggatatatcttacgagacatatcaaaaataccaggaggggcaatgtatgcagatgacactgcaggctgggacacacgcataacagaagacgatctacataacgaagagaaaattacacaacaaatggatcctgaacacaggcagctggctaacgcaattttcaaattaacctatcagaataaagtagtgaaagtacaacgtccaacccctaagggaacagttatggatataatcagcagaaaagatcagcgtggatccgggcaagtaggaacctacggactaaacacattcacgaatatggaagcacagctcatacgacaaatggaaggagaaggagtactttcaaaagcagacctggaaaacccacatctccttgagaagaaaataacccaatggctggaaacaaaaggagtagaaaggctaaagagaatggccattagtggagatgactgtgtcgttaaaccgatagacgatagatttgccaatgctttattggctttaaatgacatgggaaaagtcaggaaagatatcccacagtggcaaccgtctaaaggttggcacgactggcaacaggtcccgttctgtagccaccattttcatgaattaataatgaaagatggaagaaaattagtagtaccatgcaggccccaagatgaattgataggacgtgccagaatatcgcagggcgcaggatggtcactgaaggagacagcttgcctagggaaagcatatgcacaaatgtggagtttaatgtactttcatagaagggatctaaggctcgcaagtaacgcgatttgctcagcagttccggtacactgggtaccgacaagtaggacgacttggtcaatacacgcacatcatcagtggatgactacagaagacatgttgacagtatggaatagggtctggattgaagacaatccatggatggaagacaaaactccagtgactacgtgggaagatgtcccatacctaggaaaaagagaagatcaatggtgcggctccttgattggcttgacctcacgagctacgtgggcgcagaatatcctaacggcaatacaacaagttagaagcctaatcggcgacgaagaatttcttgattatatgccttcaatgaaacgttttcgaaaagaagaagaatccgaaggagcaatatggtaa

SEQ ID NO: 23514 - RNA, 9873 nt, synthetic construct
  misc_feature 1..9873: note = derived and/or modified CDS sequence (opt6) from DENV-3__KJ622195__SS-prME
  source 1..9873: mol_type = other RNA
acaagtttgtgcctaatgatgatgctacctgcgactctagctttccatctgacctcgagagacggtgaaccgagaatgattgtagggaaaaatgaaagaggtaaatctttactcttcaaaaccgccagcggtataaatatgtgcactctcattgcaatggatttaggtgaaatgtgtgacgatactgtcacctataaatgtcctctgatagcggaagtggaacccgaagatattgactgctggtgtaatctcacatctacgtgggtgacatatggcacatgcaaccaagcgggagaacataggcgagacaaacgaagcgttgcgctcgctcctcatgtggggatgggacttgatactaggacacaaacatggatgagtgctgaaggtgcatggagacaagtggaaaaagttgaaacttgggcattgaggcacccaggatttacaatcttagcattgtttctagcccactacatcggcacatctcttacgcaaaaagtggtaatatttatattactgatgctagtaaccccatcaatggcgatgaggtgtgttggtgtcggaaacagggattttgtagaaggattatccggggcaacatgggtagacgtagtactcgaacacggagggtgtgtgaccacgatggcgaaaaacaaacccacacttgatatagaattgcagaaaacagaagctacacaactggctacactcaggaaactatgtatagaaggaaaaataacaaatattacgactgacagcagatgtcccacgcaaggtgaagcaatactaccagaagaacaagatcaaaactatgtgtgcaaacacacttatgttgatagaggatggggaaatggctgtggactttttggtaaaggatctctcgtcacgtgcgcaaaatttcaatgtcttgaatcaatagaaggcaaagttgtacaacacgaaaatttaaaatacacagttaccataactgtgcacactggtgatcagcatcaagtcggtaacgatacacaaggagtaacggcggaaataacgccgcaggcatcaactgtcgaagcaatactaccggaatatgggacactagggttagagtgctcacccagaacaggtctagactttaatgaaatgatattgctcaccatgaaaaataaggcttggatggtacatcgacagtggtttttcgatctccctctcccatggactagcggtgcgatcaccgaaacacccacgtggaaccggaaagaattgctagtaacattcaaaaatgcacatgcaaagaagcaagaggttgtagtcctaggatctcaagagggcgcaatgcatactgcgcttacaggagccacagagatacagaatagtggaggaaccagcatatttgccgggcatttaaagtgcagattgaagatggataaactagaattgaaaggaatgtcatatgcaatgtgtttaaacacatttgttcttaagaaagaagtgtcggaaactcaacacggtacaatacttataaaagttgaatataaaggtgaagatgcgccgtgcaaaatcccgtttagtacagaggatggtcaaggaaaggctcacaatggacggcttataacggctaacccagtggttacaaagaaagaagaaccagtgaacattgaggcggagccaccattcggtgaaagtaacatcgttattggaataggagacaaagcgttaaaaataaactggtacaagaaaggatctagcatcggaaaaatgtttgaagctaccgcaagaggggcacgtcgaatggcaatactaggcgatacagcatgggacttcggcagcgtgggtggggttttaaacagccttggtaaaatggtacaccagatctttggatcagcgtatactgctctttttggaggcgtatcctggataatgaagatcgggataggtgtactactgacgtggatagggttgaactctaaaaacacaagtatgagcttttcctgcatagttattggaatcattaccctataccttggaaccgttgttcaagcagatatggggtgtgtaataaattggaaaggcaaagaactaaaatgtggaagtggaatttttgtcactaacgaagttcacacatggactgaacagtataaattccaagctgattcacccaagaggttagccacagcaatagctggcgcttgggaaaatggtgtttgtggtataagaagtactacccgcatggaaaaccttctttggaaacagatagccaacgagttgaactatattttatgggaaaataatataaagttaacagttgttgtaggtgacattattggagtccttgaacaaggaaaaagaacattaacacctcagcctatggaactcaaatattcatggaaaacatggggaaaagctaagatagttacggcagaaatacaaaattcatcctttatcattgatggaccaaatacgccagagtgcccttcagcttccagggcttggaacgtctgggaagtggaagattacggttttggtgtatttacgaccaatatttggctgaaactgagggaagtttatacgcaaacatgcgaccataggctaatgagtgcagcaattaaagatgaacgagccgtacacgccgacatgggttattggatcgaaagtcagaaaaatggatcttggaaacttgagaaggcttcattcatagaagtaaaaacatgcacatggccaaagtcacatactttgtggagcaacggagtactagagtctgacatgatcatacctaaaagcctagctggccctatttcacaacacaatcacagaccaggttatcacactcaaacagcgggaccgtggcacttgggaaaactagagctagattttaattactgtgagggtacaaccgttgtaattacagagaactgtggtactagaggaccctcattacgcactaccacggtgagcggtaaattgatacatgagtggtgttgtagaagttgcacattaccacctttaagatatatgggagaagatggatgttggtacgggatggaaattagaccaataaacgaaaaagaagaaaatatggtaaaaagtctcgtgtccgcagggtcaggtaaagtagataactttacaatgggcgtgctatgtctagcaatactattcgaagaagtaatgagaggaaaatttgggaagaaacatatgatcgccggtgttctactaacattcatgcttcttttgagtggacaaattacttggcgagatatggcacatactctcatcatgatagggagcaatgctagtgacagaatgggaatgggcgtgacgtacctagcactgatagcaacatttaaaattcagccatttttggcattaggatttttcttaaggaaactgacatcacgagaaaatttgcttcttggtgtaggtctcgctatggctactacattacaactgcctgaagacatagagcaaatggctaacggcatagcacttggactcatggcacttaagttaataactcagttcgagacatatcagttatggacagccttagtgagtctcacatgttcaaacacaatctttacattaacagtagcgtggaggactgcaaccctaattcttgcaggagttagtttacttccagtttgtcaatcatcgtcaatgcgtaagaccgactggctacctgtagcagttgccgctatgggagtaccccctttaccacttttcattttcagtctaaaagacacattaaaaaggagatcgtggccattaaacgaaggagtaatggcagtaggacttgtcagcatattagcatctagcctcctaagaaacgacgttccaatggcaggtccgttagtagccgggggattactaatagcctgttatgtgataaccggaacttcggcggatttaactgttgagaaagcagctgatgtaacatgggaagaggaagcagaacagacaggcgttagccataatctaatgattactgtagatgatgacggaacaatgagaataaaagacgatgaaacagagaatatcctcacagttttattgaagacagcattattaatagtatccgggatttttccttatagcatacctgcgacactattagtatggcatacttggcaaaagcaaacccaacggagtggagttctatgggacgtaccttccccaccagaaacacaaaaagcagaactcgaagaaggtgtctatcgaattaaacagcagggtatattcggaaaaacacaggtgggagtaggggtacaaaaagaaggtgtattccacacgatgtggcatgtgacaagaggggcagttcttactcataatggtaagagattagaaccaaattgggcaagtgtgaagaaagatctaatttcatatggcggtggatggcgtttatcagcacaatggcaaaaaggggaagaagtccaagttatagcagtagaaccagggagaaatcccaaaaatttccaaactatgcctggcatatttcaaaccaccactggggaaatcggtgctatagcactggacttcaaacccggcacttcgggaagtcctattatagatcgagaaggcaaagtagtaggtctctatggaaatggggtagttaccaaaaacggaggatatgttagcggcatcgcgcaggcaaatgcagaaccagatggaccgactccagaactagaagaagaaatgtttaagaaaagaaacttaacaatcatggacctacatcccggttcgggtaagaccagaaaatatttgccagcaatagtgagagaggccataaagcgacgcctaaggacattgatacttgccccaacacgagttgttgcagcggaaatggaggaagctctgaaaggattgccgataagatatcagacaactgcgaccaaatccgaacatacgggaagagaaattgtcgatctaatgtgccatgcaacattcaccatgaggctactatcaccggttagggtgccaaactataatctaataataatggatgaagcccacttcactgatcctgcgagtattgcagctcgcggatatatcagtacaagagttggtatgggagaggcagcagcaatattcatgacggcaactccaccaggcactgctgaagcatttccacagtcaaatgcaccgatccaggacgaagaaagagacataccagagagaagttggaactctggtaacgaatggattaccgactttgttgggaaaaccgtatggttcgtaccctcgataaaagcagggaacgatattgcaaactgtttaaggaaaaacggtaagaaagttatacaattatctcgtaaaacttttgacacggaataccagaaaacgaaacttaatgattgggattttgtagtcacaacagacatatcagaaatgggtgcaaattttaaagcagatagagtcatagatccgcgaaggtgcctaaaaccggttatattaaccgacggcccagagcgtgtcatacttgccggtccaatgcctgtaactgccgcatctgctgcacaaagacgtggacgtgtaggacggaacccacaaaaagaaaacgaccaatatatatttactggccaacccctcaacaatgatgaagatcatgctcattggacagaagcaaaaatgctcttggataatattaatacgcccgaaggaataataccagccctttttgaaccagagcgtgaaaaatccgcagctatagatggagaataccgacttaaaggagaatcaaggaaaacattcgttgaactcatgcgccggggtgacttaccagtctggctagctcataaagtagcatcagaaggcattaaatatactgacaggaagtggtgtttcgacggcgaacggaacaatcaaatacttgaagaaaacatggacgttgagatttggacaaaggaaggtgaaagaaagaaattaagacctagatggcttgatgcacgcacttactcgaatccgttagctttaaaagaatttaaagattttgcagcgggaagaaaatcgatcgctcttgatttggtaacagagattggcagagtgcctagtcatctagcacatagaacacgaaatgcactagataaccttgtcatgcttcacacttcagagcatggaggtcgtgcttatcgacacgccgtagaagaattaccagagacaatggaaactctgcttctactgggactaatgattttacttacgggcggtgctatgctctttctaataagtggcaaaggcataggcaaaacgtcaataggccttatctgtgtaattgtttcttcaggcatgctttggatggctgatgttccgttacaatggatcgcatctgcaatagtcttagagttcttcatgatggtgttgttgataccagaaccagagaaacaaagaacaccgcaagataatcaactagcatatgttgttatcggaatactaactttggcagcaattgtcgcagcaaatgagatggggctactcgaaacgactaaaagagacttagggatgtctaaggaaccaggtgtggtgagcccaacgagctatttagacgtagatttacaccctgcaagcgcgtggacattatacgccgttgcaacaacagttataacgcctatgttgcgtcatacaatcgaaaacagtaccgcaaatgtgagcttagcagccatagcaaatcaggcagttgtcttgatgggtttagataaaggatggcccatatcgaaaatggacctgggtgtccctttattagcattaggttgctacagtcaagtaaaccctctcaccctgactgccgcagtgttactgcttgtaacacactacgctataataggtccaggtcttcaagcaaaagcaactcgagaggcccaaaagagaactgcagctggaattatgaaaaatccaactgtagacggtattatgactattgaccttgaccccgtgatctatgactcaaaattcgagaagcaattagggcaggttatgttattagtcctgtgcgcggttcaattattgctgatgagaacaagctgggccttatgtgaggccctgactctagctactggaccaataacaactctttgggaggggagcccaggaaagttctggaatacaactattgcagtatcaatggcaaatatttttagaggtagttaccttgctggagctggtttagcatttagcattatgaaatctgtaggaactggaaaacgtggtacagggtcacaaggagaaacacttggagaaaaatggaagaagaaattaaatcaactttcaagaagagagttcgaactttacaagaaatcgggtattaccgaagttgatcgaacagaagccaaagaaggactaaaaagaggtgaaacgacacatcatgctgttagccgaggtagcgccaagctgcaatggtttgtagaaaggaacatggttataccagaaggtagagttattgacctaggatgtggcaggggtggatggagttactactgcgcaggtttgaagaaagtaaccgaagttcgcggctatacgaagggcggacctggccatgaggagccagtcccgatgtcaacttacgggtggaacactgtaaaactgatgtcaggaaaagacgtattctatttaccacccgagaagtgcgatacacttctttgcgatatcggcgaaagtagcccctcccctactgtcgaagaatcacgaaccattagagttctcaaaatggtcgaaccatggctcaaaaataaccaattctgtattaaagttttaaatccctacatgccaacagtgattgagcacctggagagactacaaagaaaacatggaggtatgttggtaaggaatcctctttcaagaaattccacacatgaaatgtattggatatcgaatggaaccgggaatatagtatctagcgtaaatatggtctctagattactacttaatcgatttacaatgacgcacagaagaccgacaattgaaaaggatgtagacctaggcgcgggtacaagacatgttaatgcggagccggaaactccaaatatggatgtaataggagaaagaataaagcgaataaaggaggaacactcttctacctggcattatgatgatgaaaacccttacaaaacttgggcttatcacggtagctatgaagtgaaagcgacaggttcagcatcatcgatgataaatggcgtagtgaaattactaacgaaaccgtgggacgtggttccgatggtcacccaaatggccatgacggacacaacgccctttggacaacaaagagtctttaaagagaaagttgatactcgcactcctagaccgatgccggggacgcgcaaagtcatggaaattactgccgagtggctatggagaacccttggccgaaacaaacgacctagactatgcacgagagaagaatttactaagaaagtaagaacaaatgcggcaatgggagctgtttttacagaggaaaaccaatgggaaagtgctagggcagcagtcgaagatgaagaattttggaagctggtcggaagagaaagggaattacataaactaggtaaatgcggttcgtgtgtatacaacatgatggggaaacgggagaagaaactcggtgagttcggcaaagcgaagggcagccgcgcgatttggtatatgtggttgggagcacgatatttagagttcgaagcattgggatttttaaacgaagatcattggttctcgcgagaaaactcctattcaggtgtagaaggagaaggactgcacaaattagggtacatactaagagatatcagtaagatcccaggtggcgcaatgtacgccgatgatactgccggctgggatactagaattacagaagacgatttacataatgaggaaaagataacacaacaaatggatccagagcaccgccaattagccaatgcgatttttaaattaacctaccagaataaagttgttaaagtacagagaccaaccccaaaaggtacagtaatggatataatcagcaggaaagaccagcgcgggagtggtcaagtgggaacctatggacttaatacatttactaatatggaagcgcagctcatacggcaaatggaaggtgaaggggtactcagtaaggcggatttagagaaccctcatctattagagaagaaaattactcaatggctagaaacaaaaggggtcgaacgtttgaagagaatggccatctcgggagacgactgcgtagtaaaacctatagacgaccgtttcgcaaacgcgctccttgcgttgaatgacatgggcaaagttcgcaaggatataccccaatggcaaccaagtaaaggatggcatgattggcagcaagtccccttctgtagccatcattttcatgagttaatcatgaaagatgggagaaaactcgttgtaccatgccgaccgcaagatgagctcattgggcgggcgagaatcagtcaaggagccggatggagtcttaaagaaactgcatgccttggcaaagcatacgcccaaatgtggagtttaatgtactttcatcggagagatttaagattagctagtaacgccatatgtagtgctgtacctgtgcactgggttccaacgtctagaacaacttggagcatccatgcgcatcatcaatggatgaccacagaagatatgctcactgtatggaatagagtttggatagaggacaatccttggatggaagataaaacacctgttaccacatgggaagatgttccctaccttggtaagcgtgaagaccaatggtgcggaagtttgattggattaacttcacgagcaacgtgggcccaaaacatcttaacagcaatccaacaggtgaggtcattaataggggatgaagagttcttagattatatgccttcaatgaaacgcttccgcaaagaagaagaaagcgaaggcgcaatatggtaa

SEQ ID NO: 23515 - RNA, 9873 nt, synthetic construct
  misc_feature 1..9873: note = derived and/or modified CDS sequence (opt6) from DENV-3__KJ622196__SS-prME
  source 1..9873: mol_type = other RNA
acaagtttatgcctgatgatgatgttacctgcaacactcgcttttcacctaacaagtcgcgacggtgaaccgcgcatgatcgtaggcaaaaatgaaagaggtaaaagtctcttattcaaaacggcatcgggtataaacatgtgtacacttatcgcaatggacttaggagaaatgtgtgatgatacggtaacgtacaaatgcccactaattgcagaagtagaaccagaagacattgattgttggtgtaacctaacatctacatgggtgacatatgggacgtgcaaccaagcgggagagcatagaagagacaaaagatctgtagcgctagcaccgcatgtggggatgggattagacacacgtactcaaacgtggatgtcagcagaaggagcttggaggcaagtcgaaaaagtagaaacatgggcattaagacaccctgggttcacaattttggcactgttcctagctcactatataggaacgagtctaacacaaaaagtagtaattttcatcctacttatgttagtgacaccatctatggctatgcgatgcgtaggtgtaggaaacagagatttcgttgagggactgagtggagccacctgggttgatgtggtcctggaacatggtgggtgtgtaacaacaatggccaaaaacaaacctacgttagatattgaattgcagaaaactgaagcaacgcaacttgctactttaagaaaactgtgcatcgaaggaaaaattaccaacattacaacggattcccgatgtcccactcaaggagaagcgatattacctgaggaacaagaccaaaactatgtctgtaaacacacgtatgtggacagaggatggggaaatgggtgtggacttttcggaaaaggttcgttagtcacatgtgccaaatttcagtgtctggaatctattgaaggaaaagttgtgcaacatgagaacttaaaatacacagttactatcaccgtccacactggtgaccagcaccaagtaggtaatgatacacaaggagtgacagcagaaatcacaccacaagccagtacggtggaagctatccttccagagtatggcacattgggtctagaatgttcaccacgcacaggtctagattttaatgagatgatactgctaacaatgaaaaacaaggcttggatggtccaccgtcaatggttctttgatctaccattaccctggacgagtggagcgatcaccgaaacacctacatggaatagaaaagagctattggtcacattcaaaaatgcacatgctaagaaacaggaggtcgtggttctgggtagtcaagagggcgcaatgcataccgcattaacaggtgcaactgaaattcaaaattcaggcgggacttcgatatttgcaggacatttaaaatgcagattaaaaatggacaagctagagttaaaaggaatgagctatgcgatgtgcttgaatacattcgttctaaagaaagaagtatctgagacacagcatggtacaattttaattaaagttgaatataagggagaagacgctccatgcaaaatacctttttcaactgaagatggacaaggtaaggcacataatggtaggttaataaccgctaatccggtcgttaccaagaaagaagaacctgtgaatatcgaagcagaacctccatttggagaatcgaatattgtaatcggaataggtgataaagccttaaagataaactggtacaagaaaggaagttcaatcggaaaaatgtttgaagcaaccgcacgaggagctaggagaatggcaatactgggagataccgcgtgggattttggttctgtaggaggagtactaaacagtctggggaaaatggtccatcagattttcggatcagcatatacagctctatttggcggagtctcatggattatgaaaattggaatcggtgttttactgacatggataggattaaacagcaaaaatacttcaatgagtttctcttgcatagttataggaatcattacattgtacttggggacggtagtgcaagcagatatgggatgcgttataaattggaaaggaaaggaacttaaatgcggtagtggaatatttgtgacaaatgaagtacacacctggacagaacaatataaattccaggccgattcacccaagagattggcaacagcaatcgcgggggcctgggaaaacggcgtctgcgggatccggtcaactacaagaatggaaaatctactctggaaacaaatcgcaaatgaactaaactacattctctgggaaaataatataaaattaacagtggttgtaggggatataatcggagtcttggaacagggaaagagaacactaacaccgcagccaatggaattgaagtacagctggaagacttgggggaaagcgaaaatagtaactgcggaaatacagaacagttcttttataattgatggacctaatacacctgaatgcccgagcgcgtcgcgagcatggaatgtgtgggaagtagaggattatggatttggtgttttcacaacaaacatatggttaaagttgagagaagtatatacacaaacatgtgatcatcgactcatgtctgctgcaatcaaagatgaaagagctgtgcacgcggatatgggctactggattgagtctcagaaaaacggtagctggaaacttgaaaaggcctcattcatagaggttaaaacttgcacgtggcctaaaagccataccctgtggagcaatggagtactagaaagtgatatgataataccaaaaagcctagcaggaccaatatctcaacacaatcatagacccggctaccatacccaaaccgctggaccatggcacttaggcaagttggagttagactttaactattgcgagggaacaactgtggtgattacagaaaattgtggtactagagggccgtctcttagaacgacgaccgtatctgggaagttaatacatgaatggtgctgccgttcatgcactctacccccattgagatacatgggggaagatggatgttggtacggaatggagatacgaccaatcaatgaaaaggaagagaacatggttaaaagtttggttagtgcagggtcgggaaaggtagataactttactatgggcgttctatgtctagcgatcctttttgaggaagtaatgagagggaagttcggcaagaaacatatgatcgccggtgtattactgacgtttatgttattgttaagtggacaaatcacctggcgggatatggcccacaccttaatcatgattggcagcaacgcatcagataggatgggtatgggggttacttacttagccctaatagccacatttaaaattcaaccattcctcgcactcggattctttttgagaaaattgacgtcccgcgaaaatttactattaggtgttggactcgcaatggcgactactctccagttaccggaagatatagaacaaatggcgaatggaatagcgctaggattaatggctctcaaattaataactcagtttgagacttaccaattatggacagcgttagtaagtctaacctgctctaatacgatattcaccttaacagtagcatggagaaccgccacactaatcttagcaggcgtcagtcttttacccgtttgccaatcgtctagtatgaggaagacagactggctacctgtggcagtcgcagccatgggggtacctcccttacctctatttatattttcattaaaagatacacttaagcgaaggagctggccacttaatgaaggggtgatggctgtcggtcttgtatcgatcctagcttcttctttgttgcgtaatgatgtccccatggctggccccttggttgcaggcggactactaatagcatgttacgtcatcaccgggacgagtgccgatctaacggtagaaaaagccgctgacgtaacgtgggaagaagaggcagaacaaactggagtaagtcataatctgatgattactgtagacgatgatggaactatgcgaattaaagacgacgaaacagaaaatatattgacagtattattaaagactgcgttacttatagtaagtgggatattcccctattctattcccgccacactattagtatggcatacatggcaaaagcaaacacagcggagcggagtactatgggacgtacccagtccacctgaaacacaaaaagcagaattagaagaaggggtgtataggattaaacaacaaggaatcttcggtaaaacccaggtaggtgttggagtacaaaaagagggagttttccacactatgtggcatgtaacaagaggcgctgtgctcacccataatggaaaaagactcgaacctaattgggcgagtgtaaagaaagatctaatttcatacggcggcggatggcgattgagcgctcaatggcaaaagggcgaggaagtgcaagtgatagcggtagaaccaggaagaaatcccaaaaattttcaaacaatgcctggaatatttcaaacaactacaggagagattggtgcaatagctcttgattttaaaccaggtacttccggaagccctattatcaacagagaaggaaaagtagtaggactttatggaaatggcgttgtcacgaaaaatggaggctacgtatctggaatcgctcaagcgaacgccgaaccagatgggccaacacctgaattagaagaagaaatgtttaagaaaagaaatttaacaataatggatttacacccaggcagcggaaaaactagaaagtatctgccggcgatagtccgtgaagcaattaaaagaagactaagaacattaatattagcgccaactagagtagtcgcagcagaaatggaagaagctctgaaaggcttgccaattaggtaccagacaacggcaacaaaaagtgagcataccggcagggaaatcgtggacctaatgtgtcatgctacttttacgatgagattactatcacccgtacgagtacctaattacaaccttataattatggacgaggctcattttactgatcctgctagcatcgccgcacgaggctatatatcaacaagagttggaatgggagaagctgctgcaatattcatgactgcaacaccacctggaaccgctgaagcatttccccaaagcaatgccccaatacaagacgaagaacgtgacatacccgaaagaagttggaactcaggcaacgagtggataaccgacttcgtaggcaaaaccgtttggttcgtaccttctatcaaagccggcaatgatatagctaattgtttgaggaaaaatggcaagaaagttatacagctgtcacgaaaaacattcgataccgaatatcagaaaacgaagttgaacgattgggacttcgtcgttactaccgacataagcgaaatgggagctaactttaaagctgatcgagtgattgatccgcgaaggtgtctcaaaccggtaatactgactgacggaccagaaagggtaatcttggcaggaccgatgcctgtgaccgcagcgtccgcagcacaaagacgcgggagagtaggacgtaacccacagaaagagaatgaccaatacatctttaccggacagccgctaaataatgatgaggaccacgcacactggacagaagcgaaaatgttactagacaacattaacacccctgagggaataataccagcactatttgaaccagaacgtgagaaaagtgccgcgatagacggcgaatatcgactaaaaggggaatctagaaaaacattcgttgaattaatgagacgaggtgatctaccggtgtggttagcacataaagtagcttcggaaggcattaagtatactgaccggaaatggtgtttcgacggcgagagaaataaccaaatattagaagaaaatatggatgtagaaatctggactaaagagggagagcggaagaaattaagaccaaggtggctagatgcacgtacctatagcaacccactagccctcaaagagtttaaagattttgctgcaggccgaaagtcgattgcccttgacttagtaacagaaattggaagagttcccagtcacctagcgcatagaacaaggaatgcgttggataatctcgtaatgttacatacgagcgagcacggcggacgcgcttaccgacatgcagtcgaggaattgcccgaaactatggagactttactactattaggtttgatgattctactcactggaggggccatgctatttttgataagcggaaaagggataggtaaaacttcaatcggccttatatgtgttatagtctcatcaggaatgttgtggatggcagacgtaccactccaatggatagcaagcgcgatagtacttgagttctttatgatggtcttgctaatacccgaacccgagaaacaaaggactccccaagataaccagttagcatatgtcgtaatcgggatacttaccctcgcggcgatagttgctgcaaatgaaatgggcctcctagagaccacaaagcgagacctaggaatgtcaaaagaacctggagtagttagcccaacgtcttacctggatgtagatctacatccagctagtgcctggacactttatgctgtggctacaacggtaataacccctatgttaagacacaccatcgaaaatagcaccgcaaacgtaagcctagctgcgattgctaatcaagctgtagttctgatgggtttggacaaaggatggcctattagtaaaatggacttaggagtcccgctgttagcactcggatgttacagccaagtaaaccctttaacactgactgcggctgtactattgctagtaactcactacgcaataattggtcccgggctacaggcaaaagctactagggaggcccaaaaacgaactgctgcaggaattatgaaaaatcctactgtagatggaatcatgaccatagacctagaccctgtgatttatgacagtaaatttgaaaaacaactgggccaagttatgttacttgtcctctgtgctgttcaactccttctcatgagaaccagctgggcgttatgcgaagcacttaccttggcaactggaccgataacaacactctgggaaggaagtccgggtaaattttggaacaccacaattgcagtctcaatggctaacattttcagaggatcctacttggccggtgcggggctagcattttcaatcatgaaatctgttggtacaggtaaaagaggtactgggtcacagggagaaacacttggggaaaaatggaagaagaaactaaatcaactatcgcgtcgggaatttgaactatataaaaagagtggtatcacagaagtggatagaactgaagcgaaagaggggctgaaaagaggagaaacgacacaccatgctgtgtcaagaggcagcgcaaagctacagtggttcgtagaacgtaatatggtaattccggaaggaagagtgatcgacttaggatgtggtagaggaggctggagctactattgtgcaggactaaagaaggtaacggaagtacgtggttatactaaaggtggtccaggtcacgaagaaccagtgcccatgagcacttatggttggaataccgtaaaacttatgtctggtaaggatgtattttaccttcctcctgaaaaatgcgacacgttattatgcgacataggagagtcctcaccttcacccactgtggaagaatcacgtacaataagggtactaaaaatggtcgagccctggttaaagaacaatcaattttgtatcaaagtactcaatccttatatgcctacagttatagaacaccttgagaggctacaacgtaaacatggtggaatgctggtaagaaacccattgtcgagaaactcaacccatgaaatgtattggatatcaaacggaacaggaaatattgtttcatcagtaaatatggttagtcgtctcctactgaatcgattcacaatgacacatcgcagacccaccatcgaaaaggatgtggacctcggtgcaggcactagacatgtaaatgcagagccggaaactcctaatatggatgttatcggtgaacgtataaaaagaataaaagaagaacattctagtacatggcattatgatgatgaaaatccgtataaaacctgggcataccatggatcatacgaagtgaaagcgactggcagcgcatcaagtatgatcaatggtgtagtaaaacttttaactaaaccttgggacgtagttccaatggttacccacatggctatgacagatactacaccgtttggacaacaaagagtttttaaagaaaaagtagacacaagaacaccgcggccaatgcctggaacgaggaaagtgatggagatcaccgctgagtggttatggcgtactctcggtcgaaataaacgacctagactatgtaccagggaagaatttactaagaaagtaaggactaatgcggcaatgggagccgtatttactgaagaaaatcaatgggagtctgcacgtgcagcggtagaagatgaagagttttggaagttagtgggacgggaaagggagctacacaaactagggaaatgcggaagttgtgtatacaatatgatgggaaagagagagaagaaactaggcgagtttggtaaagctaaaggtagtagagccatctggtatatgtggttgggtgcacgttatctggagtttgaagcgttagggtttctgaatgaagatcattggttctccagagaaaattcatactcaggagttgagggagaaggcctacacaaactggggtatattcttagagatattagcaaaataccaggcggtgcaatgtacgcggacgacactgcgggttgggatacgagaattactgaagatgaccttcataacgaagagaaaattacacagcaaatggatccagaacataggcagctggctaacgcaattttcaaactaacataccaaaacaaagtagtaaaggtgcagagaccaacacccaaaggaactgtaatggatataatctcaaggaaggatcaaaggggtagtggacaggttggcacttatggactaaatacctttacgaatatggaagctcaactaataagacaaatggagggcgagggtgttttatcgaaggcagatttggaaaatccacacctactcgagaagaaaattacacaatggctagaaacaaaaggcgttgagcgattaaaaaggatggcaataagtggagatgactgtgtagtaaaacctattgatgatagatttgctaacgcgctattagccttgaatgacatgggtaaagtacggaaagacattccacaatggcaaccctctaaaggatggcacgactggcaacaagtgcctttctgcagtcaccactttcacgaactaattatgaaagatggacgaaaattagtggtaccttgcagacctcaagacgaattaatcggacgggcccggatttcccaaggcgcaggctggagcctgaaagaaacagcctgcttaggaaaagcatacgctcagatgtggagtttaatgtacttccaccgaagggacttgagactagccagtaatgcgatatgctcagcagtaccagtacactgggtacccacatcaagaacaacatggtctatacatgcacatcatcagtggatgacaactgaagatatgctcacagtgtggaatcgagtatggattgaggacaatccatggatggaggataagacccccgtcactacctgggaagacgtgccgtatttaggtaaaagagaggatcaatggtgtggatcattaattggtctaaccagccgagcaacatgggcacaaaatattttaacggcaattcaacaagtgagatcactaataggggacgaggaatttctagattatatgccctctatgaaaagattccgaaaagaggaagaatcggagggagcgatatggtaa

SEQ ID NO: 23516 - RNA, 9873 nt, synthetic construct
  misc_feature 1..9873: note = derived and/or modified CDS sequence (opt6) from DENV-3__KJ830751__SS-prME
  source 1..9873: mol_type = other RNA
acaagtctatgtttaatgatgatactaccagcggcacttgcatttcatttgacatctagagatggagaacctagaatgatagtagggaaaaatgaacgtggtaaatcgttgctgtttaaaacagcatcgggtataaatatgtgcactttgatagcaatggatctaggtgaaatgtgtgacgacacagtgacctataaatgcccacacattactgaagtggagcccgaagatatagattgttggtgtaatctaacatcaacttgggttacgtacggaacatgtaaccaagcaggagaacacaggagagataaacgttcagtggcattagcaccgcacgtaggtatgggtctagacacgcgtacacaaacatggatgtccgcagagggtgcatggagacaagttgagaaagtggaaacatgggcattaaggcaccccggatttacaatactagcattgttcttagctcattacataggaacttcactaacccaaaaagtcgtcattttcatactcttaatgttagtcacgccttcaatgacgatgagatgcgtaggggtaggaaatcgtgactttgtagagggattatcaggtgctacatgggtagatgtagtcctggaacatggtggttgtgtaacgacaatggccaaaaataaaccaactttagatatagaactacagaaaacagaggcaactcaattagcaacattgcggaaactatgcatcgaaggaaaaatcaccaatataacaacagattcaaggtgtccaacacaaggtgaagctgtgctaccagaagaacaagaccaaaattacgtctgtaaacatacatacgtcgacaggggatgggggaatggatgcggtttatttggaaaaggtagcctcgtaacgtgcgctaaattccaatgcctcgaaccaatagagggcaaagtggtgcaatatgaaaatctaaaatacactgtaataatcaccgtacatactggagatcaacaccaagtcggtaatgaaacacaaggtgtaactgccgaaataactcctcaagccagtaccaccgaagcaattttaccagaatatggcacacttggcttagagtgcagtcctagaaccgggcttgactttaatgaaatgatactattaactatgaaaaataaagcgtggatggttcatcgtcaatggttctttgatcttccattaccgtgggcatctggcgcaacgaccgaaacaccaacttggaatagaaaagaacttctcgtgacgtttaaaaatgcacatgccaagaaacaagaagtggtggtgttaggatctcaggagggtgctatgcatacggcactcacaggtgcgactgaaatacaaaattcaggcggtacatcgatttttgcaggacatctgaaatgcagattaaaaatggataaactggagctcaaaggcatgagctatgccatgtgcacaaatacattcgttttaaagaaagaagttagcgagactcaacatggaactattctaattaaagttgagtacaaaggcgaagatgctccatgcaaaattcctttctcaacagaagacggccaaggcaaggcacataatggacggctgataacagctaatccagtcgtaacgaagaaggaggagccagtaaatatcgaggccgaacctccctttggtgaaagtaatatcgtgataggaatcggggacaatgccctcaaaataaactggtataaaaagggcagcagtataggtaaaatgtttgaggccacggctcgaggcgcgagaagaatggcgatattgggcgacaccgcatgggatttcggaagtgtaggtggggttttaaattcattaggaaagatggtccatcaaatatttggatctgcatacactgcactcttttcaggggtctcatgggtaatgaaaatagggattggtgttctactaacctggataggactaaatagtaaaaacacaagcatgtccttcagttgcattgctataggtataatcacgttatatttaggagctgttgtacaagcggatatgggctgtgtaatcaactggaagggaaaagaactgaaatgcggaagtggtatatttgtgacaaatgaagtacacacgtggacggagcaatacaaatttcaagcagacagcccaaaaagattagccaccgcaattgccggtgcttgggagaatggggtatgtggtataagatcaacaacaagaatggaaaatctgctatggaagcaaattgcaaatgagctgaactatatactctgggaaaacaatattaaacttaccgtagtggtcggtgatacaatcggtgtcctagagcaaggtaaaagaacccttacgccacagcctatggaattaaaatacagttggaaaacatggggtaaagcaaaaattgtcacagcggaaacgcaaaattcaagtttcataatagacggaccgaatacccctgaatgcccttcagcctcgcgtgcatggaatgtatgggaggtcgaagattatggatttggcgtattcacgacgaacatttggctaaaattgcgggaagtttatacacagctgtgtgatcatcggctgatgagcgccgcagtcaaagatgaaagagcagtacatgccgacatgggatactggatagaatcacaaaagaatggaagctggaagctcgagaaagcatcgttaatagaagtaaaaacttgcacttggccaaaatcgcacacactctggtcaaatggcgtacttgaaagtgacatgataatacctaagagcttagccggtcctataagtcaacataactatcgacctggataccatacccaaacggcaggtccctggcatcttggtaaacttgaactagattttaattattgcgagggaacaacggtcgttattaccgagtcttgtggaaccagaggtccaagcctaagaactactactgttagtggcaaattaattcacgagtggtgctgccgcagttgcacattaccgccactaaggtatatgggagaggacggttgctggtatggaatggaaataaggccgatcagtgagaaagaagaaaacatggtgaaatcgctggtgagcgccggctcagggaaagtcgacaattttacaatgggagtgttatgtttagccatactttatgaagaagtcatgagagggaaattcggaaagaaacacatgatagctggggtatttttcactttcgtattactattaagcggacaaataacttggagaaatatggcccacactctgataatgattggatcaaacgcaagtgacagaatgggcatgggcgtaacatatctagcattgatagctacatttaaaatacaaccctttctggcacttggattctttttgcgaaaattgaccagtagagaaaatctattattaggcgttggattagctatggcgaccacgttgcagctgccggatgatatagaacaaatggccaacggaattgcactgggattgatggcccttaaattaataacacaattcgaaacatatcagctatggaccgcattagtgtcactgacctgcagtaataccatgttcacattaaccgtggcatggcgaacagctacactgatcttagctggagttagtctgctaccagtatgccagagttcgtcaatgagaaaaaccgattggttaccgatggccgtcgcggcaatgggggttccgccccttcctttattcatatttaacttgaaagacacgctgaaaaggagatcttggcctctaaatgaaggagtaatggcagtaggtttggtctcgatacttgccagctccctcctgaggaatgatgtcccaatggcgggcccactggtcgcaggcggattgctcatcgcttgttatgtaattacaggtaccagcgcggatctgaccgttgaaaaagcagccgatgttacatgggaagaggaagctgaacaaaccggtgttagtcacaacctgatgattacagttgacgatgatgggaccatgcgtataaaggacgatgaaatagaaaacattttaacagtgttactcaaaacagctctcttgatagtatcagggattttcccatactctataccagcaacgttgctcgtctggcacacgtggcaaaagcaaacacaaagatcaggggtactatgggatgtcccatctcctccagaaactcagaaagcagaactagaggaaggggtttatagaataaaacaacaagggatattcggaaaaactcaagtgggtgtgggagttcaaaaagaaggtgtattccataccatgtggcatgtgacgcggggagctgttcttacgcataacggtaagaggctagaacctaactgggctagtgtgaagaaagatctaatatcttatggtggtggttggagattatctgcccaatggcagaaaggagaggaggttcaggtaatagcagtagaaccaggcaaaaatccgaaaaatttccagacgatgcccgggactttccaaactacaacgggagaaataggcgccatagctttagattttaagccgggaacgtctggtagtcccatcattaacagagaaggtaaagttgtgggactatacggaaacggagtcgtgaccaaaaacggtggatatgtatccggtatagcccaaactaatgctgaaccagacggaccgacgccagagctagaggaggaaatgttcaagaaaagaaatctaacaatcatggaccttcatcccggcagcggtaaaacccggaagtatttacctgctattgtccgtgaggctattaaacgacgcttaagaactcttatactcgcgcctacgagagtagttgctgcagaaatggaagaagcattgaaaggattgcccatcaggtatcaaacaacagcaaccaaatccgaacatacaggacgcgaaatcgtcgacctgatgtgccatgcgacttttacaatgcggttactaagtcctgttcgagtgcccaattacaatcttattataatggacgaagcacattttactgatccagcgtccatagctgccaggggttacattagcacgagggtaggtatgggagaagcagcagctatatttatgacggccactcctcccggaacggcagacgcttttccacaatcaaatgcacctatacaagacgaagaacgagatatacccgagcgtagctggaatagcggaaatgaatggattaccgacttcgccggaaaaacggtatggttcgtcccgtcaataaaggccggcaatgatatcgcaaattgccttcgcaagaatggtaagaaagtgattcaattgtcaagaaaaacgttcgatactgaataccagaaaacaaaactaaacgattgggatttcgttgtaaccacagatatatcggaaatgggtgctaactttaaagctgatcgagttatagatcctagacgttgcctaaaaccggtaattctaacggatggacctgaaagagtaatattggccggacctatgccggtaacagcagccagcgcggcgcaaagacgagggcgtgtagggaggaacccccaaaaagaaaacgaccaatatatatttacaggacagccactcaataatgatgaagatcatgcacattggaccgaggctaaaatgttgttagataacataaatacaccagaaggcattctacccgcattgttcgaacccgaaagagaaaaatccgctgcaatagatggagaataccggctaaaaggagaatctaggaaaacatttgtcgagctgatgagacggggtgacttacctgtctggttggctcataaggtagcatctgaaggaataaaatacacagatcgaaaatggtgttttgatggacaaagaaataatcaaatattagaagagaatatggatgtcgaaatctggacgaaagagggagaaaagaagaaactaagacctagatggctagatgctcgaacctatagtgatccactagccctgaaagaatttaaagacttcgcagccggacgaaaatcaatagcactcgatcttgttacagaaattggcagagtcccatctcatctagcacacagaacacgtaacgcattagacaatcttgtcatgttacatacaagtgaacatggtggacgagcgtatcgtcatgccgtggaagaactaccagaaactatggaaacacttttactcttgggattaatgatactactaaccggcggtgctatgttgttcctaatatcaggaaaaggtatcggaaagacatctattggcctaatttgtgtcatcgcttcctctggaatgctgtggatggctgaggtcccgttacaatggatcgcgtccgcaatagtattagagttctttatgatggtcttactgatccctgaaccggaaaagcaaagaaccccacaggataatcaattagcgtacgtagtgattggaatactaacacttgccgcgataattgctgccaatgaaatgggattgttagagacaactaaaagagacttgggaatgagtaaagaacctggggtggtatcacccacaagctaccttgacgttgatctacaccccgcttcagcatggacactatatgctgttgctacgacagttattactcccatgttacgacatacaatagagaacagcacagccaatgtctcgcttgcggcaattgctaaccaggcggttgtacttatgggtttagataaagggtggccaatatcaaaaatggatcttggagtcccattgctagcattaggatgctattcccaagtaaacccattaacattaacagcagcggtacttcttctgattactcattatgcaattataggcccaggtctccaagcgaaagcgacaagagaggcccagaaacggacggcagccgggattatgaaaaaccctactgttgacggaattatgacgatagatctggacccggttatatatgactcaaaatttgagaaacaacttggtcaggttatgctattagtcctatgcgcagtgcaactacttttgatgagaacaagttgggcactttgtgaagcgctaaccttggcgaccggaccgatcactaccttatgggagggatcaccaggaaaattttggaatactaccatagccgtatcaatggcaaacatctttagaggatcgtatctggcgggtgccggtctggcattttccataatgaaatcggtaggtaccgggaaacgaggcactggaagtcaaggagaaactcttggagagaagtggaagaagaaactgaatcagttatctcgcaaagaatttgatttatataagaaatccggtataacagaggtcgatcgtactgaagcaaaagagggtctaaaacggggagagacaacacatcacgcagtttcacgagggagtgccaagttacaatggtttgtcgagagaaatatggtagtacccgagggtagagttatagatttgggttgcggaagaggtgggtggtcctattactgcgccggtctcaagaaagttacagaagtgcgaggttacacgaaaggaggcccgggacatgaggaaccagtaccaatgagcacttatggatggaacattgtgaaacttatgtcgggcaaggatgtattttacttgcccccggaaaagtgcgacaccttattatgtgacattggcgaaagcagcccgtcaccaactgttgaagagtctcgtactatacgggtgctcaaaatggtagaaccatggttgaagaataatcagttttgcataaaggtactgaacccttacatgccaacagtgatagaacatctggaacgcctccaacggaaacatggtggtatgctagtaaggaatcctctttccagaaactccacacatgaaatgtactggatatctaatggaacaggtaacatcgttagttcagttaatatggtatctcgcttattattaaatagatttacaatgacccatagaaggcctaccatagagaaagacgtagatttgggcgcaggcacgagacatgtaaacgcagaaccagagactcctaacatggatgtgataggggaacgcataaaaagaataaaagaagaacataactccacatggcactatgacgatgaaaatccttataaaacctgggcatatcacggatcatacgaagtgaaagcaactgggtcagctagcagtatgattaatggcgttgtaaaacttttaacgaaaccttgggacgttgtacctatggtgacacaaatggccatgacggatacaacaccatttggccagcaaagagttttcaaggaaaaagtcgatacacgaacaccaagacctatgcctgggactagaaaagtgatggaaataacagccgaatggctttggagaaccttaggaagaaacaaaagaccgcgtctgtgcaccagagaggaatttacaaagaaggtgcgcacaaacgccgcaatgggagcggtttttacggaagaaaatcaatgggacagcgcaaaagcagctgtcgaagacgaggaattttggaaactcgttgaccgagagagagagttgcataagctaggaaagtgcggttcctgtgtatataacatgatgggaaagcgtgagaagaaattaggggaatttggtaaagctaagggatctagagcaatctggtatatgtggctaggagccagataccttgaatttgaagcactgggattcttaaacgaagatcactggttttctagagaaaatagttattcaggagtggaaggagaaggactccacaaattgggctacatattgcgagacatcagtaagataccaggtggtgcgatgtatgccgacgataccgcgggttgggatacacgaattaccgaagatgatctacacaatgaagagaaaataatccaacaaatggatccagaacatcgtcaattagctaacgctatttttaaactcacataccagaataaagtcgtgaaagtacaaagaccaacacccacgggtacagtaatggacataatatctaggaaggatcaaaggggtagtggtcaggtagggacatacggactaaacacatttactaatatggaggcacaattggtccggcagatggaaggtgagggcgtcttaacaaaggccgatctagagaactcgcatttaccggagaagaaaatcacgcaatggttggaaactaaaggagttgaaaggttgaaaagaatggcaatctcaggtgatgactgtgtggttaaaccgatcgatgatcgcttcgcaaacgcgctggtagctttaaatgacatgggtaaagtaaggaaggacatcccacaatggcaaccttccaggggctggcacgattggcaacaagttcctttttgtagtcaccattttcacgaattgataatgaaggacggaagaaagctagttgtaccgtgcagaccccaggatgagcttatagggagagcaagaattagtcagggtgcggggtggagcttgagggaaaccgcctgtctcgggaaggcttatgcgcaaatgtggtctttaatgtactttcacaggagagatttgagattggcgagcaacgcaatatgcagcgcagttccagtacactgggtaccgacatctcgtacaacctggtcaatacatgctcaccaccaatggatgactactgaagatatgttaacggtttggaatagggtttggatagaagaaaatccttggatggaagataaaactccagtaacgacatgggaaaatgtaccgtatctaggaaagagagaagatcagtggtgcggatcgttaataggactgacatcacgcgcaacatgggcacaaaacattccaactgcaattcagcaggtacgatcattaattggaaatgaagaatttttagactacatgccaagtatgaagaggttccggaaagaagaagaatcggagggagcaatttggtag

SEQ ID NO: 23517 - RNA, 9873 nt, synthetic construct
  misc_feature 1..9873: note = derived and/or modified CDS sequence (opt6) from DENV-3__KC762681__SS-prME
  source 1..9873: mol_type = other RNA
acgagtttgtgtctcatgatgatgttaccagcaaccctagcatttcacctgacatctagggacggggaaccgaggatgatcgttggcaaaaatgaaagaggtaaatcattactgtttaaaactgcaagcgggattaatatgtgcactctaattgctatggatctcggcgaaatgtgtgatgatactgtaacttataaatgtccgctgattacagaagttgaaccggaggacattgattgctggtgtaacttaacatcaacatgggtcacttacggcacttgcaaccaagcgggagaacatcggagggataaaagatcagtggcattagctccacacgtaggtatgggactcgatacacgaactcaaacttggatgtcggcagaaggagcctggcgccaagttgaaaaagtagagacgtgggcattcagacaccctggctttactatattagctttatttctcgcgcactatataggcacttcactcacacaaaaagtggttattttcattctactcatgcttgtgacaccatctatgacaatgagatgtgtaggggttggaaaccgtgattttgtggaagggttatcgggggcaacctgggtagacgttgtgctggaacatggtgggtgtgtaaccacaatggcgaaaaataaaccgacattagatatagaactacagaaaaccgaagcaacacaactagcgacccttcggaaactatgtatagaaggaaaaataacaaatgtcacaacggactcaagatgtccgacacaaggagaggccatacttcctgaagaacaagaccaaaactacgtatgtaaacatacgtacgttgatagaggatggggtaatggttgtggattgttcgggaaaggtagtctcgtgacatgtgctaaattccaatgcttggagttcatagaagggaaagtggttcaacacgaaaatttaaaatataccgtaattatcacggtacacacgggagaccaacatcaagttggaaatgaaacccaaggggtaacggctgaaataacaccacaagctagcactgtagaagcgatattaccagagtatggtacactggggctcgaatgttccccgcgaactggtttagattttaatgagatgatattactaacaatgaaaaataaagcctggatggtccatagacaatggtttttcgatttacctctaccatggacaagcggcgcaacaactgaaacaccaacctggaacaagaaagaacttctagtaactttcaaaaatgcccatgccaagaaacaagaagtagtggtactaggatcccaagaaggcgctatgcatactgcacttacaggagctactgaaatacaaacctctggaggtacatcaatcttcgctggacatctaaaatgcagattaaaaatggataaattagaattaaaaggcatgtcatatgcaatgtgtttaaatgcattcgtattgaagaaagaggtttcagaaacacaacacgggacaatcttaataaaagttgagtataaaggcgaggatgcgccctgcaaaataccattttcaacagaggatggtcaaggcaaagcacataatggtcgcctcataaccgccaatccagtagtcaccaagaaagaagaacccgtaaacattgaagcagaaccaccctttggagaatctaatatagtaattggcataggtgataaagcattaaaaatcaactggtacaagaaagggtcaagcattggaaaaatgtttgaggccactgcacggggcgcaagacggatggcaatactcggagatacagcatgggatttcgggagcgtaggcggagtgctcaacagtctagggaaaatggtgcatcaaatttttggttccgcttatacggctttattctcaggggtatcttggataatgaaaattggcataggtgtacttttaacatggataggacttaattcgaaaaatacaagcatgtcattttcttgtatagtaataggaattatcaccctctatttaggggcagtagtacaagcagacatgggttgcgtaatcaactggaaaggcaaagaattaaaatgcggatctggaatatttgttactaatgaagtgcacacatggaccgaacagtataaattccaggcagatagccctaaacgtcttgcaacggcaattgctggtgcctgggaaaatggagtgtgtggcattagaagcacaacgcgaatggagaatttgttatggaaacaaattgcgaatgaattaaactacatactctgggagaataacattaaactaactgtagtagttggcgatataatcggcgttttggaacaaggaaaaagaacactaacaccccaaccaatggatctcaaatatagctggaaaacgtggggaaaagcgaaaatagtgactgctgagacacagaatagttcatttataatcgacggacccaatacacccgagtgcccatcagcgagccgcgcttggaatgtatgggaggtggaggactacggctttggagtattcactacaaacatatggcttaaacttagggaaatgtacacacaattatgtgatcacaggttaatgagcgctgcagtcaaagatgaacgagctgtccacgcagatatgggctactggatcgaaagtcagaaaaatggaagctggaaattagaaaaagctagtctaatagaggttaaaacttgcacatggcccaaaagccacaccttatggagtaatggagttcttgaatcagatatgattatacccaaatcattggctggtccggtaagccaacacaactacagaccggggtatcatacccagacagccggcccatggcatttaggaaaattagaactcgactttaactattgtgaaggcacgaccgtggtaatcactgaaaattgtggaacgcgtggtccatcgctacgaacaacaactgtatcaggaaaactaatccatgagtggtgttgtcggagttgcacattaccacctcttagatatatgggagaagatggctgctggtatggcatggaaatacgtcctataaacgaaaaagaagagaatatggtgaagtccttagtttcagctggttcaggaaaggtagataactttacgatgggcgtattatgcttggccatactatttgaagaagtaatgaggggtaaatttggtaagaaacacatgatagcaggcgtattgtttacgtttgtattgctgttatctggtcagataacatggagagacatggcgcgtactctgatcatgatcggtagcaatgcatccgataggatgggcatgggcgtaacatatttggctttaatagctacattcaaaattcaaccattcctggcactaggtttctttttaagaaaactaacctcaagggaaaacttattattaggcgttggactagcgatggcgacgactcttcaattaccagaggatatagaacaaatggctaatggcatagctctcggcctaatggcattaaaactaatcacacaattcgaaacttatcaattatggacagctttagtcagcttgatgtgtagcaacacgatgttcacactcaccgtcgcatggagaaccgcaactttgattttagcagggatatccttattgcccgtctgccagtcatcaagtatgagaaaaacagactggctaccagttacggttgcagccatgggagttccccctctgcctctgtttatatttagtctaaaagatacactcaagagaagatcgtggcccctcaatgagggagtaatggccgtgggactggtatcaattctcgccagttctttattaagaaacgacgtacctatggctggcccgctcgtcgctggtggccttctaatcgcttgttatgtgattacgggcaccagtgccgacctaacagtagaaaaagccgcagatgtaatttgggaggaagaggcagaacagaccggagtgagccacaacttaatgattacggttgacgacgacggcacaatgagaatcaaagatgatgaaactgaaaacatcttaacagtattactaaaaacggcattgctaatagtttcgggcatttttccctactcgattccggcaactctattggtgtggcatacgtggcaaaaacaaacgcaacgctcaggtgttctatgggatgttcctagtcccccggaaacacaaaaagcggagctagaagaaggtgtatatcgtattaaacaacaaggcatatttggcaaaacacaggtcggtgttggagttcaaaaagaaggcgtcttccacaccatgtggcatgtaacccgaggagcagtattaacacacaacggcaaaagattagaaccaaattgggcttctgttaagaaagatcttatctcgtacggcggaggttggcgcctttcagctcaatggcaaaaaggcgaagaagttcaagtaatcgctgttgaacccggcaaaaatcctaagaactttcaaacaatgccaggtatattccaaactaccaccggtgaaataggagcgatcgctctagattttaaaccaggaacatcagggagtcccatcatcaatagggaaggcaaggtagtcggtctctatggaaacggtgtggtaactaaaaacggtggatacgtgagtggaattgctcaaacgaacgcagaaccagatggtcctacacccgagctcgaagaagaaatgttcaaaaagaggaacttaactataatggatctacacccggggagcggaaagactagaaagtatcttccagctatagtcagagaagccattaaaaggaggttacgcacgctcatactagcccctactagagttgtggcagcagagatggaagaagccttaaagggactgccgatacgataccagacaactgcaactaaatcagcccacacaggaaaagaaatagtagaccttatgtgccacgcaacatttacaatgagactactatcgcctgtgcgtgtacctaattacaatttaattataatggacgaagcgcacttcacagatccagcgtcgatagcggcgagaggatatataagtacacgagtggggatgggagaagcagcagcaattttcatgacggcgacacctccaggcaccgctgatgcattccctcaatcaaatgcccccatacaagacgaagaacgggatatacctgagagatcctggaactcaggaaatgagtggatcactgatttcgccggaaaaacggtttggttcgtaccaagcattaaagcagggaatgatattgcgaactgcctccgcaaaaatggcaagaaagtaattcaactctcaagaaagacttttgatactgagtaccagaaaaccaagctcaacgactgggactttgtagtaaccaccgacataagtgaaatgggagcaaattttaaaacagaccgggtaatagacccaagacgctgcttaaaaccagttatacttactgacggaccagaaagagtaatccttgctggaccaatgccagtaaccgtcgcgtctgcagcacaacgaagagggcgagtgggtagaaacccacagaaagagaatgaccagtatatatttaccggacaaccattaaacaacgacgaagaccatgcacattggacagaagctaaaatgttactagataatatcaacactcctgaaggaatcatcccagcgctgttcgagccagaaagagagaagagtgccgccatcgacggagagtatcgcctaaagggagaatcacggaaaacctttgtggagttaatgaggagaggagacctcccagtctggcttgcacataaagttgcatcggagggaataaagtacaccgatagaaagtggtgttttgatggagagaggaacaatcaaatattagaagaaaacatggacgtagagatatggacgaaagaaggagagaagaagaaactacggccacgctggcttgatgccagaacgtatagcgatccgttagcactgaaggagtttaaagatttcgccgcaggtagaaagagcatagcgcttgacttggtgacagaaatcggtcgggttccaagtcatctggcacacagaactagaaatgcattggataatttagtaatgttacatactagcgaacatggaggtagagcctatagacatgcggtggaagaattaccagaaacaatggaaacactgctattactcggtttaatgattttattaaccggaggtgctatgttattcctaatatcaggcaaaggaatcggtaaaacttccattggtttaatctgcgttgtcgcttcaagtgggatgttatggatggcagatgtacccctacaatggatagcatcggcaatagtcctagagttctttatgatggtattactaattcctgaacctgaaaaacaaagaacaccccaggacaatcagttagcatacgtagtaataggtatattaaccctagcagcaatagtcgcagcaaacgaaatgggactactcgaaaccacaaaaagagacttggggatgagcaaagaacccggtgttgtttcgcctacttcttacttggacgtggatttacatccagcgtcagcttggactttatacgcagtcgccactactgtaataacgccgatgctgaggcacactattgagaactccactgcaaacgtctccctagcggcaatcgcaaaccaagcagttgtacttatgggccttgataagggatggcccatttcgaagatggatctaggggtaccattactagcactaggatgttattcccaagtgaatccactcaccttaacagcagcggtcttactattagttactcattatgcaattattggacctggattacaagccaaagccacaagagaagctcagaaaagaacagcagcaggtataatgaagaatcctacggtagacggaatcatgacaattgatctagacccggtaatctatgatagcaagtttgaaaaacaacttgggcaagtaatgctcctagttctatgcgctgtccaattgcttctaatgagaacgagttgggcattttgtgaggccttaactcttgcaaccggacctataacgacgttatgggaaggatcaccgggtaaattctggaacacgacaatagcagttagcatggcaaacatattcagaggatcgtacctggccggcgctggcctcgctttttcgataatgaaaagcgtaggcacgggtaaacgaggaacgggatcccaaggtgaaactttaggagaaaaatggaagaagaaactaaatcaattaagcagaaaagaatttgatctttataagaaaagcggtataacagaagtagaccgtacagaagcgaaagaaggattgaaaagaggtgagatcacgcatcacgccgtgtcacggggcagtgcaaaactacaatggtttgtagagagaaacatggtaataccagaaggcagagtaattgaccttgggtgtggacgaggtggttggagttattattgcgcgggattgaagaaagtgacggaagtgcgagggtacacgaaaggtggtccgggccacgaagaacctgtgccaatgtcaacctatggatggaacatagtcaaattgatgagtggtaaagatgtattctacctgccacctgaaaaatgcgacacactactatgcgatataggcgaatcgtcgccttctccaaccgtagaagaaagcagaacaatcagggtcttgaaaatggtagaaccctggttaaagaataatcaattttgtatcaaagtactgaacccatatatgccaacggttattgaacacttagaacgtctacaacgaaagcacggcggaatgctagtaagaaacccattgagccgaaactcaactcacgagatgtattggattagtaacggaaccggtaatatcgtatcatcagtaaatatggtatctagactattgttaaacagattcactatgacacatagacggcccacgatagagaaggatgtggatctaggtgcgggtactagacatgtaaatgcagaacccgaaacgcctaatatggacgttataggagaacgtattaggagaatcaaagaggaacattcatcgacatggcactatgatgaagaaaatccgtacaaaacttgggcgtaccatggtagttatgaagtaaaagcgacaggttcagcttcttcaatgataaatggagttgttaaactccttacaaaaccgtgggacgtagttccgacggtaacacaaatggccatgactgacacaactcctttcggccaacaacgagttttcaaagaaaaagttgatacacgcactccaaggccaatgccaggaacaaggaaagcaatggagataacagcagaatggttatggcgtactctaggccgaaataaacgcccaagattgtgtactagagaggagttcacaaagaaagtgagaactaacgccgcgatgggcgccgtgtttacggaggaaaatcagtgggattcggctagagctgccgtagaggacgaggagttttggaagctagttgatcgtgagagagagctacacaaattaggcaaatgtggatcatgcgtatataatatgatggggaaaagagaaaagaagttaggcgaatttggtaaagcaaaaggatctcgagcgatatggtatatgtggcttggagcacgatatttagaatttgaggcactcggatttttaaatgaagatcactggtttagtagagaaaactctttttcaggcgtagaaggtgaaggcttgcataaactaggatatattttaagagatatctccaaaataccagggggagctatgtatgctgatgatacagcagggtgggatacacgaataacagaagatgatttacacaatgaggagaaaataactcaacaaatggacccggaacacagacaattggccaatgctatattcaaattaacataccaaaacaaagtagtaaaagtacaacgtccgacaccaaaaggaacagttatggacatcatatcgcggaaggaccaaaggggttcaggacaggtcggaacatatgggctaaatacctttaccaacatggaagtgcagctgattaggcaaatggagggagaaggtgtattatctaaagctgacttagaaaacccacatctattagaaaaagaaatcactcaatggttggaaacgaagggggtcgaaaggttgaaaaggatggcaatatcaggggacgattgcgtagtaaagccaatagacgaccgatttgctgacgcgctgctcgcattgaacgatatgggaaaagtacgaaaagatataccacagtggcaaccttctaaaggatggcatgactggcaacaagtaccgttttgcagtcatcattttcatgaacttataatgaaagatggcagaaaattagtcgtaccttgtcgccctcaggatgaattgataggcagagcacgtatatcacaaggagccgggtggtctctaaaagaaactgcctgcttgggaaaagcatatgcacagatgtgggctttaatgtattttcatcgacgcgatctgaggttggcaagcaatgcaatctgtagtgcagtacctgtacactgggttccaaccagtcgtacaacgtggtcgattcacgcacaccaccaatggatgacgactgaagacatgttgacagtatggaatcgagtttggatagaggataacccctggatggaggataaaacgcctgtaactacttgggaagatgtcccttatctcggaaaaagagaagatcaatggtgtggctcactaatcggattggcctcacgggccacctgggcgcaaaacatcctgacagccatccaacaagtacgcagtttaattggaaacgaggagttcctagactatatgccaagtatgaaacgattcaggaaagaagaagaatcagaaggtgcaatctggtaa

SEQ ID NO: 23518 - RNA, 9873 nt, synthetic construct
  misc_feature 1..9873: note = derived and/or modified CDS sequence (opt6) from DENV-3__KC762684__SS-prME
  source 1..9873: mol_type = other RNA
accagcctttgcctaatgatgatgttaccagcaacactagcatttcatttgacgtctcgggatggagaacctcgcatgatagtagggaaaaacgaaagaggaaaaagtctattatttaaaaccgctagtggaatcaatatgtgtactttgatagctatggatcttggagaaatgtgcgacgacactgtaacatataaatgtccactaataacagaagtagaacctgaagacattgattgctggtgtaatcttacatcaacctgggtgacttatgggacgtgtaaccaagctggagaacataggagggacaaaagatccgttgcattagcgcctcatgtaggtatgggccttgacaccagggctcaaacgtggatgtcagcggaaggagcatggagacaagtcgaaaaagttgaaacatgggcatttagacatcctggatttacaatccttgccttatttctggcccattatattgggacaagtctgacccaaaaagtagttatattcatattgttaatgctagtaaccccttcgatgactatgaggtgtgttggcgtaggcaatagagatttcgttgaaggactctcaggagcgacatgggtagatgtggttttagaacatggaggttgcgtaaccacaatggcgaaaaacaaaccgacactagatatagaactacagaaaactgaagcaactcaactcgcaacactgaggaaactatgcatcgaaggtaaaataacaaacgtaacgactgattccaggtgtcccacccaaggagaagcaatattacccgaagaacaagaccaaaactacgtctgcaaacacacgtacgtagatagaggatggggaaatggatgcgggttatttggtaaaggatctttagtaacgtgtgcaaaattccaatgtctggaactaatagaaggaaaagtagtacaacacgagaatctgaaatatacggtttctattacagtccacactggtgatcaacaccaagttggcaatgaaacacagggggtcacagcagagataacacctcaggcttcaacagtcgaagctatactacccgagtatggaacattaggtctagagtgctcaccacggactggattagatttcaacgaaatgattctactaacaatgaaaaacaaagcgtggatggtccacaggcaatggttctttgatctacccctaccatggacatcgggtgctacaacagaaactcccacttggaataagaaagaattattagtcacttttaaaaacgcccatgccaagaaacaagaagtcgtcgtactcggcagtcaggagggtgccatgcatactgcattgactggtgctacggaaatacaaaccagcggagggacatccatattcgcaggacacttgaagtgtcgattaaagatggataagctagaactcaaagggatgagttatgctatgtgcagtaacgcattcgtacttaaaaaggaagtatcagaaacacaacatggaactattttaataaaggttgaatacaaaggtgaggacgcaccctgcaagatacctttttcaaccgaagacggtcaaggtaaagcacacaatggaagattaatcaccgcgaatcctgttgtgactaagaaagaagaaccagtaaacatcgaagcggaacctccatttggcgagtccaatataattataggaatcggagataaagcactgaaaatcaactggtataagaaaggcagcagtatcggaaagatgtttgaagcaacggcccgtggagcccgtcgaatggcgatactaggtgacacagcatgggattttggcagtgtaggaggagttctgaatagtttaggaaaaatggttcatcagatatttggcagtgcctatactgctctatttagtggagtgtcgtggatcatgaaaatcggtattggtgtccttctcacttggataggccttaattcaaagaacacttcaatgtcattctcatgtattgtaatcggaataatcaccctataccttggggcggtggttcaagccgatatgggatgtgttattaattggaaagggaaagaacttaaatgcggcagtggtattttcgtgacgaacgaagttcacacatggaccgaacaatataaattccaagctgattcaccaaaacgactagccacggctattgctggagcatgggaaaacggagtatgtggtattaggtcaacgaccagaatggagaacctgttatggaagcagatagccaatgagctaaattacatattatgggaaaataatataaaattgacagtagttgttggcgatattataggaatactggagcaaggcaaacgcacattaactccgcagccaatggagttgaagtattcatggaaaacatggggaaaggcaaagatagtcacggctgagatgcagaatagtagtttcataatagacggcccgaataccccggaatgtcctaatgcgtctagagcgtggaatgtttgggaggtagaagactacggttttggagtattcacaacaaacatatggctaaaattacgggaaatgtatactcagctatgcgatcatagattaatgtccgccgcaattaaagacgaaagagccgtacatgcagatatgggttactggatcgaatcgcagaaaaacggcagttggaagctagaaaaggcttcgctaatcgaagtcaagacatgtacatggccaaaatctcacacgttgtggtcaaatggcgtactagaaagtgatatgattatacctaagtccttggccggaccaattagtcaacacaactatcgacctggataccatacgcaaaccgcaggaccatggcatttaggcaaattggaattagattttaattactgtgaaggcacaaccgtagttatcaccgaaaactgcggaacccgaggtcctagtttgcgcaccacaacggtttcaggaaaacttattcatgaatggtgctgcagatcgtgtaccctacctcctctaagatatatgggagaagatggatgttggtatggtatggaaataagacccataaatgaacgagaggaaaatatggtcaagtcattagtaagtgctggctcaggaaaagtagataatttcacgatgggcgttttatgtttagccattttattcgaagaagtaatgaggggtaaattcggcaagaaacatatgatagctggcgtattctttacttttgtactactattgtcagggcaaataacgtggcgtgatatggcaagaactcttataatgatcggttcaaacgcttcagaccggatggggatgggagtcacgtatctcgcacttatagcaacttttaaaattcagccttttctagcactcggctttttcctacgaaaactgacctcgcgagaaaacctgcttctaggcgtaggactagctatggcaaccactctacaactcccagaggatatcgaacaaatggcgaatggtatagcactgggattgatggccttgaagttagtcactcaattcgagacatatcaattatggacagcgttagtttctttgatgtgctctaataccattttcactcttacagtcgcatggcgaacggccactctgatcttagccggaatttcgttattaccgttatgccagtctagtggaatgagaaagacagactggttaccgatgacggttgccgctatgggcgtcccgccattacctctatttatctttagtctaaaggatacactcaagaggaggagctggccactaaatgaaggagttatggctgtggggcttgtatccattttagcctcaagtttattgcgaaacgatgtacctatggctggaccactggtagctggtggattactcattgcatgttacgtaattacgggaacgagcgctgatctaacagtcgaaaaagcggctgacgtcacgtgggaagaagaggcagagcagactggtgtaagccataatctgatgataactgtagatgatgacggtactatgcggataaaagatgatgaaactgaaaatattctaacggttctcctgaaaacggctttgctaatagtttctggcatattcccttactcaataccagcaacgttacttgtatggcacacttggcaaaaacaaacgcagcggtccggcgtactgtgggacgttccatcgcctcctgaaacacagaaagcggaactggaagaaggtgtctataggataaagcaacaagggatattcggaaagactcaagtaggagttggagtccaaaaagaaggcgtttttcatacaatgtggcatgtcactagaggtgcagtactaacatataacgggaaaagactagaacctaattgggcatccgtcaagaaagatttaatctcgtacggaggcggatggcgactaagcgcacaatggcagaaaggggaagaagtacaagttatcgcagttgaaccgggcaaaaatcctaagaatttccaaacgatgcccggtatcttccaaacgacaacaggcgaaatcggcgcaatagccttggattttaaacccgggacctctggtagtccgatcatcaatagagaagggaaggtggttggactatatgggaatggagtcgtaactaagaacgggggttatgtatcaggaatagctcagacatctgcagaaccagatggacctacgccagaattagaagaagaaatgtttaagaaacgaaatttaactattatggacttgcatccaggaagcggaaaaacaaggaaatatctaccagccatagtgagagaagcgataaaaagaagattacgaacattgatcctagcgccaacccgtgtagtcgctgctgaaatggaagaagcgttgaaagggctgcccataagatatcaaacaacagccactaaatcggaacacactggcaaagagattgtagacctaatgtgtcatgctacatttacaatgaggttactaagcccagtacgtgtaccaaactacaaccttattatcatggacgaagcacatttcacagaccccgcaagtatagctgcgagaggatatataagtacaagagtaggtatgggcgaagccgcggcaattttcatgactgctactcctcctggaacggcagatgcttttccgcagtcaaacgccccaatacaggacgaagaacgagatataccagaacggtcttggaatagtggaaacgactggattacagactttgctggaaagaccgtatggtttgtcccgagtatcaaggcgggtaatgatattgcaaattgtctacgcaaaaatggaaagaaagtcattcaattatcacgaaaaacattcgacacagaatatcagaaaacaaaactgaacgactgggatttcgtagtaaccacagatatcagtgagatgggagctaattttaaagcggatcgtgttatagacccacgtagatgtttaaaacccgtgattctaacggacggaccggaaagagtaatactagcagggccaatgccagtaacggtagcaagtgccgctcaaagaagaggcagagtaggcagaaatccacaaaaagaaaacgatcagtatatattcacaggacaaccactcaataacgacgaagaccacgctcattggactgaagcaaagatgctcctcgataatattaacacacctgagggtatcattcctgcattattcgaacctgagagagagaaaagcgcagctatagatggtgagtatagactaaaaggtgagagtcgtaaaacttttgtagagttaatgagacggggtgacttaccggtttggcttgcacataaagtagcatcagaaggtattaaatacacagatcggaagtggtgttttgatggcgagagaaacaaccaaatcctcgaagaaaacatggacgtcgaaatctggacaaaagaaggtgagaaaaagaagttacgaccaagatggcttgacgcccgtacttattcagatccattagcgttgaaggaatttaaggatttcgccgcgggaaggaagtcaatagctctcgatctagttacagaaattgggagagtacctagccatttagcacatagaactagaaacgctctagataatttagtaatgcttcatacgagtgagcacggagggagggcataccgtcatgcagtagaagaactaccagagacaatggaaacactcttacttctgggattgatgattcttcttacaggaggagttatgttatttttaatttccggtaaaggggttggtaaaacctctataggtttgatatgcgttgtagcatcgagcagtatgttatggatggcagatattcccttgcaatggatagcatcagctatagtattagaatttttcatgatggtattactaattccagagccggaaaagcaaaggacgccacaagataaccaactagcttatgtagttatcggaatcttaactctagcagcaattgtcgctgctaacgaaatgggcttgttagaaactacaaaaagggacttaggaatgtcaaaagagccaggtgtcgtcagtccaacaagctacctggacgtggatctacacccagcatccgcatggactctttatgcagtggcaacgactgttatcaccccaatgctaagacatacaatagaaaacagtacagctaatgtaagtttagcagcgattgctaatcaagccgttgtgttaatgggtcttgataaaggatggccaatttcgaaaatggacctaggtgtacccctattggccttaggctgctacagccaagtaaacccgctcacactaactgcagcagtattgcttctcgtcactcattacgcaattataggtcccggattacaagctaaggctacaagagaggcacaaaagcgaactgcagccggaattatgaaaaaccctactgtagacgggataatgacaatagacttagatccagttatttatgatagtaaatttgaaaaacagctgggtcaagtgatgctactcgttttatgtgcagttcaactactactaatgagaaccagttgggcattctgcgaggctctaacacttgcaacaggcccgattacaacgttatgggaagggtctccaggtaagttctggaatacaacaatagctgtgtctatggctaacattttcagaggttcatatctagcaggcgcaggacttgcgttttccataatgaaaagcgtagggacgggaaaaagaggaactggaagccaaggagaaactttaggagaaaagtggaagaagaaactaaaccaactatctagaaaggaatttgatctgtataagaagtctggaattactgaagttgacagaacagaggctaaagagggactaaaacgaggcgaaattacgcatcatgcagtcagccgaggatccgcaaagctacaatggttcgtggagaggaatatggtcatcccagaaggacgcgtaatagatttgggatgcggaaggggaggctggtcctattattgcgcagggctgaagaaagttacagaagtcagaggttataccaagggtggtcccggacacgaggaacccgtacccatgagtacttacggatggaatatagtgaagctcatgtctggtaaagatgttttctacttgccaccagaaaaatgcgacacactattatgtgatataggtgaatccagtccttctcccacagttgaggaaagtcgaactataagggttctaaaaatggtagagccgtggcttaagaataaccaattttgcataaaggtattaaacccttatatgccagcggtcattgaacatctagagcggctacagcgcaaacatggaggcatgctagtaagaaacccactgtccagaaactcaacacatgagatgtattggatatcaaacgggacaggaaatatagtgtcttcagtgaatatggttagcagattactgctgaacagatttactatgacatacaggcgccctactatagaaaaagacgttgatctaggggctggcacacgacatgtaaatgctgaaccagaaactccaaacatggatgtgataggagagagaataagaagaataaaagaagaacactcctctacatggcactatgacgatgaaaatccatataagacatgggcttaccatgggtcctatgaggtaaaagcaacaggatcagcttcgagcatgataaatggcgtagttaaactactaacaaaaccatgggacgtggttcctacagttacacaaatggctatgactgacactaccccctttggacaacaacgtgtcttcaaagagaaagtggatacaaggacgccaaaaccaatgccagggacacgaaaagtcatggaaataacagcagaatggttatggagaaccttaggacggaataagagacctcggttgtgcactcgtgaagagttcaccaagaaagtgagaacaaacgccgcaatgggagcagtattcacggaagaaaaccaatgggatagcgcacgcgcggcagtagaagacgaagaattttggaaattagtggatcgagaacgagaattacataaactaggaaaatgtggtagctgcgtatataatatgatgggtaagagagagaagaaactcggtgagttcggaaaagcaaaaggcagtcgagcgatttggtatatgtggctaggagcgaggtatttagaatttgaggctttaggattcctaaacgaagaccattggtttagcagagaaaactcttacagtggtgtggaaggggaaggtttgcacaaactgggatatattcttcgagacatatccaaaataccaggcggagcaatgtacgctgatgatacagcgggatgggataccagaattaccgaagatgacctccataatgaggagaaaattactcagcaaatggatccagaacatcgacaacttgccaatgcaatatttaaattgacttatcagaataaagtagtgaaagtacagcgaccaaccccaaaaggaaccgtaatggatattatctcacggaaagaccaaaggggatcgggacaagttgggacatatggcttaaatacgtttacgaatatggaggcacaattgataaggcaaatggagggagaaggagttttgtctaagacagatttggaaaatccgcatttactagagaagaaaataacacaatggttagagaccaaaggagtggaacgcttaaaaagaatggccatctcaggagacgattgcgtagtaaaacccatagacgaccgcttcgcaaatgcgttattggcgttgaatgacatgggcaaagtgcgcaaagatatacctcagtggcaaccctcaaaagggtggcacgattggcagcaagtacctttttgttcacatcactttcatgaattgataatgaaagacggacgcaaactggtggtgccgtgccgaccacaagacgaacttatcggtcgcgctaggattagccaaggtgcaggttggtcattaaaagaaaccgcatgcctcggaaaggcttacgcgcaaatgtgggctttaatgtattttcatcgacgggatctgcgtttggcaagtaatgctatctgctcagctgtgccagtacattgggtaccaacaagcagaaccacatggtcgatacacgcacatcaccaatggatgactacagaggatatgcttactgtatggaaccgggtttggattgaagacaacccatggatggaggacaaaacaccagtcacgacctgggaggacgtaccttatctaggcaaaagagaagatcaatggtgtggatctcttataggactaacctctagagctacctgggcccaaaacatactaaccgcaatacagcaagtacgaagcctaataggcaatgaggagttcctagattatatgccatcgatgaagagatttaggaaagaggaggagtctgagggtgctatatggtaa

SEQ ID NO: 23519 - RNA, 9873 nt, synthetic construct
  misc_feature 1..9873: note = derived and/or modified CDS sequence (opt6) from DENV-3__KC762686__SS-prME
  source 1..9873: mol_type = other RNA
acaagtctatgcctaatgatgatgcttccagcaacgttggcattccatctgacctcacgagatggtgaaccaagaatgatcgttggtaaaaatgaaagaggaaagagcttgcttttcaaaacagcatctggtattaatatgtgtacactgatagccatggatttaggtgaaatgtgtgacgataccgttacatacaaatgccctctaattaccgaagtagaacctgaagacatagactgttggtgtaatctaaccagcacctgggtaacttatggcacttgcaaccaagcaggagaacacaggcgcgataaaagatccgtagctctggctcctcacgttggtatgggattggacactcgagcacaaacgtggatgtccgcagaaggagcatggcgacaagtcgaaaaagtagaaacatgggcatttcgtcacccagggtttacgatattagctttattccttgcacactatataggtacaagtttgacccaaaaagtagtcatattcattctgctgatgctagtcaccccttccatgacgatgagatgtgtaggtgtaggcaatcgcgattttgtcgaaggtttgtcaggcgcgacttgggttgatgtagtattggaacatggtggatgtgtaacaacaatggctaaaaacaaacctaccctcgacatcgaactacagaaaacagaagcaacacagttagccactctacgcaaactctgcattgaagggaaaataacgaatgtcactacagattcacgatgtcctacacaaggagaagctatactgccagaagaacaagaccaaaactatgtatgcaaacacacatatgtcgatagaggatggggaaatgggtgcggtttattcggaaagggtagtctcgtaacctgcgctaaattccaatgtctcgaatttatcgaaggtaaagtagtacaacacgaaaacttgaaatatacagtgattataacagtacatacgggagatcaacaccaagtaggtaatgaaacacaaggagtaacagcagaaataacccctcaagctagcactgttgaagccatactaccagaatacgggacacttggattagaatgcagtccacgcactggtcttgatttcaacgagatgatactgttgactatgaaaaataaagcctggatggtacataggcaatggttcttcgatctgccattaccatggaccagtggtgccacaaccgagacacctacttggaataaaaaggaattactcgtaactttcaaaaatgcgcatgcgaaaaagcaagaggtagtagttctcggttcacaagaaggtgcaatgcataccgcactcacaggggcaactgaaattcaaacatctggtggaacctcgattttcgcgggtcatcttaaatgtagattaaaaatggataaattggaactgaaaggcatgtcttacgccatgtgtctgaacgcttttgttctaaagaaagaagtgagtgagactcagcatggaacaattcttatcaaagtggaatataaaggagaagatgcgccatgtaagatcccatttagcacagaagacggtcaaggaaaagcacataatggacgtctaatcacagccaaccccgttgttaccaagaaagaggaaccaattaacatagaagctgaaccaccattcggggaatcgaatatagtaattgggatcggcgataaagcgttaaaaataaattggtacaagaaaggttcatcaataggtaaaatgtttgaggcaacggcaaggggagctcggcgcatggcaatattaggcgacactgcatgggacttcggaagtgttggaggcgtgcttaattctttaggaaagatggtacaccaaatctttgggtccgcgtatacagcattattttctggtgtgtcttggatcatgaagatcggaattggggtactgttaacatggatcgggctcaatagtaaaaatacatctatgagcttctcatgcatagtaataggtatcataactctttacctaggggcagttgttcaagctgatatggggtgcgtaatcaattggaaaggaaaagagctaaaatgtggcagcggaatttttgttactaatgaagttcatacttggaccgagcaatacaagtttcaggcagactcacctaaaagattagcaactacgatagcaggcgcctgggaaaatggcgtttgtggtatacgtagcacaacacgtatggaaaaccttctatggaaacaaattgcaaacgaattaaactatatactatgggaaaacaacataaaactaaccgttgtagtaggggatataataggtgtgcttgaacaaggaaaaaggacgttaacgccacaacctatggaacttaaatatagctggaaaacatgggggaaagccaaaattgttacagcagaaacacagaactcctcatttataatagatgggcctaacacgccggagtgtccatccgcttctcgggcatggaatgtatgggaggtagaggattacggatttggtgtatttactactaacatttggctcaagctaagggaaatgtatacgcagctatgtgatcataggctcatgagcgcagcagtaaaagatgaaagggctgttcatgcagatatggggtactggatagaatcacagaaaaatggatcgtggaagttagagaaagcgtctttgatagaagtcaaaacatgtacgtggcccaaaagtcataccctttggagtaatggagtcttagaaagtgacatgataataccaaaatcactcgcaggaccagttagtcaacacaatcatagaccagggtatcacactcaaaccgctggaccctggcatttaggtaaactagagcttgattttaattattgcgaaggaaccactgtcgtaatcactgagaattgtggtactagagggccatcactaagaacaacaacagtcagtgggaaattaattcatgaatggtgctgtagatcctgtacgcttccacccttacgttatatgggagaagatgggtgttggtatggaatggaaataaggccaatcaatgaaaaggaggaaaacatggtaaaatcgcttgttagtgcaggtagcggaaaggttgataatttcaccatgggtgtattgtgcctagcgattctcttcgaagaagtaatgagaggtaagtttggcaagaaacatatgatcgccggtgtactcttcacttttgtattattactatctggccagatcacgtggagagatatggcacgtacgctgataatgataggatctaacgcatcagatagaatgggaatgggagtaacatatctagcccttatcgctacctttaaaattcaaccgtttctagctcttggattcttcctaagaaaattaacctccagggaaaaccttttattgggagtaggtttggcaatggccaccacattacaactaccagaggatatagaacaaatggcaaatggcatagctttaggtctgatggcattaaaactaatcacacaatttgagacataccaattatggacagccttagtaagtttaatgtgttccaacacaatattcactctcacggttgcgtggcggacagctacgctgatactagcaggaattagcttattaccagtttgccagagttcatcaatgcgtaaaacagattggttacccgtaaccgtggcagctatgggagttccgcccctacccctctttatcttttccttaaaagacactcttaaaagacgatcctggcctcttaatgaaggtgtgatggcagtaggattagtgagtatactagcgtcatcactactacgaaacgatgttccaatggcaggcccgttagtagctggtggattattaatagcatgctacgttattacaggaacttcagcagatttgacagtagaaaaagcagcagatgtaatatgggaagaagaagctgaacaaacgggggttagtcataatttaatgattactgtagacgacgatggaacaatgagaattaaagatgacgaaacagagaacatattaacagttcttctgaaaacggcgctcttaatcgtgtctggaatatttccctattcgatccctgctactttgctagtatggcacacttggcaaaaacagactcagagatctggagttctgtgggatgtcccctcaccaccagaaacacaaaaggcagaactcgaagaaggcgtttacagaatcaaacaacagggtatatttggtaaaacacaagtgggagttggggtccagaaagaaggtgtgtttcatacaatgtggcatgtcactcgcggtgcagtactcactcataatggcaagagacttgaacccaattgggctagcgttaagaaagacctaatttcgtatggagggggatggagactatcggcgcaatggcaaaaaggagaagaggttcaggttatagccgttgaaccgggcaaaaatcctaaaaactttcagaccatgcccggtatatttcaaactacaactggggaaataggggctattgcattagactttaagccaggaacatctggttcacccataattaatagagagggaaaagtagtcggcttatacggtaatggggtagttacgaagaatgggggatatgtcagcggtatcgctcaaaccaatgctgaaccagacggtcctacaccagaattagaagaagaaatgtttaaaaagcggaatttgacgattatggatctacacccaggaagcggcaaaacacggaaatacctaccggcaatcgtacgtgaagccataaaacggcggttaaggactctcatattggctcccaccagagtcgttgcagcggaaatggaagaagcacttaagggactacctataagatatcagacaacagctactaaatcggcacatacaggaaaggaaatagttgacttgatgtgtcatgcaacatttaccatgagactcttatcaccggtacgagttccgaattacaatcttataattatggatgaggcacacttcacagaccctgcttctatcgcagccagaggttacatctcaactagggtagggatgggggaagcagcagcgatatttatgactgcaaccccaccaggaaccgcagatgcttttccacaaagtaatgcaccaatccaagatgaagaaagagacataccggaaagatcgtggaacagcggtaatgaatggataactgattttgcaggaaaaacagtttggttcgttcctagtataaaagccggaaacgacatcgcgaactgtcttaggaaaaacgggaagaaagttatccaattatctcgcaaaactttcgacactgaatatcagaaaaccaaacttaacgattgggacttcgtggttacaacagacattagcgaaatgggagcaaattttaaagcagacagggtcatcgatcccaggagatgtttgaaacccgtaatcttaacggatggtccagaacgcgtaatattagcaggtcctatgccggttaccgtcgcttctgcagcccaacgaagaggaagggtagggcgaaacccgcaaaaagaaaacgaccaatatatattcaccgggcaacctctaaacaacgacgaagaccatgcacattggactgaagcaaaaatgcttctcgataatatcaacacaccagaaggaattatacctgctctatttgagccggagcgagagaaaagtgcagcaatagacggagagtacaggttaaagggagaatcccgtaagacattcgtcgaactaatgagaagaggagacttacctgtatggcttgctcataaagtggcatcggaaggaattaaatatacagaccggaagtggtgtttcgatggcgaaagaaacaaccaaattttggaagaaaatatggatgttgaaatttggacgaaagaaggtgagaaaaagaagctaaggccacgatggttagacgcgcgtacctattcggacccattagcattaaaagaatttaaagactttgctgccgggagaaaaagcattgccttagatttagttacggaaatcggtcgcgtccctagtcatcttgcgcacaggacaagaaacgcccttgacaatcttgttatgttgcatacctccgaacacggcgggagggcctacagacatgcagtagaagaattaccggaaactatggaaacactattgctactcggattaatgatcttattgacagggggagctatgttattcttaatatcggggaaaggaataggtaaaacctcgatcgggctaatatgcgtagtggcatcaagtggcatgctctggatggctgacgttccactgcaatggatagcaagtgccatcgtgctggagttcttcatgatggttttattaataccagaacctgaaaaacaacggacaccccaagataatcagttagcatacgtcgtgataggtatactaactttagctgccattgtagccgcaaacgaaatggggctcttggaaactacgaaaagagatctaggtatgagcaaagagccgggagttgtaagtccgaccagctatctagacgtagacttacatcccgccagtgcatggacattatatgcggtagcaaccacagtaatcacgcccatgctaagacacaccatagagaactcaactgccaacgtatcactagcagcgattgctaatcaagctgttgtactgatgggactcgataaaggatggccgatatcaaaaatggatctgggagtacccctacttgcgttaggttgctatagtcaagtaaatcctctcacactaactgcagcggtgttattattagtgacacattatgcaattatcggtcctggtttacaagctaaagccacaagagaagcccagaaacgcaccgctgcaggtatcatgaagaacccaaccgttgacggaattatgactatcgatcttgaccctgtcatatacgactcaaaattcgaaaagcagctaggccaggttatgttattagtactttgtgcggttcaactactattaatgagaacgtcctgggcgttctgtgaggctttaacattggcaaccggaccaataacgaccctttgggaggggtcaccaggaaaattctggaacacaactatagcagtatctatggctaacatatttaggggatcatatctggccggggctggtctagcattttcgattatgaaatcggtaggtaccggtaaacggggcacgggtagtcaaggtgaaacactaggcgagaaatggaaaaagaagttgaaccaattatcccggaaggagttcgacctatataaaaagtcgggaataactgaggttgatagaacagaggcaaaggagggtctaaaaagaggcgaaatcactcatcatgccgtttcaagaggctctgctaaacttcagtggtttgtcgaacgtaacatggtcataccagagggacgggtaatagaccttggctgcgggagaggagggtggagttactattgtgcaggcctcaagaaagtgacagaagtcaggggatacacaaaaggtggaccagggcatgaagaacccgttcccatgtcaacatatggctggaatattgtcaaactcatgtcgggaaaagatgtattctatctgccacctgaaaaatgtgacactctattatgtgacataggtgaatcaagcccttctcctaccgttgaagaaagcaggacaatccgagtattaaaaatggtagaaccgtggctcaaaaataaccagttttgcattaaagtactgaacccatatatgccgacggtcatcgaacatctagaaagattacaaaggaaacatggaggtatgttagttcggaatccattgtctcgaaacagtacacacgagatgtactggatctcaaatggtacaggtaatatagtttcatctgtaaatatggtatccagattactattaaatcgattcacgatgacacatcgtagaccgacaatcgaaaaagacgtggatttaggagcaggaacgcggcatgtgaatgcagagcccgaaacaccgaacatggacgttataggagaacgcatcagaagaataaaggaagaacactcatccacctggcattacgacgaggaaaatccttataaaacatgggcttatcacggttcgtacgaggtaaaggctactggaagtgcaagctctatgatcaatggagtagttaaactattaacaaaaccctgggacgtagttcctactgtcacgcagatggcaatgacggataccacaccattcggtcaacaacgcgtctttaaagagaaggtcgacacgcgaacacccagacctatgcctggaacaaggaaagccatggaaataacagccgagtggctatggcgtactcttggaagaaataaaagaccacgactatgtactcgtgaagagttcaccaagaaagtcagaactaatgctgcaatgggtgcagtattcactgaggaaaaccaatgggacagcgcaagagcagcagttgaagacgaagaattttggaaattagttgatcgagaaagagagttacataaactagggaaatgcgggtcatgcgtatacaatatgatggggaaaagggaaaagaagttaggagaatttggtaaagccaagggatctcgagcgatctggtatatgtggctaggcgctcgatatttagagttcgaggctttaggtttcctcaatgaagatcactggttcagtagagaaaacagctttagtggtgtagaaggcgaaggattgcacaagctaggttacattctgagagacatttctaaaataccaggcggtgccatgtacgcagacgacacagctgggtgggatacacggataaccgaggatgatttacacaacgaggagaaaattactcaacagatggagcctgaacatagacaattagccaatgctatatttaaattaacataccaaaacaaggttgtaaaagttcagagacctacgccaaaagggaccgtcatggacataatatcaaggaaagatcaaagagggtcaggacaagttgggacctatggattaaacacatttacaaacatggaggtacaattaatacgtcaaatggaaggagagggagtattatcgaaagcagatttggaaaatccacatttgctagagaaggaaataactcaatggttagaaaccaagggagtagagaggcttaaacgaatggctatcagtggtgatgattgtgttgtgaaaccaatcgacgatcgtttcgcggatgccttacttgctctaaatgatatgggaaaagtcagaaaagatataccacaatggcaaccatcaaagggatggcatgactggcaacaggtcccattttgtagtcatcactttcacgaactaataatgaaagacgggcgaaaactcgtggtcccatgtcgtccccaggacgagctaattggtagagcccggatatcacaaggagccgggtggtcacttaaagagacagcttgtttaggtaaggcttacgctcagatgtgggcattaatgtactttcatagacgagacctccggttggcgagtaacgctatttgcagcgcagttcccgtccattgggtgccgacaagccgaacgacctggtcaatacatgcacatcatcaatggatgacaactgaagatatgctaactgtgtggaatagagtatggattgaagataacccttggatggaagataaaactcctgtaaccacctgggaagacgtaccttatcttggtaaaagggaagatcagtggtgcggttctctaataggacttgctagtagagccacatgggcacaaaatatactcaccgcgatccaacaagtaagatctctcatcggaaacgaggaatttttagactatatgccatccatgaaaagattccgtaaagaagaggaatctgaaggagcgatatggtga

SEQ ID NO: 23520 - RNA, 9873 nt, synthetic construct
  misc_feature 1..9873: note = derived and/or modified CDS sequence (opt6) from DENV-3__KC762685__SS-prME
  source 1..9873: mol_type = other RNA
acttcgttatgcctcatgatgatgttacctgcgactttagcatttcacttgacgtcaagagacggagaaccaagaatgatagttggtaaaaatgaaagaggaaaatccctgttatttaaaaccgcgtcaggaataaacatgtgcactcttatcgcaatggacctcggagaaatgtgcgacgatacggttacctacaaatgtccgttaataacagaagtagaaccagaagacatcgattgctggtgtaatctaacaagtacatgggttacctatggaacatgtaaccaagcaggggaacatagacgcgataaacgatccgtggcactggcgccccacgtaggaatgggtctggatacccgagcacaaacctggatgtccgcggaaggagcttggagacaagtggaaaaagtagaaacttgggcgttcagacacccaggatttaccatattggcattgttccttgcacattacattggaacttcacttacacaaaaagtagtcattttcattttactaatgttggtaaccccaagcatgactatgcgttgtgtgggagtaggaaacagagattttgtcgaaggactatcaggggcgacatgggtagacgttgtcctcgaacacggcggatgcgtaaccacaatggctaaaaacaaaccaacattggatattgaactacagaaaaccgaagcaacgcaattagctactttgcgaaaattatgcatcgaagggaaaataactaatgttaccactgattcgagatgcccaacacaaggagaagccatactgccagaagaacaagaccaaaattacgtgtgtaaacatacatacgtggatagaggatggggtaacggatgtggattattcggtaaaggatcattagttacatgcaccaaatttcaatgtctagagttcattgaaggaaaagtagtccaacacgaaaatttaaaatatacagtgataatcaccgtacatactggagatcaacatcaagtaggaaatgaaactcaaggtgttacagctgaaataaccccacaagcgtctacagtggaagcaattcttccagaatatggaactctaggactagaatgctcaccgcgaacaggtctggacttcaacgagatgatacttcttacaatgaaaaataaagcatggatggtgcatagacaatggttctttgatctaccactcccttggacgagcggagccaccaccgaaaccccaacatggaataagaaagagcttcttgttacattcaaaaatgctcatgctaagaaacaagaggtagtggttcttggatcccaagaaggagcaatgcatacagcactaacaggtgcaaccgaaatccaaacgagcgggggaacttcaattttcgcaggacatttgaaatgtcgattaaaaatggacaaattagagctcaaaggtatgtcctatgcaatgtgtctaaacgcctttgttttgaagaaagaagtatcagaaacgcaacatggaacaatcctgattaaagtagaatacaaaggcgaagatgcgccgtgtaaaattccttttagcacagaagacggacaaggaaaagcacacaacgggaggttgattacagctaatccagtggtgactaagaaagaagaacccgtaaacatagaggcggaaccaccgtttggtgagtccaatatagtcatcggtataggtgataaagcactaaaaataaactggtataagaaagggtcaagtatcggaaaaatgtttgaagcaacagctagaggagctcgcagaatggctatattaggagataccgcttgggatttcggttcggtgggcggcgtgctcaactcattaggaaaaatggttcatcaaatcttcgggtctgcatatacagctttattttctggagtgagttggataatgaaaataggtataggagtacttcttacatggataggactgaacagcaaaaatacgtcgatgagtttttcgtgtattgttatcggtatcataacactctatcttggagcagtggttcaggctgacatgggatgcgtaataaactggaaaggaaaagaattgaaatgcggatcgggaatttttgttacaaacgaggttcatacatggacggaacaatacaaattccaagcagacagtcctaaaagattagctactgcaattgctggggcatgggaaaatggagtatgtggaatcagaagtacaacccgaatggaaaacctactatggaaacaaattgcaaacgaactcaattacatattgtgggaaaataatataaaattaactgttgttgtaggggatataatcggggttcttgaacaagggaaaaggacgctaacgccgcaaccgatggaattaaaatattcgtggaaaacatggggtaaagcaaagatcgtaaccgctgaaactcaaaactctagtttcataattgacggtcctaatacacctgagtgccctagcgcatccagggcatggaatgtatgggaagtcgaagactatgggttcggcgtttttacaactaacatatggctaaagctacgtgaaatgtacacgcaattatgcgatcacagactcatgtccgcagcagtcaaagatgagagggcagtacacgcagacatgggatattggattgaatcgcagaaaaatggaagctggaaattagaaaaagccagtttaatagaagtaaaaacgtgtacgtggccaaaatcgcacactttatggtctaatggcgtgctagagtccgatatgataattccaaaatcattagcaggaccggtttctcaacacaattataggccgggctatcacactcaaacagccgggccatggcatctcggaaaattagaactagatttcaactattgcgaaggaaccacagtggtcatcacagaaaattgcggaacacggggtccctccctaagaaccacaacggtaagtggaaaattaattcacgaatggtgttgtagatcctgtacattaccaccactcaggtatatgggagaagacggttgttggtacgggatggaaattagaccaatcaatgaaaaagaagagaatatggtaaagagtcttgttagcgcgggcagcggtaaagttgataacttcacgatgggagtgttatgcttggcaatactgttcgaagaagtaatgcgaggaaaattcggtaagaaacatatgatcgcgggggtattattcacttttgtattattgttaagtggtcaaataacatggagagacatggcacggactttaataatgataggaagcaatgcgagtgaccggatgggaatgggggtcacctatctggcactaatagcaacttttaaaatccaaccatttttagcattgggtttctttttacggaagttgacgagcagggaaaatcttttacttggcgtaggtctggccatggcgactactctacaactcccagaagacatcgaacaaatggcaaacgggatagccttgggccttatggcattaaaactgattacacaatttgaaacttatcaattatggactgcattagtatcactaatgtgttccaatacaatattcacgttaacagtcgcttggaggacggcaactctgatactcgcaggaatatcgctattaccagtatgtcaaagttcgagcatgagaaaaactgattggctgccggttacagtagccgcgatgggcgtcccgccgctccctttgtttatattctcactgaaagacacattaaaaagacgttcttggccccttaatgagggggtaatggccgttggccttgtgagtatactagctagtagcctattaagaaacgatgtaccaatggcaggtcccctagtggccggtggactgttaatagcatgttacgtcataaccgggacaagtgcagacctaactgtagaaaaagcagcggacgtaatctgggaagaagaggctgaacaaacaggagttagccataatcttatgataacagtcgacgatgatggtacaatgcgaattaaggacgacgaaacagaaaatatacttaccgttctgctcaaaacagccttattaatagtttctggaatcttcccatacagtatcccagcaactttgttagtatggcacacttggcaaaaacaaacacaaagaagcggggtgctatgggacgttcctagtcctccggaaactcagaaggcagaattagaagagggagtatacagaataaaacaacaaggtatcttcggaaaaacccaagtaggagtcggagtccaaaaggaaggagtatttcatacaatgtggcacgttacgaggggagctgtactgactcataacggaaaaagattagagcccaattgggcaagcgtcaagaaagacttaatatcatacggtggtggttggcgactatcggcccaatggcaaaaaggagaagaagtacaggtgatagctgtagagcctggcaaaaatcccaagaatttccagacgatgccagggatatttcagacaaccacgggagaaataggtgctatagcgctggatttcaaaccaggaacgtcaggcagccccataatcaatagagagggcaaagtagtaggattatacggaaacggagtggtaactaaaaatggtggttatgtaagtgggatcgcacaaactaatgccgaaccagatggccctaccccggaattagaggaagaaatgtttaagaaacgaaacctaacaataatggatctacatccagggagtggaaaaaccagaaagtatcttcctgctatagtgagagaagcgataaaaagaaggttgagaaccttaattttagcaccgaccagagttgtggcggctgagatggaagaagcacttaaaggactgcctattagatatcagaccacagcaaccaaatcagctcacacaggaaaagaaattgtagatctgatgtgccatgcaactttcacaatgaggcttttatcaccagtacgggttccgaattataatttgataataatggatgaagcacacttcacagaccccgcatcaatagccgctagaggctacatcagtaccagggttggtatgggagaagctgctgcaatttttatgacggcaacaccaccgggaactgcagacgcatttccacagtcaaatgcaccaattcaggacgaagaaagagatattcccgaaagaagctggaacagtggtaatgaatggataacggattttgctggaaaaaccgtgtggttcgtgcctagcataaaagctgggaatgatattgcaaactgtctaaggaagaatggaaagaaagtcattcagttgtctagaaaaacattcgatactgaatatcaaaagacaaaactgaatgattgggacttcgttgtaactacagacatttctgagatgggtgcaaatttcaaagctgatcgcgtaattgatcccagacgatgcttaaaaccagttattcttacggatggaccggaacgcgtaattttggctggaccaatgccggtaacagtagcaagtgccgcgcaacgcagaggacgcgtcggaagaaatccccagaaggagaacgatcaatacatatttacgggacaaccgttgaacaacgacgaggaccacgcgcactggactgaagcgaagatgctattagataatatcaatacaccagagggcattatccccgccttgtttgaacccgaaagggaaaagtccgcggctatagacggtgaatacagactaaaaggagaaagtcgaaagacatttgtagagctaatgcgacgaggagatttacccgtatggttagcgcacaaagtcgcgtcggagggaataaaatacacagaccgaaaatggtgtttcgacggtgaacgaaacaaccaaattctagaggagaatatggacgtagaaatatggacaaaggaaggagagaagaagaaacttcgaccgagatggcttgatgccaggacatatagcgatccactagctttaaaagaatttaaggacttcgcagcaggaagaaaaagtattgcgctagatctcgtaacagagatcggacgggtacctagtcacctagcccatcgaacacgcaatgctctcgataatttagtaatgttgcatacaagcgaacacggaggccgagcatatcgtcatgcagttgaagaattaccagagacaatggaaacattgttgctattagggttgatgatcttactgactggcggagcaatgctgtttctcataagtggtaaaggtattggaaaaacaagtatcggccttatttgcgttgttgcatcttctggcatgctatggatggcggacgtacccctacaatggatagcttcagcaatagtattagaatttttcatgatggtgctgcttatacccgaaccagaaaagcaaagaacaccacaagataaccaattagcatatgtagtaatcggaatattaaccctcgcggcgatagtagcagcaaatgaaatggggcttctcgaaacaacgaaaagggatttaggaatgagtaaagagcctggtgtagtaagcccaaccagttacctggacgtggaccttcatccagcatcagcatggactttatatgcggtggccaccacagtaattacgccaatgttacgtcacacaatagaaaatagtactgctaatgtaagtctagccgcgattgctaaccaagcagtagttctcatgggtctagataaaggttggccgattagcaaaatggatttaggtgtaccgctcctggcactaggttgctattcacaagtcaacccactcaccctcactgcagccgtactgcttttggttacccattatgcgatcatagggccaggtttgcaagcaaaagctacgagagaggcgcagaaaagaacagctgctggaatcatgaaaaatccaacagttgatggtattatgacaatagatttagatccggttatttacgactccaagtttgaaaaacagttgggtcaagtgatgcttctagtcctgtgcgccgtgcaattacttctgatgcgcacaagttgggctttttgcgaagcattaacattagctactgggccgattactacattatgggaaggtagtcctgggaaattttggaacaccacaatagctgtgagtatggcaaatatctttcggggaagttacttagccggtgcaggattagctttctcaattatgaagagtgttggtacagggaaaagaggaacaggttctcagggggagacacttggagagaaatggaagaagaaacttaatcaattatcaagaaaagagtttgacctgtataagaaatctggcataacggaagttgatcgtactgaagcaaaagaaggacttaaaagaggagaaatcacacaccatgcagtatcaagaggaagtgctaaactacaatggtttgttgaacgtaacatggtaatcccagaagggcgagtaattgatctgggatgcggtcgaggtggttggagttattattgtgcgggtctaaagaaagtaacagaagttagaggctatactaaaggcgggccaggacatgaagaacccgtgccgatgtccacctacggttggaatatcgtcaaacttatgtcaggcaaagatgtattttatttacccccagaaaagtgtgatacgttactatgcgatatcggagaatcgtcaccgtcaccaactgtggaagaaagtcgaactatcagagtcctaaaaatggtagaaccatggcttaaaaacaaccagttttgtattaaagtcctaaacccgtacatgcccacggtcatagagcatctagagcgactgcaaagaaagcatggcggaatgttggttcgtaacccactatcacgcaatagcactcatgaaatgtactggattagcaacggaacaggaaacatcgtatcatctgtaaatatggtaagcagactactgctaaataggtttactatgactcacagaagacctacaatagaaaaagacgtagacctgggagcaggcacacgtcacgtaaatgcagaacccgagacacccaatatggacgttatcggggaaagaataagaagaattaaagaagaacactcaagtacatggcactatgacgaagaaaacccgtacaaaacatgggcatatcacggatcatacgaggtcaaagcaaccggatccgcctcctcgatgataaatggtgtagttaaattgcttactaagccatgggatgtggtacccacagtaactcaaatggcaatgactgacacaactccgttcggacaacaacgtgtatttaaagaaaaagtcgacactcgtactccccgaccaatgcctggcacgcgaaaagccatggaaattacagctgaatggttgtggagaacattgggtcgcaataagcgccccagattgtgtactagagaagagttcaccaagaaagttagaactaacgccgcaatgggggcagtgttcaccgaagagaaccaatgggatagtgctcgtgctgctgtggaagatgaagaattttggaaattagttgatagagaaagagagttacataaattgggaaaatgtggatcttgcgtctataacatgatgggtaaaagagagaaaaagttaggtgaatttggaaaagctaagggttccagagcgatatggtacatgtggttaggagccaggtacttagagttcgaagcactaggattcctgaacgaagatcattggttttctagagaaaactcgttctccggagtggagggagagggcttacataaactagggtacatactacgggatatatctaaaattccgggtggtgcaatgtacgccgacgacaccgcaggatgggacacacggataacagaggacgatctacacaatgaagagaaaataacacaacaaatggaaccagaacatcggcaattagcaaatgcgatattcaaattaacttatcagaataaagtagtcaaggtccaaagaccaaccccaaaagggactgttatggatattatttcaagaaaagatcaaagaggaagcggacaagtaggaacatatggtttaaataccttcacaaatatggaagtacagttaattagacagatggaaggcgaaggtgtgttaagcaaagcagacctagagaatccccacctgttagaaaaagagataacccagtggctagaaacaaaaggagtggaacgactaaaaaggatggcaatatcaggagatgactgtgtcgtcaaaccgattgacgatcgatttgccgatgcgttattagctttaaatgatatgggcaaagttcgaaaggacataccccaatggcagccatcgaaagggtggcatgattggcaacaagtacctttttgttcacaccatttccacgagcttataatgaaagatggacgtaaattggtagtaccatgtcgacctcaagacgaattgataggtcgcgctagaatttcccaaggggctggttggtctctcaaggaaacagcatgcctaggtaaagcgtacgcacaaatgtgggcactaatgtatttccataggagagatctccgactggcatcgaacgcaatttgctcagcggtaccagtacattgggttccaacgtctagaactacctggagtatccatgcccatcatcagtggatgaccaccgaggatatgttgacagtttggaatcgtgtatggattgaagacaatccttggatggaggataaaacccccgtgacaacatgggaagacgtaccgtatttaggtaaacgagaggatcaatggtgtggtagtcttataggactggcctctcgcgcgacttgggcccagaatattttaacagccattcaacaagtgagaagtttaataggaaacgaggagttcttagattatatgccctccatgaagcgattcagaaaagaagaggaatcagaaggggctatttggtag

SEQ ID NO: 23521 - RNA, 9873 nt, synthetic construct
  misc_feature 1..9873: note = derived and/or modified CDS sequence (opt6) from DENV-3__KC762687__SS-prME
  source 1..9873: mol_type = other RNA
acgagtctctgtttaatgatgatgttaccagcaacgttagcatttcatttgacaagtcgagacggcgaaccacgaatgatagtagggaaaaatgaaagaggtaaatccctgttgtttaaaactgcttctggaatcaacatgtgcaccttgatagctatggatttaggcgaaatgtgcgacgacactgtaacctataaatgtcctttgataactgaagtggaaccagaagacatagactgctggtgtaatttaacatcaacatgggttacctatggaacctgtaatcaagccggtgaacaccgcagagacaaaagatcagtggcattggcacctcacgtaggaatgggactagatacacgtgctcaaacatggatgagtgcagaaggcgcttggcgacaagtcgagaaagtagaaacatgggcttttcgtcacccaggctttactatcttagcactgtttttagcgcattacatcggaacttctcttacacagaaagtagtaatcttcatattactgatgttagtgactccatctatgacgatgcggtgtgtaggagtaggaaatcgtgattttgtggaaggattatccggagcaacgtgggttgacgtagtactagagcatggaggctgtgtgacgacaatggcgaaaaataaacctacgctagatatagaacttcagaaaactgaggcaacacaattagcaacgctcagaaaactttgtatagaaggaaaaattaccaacgtgacaaccgactcgcgctgcccaacccaaggggaagccatactacctgaggaacaagaccaaaattacgtttgtaaacatacatatgttgataggggttgggggaacggctgtgggctttttggaaaaggttcacttgtaacctgcgctaaatttcaatgcttagagtttatagaaggaaaagtggtccaacatgaaaatctgaaatacaccgtaataataactgtacacactggggatcaacatcaagtgggaaacgaaacgcaaggcgtaactgctgaaataacgccccaagcatcaacggtagaagcaattcttcccgagtacgggacacttggactggaatgctcaccacgaactgggttagatttcaatgagatgatattactaacaatgaaaaataaagcatggatggtacaccgtcaatggttctttgatctgccattaccttggacaagtggagccactactgaaacaccaacctggaacaagaaagaacttcttgtaaccttcaagaatgcacacgccaagaaacaagaggtggtagtacttggatctcaagaaggcgcaatgcacacggcgttaactggagcgacggaaatccaaacatcgggaggaacgagtatttttgcaggtcacctgaaatgccgtttaaagatggataaacttgagctaaagggcatgagttacgcgatgtgccttaacgcgttcgtgctaaagaaagaagtaagtgaaactcaacatggtacgattctaattaaagttgagtataagggtgaggatgcaccatgcaaaattccattctcaacagaagacgggcaagggaaggcacacaacggaaggttaatcacagccaacccagtagtagtgaagaaagaagaaccggttaatatagaggcagaaccacccttcggagaaagtaatatagttattggtattggagacaaagcactgaaaataaattggtataagaaaggtagtagcataggcaaaatgtttgaagctacagcacgtggagcaaggcgaatggccattttaggcgatacagcatgggattttgggtctgtaggaggtgttctcaacagcctcggaaaaatggtacatcaaatattcgggtctgcatatacggctctgttctctggagtgagctggataatgaaaattggaatcggggtacttctaacgtggattggcctaaatagcaagaacacatccatgagtttttcctgtatcgtgataggtataattacgctatacttgggagcagtggtccaggcagatatgggatgtgttataaattggaaaggaaaagaattgaaatgtggctcaggcatttttgtcaccaatgaagtacatacctggactgaacaatacaaattccaggcggacagtcctaaaagacttgctacggcaatcgccggcgcgtgggaaaatggtgtatgcggtataagatcaaccacaagaatggaaaatcttctctggaaacagatagcaaacgaattgaactacattttatgggaaaataatataaaattaacggtcgtcgtaggagatatcatcggagtattagaacagggaaagcgcacactaacgccacaaccaatggaactgaagtatagttggaaaacgtggggaaaggcaaaaattgtaactgcagaaacccagaacagctcgtttataatagatggaccaaataccccagagtgtcccagcgcgagtagagcatggaacgtatgggaagtcgaggactacggatttggagttttcactacaaacatctggcttaaactacgtgaaatgtatactcagctctgtgatcacaggctgatgagcgctgcggttaaagacgaaagagcagtacacgctgacatgggctattggatagaaagtcagaaaaatggatcttggaaactcgaaaaagcgtcgttgattgaagtaaagacctgtacgtggcctaaatctcatacactatggagtaacggagtattggaaagtgacatgatcatacctaaatctctagccggtccggtctcccaacacaattacaggcccggttatcacacacaaactgcaggtccatggcatttaggaaagttagaacttgattttaattattgtgaaggaactactgttgtcataaccgaaaactgcggcaccagagggccatcactaagaacaactaccgtatcaggtaaactcatacacgaatggtgctgcagaagttgtacgctaccgccactcagatatatgggtgaggatggatgttggtacggcatggaaatcagaccaatcaatgaaaaagaagaaaacatggttaaaagcctggtatcggcaggatccggaaaggttgataattttacaatgggcgtactttgtttggccattcttttcgaagaagttatgcggggtaagtttggaaagaaacacatgatcgccggggtgctctttacttttgtgttattgctctccggccaaatcacatggcgtgatatggctaggacattaatcatgatcggaagtaatgcaagtgatcgtatgggaatgggtgtcacttacctagctcttatagcgacatttaaaatacaaccatttctagcattaggattctttctacgaaaattaacatcgcgagagaacctcctgttaggagtaggactcgcaatggccacaacactccaattaccagaggatattgaacaaatggctaatgggatagcactaggattaatggcattaaaattaataactcaatttgaaacttatcagttatggactgcattagtttcattaatgtgctcgaacactatattcactttaacagtagcttggagaacagctacgttaatactcgctggaatttctttattcccggtgtgccaatcaagttcaatgcgaaaaaccgactggttacccgtcaccgttgccgcgatgggagtcccaccattaccgctattcatttttagtttaaaagacacacttaaaagaagaagttggccattaaatgaaggagtaatggccgtcggcttagtgtcaatattagcaagtagcctcttacggaatgacgttcctatggcaggaccattagttgcgggaggactactcatcgcatgttacgtaataaccggaacctcagcagatcttaccgtagaaaaagcagccgacgtaatttgggaagaagaagcagagcaaactggagtatcacacaacctgatgatcaccgtagacgatgacggtacaatgagaataaaagatgatgaaaccgaaaacattctcacagtcttgcttaaaaccgcattattgattgtatctgggatcttcccctacagtatacctgcaacgcttttggtatggcatacatggcaaaagcaaacgcagcgctccggtgtattgtgggatgtcccgagccctcccgaaacacaaaaagctgagttagaggaaggtgtgtatcgaataaagcaacaaggaatcttcggaaaaacacaagtaggagtgggggtccagaaagagggtgttttccacacaatgtggcacgtaactagaggagcagtgttgacgcataacggtaaaagattggaacccaactgggctagtgtcaagaaagatctcatctcttacgggggaggatggaggcttagtgcacagtggcaaaagggggaggaggtacaagtaatcgctgtagaaccaggtaaaaaccctaagaatttccaaaccatgccaggaacattccaaaccactacaggcgaaataggtgctatagcattagattttaaaccgggaactagcggttctccaatcattaatcgcgaaggaaaggtagtcggactatacggaaacggagttgtaactaaaaatggcgggtatgtatcgggaatcgctcaaacaaacgcggaacccgacggtcctacaccggagcttgaggaagaaatgttcaaaaagaggaatttaactattatggatttgcacccagggtcaggcaaaacaaggaaatacttgcctgcaatagttcgagaggcaattaaaagaagattgagaactctgatattagcaccaacacgagtcgtagcggcggaaatggaagaagcattaaaaggtttaccgatccggtatcaaactacagctacaaaaagtgtgcacacgggcaaagaaattgttgatcttatgtgtcatgctacatttacgatgaggttattatcacccgtaagagttcctaactacaatttaattattatggacgaagcccatttcacagatcctgcgtcaatagctgccaggggttatatcagtactagagtcggcatgggtgaagcagcagctattttcatgacagcaaccccacctggtactgcggatgcttttccacaatcgaatgctccaatacaagatgaggaaagagatattcctgagcgtagctggaactcaggcaacgaatggataacagacttcgccggtaaaacagtctggttcgtgccaagtatcaaagcgggtaatgatatagcgaattgtctacgtaagaatgggaaaaaggtaatacagttatctaggaaaacctttgatactgagtaccaaaagacgaaactaaacgattgggattttgtagtaacaactgatatatccgaaatgggggccaacttcaaagcagatagagtaatagacccgcgaagatgcttgaaacctgttatacttacagacggcccagagagagtgatactagcaggccccatgccggtcacagtagcaagcgcagcccagcgccgaggtcgggtgggtcgtaatcctcagaaagaaaacgatcaatatatttttactggccagccattaaacaatgacgaagatcacgcacattggacagaagccaagatgcttttggataatataaatactcctgagggcataattccagcactctttgaaccggaacgagagaaatctgctgcaattgatggagagtatagactaaaaggagaatctcgaaaaacatttgtggaacttatgagaagaggtgatctaccagtttggcttgcacacaaggtcgcctcagaaggtatcaaatacaccgatcgaaaatggtgctttgacggcgagagaaacaatcagatcctagaagaaaacatggatgtcgaaatctggactaaagaaggcgaaaagaagaaactaagaccaagatggttggatgctagaacttattcagacccattagcattgaaagagttcaaggatttcgctgccggtaggaaatccatagctttagatctcgttaccgaaataggtcgagtaccttctcaccttgcacataaaacacgttcagctttagacaatttagtaatgctgcacacgtccgaacatggcggacgtgcttaccgacacgctgtagaagaattaccggaaacaatggagaccttattactattaggactaatgatactactaactggtggggccatgctatttttaatatctgggaaaggcataggcaagacgagtataggccttatatgtgtcgttgcatcaagtggtatgctatggatggctgatgttcctttacaatggatagcatcagcgatagtacttgagttctttatgatggtgttgttaataccggaaccagaaaagcaacgaaccccgcaggataaccagttggcatatgtggtaattggaatacttacgttagctgcaatagtcgctgcgaacgagatgggcctactggaaaccactaaaagggatctagggatgtctaaggaacctggagtagtctcaccgacatcgtacctagatgtagatctgcaccctgctagtgcttggacgctatacgccgtggcaacaactgtgataacgccaatgcttagacataccatcgaaaatagtactgcgaatgtctcgttagcagcaattgcgaatcaagccgtggttctaatgggattggataaaggttggccaatctctaagatggacctaggtgtacccctgttagccctgggttgctacagccaagtaaatcctctaacattgactgcagccgtacttttactcgtcacacattatgcaataattggtccaggcctacaagccaaagccacgagagaggctcaaaagagaactgcagccggaattatgaagaaccccaccgtggatggcatcatgacgatagatttagaccccgttatttatgactctaagtttgaaaagcagctgggccaggtgatgctgttagtactttgtgcggtacagttactcttaatgaggacaagttgggcgttttgtgaagctctcacattggcaacaggacccatcacaacgctatgggaaggtagtccaggaaagttttggaacaccactatagccgttagcatggctaacatctttaggggcagttatttagctggagctgggttggcatttagtattatgaagtcagtgggtacaggcaaaagaggcacaggatctcaaggtgagactttgggagaaaaatggaaaaagaaactaaaccaactttcgcgcaaagaatttgacctatacaagaagtcgggtataactgaagtagaccgtacagaagcaaaagaagggttaaagagaggcgaaataacacatcatgcggtttcacgagggtctgcaaaattgcaatggttcgtagaaagaaatatggtcataccagagggtcgagttattgatttaggatgcggtcgaggcggctggtcatattattgtgcaggacttaagaaggtaaccgaagttcgtggatatacaaaaggtggcccaggccatgaagaaccagtacctatgtcgacctacggatggaacatagtcaaactcatgagcggaaaagatgtcttttacctaccccctgagaagtgcgatacactcctttgtgatataggagaatcaagtccatctccaactgtagaagaatcgagaaccataagagtgcttaagatggtggagccgtggcttaagaacaaccaattttgcattaaagtattgaacccttacatgccaaccgtcatagaacatttagagcgactacaacgcaaacacggtggaatgctggtgcgtaatccgctctcaagaaactcaactcatgagatgtattggattagcaatggaaccggaaatatagtcagcagtgtaaacatggtatcaagactgctcttaaaccgctttacaatgacacatcggagacccacaattgagaaagatgtagatctaggtgcggggactcgacacgtaaatgctgaacccgaaaccccgaacatggacgtaataggcgaacgaatcagacgcatcaaagaagaacactcctcaacttggcattacgacgaggaaaacccttacaagacgtgggcatatcacggttcctatgaggtgaaagcaacaggaagtgcctcaagtatgataaatggcgtagtaaaattgttaacaaagccctgggacgtagtgccgactgtaactcaaatggccatgacggatacaactcccttcggtcaacagagagtttttaaagaaaaagtagatacccgaacaccaagaccaatgcccgggacccgaaaagccatggaaattaccgcagaatggttgtggagaacattgggaagaaataaaagaccaagactttgcacccgagaggaatttactaagaaagttagaaccaatgccgctatgggtgctgtatttacagaggaaaatcaatgggactcagcaaaggcagcggtagaagatgaagaattttggaagttagtcgacagagagagggaattacataagctaggtaagtgcggatcttgtgtatacaacatgatgggtaagcgggagaagaaattaggagagtttggcaaagcaaaaggctcgagagcaatctggtatatgtggctcggagcgcgttatcttgaatttgaagcattgggatttttaaatgaagaccattggtttagccgggaaaattctttttctggagttgaaggcgagggtttacataaattgggatatatcttgagagacataagcaaaatacctggtggcgctatgtatgcggacgataccgctggatgggacacaaggataacagaagacgatctccataacgaagagaaaataacccaacaaatggatcctgaacaccgacagctagctaacgccatcttcaaacttacctatcagaataaagtagttaaggtgcagaggccaacaccaaaaggaaccgtaatggacataatttcgaggaaagatcagagagggagtggacaagtaggaacctatggattaaacacttttacaaacatggaggtacaactcatccgacaaatggaaggcgaaggtgtactgtcaaaagcagatctagaaaaccctcatttattagaaaaagaaatcactcaatggttagaaacaaaaggagtcgagagattaaaacgaatggcaatatcaggcgatgactgcgttgtaaaacccatagacgaccgatttgccgatgcactacttgctttgaacgatatgggaaaagtacggaaggatattccacaatggcaaccttctaagggttggcatgattggcaacaagtacctttctgtagtcaccattttcacgaactcataatgaaagacggtaggaaacttgtggttccttgtcgtccacaggacgagctgataggtagagcaagaatttcgcagggagcggggtggtccttacgcgaaacagcttgtctcggcaaagcatatgcacaaatgtgggcactgatgtactttcatagaagagatttgaggctcgcaagtaatgcaatatgtagtgctgttccggtacattgggttccgacgtctagaacgacctggtccattcacgctcaccaccagtggatgacgaccgaagacatgttgactgtgtggaatcgcgtttggatagaagacaacccctggatggaagataagactccagtaaccacatgggaagatgtaccatatctaggaaaaagagaagatcaatggtgcggctcactaataggcctagccagtcgtgcaacttgggcacagaacattctaactgcaatccaacaagtaaggagtttgatcggtaatgaggaatttttagactacatgcctagcatgaaaagatttcgtaaagaggaagagtccgaaggagccatatggtaa

SEQ ID NO: 23522 - RNA, 9873 nt, synthetic construct
  misc_feature 1..9873: note = derived and/or modified CDS sequence (opt6) from DENV-3__KC762688__SS-prME
  source 1..9873: mol_type = other RNA
acaagtctatgccttatgatgatgttacctgcaactctagcattccatttaacaagtcgagatggggaaccaagaatgatcgtgggcaaaaatgaaagaggaaaaagtttactcttcaaaactgcatcaggtatcaacatgtgtacactaatcgcgatggacttgggtgaaatgtgtgatgatactgttacatacaaatgccccctcataactgaagtagaaccagaagatatagactgttggtgcaatctcacctctacctgggtaacgtatggtacttgcaatcaagcgggagaacacagaagagacaaaagaagtgtagctttagcaccacatgttggaatgggtctagacacgagagcacaaacgtggatgtctgccgaaggggcgtggagacaagttgaaaaagttgaaacatgggcattcagacatccaggattcacaattctagcgctattcctagcacattatatcggtacgtctctgacacaaaaagtagtcatatttattttgttaatgcttgtaacaccgagtatgacaatgagatgtgttggagttggtaaccgagattttgtcgaaggtcttagtggagcgacatgggttgacgtagtcctcgaacacggaggatgtgtaacaacgatggctaaaaacaaacctactcttgatatagaactacagaaaactgaagcaacacaattagcaactctccgaaaattgtgtatagaaggaaaaataacaaacgtaaccacagatagcagatgcccaacacaaggagaagcaatactaccagaagaacaagaccaaaattacgtgtgtaaacacacctacgtcgaccgcggttggggaaatggttgtgggctatttggtaaagggtccctagtaacttgcgcaaaatttcaatgtctagagttcatagaaggaaaagtagtgcaacacgaaaacttgaaatacacagttataataacagttcatacaggagaccaacatcaagtaggaaacgagacacaaggagtcactgccgagataactccacaagcaagtacggtagaagccattttgccagagtatggtaccctcggtctagaatgttcgccaagaacgggtctagattttaacgaaatgattttgctaacaatgaaaaacaaagcctggatggtacatagacaatggttctttgatttaccactaccatggacatcaggtgcaaccacagagacaccgacatggaataagaaagagttactcgttactttcaaaaatgctcatgccaagaaacaagaagtagtagtcctaggtagtcaggaaggtgctatgcacacagctttaaccggggctacagaaatacaaacaagcgggggaacaagtatattcgctggacacttaaaatgtcgacttaaaatggacaaattggaactaaaaggcatgagttatgcaatgtgtctaaatgcttttgttctgaagaaagaagtatcagaaactcaacacggaactattctaatcaaagtagaatataaaggtgaagatgctccatgtaaaatcccatttagtactgaggacggtcaaggcaaagctcataacggtaggttaattacagcaaatccagtggtcactaagaaagaagaacctgtcaacattgaagcagaaccgccttttggagaatcaaacatcgtaattggtataggcgataaagctctaaaaataaactggtataaaaagggctcaagtataggaaaaatgtttgaagctactgcccgaggagctagaagaatggcgatactcggagataccgcatgggactttggatcggttgggggcgtcttaaattcattaggaaaaatggtccatcagatatttggctccgcctacaccgcattattttcaggagtatcctggataatgaaaattgggataggcgtattattaacatggataggtctaaatagcaaaaatacgagtatgagttttagttgcatcgttattgggataatcacattatatttaggggcagtagtacaagccgacatgggttgtgttataaattggaaagggaaagagctgaagtgtggttctggaatcttcgtaacaaatgaagttcatacctggacagaacaatacaagtttcaggctgacagtccaaagagacttgcaacagcaatcgcgggtgcgtgggaaaacggggtatgtggtattagatcaactacaagaatggagaacctactttggaaacaaattgccaacgaattaaattatatcctatgggaaaacaatatcaaattgacggtagtcgtaggagacatcatcggggtactagaacaagggaagagaacactaacacctcagccaatggaattaaagtactcttggaaaacttggggtaaagcaaaaatcgtaactgctgaaactcaaaatagctcgtttatcatagacggacctaatactcctgaatgtccttcggcgagtagagcgtggaatgtatgggaagttgaagactacggatttggtgtctttactacgaatatctggctgaagctaagagaaatgtatacacagctatgcgaccacagattaatgtcagctgcagtaaaagatgaacgcgcggtacatgcagatatgggatactggattgaatctcagaaaaatggttcgtggaagttagaaaaagcatcgctgatagaggtcaaaacatgtacgtggccgaaaagccacacattatggagtaatggtgtattagaatcggatatgattattcctaagagcttagcagggcccgtctctcaacataactaccggcccggatatcatacacaaactgcagggccatggcaccttggtaaattggagttagattttaattattgtgaaggcaccactgttgtaataacggagaactgcggaacaagaggaccatctttgcggactacgacagtaagtggaaaattaatccatgagtggtgctgcagatcgtgtacactccctccactgaggtatatgggagaagatggctgctggtacggaatggaaataagacctatcaacgaaaaagaagagaacatggtaaaatccttagtatcggcaggtagtggaaaggtagataattttactatgggagtcctatgtttagccatactgtttgaagaggtaatgagaggcaaattcggtaagaagcatatgattgcaggggtattgtttacattcgttctactgttgagtggtcaaataacatggagggacatggcaagaacattgataatgattgggtccaacgcatcggataggatgggcatgggagtgacgtacctagccctaatagctacttttaaaatccaaccattcttagccttgggatttttcttaagaaagttgacaagtagagaaaacctcctattaggtgtaggacttgcaatggctaccacactccaattgccagaagacatcgaacaaatggcgaacggtattgcactaggtctgatggctctaaaattaatcacccaatttgagacatatcaactatggacggccttggtaagcctaatgtgtagtaatactttatttacgcttaccgtagcatggagaacagcgactcttatattagctgggatatccttactgccagtttgtcaatcaagctcgatgagaaaaacagactggctaccagtaacagttgcagcgatgggagtacctccgttgccattattcatttttagcctaaaggatactttaaagaggagaagctggccgctgaacgagggggtaatggcagtaggtctcgtatcaattttagctagttcgctactaagaaatgatgttccgatggcagggcctttagtagccggaggattgttaattgcatgttacgtaatcacgggtacatccgcagacttaaccgtcgaaaaggcagcagacgtaatatgggaagaagaagctgaacagaccggtgtgtcacataatttaatgatcacagtagacgacgacgggaccatgagaataaaagatgacgagacagaaaacattttaacagtattgctaaagacggcactgttaatagtctcgggcatatttccatatagcatcccagcaacattgttagtctggcatacctggcagaaacaaacacaaagatctggcgtattgtgggatgttccatccccacccgaaacacaaaaggcagaactagaagaaggtgtatatagaataaagcaacaaggaatattcggtaagactcaagttggagtaggtgtacaaaaggagggcgttttccacacaatgtggcatgttacccgaggggctgtgcttacacataatgggaagaggttggaacccaattgggcctcggtcaagaaagatttgatctcgtatggcggcggatggcggctgtcagcacaatggcaaaaaggtgaggaggtacaagtaattgcggtagaacctggcaaaaaccctaagaactttcaaactatgccaggtatatttcaaactaccacgggagaaattggcgctatagccctcgattttaaacccgggacaagtggatcccctattattaaccgggaaggaaaggtagtaggattgtacggtaatggtgtagtaactaagaacggaggttacgtttcaggcatagctcaaactaatgcggagccagatggcccaaccccagagttagaagaggaaatgtttaagaaaaggaatctcaccataatggatcttcacccggggagcggcaaaaccaggaagtatttaccagctattgtcagagaagcaattaaaagacggttacgcacactaattcttgcgccaactagagttgtcgcagcggaaatggaagaagccttaaaaggattacctataagatatcaaactacagcaacaaagagtgcacacacaggcaaagaaatagtcgacttgatgtgtcacgcaacctttacaatgcggcttctatcgccagtgcgcgtccctaactataacctgatcatcatggacgaggcacactttacagatcccgcttcaattgctgcccggggttatattagtacaagggtcggcatgggcgaagcggcggctattttcatgaccgcaacaccaccgggaacagcagacgccttcccccagtcgaatgcacccatacaagacgaggagcgagatattcctgagcgctcgtggaactcgggtaacgaatggataacagacttcgcaggaaaaacagtctggtttgttccatcgataaaagctggtaatgatatagcaaattgtctaaggaaaaatggcaagaaagtcatacaactgtctcgcaaaacctttgataccgaatatcagaaaacaaaattaaatgactgggattttgttgtaacaacagacatttctgaaatgggagcgaactttaaagcggatagagtcatcgatccacgtcgttgtttaaaaccagtcatactcacagatggacctgaaagagtaatactagctggacccatgcctgtgacagtagccagtgctgcgcaacgaagaggcagggtgggtcgtaatccccaaaaagaaaatgaccaatatatcttcactgggcaacctttaaacaatgacgaagaccacgcgcactggacagaagcgaagatgctcttagataacattaatacaccagaaggtataatacccgctctcttcgagccagaaagagaaaagagtgcagcaatagacggagagtaccgtttgaaaggagagtctcgaaagactttcgtcgaattaatgcgacgaggagatttgccagtatggctggcccacaaagtcgcctcagaggggatcaagtatacagatcgaaaatggtgcttcgacggtgaacgtaataaccaaatattagaagaaaacatggacgtagaaatctggactaaagaaggagagaagaagaaactgcgccccagatggttggacgcgaggacatacagtgatcctcttgcactaaaagagtttaaagattttgcagcgggacgtaaatcaatagcattagatctagtaacggaaataggacgcgttccatcacacttagcacatcggactcgaaatgccttagataacctcgtaatgttgcatacgtctgagcacggcggcagggcatatcgacacgcagttgaggagttccccgaaactatggaaacattgctactactaggtctaatgatattactgacgggtggggcaatgctatttttaatatcaggcaaagggatcggcaaaacgagcataggccttatctgtgttgttgccagttctggcatgctatggatggcagacgttccccttcaatggatagcgagcgcaatcgttctggagttcttcatgatggtgctgcttatcccagaaccagaaaaacaaagaacaccgcaggataatcagctcgcatacgttgttatcggtatactaacacttgcagctatcgtagccgcaaatgaaatgggtctcttagaaacaacaaaacgtgatttggggatgtccaaggaaccaggggtagtgtcaccaacatcatacttagacgtcgatttgcaccctgcgtcagcctggacactttatgcagtcgcaacaactgtgataacgccaatgctgcgtcacaccatagaaaatagcaccgcgaatgtgtctttagcagcaatcgcaaaccaagccgtagtattgatgggtttggataaaggctggccgatctccaaaatggacttaggggttccgttactagcgttaggatgttatagccaggtaaatcctcttaccttaaccgcagcagtcttactgctagtaacacactacgccattattggcccgggattacaagcgaaggcaaccagggaagctcagaagcgcactgctgcaggtataatgaaaaaccccactgtggatggaataatgactatagatttagatccagttatatatgactccaaatttgaaaaacagttaggccaagttatgttattagtattatgtgcagttcaacttttattgatgcgaacaagctgggcattctgtgaggccctgacattggccaccggaccgataactactttatgggaagggtctccgggaaagttctggaacacaaccatcgcggtcagcatggcaaacatattcagagggtcttatctcgcgggtgcgggcctcgcgttttcaataatgaagtcggtaggcacaggcaagcggggcacaggatcacaaggcgaaacactaggggaaaaatggaaaaagaaactcaaccaacttagtcgaaaagagttcgatttatacaagaaatctggcataactgaagtcgatcgcacggaagctaaggaaggcctaaagaagggagaaattacacaccatgcggttagccgaggatccgcaaaattgcaatggttcgttgaacggaacatggtaatccccgagggcagagttattgacctcgggtgcgggcgaggagggtggagctactattgcgctggtctgaagaaagtaactgaagttaggggctataccaagggtgggccaggacatgaagaaccggttcccatgtcgacatacgggtggaacattgtaaaactcatgtctggaaaagacgtcttttacctccctccagagaagtgtgacacactcttatgtgacattggagaatcttcaccatcgccaacagtagaagagtccagaactataagggtattaaaaatggtagagccgtggctcaaaaacaaccaattctgtataaaggtacttaatccttatatgccgactgtgattgaacatttagaacgtttacagcgaaaacacggtggaatgttagtaagaaaccctttatctagaaattcgacgcatgaaatgtattggatcagtaatggcacgggtaatatagtctctagtgtaaatatggtcagtcgacttttattgaataggttcacaatgacacatcgaaggcctactattgaaaaggatgttgacttgggtgccggtactaggcacgtaaatgcagagcctgagacaccgaatatggacgtaatcggagagaggataagacgcataaaagaggaacactcgtcgacatggcactatgatgaagaaaacccttacaagacctgggcgtatcatggttcttatgaagtaaaagccacgggatctgcaagttctatgatcaacggcgtcgtgaagttgctgactaaaccgtgggacgtagtcccaacagtaacccaaatggcgatgactgacacaacaccattcggccaacaaagagtctttaaggaaaaagtggatacaagaacaccaaggcctatgccaggcacacgcaaagcaatggaaataacggcagaatggttatggcggacgttaggtcgtaacaaacgaccaaggctctgtactcgcgaagagtttactaagaaagtaagaactaatgccgcgatgggcgccgtatttacagaggaaaaccaatgggatagtgctagagctgccgtagaggacgaggagttctggaaacttgtagatcgcgagcgggaactccataaactcggcaaatgtggatcatgcgtgtacaacatgatgggaaagagagaaaagaaactcggagaatttggtaaagctaaaggaagtagagctatttggtacatgtggttgggtgccagatatttagagttcgaggcgcttggcttcttgaatgaagatcactggtttagcagagaaaactcgttttcaggtgtcgaaggagagggactgcataaattaggatacatacttcgtgacataagtaaaatacctggcggggccatgtatgctgatgatactgctggatgggatacaaggatcactgaagatgacttacacaatgaagaaaagataacacagcaaatggatccagaacatagacaacttgccaacgcaattttcaaattaacataccagaataaagtcgtaaaggtacaaaggccaactcctaaaggtacagtaatggacattataagtaggaaagatcaacgtggcagtggacaagtagggacatatggattgaacacattcacaaatatggaagtacagctgatacgacagatggaaggagaaggagtattaagcaaggcagatctggagaacccccatttactggaaaaagaaattacccaatggctagaaactaagggggtcgaacggttaaaaagaatggcaattagcggagatgattgcgttgtaaagcccattgacgatcgatttgctgacgccttactcgcattaaatgatatgggtaaggttcgaaaagatataccacaatggcaaccatcgaaaggatggcatgactggcagcaggttcctttctgttcacaccattttcacgaacttataatgaaagatggtcgaaagttggttgtaccatgccggcctcaggacgagttaataggtcgagcgaggataagccagggggcaggatggtcgcttaaagaaacagcatgccttgggaaggcatacgcacaaatgtgggcactaatgtatttccatagaagggatctaagattggctagtaatgccatctgcagcgctgtcccagttcactgggttccaacaagcagaacgacttggagtatacatgcacatcatcaatggatgacaaccgaagatatgcttactgtatggaaccgcgtctggattgaagataatccctggatagaagacaagacaccagtaaccacatgggaggatgtcccatatttaggaaaaagggaagaccaatggtgtgggtcactaataggtctggcttcccgggcaacttgggctcaaaacatactgacagcaatccaacaggtaagaagcctaatcggaaacgaagaatttttagattatatgccttctatgaaaaggtttcgtaaagaggaagaaagcgaaggtgcaatttggtag

SEQ ID NO: 23523 - RNA, 9873 nt, synthetic construct
  misc_feature 1..9873: note = derived and/or modified CDS sequence (opt6) from DENV-3__KC762689__SS-prME
  source 1..9873: mol_type = other RNA
acctctctgtgcttgatgatgatgataccggctacgcttgctttccatctaacaagccgcgatggagaaccgcgcatgatagtaggtaaaaatgaacgtgggaaatctcttctatttaaaaccgcaagcgggataaatatgtgcacactgattgctatggacttaggggaaatgtgtgacgacactgtaacatataaatgtcctttaatcaccgaagtagaacccgaagatatagattgttggtgtaacctgacaagtacctgggttacatacgggacatgcaaccaagccggagagcatcgacgagataaacgaagtgtagcactggcgccacatgtcggcatgggattagatacaagggcgcaaacatggatgagcgcagaaggagcttggagacaagtcgaaaaagtagagacatgggcattcaggcatccgggctttacaatactcgctttgtttctagcacactacattggcacatcactcacgcaaaaagtagtaattttcatactattaatgctagtaactccaagtatgactatgcgatgtgtaggagtgggaaatagggactttgtcgagggactttctggtgccacctgggtcgatgtcgttctagaacatggagggtgtgttacaacaatggccaaaaataaaccaacattagatatagaattacagaaaacagaagctacacaattagcaacactgaggaaactatgcatagaaggtaaaataacaaatgtaacaaccgacagccgatgcccgacgcaaggggaggcaatactacccgaagaacaagatcaaaattacgtgtgtaaacatacttacgtagataggggttggggtaacggatgtggactgttcggtaaaggatcgttggttacatgcgccaaattccaatgtttagaatttattgaaggaaaagtagtccaacatgagaatttgaaatatacagttataattacagtccatacaggagatcaacatcaggtgggaaatgaaacacagggtgtaacggctgaaataacccctcaggcttccacagtagaggctatactccctgagtatggaacactaggcctagaatgctccccacgaacaggacttgactttaatgaaatgatccttctcactatgaaaaacaaagcatggatggtacataggcaatggtttttcgacctgccattgccctggacgtctggggcaacaactgaaactccaacatggaacaagaaagagctactcgttacattcaaaaacgcacacgctaagaaacaagaagttgtcgtgcttgggagccaggagggggccatgcatacagcattaacgggcgcaactgaaatccaaacgagtggtggcacatcgatatttgctggacatttaaaatgtagattaaaaatggataaattggagttgaaagggatgtcctacgcaatgtgcttaaatgcatttgttcttaagaaagaagtctcagaaactcaacatggcactattcttataaaagtcgaatacaagggtgaggatgctccgtgtaagatacccttttcaaccgaagacggtcaaggaaaagcacataacggtaggttaattaccgcaaatccagttgtcaccaagaaagaagaacctgtaaatatagaggctgaacctccatttggggagagtaatatagtaataggaattggagataaagccttaaaaataaattggtataagaaaggatcaagcataggaaaaatgtttgaggccacagcaaggggtgcccgcagaatggctatcctaggagatacggcatgggactttgggtcagtgggaggtgtactcaactcattaggaaaaatggttcaccaaattttcggaagcgcatacactgctctttttagtggtgtgagttggatcatgaaaatcgggattggggtactactaacctggatcggcttaaatagtaagaatacaagtatgtctttttcatgtatagtaataggaattatcacattatatctgggagcggttgtacaagcagatatgggttgcgtgataaactggaaaggaaaagaattaaaatgcggcagtgggatatttgtaacaaacgaggtgcatacatggaccgaacaatataaatttcaagcagacagccctaagaggctagcaactgcaatcgccggagcatgggagaatggcgtatgtggaatacgttcaacaacaagaatggaaaatctactctggaaacaaatcgcaaatgaactgaattatattctctgggaaaacaatataaaattgacagtggtggtaggggatattataggagtgcttgaacaaggaaaaagaactctaacgccgcaaccgatggagttaaagtacagctggaaaacttggggaaaggctaaaattgtaacagcggaaacgcagaatagttcgtttataattgatggccctaacaccccagaatgtccatcagctagccgagcttggaacgtatgggaagttgaggattacggatttggcgtatttacgactaatatttggcttaaattgagagaaatgtatacacaattgtgcgaccatcgcctaatgagtgcagcagtaaaggacgagagagcggtgcacgctgacatgggatattggatagagagtcaaaagaatggatcttggaaactagaaaaagcaagcctcatagaagtaaaaacgtgtacatggccaaaaagccatactctatggtctaacggcgttctagaaagtgacatgattattccaaaatcactagcggggcccgtctcacaacataactatagaccgggataccacacacagacggccggaccgtggcaccttggtaaactggaactagactttaattattgcgagggcacaaccgtagttataacagaatcatgtggtactagaggtccctccttaagaactacgaccgtttccgggaaactaatacatgaatggtgttgccgatcctgtacattacccccactaagatatatgggcgaagacgggtgttggtacggcatggaaatcagacctataaatgaaaaggaggaaaacatggtaaagtcgcttgtgtcggcgggatccggaaaagttgataactttactatgggtgttttatgtttagcgatactatttgaagaggtaatgaggggaaaattcggaaagaaacacatgattgccggtgttttgttcacatttgtactattactaagcggtcaaattacatggagagacatggcacgcactctaataatgataggttctaacgcaagtgatagaatgggtatgggcgtaacttatttagccttgatagcaacgtttaaaattcaaccgtttttagccctaggtttcttcttgagaaaactaacaagcagagaaaatctactccttggagtaggattggctatggctacaacactacaactcccagaggatatagaacaaatggcgaacggaatagcattaggtttaatggcacttaaattgataacgcaattcgaaacctaccaactctggacggcgcttgtgtcactaatgtgtagtaacacaatattcacgttgaccgtggcatggaggacggcaacgctaatattagcaggaatcagcttattgcccgtctgccagagttcgtcaatgagaaaaacggattggctccccgtgacggttgctgctatgggggtgcccccactaccactgttcatcttctcactaaaagatacacttaaacgccgatcctggcccctcaacgagggagttatggcagtaggtctagtaagtatactagctagctcactattaaggaatgacgttccaatggctggtccattagtggctggaggcctcctaatagcatgctatgtaataaccggaactagcgctgatcttactgtggaaaaagcagccgatgtcatatgggaagaagaagcggaacaaactggtgtatctcacaatctaatgatcactgttgacgatgacggaaccatgagaatcaaggacgacgaaaccgaaaatattttgacagtgctactgaaaaccgccctccttatagttagtggaatattcccatactccatccctgcaaccctattagtatggcacacatggcaaaaacagactcaaagaagtggtgtactttgggacgtgccttctcctcctgaaacccaaaaagcagagctagaagaaggagtatatcgcataaaacagcaaggtatattcggtaaaacgcaagtgggagtcggcgtacaaaaggaaggagtgtttcatacgatgtggcacgtcacacgtggagcagttttaactcacaatgggaaaaggctagagcctaactgggcttcagtcaagaaagacttaataagttacggcggcggatggcggttaagtgcccaatggcagaaaggtgaagaagtacaagtcgtagccgtagaaccgggtaagaatcccaaaaactttcaaactatgccaggcatcttccaaacgaccacaggtgaaataggagcaatagctctagactttaagccaggaacatctggcagccctataatcaatagggaaggcaaagtagttggtttatatggcaatggagtagtaaccaaaaatggtggatatgttagcggtatcgcccaaaccaatgcagaacctgacggaccaactcctgatctggaggaagaaatgttcaagaaacgaaatttaacaatcatggatctacaccctggatccggaaagacgagaaaatatctcccagccatagtacgagaagctattaaaagaagactaagaactctaattttggcgccaacgagagtggtcgctgctgaaatggaagaagccctaaagggattacccattagatatcagaccacggcaacaaaatcagttcacaccggcaaagaaatagtagacctaatgtgccatgcaacctttacaatgagactcctaagtcccgttagagtacccaattataacctaataataatggatgaggcgcatttcacagatccagcgtcaatcgcagcccgtgggtacatctctactcgagtaggtatgggagaagcagcggccattttcatgacagccacaccacctggtacagctgacgcctttccacaaagtaatgctccaatacaagatgaagaaagagacataccagaaagaagttggaatagtggtaatgaatggattactgattttgccggtaagactgtatggttcgttccctctatcaaagcggggaatgatattgcgaactgtttaaggaaaaatgggaagaaagtaattcaattgtccagaaaaacttttgataccgaataccagaaaactaaattaaatgattgggattttgttgtaacaacagatatatcggaaatgggtgcaaactttaaagcagacagagttattgacccaagaagatgtttaaaaccagttatattaacagacggtccagagagagtcatattagcaggacctatgcctgtgaccgttgccagcgcagcccagaggagaggaagagtgggcagaaatcctcaaaaggaaaatgaccaatatatttttaccggacagcctctcaacaatgacgaagatcacgctcactggactgaagcaaagatgcttctagataacataaatacaccagaagggattatacccgcacttttcgagccggagagagaaaaatcagcagccatagatggcgagtaccgccttaaaggagaaagcagaaagactttcgtggagcttatgcgacgaggtgatttacctgtgtggttagcacacaaagtcgcttcggaggggatcaagtataccgacaggaaatggtgctttgatggggaacgcaataatcaaatcctggaggaaaatatggacgtagaaatttggacaaaagagggcgagaagaagaaactcagaccaagatggctcgatgcaagaacttattcggatcctttggcattgaaggaatttaaagattttgctgcgggacgaaaaagtatagcattagacctcgttaccgagattggaagagtccctagccaccttgcttatagaactcgtaacgcactagataatcttgtgatgcttcatacaagtgagcatggaggacgtgcctatcgtcacgctgtcgaagaattgcctgagacgatggaaaccctccttttactcggtctaatgatcttactgacaggaggcgcaatgttgttcttgatttcgggcaaaggaattggcaagacatcaattgggcttatttgcgttgttgcatcaagtggtatgctttggatggctgatgttccgcttcagtggattgcttcggcaatcgtactagagttcttcatgatggttttattaattccagagcctgaaaaacaacgaacgccccaagataaccaactcgcctatgtagtaataggtatactaactttggcagcgatagtggccgcgaatgaaatgggtctattagagacaacaaagcgggatttaggaatgagtaaagaaccaggtgttgtttcaccaacctcctacttggacgtggatttgcacccggcatccgcatggacactgtatgcagtggcgacgactgtaattacacccatgctccgacatacgatagaaaattccacagccaacgtatctttagcagctatagcgaatcaagcagttgttctaatgggcttagataaaggatggccaatctcgaaagtagatttgggcgtacccctgttagccctaggttgctacagccaggtaaatcctttgacattgaccgcggcagttctactacttgtaacgcactatgctataatagggccgggattgcaagcaaaagcaacgcgcgaggcccaaaaacgaacggctgcagggattatgaaaaacccaactgtggatggaatcatgacaatagacttagacccagtaatctacgatagcaaattcgaaaaacaacttggtcaggtaatgctactggttttgtgcgccgtacaacttttactaatgcgaacaagttgggcattttgcgaagcactgactttagcgacaggccccataacgaccctgtgggagggatcaccaggcaaattctggaacactactatcgccgtgagcatggccaatatatttcggggatcttacttagctggcgctggattagcattcagcataatgaaaagtgtagggacggggaaaagaggaacaggttctcaaggcgagacgctaggcgaaaaatggaagaagaaattgaaccaattaagtcgaaaagaatttgatctatataagaaatccggtataaccgaagtggatagaacagaagcaaaagagggattaaaaagaggagagacgacccatcatgcagtgagcagaggctcggctaaacttcagtggtttgttgagagaaatatggttatcccagaaggtcgggtgatagatttaggctgcggtcgtggcggatggagttactattgcgcaggactcaagaaagtaaccgaagtgcggggttacaccaaaggagggccggggcacgaagaacccgtacctatgtcaacctatgggtggaacattgtaaagttgatgagtggaaaagatgtattttatttaccacccgaaaaatgtgacacgttactgtgcgacattggagaatcgagtccaagtccaaccgtagaggaatcgaggacaataagagttttaaagatggtcgagccttggttgaaaaataatcagttttgtattaaggtactaaatccctatatgcccacagtaatagagcatctagagagattacaacgcaaacacggcggaatgctggtgagaaacccactatccagaaattcgacacatgaaatgtattggataagcaatggtactggaaatatcgtatcttctgtaaatatggtgagtcgactactattaaatcgattcacaatgacccacagaagaccgacaattgagaaggatgtggacctgggagcgggtacaagacacgtgaatgctgaaccagaaaccccgaacatggatgtaataggcgaacgtattagacggattaaagaagaacatagcagtacttggcattacgatgaagaaaacccgtataagacatgggcttatcatggttcttacgaagtaaaagctacggggtctgcttcttcgatgatcaatggtgtcgtcaaattactaacaaaaccatgggacgttgttcccacagtcactcaaatggctatgacagatactaccccatttgggcaacagcgagtattcaaggaaaaagtagataccagaacaccaagaccgatgcctggaacaagaaaagccatggaaataacggctgaatggttatggcgaacgttagggagaaataaacgaccacgcttgtgtactcgagaagagttcacaaagaaggtccgaacaaatgccgcaatgggagcggttttcacagaagaaaatcaatgggatagtgcacgagcagccgtagaggatgaggagttttggaaattagtggatcgtgaacgagaattacataagctaggtaaatgcggttcctgtgtttataacatgatgggaaaacgagagaagaaactaggcgaatttggaaaagcgaaagggagtagggctatctggtatatgtggttaggagcgagatatctcgaatttgaggcattagggtttttgaatgaggatcactggtttagtcgagagaacagcttttctggtgtagaaggagaaggactacataagctaggttatatcttacgtgacataagcaaaattccaggaggggcgatgtatgcagacgatacggccggctgggacactagaatcacagaggatgacttgcacaatgaagagaaaatcacacaacagatggacccagagcacaggcaattggcaaatgcaatattcaaactgacttatcagaataaagtggtaaaagttcaaagacctacacctaagggaactgtcatggatataatcagtagaaaagatcaacgtggatcaggtcaagtaggcacgtatggtcttaatacctttaccaacatggaagtacaattaataaggcaaatggaaggtgaaggagtattatcaaaggcagacttagaaaacccccatctacttgaaaaagaaattacccagtggctcgagacgaagggagtagaacgattaaaaagaatggccatcagtggcgacgattgtgtggtaaaacctatcgatgaccgtttcgcagatgcactccttgcattaaatgatatgggcaaagtaaggaaagacattccacagtggcaacctagcaaaggttggcatgattggcaacaagtccctttttgttcacaccacttccatgaattaataatgaaggacggcagaaagctagtagtaccatgtaggccccaggatgaattaattgggagggcccgaataagtcaaggggctggctggtcactgaaagaaacagcatgtttggggaaagcatatgctcaaatgtgggcattgatgtatttccatcgtcgtgatctaagattagcttcaaatgcaatatgtagcgcagtacctgtgcactgggtaccaacatcgcgtacgacctggagtatccacgcacaccatcaatggatgacgacagaagacatgttgacagtgtggaatagggtatggatagaagacaatccgtggatggaagacaaaacaccagtgacaacatgggaagacgttccatacctgggaaagagagaggatcagtggtgtggaagtttaataggtttggctagtagggccacttgggcccaaaatattctcacagcaatacaacaggtccgaagcctcattggtaatgaagagtttctggactatatgccctcaatgaaaagattccgaaaggaggaagaaagtgagggtgctatatggtga

SEQ ID NO: 23524 - RNA, 9873 nt, synthetic construct
  misc_feature 1..9873: note = derived and/or modified CDS sequence (opt6) from DENV-3__KC762690__SS-prME
  source 1..9873: mol_type = other RNA
acgtccctatgtcttatgatgatgcttcctgcaaccttggcatttcatctaacttccagagacggggaaccaagaatgattgttggcaaaaatgaacgcggtaaatctctgctgtttaaaacagcgagcggaataaacatgtgtaccttaatcgctatggacctaggagaaatgtgtgatgacaccgtgacatataaatgtcctcttataactgaagtggaaccagaagacattgattgctggtgtaacttgacaagcacatgggtaacgtacggtacttgcaatcaagctggagaacacagacgcgacaaacgatctgttgctctagctccgcacgtgggaatgggacttgatactagggctcaaacatggatgtctgcagaaggtgcatggcgccaagtggaaaaagtggagacctgggcatttagacacccaggttttactatattggctcttttcctggcgcactacataggaacttcactcacccaaaaagtcgtcatcttcatcttgctaatgttagtgactccgagtatgactatgcgttgcgtgggagtaggaaaccgagacttcgtagaaggcttgagtggcgctacatgggttgacgtcgtacttgaacatggagggtgtgtaacgactatggccaaaaataaaccaacacttgacatagaactccagaaaaccgaagcgacacagctagctacgttgcgcaaactatgcatcgaaggtaaaattacgaacgtgactacagattcaagatgcccaacccaaggagaagcaatactgcccgaagaacaagaccagaattacgtgtgtaaacatacttacgtggaccgtggttggggcaacgggtgcggattatttggaaaaggcagcttagtaacttgtgcgaaatttcagtgtttagaatttattgaaggtaaagtagtacagcacgaaaatcttaaatacacagttattatcactgtacatacgggagaccaacaccaagtaggaaatgaaacccagggagtaacagcagaaataacacctcaagccagtacagtagaggcaatattaccggaatacggaaccctaggtctagagtgcagtccacgtacaggcctcgactttaatgaaatgatactattgacaatgaaaaataaagcgtggatggtccacaggcagtggtttttcgaccttcctttaccatggacgtctggagcgaccactgaaactccaacatggaacaagaaagagctattagttacattcaaaaatgctcatgccaagaaacaagaggtcgtcgtcctcggttcccaagaaggcgcaatgcatactgcacttacgggggccacggaaattcaaacatccggaggtacctctatctttgctggtcacttgaaatgtcggctgaaaatggataaactagaactgaaaggcatgtcgtatgccatgtgtctaaacgcgtttgtcctaaagaaagaggtatctgaaacgcaacatggaaccattttaataaaagtggagtataaaggcgaagacgcaccatgcaaaataccattcagtacagaggatgggcaagggaaagctcacaacggaagactaataaccgccaatcctgtagtcactaagaaagaagaaccagttaatatcgaggcagaaccaccatttggcgagtcaaatatcgtaataggaataggggataaagcgcttaaaattaattggtataaaaagggatcaagcatagggaagatgttcgaagctacagcccgaggtgcacgaagaatggcaattttaggggacactgcttgggatttcggctcggtagggggagtcctaaactcgttaggaaaaatggtacaccagatatttggatcggcttatacagcgttgttttctggagtatcatggatcatgaaaatagggatcggcgtattgttgacctggattggtctaaattctaaaaatacaagtatgagctttagctgcatagtaattggaataattacattatatttaggcgctgttgttcaagcagatatgggatgtgttataaattggaaaggtaaagaattaaaatgcggttctggtattttcgttacaaacgaagtccacacctggactgaacagtacaaatttcaagcagattctcctaaaaggctagcgaccgctatcgctggtgcatgggaaaatggcgtatgcggcatacgatctaccacccgtatggagaacctcttatggaaacaaattgccaatgagctcaactatatattatgggaaaataacattaagctcaccgttgtagttggagacatcatcggggtacttgaacaagggaaacgaaccttgaccccacaaccgatggaattaaagtatagttggaaaacatggggcaaggcaaaaatcgtaacagcagaaacgcaaaactcatccttcattatcgatggaccaaataccccggagtgtccttcagctagtagggcttggaatgtttgggaagtagaagactatgggttcggtgtcttcactactaacatatggttaaaactaagggaaatgtatacacaattatgcgatcacagactaatgtcagctgccgtaaaagacgagagggcagtccacgcggatatgggatattggatcgaaagtcagaaaaacggtagttggaaattagaaaaggcaagtcttatagaagtaaagacatgtacatggcctaaatcacacacactctggtccaatggggtacttgaaagcgacatgataattcctaaaagcctagccgggccggtcagtcaacacaattatcgacctggataccacacgcaaacggctggcccatggcatttaggcaaactggagttggatttcaattattgtgaggggacaactgttgtaattacagaaaattgtggcactcgaggtccatctctacggacaaccactgtaagcggtaaacttattcatgaatggtgttgtaggtcctgcaccttaccacctttacgttacatgggtgaagacggttgttggtacggtatggagataagaccaattaacgaaaaagaagaaaatatggtaaagtcactcgtaagcgcaggaagtggtaaggtcgataactttacaatgggtgttttgtgcttagcaatactatttgaagaagtaatgagaggcaaatttggcaagaaacacatgatagcgggtgttctgttcacctttgtgttactattgagtggacaaataacttggcgagatatggcacgaaccttaataatgatcggaagtaatgcatccgatcgcatgggtatgggcgtaacatatctagctttaattgcgacattcaaaatccaacctttcttggctcttggtttcttcctccgaaaattaaccagtagggaaaacttgttactcggagtaggtcttgctatggcaaccacattgcagctaccggaagatatagaacaaatggcaaatggtatagcgctaggtttaatggccctaaaacttataacacaatttgaaacttaccaattgtggacggcattggttagtctaatgtgttcaaataccatctttacccttacagtggcttggcgaacagccactttaattctagctggtatatctctcctcccggtatgccagtcatcctccatgagaaaaacagattggctgcctgttacagtcgctgctatgggggtacctccgctaccgttatttatattttccctaaaagatacattaaaaagacgcagttggccccttaatgagggagttatggctgtaggcctagtctcgatcttggcaagctcgcttctgagaaatgacgtacctatggccggacccttagtcgcagggggactgctcatagcttgctatgtaatcacaggtacttctgcggacctaaccgttgaaaaagcagccgatgtcatatgggaagaagaagcggagcagacaggtgttagccataacttaatgattactgtagatgatgacggaactatgcgaatcaaggacgacgaaactgagaacatactaacagtactgctaaaaacagcacttctaatagtcagcggcatttttccatacagtataccagctactctcttagtatggcatacttggcagaaacagacacaacggagcggtgttctgtgggacgttccttcgccccctgagactcagaaggcggaattagaagaaggagtttatcgtataaaacaacaaggtatattcggaaagacacaagtaggagtgggagtgcaaaaggaaggtgtttttcataccatgtggcacgtgacgcgtggtgcagtgctcacccacaacggaaaacgtttagaaccaaattgggcatctgttaaaaaggatcttatatcatacggaggaggttggaggctgtcagctcaatggcaaaaaggagaggaggtacaagtaatagcggtggaacctggcaaaaaccccaaaaatttccaaacaatgccaggcatatttcaaacaactacgggagaaatcggcgcaatcgcgttagatttcaaaccaggaacaagcggttctccaattataaaccgtgagggtaaggtggttggactctacgggaatggtgtggtcaccaaaaacggaggttatgtgtccggtatcgctcagaccaatgcagaaccagatggcccgacaccagaattagaagaagaaatgttcaagaaaaggaaccttacaataatggacttacatcctggtagcggaaaaacgaggaagtatctaccagccatagtacgtgaagcaataaaacgtagactgagaactttaatactagcaccaactagagttgtggcagctgaaatggaagaggccctcaaaggcttaccaatacgttatcaaactacagcaacaaaatctgcacacacgggcaaagagattgtagatttaatgtgccatgccacctttacaatgagattattatcaccggtgagggtcccgaattataatctaattataatggatgaagcacactttacagatccagcctcaatagcagctcggggatatatttcaactcgggtcggaatgggtgaggccgcggctatatttatgacagctacccctcccggaacagcagacgcttttccacagtcaaacgctcctatccaagatgaagaacgcgatattccagaaagatcctggaatagcggaaacgaatggattaccgacttcgcaggaaaaactgtatggttcgttccaagtataaaagcaggtaacgatatcgcaaattgtttgagaaagaacggtaagaaagtaatccaattgagtaggaaaacttttgatacggagtatcagaaaactaaattaaatgactgggactttgtagtaacaaccgatatttcagagatgggcgccaactttaaagcagaccgagtcattgatccaagaagatgcctcaaacctgttatattaaccgatgggccggaaagagtaattttagcagggccgatgcccgtcacggtagctagtgcggcacaacgtagaggtcgagtcggaagaaatccacagaaagaaaatgatcaatatatcttcacgggacaacccctcaacaacgatgaagatcacgcacactggactgaggcaaagatgttacttgataacataaatactcctgaaggaattatacccgcgctgttcgaacctgaacgggaaaagtcagcggcaatagacggcgaatacagactaaaaggtgaatcgcgaaagactttcgtcgaacttatgcgcagaggtgacctacctgtatggttagcacataaggtagcctcggaaggtataaaatacaccgacaggaaatggtgcttcgacggagaaaggaataaccaaatattagaggaaaatatggatgttgaaatatggacaaaagaaggtgagaagaagaaactacgtcctcggtggctggacgcaagaacttattccgatccactagcactgaaagagttcaaagacttcgcagccggtagaaagtctattgcattagatcttgttacagagataggcagagttccctctcacctggctcatcgtacaagaaatgctctagataatctggtaatgttacacacatctgaacatggaggtagagcatatcgtcacgctgtggaggagctgcctgaaacgatggaaacactattgctgttagggctgatgattttattaaccggaggcgcaatgttgtttttaatctctggaaaaggcataggtaaaacgtccataggcttaatctgcgtggttgcaagtagtggaatgctatggatggccgatgtaccactacaatggatcgcatcagcgatagtgttagagttcttcatgatggtcctgctgatacccgaacccgaaaaacaacgcacacctcaagataatcagctagcctacgttgtcattggaattttaaccttagcggccattgttgcagctaatgaaatgggtctattagaaacgactaaaagagatttaggaatgtcgaaagaacctggtgtagtttcacccacaagttatctcgacgtcgatttacatccagcatccgcatggacactgtacgcagttgcaacaaccgtgataacccctatgttacgacacacaatagaaaattcgaccgcaaatgtctctctcgcggccattgcgaaccaagcagttgttttaatgggcttagataagggatggccaatcagtaaaatggatttgggtgtgccattattggcactaggatgttactctcaagtaaaccccttaacactaaccgcagcagtactactcctagtaactcattacgctatcattggacctggacttcaggcaaaagctacccgagaggctcagaaaaggacagcagctgggattatgaaaaatccgacagttgacgggatcatgacgatagatctagatccagtaatatacgatagcaaatttgaaaagcaactaggtcaagtaatgttattagtgctatgcgccgtacagttactactcatgagaacatcgtgggcattttgcgaggctctaacactggctaccggaccaataactacgttatgggaaggttcgccgggaaaattctggaacacgacaatagcagtgagtatggcgaatatatttagaggatcatacctcgccggagctggcttagcattttctataatgaaatcagttggaactggaaaacgaggcaccggctctcagggagaaacgctgggggaaaaatggaagaagaaactaaaccagctgtcacgaaaagagttcgacctttacaagaaatcaggaataacagaagtagataggacagaagccaaagaaggtttaaaacgtggagaaatcacacaccatgctgtcagtagaggttcagccaaattacaatggtttgtggaaaggaacatggttataccagaaggaagagtaatagacctcggatgtggtaggggtggatggtcctattattgcgcaggactaaagaaagttactgaggtaagaggatacacaaagggcggacccggtcatgaagaaccggtaccaatgtctacatatggctggaacatagttaaactcatgagtggaaaagacgtattttacctaccgcccgaaaagtgtgacaccttgctttgcgacataggtgaaagctcacctagccctactgtcgaagagagcaggaccattcgggttctaaaaatggtggaaccatggctcaaaaataaccagttttgcatcaaagtactaaacccgtacatgccgacggttattgaacacctagagagactacaaagaaagcacggaggaatgcttgtacgtaacccactttcacgaaactcaacgcacgaaatgtactggatatctaatggtactggaaatatcgtaagctcagttaacatggttagtaggctactcctaaataggtttacgatgacacatcgaagacctactattgaaaaggatgtagatcttggcgctggtacccgacatgtaaatgccgagcccgaaacaccaaacatggacgttatcggcgagagaattagaaggataaaagaagaacacagttcgacctggcattatgacgaagaaaacccatataagacatgggcatatcatggaagttacgaagtaaaagcaactgggagcgcaagctctatgatcaatggagtcgttaaactattaaccaagccgtgggatgtagtaccaactgtgactcagatggcaatgactgatacaacacctttcgggcaacaacgggtatttaaggagaaagttgataccagaaccccacgaccaatgcccggcactagaaaagcaatggagataacagcagagtggctctggcgaactctaggaagaaataagcgccctagattatgtacgcgtgaggaatttacgaagaaagtgagaacaaatgccgctatgggtgccgtttttactgaagagaatcaatgggatagtgctcgcgcagcggttgaagatgaagaattttggaagctggttgatagggaacgggaacttcataaactaggaaaatgtggaagttgtgtttacaatatgatgggtaaaagagaaaagaagctaggagagttcggtaaagctaaaggatcaagagctatctggtatatgtggctaggagctagatacttagagttcgaggcattgggattcctcaatgaagaccattggttctcgcgcgagaactcgttttcgggcgtagaaggggaaggactgcataaactaggttacattttacgagatatcagtaaaattccaggtggagcaatgtatgcggacgacactgctggatgggatacgcgaataacggaagatgatctacataatgaagagaaaattacacaacagatggagccagaacaccgacaattagcaaatgcaatctttaaattaacatatcagaataaagttgtgaaagtacaaagacctacgccgaagggcaccgtgatggatataattagtagaaaagaccaacgtggttccggccaagtaggaacgtacgggttaaatacatttacaaatatggaggtgcaactgatacgacaaatggaaggcgagggagtgctgagtaaagccgatctagaaaatccacacttgcttgaaaaagaaattacacagtggttagaaactaaaggggtagaaagactgaaaagaatggcaatcagtggagatgactgtgtcgttaaacccatcgatgatcgctttgctgacgcacttttagcattgaacgatatgggaaaagtcagaaaagatataccccaatggcaaccatctaaaggttggcatgactggcaacaagtcccattctgttcacatcattttcacgaattaatcatgaaagatggccgtaaacttgtcgtgccatgcaggccacaagatgaactaataggcagagcgcgaattagccaaggcgcagggtggtcactaaaagagactgcatgtcttgggaaggcgtatgctcaaatgtgggcgctaatgtactttcatagaagagatttgaggctcgctagtaatgcgatctgtagcgctgtaccggtccattgggtgcccacctcccgaacaacatggtcaatacacgcacaccatcaatggatgacaacagaagatatgttaacagtttggaatagggtatggatagaagataatccttggatggaggacaaaactccagtaacgacttgggaagatgttccatacttaggaaaacgtgaagaccaatggtgtggtagtttaattggactagcttcaagggcaacctgggctcagaacattctcaccgcaattcagcaggtaagaagtttaattggcaatgaagaatttttagactatatgcctagcatgaaaaggtttcgaaaagaagaagaatcggagggggctatatggtaa

SEQ ID NO: 23525 - RNA, 9873 nt, synthetic construct
  misc_feature 1..9873: note = derived and/or modified CDS sequence (opt6) from DENV-3__KC762691__SS-prME
  source 1..9873: mol_type = other RNA
acatccttatgtttgatgatgatgttaccggctacccttgcatttcatttaacttcaagagacggagaaccacgaatgatagtaggtaaaaatgaaagaggaaagagcttactgtttaaaacagcatcagggattaacatgtgcacattaatagccatggatctaggagaaatgtgcgatgatacagtaacatataaatgtccgcttattacagaagtagaacccgaagacatagattgttggtgtaacctcacatcaacatgggttacctatgggacttgtaaccaagctggtgaacatagaagagacaaaagaagcgttgctttggcaccccacgtaggcatgggtcttgatactagagcacagacctggatgagcgcagaaggggcctggcgacaagttgaaaaagtagaaacttgggcctttaggcatccgggttttaccatactggcattgtttttagcacactacataggtacatcattaacccaaaaagtagttatatttatattactaatgcttgttacccccagtatgacgatgcgctgcgtaggagtgggaaatcgagacttcgttgaaggccttagcggtgccacatgggtcgacgtggttttagaacatggaggatgtgtaacgacaatggctaaaaacaaacctacactggatatcgaattacagaaaactgaggcaacacaattagctacgctcagaaaattgtgcattgagggaaaaatcactaacgtaacgactgattctcgttgtccaactcaaggcgaggctattttacctgaggagcaagatcaaaactatgtgtgtaaacacacatatgtagatagaggatgggggaacggttgtggcctgtttggcaaaggcagcctagtcacatgcgctaaattccaatgtctagagctcattgaaggaaaagtagtacaacatgaaaacctaaaatatacagtaataatcactgttcacacaggagatcaacatcaggtagggaatgaaacacaaggagtaaccgcagaaataactccccaagccagcactgtagaggccattttaccggaatacggcacactgggattagagtgttccccaaggacaggactagattttaacgaaatgattctcttaacaatgaaagataaggcgtggatggtacatagacaatggttctttgatcttccactgccttggacatcaggagctactacagaaacaccaacttggaacaaaaaggagctgttagtaaccttcaaaaatgcacacgccaagaaacaagaagtcgtcgtgcttggttcacaagaaggagcgatgcataccgcactaactggtgctacagagatacaaactagcgggggaactagcatatttgcagggcatctcaaatgtagactaaaaatggataaactagaactaaaaggtatgtcatatactatgtgttcaaacgcttttgtgttaaagaaagaggtcagcgaaacacaacacggaacaattctaataaaggtggaatacaagggtgaagatgcaccatgtaagataccattttcaactgaggacggtcaggggaaagcacacaatggaagattgattacggcaaaccctgtggtcactaagaaagaagaacctgtcaacatagaagcagaacctccctttggggaatccaacataataatagggattggggacaaagctcttaaaattaactggtacaagaaaggttcttcgatcggaaaaatgtttgaggctacagctagaggagcgcgaaggatggctatattaggggacaccgcctgggacttcgggagtgttggtggggtgctaaacagcttagggaaaatggtccatcagatctttggatcagcttatacagcactattctcaggcgtttcatggattatgaaaatcggaataggtgtgttactaacgtggatagggctaaactccaagaacacatcaatgtcattttcatgtatcgtcataggcattataactctatacttaggcgctgttgtacaggcagacatgggatgtgtaataaattggaaaggaaaagagctaaaatgtggaagtggtatattcgtaacaaacgaggtacatacctggacagaacagtataaatttcaagccgatagcccgaggagactagcaactgccattgcaggggcgtgggaaaacggagtatgcgggattagaagtactactcgtatggaaaacctactttggaaacagatagcgaatgaattaaactacatactctgggaaaataatataaagttaacagtagtggttggcgatacaataggtgtattggaacaaggcaaacggactcttactccacaacccatggaactgaaatattcttggaaaacttggggcaaagcaaaaattgtaactgccgaaacacagaactcaagtttcataatagacggacccaacactcccgaatgtcctaatgcaagcagagcatggaacgtttgggaagtggaagactatgggtttggcgtattcaccaccaatatatggctaaaattgagggaaatgtacacacagttatgtgatcaccgcttgatgagtgcagccgtcaaagatgaacgagcagttcatgcagacatgggttactggatcgagtcccagaaaaacggtagctggaagttggaaaaagctagtctgatagaagtaaaaacttgtacatggccgaaatcacacacattgtggagtaacggagtactcgaaagcgatatgattattccaaaatcattggcgggaccaatctcacaacataactacaggcccggctaccacactcaaactgcaggaccatggcatctgggaaaactcgaacttgatttcaactattgcgaaggcacgacagtagttataacggaaaattgcggagcgcgaggaccgtctttacgaacaacgacagttagcggtaaactaatacacgaatggtgttgtcgaagttgtacattgccacctctccgctacatgggggaagatgggtgttggtatggtatggaaattcgccccataaatgaaaaggaagagaacatggtaaaatctctcgtttcagctggaagtggcaaagtggacaatttcactatgggggttctatgtttggctattctatttgaagaagtcatgagagggaaattcggaaagaaacatatgattgcaggagtgttgttcacctttgtattgttactaagcggacagattacttggagggatatggctcgaactttaataatgataggttccaatgcatcagacagaatggggatgggtgtcacctatctagccttaatcgcgacatttaaaatacaaccttttctggccctgggattctttctaagaaagttaacctcaagagaaaatctattattaggtgtcgggcttgctatggcaacgactctacaactgcctgaagatatagaacaaatggctaacggaatagccctaggattaatggcattaaaactaattacacaatttgaaacctatcaactatggactgcgttagtatccctgatgtgtagtaatacgatatttactctcaccgttgcatggaggactgctactttgatcctggcagggatatcgttattcccagtatgtcagtcaagctccatgagaaaaacagactggctaccaatgacagtcgcagctatgggtgttccaccattgcctctgtttatattctcactgaaggatacacttaaacgtaggtcgtggcctctaaatgaaggagtaatggcagttgggttagtttcaattttagcatcctcattactgcgtaatgatgtaccaatggctggccctctggtagccggtggtttattgatagcgtgctatgtgataacggggacttctgcagacttaaccgttgaaaaagcggcggatgttacatgggaagaagaagcagagcaaactggcgtttcccacaacttgatgattactgttgacgacgacgggacaatgcgaattaaggacgatgagacggagaacatcctaaccgtactactaaagacagcgctgttaatagttagcgggatattcccctattctatcccggctacgctattggtatggcatacttggcaaaaacagacacagcgcagtggagtactatgggacgttccgagtcctcctgagactcagaaagccgaattggaggaaggagtctatagaataaaacagcaaggtatttttggaaagacgcaagtaggagtcggagtacaaaaggaaggagtctttcatacaatgtggcatgtgactagaggagctgtactgacttacaatggaaagagattagagcctaattgggcatccgtaaagaaagacttaatttcctatgggggcggatggcgtttatcagcgcaatggcaaaaaggagaagaagtacaagtcattgcagtagaacctgggaaaaaccccaaaaatttccaaactatgcctggtatattccaaactaccacaggagaaattggtgccattgctctagacttcaaaccaggcacatccggaagcccaatcataaatcgtgaaggcaaggtggtaggtctgtatggcaatggagtggttacaaagaacgggggatatgtttcaggtattgcgcaaactaatgcagaacctgatggtccgacccccgaactagaggaagagatgttcaaaaagcgaaacttaacaatcatggatctacacccaggttcaggtaagactagaaaatacttacctgccattgttagagaggcgataaagcgcagactaaggacactaattctcgcaccaactcgtgttgtagctgccgaaatggaagaagcgctaaagggtttgcctataaggtatcaaactactgcaacaaaaagtgaacacactggtaaagagatagtggacttaatgtgccacgcaacatttactatgagactcttaagtcctgtaagagtaccgaattacaatttgattatcatggacgaagcacacttcactgatccggcatcaatagcagctcgaggctatatttccacaagagtaggtatgggcgaagcagctgccatcttcatgacggcaactccacccggaacagcagacgctttcccacaatctaacgcaccgatccaagatgaggaaagagatatcccagagagaagttggaactctgggaatgattggataacagacttcgctggcaaaaccgtatggtttgtgccaagcataaaggctggtaatgatattgcaaactgtttgcgtaaaaacgggaagaaagtgatacagctctcaagaaagacattcgacacggaataccagaaaaccaagctcaacgattgggattttgtagtaacaacagacataagtgagatgggagctaacttcaaggcggatagagttatagacccaagaagatgtttaaagccagtcatcttaacagatgggccggagcgcgtgatactagctggccccatgccagtaacagtagcgagtgctgcccaaagaagaggaaggattggaagaaacccacagaaagaaaatgatcagtacatttttaccggacaaccactaaataatgacgaagaccatgcccattggactgaggcgaaaatgttattagataatatcaatacacctgaaggcattatacctgcactttttgaaccggaacgagaaaaatcggcagcgattgacggggagtaccgactgaaaggagaaagtagaaaaacctttgtcgaactcatgcgtagaggggacttaccggtttggcttgcacacaaagtagcatcagaaggaataaaatacacagatagaaaatggtgttttgatggtgaaagaaacaatcaaatacttgaagaaaacatggacgttgaaatctggacaaaggaaggggagaagaagaaacttagaccgaggtggcttgatgcgcgaacgtactcagatcccttagcattaaaggaatttaaagacttcgcagccggtagaaagtcaatagcactagatttggttaccgaaattggtcgagttccaagccacctagctcaccgtacaagaaatgcattagataacttagtcatgctacataccagtgaacatggaggacgagcatatagacatgcagtagaggagctcccagagacgatggaaacccttctactactagggttgatgattttactcacaggtggggccatgctatttctaatctccggaaagggagtggggaagacttcaataggacttatatgtgtcgttgcgagttcgggtatgttatggatggcggatattccactccagtggatcgcatcggccatcgtcctcgagttctttatgatggtgctactaatcccagaacctgaaaaacaaagaacgccccaggataatcaattagcgtacgtagtaattgggatcctaacacttgcagcaattgtggctgcgaacgagatgggcctgctggaaacaactaaaagggatttagggatgagcaaagaaccaggagtggtttctccaacatcttatcttgacgtcgaccttcaccccgctagtgcatggactctttacgcagtggccacgacagtgataacaccaatgcttcgtcacactatagagaatagcactgcaaacgtgagcttagcggcaatcgcgaatcaagcggtagtacttatgggactagacaaaggttggcccatttcaaaaatggatttaggcgtccccttgctggctttaggatgttatagtcaggttaatccattgacgttgacagcagcagtgttattgctagtaacccattatgcgatcatagggcctggtttgcaggctaaagcaacaagagaagctcaaaagagaacagccgctggaattatgaaaaatccaacagttgatggaataatgacaatcgatctggatccagtgatttatgactctaagttcgaaaaacaattaggacaagttatgcttctagtactatgtgcagtgcagctacttctaatgagaacgtcgtgggcgttttgcgaagcgcttaccttagcaacgggacccataactaccttatgggaaggttccccaggtaagttctggaatactaccattgcggtaagcatggcaaatatatttagaggatcgtaccttgctggcgcaggacttgctttttcaattatgaaatcagtgggcactggaaaaagaggaacaggatcacaaggcgaaacactaggagaaaaatggaagaagaaattaaaccaactaagtagaaaagaatttgatttatataagaaaagcggtataacggaggtagacagaacagaagccaaagaaggtttgaaaagaggcgaaatcacacatcatgctgtcagtagaggatccgcaaaattacaatggttcgttgaaagaaatatggtaattccggaaggacgcgtaatcgatctagggtgtggaaggggcggatggtcatactattgtgctggcctgaagaaagtgactgaggtccgaggttatacgaaaggaggaccaggacacgaggaaccagtaccaatgtcaacctacggttggaacatagtcaaactaatgtccggaaaagatgtattctatcttcctccagagaaatgtgacacactcttatgcgatattggtgaatcatcgccttcgccaactgtcgaagaatctcgaaccataagagtactcaaaatggttgaaccttggctcaaaaacaaccaattctgcataaaggtattgaatccgtatatgccgactgttatagagcacttagaaagactccagaggaaacacggaggaatgctggtaaggaatccgttatcgcgaaattctacacatgagatgtattggataagtaacggaaccgggaatatagtatcgtctgttaacatggtctccagactattgctaaacaggtttacaatgacttatagaaggcccacaatagaaaaagacgttgacctgggtgcaggtactcggcatgttaacgccgaaccggaaacacccaacatggacgttatcggagaaagaatccggaggataaaagaagaacactcgtctacgtggcattatgatgatgaaaacccttataaaacctgggcatatcatgggtcatacgaagtgaaagcaactggatcagcctcatctatgataaatggagttgtaaaactattaacaaaaccatgggatgtagtaccgactgtaacacagatggcaatgaccgatacaacaccattcgggcaacaaagagtttttaaagaaaaggttgatacacggacaccaaaaccaatgcccggtactagaaaggtcatggaaattactgccgagtggctgtggaggacattgggccggaataaacgacctaggctgtgtacaagggaggaatttacgaagaaagtgagaactaatgctgctatgggagcagtatttacagaagaaaatcagtgggattcagcaagagcggcagtggaagacgaagagttctggaaattagtagatcgagagcgagaattgcacaaattaggaaaatgtggaagctgtgtctacaatatgatgggaaaaagagagaagaaacttggagaatttggaaaagcgaaaggatcgcgagccatttggtatatgtggctaggtgccagatacctagaatttgaggctttaggtttcctaaacgaagaccattggttttcacgagaaaacagttattctggagtcgaaggagaaggcctacataaattagggtatattctaagggatatttcaaaaattccagggggagctatgtacgccgatgatacagcaggctgggatacacgcattactgaagatgacctacataacgaggagaaaattacgcagcagatggatccagagcacaggcagctcgcgaacgctatttttaagctaacgtatcagaacaaagtagttaaggtacaaagaccgactccaaaggggacggtcatggatatcatctcacgtaaagatcagcgagggtcaggtcaagtgggcacctatgggctgaatacatttactaatatggaggcccagctaatacgacaaatggaaggagagggggttctctctaagacagacttagaaaatccacacctactagaaaagaaaataacgcaatggttagaaaccaaaggagtagaaagactaaaaaggatggcaatttcgggtgatgattgtgtcgtaaagccaattgacgatagattcgccaatgctctattagccttgaatgatatgggcaaagtaaggaaggatatacctcagtggcaaccaagtaaaggatggcatgactggcaacaagttccgttttgctcgcatcattttcatgagttaataatgaaggacggaagaaaattggtagttccatgtagaccgcaggatgaactaataggacgggcaagaatatcacaaggcgcagggtggtcattaaaagaaacagcttgtttaggaaaggcttatgctcaaatgtgggcattaatgtatttccacagacgtgatctcagactagcgagcaatgccatctgttcagcagtcccagtacactgggtacccacgtccagaacaacatggtctatacacgctcaccaccaatggatgacaaccgaagatatgttaaccgtctggaacagagtttggatagaagacaacccttggatggaagataaaacaccagtaaccacatgggaggacgtgccttacctcggaaaacgtgaagaccaatggtgcggatcactcataggattaacctctcgtgctacatgggcacaaaatatactgacagcgatccaacaagtccgaagtttgatcggtaatgaagaatttctagattatatgccaagtatgaagcgcttccgaaaggaagaggagtcagagggagcaatatggtag

SEQ ID NO: 23526 - RNA, 9873 nt, synthetic construct
  misc_feature 1..9873: note = derived and/or modified CDS sequence (opt6) from DENV-3__KC762692__SS-prME
  source 1..9873: mol_type = other RNA
acttccttgtgtctgatgatgatgttaccggcaaccttagctttccacctaacatccagagacggagaacctagaatgattgtagggaaaaacgaaaggggtaaatcattactatttaaaactgcgtcgggtatcaatatgtgtacattgattgctatggatctgggggaaatgtgtgatgatacagtaacatacaaatgccctcttataacagaagtggaaccagaagatattgattgctggtgtaacttaacaagtacctgggttacatatggaacgtgtaaccaagcaggagaacataggagggataaaaggtctgtagcattggcgccgcacgtcggaatgggtttagatacccgcgcacaaacatggatgagtgcggaaggagcatggagacaagtggagaaagttgaaacatgggcattcagacatccaggttttacaatacttgccctattcttagctcactacataggcacttcattaactcaaaaagttgtaatttttattctactaatgcttgttacaccgagtatgaccatgagatgtgtcggagtaggaaaccgcgacttcgtagagggtcttagcggggcaacctgggtagatgtagtattggagcatggtgggtgtgtaacaacgatggcgaaaaataaaccaacccttgacatagaactccagaaaacggaagcaacacaacttgccaccctcagaaaattatgtatagagggaaaaataacgaatgtaactacggatagcagatgtcccacccaaggtgaagctattctacctgaagaacaagatcaaaattacgtgtgtaaacacacttacgttgatagaggatggggaaatggctgtggactatttggaaaaggatcacttgtcacttgtgcaaagttccaatgtcttgaactaattgaaggcaaagtcgtccaacatgaaaaccttaaatacacagtaatcataaccgtccatacgggtgaccaacaccaagttggaaatgagactcaaggcgttacagcagaaatcacacctcaagcatcgacagttgaagcaatattacccgaatacgggactttgggactggaatgttcaccaagaacgggcctggattttaatgagatgattctgctaacgatgaaaaacaaggcttggatggtacatagacaatggttctttgatttaccactcccctggacgtcaggagcgacgacggaaactccaacatggaacaagaaagaattgctcgtgacatttaaaaatgcccacgcaaagaaacaagaagtagttgttttaggaagtcaagagggcgctatgcatactgcattgacaggcgccactgaaattcaaacctcaggaggaacaagtatctttgcaggccaccttaaatgtagattaaaaatggataaactagaattgaaaggaatgagctatgccatgtgctcgaatgcattcgtgctaaagaaagaggtttcggaaacgcaacatggaaccattctaatcaaagtggaatacaaaggtgaggatgctccttgtaaaatacctttctcgacagaagatgggcaagggaaggctcataacggcagattaataacagctaaccccgtcgtcaccaagaaagaagaaccagtaaatatagaagctgaacctccttttggagaatccaacataataattggtataggtgataaagctctcaaaataaactggtataaaaagggttcatccatagggaaaatgtttgaagcgactgcacgtggggctagaagaatggcaattctcggtgatacagcgtgggactttggttcagtaggaggggttttaaattcattaggaaaaatggttcatcaaatattcggttctgcatatacggcattattttcaggtgtatcttggataatgaagattgggataggggttctcctaacttggatagggttgaactctaaaaatacctccatgtcatttagttgtatagtgatcggaataataacgctttatctaggcgcagtggtacaagcagatatgggatgcgtaatcaactggaaaggaaaagaattaaaatgcggcagcggaatatttgttactaatgaggttcacacatggacagagcaatacaaatttcaagcagacagtccgaaaaggcttgcaacagccattgttggagcgtgggaaaatggagtgtgtggcattagatcaaccacgaggatggaaaatttactttggaaacagatagcaaatgaactaaattacatactatgggagaataatatcaaactaactgtggtagtaggggatataattggtgtacttgaacaaggtaaaaggacattaactccacaacctatggagttgaaatattcctggaaaacatgggggaaagcaaaaatagtgactgcagagatccaaaacagttcttttattattgacggccctaacacaccagagtgcccgaatgcctctagagcatggaacgtttgggaagtagaagattacggattcggcgtatttacgacgaacatctggttgaaacttcgtgaaatgtacacacagttatgcgatcatagactaatgtcggcagccgtaaaggatgaaagagctgtgcatgcggacatgggatattggatagaatcgcagaaaaatgggagttggaaacttgaaaaggcaagtctgatagaagtaaagacatgcacttggccgaaatcgcatactttgtggagcaatggagtattggaatcggatatgataataccaaaatcactagcaggccccataagtcaacataattaccggcccgggtatcacacacaaacagcagggccatggcatctcggaaaactagagttagactttaattattgtgaagggacaactgtggttatcacggaaaattgtgggacaaggggtccttcacttcgcactactacggtcagcggaaaacttattcatgaatggtgctgcagatcctgtacactaccgcctttacgatatatgggggaagatggatgttggtatggtatggagatacgaccaatcaacgaaaaagaagaaaatatggtaaagagcttagtttcagcggggtcaggaaaagttgataatttcacaatgggcgtactttgcctagctatcctattcgaagaagttatgcggggtaaattcggcaagaaacacatgatagctggagtattattcatgttcgtcttattattatctggtcaaattacctggagagatatggcacgaacattaatcatgatagggtctaatgcatctgacagaatgggaatgggagttacttacctagcactcatagctacgttcaaaatacaaccattcctagccctaggattctttctacgaaaactcacgtcacgtgagaatctattgctcggtgtgggtcttgcaatggccacaactcttcaacttcctgaagacatagaacaaatggctaatggaattgccctaggattaatggtattaaagctaataacacaatttgaaacttaccaactatggactgcactggtaagcctaacttgctctaacacaatcttcaccctaaccgtagcatggagaacggccacattgattttagccggcacgagtcttctaccagtgtgtcaatcaagttcgatgcgaaaaactgattggttgcccatgacagtggcagcgatgggcgtcccaccattaccgctctttatttttagcctcaaagacactcttaagagacggtcatggccattgaatgaaggtgtaatggccgtaggcctggtctcaattcttgcgtcaagtctccttagaaatgatgttccaatggcaggtccgttggtagccggtggattactaatcgcgtgctatgttattacaggaacttcggcggacttgacagttgagaaagctgcagatgttacttgggaagaagaagcagaacaaacaggcgtttcacataacttaatgataactgttgacgatgatggaaccatgaggataaaagacgacgaaactgagaatattctcactgttctactgaaaaccgcactacttattgtaagtggaatatttccttattcaattcccgcaactctattagtatggcatacatggcaaaaacaaactcaacgatcgggagtactttgggatgtgccatcgccgcccgaaacgcagaaagcggaactcgaagagggtgtgtacaggatcaaacaacaaggtatattcggcaaaacacaagtaggcgtaggagttcaaaaagagggtgtcttccatactatgtggcacgttacaagaggcgcagtcctgacatacaacggaaaaagactcgaacccaactgggcatcagtcaagaaagatttaatatcatacgggggtggctggcgactatcggcacaatggcaaaaaggcgaagaagtacaggtaatagctgttgaaccagggaaaaatcctaaaaatttccaaacaatgccgggcattttccagactataacgggagaaataggagctattgcactagattttaaaccaggcacttcgggatctccaataataaatcgcgaaggcaaggttgtaggcctttatggtaacggtgttgttactaaaaatggagggtatgtctccggcattgcccagactaatgcggaaccggacggtccgaccccggagctagaagaagaaatgttcaaaaagcgcaacctaactataatggatttacacccaggctcaggtaagaccaggaaatacttgccgaccatagtaagagaggcgattaaaaggagattgagaaccttaatactagcacccacgagagtggttgcggctgaaatggaagaagcattaaaaggtttacctatacgatatcaaacaaccgccactaaaagtgagcacacaggaaaagaaatcgtagacctaatgtgccacgcaactttcacaatgaggcttctgtcgccagtaagggtaccaaactataatttaattattatggacgaagcgcattttactgaccctgcgagcattgctgcaagaggatatatatcgaccagagtcggcatgggcgaagcagctgcaattttcatgacagcgacaccacctggaacagctgatgcatttccacaaagtaatgctccaatacaagatgaagaaagagacataccagaacgaagctggaacagcggcaacgactggattactgactttgcggggaaaacagtctggtttgttccctccattaaggctggcaatgatatagcaaattgtttgaggaaaaacggcaagaaagtaatacagttaagtagaaagactttcgatacagagtatcagaaaactaaactgaatgactgggatttcgtagtaactacggatattagtgaaatgggtgcaaactttaaagcagatcgagtaatcgacccaaggcgctgtctcaaaccagtaatcctgactgacggcccagaaagagtaatattagccgggccaatgcctgtaaccgttgccagcgcagcacaaagaaggggaagagtaggtaggaacccccagaaagaaaatgaccaatatatttttaccggtcaacctttgaataatgacgaggatcatgctcattggacagaagcgaaaatgttattagataatataaacactcccgaaggcatcatccccgcattgttcgaacccgagagagaaaagtctgcagcaattgatggtgagtatagactcaagggcgaaagcagaaaaacatttgttgaacttatgcgacgtggtgatttgcccgtctggctggcacataaggtagcaagtgaggggattaaatacactgacagaaaatggtgtttcgatggtgaacgaaacaaccagatactagaagagaatatggacgtagaaatttggacaaaggaaggggagaaaaagaaacttagaccaagatggctggatgcccgaacttattctgacccattagctcttaaagaatttaaagattttgcagcaggccgcaaatctatagcactagatctcgttaccgaaatagggagagttccctcacacctagctcacagaacgcgaaacgcactagataaccttgtcatgttacacacatcagagcacggcggcagagcttaccgtcatgccgtcgaagaacttccagaaacaatggaaactctcctactcctcggtttaatgatcctactgacaggaggagcgatgctgtttttaatatctggtaaaggggttgggaaaacatccattggacttatctgtgtcgtagcttcaagtggtatgctatggatggcggatataccattgcaatggatagcctcggctatagttttggaatttttcatgatggttttattaataccagaaccagaaaaacaaaggacgccccaagataaccagctagcgtatgtggtgattgggatacttaccctagctgctatagtggctgctaatgaaatgggacttctcgaaacgaccaagagagatctgggaatgagtaaagagccaggagtagtaagcccgacatcgtatcttgacgtagatcttcatcccgcttcagcttggacattgtatgctgtagccacaactgtaatcactccgatgctccgacacacaatagaaaactccacggcaaatgtgtcacttgctgcgatagctaatcaagcagttgtactaatgggtttggacaagggctggccgataagcaagatggatttaggtgtaccactattggcgttgggctgctactcgcaagtaaacccactaacacttacggccgcagtactactacttgtgacccattatgcaattattggacctgggctacaggcaaaggcaacgcgagaagctcagaagaggactgcagctgggattatgaaaaatccgacggtagacggtattatgactatagatctcgacccggtcatatacgacagcaaattcgagaaacagctaggccaagtaatgttactcgtcttatgtgccgttcaactattacttatgcgtacatcctgggcattttgcgaagccttgacattagccacaggtcctataacaacgttgtgggaaggttctcccggaaaattttggaacacaacaatagcagtctctatggctaatatctttcgtggaagctatttagctggagcaggattggctttcagtataatgaaatcagttggtacaggcaagagaggaaccggtagtcaaggtgaaactctaggtgaaaaatggaagaagaaattaaatcagctctctcgcaaagagtttgacctctataaaaagagcggcatcactgaagtagatcgtacggaagctaaagaaggcctgaaacgtggtgaaattacgcaccacgccgtaagcagagggagcgcaaagctccaatggttcgtagaacgtaacatggttattccagaaggaagagtgatagatctaggttgtggtaggggtggttggtcgtactattgcgctggactcaaaaaggtgaccgaagtccgaggatatacgaagggaggccccggacacgaagaacctgtcccaatgtctacttacgggtggaatattgtaaaactaatgtcagggaaagatgtattttatttaccacccgaaaaatgtgacactttactgtgcgacattggggaatcgagtccctcccctacagttgaagaatcacgtacaattcgtgtgttgaagatggtggaaccatggttgaaaaacaatcagttctgcataaaagtactgaatccatatatgccaactgttatagaacacttagaaagactacaaagaaaacacggtggcatgcttgtgagaaacccactgtcaagaaatagcacccatgaaatgtactggattagcaatggaaccggaaatattgtgagtagtgtcaacatggtcagtcgtttgttgttaaatagatttacgatgacttacagacgtcctaccatagaaaaagacgttgatcttggagccggaacgagacatgttaatgcagagccagaaacacctaacatggatgttatcggagaaagaatccgcagaataaaagaagaacattctagtacatggcactatgatgatgaaaatccgtataagacgtgggcgtatcatggaagttacgaagttaaagcaactggaagtgcatcatcaatgataaatggcgtagttaaactactgacaaaaccgtgggatgtagtaccaacagtaacgcaaatggcaatgacagacacaaccccattcggacagcaaagggtgtttaaggaaaaagtggatacccggacgccaaaaccaatgccagggacaaggaaaatcatggaaataaccgcaggctggctatggcgaacattaggcagaaataaaaggccgcgattatgtactcgtgaagaatttactaagaaagttaggacaaatgctgcaatgggagcggtttttaccgaagaaaatcagtgggattcagcgagagccgcagttgaagacgaagaattttggaaattagttgatagagaaagagaactacataaacagggaaaatgcggatcctgcgtatacaatatgatgggaaagcgtgagaagaaattgggggaatttggaaaagcaaagggttcgcgggctatttggtacatgtggctgggcgcacgttatttggaatttgaagcgctcggctttctaaatgaggaccattggttctccagggaaaattcatattccggtgtagaaggggaaggtctacataaacttggttatattttgagagacattagcaaaataccagggggagctatgtatgcagatgacacagcagggtgggatacgcgaattacggaggacgacttacacaatgaggagaaaataactcaacaaatggatcctgagcacagacaactagcaaatgcaatatttaaactcacatatcaaaacaaggttgtaaaagtgcaacgacccacacccaagggtacagtcatggacattatatctcgaaaagatcaaagaggatcaggtcaagtggggacgtatggtctaaatacctttacgaatatggaagctcaactaataaggcaaatggaaggcgaaggtgtcctatcaaagacagatttagagaacccacatctacttgagaagaaaataacccaatggttagaaacaaaaggagtcgaacggctaaaacgcatggcaatttcaggagatgactgtgttgtaaaaccaatagatgacagattcgccaatgcactactggcactaaacgacatggggaaggttagaaaggatatacctcaatggcaaccaagtaaaggatggcatgactggcagcaagtcccattttgttctcatcattttcatgaactcataatgaaagatggtcgtaatttagtagtaccctgcagaccccaagacgaattgataggacgtgctaggatatcacaaggcgcgggttggagcttaaaagaaaccgcatgcttgggaaaggcttatgcacaaatgtgggccctaatgtacttccataggagagatctacgcttagcctctaatgcaatatgctctgcagtgccagtgcactgggtacctacatcaagaacgacatggtctatacatgcgcaccaccaatggatgaccacagagaatatgctaacagtatggaaccgagtgtggattgaggataatccctggatggaagacaagacaccagttaccacttgggaagacgtcccttatttgggcaagagagaagatcagtggtgtggaagtttgataggactaacatcacgagcgacctgggctcagaatattctgacggcaatccagcaagtgaggagcttaattggaaatgaggagttcttagattatatgccatcgatgaagcgatttcgtaaagaggaggaatcagaaggagctatatggtga

SEQ ID NO: 23527 - RNA, 9873 nt, synthetic construct
  misc_feature 1..9873: note = derived and/or modified CDS sequence (opt6) from DENV-3__JQ920481__SS-prME
  source 1..9873: mol_type = other RNA
acttccctttgcttgatgatgatgctgcctgcaacgttggcattccacttgacgtctagagacggggagccccggatgatagtgggcaaaaatgaacgaggtaaatcacttctgtttaaaaccgctagtggtataaatatgtgtacactgatagcaatggacttaggtgaaatgtgtgacgacacggttacctataaatgcccacttattacagaagttgagcctgaagacatcgattgttggtgcaatttgacatctacatgggtaacgtacggaacttgtaatcaagcaggagaacatagacgtgataaaagaagtgttgcattagccccacacgtcggaatggggctcgatacacgtactcaaacgtggatgagcgccgaaggcgcttggagacaagttgagaaagtcgaaacctgggcttttcggcatccaggctttacaatcttagcactatttctagcacactatatcggtacgtcattaacacaaaaagtagtcattttcatccttttaatgctagtaaccccatctatgacaatgaggtgcgttggagtcggaaacagagactttgtagaaggactgtccggtgcaacatgggtggatgtcgtactggaacatgggggctgcgttacaacaatggccaaaaacaaacctacacttgacattgagcttcagaaaacggaagccacacaattggcaactttacgtaaactatgcatagagggtaaaataaccaacgtaactacagactctcggtgtccaacccaaggggaagcaatattgccagaggaacaagaccaaaattacgtctgtaaacacacgtatgtcgatagaggatggggcaatgggtgcggtctattcggcaaaggatcgcttgtgacgtgtgccaaatttcagtgtttagaaagcatagaaggcaaagccgtacaacatgaaaacctaaaatatactgttataataactgtacatactggggatcaacaccaagttggaaatgaaactcagggagtcacagcagaaattacaccccaagcatccactgttgaggcaatcctaccagaatacggaacattagggctggaatgcagccctaggacgggcttagatttcaacgagatgatactgttaactatgaaaaataaagcctggatggtgcatagacaatggttctttgacctcccactaccctggacatcgggtgctacgacagaaacacctacatggaataagaaagaactattagtaacatttaaaaatgcacatgctaagaaacaggaggttgtagtactaggaagccaagaaggtgcaatgcatacagcgctgacaggagcaacagaaatacaaaccagtggaggaacaagtatcttcgcgggacatttaaaatgtaggttaaaaatggataaactagaattgaaaggcatgtcttatgctatgtgcctaaacgctttcgtactaaagaaagaagttagcgaaacacaacatggcacaatactaattaaagtagaatataaaggggaggatgctccttgtaaaataccatttagtactgaagatggtcaaggtaaagcgcataacggtagactaataacagcaaaccctatagtcactaagaaagaagaaccggtgaacatagaggcagaaccaccttttggtgagagcaatattgtaataggcataggagataaagcactaaaaataaactggtacaaaaagggatctagcattggtaaaatgtttgaggctacggcaaggggtgctcggcgtatggcaatacttggcgacactgcgtgggattttggttcagtgggcggagtactaaactctcttgggaaaatggtgcaccaaattttcggcagtgcatacacagcattattctcaggtgtctcgtggattatgaaaattggaataggtgtactgctaacgtggatagggctaaacagtaaaaatacgtccatgagctttagctgtatagttattgggattattacactctatctgggtgcagttgtccaagctgacatgggttgtgtcataaactggaaaggaaaagaactgaaatgcggttccggcattttcgtaactaatgaagtacacacatggacagagcaatataagtttcaagcagatagtcctaaaaggcttgccacagcaatagcgggagcgtgggagaatggagtctgcggcataagaagcacaacacgcatggagaatcttctgtggaaacagatagcaaatgaacttaactacatattatgggagaataatataaaattaacagtcgttgttggagatgtgataggagtactcgaacaaggtaagagaactttgactccccaaccaatggaacttaagtactcatggaaaacgtggggaaaggcaaaaatagtcaccgctgaaactcaaaattctagttttataattgacggaccaaatactcctgagtgcccatcagcatcaagggcttggaatgtgtgggaagttgaagattatggattcggagtatttacaacaaacatttggttgaaattaagagaaatgtacacacaactttgtgaccatagattaatgagcgctgcagtcaaagatgaacgggctgtacacgccgacatgggctactggatcgagagccaaaagaatggaagttggaagctagaaaaagcctcattaatagaagttaaaacctgtacatggccgaaaagccacaccttgtggtcaaatggagttttagaatcagatatgatcatcccgaaaagtttagctggtcctatatcacaacataattatagaccagggtaccatacgcaaaccgcaggcccctggcacttagggaagctagaattagacttcaactactgtgagggaactacagtggttataacagagaattgtggaactaggggaccttctctcagaactaccacagttagtggaaaattaattcatgaatggtgctgcagaagctgtactttacctccacttagatacatgggagaagacggatgctggtatggtatggaaattagacccattaacgaaaaggaggaaaatatggtaaaatcattagtctcagctggttccggaaaagctgataattttacgatgggcgtattatgcctggcaattctttttgaagaagttatgcgagggaaattcggtaagaaacatatgattgcaggagcattatttacatttgttctgctactttcaggtcaaatcacatggagagatatggcgcacactttgataatgattggctctaatgctagcgacaggatggggatgggggtcacttacctggcactaatagcaaccttcaaaattcaaccctttttggcactaggatttttcctacgcaaattaacctcccgtgaaaatctgctgctgggagtgggccttgcgatggccaccaccctccaattgccggaggatatagaacaaatggctaatggtatcgctcttggccttatggcattaaaactaatcacccaattcgaaacttatcaattatggacagccttagttagtcttatgtgctcaaacaccatatttacgttaaccgtcgcttggagaaccgcaacgcttatacttgcggtaatctcgttgttaccagtttgtcaaagttcaagcatgcgaaagactgattggctacctatgacggtggcagcaatgggagtccctcctctaccactatttatttttagtttgaaagatacgctgaaaagacgatcatggcctctaaatgaaggtgtaatggcagtcggacttgtaagtattttagctagttcatttctaagaaacgatgtaccaatggctggacccctggtagcgggaggtctcttaatagcatgttacgttataactggaacatcggccgatctaacagtcgaaaaagcagctgatgtaacatgggaagaagaggctgaacagactggcgtatcacataacctcatgataacggtagatgatgacggcacaatgcggattaaggatgacgaaactgaaaacatacttaccgtgctactaaaaaccgcactacttatagtaagcggaatattcccctatagtatacccgccactttattagtttggcacacttggcaaaagcagactcagaggagtggtgtactgtgggacgtgccgtctccccctgaaactcaaaaagcagaattagaagaaggcgtgtacagaataaagcaacaaggcatattcgggaaaacacaggttggagtgggagtacaaaaagaaggagtttttcatacaatgtggcatgtaacacgcggagctgtgctcacacataacggtaaacgattagaaccaaattgggccaacgtcaagaaagatctcataagctacggcggagggtggaagctatcagcacaatggcagaaaggtgaagaggtccaagttatcgcagtggaaccaggcaaaaatcccaaaaatttccaaacaatgccaggcatttttcaaactacaactggtgaaattggcgccatcgctctcgattttaagccaggaacaagtgggtcaccaattattaatagagaagggaaagtcgttggtctttatggaaacggagtggtcactaaaaacggaggatacgtcagtggaattgctcaaacgaacgcagaacctgatggacccacgcctgagttagaagaagaaatgttcaagaaaagaaatttaactattatggatttacatccaggctcagggaagacaaggaaatacttaccagctatagtacgtgaagccattaaaagacgactcaggacacttatattggccccaacaagagttgtcgctgccgaaatggaagaagcgctgaagggattgccgatcagatatcaaacaacagctacgaaaagtgagcacactggaagggagatcgttgacctcatgtgtcatgctacattcacaatgagattactatctccagtgcgtgtacccaactacaatttaatcgtcatggacgaagcgcatttcactgatcctgccagtatagccgctcggggttatattagcacaagagtcggaatgggggaagcggcggcaattttcatgaccgctacaccaccaggaacggctgatgcctttccacaatcaaatgccccaattcaagatgaggaacgggatattcccgaacgaagctggaactcagggaatgaatggataactgatttcgcgggcaaaacggtatggttcgtcccctcaataaaagctggtaacgatatagcgaattgtctacgcaaaaatggcaagaaagtcattcaattaagcagaaaaacatttgatacagaataccagaaaacaaaactaaacgactgggattttgtcgttacaacagacatcagtgagatgggtgctaattttaaagcagatcgagtcatcgatccacgtcgatgtttaaaacctgtcattcttaccgacggaccggaacgagtcatactcgcaggacccatgccagtgacagtagcgtctgcagcccaaaggcgaggacgagtcggtagaaaccctcaaaaagaaaacgatcaatacatattcactggtcaaccccttaacaatgatgaggatcacgcccactggacggaggctaaaatgttattggataacattaatactcccgagggaataataccagccttatttgaaccggaacgagagaaatcggcggctatagatggtgaatacagactaaaaggggagagtcggaaaacgtttgtggaattaatgcggagaggtgacctcccagtatggttggcccacaaggttgcaagcgaaggtataaagtacacagatcgtaaatggtgttttgatggggagagaaacaaccagatattggaggaaaacatggatgtagagatatggacaaaagagggcgagaaaaagaaacttcgaccgagatggcttgatgccagaacttattcagacccattggcactgaaagaatttaaagactttgcagcaggaagaaaatctattgccctagatctggttactgagataggtcgagtcccctcacacctagcacatagaacacgaaacgcgcttgacaaccttgtaatgttacatacctcagaacatggtggtagagcgtatagacatgccgtagaagaattgccggagactatggaaacactacttttattaggtctgatgatcttactaacaggaggggccatgctctttctaatcagtggtaaaggtattggcaaaacgtcgattggtttgatctgcgtcgttgcttcttcaggaatgttgtggatggcagatgtaccattgcaatggatcgcaagtgcaatagtgctcgagttctttatgatggttttgctgataccggaaccggaaaaacaacgtacacctcaggataatcaattagcttatgtcgtgattggaatactaactctggcagctatagtagccgctaatgaaatgggacttttagaaacaacaaaaagggatttaggcatgtccaaagaaccaggagtggtaagtccgacatcatatttagacgttgatctgcatccggcatctgcctggacactttacgccgtcgcgactactgtgataacaccaatgttgagacacacaattgaaaattctacagctaacgtctctctggcagctatagctaatcaagccgttgtactaatgggactagacaaaggctggccgatctccaaaatggacctaggcgtaccactacttgcccttggctgctacagtcaagtaaatccacttacgttgacagcagctgtcttactcctagtcacgcattatgccataataggacctggacttcaggctaaagctacaagagaagcgcagaaaagaacagcagcgggaattatgaagaatcctactgtagatggaatcatgacaatcgacttagaccccgttatttatgatagtaaatttgaaaaacaattgggacaagtgatgttgctagtactttgcgctgttcaacttttattaatgaggacgtcatgggcattttgtgaagcgttaacgctggcaacgggtccaattactacattatgggagggatcaccaggaaaattttggaatactaccattgcagtaagcatggctaatattttcagaggcagttatttagcaggggcgggactagccttttcaataatgaaatcggtaggtacaggcaaacgaggaacaggttcgcagggagagacactgggggaaaaatggaagaagaaattaaatcaattatcgcgtaaagaatttgatctatataagaaatcgggtataacagaagttgataggacggaagcaaaagaaggactaaaacgaggtgaaataactcatcatgccgtaagtagagggtctgctaagttacaatggtttgtagaacgaaacatggtaatccccgaaggaagggtcatagatctcggctgcggcagaggagggtggtcgtattactgcgctggattaaagaaagttacagaagtacgcggctacactaaaggcggaccaggacatgaagaaccggttcccatgtcaacgtatggctggaatatagtgaagttaatgtctggtaaagacgtattttacctgccgccagagaaatgtgacactttactatgtgatataggagagtcaagtccctccccgaccgtcgaagaaagtaggactattcgtgtcttaaaaatggttgaaccttggctgaaaaataatcaattctgcataaaggtgcttaatccgtatatgccaacggttatagaacatctagaaagactccaaagaaaacatggaggtatgctagtaagaaacccattatcgagaaatagtacccacgaaatgtattggataagcaacggaacaggcaacatcgtaagctctgtgaacatggtatcaagactactgttaaatcgttttacgatgacccaccgacggccgaccatagaaaaagacgtagatctgggtgcagggacaagacatgtcaatgcggaacctgaaaccccaaacatggatgtaattggtgaacgtatccggcgaattaaagaggagcactcctcaacttggcattatgatgatgaaaatccgtacaaaacatgggcatatcacggttcatacgaagtaaaagccacaggatctgcaagttccatgatcaacggggttgtaaagctactaacaaaaccatgggatgtagtgcctatggtgacacaaatggccatgaccgataccactccattcggtcaacaacgcgtatttaaagaaaaggtagacacgcgcaccccacgcccaatgcccggtacaagaaaagttatggagataaccgcagaatggctttggcgcaccctcggacgtaataaacgtccaagactctgtactagggaggaatttatcaagaaagttagaactaacgctgcgatgggtgcagtgtttactgaagaaaatcagtgggattcagctagagctgcagttgaagacgaagaattttggaagctagttgatcgggaaagagaactgcataaactaggaaagtgtggatcttgtgtttataacatgatgggaaaacgtgagaaaaagttaggtgagtttggaaaagcgaaaggatcaagagcaatatggtatatgtggttaggagcacggtacctagaatttgaagctcttggatttttaaacgaagaccattggttcagtcgtgaaaattcgtatagtggtgttgaaggtgaaggactacataaactaggctatattcttagagatataagtaagattccaggtggcgccatgtacgctgacgataccgctgggtgggacacaaggataacagaagacgatctacacaatgaagaaaagataacgcaacaaatggacccagaacatagacagttagcaaatgcgatttttaaattaacgtaccaaaacaaagtggtaaaggttcaaagacctacgcctaaaggaacagtcatggacattatcagtagaaaagatcaacggggaagtggtcaagtggggacatatggtctcaacactttcacaaacatggaggcgcaattgattagacaaatggagggtgaaggagtattatccaaagcggatctagaaaacccacacttattggagaagaaagtgacccaatggttagaaactaaaggagtagaacgactcaaacgtatggcaatatccggagatgattgcgtggtaaagcctattgatgaccggttcgcaaacgcgcttctggcactaaatgatatgggaaaagtaaggaaagacataccacaatggcagccaagtaaaggatggcatgattggcagcaggtacccttctgtagccaccacttccatgaactcattatgaaggatgggagaaaactggtcgtcccatgtagaccacaagacgaattaatagggagagctagaatttcacagggtgcaggctggagcttgagagagacggcatgcttaggtaaagcgtatgcacaaatgtgggctttaatgtattttcaccgaagagacctgcgattagcttccaatgcgatatgttccgccgtccctgtgcattgggtaccaacatcacgaactacatggagtattcacgcgcatcaccaatggatgactactgaagatatgctaaccgtttggaaccgtgtttggatagaagataacccctggatggaagacaagacgcccgtaacaacatgggaagacgtgccgtatttaggcaagagagaagaccagtggtgtggatcattaataggcttaacatccagagccacctgggcacaaaatatactaacagcaatacagcaagttagatctctcataggaaacgaagagtttttagattacatgccctcaatgaaaaggtttaggaaagaagaagaatctgaaggtgcgatctggtag

SEQ ID NO: 23528 - RNA, 9873 nt, synthetic construct
  misc_feature 1..9873: note = derived and/or modified CDS sequence (opt6) from DENV-3__JQ920483__SS-prME
  source 1..9873: mol_type = other RNA
accagtctttgtttaatgatgatgttaccagcaacgttggctttccatctaacatcgagagatggagaaccgagaatgatagtgggcaaaaatgagcgtggtaaaagtctactatttaagacagcttcagggatcaatatgtgcacactaatagcaatggatctaggagagatgtgcgacgatacagttacatacaaatgcccgttaattacagaggttgaaccagaggacatagattgctggtgcaatttgacaagtacatgggtaacctacggaacatgtaaccaagcaggagaacatcgccgggataagagatctgtggcattagcgccacacgtcggaatgggactcgacacccgcactcagacatggatgagcgccgagggtgcatggcgccaggttgaaaaggtggaaacttgggccttcagacatcccggttttactattttagcactctttttagcacactatatcggtacaagcttaactcagaaagttgtgatcttcatattactaatgcttgtaacgccatctatgacaatgagatgcgttggggtcgggaatcgagactttgttgagggactctcgggggcaacatgggttgatgtagtcttggaacacggcgggtgtgtgaccacgatggctaaaaataagccaactctggatatcgaactacaaaaaactgaggctacacagcttgcgacattaagaaaactttgcattgaaggcaaaataacaaatgtcacaaccgactcacgttgtccgacacaaggagaagccattttaccagaagaacaaaatcaaaactacgtgtgtaagcatacatatgttgaccgaggttgggggaatggttgtggtttgttcggtaaaggcagcttagttacttgtgctaagttccagtgtttggagtcaatagaaggcaaagccgttcaacacgagaacttaaaatacaccgtaatcataacggtacacaccggtgaccaacatcaagtgggcaacgaaactcaaggggtcactgcggagattacaccccaagccagcaccgtggaagctatactgccggaatacggcactcttggattggaatgtagtccaagaactgggctagattttaatgagatgatcctacttactatgaaaaacaaagcatggatggtacacagacagtggttttttgacttaccattgccatggacctccggcgcaacaacagaaacaccaacctggaataagaaagaactactggtaacctttaagaatgctcacgcgaaaaaacaagaagtagtagtacttggaagtcaggagggggcaatgcatacagcactcacaggcgcgacggaaatacaaacgagcggcgggacctcgatatttgcaggccatttgaaatgtcgactaaagatggataaacttgaattgaaagggatgagctacgctatgtgtcttaacgcattcgttctaaaaaaagaagtttcagaaacacagcatggcacaatattgattaaagtagaatacaagggcgaagatgccccatgcaaaataccattcagtactgaagacggacaaggtaaggctcataatggccggcttataacagccaatccaatcgttaccaaaaaagaagagcccgtgaatatagaggctgaaccaccatttggtgaaagcaatatagtgataggtataggcgataaagcattaaaaataaattggtacaaaaaaggtagctccatcggtaagatgttcgaagcaaccgcacgaggggcacgtagaatggctatcttgggtgatacagcttgggacttcggatctgttggcggggtactcaatagccttggaaaaatggttcaccaaatttttggatcggcttatactgctctattttcaggtgtaagctggataatgaaaattggaataggcgtgctcttaacatggattggtttaaactcgaaaaacacgtcgatgagtttttcgtgtattgtcataggtatcataaccttatacttgggtgcagtggttcaggctgatatgggctgcgttattaattggaaaggaaaagagttaaaatgtggatcaggtattttcgtaacaaacgaagtccatacgtggactgagcaatacaaattccaagcagattctccaaagcgacttgcaactgctatcgcaggagcatgggaaaacggtgtgtgtggaattcgtagcactacacgaatggaaaacctcttatggaaacaaatcgcgaacgaactcaattacattctatgggaaaacaatataaagctaactatagtggtcggagatgtaattggcgtgttggagcaaggtaaaaggacattaacaccccaacctatggaactcaaatactcatggaaaacatggggtaaggcaaagatagtaacagcagaaacacaaaatagttcattcattatagacggtcccaataccccagaatgtccaagcgctagccgtgcatggaacgtatgggaagttgaagattacggctttggagttttcacgactaatatatggctaaagttgagagagaaatacacccaattatgtgaccacaggttaatgagtgcagcagtgaaagatgaaagggctgtacacgccgacatgggctattggatagagtcgcagaaaaacggatcctggaaattggaaaaagcttccttaatcgaagtaaaaacatgtacatggccaaaatcccacacgctttggtcaaacggtgtccttgaatcggacatgataatcccgaaaagtttagcaggacctatctcacaacataattatagacctggctaccatacccaaacagcaggtccttggcatctaggaaagttagaattagattttaactactgtgagggaacaacagtcgtgatcacggaaaactgtggaattagaggaccgtccctgagaaccaccacagtctctggaaagctaatacatgaatggtgttgtaggtcatgtacgctcccacccctccgatacatgggagaggacggatgttggtacggcatggagattcgaccgattaatgaaaaggaggaaaacatggtaaagtcactagtctcagctggctcaggcaaaacagacaattttactatgggcgtgttatgcttagccatcctcttcgaagaagtaatgagagggaaatttggaaaaaagcatatgattgccggtgcattatttacgttcgtactgcttctatcagggcaaataacatggcgggatatggctcacacattaataatgattggatccaatgccagcgatagaatgggcatgggagtcacctatcttgcacttatagcgacattcaagatccaaccttttttagcacttggatttttcctaagaaaattaacaagcagagaaaatcttctattaggagtgggtcttgcaatggctaccacattgcagttgccagaagatattgaacaaatggctaatggcatcgctctaggattgatggctttaaaacttataacacaatttgaaacataccaattgtggacagcacttattagtttgatgtgttcgaatacaatatttactttaacagtagcttggagaacggcaacactcatattggcagttatttcgctcttacccgtttgtcagagttcatcaatgaggaaaaccgattggctcccaatgacagtcgcagcgatgggggtaccacccttgccgttatttatatttagtctcaaagatactctgaaaagacgcagttggccattaaacgaaggtgtcatggcagttggactagtgtctatattagcttcctcgtttttaagaaacgatgttccaatggcggggccgttagttgcaggcggattgttgatcgcctgttacgtcataactggcacatcggcggacttaactgtggaaaaagcagcagatgtcacctgggaagaagaggccgaacaaacaggcgtgagtcacaacttaatgataaccgtagacgatgatggaacgatgcgaattaaggacgacgagacggaaaatatcctaaccgtacttttaaagacagcactactcatagtaagtgggatatttccatactctatcccagcaacattactagtttggcatacttggcaaaaacaaacacaaaggagtggggtattgtgggacgtgccgagtccaccagaaactcaaaaagcagaactagaagaaggcgtctacagaataaaacaacaaggcatatttggtaaaacacaagtaggagtgggggtacagaaagaaggcgtatttcacactatgtggcacgtaacgcgaggtgcagtgttgacccataatggaaagcgactagagcccaattgggctaacgtaaaaaaagacttaatatcatatgggggaggatggaaactgtcggcgcaatggcaaaaaggagaagaggtccaagtaatagcagtagaaccagggaaaaacccaaaaaatttccagacgatgccgggtatattccaaacaacaactggagaaatcggggcgatcgcgttagactttaaaccgggaacgtctggctctccaatcatcaatagagaaggaaaagtagttggattatatggaaatggtgttgtaacaaaaaacggtggttatgtttcgggtattgcgcaaactaatgccgaaccagatggtccaacgcctgaattagaggaagagatgtttaagaaaagaaatcttacaataatggatctacatccgggatcaggaaagactagaaaatatctccctgcaatagtacgcgaagctataaagagaagacttcgaactcttatcttagcccctacacgagttgttgcagcagaaatggaagaagcattgaaaggactccccattcgttaccaaacaacagcgaccaaatctgaacacaccggcagagagatagtggatctaatgtgccacgcaacctttacaatgaggctcctgtctcctgtacgtgttcctaattacaatttaattgtaatggacgaagcccattttacagaccccgcgagtattgcagctcgaggttacatatcaaccagagttggtatgggagaagcagcagcaatatttatgaccgcaaccccaccggggactgcagatgcatttccacaatccaatgctcccatacaagacgaagaacgggatatccccgaaagaagttggaattcggggaatgaatggatcacagactttgcaggtaagacggtgtggtttgtgccatccataaaggcgggtaacgacatagccaattgtttgcgaaaaaatggtaaaaaagttattcaactaagtcgaaagacgttcgacactgaatatcagaaaactaaactgaacgactgggattttgtagttacaaccgatatttctgagatgggtgcaaacttcaaagctgatagagttattgacccacgtaggtgccttaaaccagtgatactcacagatggtccagaacgtgtaattcttgcgggaccaatgcctgtaacggtagcttcggcagcgcaaagaagaggcagagtcggaaggaattcccaaaaagaaaatgatcaatacattttcacagggcaacccttgaacaacgatgaggatcatgctcactggaccgaggcaaaaatgctcctggataatataaataccccagagggtataatcccggcattatttgaacccgaacgtgagaaatcagcagccattgatggcgaatatcgcttaaaaggtgagagcagaaaaacatttgtcgaattgatgagaagaggtgatctcccagtctggctagcacataaggtagcatctgaaggaatcaaatacacagataggaaatggtgctttgatggtgaacgcaacaatcagattctagaagaaaatatggatgtagaaatctggacgaaagaaggagaaaaaaaaaaactacgaccaagatggttggacgcaagaacatatagcgatcctttggcgctaaaagagtttaaagatttcgctgcgggccgcaaaagcatagcgttggaccttgtgacggaaataggaagagtaccaagtcacttagctcatcgaactagaaatgcactagataatctagtaatgcttcacacatccgaacatgggggtagagcatatagacacgctgttgaagaactaccagagactatggaaaccttattattgttgggcctaatgatactcctgacagggggagccatgctattcctgatatctggtaaagggatcggaaaaacatcgattggtctaatttgcgtcgtagccagttcaggaatgttatggatggccgacgtaccattacaatggatagcgtcagctatagttttggaatttttcatgatggtcctgctgatcccagaaccagaaaaacaaagaacaccacaagacaatcaattagcctatgtagttattgggattcttacattagcagccatagtcgccgcaaacgaaatggggctgcttgaaactacgaaacgagatctcggtatgtctaaagaaccaggcgtggtgtctcctacttcttatttagacgtagatctacacccagcaagtgcatggacactatacgcggtagcaaccacagtaatcacgccaatgcttagacacactatcgaaaactccacagcaaacgtatcattagcggcaatcgcaaaccaagctgtggtactgatggggctcgacaaaggttggcctatatcaaaaatggatttaggtgtacctttattggctctcggttgttacagccaagtgaaccccttaaccctgactgctgcggtgcttttactcgtaactcattacgcaatcataggccccggactccaagcaaaggcaacacgtgaggctcaaaaaagaacagctgcaggaatcatgaaaaatccgacagtagacggaataatgacaatagatctagatccagttatctacgatagcaaatttgaaaaacaactgggtcaggtaatgcttcttgtactatgtgcggttcaactgctactaatgagaaccagttgggccttctgtgaagcactaactctggctaccggccccataacaacgctttgggagggaagtcccggcaaattctggaacacaaccatagctgtatcgatggcaaacatcttcagaggtagctatttagcgggagcagggctggctttttctattatgaaatcagtaggaactggaaagagaggcactggttctcaaggagaaactttaggagaaaaatggaagaaaaagctgaaccaactaagtagaaaagaatttgatttatataagaaatctggaataacagaagttgatcggacagaagctaaggaaggccttaaaagaggagaaataacgcaccacgcggtatccagaggtagcgccaaattacaatggtttgtggagagaaatatggtaataccggaaggacgtgtgattgatctaggttgtggacgaggtggatggtcatactattgtgctggactaaaaaaagtaacggaggtacgaggttacacaaaggggggtcctggacatgaagaacccgttcctatgtctacctatggctggaatatagtgaagctaatgagtggaaaagatgtcttctatctcccacctgaaaaatgtgatacgctcctatgtgatataggtgaatcctcaccttcgccgacagttgaggaatcaaggacgatacgagtattgaagatggttgagccctggttgaaaaataaccaattctgtataaaagtattaaacccatacatgccaacagtcatcgagcacttggagagattacaaaggaaacatggggggatgttagtacgcaatccactatcaagaaactcgacccatgaaatgtattggatcagcaacggaactggaaacatcgtatcttctgtaaatatggtatccaggctccttttgaatagatttactatgacacaccgtcggcctacaatagagaaagacgtagacttgggagcaggaactagacacgtaaatgcggaacccgaaacaccgaatatggacgtcataggggagaggatcaggagaattaaagaagaacatagtagtacctggcactatgacgatgaaaatccttataaaacgtgggcataccacggtagctacgaggtgaaggctacaggatcagcgtcaagtatgataaatggtgtagtaaaattactgactaaaccctgggatgtcgtcccaatggtcacgcaaatggccatgactgatacaacaccgtttggtcagcaaagagtttttaaagaaaaggttgacacgcggacaccacgcccgatgccgggaacgcgtaaagtaatggaaataactgccgagtggctatggcgaacacttgggcgtaacaagaggccacgactgtgtacccgagaagaattcattaagaaagtaagaacaaacgctgctatgggagcggtatttactgaagaaaatcaatgggattcagcacgagctgccgtagaagatgaagaattctggaaactagtagacagagaaagagaactccacaaattgggaaagtgtggaagctgtgtttacaatatgatgggaaaaagagaaaaaaaactaggagagttcggcaaagcaaaaggtagccgagctatatggtatatgtggttaggagcccgttatttagagtttgaagctctaggttttttaaatgaagaccattggttttctagggaaaattctcatagtggagttgaaggagagggtttacacaaacttggatatatcttaagggacatttcgaagattccaggcggagcgatgtatgctgatgatacggcaggatgggacacaagaattacagaagatgatcttcacaatgaagaaaaaataacacaacagatggatccagagcaccgtcagctagcaaacgccatatttaagctgacgtatcaaaacaaggtcgtgaaagttcaacgtccaacacccaagggtacagtaatggacataatcagtcgcaaagatcaaagaggttcaggccaggttggaacttacggactcaatacctttacaaatatggaagctcaactcattcgtcaaatggaaggggagggagtcctttccaaagcagacttagagaatccacacctgttagagaggaaagtcacgcaatggctagaaacaaagggcgtagaacgactaaagcggatggcaatttcaggagatgattgcgtagtaaaaccgattgatgatagatttgccaacgcgctgctagctcttaatgacatgggaaaagtaagaaaagatataccccagtggcagccctcgaaaggttggcacgactggcaacaggtaccattttgttcacatcacttccacgaactgattatgaaagatggaaggaaacttgtagtgccctgtcgcccacaggacgagctgatagggagagctcgtatcagtcaaggagctggctggtctttgagagaaacagcatgtttgggtaaggcctacgcacaaatgtgggctctaatgtactttcaccgaagggatctacgattagcatctaatgctatatgttcagcggtacccgttcactgggtcccgacatcaaggacaacctggtcgatacatgcacaccaccagtggatgactacggaagacatgttaacagtatggaaccgagtgtggatcgaagataatccatggatggaagacaaaacaccggtaacaacgtgggaagacgtaccttatctcggcaaacgagaagatcaatggtgtggttcattgataggacttacctcccgagcaacgtgggcacaaaatatcctgacagccatccaacaagtccgcagcttaataggcaatgaggaattcttggattacatgccatccatgaaacgctttcgaaaagaagaggaatccgagggtgccatatggtaa

SEQ ID NO: 23529 - RNA, 9873 nt, synthetic construct
  misc_feature 1..9873: note = derived and/or modified CDS sequence (opt6) from DENV-3__JQ920482__SS-prME
  source 1..9873: mol_type = other RNA
acgtcattatgccttatgatgatgctccccgcgactctcgcatttcatcttacatcaagggacggagaaccaaggatgatagtaggcaaaaatgaacgagggaaatcgttgttatttaaaacggcaagcggaataaatatgtgtacacttatcgcaatggatttgggtgaaatgtgtgacgatactgttacatataaatgtccgcttataacagaagtcgaaccggaagatatagattgctggtgcaacttaacttctacctgggtaacatatggaacatgcaaccaagctggtgagcacagaagggacaaacgtagtgtagctctagcaccccacgtcggaatgggcttggatacgcgcactcaaacttggatgtccgctgaaggtgcctggagacaagtagagaaagtggaaacttgggcattcagacacccgggatttacgatcttagcattattcctggcgcactacataggtaccagcttaacacagaaagttgtaatattcattttgttaatgctcgtaactccatctatgactatgaggtgcgtaggggttggtaatcgcgacttcgtagaaggcctttcaggcgcgacttgggtcgatgttgtgctagagcacggaggatgcgtcacaacgatggctaaaaataaaccaactttagatattgaactacagaaaactgaagctactcagctagcaaccttaagaaaactatgcatagagggaaagataaccaatgttacaacagacagtagatgtccaacgcagggcgaagccatacttccggaagaacaagatcaaaactatgtctgcaaacatacgtacgttgacagaggttggggaaacggatgcggcctctttggaaaagggagccttgtaacatgtgcgaagttccaatgtcttgaaagtatagagggaaaagcggtgcaacatgaaaacctaaagtacacagtcatcattaccgttcacacaggagatcagcatcaggttggaaatgaaacacaaggagtgacagctgaaataacgccccaagcgtctaccgtagaagctatattacccgaatatggtacactgggattagaatgctctccgcgtacaggattagattttaatgagatgatactactcacgatgaaaaacaaagcctggatggtccacagacaatggttctttgatcttcccctcccttggactagcggagctactacagaaacgcccacctggaataagaaagagttattggtgacatttaagaacgcacatgccaagaaacaggaagtagtagtattaggtagtcaagaaggtgcaatgcacactgcactgacaggcgcaactgaaatacaaacgagtggaggaacatctatttttgcaggtcacttgaaatgcagattaaaaatggataaacttgaacttaaaggtatgagctacgcaatgtgtttaaatgcatttgtgcttaagaaagaagtaagtgaaacccaacatggtactattttgataaaagtagagtataaaggtgaagatgctccctgtaaaatacccttctcaacagaggacggccaaggaaaagcacataatggtcgtttaattacagcaaacccaattgttaccaagaaagaggaaccagttaacatcgaggcagaacctcccttcggagagtccaatatcgttataggtattggagacaaagcattaaaaatcaattggtacaagaaaggatcgtcgattggaaaaatgtttgaagcaactgcaagaggtgcacgacgtatggcaatacttggagataccgcatgggactttggatcagtcggaggcgtattgaactctttaggcaaaatggtacatcaaatatttgggtcagcttacacagctttgttttctggcgtatcctggatcatgaaaattggtataggagtcctcttaacttggattggattaaacagcaaaaatacttctatgtcattcagctgtatagttatcggaataataactttgtacttaggagcagtagttcaagcagatatgggatgtgtaattaactggaaaggtaaagaactaaaatgtggcagtggaatatttgtcacgaatgaagttcacacttggacagagcagtataaatttcaagcggacagccctaagagacttgccacggcaatcgctggtgcttgggaaaatggagtttgcgggataagatccaccacccgcatggaaaatcttctatggaaacaaattgctaatgaattgaattatattttatgggaaaacaacattaagctaaccatagtcgtaggtgatgttataggtgtattggaacaagggaaaaggacactaacgcctcaaccgatggagttaaaatatagttggaaaacttgggggaaggcaaaaatagtgacagcagagacacaaaactcatccttcataattgacggtcctaatacacctgagtgtccatccgcaagccgagcgtggaacgtatgggaggtagaagattatggttttggagttttcactacgaatatatggctaaaattaagagaaaagtacacacagttatgtgatcatagattaatgagcgcagctgtaaaagatgaaagagcagtccacgcggacatgggatattggatagaatctcagaaaaacggaagctggaaacttgaaaaagcatcactaatagaagtgaaaacgtgtacctggcccaaaagtcatacactgtggtcgaatggagtactagaatccgacatgataattccaaaatcactcgcaggcccgatttcacagcataattaccgtccaggttaccatactcaaaccgctggaccttggcatctcggtaaactagaactcgatttcaactattgcgaaggaaccacggttgtaataaccgaaaattgcggaatcagggggcccagtttaagaactacgacagtctcaggtaagctaatccacgaatggtgttgtagaagttgcacacttccacccttaagatacatgggagaagatgggtgttggtacggaatggaaatacgacccattaatgagaaggaagaaaacatggtcaagagtctagtgtcagcagggagtggaaaaacagacaatttcacaatgggagtcttatgcctagcaatactttttgaagaggtaatgagaggcaaatttggcaaaaagcacatgattgccggtgctctattcacgtttgtgttactgctaagtggacaaataacatggagggacatggcccatactttaattatgataggctccaacgcaagcgacaggatgggtatgggtgtgacatatctagcactaatagcaaccttcaagatacaaccctttctagcgttaggattctttttacgcaaactgacttcgcgtgagaacttactcttaggggtgggtttagcaatggctaccaccttacaactaccagaagatatagaacaaatggcgaatggaatagcattaggccttatggctttaaaattgattacacaattcgagacataccaactttggacggcactaatatctctaatgtgctccaacacaatttttacgctaacagtcgcttggcgcacagcaacattgattttagcagtaattagtctcttacctgtatgccaatcaagcagtatgaggaaaactgattggttacccatgactgtcgccgcaatgggagtcccaccccttcctctatttatatttagcttgaaggatacattaaaaagaaggagttggccgctgaatgaaggggtaatggctgtgggtctggtgagcatattagcaagctccttccttaggaatgacgtgccaatggccggtccattagtcgccggaggtctactgattgcgtgttacgtcattacaggtacttcagctgatctaactgtagagaaagctgccgatgtgacttgggaagaagaagctgaacaaacaggagtttcgcacaatttaatgattacagttgacgacgacggtactatgcgaatcaaagacgacgaaacggaaaacatactaaccgtattacttaagactgcacttctcattgtaagtggtatattcccatattcaatacctgccactttgttagtttggcatacttggcaaaaacaaacacaacgcagtggagtgttgtgggatgtaccaagtccccctgagactcagaaagccgaactggaagaaggggtttatcgcattaaacaacaaggaatatttggcaagacccaagtcggagtcggcgtacagaaagagggagtatttcacacaatgtggcatgtgacccgaggtgcagtcttaacgcacaacggcaaaagattagaaccgaactgggccaatgttaagaaagacttaatatcatacggcgggggatggaaattaagcgcacaatggcaaaagggagaggaagtacaagtaatagcagttgaacccggtaaaaatccaaagaatttccaaactatgccagggattttccaaactactactggggaaataggagcaatcgcgcttgattttaaaccaggaacgtcaggttctcctattataaaccgggagggtaaggtcgtgggtctttacggaaacggggttgtcaccaaaaacggcggctatgtatctggaatagcccaaacaaatgcagagccggacggaccaacaccagaactagaagaggagatgttcaagaaacgcaatctaacaattatggatttacaccccggaagtggaaaaacgcgaaaataccttcctgcaatcgtaagagaagcaattaaacgtcggctcagaactctgatactagctccgactagagttgtggctgcagagatggaggaggccttgaagggactgcccattcgatatcaaacaactgctacaaagagtgaacacactggaagagagatagtcgatctaatgtgtcatgccacatttactatgcgtctgttgtcacccgttcgcgtacccaactataacctaattgtaatggacgaagcacactttacggaccccgcgagtatagcagcaagggggtacatatcaacacgagttggcatgggcgaggctgcggcaatattcatgactgcaacgcctcccggtacagcggatgcatttccccagtccaacgcccctattcaagacgaagaaagagacattccggagcgatcttggaacagcggaaatgagtggatcacggattttgcaggtaaaaccgtctggtttgttccgagcataaaagcaggtaacgatatcgcaaactgtttacgtaaaaatggaaagaaagtgatccaattgagtcgtaaaacttttgatacggaataccagaaaacgaaactgaacgactgggatttcgtagtgactacagacatttcagaaatgggtgctaattttaaagccgatagggtaattgatcctagacgttgcctaaagcctgtaattctgacagatggcccagaaagagtcattctagcaggtccaatgcctgtaacggttgcaagcgccgcccaaagacgtggaagggtaggtcgaaactcccagaaggaaaatgaccagtacatatttacagggcaacccctaaataatgatgaagatcacgcacactggacagaagctaaaatgttattagataatataaatacgcctgaaggtatcatacctgcactttttgagccggaaagggaaaaatctgcggcaattgatggtgaatacagacttaaaggagaatcaagaaaaacgttcgtcgaacttatgcgtcgaggtgatttgcctgtttggctagcccacaaagtggcaagcgaaggcataaagtacacagatagaaaatggtgtttcgacggtgaaaggaataatcaaatattagaagaaaacatggacgtagagatatggaccaaggaaggcgaaaagaagaaactgaggccgagatggttagatgcgaggacatattcggacccacttgctctcaaagagttcaaagacttcgctgctggtcgaaaatccatcgccttagacttggtaacagaaataggacgtgtgccatcccatctcgcacatagaactcgtaacgcattagacaatttagtaatgctgcacacatccgagcatggcggacgtgcataccgacacgcagttgaagaactcccggaaacgatggagacattgttactattgggtttaatgatcctgttaacaggaggtgcaatgctatttttaatttctggaaaggggattggtaaaacatcaataggcttgatctgtgtagtcgcctcttccggaatgctctggatggcagatgtaccactacaatggattgcatcagctatagtactagagttctttatgatggtgttacttatcccagaacctgaaaagcaaagaactccccaagataaccagttggcctatgtagtaattggaatcctaactcttgcagctattgttgctgcaaatgaaatgggactccttgaaacaaccaaaagagatttagggatgagtaaggagccaggggttgtcagcccaaccagttatctagacgttgatctacatcctgccagtgcgtggacattatacgcagtagctactacggtaataacgccaatgttacgccacacaatagaaaattctacagctaacgtgagcttagcagccatcgcaaatcaagctgttgtcctaatggggttagataaaggatggccaataagtaaaatggacttgggcgttccgttattagctcttggatgttatagccaagtcaacccactaactcttaccgctgctgtgctattactcgtcacacactacgccatcataggtccggggttgcaagcgaaagcaactcgcgaagcacagaagcgaaccgcagccggaatcatgaaaaatcccacggttgatggtattatgacgatagatttggatccagtaatctatgactctaaattcgaaaaacaattaggccaggtgatgctattggttctctgcgctgtccaactcttgcttatgagaacctcctgggcattctgtgaagccctaacgctagcaacaggacctataacgacactgtgggaaggatcccccgggaaattttggaacactacaatagcggtaagtatggcaaatattttccgaggtagctatctggcaggagctggtctcgcattctccatcatgaaatcggttggaacaggtaaaagaggtacgggcagccaaggcgaaacattgggagagaagtggaagaagaaactaaatcagttgagtagaaaagaatttgacttatacaaaaagagtgggataaccgaagtagatagaactgaagctaaggagggactcaagaggggtgaaatcacgcaccacgcggtatcacggggtagtgcaaagttgcagtggtttgtggaaagaaacatggtgataccggaaggtagagtgatcgacttaggctgcggtagaggaggatggtcgtattattgcgcaggcttaaagaaagttacagaagtcaggggttatactaaagggggccctggtcacgaagaaccagtacctatgtctacatatggttggaatatagtaaaactaatgtctggtaaagatgtcttctatttaccaccagagaaatgtgacacgctcctctgtgatataggcgaaagtagtcccagccccacagttgaggaaagccgaacgataagagtacttaaaatggtagaaccgtggctaaagaataatcagttttgtattaaagttttaaacccttatatgccaactgtcatagagcatttagaaagactccaacggaaacatggagggatgctcgtgcggaatcctcttagtagaaattccacacacgagatgtactggatttctaacgggacaggtaatatcgtctcatcggtgaatatggtaagtaggttattactaaatcgcttcacgatgactcatagaagaccaacaatcgaaaaggacgtagatttaggagctggcacaaggcatgtgaacgcagaaccagaaaccccaaatatggacgtaataggagagaggatacgccgaataaaggaggaacactcatcaacgtggcactatgatgatgaaaatccgtacaaaacttgggcatatcatggaagttacgaagtcaaagcaactggaagtgctagttctatgatcaacggagtagtaaaactgttaacgaagccatgggacgttgtccctatggtaactcagatggcaatgactgacacaactccatttggacaacaacgggtgtttaaagaaaaagtagacacaagaacaccacgcccgatgccgggaacgcgcaaagttatggaaataacagcagaatggctgtggagaactctaggaagaaacaaaagacctcgattatgtacccgtgaggagttcattaagaaagtgagaacaaacgctgcaatgggggcagtttttacagaagaaaatcagtgggattccgctagagctgcagttgaggatgaagaattttggaaattagttgacagagaaagggagcttcacaaattagggaagtgtggtagttgcgtttataacatgatggggaaacgcgaaaagaaactcggagaatttggaaaagcgaaaggttccagggccatttggtatatgtggttaggcgctcgctaccttgagttcgaggctttaggtttcttaaatgaagatcactggttttcaagggaaaattctcactccggtgttgaaggtgagggacttcacaaattgggatacatcttgcgagatatatccaaaataccaggaggagctatgtacgccgatgacacagcaggctgggacacacgtattaccgaagatgatctccataatgaagaaaagataacgcagcaaatggatccggagcatagacagttggcaaacgccatattcaagttgacatatcaaaataaagtcgtaaaagtgcaaagaccgacaccgaaaggaacagtaatggatattatctctagaaaagaccaaagagggtctggccaggtgggaacatatggtcttaatacatttacaaacatggaagcgcaactcatacggcaaatggagggagagggggtcttatcaaaggcagatcttgaaaatcctcaccttcttgaaaagaaggtaacacaatggttagaaacgaaaggagtcgaacggctgaagagaatggcaatatcaggtgacgactgcgttgtgaaacctatagatgacaggtttgcgaatgcgctcctagcacttaatgatatgggcaaagtgagaaaggatatacctcaatggcagccatcgaaaggatggcacgattggcaacaagttccgttttgcagccatcatttccatgaacttattatgaaagatggaagaaaattggtagtaccatgtagaccacaagacgaactaattggacgggcgcggataagccaaggcgccggatggagtttaagggagacagcatgcctcggcaaggcttatgcccagatgtgggcattaatgtattttcacagaagagatttaagattagcatcaaacgccatatgttcagcagtaccggtacactgggtaccaaccagtaggactacgtggtcaattcacgcacatcatcaatggatgacaacagaagatatgttgaccgtttggaatagagtatggattgaggacaacccatggatggaggataaaacaccagttacaacatgggaagatgtaccatacctaggaaaacgggaggatcaatggtgtggcagtctaattggattgacaagccgggcaacttgggcccagaacatactgacagcaatccaacaggtaagatctctcattggaaacgaagaatttttggattacatgccatcaatgaaaagattcaggaaagaagaagaaagtgaaggtgcaatatggtaa

SEQ ID NO: 23530 - RNA, 9873 nt, synthetic construct
  misc_feature 1..9873: note = derived and/or modified CDS sequence (opt6) from DENV-3__JQ920484__SS-prME
  source 1..9873: mol_type = other RNA
acgagcttgtgtttaatgatgatgctgccggcaacattagcattccatctgacaagtcgagacggggaaccaaggatgatcgttggcaaaaatgaacgaggtaaatcactattatttaaaacagcaagcggaattaatatgtgcacactcatcgcgatggatctaggagaaatgtgcgatgatacagttacatataaatgtccattaatcacagaagtggaaccggaagacattgattgttggtgcaatttaacctcgacatgggtgacatatgggacatgcaaccaagcaggagaacatcgcagagataaaagatccgtagctctagcacctcatgtcggaatgggtttggacacgcgcacccaaacctggatgtcggcagaaggagcatggcggcaagtggaaaaagttgaaacttgggcctttagacatccaggattcaccatcctcgcactatttttagcacattatataggtacgtcattaacgcaaaaagtagtgattttcattttactgatgttagtaacaccgtcaatgactatgagatgcgtaggagtgggaaatcgagacttcgttgaaggacttagtggagcaacgtgggtcgatgttgtattagagcatggaggatgcgtaacgacaatggccaaaaataaaccaactcttgacatagaattacagaaaactgaggctacacaactagcaaccctaagaaaactttgcattgaaggaaaaataaccaatgtgacgacggattcacgttgcccgactcaaggagaggcaatactcccagaagaacaagaccaaaattacgtttgtaaacatacctatgtagatagaggttggggaaatgggtgtggattatttggaaaagggagtctagtcacatgtgcaaaatttcaatgcttagagtccatcgaagggaaggccgtgcaacacgaaaacctaaagtatactgtcattataacagtgcatacgggggatcaacaccaggtaggcaatgaaacacaaggagtcactgcggagataactccacaggcaagtacagtggaagcaattttacccgaatatggcaccctaggactagagtgttcacctagaacaggattagattttaacgaaatgatattattaacaatgaaaaacaaggcctggatggtacacaggcaatggtttttcgacctgcctttgccttggacaagcggggcaacaacggagacacctacatggaataagaaagaactattagttacatttaaaaatgcacatgccaaaaagcaagaagtagtagttcttggtagtcaggaaggcgctatgcatacggcactaaccggagcaaccgaaatacagaccagcggcggcaccagcatatttgctggacatctaaaatgtcggctaaagatggacaaacttgaattaaaaggaatgtcttatgccatgtgcttaaatgcatttgtgctaaagaaagaagtttcagagacacaacatggaacaatcctaataaaagtggagtataaaggagaagatgcaccttgcaaaatacctttcagtactgaagacgggcaaggaaaggcacacaacggacgactaattacggctaaccccatagtcaccaagaaagaggagccagttaatatagaagctgaaccgccttttggtgagagcaacatcgtaatcggaatcggagacaaagcactcaaaataaattggtacaaaaagggaagtagtataggtaagatgtttgaagccacagcaaggggtgcaaggcgtatggccatattaggagacacagcatgggacttcgggagcgtagggggagtactaaatagtttagggaagatggttcatcagattttcggtagcgcctatacagcactattttctggggtatcctggattatgaaaatcggaataggagttttattaacctggatcggcctaaattcaaagaatactagcatgtctttctcttgtattgtgataggaatcataacactttatctaggtgcagtcgtacaagctgatatgggatgtgtaataaattggaaagggaaagagctaaagtgtggatcgggaatatttgtcactaatgaggttcacacctggacagaacaatacaagttccaagcggactctccaaagagactggccacagccatcgctggcgcatgggaaaatggagtatgtggaatacgcagtaccacaaggatggaaaatttgctctggaaacagatcgcgaatgaactaaattatatcttatgggaaaataatattaagttgacgatagtagtcggagatgccatcggggttctagaacaagggaaaagaactttgacaccgcaacccatggaattaaaatattcttggaagacgtgggggaaagctaagatcgtaaccgctgagactcagaatagtagtttcatcattgatggaccaaacacaccggaatgcccatccgcctccagggcctggaatgtttgggaagttgaagattacggtttcggagtcttcacaacaaatatttggttaaaactccgagaaaaatacactcaattatgtgaccataggttaatgtccgctgcagtgaaggacgaaagagcagtccatgcggacatggggtattggattgagtcccagaaaaatggatcatggaaattagaaaaagcatcattaatcgaagtcaaaacgtgtacatggccaaagtcacatacgctatggtcgaacggagttctagaaagtgacatgataataccaaagagtcttgctggaccaatatcccaacataactatagacctggataccatacccaaacagctggaccttggcatttgggaaaactagaactcgactttaattactgtgaggggacaacggtagtcatcacggaaaactgcgggattcgtggaccatcactacggacaactaccgtatccggaaagttaatacatgaatggtgctgtagaagttgcacattgccacctttaagatatatgggcgaagacgggtgctggtatggtatggaaatacgtccaataaatgaaaaagaggaaaacatggtcaaaagtctagtatctgccggctcgggaaaaacagataatttcaccatgggagtactatgtcttgcgatattattcgaggaggtcatgcgcggaaaattcggcaagaagcatatgatagcaggagctctctttacatttgtattgttgttgagtgggcagattacctggagggatatggcgcatacgcttatcatgatcgggagtaacgcaagcgaccgaatgggaatgggagtgacctacctagcattaatcgcgaccttcaagatccaaccgtttctagcactaggattctttttacgcaaactcacttcacgtgaaaacttactcttaggcgtcggcctcgcaatggcaacaactttgcagcttccagaggatatagaacagatggctaacggaatagctctcggtctaatggcacttaaactaattacccagttcgaaacttatcaattgtggactgcccttatttctttaatgtgttcaaacacaatcttcaccttaaccgtcgcctggcggacagctactctaatactcgcagttataagtttgttaccagtatgccagtcctcgagtatgcgaaagaccgattggttgccaatgacagtcgccgcgatgggagtaccgccacttccactctttatattttctttaaaagacacactaaaaaggagaagctggcccctcaatgaaggtgttatggcagtcggtttagtgagcattttagcgagtagcttcttaaggaatgatgtaccaatggccggcccgctcgtcgcgggaggactattgattgcctgttatgtcataacgggtacaagtgcagatctaaccgtcgagaaagcagccgacgtaacatgggaagaagaagctgaacaaactggtgtatctcacaatctaatgataactgtggatgatgatggtacgatgcgaattaaagatgacgaaacagaaaacatattaaccgttctgttgaaaacagcattactcatagtcagcggaattttcccatattcaatccctgcaacgttacttgtatggcacacatggcaaaaacaaacacaacgtagtggcgttttatgggatgtacctagtccacctgaaacacaaaaggccgagttagaagaaggagtgtatcgtataaaacagcaaggcattttcggaaagactcaagtaggggtaggagttcaaaaagagggggtcttccatacgatgtggcacgtaacgagaggtgccgtgttaacttataatggtaaaagattagaaccaaattgggcaaacgtcaagaaagacttaatcagctatggaggaggatggaagctgagtgcgcaatggcaaaaaggcgaagaggtacaagtaatagcagtagaaccaggtaagaatcccaaaaattttcaaaccatgcctggaatcttccaaacgacgactggagaaataggcgcaattgcactcgactttaaaccgggtacaagtggtagtccgattataaatagagaaggaaaagtcgtgggcttatatgggaatggcgtggtcacaaagaacggaggttatgtttcaggtatagctcaaacgaacgcagaacctgacggccccacaccagaactagaggaggaaatgtttaagaaacgtaatttaaccattatggatcttcatccaggcagcggaaaaactcgaaagtatctaccggcaatagtaagggaggcaataaagaggcgcctgagaaccctcattctagcccctacaagagtcgttgcagctgaaatggaggaagcactgaaaggattaccaataagatatcagacgacagctacaaaaagtgaacacactgggagagaaattgttgacctaatgtgtcatgcaacgtttaccatgagactcctcagcccagtgagggtcccgaactataatctcatagtgatggatgaagcccactttacagatcctgcatccatagcagcccgtggctacatatcgacacgagttgggatgggagaggccgcggcaatttttatgacagccacgccgcctggaacagcagacgctttcccccaatcaaacgctccaattcaagatgaagaaagagatattcctgagagaagttggaatagtggaaacgaatggataacagacttcgcaggaaaaaccgtctggttcgttccttctataaaggcaggaaatgacattgcaaactgcctgcgtaaaaacggcaaaaaggtcattcaactatcaagaaaaacatttgacactgagtatcagaaaacgaaattgaatgattgggactttgtagtaacaacagatataagcgaaatgggagcaaacttcaaagctgacagagtaattgatcctagaaggtgcttaaagccagtgattttaaccgatgggccagaaagagttatactagcaggtccaatgccagtgactgtagcatcagcagcccaaagaagaggcagggtaggccgaaacagccaaaaagagaatgatcagtatatttttacagggcaaccactaaataatgacgaagatcatgcacattggacagaagccaagatgctcctagataatatcaatacgccagaaggaataattcccgctctgtttgagcctgaaagggaaaaatccgcagcaattgatggagaatataggttaaaaggcgagtctagaaaaacattcgtcgaactcatgcgcagaggcgatctcccagtgtggttagcgcataaagtcgcatcagaagggataaaatatacagacagaaaatggtgttttgatggagagagaaacaaccagatactcgaggaaaacatggatgtcgagatatggacaaaagaaggtgagaagaagaaactacgaccgagatggctggatgctcgaacgtattctgatcccctagcactaaaagagttcaaagatttcgcagcaggtagaaaatcgatagcactcgaccttgtaaccgagataggaagagttccgagccatttagctcaccgaaccagaaatgcactagataatctggtaatgctacatacatcggaacatggagggagggcttatagacacgccgtagaggaactgccagagacaatggaaacgttattattactaggactcatgattttattaacaggcggtgcaatgttatttcttatctctggaaaaggaattggaaagacctcaattggtttgatatgtgtagtcgcgtcgtcaggcatgctatggatggcagacgtgccacttcaatggatagcatccgccatcgtactagagttctttatgatggtacttcttattcctgaacctgaaaaacaaagaactccgcaagataatcagcttgcgtatgtagtaatcggcattttaacattagcagcaatagtagcagcaaatgaaatgggattactagaaactacgaagagagacctaggaatgagcaaagaacctggagtagtgtctcccacttcatatttagatgtcgatctacatccagcttcggcttggacattatatgctgttgcaaccacagtgattacacctatgctcaggcataccattgaaaactctaccgcaaatgtatccctagctgcgatagcgaatcaagcagtcgttttaatgggactagataaaggctggcctatttcaaaaatggacctaggcgtccctctattggcattaggatgttattcccaggtaaaccccttaaccttgactgctgctgtactgcttttagtgacacattatgcaatcattgggcctggactgcaggccaaagctacaagggaagctcagaagcgcaccgccgccggaattatgaaaaacccaactgtagatggcataatgaccattgatttagatcctgtaatatatgatagtaaatttgagaaacagcttggacaagtcatgcttctagtgctttgcgcggtacagctgctacttatgcgtacttcttgggcattttgtgaggctttaactctagcaacaggcccgattaccaccctatgggaagggagcccaggtaaattctggaatactacaatagcggtgtcaatggcgaacatattccgtggctcctatctcgcaggagctgggttggcattttcgataatgaaaagcgtaggtaccggtaaacgggggaccggctcacaaggagaaacactaggagagaaatggaagaaaaagctaaatcagttaagtagaaaagaatttgacttatataagaaatcagggatcaccgaggttgataggacagaggcaaaagagggtttaaagcggggagagattacccaccatgcggttagcagaggatccgcaaaactacaatggttcgtcgaacgcaatatggtaatacccgaaggacgcgttatagatcttggatgcggtagaggcggctggtcgtactactgtgcaggattaaagaaggtaacagaagttcgtggttatacgaaaggtggtccaggtcatgaagaaccagttcccatgtcaacatacggttggaacatagtaaaactgatgagtggaaaggacgtattctatctaccgccggaaaagtgtgatacattactgtgcgatataggagagagttccccatctcctacagtagaggaatcacgaacaattagagtactcaaaatggttgagccgtggctaaagaataatcaattttgtatcaaggttttaaatccctacatgcccacagttatcgaacacttagaacgactacagagaaaacacgggggcatgcttgtacgtaatccgctaagtcgaaactccacgcatgaaatgtattggatttctaacggaacgggaaatatagtaagctcagtaaatatggtttctagattattactaaatagattcacaatgacgcataggagaccaaccatagaaaaagacgtcgatctgggagcggggacacgacatgttaatgcggaacccgaaactccgaacatggatgttataggcgaaagaatcagacgaattaaagaagaacattcgtcgacctggcattacgatgatgaaaatccatacaaaacatgggcatatcacggctcatatgaggtaaaggcaacgggatcagcttcttcaatgattaacggtgttgtaaaattattaactaaaccctgggatgttgttcctatggttacgcaaatggcaatgacggataccacaccttttggtcaacaaagagtattcaaggaaaaagtcgatactcgtactccccgaccgatgcccggaacaagaaaagtgatggaaataacagcagagtggttatggcgcactcttggaagaaataagagaccaagactctgtaccagagaagaatttatcaagaaagtgcgtaccaacgccgccatgggcgctgtttttacagaggagaaccaatgggattctgcacgagctgctgttgaagacgaagaattttggaagctagttgacagggaacgcgaactacataaactaggaaaatgtggcagctgtgtatataacatgatgggaaagcgagagaagaaacttggagagttcgggaaagctaaagggagcagagccatatggtatatgtggttaggtgcacgttatctagagttcgaggctttagggtttcttaacgaggaccactggttctcacgagaaaattctcattcaggagttgaaggagaaggtttacataaactaggatatatactgcgagatatcagcaaaataccaggaggtgccatgtatgccgatgacacggcgggctgggatacgcgtataactgaggatgatttacacaatgaagagaaaataacacagcagatggaccctgagcacagacagctagcgaacgctatatttaaactaacatatcaaaataaagtagtcaaagtacagaggcctacgccaaaaggcaccgtgatggatataattagcagaaaagaccagagaggatcagggcaagttggcacatacggattaaatacgtttactaacatggaggcccagctgatacgccaaatggaaggggagggagtattatcaaaagcagatctagaaaatccccatctattggagaagaaagttacacaatggctagaaactaaaggcgtagagaggcttaaacgaatggccatcagtggagacgattgcgttgttaaacccatcgatgatagatttgcgaacgcattgctagcgcttaacgacatgggcaaagttaggaaagacattcctcaatggcaaccctctaaaggctggcatgattggcaacaagtcccattttgctcacaccatttccatgagcttataatgaaagatggccgaaaactggtggtaccatgccgaccacaagacgaacttattgggcgggcaaggatatcacagggagctggatggtcgctccgtgagactgcgtgtttaggcaaggcttacgcacaaatgtgggctttaatgtactttcatcgaagagatctcagactagcctcaaatgcaatatgttcagcagttcctgtacactgggtacctacctcacgcaccacctggtctatccacgcacaccatcagtggatgacgactgaggatatgctaacagtatggaatcgtgtctggatcgaggacaacccatggatggaagataagactccagtaacaacttgggaagatgtaccatacctaggaaagagagaagatcaatggtgtggatctttaataggacttacctccagggcgacatgggcacaaaacattttaactgccattcaacaagtaaggagcctcataggtaacgaggagttccttgactacatgccaagtatgaagcgcttcagaaaggaggaagaatcggaaggggctatatggtaa

SEQ ID NO: 23531 - RNA, 9873 nt, synthetic construct
  misc_feature 1..9873: note = derived and/or modified CDS sequence (opt6) from DENV-3__JQ920486__SS-prME
  source 1..9873: mol_type = other RNA
acatcgctttgtcttatgatgatgttaccagcaacacttgcatttcatcttacatctagagatggagaaccacggatgatcgtaggcaaaaacgaaagagggaaatctctattattcaaaacagcttcaggtataaatatgtgcactctgatagctatggatttgggtgaaatgtgtgacgacacagtcacttataaatgtcctctcataacagaagtggaaccggaagacatcgattgctggtgtaatctgacgtcgacatgggtaacttatggaacctgcaatcaagcaggagaacatcgacgagacaaacgttccgtagcactggcgccacatgtcgggatgggattagatacgaggacacaaacatggatgtcagcagaaggagcttggcgccaagtcgaaaaagtagaaacttgggcattcagacatccaggctttacgatcctggcacttttcttagcccattacattggtacatcactgacccaaaaagtagtaatatttattcttcttatgttagtcactccttctatgactatgagatgcgtaggggtaggaaaccgagattttgtagaaggactgtctggcgccacgtgggtagacgttgtattagaacatggtggctgcgtaactaccatggctaaaaataaacctacactcgatatagaactacagaaaaccgaagccactcaattggcaactttgagaaaattgtgcattgaaggtaaaataacaaacgtcactacagacagtagatgtccaacgcaaggggaagcaatattgcctgaagaacaagaccaaaattacgtgtgcaaacatacctatgtagatagagggtggggtaatggctgtggcttattcgggaaaggtagtctagtgacatgtgccaaatttcaatgtttagaaagcattgaaggaaaagcagtacaacatgaaaacttgaaatacactgttataataacggtacataccggggatcaacaccaagtcggtaatgaaacccaaggagtcacagctgaaataactccacaagcctcgacggtggaagcgatactacccgaatatggcaccctcggattagaatgttcgccacgaacgggattagatttcaacgaaatgatacttttaacaatgaaaaataaggcttggatggtacatagacagtggttcttcgacttgccgcttccatggacaagcggagctacaacggaaactcccacatggaacaagaaagaactattggtaacgttcaaaaatgcacacgccaagaaacaagaagtagtggtactcggatcccaagaaggggcgatgcataccgcattaactggtgctactgagatccaaacaagtggtggaacgtcaatattcgccggtcacttaaaatgtcgtctaaaaatggataaattagaacttaaaggcatgtcctatgcaatgtgcctcaacgcttttgttctcaagaaagaagtcagtgaaactcaacacggcactatactaataaaagtagaatataaaggggaagatgcaccatgcaaaattccattttccactgaagacggtcaaggaaaagctcataacgggagacttataacagctaatcctatagtaactaagaaagaagaaccggtaaacatagaagctgagccccctttcggggaaagtaatattgttataggaatcggagataaagccttaaaaatcaactggtataagaaaggtagttcgatagggaaaatgtttgaagcaactgcacgtggtgcaaggagaatggctatattaggagatacggcatgggattttggtagtgtcggtggagtactaaattctttaggcaaaatggtgcatcagatctttggatccgcgtacaccgctctattttcaggagtatcatggataatgaaaattgggatcggcgtacttctaacgtggatagggctaaactctaaaaatacaagcatgagtttctcttgcatagtaataggtataataactttatacctaggagccgtggttcaagctgacatggggtgtgtaataaattggaaaggaaaagaactaaaatgcggatcgggcatcttcgtcactaatgaagtccatacatggaccgagcagtacaaatttcaagcagattcacccaaaagactagccactgcaattgctggagcctgggaaaatggagtctgtggcataagatccacaacacgaatggaaaatttattatggaagcaaattgccaatgaactaaattacattttatgggaaaacaatatcaaacttacaatcgtggtaggcgacgccataggtgtccttgaacaaggcaaaaggaccctgactccacagcctatggaactgaaatactcatggaaaacttggggaaaagctaaaatagttacggcagagacacaaaactcatcttttataatagatggtcctaacactcctgaatgtccatcagcttctcgtgcatggaatgtttgggaggtagaagactatggctttggtgtgttcaccacaaatatttggttaaaattgcgagaaaaatatacacagctttgcgatcacagactaatgtcagcggctgtgaaagacgaaagagctgtgcacgttgatatgggttactggattgaatcacagaaaaacggttcatggaaactagaaaaagcatcattgatcgaggtcaaaacatgtacatggcctaaatcgcatacactctggagtaatggtgtattagaaagcgatatgattatacctaaatccctagctggtccgatttctcaacacaactatagacccggataccatacccaaacagcaggaccctggcatttaggtaagttagagctagattttaactactgcgagggtaccaccgtcgtgataacggagaattgcggcattagaggcccatcactccgaactacaaccgtaagcggcaaactgattcatgagtggtgttgccgttcttgtaccctacccccactacgctatatgggagaagatggctgttggtatggtatggagattcggcccataaatgaaaaagaagaaaatatggttaaatcgctcgtatcggcaggcagcggtaagactgacaacttcacaatgggcgtactttgtcttgcaatactatttgaagaagtaatgaggggtaaatttggcaagaaacatatgatagcgggcgcactgtttacatttgtattgttgcttagtggtcaaataacgtggcgcgatatggctcatactttaataatgataggaagtaacgcctcggatagaatgggcatgggtgtaacttatctagctctcatagccacctttaagatacaaccttttctagcgttgggctttttcctccgaaagttaactagccgagagaatttacttctcggcgtaggcttagccatggcaacaacattacaacttccagaagatattgaacaaatggcaaatggaattgcactaggcttaatggcactaaaattaattacccagtttgagacataccaactctggacagcattaattagcctgatgtgttccaacacaatctttacacttacggtcgcctggaggaccgcgactctcattttagccgtcatcagcctactacctgtatgtcaatcgtcgtcaatgcggaagacagactggttacctatgaccgttgccgcaatgggcgtgccaccattacccttattcatattttcattaaaggatacattaaagcgaagatcatggcctttgaatgagggagtcatggctgtagggctggtatctatacttgcgagcagttttctcagaaacgacgttccaatggctggtcctttagtcgcaggagggctcttaattgcgtgttacgtaatcaccggcacgtcagctgatctaaccgttgaaaaggcagcagatgttacttgggaagaagaagccgaacagacaggcgtttctcacaacttaatgataacagttgacgacgatggcacaatgagaataaaagatgacgagacagaaaatatacttaccgtattactaaaaaccgctttattgattgtatcaggtatatttccatatagtataccggctactttgctggtctggcacacctggcagaaacagacccaaaggtcaggagtcttgtgggatgtaccaagtcccccagaaacacaaaaggctgaattagaggaaggagtataccgcataaaacaacaaggtatatttggaaaaacgcaagtaggggttggtgttcaaaaggaaggagtatttcataccatgtggcatgttactcgaggagccgtacttacacataacggcaaacgattagaaccaaattgggcaaacgttaagaaagacttaatttcgtacggaggtggatggaaactgtcagctcagtggcagaaaggagaggaagtacaggtaatagcagtggaacccggcaaaaatcccaaaaacttccaaactatgcctggaatatttcagactacgaccggggaaattggagccatcgcattggactttaaaccagggaccagcgggtccccaataataaacagggaggggaaagtagtgggactctacggcaatggagttgtgactaaaaacggtggatatgtctccggaatagcacaaaccaatgcagaaccggatggccctactccggaactagaagaagaaatgtttaagaaaaggaacctgactattatggacttacatccagggtcaggaaaaaccagaaaatatttaccagcgatagtgagagaagccataaaaaggcgtctacggacattaatcttagccccgaccagagtcgtagctgcagaaatggaagaggcattgaaaggcttaccgatacgctaccaaacaacagccaccaaatcggagcatactggcagggagatcgtcgatctaatgtgccatgctacttttacgatgagacttttgagccccgtaagagtacctaattataatctaatcgtaatggatgaggcacattttactgatccagcgagtatagccgcccgtggctacataagtactagagttggaatgggagaagccgcagctatattcatgactgctactccaccgggtacagctgatgccttcccacaatccaacgctccaatccaagatgaagaacgggatattcctgaaaggagctggaatagcggtaacgaatggatcacggattttgcaggtaaaaccgtctggttcgtccctagcatcaaagctggaaacgatatagcaaattgtctgcgtaaaaatggtaaaaaggtaattcaactaagtagaaaaacgtttgatacggaatatcagaaaactaaactcaatgattgggattttgttgtcactacagatatatcagaaatgggcgcgaattttaaagcagatcgggtgatcgacccacgtcgctgcctcaaacctgtaatactcaccgatggtccagagagagtaattctcgcaggtcctatgccggtaactgtagcttctgcagcccaacgcagaggtagagtaggaaggaactcacaaaaagaaaatgatcaatatatttttactggacaacctcttaataatgatgaagaccacgctcattggaccgaagccaaaatgcttcttgacaatataaacacacctgaaggaataatcccagcactatttgaaccagagagagaaaagagcgctgcgattgatggagagtatcgcttgaaaggggaatctcgcaagacctttgtagaactaatgaggcgaggtgatctgccggtttggttagctcataaagtagcaagcgaaggaataaaatacacagacagaaaatggtgttttgacggtgagagaaacaatcagatacttgaagaaaacatggatgtagaaatatggacaaaagagggggagaagaagaaattgagacccagatggctcgacgcccgtacttacagtgaccccctagccctcaaggagtttaaggattttgcagctggtagaaagtccattgccctggaccttgtaacagaaataggtagagtacccagccacctagctcaccgaacaagaaatgccttagacaacttagtcatgttgcatactagcgaacacggtggacgagcttacaggcatgccgttgaagaattaccagaaacaatggaaacactacttctcctcggactaatgatactcctgaccggcggagctatgctatttctcataagtggcaaaggtatagggaaaacaagtataggattgatttgcgtcgttgcaagttcaggaatgctatggatggcagacgtacccctgcaatggattgcctcagcaatagttttggaatttttcatgatggtactcttgataccagaacctgaaaaacaaagaacaccacaagataatcaattagcttacgttgttataggaatcctcactctcgctgcaatagtagcagcaaacgaaatgggcttactagagactactaaacgagatttaggaatgtctaaagagcccggagtagtatcaccgacgtcttatctggatgtggatctacatcctgcaagcgcctggacactttacgccgttgcaaccactgtgattaccccaatgttacggcatactatcgaaaacagtactgcaaacgtctctttggcggctattgctaaccaagcggttgtactgatgggtctcgataaaggctggcctatctcaaagatggatctaggtgtaccgctgttagcattgggatgctatagtcaagttaatccattaacgttaaccgccgcagtattattattagttacccactacgccatcatcggcccaggattgcaagccaaagcaacaagagaggcacaaaagcgtacagcagcaggtataatgaaaaatccgactgttgatggcataatgaccatagatttagatccggtaatctatgacagcaaatttgagaaacagctaggacaagtaatgctacttgtgctttgcgccgtacaactccttttaatgagaacttcatgggcgttctgcgaagctcttacgttggcaacgggaccgattaccacgttatgggaaggatcaccgggcaagttctggaacacaacgatcgcagtaagtatggccaatatttttaggggtagctacttagctggtgctggactagcattttctataatgaaatcagtgggtaccgggaaacgaggaacaggatcccaaggagaaacgctaggggaaaaatggaagaagaaacttaaccaactctcccgtaaagaatttgacttgtataaaaagagtggaattacagaagttgatagaatagaagcaaaagaaggactcaaaagaggagaaataacgcatcacgcagtatcaagagggtctgctaaattacaatggttcgttgaacgtaatatggtcatacccgagggaagggtaattgaccttggatgtgggcgaggaggatggtcatattactgcgcaggtctaaagaaagtaacagaagtgcgtggatatacaaagggcgggccagggcatgaagaacctgtccctatgagcacctacggatggaatatcgttaaactcatgagcgggaaagatgtattctatcttcctcccgaaaagtgtgacacacttttgtgcgatataggagaatcatcgccatcaccaacagtagaagaatctagaacaatacgagtgctaaagatggtagaaccatggcttaaaaataaccaattctgcattaaagttctaaatccatatatgccaacagtcatagagcatctcgaacgtctgcagagaaaacatggtggaatgttagtacgaaatcccttgtctaggaactcaactcacgaaatgtactggatatcaaatggaacaggtaacatagtcagttcagtaaacatggtaagtcgactacttctaaaccgctttactatgacgcatagaagaccaacaatagagaaagatgtagacctcggagccggtacacgacatgtcaacgctgaaccagaaaccccgaacatggatgtaatcggcgagaggattagacggattaaagaagaacactcgtcgacatggcactatgatgacgaaaatccatacaaaacatgggcgtatcatgggtcttacgaggtgaaagcaactgggagcgcatcatcgatgataaatggagtagtaaaacttctgaccaaaccttgggacgtagtcccaatggtaacacaaatggccatgaccgatacaacaccgttcggacagcaaagagtattcaaagaaaaagttgatactagaacacctagacccatgcctggtaccaggaaggtaatggaaattacagcagagtggctttggagaacgctaggccgcaacaaacgtccacgtttgtgcacaagagaagagttcattaagaaagtcagaactaacgcggcaatgggagcagtgtttactgaagaaaatcagtgggatagcgctagagcagcagttgaggacgaagagttctggaagttagtagatagagaacgagaacttcataaactagggaaatgcggctcgtgtgtatacaatatgatggggaagcgagagaagaaattaggagagtttggcaaagcaaaaggatcacgcgccatatggtatatgtggctaggagcccgctacttagagttcgaagctcttggatttttgaacgaagatcactggtttagtagggaaaactcacatagcggagtcgaaggagaaggcctgcacaaacttggctacatattacgggatataagcaaaataccaggaggagctatgtacgctgacgatactgctggttgggacacacggatcaccgaagacgatttacataacgaagagaaaataacacagcaaatggacccagaacaccgacaactggcgaacgcaatctttaaactaacgtatcaaaataaggttgttaaggttcaacgacccaccccaaaaggaaccgtaatggacataatatcacgaaaagaccaacgtgggtcaggccaagtaggaacctatggacttaatacttttacgaacatggaagcacaactaatacgacaaatggaaggagaaggagtcttaagtaaagcagacctagaaaacccacatttgttagagaagaaagtaacacagtggttggagacaaaaggagtcgagagactgaaaagaatggcaattagtggcgatgattgtgttgtaaaaccaatagacgataggttcgctaatgctttgctcgctttaaacgatatgggaaaagtgcgtaaagacatcccgcaatggcaaccttcaaaaggatggcatgattggcaacaagtaccattttgtagtcatcacttccatgaacttataatgaaagacggaagaaaactcgttgttccatgccgaccacaggacgaacttatcggccgagcccgaatctcacagggggccggatggagtttaagagagaccgcatgtcttggcaaagcatacgcacagatgtgggcattaatgtatttccaccgtagagatctaaggttagctagcaatgcaatatgttctgcggtacctgtgcactgggtaccgacctcacgcaccacgtggagtatccacgctcaccatcaatggatgacgacagaagacatgttgacagtgtggaatcgggtttggatagaggataacccgtggatggaagataaaacaccggtaacaacctgggaggacgtaccgtatttaggcaaaagagaagaccaatggtgcggctctctaataggattgacaagtagggcaacttgggcacagaacattctaacggcaatacaacaagtacggtccctaataggcaatgaagagttcctggactacatgcccagcatgaaacgctttcgcaaagaagaagaatctgagggagctatatggtga

SEQ ID NO: 23532 - RNA, 9873 nt, synthetic construct
  misc_feature 1..9873: note = derived and/or modified CDS sequence (opt6) from DENV-3__JQ920485__SS-prME
  source 1..9873: mol_type = other RNA
actagcttatgtttgatgatgatgctcccggcaacattagcatttcatttaacaagccgggatggagaaccaaggatgatagtaggcaaaaatgaacgcggaaaatctctactttttaaaacagcttcagggattaacatgtgtacacttatagctatggatttgggagaaatgtgtgatgatacagtaacctataaatgcccacttataacagaggtggaacctgaggacatagactgctggtgcaatcttacgtcaacatgggtgacatatgggacatgcaaccaagcgggagaacatcggagagataaacgttcagtggcacttgcaccccatgtaggaatggggctagataccaggacgcaaacatggatgagtgcagaaggagcctggagacaagtcgagaaagtagaaacatgggccttccgtcatccaggttttacgatattagctttattcttggcacattacataggaaccagcttaacccaaaaagtggtgatttttatactattaatgttagtcacgccctctatgactatgaggtgtgttggggtcggaaatagagatttcgttgaaggtttatcgggagccacatgggtggatgtggtattggagcatggtggatgcgttacaacgatggctaaaaataaacccactctcgacatcgaattacagaaaacagaagcgactcaattagccacactccgaaaactatgtatagaaggaaaaatcacaaatataacaacggacagccggtgtccaacccaaggcgaagcgatcttgcccgaggagcaagatcaaaactacgtgtgtaaacatacgtatgtagacagaggatggggtaatgggtgcggattattcggaaaaggatctctggtgacttgcgcaaaattccaatgtttagaaagtatcgaaggcaaagccgtacaacatgaaaacctgaaatatacagttattataacggtacacacgggagaccagcaccaagtaggtaacgaaactcaaggtgtaacagccgaaataacacctcaggcttccactgtggaagccatactccctgaatatgggacattagggcttgaatgctcacccaggacaggactggactttaacgaaatgattctcttgacgatgaaaaataaggcatggatggtacataggcaatggttcttcgatttacctcttccttggacatcaggggcaacaacagagacaccaacgtggaacaagaaagaattactggtaacatttaaaaacgcacatgccaagaaacaagaagtggtagtattgggatcccaagaaggagctatgcatacagccctaacaggagccaccgaaatccaaacgagcggagggacaagtatttttgctggacacttaaaatgtagactcaaaatggataaattggagcttaaaggtatgtcatatgcaatgtgcctaaatgctttcgttcttaagaaagaagtaagcgaaacgcagcatggtactattttgattaaagtggagtataagggagaagatgctccttgtaaaattccatttagtactgaagatggacaggggaaggctcataatggacgacttattacagctaacccgatagtaacgaagaaagaagaacctgttaatatagaggcagaaccaccgtttggagaatctaatatagttattggaattggcgataaggctttgaagattaattggtacaagaaaggtagctccattggtaaaatgtttgaggccacagccagaggggctaggcgaatggctatattaggtgatacagcctgggacttcggatcagtaggtggtgtcctaaattcattgggaaaaatggtacaccaaatattcggatcggcatacactgcgttattctcgggcgtaagttggattatgaagatcggaataggggtgttattgacctggattggactaaacagcaagaatacaagcatgagctttagctgcatagttatcgggataataactctttacttaggcgcagtagtacaggcagatatgggttgtgtgatcaattggaaaggaaaagagttgaaatgtggatcagggatttttgttaccaatgaagtacacacgtggacagaacaatataaatttcaagctgacagcccaaaacgtttagcaaccgctatagcaggggcatgggagaacggggtatgtggcattagaagtacaactagaatggaaaacttgttatggaagcaaatagcaaatgaacttaactacattctgtgggaaaataatataaaattaactatagttgtaggtgatgtaataggtgtattagaacagggaaaaaggacattaacaccacaaccgatggagctaaaatattcttggaagacttggggtaaagctaagatagtcacagccgagactcaaaattcctcttttataatagatggaccaaacacaccggaatgcccaagtgccagcagagcgtggaacgtttgggaagtcgaagattatggtttcggagtttttacgaccaatatctggttaaaattaagagaaaaacatactcaattatgcgatcacaggctaatgtctgccgctgtaaaagacgagcgagctgtacatgcagatatgggctattggattgaatctcagaaaaatgggagctggaaattagaaaaagcgtctttaatagaagttaaaacatgtacctggccaaaatcacacaccttatggtcaaatggggtattggagtcagatatgataatacctaaatcccttgcaggtccaatatcgcagcacaactatcgcccaggttatcacactcagacggccggtccatggcaccttggaaagctggaattagatttcaattactgtgaaggcactacagtggtaatcacagaaaattgtggaatacggggaccgtctcttcgaacaacaaccgtatcagggaagttgatccatgaatggtgttgtagaagttgcacattaccaccactacgctacatgggagaggatggttgttggtatggcatggaaatacgaccaataaatgaaaaagaagaaaatatggttaaaagtttagtgagcgcaggtagtggaaaaactgataactttaccatgggtgtactatgtttagctattctattcgaagaagtcatgagaggaaagtttgggaagaagcatatgattgcaggagccctgtttacgttcgtattacttttgtccggacaaatcacatggcgagatatggcgcacactttaataatgataggcagcaatgcatcggacagaatgggcatgggagtgacgtacctagctctgattgcaacttttaaaatacaaccatttcttgctttagggttctttttaagaaagttaacgagtagggaaaaccttttgcttggagttggattagctatggcaacgacactccaactccccgaagatattgagcagatggctaatggaattgcactgggacttatggcgctaaaacttataacgcaatttgaaacttatcaactgtggacagcgttaatatcgctcatgtgcagtaacactatttttactctcacggtggcatggcgtaccgcaaccctaatcctagcggtcatatcactcctgcctgtttgccaatcgagttccatgcgtaaaacggactggcttccaatgacagtcgcggccatgggtgtaccacctttacccctatttatttttagtttgaaggatacactaaaacgcaggagctggcctttgaatgaaggagtaatggccgtgggattagtgtccattctagcgagttcatttttgcgaaatgatgtacctatggcaggtcctttagtagctggaggacttttaattgcctgttatgttattacaggaactagcgcggatttgacagtagagaaggctgcagatgtcacatgggaagaagaggccgaacaaacaggggtcagtcataatctaatgatcacagtagatgacgatgggactatgaggattaaagacgatgagacagagaacattttaacagtattactaaaaacagctttgttaatagtgagtggaattttcccgtattcaatcccggcgactttgctcgtatggcacacttggcaaaagcagacacaacgaagcggagtcttatgggatgttccatcgccaccagaaacacaaaaggctgaactcgaagaaggtgtatacagaattaaacaacaaggtatttttggcaagacgcaggttggagtgggagtacaaaaggagggggttttccacactatgtggcatgtaactcgtggagccgttttgactcataacggtaaacgattagaaccaaattgggccaacgtcaagaaagatcttataagctatggtggtggctggaaacttagtgcgcagtggcagaagggagaagaagtacaagttatagcagtggagcctggtaagaatccgaaaaattttcaaacaatgcccggaatattccaaacaacgactggagagattggtgcaattgcactagacttcaaaccaggaacatctggatcacccataattaacagagaaggaaaagtagtggggttatatggtaatggcgtagtcaccaaaaatggaggctatgtctctggaattgcgcaaacgaatgcagaacctgacggtcccattccagaacttgaagaagagatgttcaagaaacgtaatttaacgattatggatttacatcctggatccggaaaaacccgaaaatatctacctgcaattgtacgtgaagccatcaagcgaagactcaggacactcatattagcacccactagggtcgtcgctgcggaaatggaggaggcgctaaaaggtttaccgataaggtatcaaacaacggcaaccaaatccgaacacacaggaagagaaatcgtagacctcatgtgtcacgcaacgtttactatgaggctattgtctcctgtccgtgtaccaaactataacttaatcgtaatggatgaagcgcatttcactgatcccgcatcaatcgctgcccgaggctatatctcaacacgagtgggtatgggagaagcagccgcaatatttatgacggctacccctccaggaacagcagacgcattcccacaatcgaacgcaccgatacaagatgaagaaagagatattcctgaaagatcctggaactctggtaatgaatggataacagatttcgccggaaagacggtatggttcgtaccaagcattaaggcagggaatgacatcgcaaattgtttgcgcaagaacggtaagaaagtaatacaactctcacgcaagacttttgataccgaatatcaaaagacaaaactgaatgactgggattttgttgttacaactgatatttcagagatgggtgcaaattttaaggcagatagagtcattgacccacgaagatgtctcaaacctgtaatcttaacggatggaccagaacgcgtaatcctggccgggcccatgcctgtgacagtggcatctgcagcgcagcgcagaggtcgggtaggaagaaattcacaaaaagaaaacgaccaatatatatttacaggacaaccattgaataacgacgaagaccacgcgcattggacagaggcaaaaatgctgttagataatatcaatacccccgaagggattatcccagcattatttgagccagaaagagaaaagagtgcagccatagacggtgaatacaggttaaaaggtgaatcaaggaaaaccttcgtagaacttatgaggcggggagacttaccagtctggttagcacacaaagtagcatcagaaggtattaaatataccgatagaaagtggtgtttcgacggagaaaggaataatcaaatcctagaagaaaacatggacgtggaaatatggactaaagaaggagagaaaaagaaactacgtcctagatggctagatgctagaacttacagcgatccgttagcattaaaagagtttaaagattttgcagcaggacgaaaatccatagcactagacttggttaccgaaatagggcgagtccccagccacttagcacatagaacgcgaaacgcattagataatctagtgatgctgcacactagcgaacacggtggcagagcatatcgccacgcagtcgaagagttgcccgaaacaatggaaacgcttttacttttaggtctaatgatacttcttactgggggagcgatgctgtttctaatctcgggaaagggcatcggtaaaacaagcatcggtttaatctgtgtagtagcctccagtgggatgctatggatggccgatgtcccgttacaatggatcgcatcggcgattgtgcttgagttctttatgatggttttattaatacctgaaccagaaaaacagagaacacctcaagataaccagttagcgtacgtcgttattggaatacttactctggcagccatagtagctgcaaatgaaatgggcctattagaaacaacaaaacgagatcttggcatgtcgaaagagcccggggttgtctccccaacttcctatttagacgtagatctacatcccgcttctgcatggacgttatatgctgtcgcgactacagtaataacaccgatgctccgccacacaatcgaaaattctacagctaatgtaagtttggcggcaattgcaaatcaggctgtggttttgatgggtcttgataaaggatggccaatttccaaaatggatttaggtgtacccctattagcattagggtgttactcacaagtgaacccgttgacattaacagcagcagtattactattagttactcactatgccatcatagggcccgggctccaggccaaggctaccagggaagcacagaaaagaacagctgctggaatcatgaaaaatccgactgttgatggaataatgacgatagacttggacccggtaatctatgatagcaaattcgaaaaacaactcggtcaagtaatgctgttggtcctctgtgccgtccaattgcttctaatgcgcacgagttgggcgttctgtgaggctctcaccttggctaccggacctataaccacactctgggaaggttctccgggtaaattctggaacacaacaattgcggtgagcatggcgaatatattccgtggatcatatctagcaggggctggattagctttctcgataatgaaatcggtcggaacaggtaaaagaggaacgggatctcaaggagagacattaggcgaaaaatggaaaaagaaattaaatcagttaagtaggaaagaatttgatttgtataaaaagagtggaataaccgaagtagacaggattgaagcaaaagagggtcttaagcgaggagaaataacccaccacgctgtatccagaggaagtgcaaaacttcaatggttcgtggaaagaaatatggtaattccggagggaagagtgattgatttaggatgtggacggggtggatggtcctactactgtgcaggtctaaagaaagtcactgaagtgaggggctacactaaaggcgggcccggtcatgaggagcccgtcccaatgtcaacttacgggtggaatatagtcaaattaatgagcggaaaagacgtgttttacctaccgccggaaaaatgcgacacacttctgtgtgacataggagaaagcagtcccagtcccacggtagaagagtctagaacaatcagagtcctaaaaatggtagagccctggctgaaaaacaatcagttctgtatcaaagtattaaacccttatatgccgacagttatagagcacttagaacgactacaaaggaaacatggtggaatgctagtaagaaacccgcttagtcgtaatagtacacatgaaatgtactggataagcaacggaacgggtaatatagtctcgagtgtaaatatggttagtagattgctcctcaacagattcactatgacacaccgaaggccaacaatcgaaaaggatgtagatttgggggcaggaacacgacacgttaacgctgagccggagacgccaaatatgaatgtgataggcgagcgtataagacggataaaagaagaacacagtagtacatggcattacgatgacgagaacccgtataagacctgggcataccacggaagttatgaagtcaaagcaaccggttcagcatcttcaatgataaatggcgtagtaaaactacttacaaaaccatgggatgtagttccaatggtaactcaaatggccatgactgatactacacccttcggtcaacaacgagtctttaaggaaaaagtcgacacaaggacgccgagaccaatgccagggactcgtaaggtcatggaaataacagctgaatggttatggcgaacattgggccgcaataagagacccagattatgcacgagggaagaatttatcaagaaagttcgtaccaatgccgccatgggagctgtattcacggaggaaaaccaatgggattcggcaagagcagccgtagaggacgaagaattttggaaattggtcgatagagaaagagaattacataaattaggaaaatgtggctcatgtgtatacaatatgatgggtaagcgtgagaagaaattaggtgagttcggcaaagctaaaggatcaagggcaatatggtatatgtggttaggcgctagatatctcgaatttgaagcactgggcttcctaaatgaagaccactggttttcaagagaaaatagccatagtggagttgaaggcgagggtttgcataaacttggttacatcctcagagatataagcaaaattcctggaggtgcaatgtatgccgacgacactgcaggttgggacactcgaataactgaagatgacctacataatgaagagaagatcacccaacaaatggacccggaacatcgacaactagccaacgctatattcaagttaacatatcaaaataaagtagtgaaggttcaaagacccacccctaaaggaactgtgatggacatcatttcacgaaaagatcaacgaggaagtggacaggtcggcacttacggattaaacacattcactaatatggaagctcaattgataagacaaatggagggcgagggcgttttaagtaaagccgatcttgaaaatcctcacttgctggaaaagaaggttacacagtggctagagacgaaaggagtggagcgtcttaagagaatggcaataagtggggacgattgtgtagtgaaacctatagatgatagattcgcaaacgctttacttgcgttaaacgatatgggaaaagtacgaaaagatatcccgcaatggcagccaagcaaaggatggcatgactggcaacaggttccgttttgcagtcatcactttcacgaacttattatgaaagacggccgcaaattagtagttccgtgcagacctcaagacgaattaattggcagagctcggataagccaaggtgctggatggtctttacgcgaaacagcctgcttgggtaaagcatatgcacagatgtgggcgttaatgtactttcataggagagatctaagactggcatccaatgcaatctgttccgcggtcccagtacactgggtgccaacttcaaggaccacgtggagcatacatgctcaccatcaatggatgaccacggaggacatgctaacggtatggaatagagtatggatagaggacaacccatggatggaagacaagacaccagttacaacttgggaagatgtaccttatcttggtaaaagagaggatcaatggtgcggcagcttgatcggcttgacgtcacgggcgacatgggcccaaaatattctaacagcaatacaacaagtcagatcattgataggtaatgaagaatttctagactacatgccttcaatgaaaaggtttagaaaagaagaagaacctgagggagcaatatggtaa

SEQ ID NO: 23533 - RNA, 9873 nt, synthetic construct
  misc_feature 1..9873: note = derived and/or modified CDS sequence (opt6) from DENV-3__FJ644564__SS-prME
  source 1..9873: mol_type = other RNA
acttcactatgtctaatgatgattttacccgctgcattggcatttcacttgacaagcagagacggggaaccacgaatgatcgtaggcaaaaatgaaagggggaaatcattgttatttaaaactgcatcgggtattaacatgtgtacgttaatagcaatggacttgggagaaatgtgtgacgacactgtgacgtacaaatgtccacacattacagaagtagaaccagaagatatagattgctggtgcaatttgacaagtacctgggtaacctacggtacttgtaatcaagcaggagaacacaggcgagataaaagaagcgtagccctagcaccacatgtaggaatgggtctcgatactagaacacaaacatggatgtcggctgagggagcatggcggcaagtagaaaaagttgaaacatgggcattgagacacccaggatttacaatacttgcactatttttggcacactatattggaacaagtctaacgcaaaaagtagttatatttatacttctaatgctggttactccgtcaatgacgatgcgttgcgtgggtgtcgggaatcgagactttgttgaaggattatctggagccacttgggtcgatgtcgtacttgaacatggaggatgtgtaacaacaatggccaaaaataaacctacattagatatagaacttcagaaaacagaagcgacgcaacttgctacgctgcgtaaattatgcatcgaaggaaaaataactaatattactactgactcgcgttgtccaactcaaggagaagctgtccttccagaagaacaagatcaaaattatgtttgcaaacatacatatgtagacaggggatggggtaatggctgcggcctttttgggaaaggatccctagtcacatgtgcaaaatttcaatgtctagaaccgatagaaggaaaagtcgtacaatatgaaaacctcaaatatacagtaattataactgtccatacaggggaccaacaccaagtaggcaacgagacgcaaggggtaacagcagaaataaccccacaagcgagtacgactgaagcgattttaccggaatacggaacccttgggctagaatgcagtcctcgaacgggattagatttcaacgaaatgatcctcctaacgatgaaaaataaagcctggatggtacatcgtcaatggtttttcgatctgccattaccttggacaagcggtgcaacaaccgaaacgccaacgtggaatcgcaaagagttattagtgacgttcaaaaatgcgcatgcgaagaaacaagaagtagttgtgctaggatcacaagaaggagctatgcataccgcgttaacgggagcaacagaaatccaaaacagtggaggtacaagtatctttgctggtcatctcaaatgcagattgaaaatggataaactcgagcttaagggtatgagctatgccatgtgtactaacacattcgttttaaagaaagaagtaagtgaaacacaacatggtaccattctaatcaaagtagaatataagggggaagatgctccctgtaaaatccccttttcaacggaagacggccaaggaaaagcccataatgggagactaattacagctaatccggtggtcactaagaaagaagaaccggtgaatatcgaagccgaaccaccatttggcgagtccaatatagtaattgggataggagataacgcattaaaaattaactggtataagaaaggaagctcaatagggaaaatgttcgaggccacagcaaggggcgcaagacgaatggctatcttaggagatacagcatgggatttcgggtctgtagggggagtactaaacagtttgggaaagatggtacatcaaatattcgggtcggcgtacacggcgctattttctggagtatcatgggttatgaaaataggcataggagtcctattgacttggataggcttgaatagtaaaaataccagtatgtcattttcctgcattgcaattggcattataacattatacctcggagcggttgtgcaagcagatatggggtgtgttataaactggaaaggtaaagaactgaaatgtggaagtgggattttcgtaacaaatgaagtgcacacgtggacggaacaatacaagtttcaagcagattcaccaaaacgactagcaacagcgatagcaggagcatgggagaacggagtatgtggaataagatcaacaacacgcatggaaaacttactatggaaacaaatcgcgaatgagctcaattatatattatgggaaaataacattaaattaactgttgtagtgggtgacacaataggtgtactcgaacaaggaaaaaggacccttacaccacaaccaatggaattgaagtattcgtggaagacgtggggaaaagctaaaatcgtaacagctgaaacacaaaattcatcatttataatagacgggccaaatactccagagtgcccgtctgcatcaagggcttggaatgtatgggaagtagaagattatggattcggagtatttacaaccaacatatggcttaaattgcgggaggtatatacacagatgtgtgaccatagactcatgagtgcagccgtaaaggacgaaagggctgtgcatgcagacatggggtactggatcgaatctcagaagaatgggtcatggaaacttgaaaaagcatcccttatagaagtcaaaacttgcacttggccaaaaagtcacaccctctggtctaatggtgtattggaaagtgatatgataatcccaaaatcacttgcaggacctatatcacaacacaatcacaggccaggataccacacccagacagccgggccatggcacttagagaatctagaacttgatttcacttactgcgagggaactacagtagtaattacagagaattgtggcactcggggtccatcactacgtacgaccacggtaagtggaaaattaattcacgaatggtgctgtcgaagctgtacactaccacctctaagatacatgggtgaagatggttgttggtacggaatggaaattcgtccaatttcagaaaaagaagaaaatatggtgaagtcacttgttagtgctggtagtggtaaagttgataactttacaatgggcatcttgtgccttgcaatactcttcgaagaagtaatgcgtggaaaatttgggaagaaacacatgatagccggggtgttctttacttttgtcttattattgagcgggcaaataacatggagagatatggcacatacattgataatgataggcagcaacgcgtcagatcggatgggtatgggggttacatatctcgcccttatagccacattcaagatacaaccatttctcgctcttggcttctttctccgaaagttaacatcacgggaaaacttactactaggagtaggtttagcaatggcaactactctccaattgcccgaagacattgaacaaatggcaaatggaattgcacttgggttaatggcgctcaaattaataacacaatttgaaacgtaccaattatggactgccctgatatcattaacatgttcaaatacaatatttacattgacagtagcatggagaacggcaaccctaattctcgcaggcgtatccctattacctgtatgtcagagcagctcaatgagaaaaaccgattggttgcccatgacagtagccgctatgggggtccctcctcttcctctattcatattctcacttaaggatacactgaaacgtcgctcgtggccgctcaatgaaggcgtcatggcagtcggccttgtgtctatacttgcaagctcactcctaaggaatgacgtcccaatggcaggacctctagttgctggaggcttacttatagcttgctacgtaataactgggacttcagctgatctcacagtcgaaaaggcagccgatgtaacttgggaggaagaagccgaacagacaggtgtttcccacaatttaatgataaccgtcgacgatgatggtacaatgagaatcaaagacgatgaaacagaaaatatcttaacggtattgttaaaaaccgccctactaattgtatcgggaatcttcccatattccattcctgcgacgctattagtatggcacacatggcaaaagcaaacgcaacgaagcggtgtattatgggacgtaccatccccgccagaaacacaaaaggcagaactcgaagaaggagtatatagaatcaaacagcaaggaattttaggcaaaacgcaagtcggggttggggttcaaaaggaaggggtctttcatactatgtggcatgtaactagaggagctgtactaactcataacggcaaacgtctagagccaaactgggcatcagtcaagaaagatctaatttcttatggtggagggtggcgtctatcggctcaatggcaaaaaggagaggaggtacaagtcatagccgttgagcccggcaaaaacccgaagaatttccaaactatgccaggaacatttcaaaccaccacaggtgaaataggggcaatagcgctagatttcaagccaggaacctctggttcccccattattaatcgtgaaggaaaggttgttggtctatatggaaacggcgtggtaaccaaaaacggaggatacgtaagtggaatagctcagaccaatgctgaacccgatggcccaacaccagaattggaagaagagatgtttaagaaacgcaatcttacaattatggacctacacccaggctccggaaagacacgtaaataccttccggcaattgttcgcgaagcaattaaacgtaggctcagaacgctaatcttagcgccaaccagggttgttgccgcagaaatggaggaggctttaaaaggactacccattcgatatcaaaccacagctactaaatctgaacataccggaagagaaatagtagatttgatgtgtcacgctacgttcacaatgcgacttctgtctccagtacgagtgcctaattataatctaataatcatggatgaagctcactttacggatccagcatcaattgcagctaggggatatatatcgactcgagtgggaatgggagaggccgctgcaatattcatgagtgccacacctccgggtactgctgatgctttccctcaaagtaatgcacctatacaagatgaggaacgcgatatacctgagagatcatggaactctggaaacgaatggatcacagattttgcaggtaagacagtctggtttgtacctagtattaaagctggtaacgacatcgctaactgtttacgtaagaatggtaagaaagtaatacaactatcaagaaaaacctttgatacagaatatcagaaaacgaaactgaatgattgggattttgtagtcactacagatattagtgaaatgggcgctaatttcaaggcagatcgcgtaattgatcctagacgctgtcttaaacctgtaatactaacagatggtccagaaagggtaatattagcggggccgatgccggtcacagcagcgtcagcagctcagagaaggggcagggttggaagaaacccccagaaggaaaatgatcaatatatctttactggtcaaccactgaataacgacgaggaccacgctcattggacagaagccaaaatgctactagacaacataaatactcctgaaggaataatacctgccttatttgaacccgaaagagagaaaagcgctgcaatcgatggtgaataccgacttaagggagagtcaagaaaaacgttcgtagaactcatgaggagaggagatttacccgtatggcttgcgcataaggtagcttctgaaggaatcaagtatacagatagaaaatggtgttttgatggacaacgcaataatcaaatattagaagaaaacatggacgtagagatctggacaaaagaaggtgagaagaagaaattacgaccccgttggcttgatgcgcgaacttactcggatcctctggcactcaaagaatttaaagactttgctgcgggaaggaaaagcatagcgcttgacctcgtcactgagataggacgtgtaccgtctcatctagcacaccgtacccgcaatgcattggataacctagtgatgttgcatacaagtgaacatggtggcagagcgtacagacacgcggttgaagagttgcctgaaacaatggaaactttactgttacttggcttaatgatattacttacaggtggagctatgcttttcttaatttcaggtaaaggtatcggtaaaacgtcgataggattgatatgtgtaatagcgtctagtggcatgctatggatggccgaaatacctctccaatggatcgcctcagctatagtactggagttctttatgatggttttgttaataccagaaccagagaaacagcgaacaccacaagacaatcagttggcatacgtggtaataggcatcctaactttggcggcaattatagcggccaacgaaatgggactgctcgaaactacgaaacgagacttaggtatgtcaaaagaaccaggagtagtatcaccaaccagttacctagacgttgatttacatccagcatcggcttggacgctttacgccgtagcaacaacagtaatcactccaatgcttcgtcacacaatcgaaaattctacggccaacgtaagcctagctgcaatcgcaaatcaagcagttgtattaatggggctagataaaggatggcccataagtaaaatggaccttggagtaccactcttagcactcggatgttactcccaagtcaacccgctgacattaacggcagcggttctgttacttataacgcactatgctataattggtcctggactacaagcaaaagccacaagggaagcacaaaaacgaacggcagcgggaataatgaaaaaccccacggtagacggcataattacaattgatttagatcccgtcatttatgactcaaaattcgagaaacaattaggacaagtgatgcttttagtattatgcgcagtacaactcctattgatgcgaacgtcctgggcactttgtgaggctttaacactagcaacagggccaattactacactttgggaagggtctcccggcaaattctggaacactacgattgccgtatcaatggcaaatatatttcggggaagttatctagccggagcaggtttagcatttagtataatgaagtcagtaggaaccggtaaacgtgggacaggatcccaaggagaaacgctgggtgaaaaatggaagaagaaattgaaccagctatcacgtaaagaatttgatttgtataagaaaagcggtataacagaagtagatagaacagaggcaaaggaaggattgaaacgtggagaaaccacccatcacgccgttagcagaggctcagctaaattgcagtggttagtcgaacgaaacatggtaataccggaaggaagggtaatagatctagggtgtggccggggcggatggtcatattattgcgcggggctaaagaaagtaacagaggtcaggggatataccaaaggaggtcccgggcacgaggaacccgtacctatgtctacctacggctggaacatcgtcaaattaatgtccggcaaagatgtgttctatctgccgccagaaaaatgtgacaccctcttatgcgatataggcgaaagtagtcctagtccgactgtagaagagagcagaacaattagagtattgaaaatggttgaaccctggctcaaaaataaccaattttgtataaaggttttaaacccttacatgcccgcagtaatcgagcacctggaaagactccagaggaaacatggaggtatgttagtaagaaacccattaagtaggaactctactcatgaaatgtattggatatctaatggaacgggaaatatagttagtagtgtgaatatggtgtcccgtctacttcttaatagattcacaatgacgcatagaagacctaccatagaaaaggatgtagatcttggagccggaacgcgacatgtcaacgcagaacctgaaacacctaacatggatgtcatcggcgagagaattaagcgaattaaggaagaacataacagtacttggcactacgacgatgagaatccttacaagacatgggcttatcacggctcatatgaagtgaaagccacgggatccgccagtagtatgattaatggagtagtaaagttgttaacaaaaccatgggacgtagtacctatggtgactcaaatggcaatgacagataccacgccatttggtcaacaaagggtatttaaggaaaaagttgacactaggaccccgagacccatgccagggacgcgaaaggtaatggaaataactgccgagtggttgtggcgaacattgggaaggaacaaaaggccgagactatgcacaagggaagaatttacgaagaaagtcaggaccaacgctgcaatgggggccgttttcaccgaagaaaatcaatgggattcagctaaagcggcagtcgaagacgaagaattttggaaattagttgacagggaacgagaattacataaactagggaaatgtggtagttgtgtgtataatatgatgggcaagagagagaagaaactaggagaatttggtaaagcgaaaggaagcagagccatttggtatatgtggttaggttccagatatctagaatttgaagcgttaggctttttaaatgaagatcattggttttcacgcgagaatagctattccggagttgaaggagaaggtctgcataagctgggttatatcctgagagacatatcaaaaataccgggaggagcaatgtacgcagatgacactgcaggttgggacacgcgaattacagaagacgatttgcataacgaagaaaagataacccaacaaatggatcctgaacaccggcttctggccaatgccatcttcaaactaacataccaaaataaagttgtgaaggtacagagaccgacgccgacagggacagtcatggatattataagcaggaaagatcaacgcggaagtggtcaggtgggtacttatggtctaaacacctttactaacatggaagcacaacttgtgaggcaaatggaaggagaaggagtgttatctaaggctgatctagagaacccccatctgcctgaaaagaaaataacacaatggctggaaacgaagggcgtcgaacgtctaaaaaggatggcaataagtggtgatgactgcgtagttaaacctatagacgacagatttgccaatgcactattagctctcaacgacatgggaaaggtacggaaagatatcccccaatggcagccgagtaaaggttggcacgactggcaacaggtaccgttctgttctcaccattttcacgagcttataatgaaagatgggagaaaattggttgtcccctgtcgcccacaagacgaattgataggcagagctaggatttcacagggagcaggttggtccctccgagaaactgcttgcttaggtaaggcgtatgcccaaatgtggtctctaatgtacttccatagacgagatttaagattagctagtaacgctatttgttcagcggttccagtacattgggtaccaacgtcaaggacgacttggagtatacatgcgcatcatcaatggatgacaacagaggatatgctcacagtctggaatcgagtatggatagaggacaacccgtggatggaagataaaactccggtaacaacttgggaaaatgtaccttatctagggaaacgggaggatcaatggtgtggttccctaataggccttacttcaagagcaacatgggcccagaatatacccacagcaatacaacaagtgagatcgctcataggaaacgaggagtttcttgactatatgcctagcatgaaacgttttaggaaggaagaggaaagcgaaggagccatatggtag

SEQ ID NO: 23534 - RNA, 9873 nt, synthetic construct
  misc_feature 1..9873: note = derived and/or modified CDS sequence (opt6) from DENV-3__HQ235027__SS-prME
  source 1..9873: mol_type = other RNA
acatctctttgcctcatgatgatattgccagctgcactcgcttttcacttaactagcagagacggagaaccgagaatgatagtaggtaaaaatgaaagagggaaatccttattatttaaaacagcaagcggaataaatatgtgtactctcattgcaatggacctaggagaaatgtgcgatgatactgtaacatacaaatgcccccatattacagaagttgaacccgaagacatcgattgttggtgcaacctaacaagtacatgggtgacatatggaacttgtaatcaggcgggtgaacacagacgagataaacgcagtgtggcattggcgccacatgtaggaatgggtttagatacaagaacacaaacctggatgagtgctgaaggcgcttggaggcaagttgaaaaagtagaaacgtgggccctcaggcatcccggattcactatattggcgcttttcttagcgcattacataggaacgtcactcactcagaaagttgtaattttcatactcttgatgctggtaacccccagcatgacgatgagatgtgtcggtgtaggtaaccgagattttgtcgaaggattgtctggagccacttgggtcgacgtggtactagaacatggaggatgtgtcaccacgatggctaaaaataaaccaacattagatatcgaattgcagaaaacagaagcaacacaattggctacgttgcggaaattatgtatagaaggaaaaataacgaatattactaccgatagtagatgcccaactcaaggagaagcagttcttccagaagaacaagatcaaaactatgtatgcaaacatacctacgtagacagaggatggggaaacggttgtggtttattcgggaaaggatctctcgtcacatgtgccaaatttcaatgtttagaaccaattgaaggcaaagtcgtgcagtacgagaacctaaagtacactgtcattattaccgtccacacaggagaccaacaccaagtaggtaatgaaacgcaaggagtcaccgccgaaattacaccacaagccagtactacggaggcaatactgcctgaatacggaaccctagggttagaatgctcaccacgtactgggctagattttaacgagatgatactgttaactatgaaaaacaaagcatggatggtacacaggcaatggttctttgacctaccacttccttggacctctggtgctacaacagagaccccaacctggaatcgtaaagaactcttggtaactttcaagaacgcacacgctaaaaagcaagaggtagtggtactcggatcccaagaaggggcgatgcacactgcattgactggagccattgagatacaaaactccggaggcacaagcatattcgctggtcacctaaagtgccgtctcaaaatggacaaactcgagcttaaaggtatgtcctatgcaatgtgtacaaagacattcgtcttgaagaaagaagtatcagaaacacaacatggcactatcttaataaaagtagaatacaaaggggaagatgcgccgtgcaaaattcccttttcaactgaagacggtcaagggaaggcttataacggcagactaataacagcaaatccagtagtcaccaagaaagacgagcccgtgaatatcgaagccgaaccaccttttggagaatctaacatcgttataggtataggggacaatgccttaaagataaattggtataagaaaggtagttctatcggaaaaatgtttgaagcgacggcacgtggagcaagacgcatggccattctgggtgatacggcctgggatttcggatctgttggtggtgtactgaactcgttgggcaaaatggtacaccagattttcggaagtgcatacaccgctttattctcaggggtctcttgggtaatgaaaatcggtatcggtgtgcttttaacatggatcggccttaattctaaaaatatttcaatgtcattttcgtgtattgctataggaataataactctgtacttaggtgcagtggttcaagcagatatgggttgtgtaataaactggaaaggcaaagaactcaaatgcggttcaggaatcttcgtaaccaatgaagtacacacatggactgaacaatataaattccaggcagacagtcccaaaagattggctacagctatagccggtgcatgggagaacggagtgtgcggcataagaagtacgacccgtatggaaaacttgttatggaagcaaattgcaaacgagttgaactacatactatgggaaaataacatcaaactaaccgtggtagtcggagacacaatcggggtcttagaacaaggtaagcggaccttgactccacaaccaatggagctgaaatactcctggaagacctgggggaaggcaaagattgtcacggcagaaactcaaaattcgtcattcattatagatggtccgaatacgccggagtgcccatcagcttctagagcctggaatgtatgggaagtagaggattatggcttcggcgtatttactacaaatatttggttaaaactgagagaagtctatacccaattatgtgatcacaggcttatgtcagctgctgttaaagatgaacgggcggtccatgcggatatggggtactggatagaaagtcagaaaaatggaagttggaaacttgaaaaggcctcattaatagaggtaaaaacgtgcacgtggcctaaaagtcatacgctatggtccaacggggtactggaaagtgacatgataatacctaaaagtttagcgggacctatttctcaacataaccatagaccaggttaccatactcaaacagcaggaccatggcacctaggaaaattagaattggacttcaactattgtgagggaacaacagtcgtgatcacggaaaattgtggtaccagaggtccttctttacgcacgacaacagtaagtggaaaattaatacatgaatggtgctgcagatcgtgcacattacctccgttaaggtatatgggggaagacggctgctggtacggtatggaaataagacctataagcgaaaaagaagaaaacatggtaaagagtctggttagtgcaggaagcggaaaagtagacaactttacaatgggtgtgttatgcttagcaatcctatttgaagaagtaatgcggggaaaatttggtaagaaacatatgatagcaggggttttctttacgttcgtactgctgttatcgggtcaaattacctggagagacatggcacacaccctaatcatgataggctcaaacgcaagtgatcgaatgggaatgggagtaacatatctagcccttattgcaacatttaaaatacaaccattcttggcattgggatttttcctacgaaagttaacatcaagagaaaatctcttgttaggtgtagggttagccatggctaccacgctacagctccctgaggatatagagcaaatggcaaatggcatagccttaggcctaatggctctgaaattaataacacagttcgaaacataccaactatggaccgcactcatctctctaacatgctctaatacaatgtttacacttacggttgcgtggcgtactgccacactaattctagcaggagtttctttgctgccagtttgtcagtcatccagtatgaggaaaacagattggttaccaatggcagtggcagccatgggcgttccacccttacctctatttatatttagccttaaagatacattgaagcgcaggtcttggcccttaaatgagggtgttatggcagtaggcctagtaagtatcctcgccagctctcttctcagaaatgacgtaccaatggctgggcctttagtagccggtggattgttaattgcttgctacgtcatcacaggtaccagcgcggatttgacagtagaaaaagctgccgatattacatgggaagaagaagcagagcaaaccggagtgtcccataatttaatgattaccgtggatgacgacggcactatgcgtatcaaagatgatgaaacagaaaatattctcacagttctacttaaaacagcactgctcgtagtgtctggagttttcccatatagtatcccagcaacactattggtatggcacacctggcaaaagcagacacaaagatcaggggtgctttgggatgtgccttcgccccctgaaacacaaaaagcggagctcgaagaaggagtttataggataaaacaacaaggaatttttggcaaaacccaagtaggtgtaggagtccaaaaagagggagtttttcacaccatgtggcacgttacccgaggcgcagtattaacatacaatggaaagcgtttggagccgaactgggcctccgtcaagaaagacctaattagctatggtggtggttggaggttgtccgcacaatggcaaaaaggggaagaggtccaggtaatagccgttgaaccaggtaaaaaccctaaaaattttcaaacaatgcccgggacatttcagacaacgacaggagaaattggagcaatagccctagactttaaacctggcacaagtggatccccaataatcaatcgtgaaggtaaagttgtaggactatacggtaatggggttgtaactaaaaacggcggatacgttagtggaatagcacaaacaaacgcggaaccagatggtccaactccggaactagaagaggagatgttcaagaaacgaaatctcacaataatggacctacatccaggctcaggcaagacgagaaaatacttgccggcaattgtgagggaggcaataaagagacgactccggacgctgatcctagcaccaacaagagtcgttgccgcggaaatggaggaggctttaaagggccttcctatacgttatcaaaccaccgctacaaaatcggaacacactggtagagaaatagtagacctaatgtgccatgcaacattcaccatgcgcttattatcccctgtcagagttccaaattataatctaataataatggacgaagcgcatttcacggaccctgcctccatagcagccagaggatatatttcaacaagggtaggtatgggggaagcagcagcgatttttatgaccgcaaccccaccaggaactgcagacgcatttccccaaagtaacgcaccaattcaagatgaggaacgcgacattccagaaagaagttggaatagcgggaatgaatggataacagactttgcaggaaagacagtgtggtttgtgccatcgatcaaagctggaaatgatattgctaattgcctgaggaaaaatggtaagaaagtaatacagctttcgagaaaaacttttgataccgaatatcagaaaactaaattgaacgactgggattttgtcgtaaccactgatatttctgagatgggagctaactttaaagcagatagagtcattgatccacgtcgctgcctcaaacccgtaattctaacggatggaccagaacgtgtcattctcgctggacctatgccagtaacagctgcctcagcggcacaacgcaggggacgcgttggtagaaacccacaaaaagaaaatgatcaatacatttttacaggacagccgttaaataacgacgaagatcacgctcattggacagaggcaaaaatgctcttggataacataaatactcccgaaggtataatacctgcattattcgaaccagagagggaaaagtcagccgcaatagatggcgaatatcgactgaaaggtgagtcaagaaaaacattcgtagaattaatgagaagaggagacttacccgtgtggctggctcataaagttgcatccgaaggtatcaaatacacagacagaaaatggtgctttgatggccaaagaaataaccagatcttggaagaaaatatggatgtggaaatatggacaaaagaaggcgagaaaaagaaattacggcccagatggttggatgcacgaacatactccgacccacttgcgttaaaagaatttaaagacttcgctgcagggagaaagagtattgcattagatttggtcacggaaattgggagagtaccgagtcacctcgcacatcggactcgaaatgcactagataatttagttatgcttcatacatctgaacacggaggacgggcatatagacatgccgtggaggaactacccgaaactatggaaacactactattattaggattaatgattttattgactggtggagcgatgctattcttaatatctggtaaaggcatcggcaaaacatctatagggttaatctgtgtgatagcaagcagtggaatgttgtggatggcggaaatacctttacaatggatagctagtgccatagtcctggagttctttatgatggttcttttaatacccgaaccagaaaagcaaagaacgccacaagacaatcagctagcatatgttgtaattggaatccttaccttagcagcaattatagctgctaacgagatgggattgctagaaacgactaaaagagatttaggtatgtcaaaggaaccgggggtagtttcaccgacttcctatttagatgtagacctccacccagcttcggcatggacgttatacgcagttgcaaccacggttataacgccaatgctaagacatacaatagaaaattctacggctaatgtatctttggcagcgattgcaaatcaggccgtagtactaatgggacttgacaaaggttggccaataagtaaaatggatctcggggtacctttactagcacttggttgttatagtcaggtaaaccccctcacactcactgcagcggtcctcttattgataacccactatgcaatcataggacccggtttacaagcgaaagcaactagagaagcgcaaaaacgcactgcagcagggataatgaaaaatccgaccgttgatggtattatgaccattgatctggatcccgtaatatatgactcaaaattcgaaaaacaactgggccaagtaatgctattagtcttatgtgccgtccaacttcttttaatgcgtacatcttgggcactgtgtgaagctctaaccttagctactggaccaattacaacactgtgggagggaagtccaggtaagttctggaacactacaattgcagtatccatggcaaatatatttaggggttcctatctagcaggagcaggtctagccttcagtataatgaaaagtgttggtacgggtaaaagaggcacgggcagtcaaggcgaaactctcggcgaaaagtggaaaaagaaacttaatcagttgagcagaaaagagttcgacaggtacaaaaagtcaggcattactgaagtagacagaaccgaggccaaagaagggctaaaaagaggggaaactacacaccatgcagtctcaagagggtcagccaaattgcagtggttcgttgagagaaatatggtcatacctgaaggcagagtcattgatttgggttgtggacgaggcggttggtcctattactgcgctggcctgaaaaaggtaacggaggtaagagggtacacaaaaggcggtcctggccatgaagaacccgtaccgatgagtacatatggatggaatatagtaaagctaatgtcggggaaagacgtattttacttgccacctgaaaaatgtgatactttactttgcgacataggcgaatctagccctagcccgaccgtagaggaatctcgtacaattagagtactcaagatggttgaaccatggctcaagaacaatcaattttgtattaaaatattaaatccatatatgcctactgtcatagaacatcttgaaagactacagaggaaacacggagggatgttagtcagaaatcccctctctcgaaattcaacccatgaaatgtactggatatccaacgggaccggaaatatagtcgcctccgtaaatatggtttccagacttctattgaatagattcactatgacccataggcgccccaccatagaaaaggacgtcgatctgggtgctggtactcgtcacgtaaacgcagagccggaaaccccaaatatggacgtgataggtgaacggataaaaagaatcaaagaagaacacaatagtacttggcattatgatgatgagaatccttataaaacttgggcgtaccacggctcttatgaagtgaaagcgacaggatcggcttcttcaatgataaatggagtagtgaaacttttaactaagccctgggacgtagtcccaatggtcacgcaaatggccatgactgacactacaccgttcggacaacaacgcgtctttaaagaaaaagtcgatactaggacaccgcgttctatgccgggtactaggagagttatggggataaccgctgaatggttatggagaacattaggcaggaacaagaaaccacgattatgtactagggaagaatttaccaagaaagtaagaacaaacgccgcaatgggggctgtgttcacagaggaaaaccaatgggatagtgcaaaagcagcagttgaagacgaagatttctggaaacttgtagatagagaacgtgaattacataagctcggaaaatgcggctcgtgtgtttacaacatgatgggaaagcgcgaaaagaagttaggcgaatttggaaaggctaagggatcgcgggcaatttggtatatgtggttaggagctagatacttagagttcgaagcgctagggtttctaaatgaagaccactggttctcaagggaaaacagctacagtggggttgaaggcgaaggcctacataaattaggatacattctaagagatatatccaagataccagggggcgcaatgtatgcagacgacactgccggctgggatacaagaattactgaggacgatttacataatgaagagaaaataacccaacagatggatcccgaacatagacagcttgcaaacgctatatttaaattaacataccaaaataaagtagtgaaagtgcaaagacctacaccaactggaacagttatggacataataagccgaaaagaccaacgtggatctggacaagtaggcacatacgggcttaacacgtttactaacatggaagcacagctcatccgacagatggagggagaaggggtactaagcaaagccgatttagaaaacccacatcttcctgagaagaaaattacacaatggcttgaaactaaaggagtcgaaaggttaaaacgcatggctatctcaggcgacgattgtgttgtaaaaccaatcgatgatagatttgcgaacgcattacttgctttaaatgatatggggaaagtccgcaaagatatcccacaatggcaaccatctaagggttggcacgattggcaacaggttcccttttgtagtcatcactttcacgagctcatcatgaaggacggaagaaagttagtggtaccttgtcgtccacaagacgaactaataggacgagccagaataagccaaggtgctggttggtcactaagagagacggcatgtctaggaaaagcatatgcgcaaatgtggagtctaatgtattttcaccggagggacttaagattagctagcaatgcaatatgcagcgcagtaccagtgcattgggttcccacttcacgtaccacttggtcgattcacgctcaccaccaatggatgacaaccgaagatatgttaactgtatggaaccgcgtatggattgaagacaatccatggatggaagataaaacgccggtgaccacgtgggaagatgtcccatacttaggaaaaagagaagaccaatggtgcggttcattgataggactaactagcagggcaacatgggcccagaacatacctacggcaatacagcaagtaaggagcttgataggaaacgaagagttcttagattacatgccatctatgaaacgctttcgtaaagaagaagagtctgaaggcgcaatttggtaa

SEQ ID NO: 23535 - RNA, 9873 nt, synthetic construct
  misc_feature 1..9873: note = derived and/or modified CDS sequence (opt6) from DENV-3__JQ920476__SS-prME
  source 1..9873: mol_type = other RNA
acttcactttgcctgatgatgatgttgccagcaactctagcttttcatctgacatcgagagatggagaaccgagaatgattgtagggaaaaatgaacgtggtaaaagtctactattcaaaacggcaagtggaataaatatgtgcacactaatagctatggatctgggagaaatgtgtgatgatactgtaacatataaatgtccacttattactgaagtcgaaccagaggacatagattgctggtgtaatttaacgtcaacttgggtgacctatggtacctgcaaccaagcaggggagcacaggcgagacaaaagatctgttgctttagcgcctcacgtaggaatggggctagatacacggacccaaacttggatgtcggcagaaggagcatggcgccaagtggaaaaagttgaaacatgggcatttcgtcatccaggttttactatattggcattatttctagctcattacataggaacatcgttgacacaaaaagtggtgatatttattctgctaatgcttgttacaccaagcatgactatgagatgtgtcggagtcgggaaccgcgactttgtcgaaggattatctggagcaacctgggtcgatgtcgttttagagcatggtggatgtgttaccacgatggctaaaaataaaccaactttagatatagaattacagaaaactgaggctactcaacttgcaacactaaggaaactatgtatcgagggaaaaattactaatgttacaacagattcaaggtgcccaacccaaggtgaagcgatattgcctgaagaacaagatcagaattatgtatgcaaacatacatatgttgatagaggatggggaaacggttgcggactatttggtaaaggaagcctagttacatgcgctaagtttcagtgcctagagtcgattgaaggcaaagcggtgcaacatgaaaacttaaagtacactgtcattataacggtacacactggagatcaacaccaagtaggaaacgaaactcagggcgtaaccgcggaaataacgcctcaggcttctaccgtagaagcaatacttcctgaatacgggaccttaggcctagaatgtagcccgcgcacaggcctagattttaatgaaatgatcttactaaccatgaaaaacaaggcttggatggtacaccgtcagtggttctttgatcttcctttaccatggacaagtggtgcaaccacagaaacacccacgtggaacaagaaggaattattagtaacgtttaaaaacgctcacgcaaagaagcaggaagttgttgtcttaggcagtcaggaaggggcgatgcatacagctctgacaggtgctacggagattcagacgtctggaggaacaagcatatttgcgggtcacttaaaatgtagattaaaaatggataaattggaactaaaaggtatgtcgtacgctatgtgtctaaatgcattcgttttaaagaaagaagttagtgagacacaacacgggacgatacttataaaggtagaatacaaaggagaagatgctccatgtaagataccattcagtacagaagatggtcaagggaaagcacataatggaagactaatcacagcaaatcccatagtaactaagaaagaagaacctgtaaacatagaagctgaaccaccattcggagaatcaaacatagtaattggaataggagacaaagcactcaaaattaattggtataagaaagggtcttcgataggtaaaatgtttgaggcaaccgcgcgtggagctcgtagaatggctatattaggagatacagcttgggattttggatctgtaggaggagtactcaactcactgggaaaaatggtccaccaaattttcggctctgcgtataccgctctattttctggggtctcctggataatgaaaataggaatcggcgtgttattgacgtggattggactaaacagcaaaaacacatcaatgagcttttcatgtatagtcatcggaataattacattatatttgggcgcagtagtccaagctgatatgggttgcgtaattaattggaagggaaaggagttaaaatgcggttctggtattttcgtgactaacgaagttcacacgtggacagaacagtacaaatttcaagcagattcacctaaacgtttagctactgctatcgctggcgcttgggaaaacggcgtgtgtggtataaggtcaactacaaggatggaaaacctgctttggaaacagatcgccaacgaacttaattatatactatgggagaataatataaaattgacaatcgtcgttggagatgttattggagtactagaacaaggaaaaaggacgcttacaccacagcctatggaactgaagtacagttggaaaacatggggcaaggctaaaatagtaacggctgaaacccaaaactcatccttcataatcgatgggccgaatactcccgaatgtccaaatgcaagtagagcttggaatgtttgggaggtcgaagattacggatttggtgtctttacaacgaacatttggctcaaacttagagagatgtatacacaactctgcgatcaccgcctaatgagtgcagccgtgaaagacgaaagggcagtacacgcggacatgggctattggatagaaagccagaaaaatgggagctggaagctcgagaaagcgagcctcatagaagttaaaacctgcacatggccaaaatcacacaccctgtggagtaatggtgttctagaaagcgatatgataataccaaaatcattagcaggaccgatttcacaacacaattacagaccaggataccatacacaaaccgctggaccctggcacctcggcaaactggaactagacttcaattactgcgaaggaactacagttgtaattactgaaaattgcggaacacggggcccatctttacgaactactaccgtcagcggcaaactaatacatgagtggtgttgccggagttgcaccctaccgccactacgatatatgggtgaagatggttgctggtacggaatggaaattcgaccaattaatgaaaaagaagaaaacatggtgaaatctctggtttcggcgggatccgggaaagcggacaattttactatgggagtactttgcttagccatactattcgaagaagttatgcgaggaaaatttggcaagaaacatatgatcgccggtgcactgttcacattcgtgttgttactcagtggtcaaattacatggcgagatatggcacatactctaataatgataggctcaaatgcgtctgatcgtatgggtatgggtgtgacatacttagctctcatcgcaactttcaaaatccaaccattcctggcgttaggtttctttttacgaaaacttacaagtcgtgaaaatttgctcttaggggttggtctagcaatggcaacgacgcttcaactaccagaagatatagaacaaatggcgaacggaattgccctagggctaatggctttaaaattaatcacgcagtttgaaacataccagctttggacagcacttgtgagcttaatgtgtagtaacaccattttcactttaacggtggcgtggcgaacagcgacattgattcttgccgttataagtctattaccggtctgtcagagttcaagtatgagaaaaacagattggctcccaatgacagtagcagccatgggcgtccctcctcttccattatttatcttttctttaaaagatactcttaaaagaagaagctggccattgaatgagggagtaatggcagtgggattggtatcaatactggcttctagctttttgagaaatgatgtacctatggccggccccctagttgcagggggattacttattgcgtgttacgtaataacagggacatctgctgaccttacggtggaaaaggctgccgacgtcacttgggaagaagaggcagaacaaacaggagtatctcataatttaatgataacagtagatgacgacggcacgatgcgtattaaagatgatgagaccgagaacatattgacagtattgcttaaaacggcgttactaatagtctcaggaatatttccttatagtattccggcgactttattggtttggcatacatggcagaaacaaacacaacgctccggggttctctgggatgtaccaagtccccctgaaacacaaaaagcagaactagaggagggagtctatagaatcaaacaacagggtattttcgggaagacccaagtaggggttggcgttcagaaggagggagtttttcacactatgtggcacgtcacaagaggggcagttttaacccataacggaaagagattagagccaaattgggccaacgttaaaaaggaccttatatcctacggtggcggatggaagttgagtgctcaatggcaaaagggggaagaagtacaagtgatagcagtagaacctggcaaaaacccaaagaacttccaaacgatgccaggaatctttcagactactacaggtgagattggagctattgctctagacttcaagccaggaacaagtggaagccctattatcaatagagagggtaaagtcgtagggctttacggaaatggagttgtaaccaaaaatggtggttatgtctctggaatagcacagacgaatgcagaaccagacggcccaacccctgaactagaagaagaaatgtttaagaaaaggaatcttacgattatggacctacaccctgggagcggtaaaacaagaaaatacctccccgctatagtcagagaagcaataaaacgaagactacgtactcttattttagctcccacccgagtggtggcggcagagatggaagaagcgcttaagggattaccgatccgttaccaaaccacagctacaaaatcagaacatacgggacgggaaattgtagatctgatgtgccatgcaacattcactatgaggttgctgagtcctgtcagagtgcctaattataacctcatagtaatggatgaggctcattttacggatcctgcgtcaattgcagcaaggggatatatatccaccagagtgggaatgggcgaagccgcagcgatttttatgacagccactccgccaggaactgctgacgcattcccccagtcaaatgcgcccattcaagatgaggaacgggatataccagaacgcagctggaatagcggcaatgaatggattacggactttgctgggaaaacggtatggttcgtgccgagtattaaagcaggaaacgatatcgcaaattgtttacggaaaaatggcaagaaagtaatacaattgagtagaaagacatttgatacagagtaccagaaaacgaaacttaacgattgggatttcgtcgtaactacagatatctcagaaatgggtgccaactttaaagctgatagagtaatcgatcctagacgatgtttgaaaccagtaatccttacagatggaccagaacgagtaatcctagctggtccgatgccagttacagttgcctcggcagctcaaagacgaggaagagtaggacgcaatccgcaaaaggaaaatgaccaatacattttcacaggccaaccacttaataatgacgaagaccatgcacattggacggaagctaagatgctattagacaatataaatacaccggaaggcatcatacctgcactgttcgaacctgagagggagaaatctgcggcaatagacggtgaatacagactgaaaggagagagccgaaaaaccttcgtcgaattaatgcgaagaggagatctcccggtatggttagcacacaaagttgcgtcagaaggtatcaaatatacagacaggaaatggtgtttcgacggtgagcgtaacaaccagatactggaagagaacatggacgtagaaatatggacaaaagaaggtgaaaagaagaaattacgtcccaggtggttagacgcgagaacctacagcgacccactcgcactgaaagagtttaaagactttgccgctggcaggaaatccattgcacttgatctagttactgaaataggaagagttccttcccaccttgcgcaccgcacgagaaatgcattagataatctcgtaatgttacacacaagcgaacatggtggtagagcctatcgccatgctgtagaagaactgccagaaactatggaaaccttacttttattaggtttaatgatattattaactggtggtgcaatgctgtttttaatatctggaaagggtataggaaaaacaagtataggattaatttgtgttgttgcatcgagtggaatgctatggatggcagacgtacccctacaatggattgcatccgcaatagtgttagaatttttcatgatggtcttattgatccctgagcctgaaaaacagaggactccccaagacaaccaacttgcatacgttgttatcggtatcttaactttagccgcaatagttgcggcgaatgaaatgggactacttgaaacaacaaagcgtgacttaggcatgagcaaagaaagtggcgtagtttcaccgacatcctatttagacgtagatctacatcccgcgtcagcgtggaccctatatgcagttgctacgactgtaataacaccgatgttgcgacatacaatagagaactcaacagccaatgtgagtttggctgcaatagcgaaccaagccgttgtgttaatgggtctagacaaaggttggccaataagtaaaatggacctaggggtaccactccttgcattgggatgttattctcaggtaaatccactaacccttaccgcagcggtcttattgttagtaacacactatgcgattattgggcccggtctgcaggcgaaagcaactcgtgaggcccaaaagagaacggcagcaggcataatgaagaaccctacagtcgacggcataatgacaattgacctagaccccgtaatttacgacagtaaatttgaaaaacagctcggacaagtcatgttactcgtactatgtgcagttcaattgctactaatgagaaccagttgggcattttgcgaagcattgacactcgccacagggccgataacgacactatgggaaggctcgcccggtaaattttggaacactacaatcgcggtttcaatggcgaatatatttcgaggaagctatctagcgggcgcaggactggctttttccatcatgaaaagtgtggggactggaaaacgtggaacaggatcacaaggagaaacactgggagaaaagtggaagaagaaacttaaccaactttctagaaaagaatttgatttatacaagaaaagcggaatcacggaagtggatcgtacagaggccaaagaaggattaaaaagaggagaaataactcatcacgccgtatcaaggggatccgctaaacttcaatggttcgtagaacgtaatatggtcattccagaaggacgggttattgatttaggatgcggaagaggaggttggtcttattattgcgccggattaaagaaagttacggaagtacgcggatatacgaaaggtggtccgggtcatgaagaaccggtccccatgtccacgtatggttggaatatagtaaaattaatgtctgggaaagatgtattttaccttcctccagaaaaatgtgacactttattatgcgacataggagaatcatccccatcaccaacagtcgaagaatctcgtacaatacgagttttaaaaatggtagaaccttggctcaaaaataaccagttttgtataaaagttcttaatccctacatgcctactgttattgagcatctggaacgactacagcgaaaacatggaggtatgcttgtaaggaatcctttaagccgaaattcgacacacgaaatgtattggattagtaatggaaccggaaacatagtatcgtcagtcaacatggttagcagattattattgaatagatttacaatgacgcaccgaagaccaacaattgagaaagatgtagatctgggagcgggtaccagacatgttaacgctgaacctgagacccctaacatggacgttattggagaaagaatcagaagaataaaagaagaacattctagcacatggcattatgatgatgaaaatccctataagacctgggcctatcatggaagctatgaggttaaggcgacgggcagtgcatcaagtatgattaacggtgtagtaaaacttctaacaaaaccatgggacgtggttccgatggttacacagatggctatgacagacaccacaccttttggccaacaaagagtatttaaagagaaagtcgacactagaacaccaagacctatgcctggcacacggaaagtgatggagataacagcagaatggttatggcgaactctcggcagaaataaaaggccaagactgtgtacccgagaagagttcatcaagaaagtcagaaccaatgcagcaatgggagcagttttcaccgaagaaaatcaatgggattctgctagagctgcagttgaagatgaggaattttggaaactggttgaccgcgagcgagaattacataaattaggaaaatgtgggagttgtgtatataatatgatgggaaaacgagagaagaaattaggagaatttggcaaggcgaaaggaagccgggcgatatggtatatgtggcttggagcaagatatcttgaatttgaagcgctaggcttcttgaatgaagaccattggttttcacgggaaaattcacactcgggagtcgaaggagaaggtctacataaactaggctacatattaagagacatatcgaaaatacccggcggggcaatgtatgccgatgatacagctggatgggatactagaattacagaagatgatctgcataacgaggagaaaattacacaacaaatggacccagagcatagacaacttgcaaacgcaatcttcaaacttacgtatcaaaataaagtggtaaaggtacagcgacctacaccaaaaggaacagttatggatatcataagtagaaaagaccaacgaggtagcggccaagtcggtacttatggcttaaacacatttacaaatatggaagctcagctcataaggcaaatggaaggcgagggagttttatcaaaagctgacttagaaaacccgcatctacttgaaaagaaggtaacgcaatggttagaaactaaaggagtggagcgacttaaacgaatggcgatatcaggggatgattgcgtagtaaagccgatagacgaccgtttcgccaatgcgttgttagcgctaaatgatatgggaaaggtacggaaggatattccacaatggcaacctagcaaaggatggcacgattggcaacaggttcctttttgcagtcatcattttcatgaactgattatgaaagatggacgtaagctcgtggtgccatgccgaccacaggatgagctcataggcagagctcggatttcacaaggggctggatggtctctgcgagaaacagcatgcttaggaaaagcgtatgcacaaatgtgggcactaatgtactttcatcgccgagatttaagactagcaagcaacgccatatgtagtgctgttcccgtacactgggttccaaccagcagaaccacatggagtattcatgcacaccatcaatggatgactaccgaagatatgttaaccgtttggaaccgagtgtggattgaggacaatccctggatggaagacaaaactccagttacaacatgggaagacgtcccatatttgggaaaacgagaagatcagtggtgtggatcacttatcggtttaacttcaagggcaacatgggcacaaaatatactcactgctatccaacaggtaaggtccttaataggaaacgaagagttcctcgactacatgccctcaatgaaaagattccgcaaagaagaagagagtgaaggagcaatctggtag

SEQ ID NO: 23536 - RNA, 9873 nt, synthetic construct
  misc_feature 1..9873: note = derived and/or modified CDS sequence (opt6) from DENV-3__JQ920477__SS-prME
  source 1..9873: mol_type = other RNA
acttcattatgtcttatgatgatgttacctgctacgcttgcgtttcatctcacatcaagagatggggaacccagaatgatagtcggtaaaaatgaaagaggaaagagcttattgttcaaaactgcgagcggaataaatatgtgcacattaatagcaatggatttaggcgaaatgtgtgatgatacggtaacttataaatgccccctaataacggaagtagaacccgaagatattgattgctggtgtaaccttacttctacatgggtcacttacggcacatgcaaccaagccggtgaacataggagggacaagcgttcagttgcactcgcaccgcacgtaggtatgggcttagacaccagaacacaaacctggatgagcgcagaaggagcctggcgacaagtagagaaagtagaaacttgggcctttaggcatccaggtttcacaatattagctttattcctggctcattatatcggaacttccctcacgcaaaaagtagtgatatttattcttctgatgctggtaacacccagcatgaccatgcgttgtgtaggagtcggtaaccgcgactttgtagaaggtttgtctggagccacatgggtcgatgtcgttttagaacacggaggatgcgtaactactatggctaaaaataaaccaacgcttgatatagaactccagaaaacagaagcaacacaacttgccacattgcgaaaattatgcatagagggtaaaattaccaatgtcacaacagacagtcgctgtccaactcaaggagaggctatactgccagaggagcaggatcaaaactacgtatgtaaacacacctacgttgatcgaggatggggcaatgggtgtggactattcggaaaaggcagtttagtgacttgcgcaaaatttcaatgcctagagtcaatcgaaggaaaagccgtacaacatgaaaacttaaaatacacagttataattacagtacatacgggcgatcaacaccaggtaggaaatgagacacaaggcgtaactgccgaaatcactcctcaagctagtaccgtggaagctattttgcctgagtacggtactttaggattagaatgttcgcctcgaactggtctagacttcaacgaaatgatactattgaccatgaaaaataaggcttggatggttcaccgacaatggttctttgaccttccattgccatggacttctggagcaaccaccgaaactccgacctggaacaagaaagaacttttagtaacttttaaaaatgcgcatgccaagaaacaggaagttgtagtacttgggtcccaagaaggcgcaatgcatacagctctaaccggagctaccgagattcagacgagtggagggacttctatatttgcaggccacctaaaatgcagattaaaaatggataaattagaacttaaaggcatgtcatatgcaatgtgcctcaatgcatttgtactaaagaaagaagtaagtgagacgcagcacggaacaatcttgataaaagtagagtataaaggggaagacgctccatgtaaaattccgttctcaactgaagatggtcaagggaaagcacacaacggccgactaattacagctaatccaatagtgaccaagaaagaagaacctgtaaatattgaggcggagcctccattcggagaatcaaacattgtgatagggataggggataaagcattaaaaataaattggtacaagaaaggtagctccataggaaaaatgtttgaggcaactgcaaggggagctaggagaatggccatacttggagatactgcatgggacttcggttctgttggtggagtactaaatagcttgggaaaaatggtccaccaaatattcggaagtgcatacactgcactattttcaggtgtatcgtggataatgaaaataggaatcggcgttctccttacttggatcgggctcaactccaaaaatacctctatgagtttttcatgtattgtcatagggattataactctatacctaggagctgtagttcaagcggacatgggatgtgtaatcaactggaaaggtaaagaattaaaatgtggctccggtatcttcgtcacaaatgaagtacacacatggaccgaacagtacaaatttcaagcagacagccctaaacgactagccactgctatagcgggagcatgggaaaatggtgtttgtggcattagaagtacgaccagaatggaaaacttactatggaaacaaatagccaacgaactgaattatatactatgggagaataatatcaaattaacaattgtagttggggatgtgataggggttttggaacaagggaaacgtacactaacacctcaaccaatggaactgaagtactcttggaagacgtggggaaaagccaagatagtaactgcagagacacaaaattctagctttattattgacggcccgaacactcccgaatgtccttcagcactgcgagcatggaatgtgtgggaagtagaagactatggatttggggttttcacaactaacatatggttaaaactgcgagaaaaatatacacaactatgcgatcatcgtttaatgagcgcagctgtgaaagatgaaagagctgtacacgctgatatggggtattggattgaatctcaaaagaatggctcgtggaaacttgaaaaggcttctcttatcgaagtaaaaacatgtacttggccgaaatcgcatacattatggtcgaacggtgtattagaaagtgatatgataatacccaaatcccttgctggccccatatcacaacacaactatcgcccggggtatcatacacaaacagcaggaccgtggcatttaggtaaattagagcttgatttcaattattgtgaaggaactaccgtggtcataacagaaaattgtggtacaaggggaccgagccttcgcacgacaacggtctcaggaaagctgatacacgaatggtgctgtagaagctgcactctacccccattaagatatatgggagaagatggatgctggtacggaatggagatcaggcccattaatgaaaaggaagagaacatggtaaagtcgctggttagcgcaggtagcggaaaaaccgataacttcaccatgggagttttatgccttgccatactatttgaggaagtaatgcgaggaaaatttgggaagaagcacatgattgcaggcgcccttttcactttcgtcttactattatcgggtcaaatcacttggcgagatatggcacatacgttaataatgataggtagtaacgctagtgacaggatgggtatgggtgtaacatatttagcattaatagctacatttaaaatccaacctttcttggcccttggtttcttcttaagaaaactaacgtctagagaaaatctactattaggagtgggattggcgatggcgacaactttacaattacctgaagacatcgaacaaatggcaaacggcatagcactagggttaatggctcttaaactaataacacaatttgaaacatatcagttgtggacggcgctggtctcattgatgtgctctaatacgatattcactttgaccgttgcttggcgtacagccacattgatcctagctgtaataagtctcttacctgtatgtcaatctagttctatgcgtaaaacagattggctaccaatgactgtagcagccatgggcgtgccacccttgcccttattcatattttcacttaaagacacattgaaaaggcgatcctggccgttgaatgagggagtaatggcagtaggactggttagcatcctcgcaagcagctttttacggaatgacgtgcctatggcaggacctttagttgctgggggtttactaattgcctgttacgtaataacaggcacgagtgccgacctaactgtagagaaagctgcggacgtaacatgggaagaagaagcagagcagactggagtctctcacaatttaatgataactgtagacgatgatggaacgatgagaattaaagacgacgaaaccgagaatatactaacagttttactcaaaacagctttacttatagtttcgggcattttcccatactcaataccagcaaccttattagtgtggcacacgtggcaaaagcaaacgcagcggtctggagttctttgggacgtacccagtccgcctgagacccaaaaagcagaattagaagaaggggtttaccggataaagcaacaaggaatttttggcaagactcaagtcggagtaggtgttcagaaagaaggagtattccacactatgtggcatgtaacaagaggggcggttctaacccataatggaaagagacttgaacctaattgggcaaatgtgaagaaggatcttatttcttacggaggcggatggaaactaagcgctcaatggcaaaaaggagaagaagtgcaggttatagcagtcgagcccggcaaaaatcccaagaacttccagacaatgccaggaattttccaaacaactacgggtgagataggggccattgcattagactttaaacctggcactagcggttcaccgattataaatcgagaaggaaaagtagtgggtctctacgggaatggagtagtaacaaagaatggaggatatgtatcgggcatagcccaaacgaatgcagagccggacggtcccacgccagagttggaagaagaaatgttcaagaaaaggaacctcactattatggacttgcatccaggtagcggtaaaacccgaaaatatttacccgcaattgtaagagaagctatcaagcggagactccgaacgttaatactcgcaccaacgcgggtagtagccgcagaaatggaggaagcacttaaagggttaccaattcgataccaaacaacagcaacaaaatcagagcacaccggtcgtgagatagttgatttaatgtgtcacgctacattcaccatgcgactcctctcacctgttcgagttcccaactacaatttaatagttatggatgaagcacatttcacagatccggcgtcaatcgcagcccgcggatatatatccacgagggtcgggatgggggaagcagcagctataagtatgaccgcaactccaccgggtacagcagacgcgtttccacagagcaatgctccgatacaagacgaagaacgagacattccagaaagatcctggaactcaggaaacgagtggatcacagactttgcaggaaaaactgtttggttcgtccctagtattaaagcaggtaacgatattgccaattgtttaaggaaaaatggcaaaaaggttatccaactaagccgcaagacatttgatactgagtaccagaagactaaacttaatgattgggactttgtcgtcacgacagatatatcggagatgggtgccaactttaaggccgaccgagtgattgatccccgtaggtgcctaaagccagtaattcttactgatggaccagaaagagtcattctggctggaccgatgcctgtaacagtcgccagtgctgcgcaaagacgaggaagagttggacgaaattcacaaaaggaaaatgaccaatatatcttcacgggtcagcccttaaataacgatgaagatcacgcgcattggactgaagctaaaatgttattggacaatattaacactccagaaggaataatacccgcgttattcgaaccagaaagagaaaagtctgcagccatagacggggaatatcgactaaaaggagagagccggaaaacattcgtagaattaatgcgcagaggcgatctcccagtatggttagcccacaaagtagctagtgaaggaataaaatacacagatagaaaatggtgctttgacggagagaggaataatcaaatacttgaagaaaacatggatgtggagatctggacaaaagaaggagaaaagaagaaactacgacctcggtggctggatgcgagaacgtacagtgatcctcttgccctgaaagaatttaaagacttcgcagccggccgaaagtctattgcactagacctagttaccgaaataggaagagtaccttcgcatctagcacacagaaccagaaatgcacttgacaatttagtgatgctccatacaagcgaacatggagggagagcgtatcgacacgcggttgaggagctacctgagactatggaaacattgctactacttggattaatgattcttttaacaggtggagcaatgctattcttgattagtggaaaaggaattggtaaaacatctattggtttgatctgcgtcgtggctagttccggcatgctctggatggcagacgttccattacaatggatcgccagtgctatagtgcttgaatttttcatgatggttttgctgataccagagccagagaaacaacggactcctcaggataatcagctagcttacgtagtcattggcatattgacactagctgctatcgttgctgcaaatgaaatgggtttattagaaactaccaagagagatttaggaatgtctaaagaacctggcgtggttagtccaacatcctacttagatgtggaccttcatcctgctagcgcatggactctatatgccgtagctacgacggtcataacgccaatgctacgacatacaatagaaaacagtaccgcgaatgtatctttagctgcgatagcaaaccaggcggtagtactaatgggattagataaaggttggcctattagcaaaatggatctaggagtgcccttgttagcattaggatgctatagccaagtaaatcctctcactttaacagctgcagtccttctcttagtaacacattatgcaataattgggcccggtttacaagcaaaagcaacgagagaagcacagaaaagaacagcagccgggatcatgaaaaatcccaccgtagatgggataatgacaatcgatttagacccagtgatctatgatagcaaatttgaaaaacagttaggccaagtcatgttattagtactgtgtgccgtacaactactattaatgagaacgagttgggcattctgtgaggcgctcactttagctaccggaccaataacaactctatgggaaggatcaccaggaaaattctggaatacaactatagctgtatcaatggcaaatattttccgaggctcatacttggcgggggcgggattggccttcagtattatgaaaagtgttggtaccggtaaacgcggtacagggagtcaaggagagaccttaggcgaaaaatggaaaaagaagctaaatcaactgagccgcaaagaatttgatttatacaagaaaagcggaattactgaggtagatcgcaccgaagcaaaagagggactaaagcgtggagaaattacgcatcacgccgtttctcgagggtcagcaaaactacagtggtttgtcgaaagaaatatggtaatcccagaaggtcgcgtaattgatctcggatgtggacgcggcggatggtcctactactgcgctggcttaaagaaagtaacagaagtacgaggctatacgaaaggtggccctggacacgaagaacctgtaccaatgtcgacttatgggtggaatatagtgaagctaatgtcaggaaaggacgtgttctacttaccacccgagaaatgcgatacgctattatgtgatatcggagagtcatcgccgagtcctactgttgaggaatctcgaacaataagggtgctaaaaatggtcgaaccgtggctgaaaaataaccaattctgcataaaagtattgaacccatacatgccaacggtgattgaacatttggaaaggctccagcgcaaacacggcggaatgcttgtgagaaatccgttaagtagaaacagtacacatgagatgtactggattagtaatggaaccggaaacattgtttcctctgttaatatggtatcacgtttgttattaaatagattcacgatgactcacaggagacccaccattgaaaaagatgtagacttaggtgccggaacacgacatgtaaatgcagaacccgaaactccaaatatggatgtgataggtgaaaggatacgacgaataaaggaagaacactctagcacgtggcactatgacgatgagaacccgtataaaacctgggcgtatcacgggtcctacgaagtaaaggcaacaggatcagccagttcaatgattaatggggtggtgaaattacttaccaaaccatgggatgtggtgcctatggttacccaaatggctatgaccgatactacgccttttggtcaacagagggttttcaaggagaaggtagatactcgtactccacgccccatgccaggcactaggaaagtaatggagattacagctgaatggctatggcgcactttaggcagaaataagagaccgagattgtgcaccagagaggagttcatcaagaaagttaggacaaatgcagcaatgggggctgtgttcacggaagaaaatcaatgggatagtgccagagccgcagttgaagacgaagaattttggaagctcgtcgatcgggaaagagagcttcataaattagggaaatgtggttcatgtgtttacaatatgatgggaaaacgagagaagaaactcggagagttcggcaaagcgaaaggatccagggccatttggtacatgtggttaggagctagatacctagagttcgaagcgttaggatttttaaacgaggatcactggttcagtcgagaaaattcacatagtggcgtcgaaggggaagggttacacaagttaggctatattttaagagacataagcaaaataccaggtggtgcaatgtatgcggatgatacagccggttgggatacacgtataacagaagatgacctccataatgaagagaaaattactcaacagatggaccctgaacatagacaactggccaatgcgatatttaaattgacatatcagaacaaggtcgtaaaagttcaacgtccaacgccaaaaggtactgttatggacatcatttcccgtaaagatcaacgtgggtctgggcaagtcggcacatatggacttaatacttttactaacatggaagcacagctaatacgacaaatggaaggcgaaggggttttatcaaaagccgacttagagaatcctcatttgctcgagaagaaagtaacacaatggttagaaaccaaaggagtagagcgtttaaagcgtatggcaatatcgggggatgattgtgtagtaaaaccaatagatgacagatttgcaaatgcactactagctttaaatgatatgggtaaagttaggaaagatattccacaatggcaaccgagtaaagggtggcatgactggcaacaagtaccattttgtagccatcactttcacgagttaataatgaaggatggccgaaagttagtagtgccgtgccgtcctcaggatgagcttataggccgtgctaggatttcacaaggggcaggatggtctcttcgtgaaacagcatgtttgggtaaggcttacgcgcagatgtgggcgcttatgtattttcaccggagggacttacgattagcttcaaatgctatatgtagtgctgttcccgtacattgggtccccacgtctcgaacaacatggagcatacatgcacatcatcaatggatgaccacagaagatatgttaacagtttggaacagagtatggatagaggataacccatggatggaagacaagacgccggttaccacttgggaagacgtaccgtatctcggtaagcgagaggaccaatggtgcggcagcctaataggcctaacgtctcgagcaacgtgggcgcagaacatcttaaccgcgatacaacaagtaaggtcactaattggcaacgaagagtttttagactatatgcctagcatgaagcgcttcagaaaagaagaagaaagtgaaggggcaatatggtaa

SEQ ID NO: 23537 - RNA, 9873 nt, synthetic construct
  misc_feature 1..9873: note = derived and/or modified CDS sequence (opt6) from DENV-3__JQ920478__SS-prME
  source 1..9873: mol_type = other RNA
acttcattatgcctaatgatgatgcttccagcaactctcgcattccacctaacttctagggatggagaacctaggatgatcgtaggcaaaaatgaacgtggtaaaagtcttctgtttaaaactgccagtggaataaatatgtgtacattgattgctatggatctaggtgaaatgtgtgatgatactgtaacatataaatgtccattgatcactgaggtagaaccagaggacatagattgttggtgcaatctcacgtcaacatgggtcacctatggcacttgtaatcaagccggagagcatcgcagagacaaaaggagcgtggctctggcaccacatgtaggtatgggactcgatactagaacacaaacatggatgagtgcagagggcgcttggcgtcaagtagaaaaagttgagacttgggcatttagacatcccggctttacaatcttagcactctttttagcacattacatcgggacatcattaacccagaaagtagtgatttttatactcttgatgttggtaacgccgtctatgaccatgagatgtgtaggcgtgggaaaccgggactttgtagaggggttgagtggcgctacctgggtagatgtagtgctcgaacatggtggttgcgtaaccactatggcgaaaaacaaaccgacactggatatagagttacagaaaactgaagcaacacagttagctactctaagaaaattatgcattgaaggaaaaataacaaatgttactacagacagcagatgcccaacacaaggtgaagctatcctaccagaagaacaagatcagaactacgtttgtaaacacacatacgtcgatagaggatggggtaacggatgtggcttatttggtaaaggaagtttggttacatgcgctaaattccaatgtttggaatctatagaaggcaaagcagttcaacatgagaatcttaaatacactgtaattattactgtacacactggagatcagcatcaagtgggtaatgaaacgcaaggggtcactgctgagataacccctcaggcatcgaccgtagaagcaatactacctgaatacggtaccttggggcttgagtgcagtcctaggactggtcttgattttaatgaaatgatcctactgacgatgaaaaacaaagcgtggatggtacataggcaatggtttttcgacctcccgttaccatggacgtccggtgcgacaactgagactccaacatggaataagaaagagttattagtaacatttaaaaacgctcacgccaagaaacaggaagtggtagtcctcggttcccaagaaggagcaatgcacacggcgctaactggagcaaccgaaattcaaacgagcagaggaacttcaatttttgcgggccatttaaaatgccgactaaaaatggacaaattagaattgaaaggaatgagttacgcaatgtgcctaaatgccttcgtacttaagaaagaagtaagtgaaactcaacatggaacaatattaattaaagtagaatacaaaggagaggacgccccttgcaaaatcccgttttctacagaagacggccagggaaaagcccacaacggaaggctcattacagcaaacccaatcgttacaaagaaagaagaaccggtgaatattgaagctgaaccgccgtttggagaaagtaatattgttattggaattggggacaaggcattaaagattaactggtacaagaaaggaagctcgattggtaaaatgtttgaagctaccgctaggggcgcgagaaggatggccatattgggggatacagcttgggactttggaagtgtaggtggtgtactcaacagcctgggaaaaatggtgcaccagatttttggtagcgcttacaccgctctcttttcgggtgtatcttggatcatgaagattggaataggcgtgttactcacgtggattggccttaatagtaaaaatacatcgatgagcttttcttgcattgttataggaataatcactttatatctcggcgctgtagttcaggccgatatgggctgcgttataaactggaaaggcaaggaattgaagtgcggcagcggaatattcgttacaaatgaggtgcacacttggacggaacaatataagttccaagctgactctccaaaaagactagcaacggctatagctggtgcgtgggaaaatggggtatgtggaataagatcaacaaccaggatggaaaatttgctctggaaacagatagcaaatgaattgaattacatactctgggaaaataatattaagttaacaattgttgtaggggatgtaataggagtactagaacaaggcaagcgaacgctaaccccacaaccaatggaattaaaatactcctggaaaacctgggggaaagcaaaaatagtgactgctgagactcaaaattctagttttatcatagacgggcctaatacgccagagtgcccaagtgcgctacgtgcatggaacgtttgggaagtagaagattatggattcggagtctttacaacgaatatatggctcaaattacgagaaaaatatacacaactatgtgaccacagactaatgtcggcggccgtcaaagatgagagggcggtacacgctgacatgggttattggatagagagtcagaaaaatggatcgtggaaacttgagaaagcatcactaatcgaagttaaaacctgcacatggccaaaaagtcatacattatggagtaacggggtactagaatcagacatgataataccgaaaagtttagccgggccgataagtcaacataattatcgcccgggatatcatacacaaactgccggcccatggcacttgggaaaacttgagttagattttaattactgcgaaggtacaacagttgtgatcaccgaaaactgtgggacacgtggtccttcactaagaacaacgactgttagtggtaaattaatacatgaatggtgttgtagatcatgcacactacctcccctcaggtacatgggagaggatgggtgctggtatggtatggaaatacgacccatcaatgaaaaagaggaaaacatggtaaagagtcttgtcagtgcggggtcaggcaaaacagacaacttcacgatgggagtcttatgccttgctatactatttgaagaagttatgcgcggtaaatttggtaagaaacatatgatagccggtgctttatttacgttcgtgttgttgttatccggacagataacctggagagacatggcacacactctcattatgataggatcgaatgcatcggatcgtatgggaatgggagtgacatacctagccttgatagccacattcaaaatccaaccatttctagcgttagggttctttcttagaaaattaacttcacgtgaaaatttattattaggagttggactcgcgatggcaactacactccaactaccagaggatattgaacaaatggcaaatggcatagctcttggtctaatggccctaaaacttataactcaattcgagacatatcaactctggacagcattgattagtcttatgtgttctaacacgatattcactctcacggtagcatggagaaccgctacactaatattagctgttattagtttacttccagtttgtcaaagtagttcaatgcgtaaaactgattggctaccaatgaccgtcgcagcgatgggagtacctccgttaccactattcatattttccttaaaagatacactaaaacgtagatcgtggcctttaaacgagggggtaatggcagtgggattagtttccattttagcgagttcctttttacgtaatgacgtccctatggcaggccccctagtagcgggaggtttactaattgcttgttacgttataacaggcacaagtgctgacctaacagtagaaaaagccgcagatgtcacatgggaagaagaagctgaacaaacaggtgtctcccacaatctaatgataacagtagacgatgatggtacaatgaggattaaggacgacgagacagaaaacattttaacggttctattaaaaacggctctccttattgtctccggaattttcccatactcaattcctgccactctcttagtctggcacacgtggcaaaaacaaacccaaagaagtggcgtattgtgggatgttccttcgccacctgaaacgcagaaggccgaattagaagaaggtgtatacagaataaaacaacagggaatattcgggaagacacaagttggtgtaggagtccaaaaagaaggcgttttccacacaatgtggcacgtgactagaggagcagtgctaactcacaatggaaaacgacttgagcccaactgggcaaacgtcaagaaagacttaatttcctatggaggtggctggaaattaagcgcccagtggcaaaaaggtgaggaggtacaagtaatcgctgtagaacccggaaagaatcccaaaaattttcaaacaatgccaggaatattccagaccactactggtgagatcggagctatagctttagatttcaaacccgggacaagcggatcacctataattaatagagaaggaaaagtagttgggttatatggcaatggagtggtaactaaaaatggaggatacgtatcagggatcgcccagactaatgcagaaccagatgggccgacaccggagttggaagaagaaatgtttaagaaacggaatttaactataatggatttgcacccaggatcaggaaaaacccgaaaatacttgcctgcaatcgtgcgagaggcaataaaacgtcggttacgaacattaatcctagcccctacaagggtagtggctgccgagatggaagaagcgttaaaaggactaccaatacgttatcagacaacggcaactaaatcagaacatactggacgggaaatagtagatttaatgtgccacgcaacattcaccatgcgattactatctccagtacgcgtccctaattacaatttaattgtaatggacgaagctcattttactgatccagcatctattgctgctagaggttatataagtacccgcgtagggatgggtgaggctgctgcaatcttcatgacggcaactccaccaggaactgctgacgcatttccccaaagtaacgctccgatccaagacgaagaacgtgatataccagaaagaagttggaacagtggaaacgagtggataacagattttgctggcaagaccgtttggtttgtaccaagtataaaagcaggcaacgatattgctaattgtctgaggaaaaacgggaagaaagtcatacaactgtcgagaaaaacttttgacacagaatatcagaaaacgaaattaaatgactgggatttcgtagttaccacagatatatcagaaatgggtgccaacttcaaagctgatagagttatagatccccgtcgatgtttgaaaccggtaatattaaccgatggccctgaacgagtgatattagctgggcccatgcccgtaacagtcgcctcagcagcacagcgcagaggaagagtaggtagaaattcacaaaaagagaatgaccaatacatatttacaggacaaccactcaataatgacgaagaccatgcacactggacagaggcaaagatgcttttggacaatatcaatacgccagagggaattatacccgcgttatttgaacctgaaagagaaaagagtgcagctatagatggtgaatatcgtctaaagggagaatctaggaagaccttcgttgagcttatgagaagaggtgatttaccagtgtggttagcacacaaggtggcgagcgaaggaataaaatacacggatagaaaatggtgttttgacggtgaacgtaataatcagattttagaagaaaatatggacgtcgagatatggacgaaagaaggagagaagaagaaactaaggccacggtggttagatgccagaacctattcagatcccttggctctaaaggaatttaaggatttcgctgcaggtcggaaaagtattgccctagacttagtgactgagataggaagagtaccttcacaccttgctcatcgaacgagaaacgcattagataatctagtgatgttgcatacaagtgaacatggaggaagggcataccgacatgcagtggaagaactaccagagacaatggaaaccttattactattgggactcatgatattactcaccggaggcgcaatgctattccttataagtggtaaaggcatcggtaaaacaagcattggattaatctgcgttgtcgcctcctctggaatgttgtggatggccgatgtacctctccaatggatagcttcagcaatcgtactagagttctttatgatggtgttgttaataccggaaccggaaaaacagagaactccacaagataatcaattggcatacgtagtaattggaatattaacactagcagctattgtcgcagcgaacgaaatgggtctactggaaaccacaaaacgagaccttggaatgtcaaaagaacccggagttgtatcacccacatcctacctagatgttgacctacatccggcctccgcatggacattatatgccgttgcaacgacagtgattacgcctatgcttaggcatacaattgaaaatagtactgcaaatgtttcattagctgcgattgctaatcaagcagttgtattaatgggattagacaaaggatggcccatatccaaaatggaccttggtgttcctcttctggccctcgggtgttactcccaagttaatccactgacactaacggccgcagtattattacttgtgacacactatgcaatcataggccctggcttacaggcaaaagctacaagggaagcccaaaagagaaccgccgctggtatcatgaaaaacccaacagtcgacggcataatgacgatagacttagaccccgttatttatgattcaaaatttgaaaaacaattagggcaagttatgttactggtattatgtgcggttcagttactacttatgcggacaagttgggcattctgcgaggctttaacattggccaccggtcctataacgacattatgggaaggatctccaggaaagttctggaacaccacaattgctgtgtctatggcaaacatcttcagaggttcatatcttgctggagctggattagcattctcaataatgaagtcggtaggaaccggaaaacgtggaacggggtctcaaggggaaactttgggggagaaatggaagaaaaagctcaatcagctgtcaagaaaagaatttgacctatacaagaaatctggcataacagaagtcgaccgaactgaagctaaagagggattaaagagaggagaaattactcatcatgcagtgagtagaggatcggcaaaactccaatggttcgtcgaacgaaacatggtgataccggaaggcagagttattgacctaggatgcggacgaggtggatggagctactactgtgctggactcaagaaagtgactgaagtaagaggttatactaaaggaggtccaggccatgaagaacctgtacctatgtcaacttacggatggaatattgtgaaattaatgtcaggtaaggacgtattttatcttccgcctgaaaagtgtgacacactattatgtgatatcggagaatcgtcgccaagcccaactgtagaagaaagtcgtactattagagtccttaaaatggtggaaccatggttaaagaacaatcagttttgtataaaagtacttaacccctatatgcctaccgtcatagagcacttagaaagacttcaacgaaaacacggcggtatgttagtgagaaatcctttaagtcgcaatagtactcatgaaatgtattggatatccaatggaaccggaaacatagtaagtagcgtcaacatggtgtcacggcttttactgaacagattcaccatgacccatcgtcgacctactatagaaaaagatgtagacttaggagcagggacgagacacgtaaatgccgagccagaaacacctaatatggacgtgatcggagaacggataagaagaattaaggaggagcattcatcaacatggcattatgacgatgaaaatccatacaaaacctgggcttatcatggatcttatgaagtcaaagccacgggatcagctagtagcatgataaatggagttgtcaaacttctgacaaaaccgtgggacttagttccaatggtgacccaaatggcaatgacagatacaacaccatttgggcaacaaagagttttcaaagaaaaagtagatacccggacacctcgaccaatgcctggtactcgaaaagttatggaaataacagcagaatggttgtggagaacattgggacgtaataaaagacctagactttgcacgcgcgaagaatttatcaagaaagttagaacaaatgcggcaatgggggccgtattcacagaagaaaaccaatgggattctgcaagagcagccgtggaggacgaagagttctggaagctggtagaccgagagagagaactacacaaactcgggaaatgcggctcatgtgtttataacatgatgggaaaaagagagaagaaattaggagaatttggaaaagcaaaaggttctagggcaatttggtacatgtggctgggggcaagatatctcgagtttgaagcactaggattcttgaatgaagaccattggttttcaagggaaaattcacattcgggagtagaaggtgaaggtttgcacaagctaggttatatactcagagatatatccaagattcccggcggagcaatgtacgccgatgatacagctggctgggatacaagaataactgaagacgatctacataatgaggagaaaataactcagcaaatggaccctgaacataggcaactcgcaaatgcgatcttcaaacttacgtaccagaacaaggttgtgaaagtacaaagaccaacgcctaaaggtacagtgatggatatcatatctagaaaagaccaaagaggatccggtcaagtgggaacatatggtctgaatactttcactaatatggaagcccaacttatccgacagatggaaggggaaggcgttttaagcaaagctgatctagaaaatccacatttgctagaaaagaaagttactcagtggttggaaaccaagggggtggaaagattaaaacgaatggctattagtggagatgattgcgtggtcaaaccgattgatgaccgctttgcaaacgctttattggctctaaatgatatgggaaaggtacgcaaggacatacctcaatggcagccgtctaagggatggcacgattggcagcaagtcccgttctgttcgcaccacttccacgagttaataatgaaggacggcagaaaactcgtggttccttgtaggccacaagatgaacttataggcagagcaagaattagtcagggagccgggtggagtctacgggagacagcgtgtcttggtaaagcatacgcgcaaatgtgggcactaatgtatttccacagaagagacctgagactagcgagcaatgctatttgtagcgcagtccccgttcattgggtaccgacatcgagaactacctggtccattcatgctcatcaccaatggatgacgacagaggatatgttgacagtatggaacagagtctggattgaggacaacccttggatggaggacaaaactccagtcactacctgggaagatgtaccatatttaggcaaaagagaagaccaatggtgcggtagcttaattggtttgacaagtagagctacgtgggctcaaaatatacttactgctattcaacaagttaggtctcttataggaaatgaggagtttcttgactatatgccaagcatgaaacgtttcagaaaggaggaagaatcagaaggggcaatatggtaa

SEQ ID NO: 23538 - RNA, 9873 nt, synthetic construct
  misc_feature 1..9873: note = derived and/or modified CDS sequence (opt6) from DENV-3__JQ920480__SS-prME
  source 1..9873: mol_type = other RNA
acgtcactatgcctcatgatgatgttacctgcaactcttgcatttcacctaacatctagagatggggaaccacgaatgattgtaggcaaaaatgaacgagggaaaagtctacttttcaaaactgccagtggaataaatatgtgtaccctaatagcgatggatttaggggaaatgtgtgacgacaccgtgacatacaaatgcccgttaattacagaagtcgaacctgaagatatagattgctggtgcaatctaacttcgacttgggtgacatatggtacctgtaaccaagcaggggaacatcgacgagacaaacgaagtgtggcacttgcacctcatgttggtatgggccttgatactagaacgcaaacatggatgtctgccgaaggagcctggcgtcaagttgaaaaagttgaaacatgggcctttagacacccggggtttacgatcctcgcattatttcttgcacactatattggcacatcgttaacgcaaaaagttgtcatatttatcctacttatgttggtaaccccttcaatgacaatgcgatgtgtcggcgtaggaaaccgcgatttcgttgagggtctaagtggcgccacatgggtcgatgttgtcctggagcatggtgggtgcgtaaccacaatggccaaaaacaaacctactctcgatatagaactccagaaaacagaagcaacacaattagcaaccctacgcaaactatgtatagaagggaaaataacgaatgtgacaaccgattctagatgcccaacgcaaggggaagcaattcttccagaagaacaagatcaaaattatgtttgtaaacatacatatgtcgatagggggtggggaaatggctgcggactctttgggaaaggatctttagtgacatgtgcaaaatttcaatgtctcgaaagtatagaaggaaaagcggtgcaacatgaaaatctaaaatatacagttataataaccgtacacaccggcgaccaacaccaagtcggtaacgaaacgcaaggtgtgaccgcagagataacgcctcaagcgtcaactgtagaggcaatcttaccagactatggaacattaggacttgaatgctctccaagaactggattggatttcaatgaaatgatcttattaacaatgaaaaataaggcttggatggttcatcgacaatggtttctagatctaccattaccttggaccagcggggctactactgaaactcccacatggaataagaaagagctattagtgacattcaaaaatgctcatgctaagaaacaggaggtagttgtactaggtagccaagaaggagcgatgcacaccgctctcacaggagcaacagaaatacaaacttccggaggaacaagcatatttgccggtcacctcaaatgcagactaaaaatggataagctcgaattaaaaggtatgtcttatgcaatgtgtctaaatgcgttcgttttaaagaaagaagtttctgagacgcagcatggaacaatattgatcaaagtggaatacaaaggagaggacgcaccatgtaaaattccattctccacagaagacggacaaggtaaggcgcataacgggaggcttataacagcaaatcccatagttaccaagaaagaagaaccggtaaacatcgaagccgaacctccattcggggaaagtaatattgtgataggaataggagacaaggcacttaaaattaattggtataagaaaggatcaagtatcggcaaaatgttcgaagcaactgctagaggcgcacggaggatggccattttaggtgatacagcttgggattttggctcagtaggaggagtcttgaactcgctggggaaaatggtacatcagatttttggatcagcgtataccgcgttatttagcggcgtatcatggataatgaaaattggaataggggtactattaacatggataggactcaattcgaaaaatacttcaatgtctttctcttgcatcgtaattggtattataacactgtacctaggggccgtcgttcaagctgatatgggttgtgtgataaattggaagggcaaagaactaaaatgtggttcaggcatttttgtgactaatgaagttcacacatggactgaacagtacaaattccaggctgattctccgaagagactagcaacagcgattgccggagcatgggaaaatggtgtgtgtggaatccgtagcaccacacgaatggaaaatctgctatggaaacagatagctaacgaattgaattatatactatgggaaaataacatcaaattaacaatagtagtaggggatgtcataggagtattagagcaaggcaagagaacattaacaccccaaccaatggaactcaaatattcttggaaaacttgggggaaggcgaaaatagtcacggcagagacgcaaaatagtagtttcataatcgacggaccaaatacacctgaatgtccgtcagcgttacgagcctggaacgtttgggaggtagaggactacggatttggagtatttacgacgaacatatggctaaaactcagggaaaagtacacacaattatgtgatcaccgccttatgagtgctgcagtgaaggacgaacgggccgtgcacgcagatatgggttactggatagaaagccagaaaaacgaatcttggaaactagagaaagcctcattaatagaagtcaaaacatgtacctggcctaagtcgcatacactttggtcaaatggcgtattggagtcagacatgattatacccaagagtttggctggcccaattagccaacataactaccgcccaggctaccatacacagacggccggtccatggcacctagggaaactcgaactggatttcaactattgtgagggcacaacagtagttatcacggaaaactgtggaacaaggggacccagcttacgtaccacgacagtttcaggtaaattgatacacgaatggtgttgtagatcatgtacgttacccccattaaggtatatgggagaagatggttgttggtatggaatggagatcagacccatcaacgaaaaagaagagaatatggtcaaatctcttgtgtcagcaggttcggggaaaacggacaacttcactatgggggtactatgcttggcaatactctttgaggaagtgatgcgtggaaagttcggtaagaaacatatgatcgcaggagctctatttatgttcgtcctattgctatctggtcaaataacatggcgcgacatggtacacaccttaattatgattgggagtaacgctagcgaccgtatgggcatgggggtaacatatctggctctgatagcaacgttcaaaatacaacctttccttgcactcgggttctttcttagaaaacttacgtcccgagagaatttgctccttggagtgggtctagccatggcaacaacactacaactgccggaagacattgaacaaatggctaacggaatagcattaggattaatggcgttaaagttaattacacagtttgagacgtatcaattatggacggcactgataagtttaatgtgtagtaacaccatattcactctgacagtggcttggcggaccgccacattaatacttgcagtaataagtctcttgcccgtatgtcaaagtagttcaatgaggaaaacggactggctaccaatgaccgttgcggcgatgggggtacctcctcttcccctgtttatattttcgctaaaggatacattaaaaagaagatcatggcctcttaatgagggtgttatggcagtaggattggtgtcaatactagccagctcctttctccgaaatgatgtgccgatggcaggtccactcgtagctggagggttattaatagcttgctacgttattacaggcacaagcgcagacttaaccgttgaaaaagcagctgatgttacctgggaagaggaggccgaacaaaccggggtaagccataatctaatgattacagttgacgacgatggtactatgcgcataaaagatgatgaaacagaaaacatcttgacagttttactcaagacagcattactgatcgtctcaggaatttttccttatagcataccagcaactttattggtctggcatacgtggcaaaaacaaacacaaagaagcggggtgctatgggacgtgccgagtccacccgagacccagaaggcagagttggaagagggtgtgtatcgcatcaaacaacagggaatatttggtaagacgcaagtgggggtgggagtacaaaaagaaggcgttttccacacgatgtggcatgtgacccggggagcagtactgacacacaacggcaaacgtttggaaccaaattgggcaaatgttaaaaaggatctgatctcctatggaggaggctggaaactttctgcgcagtggcaaaaaggagaagaagtacaggtgatcgctgtagaacctggtaagaaccctaagaatttccaaactatgccagggatattccaaacgacaacgggcgaaataggagcaatcgcattagactttaaacctgggacaagcggttcaccaataataaaccgggaaggcaaagtggtaggactatacgggaatggtgtggtaactaaaaacgggggttacgttagcggtatcgcccagacaaatgccgagccggatggacctacgcctgagctagaggaagagatgtttaagaaacgtaatttgaccataatggacttacatccgggttcaggaaagacccgaaaatatctaccggcaatagttagggaagcgataaaaagaagacttagaactctgattctagcacccacacgagttgtagcagcagaaatggaggaggcgttaaaaggcctccctatcaggtatcaaacaaccgctacaaaaagcgaacacacgggaagagaaatagtagaccttatgtgccacgctacatttacaatgcgattactttcaccggttcgcgtacctaactataatttaatagtcatggatgaagcgcactttacagatccagcgtcaatagcagcaagaggatacataagtaccagagttggtatgggagaggcagcagccatttttatgactgcaactccgccaggaacggccgatgcttttcctcaatcgaatgcgcctatacaagatgaggaaagggacattccagagaggtcatggaactcgggtaatgagtggataactgatttcgcgggaaaaacggtttggttcgtcccatccattaaagcagggaatgacatagcgaattgtcttcgcaaaaatggcaagaaagtaatccagctaagtcgtaaaactttcgatactgaatatcagaaaacgaaactaaacgattgggatttcgtagttacgacggatataagtgaaatgggtgcaaatttcaaagcagatagggttattgatcccagaagatgcctaaaacctgtaatcctaaccgacggaccagaacgtgtcatattagcaggtcctatgccggtcacggttgctagcgctgcccaaagaagaggtcgagtaggaaggaactcacaaaaagagaatgatcaatacatatttactggacagcctctcaataatgatgaagaccacgcacattggacagaagcaaagatgctcttagacaatattaacacaccagaaggcataataccagccctattcgagcctgaacgtgaaaaatctgcggcaatagacggtgagtaccgactaaaaggagagtcaagaaaaacatttgtagaattaatgagacgaggagatctgccagtctggctagctcataaggtagccagtgaaggcataaaatacacagatagaaaatggtgctttgatggagaaagaaataaccagatacttgaagaaaatatggatgttgaaatatggacaaaagaaggcgagaagaagaaactacgacccagatggctagatgcccgtacttatagcgacccactagctctaaaggaatttaaagactttgcagcaggaagaaaaagcatagcgcttgatctagtcaccgagatcggacgtgtacctagtcacctcgcgcatcgcacaagaaatgccttggataacttagtgatgcttcacacgtccgagcatggtggtcgagcatataggcatgcagtagaggagctaccagaaacaatggaaacattacttctgctaggcttgatgatactactcacaggaggggccatgctatttctaattagtgggaagggtatcggaaagacaagcattggtcttatatgtgtagtagcttcgtcaggtatgctgtggatggcagatgtaccgttacagtggattgcatctgcaattgttctggaatttttcatgatggttctcttaattccagaaccagaaaaacaacgaaccccacaggacaatcagctagcttacgtggtaatcggcattcttacccttgcagcaatagttgcagcgaatgaaatgggcttacttgaaacaacgaaacgagaccttggcatgagtaaagagcccggcgtggtctcccccacgagctacctcgacgttgatttgcaccccgcatcagcctggactttatacgcagtagcaaccacagtaataaccccaatgcttcgtcacacaattgaaaatagcacagctaacgtatcattagctgcgatcgccaatcaagctgtggtcctcatgggtctagacaaagggtggcccatcagtaaaatggatctcggagtacctcttcttgctctcggatgctatagtcaggtcaatccattaacactgaccgccgccgtactcttattagttacccattatgctattattggtccaggattacaggcgaaagcaacccgagaggctcagaaaagaaccgctgccgggattatgaaaaatcccacagtagacggcattatgacaatcgatctagatcctgtaatatatgacagtaaatttgagaaacagttaggacaagtcatgctattagtcctgtgcgccgtgcaactacttttaatgagaacatcgtgggctttctgcgaagctctaacactagcaacaggaccaataactacactatgggagggctctcccgggaaattttggaacaccacaattgcggtaagtatggccaacatattcaggggtagttacttagcaggcgcaggccttgcattttcgataatgaaatccgtaggcacgggaaaaagaggaaccggaagccaaggagaaacgttgggagaaaaatggaagaagaaattaaaccaactatcaagaaaagaatttgacttatataagaaatcaggtataacggaagttgacagaacagaagcaaaggagggattaaaaagaggagagataacacatcatgccgtaagccgtggtagcgccaagctccaatggtttgttgaaagaaacatggtcattccagaaggcagagtaatagacctcggatgtggtcgtggaggatggagttattactgcgccggactaaagaaagtaacagaagtacgagggtacaccaagggtggtccgggacatgaagaaccggtacctatgagtacatacggatggaatattgtcaaacttatgtccggtaaagatgtattttacctaccccctgaaaaatgtgatacacttttatgtgacataggagagtcgtctcctagtccaaccgttgaagaatctcgaaccatccgagtattaaaaatggttgaaccttggcttaaaaacaatcaattctgtataaaggtactaaatccatatatgccgacagttatagaacatttagagcgactacaacgtaaacatggtgggatgctggtacgtaatccactatcacgtaactctactcacgaaatgtattggatatcaaacggaacaggcaatatagtatcatcagtcaatatggtaagccgcttattattgaataggtttacaatgacccatcgacgacctactattgagaaagatgtagacctaggagcaggtacaaggcatgtaaacgcagaaccagaaactcccaacatggatgtaatcggagaaagaatccgaaggattaaagaagaacatagcagcacatggcactatgatgacgaaaacccttacaagacctgggcttaccacggttcttacgaagtaaaagctactgggtcagctagctcaatgataaatggggttgtaaaacttctgacaaaaccctgggatgttgttccgatggttacccaaatggcgatgacagatacaactccattcggacaacaaagggtatttaaagagaaagtcgacacaaggactccaagacccatgccaggaacaagaaaagtaatggaaataaccgctgaatggctctggagaaccttaggaagaaataaaagacccagattatgtacgcgtgaggagtttattaaaaaggtacgaacaaatgctgctatgggagccgtattcacggaagagaatcaatgggatagcgcaagagctgccgttgaagacgaagaattttggaagttagtggatagagagcgggaacttcacaaacttggtaagtgcgggtcatgtgtctataacatgatgggaaaaagagagaagaaattaggtgagttcggtaaagctaaaggatcacgtgccatatggtatatgtggttaggagcaagatacctagaatttgaagctctaggctttttaaatgaggaccattggttttcccgagagaacagtcactccggggtcgaaggcgaaggtctgcacaaattagggtatatcctgcgagatatttcgaaaataccagggggagctatgtatgcagatgatacagcgggatgggacacccgtatcaccgaagatgacctgcacaatgaagagaaaatcactcagcagatggatccagaacaccgccagctcgccaatgccatattcaaacttacgtatcagaacaaagtagttaaagtacaaagaccgacaccaaagggcaccgtcatggatataatatcacggaaagaccaaaggggatcaggacaggttggtacatatggactcaatactttcacgaatatggaagcacaattgatccggcaaatggaaggcgaaggagttctctccaaagcagatctggaaaatccgcatttgttagagaagaaagtaacacaatggctggaaacaaaaggtgtggaaaggctcaaaagaatggcgatatcaggagatgattgcgtggtaaaacccattgacgacaggtttgctaatgcacttctagcacttaacgacatgggcaaagtcagaaaagatataccccaatggcaaccaagtaaaggatggcatgactggcaacaagtaccattctgcagtcatcactttcacgaattaataatgaaagacggtcgaaaattagttgtcccctgtagaccccaagatgaactaataggacgagcacgaatatcacaaggagcgggatggtcacttagagaaacagcatgcctaggcaaggcttacgcacaaatgtgggcactaatgtatttccacaggcgagatttaagattagcatccaacgcaatttgttccgctgtaccagttcactgggtacccactagccgcactacttggtctatacatgcgcatcaccaatggatgacaactgaggacatgttgacagtttggaatagagtatggatagaggataatccatggatggaagacaaaacgccggtgacaacgtgggaagacgtaccatatctaggcaaaagagaagatcaatggtgtggatctttgataggcctgacgtcaagggctacttgggcccagaacattctgacagcaattcaacaagtaaggtcattgatagggaatgaagaatttctagattacatgcctagcatgaaacggtttagaaaagaggaagagtcagaaggggccatctggtaa

SEQ ID NO: 23539 - RNA, 9873 nt, synthetic construct
  misc_feature 1..9873: note = derived and/or modified CDS sequence (opt6) from DENV-3__JQ920479__SS-prME
  source 1..9873: mol_type = other RNA
acttcattatgtttaatgatgatgttaccagcaactttggcatttcacttaacaagtcgcgacggagaacctcgtatgattgttggtaaaaatgaaagaggaaaaagtttactatttaaaactgcatccgggattaatatgtgcacgttaatcgcaatggacctaggtgaaatgtgtgatgatacggttacatataaatgtccacttattactgaagttgaaccagaagatatagactgttggtgcaatctaacaagcacatgggttacatacggaacctgtaaccaagctggagaacatcgtcgagataaaagaagtgtcgctctagcaccacatgtaggtatgggattagacacgagaacacaaacctggatgtctgcagaaggagcgtggaggcaagtggaaaaggtggaaacatgggcattcagacatcctggattcaccatcctagctctatttttggcccattatatcggaacgtcgttaacacaaaaagtggtcatattcattttattaatgctcgtcacacctagcatgacaatgaggtgtgtcggggtcggaaatagagactttgttgaagggttgagtggagccacatgggttgacgtcgttcttgaacatggagggtgcgttacgacaatggcaaagaataaaccaacgctagacatcgaactccagaaaacggaagcgacccaactcgcaactctaagaaaactttgtatagaagggaagatcaccaacgtaacaacagattcacgctgtcccacacaaggagaagctattctgccggaagaacaagatcaaaactatgtgtgtaaacacacttatgttgatagagggtggggaaacgggtgcggattatttggtaagggatctctagttacatgtgcaaaatttcagtgtctagaatctattgaaggcaaagcagtccaacacgaaaacctaaaatatactgtaataattacagtacatacaggagatcaacatcaagtcgggaacgaaacacagggggttacagcagaaataaccccacaagcgagcaccgtagaagcgatactccctgaatatgggaccctcggacttgaatgttcgccaagaactggattggatttcaatgagatgatacttttgactatgaagaacaaggcttggatggtacacagacaatggtttctagatttgccattgccgtggacgtctggtgcaacaacggaaacaccgacatggaataagaaggaattacttgtaacattcaaaaacgcacatgcgaagaaacaggaagttgtagtgttaggttctcaggaaggcgctatgcatactgccttaactggagcaaccgaaatacaaacaagtggcggcacgtccatcttcgcggggcatttgaaatgtaggttaaaaatggacaaactagagctaaaaggaatgtcctatgccatgtgcctaaacgctttcgttttaaagaaagaagtgagtgaaactcagcacggcaccatcttaataaaagttgagtacaaaggagaggacgcaccctgtaaaatccctttttccacagaagacggacaagggaaagcacataatggtagattaattacagctaatccaattgtcacaaagaaagaagaacctgttaatattgaagcagaaccaccatttggagaatctaacatagtaataggaatcggtgacaaggctctgaaaataaattggtataaaaagggtagttctattggaaaaatgttcgaagccacagcccgtggggcaagaaggatggcaattctgggtgacacagcttgggatttcggatcagtgggtggcgtgttaaatagtcttggaaagatggtccaccaaatctttggcagtgcatatacagctttgttctcaggcgtatcttggataatgaaaattggcataggtgtattacttacatggataggcctgaacagcaaaaacaccagcatgagtttctcttgcatcgtaatcggtataataacactctacttaggagctgtcgtgcaagcagacatggggtgtgtgatcaactggaaaggaaaagaattaaaatgtggtagcggaatttttgtcactaatgaggtgcatacttggaccgaacaatataaatttcaagctgattcaccaaaaagattagcaaccgccatcgcaggagcctgggaaaatggggtgtgtggtattcgcagcacaactagaatggaaaatctcttatggaaacagatcgcaaatgaacttaactacatattgtgggaaaataatataaaattaacgattgtagttggggatgtaataggagttttggaacagggaaaacggacacttacccctcaaccgatggaactcaagtatagttggaagacttggggcaaagccaagatcgtaactgctgaaacccaaaatagttcatttattattgatggaccgaataccccagaatgccccagcgccctacgagcttggaatgtatgggaagtagaggactacggctttggagtcttcacgacaaatatatggctaaaactgagagagaagtatacacaattatgtgatcatagactgatgtctgcggcagtaaaggacgaacgggctgtacatgctgacatgggttattggatagaatcacaaaagaacgaatcctggaaacttgaaaaagcaagtctaattgaagtcaaaacatgcacgtggccaaaaagccatacattatggtcaaacggagtattggagagtgacatgatcatccctaaaagtttagctggtccgataagtcagcacaactatagaccgggctaccatactcagactgctgggccctggcatttaggcaaattagaactcgacttcaattattgcgaaggcacgacagttgttattactgaaaattgtggcatccgaggaccatcgctcaggacgaccaccgttagcggcaagttaatacacgagtggtgttgtagatcgtgcacccttccaccactcagatatatgggcgaggacggctgttggtacggaatggaaataaggccaattaatgaaaaggaagaaaacatggtaaaaagcctcgtgtcagctggcagcggaaaaacagataacttcaccatgggagtactatgtcttgcaattctcttcgaagaggttatgcgaggcaaatttggtaagaaacatatgattgccggtgctttattcatgtttgtattgctattatcaggacagataacctggcgtgatatggtacatacattaatcatgataggttcgaacgctagcgatcgtatgggcatgggggttacctatttagccctaatagcaacctttaaaatacagcccttcttagccttaggattctttctacgaaagttgacttccagggagaacttattgttaggagttggcctagctatggcgacaactttacaattacctgaagacatagaacaaatggctaacgggatagctttgggactaatggcactcaaattgattactcaattcgaaacgtatcaactatggacagccctaatatcactaatgtgcagtaacacaatctttactctcacagtagcttggagaacagccaccctaattctagcagtaatctcattactgcctgtatgccaatctagcagtatgaggaaaaccgactggttgccaatgactgtagcggcaatgggagtaccacctttaccattgttcatattctctctgaaggataccctaaaacgcagatcttggccattaaacgagggggtaatggcggtgggattggtgtctatccttgcaagctcatttctgagaaacgacgtaccgatggctggaccactcgtcgcaggaggtcttttgatagcatgttatgttattactggtacaagtgcagatcttactgtagaaaaagctgcggatgtgacttgggaagaagaagccgagcagacaggtgtttcgcataacctcatgataaccgtagatgatgacggaacaatgagaataaaggatgatgaaacagaaaatatactgacagttctattaaaaactgccttactgatagttagtggaatcttcccttatagtatcccggctactttactcgtttggcatacttggcagaagcaaactcagcgtagcggggttttatgggacgtcccgtcaccaccagagacccaaaaagcagagcttgaggaaggcgtatatagaataaaacaacaaggtatttttggaaaaacccaagtgggcgttggtgttcaaaaagaaggtgtgtttcacacaatgtggcatgtaacgagaggggcggtgctaactcataatggcaagaggttggaaccaaattgggcgaacgtaaagaaagatcttattagctatggaggaggctggaaacttagcgcccagtggcaaaaaggagaagaagtgcaagttattgctgtggaacccgggaagaacccgaaaaacttccaaacaatgccgggaatatttcagacgactacgggagaaattggagccatagccctagatttcaaaccaggtacgtctggttcgcccattattaatagagaaggtaaagtagttggtttgtacggaaatggggtagtgactaaaaacggaggttatgtatccggaatagcgcagactaacgccgaacctgatggacctacccctgagcttgaagaagaaatgtttaagaaacgcaacttaactataatggatttacaccctgggtcgggaaaaacaaggaaatatttacctgcaattgtgcgagaagcgattaaaagaagattacgcactttgatattggcacccacaagggttgttgcagccgagatggaagaagcattaaaaggactccctatcagatatcaaacaacagctactaaaagcgaacacactgggcgagaaatcgtcgacttaatgtgtcatgcgacatttaccatgcggttactgtcccctgttagagtacccaattataacctcatagtaatggatgaagcacattttacagatccagcctcaatcgctgcaaggggttatataagtacaagggtaggaatgggagaagcagccgctatatttatgacagcaactcctcctggtacagcagacgcctttccacaatctaatgccccaatccaagatgaagagagggacattccagaaaggtcttggaactctggaaacgaatggatcaccgattttgccggaaaaacagtatggttcgttcccagtattaaggccggaaacgatattgcgaattgtctcaggaaaaatggtaagaaagtaatccaactttcaaggaaaacgtttgatactgaatatcagaaaactaaacttaacgattgggattttgttgtcactaccgatattagtgaaatgggcgctaattttaaagcagatcgggtaatcgatcctagacgatgtttaaaacctgtaattctcaccgatggtcccgagagggtaattctcgctgggccgatgccagttacagtggcgagtgcagcccaacgtaggggtagagttggaagaaattctcaaaaagagaatgatcaatacatatttacaggccaaccccttaacaatgacgaggatcatgcacattggaccgaagcaaaaatgttgttagataatattaatacacccgaaggaataatcccagcattattcgagccagaacgagagaaaagtgcagcgattgatggcgaataccgactaaaaggagaatcaaggaagacattcgtcgaactcatgcgccgaggagatctcccagtttggttagcacacaaagtagcgtcggaaggtataaaatacacagatcgtaagtggtgttttgatggtgagagaaataatcaaattttagaagagaatatggatgtagagatatggacgaaagaaggtgagaaaaagaaactgcgaccaaggtggctagatgcacgaacatactctgaccccctagctttaaaagaatttaaagactttgcagcgggtcgaaaaagcattgcactagatttagtcactgaaattggacgagtacctagtcatttagcccatagaacaaggaacgctttagacaacctcgtgatgttacacacaagtgaacacggtgggcgagcatatagacatgcagtggaagaactaccggaaactatggagaccttacttttactaggtttaatgatacttttgacaggaggagcaatgttatttcttatatccgggaaaggaatcggaaagacatcaatcgggctcatatgtgtggtcgctagcagtggaatgttatggatggcagatgtgccgctgcagtggatagcaagtgccatcgtattagagttctttatgatggtactactaataccggaaccagagaaacagcgcacccctcaagataatcaactagcttatgtagtaatcggcatattaactttggcagcaattgttgctgcaaacgagatgggcttattggaaacaactaaacgagaccttggtatgtccaaggaaccaggcgtggttagcccaacgagttacttggatgtagacttacatccagcatctgcgtggactctttacgcagttgcaaccactgtaatcacccccatgttaagacatacgattgaaaacagcactgctaacgtatcactcgctgcgattgctaaccaagcggtcgtactgatgggcttagataaggggtggccaatatctaaaatggatttaggagttccactacttgcgctcggttgttattcacaggtcaatccattaacccttacggcagcagtgctattattagtgacacattacgcaataatcggtccaggactacaggcaaaggctactcgtgaagctcaaaaacgcacagctgctggaataatgaaaaatcctacggtcgacggaataatgacgattgatcttgaccctgttatttatgattcaaagtttgagaaacaattaggccaagttatgttattagtattgtgcgcagtacaattactactaatgcggaccagttgggcattttgtgaagcactcacactcgctacaggacctataacaacactgtgggaaggaagtccgggtaaattttggaatactacaatagccgtatcgatggccaatatttttcgaggttcatatcttgccggagcaggactagctttttccataatgaaatctgtcggtaccggaaaaagaggaactggttcccaaggcgaaacattaggagaaaaatggaagaagaaattaaatcaactatctagaaaggaatttgacttatataaaaagtcgggtataacggaagtagacaggacagaagctaaggaaggattaaaaagaggagaaataacacatcatgcggtatcaagaggatccgccaaactacaatggtttgtcgagcgtaacatggtaattccagaggggagagtgattgatttagggtgcggtcggggcggctggtcatattatagcgcaggactcaagaaagttactgaagttagaggatataccaaaggtggaccgggccatgaagaaccagttccaatgtcaacatatggatggaacatagtgaaacttatgtctggaaaagatgtattttatcttccgccggaaaaatgtgacacacttttgtgtgacattggagaatcatcaccctcacctacagttgaagaaagtagaacaatacgggttttaaaaatggtggaaccatggttgaaaaataatcaattttgtattaaggtactaaatccctacatgcccacagtgatagaacacctagaacggctgcagcgaaaacatggagggatgctagtcaggaatcccctttccagaaacagtacacatgaaatgtactggatttcgaacggtaccggtaatattgtatcatcagtaaatatggtgtcaagactactattaaataggtttactatgacacatcgccgccccacaatagaaaaggacgtagatctgggagcagggacaaggcatgtcaatgctgaaccagagacaccaaatatggacgtaatcggtgagagaataagacgtataaaggaagaacactctagtacttggcattacgatgatgaaaatccatacaagacttgggcctatcacgggtcgtatgaagttaaagcgacgggcagcgcaagcagcatgataaacggggttgtgaaactgcttactaaaccatgggatgtagtacccatggttactcaaatggccatgacagacactacaccatttggccaacaaagagtgtttaaggaaaaagtagacactagaacaccacgaccaatgccaggtacaagaaaggttatggaaataaccgctgaatggttatggcggacactaggccgcaataaaagaccaagactttgcacacgagaagaatttatcaagaaagtcagaacaaacgcagcaatgggtgcagtattcacagaagaaaaccagtgggatagtgctagagcagcggttgaggatgaagagttctggaaattagtagaccgtgaaagagagcttcacaagttaggtaaatgtgggagttgtgtctataatatgatgggtaaaagggagaagaaattaggggagttcggaaaagcaaagggttcgagagccatttggtatatgtggttgggtgcgcgatacttagagttcgaggccttagggttcttgaatgaggaccactggtttagccgtgaaaattctcattcaggagttgaaggagaaggtttgcacaaacttgggtatatattacgtgatatttctaaaataccgggaggggcaatgtatgcggacgatacagctgggtgggatacacgaatcaccgaagacgatctacacaacgaagagaaaataacccaacaaatggacccagaacacagacaattagcaaatgcaattttcaagctgacgtatcaaaataaagtcgtaaaggtccagaggcctactcctaaaggcactgtaatggatattatctctagaaaggatcaaagaggttcaggtcaagtaggtacatacggactaaacacatttaccaatatggaagcgcaattaataaggcaaatggaaggggaaggagtactttccaaggctgacctagaaaatccgcatctgctggagaagaaagtcacacagtggttagaaactaaaggagtagaacgattaaaacgaatggcaatttcgggagacgattgtgtagtaaaaccgatagatgatcgtttcgcgaatgcacttttagcacttaatgatatgggaaaggtgcgaaaagatatacctcagtggcagccgagcaagggttggcacgactggcagcaggtccctttctgctctcatcattttcatgaattaattatgaaagatggaagaaaactcgtcgttccttgtcgaccacaagatgagttaatcggacgggcgaggatttcccaaggcgccggttggtcgctgcgcgaaaccgcatgcttgggaaaagcctatgcacaaatgtgggcgttgatgtactttcacagaagagacttaagactggcatcaaatgcgatttgcagtgctgttccagtacattgggtaccaacgtcacgtacaacatggtcgattcatgcccatcatcaatggatgactaccgaagacatgttgacggtgtggaaccgtgtttggatagaagataacccgtggatggaggacaaaactcctgtaacgacttgggaggacgtaccttatcttggaaagagggaagatcaatggtgtggttctttgataggattaacttcaagagccacatgggcgcaaaatatattaacggcaattcaacaggtacgatcactcataggaaatgaagagttcctagactacatgccaagtatgaaacgctttagaaaagaagaggagtcagaaggagcaatttggtga

SEQ ID NO: 23540 - RNA, 9873 nt, synthetic construct
  misc_feature 1..9873: note = derived and/or modified CDS sequence (opt6) from DENV-3__KU216208__SS-prME
  source 1..9873: mol_type = other RNA
acttcactatgcttgatgatgattctacctgcagcccttgcattccacctaacatcgagggatggggaaccaaggatgatcgttggcaaaaacgaacgaggtaaatctctactatttaaaaccgcttctggtataaatatgtgcacattaatagctatggacttgggtgaaatgtgtgatgatacagttacatataaatgtccccacataactgaagtcgaaccagaagatatagattgctggtgcaacttaacgtcaacctgggtaacgtatggcacgtgcaaccaagctggagaacacagacgagacaaaaggtcagttgcacttgcaccacatgttggaatggggttagatacacgtacccaaacatggatgtctgctgaaggtgcttggaggcaagtggaaaaagtggaaacctgggccctacgtcacccaggatttaccatacttgccttatttctagcacattatataggaacgtcactaacacagaaagtagttatatttatcctgttaatgctggtcacaccctccatgacgatgagatgtgtaggtgtcggaaaccgagattttgtagaaggccttagcggggcgacttggatcgacgtagtattggaacacggcggatgtgtaacgacaatggccaaaaacaaacccacccttgacatcgaattacagaaaacagaagcaacacaactagcaacactaaggaaactttgcattgaaggcaaaattacaaatatcaccacagactctcggtgtccaacccaaggagaagctgtcctacctgaagaacaagaccaaaattatgtatgtaaacatgcatacgtggaccgcggatggggaaacggatgcggtttgtttggaaaaggatcattggtaacatgcgcgaaatttcaatgcctagaaccaatagaaggaaaagtagtccaatacgaaaatctaaaatacaccgttattatcactgttcacacaggtgaccaacaccaagtaggaaacgaaactcaaggagtaacagccgagataacaccacaagcgagcaccacagaagcaattctaccagaatacggcaccctggggttagaatgtagtccaagaaccgggttagattttaatgagatgatattattaaccatgaaaaacaaagcatggatggtacaccgccaatggttctttgacttacctttaccatggacaagtggagcaacgactgagaccccaacctggaatcgtaaagaactgctcgtaacgttcaaaaatgctcatgctaagaaacaagaagtcgttgtactaggtagtcaggaaggagcaatgcataccgcacttacaggagcaacggagatacaaaattctggcggcacatctatattcgcaggacacctaaaatgtcgactgaaaatggacaaactcgagctaaaagggatgtcatatgcaatgtgcaccaacactttcgtactgaagaaagaggtatctgaaacgcagcacggcacaatattaataaaagtagaatataaaggtgaagatgcaccttgtaaaataccgttctcaaccgaggacggccaagggaaagcacacaacggaaggttaataacagcaaaccccgttgtgacgaagaaagaggaacctgtgaacatagaagctgagccccctttcggagaaagtaacatagtcattgggataggagacaacgccctaaaaataaactggtataagaaaggatcatctatcgggaagatgttcgaagcaacagcgcgcggagctagacgtatggcaatcctaggagatactgcttgggattttgggtcagttggtggagttttaaattcattaggtaagatggttcatcaaatttttggaagtgcctacacggccctattctctggtgtctcgtgggttatgaagattggtatcggagtcttgctgacatggatagggctaaatagcaaaaacacctccatgtctttcagctgtattgcgattggtatcataactttgtatttaggggcggtagtacaagcagatatgggttgtgtagtaaactggaaagggaaggaacttaaatgtggctctggaatcttcgtaacaaatgaagttcatacatggacggaacagtataaatttcaggcggatagccccaaaagattagcaacagcaatagctggagcgtgggaaaatggtgtatgtggcatcagatcgactacgagaatggagaacctcttatggaagcaaatcgctaatgagctaaactatatactctgggagaataatataaaactcaccgtagtggtaggagacacgatcggagtattagaacagggaaaacggacactaacccctcaaccaatggaattaaagtacagctggaagacttggggtaaagctaaaatagttaccgctgagactcaaaatagctcattcataatagatggtccgaacacacctgaatgcccatccgcctcgcgggcatggaacgtatgggaagtagaagactacggattcggagtatttacgacaaatatctggctgaagttacgagaagtttatacacagatgtgtgatcatagattaatgtcagcagcagtaaaagacgagcgggccgtgcacgccgatatgggttattggattgaaagtcagaaaaatggctcatggaaacttgaaaaagcgagtcttatcgaagtcaaaacttgtacatggccaaaatctcatactctgtggagcaacggcgtattagagtcagatatgataattccaaaatcattagccggcccaatttcccagcataattatcgaccgggctaccacacacagacagcaggaccgtggcacttaggtaaactcgaattagacttcaattactgtgaaggcactaccgtggtaatcaccgagaattgtggaacacgaggcccgagcttaagaacaactaccgtaagtggaaaacttatccatgagtggtgctgcaggtcgtgtacactaccaccattgcgctacatgggagaagacggttgttggtatggaatggaaattaggcccattagtgaaaaagaagagaatatggtgaaaagcctagtatctgcaggctctggtaaggttgacaatttcacaatgggcgtattatgccttgctatattattcgaagaagtgatgagaggaaaattcgggaagaaacatatgatcgctggcgtattctttacgtttgtattattattatcaggacaaataacatggcgagatatggctcatacccttatcatgataggctctaacgcgtctgacaggatggggatgggcgtaacttacctagcactaatagccacgtttaaaatacaaccttttctagctcttggattctttctcagaaaattaacttcgagggaaaacctcctgttaggagttggccttgcaatggcgaccacattacaattgccagaagatattgagcaaatggcaaacgggatagcactaggtttgatggctttaaagttaatcactcaatttgagacgtatcaattgtggacggccttaatatccctaacctgtagcaatacaatttttactttgacagttgcatggagaactgcaacattaattctggcaggggtgagtttattacccgtttgtcaatccagttccatgagaaagaccgattggctacccatgacagttgccgccatgggtgtaccacctctcccgctatttatatttagcctaaaagacactctaaaaagaagatcatggccacttaatgaaggcgtcatggctgtggggctcgtctcgatactagccagctcactgctccgaaacgatgtccctatggcagggcctcttgtagcgggtggcctcctaatagcttgttatgtaattacagggacttcggcggatttaactgtagaaaaggcagctgatgtaacttgggaggaagaggcagaacagacgggggtaagccataacctgatgataacagtagatgatgatggaaccatgaggattaaggatgatgaaacagaaaacatcttaactgtactgctaaaaacggcacttttaattgtttctggaatattcccttacagcattcctgcaaccttattagtgtggcacacttggcaaaaacaaacccaaaggtccggtgtgctatgggatgtcccatccccgcccgaaactcaaaaagccgaacttgaagaaggtgtatatcgaatcaaacaacaaggtatacttggaaaaacacaagtaggagtaggggtacaaaaagaaggggtatttcacacgatgtggcacgtgactagaggggctgtacttacacacaatggtaaaagactagaacccaattgggcgtcagtgaagaaggacctaatcagctacggaggaggatggcgacttagcgcacaatggcagaaaggggaggaagtacaagtgattgcagtcgaaccaggcaaaaatccaaagaattttcaaacgatgccaggtacattccaaactactactggtgaaattggtgctatagctttggacttcaaacccggaaccagtgggtcacccatcatcaatcgtgaagggaaagtagtaggtctttacggtaatggcgttgtaactaaaaatggaggctacgtatcaggaattgcacagaccaatgcagaacctgatggccctacacccgagttagaagaagagatgtttaagaaaagaaatctgacaatcatggatttgcatcccggttcaggaaaaacgagaaaatatcttccagcaatcgtaagagaagcaattaagcgtcgtttacggacacttatcctcgccccgacaagagtagtcgccgccgagatggaagaggctttaaagggactgcctataagatatcaaacgacagccacaaaatctgaacacacgggacgcgagatagtagatctgatgtgtcacgcaacattcacaatgcgtctactcagtccggtccgagtacccaattataacttaataattatggacgaagcgcattttacagatcctgccagcatagcagccaggggttatatttcaactcgtgttggcatgggtgaagcagctgcgatttttatgaccgctacaccgcctggcacagcagacgcattcccacaaagtaacgcaccaatccaagatgaggaaagagatataccagaacgtagctggaactcaggaaacgaatggataacggactttgcaggtaaaacagtatggttcgtgccatctatcaaggctggaaacgatattgcgaactgcctccggaagaacggtaagaaagtgattcaattatcgaggaagacgttcgagaccgagtaccagaaaactaaactcaacgattgggattttgtagtcaccaccgacattagcgaaatgggggctaacttcaaggcagatcgagtgattgacccacgaaggtgcctaaaacctgtaatactcacggacggtccggaaagggtaatcctggccggccctatgccggtaacagcagccagcgcagcccaaagaaggggccgagtagggagaaatccacaaaaagaaaatgatcaatacatttttaccggacaacctcttaataatgatgaggatcacgcacactggaccgaagcaaaaatgttactcgataatattaatacaccagaaggtataatccctgcactatttgaacccgaaagagaaaagtctgctgcaatagacggcgaatacagactaaagggtgagtctagaaaaacctttgtagaattgatgaggagaggagacttaccagtgtggttagcttataaagtagcttcggaaggaataaaatataccgaccgaaaatggtgttttgacggacaaagaaataaccaaatattagaagaaaacatggatgtagaaatttggacaaaagaaggggagaaaaagaaattgcgtccaagatggcttgatgcaaggacttactcggatcctttagcgttaaaagagtttaaagatttcgccgcaggaagaaagagcatcgctttggatttggtcaccgaaatcggaagggtgccaagtcatcttgcacatagaacacgaaacgcgttagacaatctggttatgcttcatacgtcggaacacggaggacgggcttatcgtcatgcggtggaagagttacctgaaacaatggaaactcttctgttattaggtctaatgattttacttacaggtggcgcaatgctgttcctcataagtggaaaaggtataggtaagacaagtataggcctaatttgcgtcatcgcctcgagcggtatgttatggatggctgaaattcctttacaatggattgcttccgctatagtattagaatttttcatgatggttctattaattcccgaaccggagaaacaacgtacccctcaagataatcaacttgcgtatgtagttattggtatactcaccctagctgcaataattgccgctaatgaaatgggactattagaaaccaccaaaagagacttaggaatgtcaaaagaaccaggagtagtaagtcccacgagttatttagacgtagatcttcatccggcgtctgcatggaccttgtacgcagtagcaactactgtgatcaccccgatgctcagacatactattgaaaactccacggcaaacgtatcccttgcagctattgcgaatcaagcggtagtactaatgggacttgacaaaggttggccgatatcaaagatggacctgggagtacctttacttgccttaggatgctattcacaggttaatccgttgacattaacagcagcagtattattattaatcactcattatgcaataattggtccaggattacaggctaaggctacgcgggaagcacagaaaaggacagccgcgggcataatgaaaaatccaacagtggacggaataattaccattgatctagatcctgttatatacgattcaaaattcgaaaagcagctcggacaagttatgctcctggttttatgtgcagtacaactgttgctaatgagaacatcttgggccctctgcgaagcattaactcttgcaacgggtccaattacaacactttgggaaggctcgcctggaaaattttggaacactaccatcgcggtttcaatggctaacatatttagaggaagctatctagcgggggctggattggcgttcagtatcatgaaaagtgtaggaacaggaaagagaggaactggctcgcaaggggaaactttaggagagaaatggaaaaagaaactgaaccaactctcaagaaaggagtttgatctatataagaaatcgggcattacagaagtagatagaactgaagctaaggaaggattaaagcgtggagaaacaacacaccacgcagtaagcagaggatcggcaaagttgcaatggtttgtagaaaggaatatggtaataccggagggcagagttatagacttaggatgtgggcgcggcggttggagctattattgtgctggactcaagaaagtaacagaggttagaggatataccaaaggaggaccagggcatgaagaacctgtccccatggcaacatacggttggaacatagtcaaacttatgtcaggcaaagacgtattttatttaccgcctgagaagtgtgatacgctactgtgcgatatcggagaatcttcaccgtcaccaacagttgaagaatctagaaccattagagtactaaaaatggtggagccctggttgaaaaacaatcagttttgtataaaggtactaaacccttacatgccagcagttattgaacatctagagagattacaaagaaaacacggaggcatgttagtcaggaaccctctcagcagaaactctacgcatgaaatgtactggatctcaaatggaacaggcaacatagtatcgagtgttaatatggtttcgcgattactcctaaatagatttacaatgactcatagaagaccaactatcgaaaaagatgtcgacctaggggccggaacacgtcatgtaaatgcagagcctgagactccgaatatggatgtaataggtgaacgaataaaacgtataaaagaggaacataacagtacctggcactatgatgacgagaacccatataaaacatgggcataccacggatcttacgaagtaaaggcaacgggtagtgcatcttcgatgattaatggagtagtaaaactattaacgaaaccatgggacgtcgtgccgatggtaactcagatggcgatgactgacacgacaccattcgggcaacagcgagtttttaaagagaaagttgatactcgaacacctcgacctatgccaggcacaagaaaggtcatggaaattacggcagaatggttatggaggacattaggcagaaacaaacgtcctcgcctatgtacaagagaagaatttacgaagaaagttagaaccaacgctgcaatgggcgctgtatttacagaagagaatcaatgggactctgcgaaagcagcggttgaagacgaagagttctggaaattagtggatcgcgaacgagagctccataaactaggaaaatgtggatcatgcgtatataacatgatgggaaaaagggagaagaaattaggagaatttggcaaagcaaaaggaagcagagccatatggtatatgtggttaggcgcgcgctatttagagttcgaggcgttaggcttcctaaacgaagatcattggttctctagagaaaattcctactcaggcgtggaaggtgaaggattacataaacttggttatatacttcgagatataagtaaaatacctggcggagctatgtacgctgacgacacagccggatgggataccagaatcacagaagacgatttacataatgaagagaaaattacacaacaaatggatcccgaacatcgcctactagcgaatgcaattttcaagttaacttatcaaaacaaagtagtgaaagttcaacggccaactcctacaggaaccgttatggatataatctcgcgaaaagatcaaagaggaagtgggcaggtaggaacctacggactcaatacattcacaaatatggaagctcaattagtacgacaaatggaaggagaaggagtgctgtcaaaagccgatttagagaatccgcatttacctgagaaaaagataacccaatggctggaaactaagggcgtcgaacgtctaaagcgaatggccataagtggagatgattgcgttgtaaaaccgattgacgacagatttgctaatgctttgctagcactcaacgacatgggaaaagttagaaaggatatacctcaatggcaaccaagcaaaggatggcacgattggcaacaggttccgttctgctcacaccattttcatgaattaattatgaaagacgggaggaagctagttgttccatgtagacctcaagacgaactaatcggcagagcgagaataagccaaggtgctgggtggagtttgagggaaaccgcctgtcttgggaaagcctacgcccaaatgtggtcattaatgtacttccaccgacgtgacctacggttagctagcaatgctatatgcagcgctgtacccgttcactgggttccgacatcacgtactacatggtcaatacatgcgcaccatcaatggatgacaactgaagatatgctaacagtatggaatagagtttggattgaagataatccatggatggaggataagacaccagttacaacgtgggaaaatgtaccttatctaggcaaacgggaagaccaatggtgcggtagtctcataggccttacatccagagctacttgggcacaaaatataccaaccgctatacaacaagtgaggtctcttataggaaatgaagagttccttgactatatgccgtcaatgaagcgatttcggaaggaagaagaatcagaaggcgctatttggtga

SEQ ID NO: 23541 - RNA, 9873 nt, synthetic construct
  misc_feature 1..9873: note = derived and/or modified CDS sequence (opt6) from DENV-3__GU370053__SS-prME
  source 1..9873: mol_type = other RNA
acatcattatgtctcatgatgattctaccagcagcattagcgttccatttgacaagccgggatggagaaccaagaatgatcgtaggcaaaaatgaaagaggaaaatcgctactttttaaaacagctagcggaataaatatgtgtactttgatagcaatggacttgggagaaatgtgtgatgatacagttacttataaatgtccacacattacagaagtggaaccagaagacatcgattgttggtgtaacttaacttccacttgggtaacatatggaacatgtaaccaagcaggggaacatcgacgcgacaaacgatcagttgctttagcaccccacgttggtatgggactagatacgagaacgcaaacatggatgtccgctgaaggagcatggcgtcaggtggagaaagtcgaaacatgggcgcttagacacccgggattcactattttggcattatttctagcacattacatagggacaagtctaacacagaaagtcgtaatatttattttattaatgttagtaactccaagcatgaccatgcgatgtgtgggagtaggtaaccgcgactttgtagaaggattgtctggtgcaacatgggtagatgttgttttggaacacggaggatgcgtaacgaccatggctaaaaataaaccgacgttggacatcgaactccagaaaacagaagcgactcaactagcgacactaagaaaactgtgtatagaagggaaaataacgaatataacaaccgatagtaggtgtcccactcagggtgaggccgtcctccccgaggaacaagaccagaattacgtatgtaaacacacatatgttgatcgaggttggggaaacgggtgtggattgtttggaaaaggatctttagtaacgtgtgcgaaattccagtgtctagaacctatagagggaaaagtcgtacaatatgagaatttaaaatatactgtcatcataacagtccatacaggagaccaacatcaagtcggaaatgaaacacaaggtgttacagcggaaataacccctcaagcgtctacaactgaggctatcttgccagaatatggtacattaggattagaatgttcccctagaactgggctcgattttaatgaaatgatattactgacaatgaaaaataaggcttggatggttcatagacagtggttctttgatcttccattgccatgggcgtcgggtgctactaccgagactccaacctggaaccgtaaagaattactcgtcacttttaaaaatgcacacgcgaagaaacaagaagtagtagtattaggaagtcaggaaggtgcgatgcatactgcgcttactggcgccacagagatccaaaactccgggggtacctcaatatttgccggccatttaaaatgtagactcaaaatggataaactagagctgaaaggcatgtcatatgctatgtgcacaaacacctttgtattaaagaaagaggtatccgaaacccagcacgggactattctgataaaagtagagtataaaggagaagatgcgccatgtaaaattccatttagtaccgaagatggacaaggcaaagcacataacggacgactaatcactgccaacccggtagtaacaaagaaagaggaacctgtcaacattgaagccgaaccaccttttggagagtctaacattgttataggtataggagacaatgccttgaaaataaattggtataagaaaggttcaagcataggaaaaatgtttgaggctacggccaggggtgcgagacgaatggcaattttaggtgatacggcctgggatttcggatctgtgggaggtgtattaaattcactcggaaaaatggttcaccaaatatttgggagtgcatacacggcactattttctggtgttagttgggtgatgaaaattggcatcggtgtattgttaacatggatcggtcttaattcgaaaaatacaagtatgtcattctcatgcatagcgataggaattataacactatatctaggtgcagtagttcaagcagatatgggttgtgtaataaattggaaaggaaaagaactgaaatgtggttccggaatcttcgtaactaacgaagttcatacatggacagagcaatataaattccaagcagacagcccgaaaagattagctactgctattgcaggagcttgggaaaacggagtttgcggaattagatctacaacgagaatggaaaatttactttggaaacaaattgctaatgaactgaactatattctgtgggaaaataacataaaacttaccgtagtagttggagacacaataggagtgctcgaacagggaaaacgaactttaacgccccaacctatggaattaaaatacagctggaaaacctggggaaaagcgaaaatcgtgactgcggaaatacaaaatagcagctttataattgatggcccaaatacacctgagtgcccttcagcctcaagagcatggaatgtatgggaagtcgaggactatggatttggagtatttacaaccaatatatggctcaaactacgtgaggtatacactcagctgtgtgaccatagattgatgtcagcagccgtaaaagatgaacgagcagtacatgcagacatgggatattggatagaaagtcagaaaaacggatcttggaaattagaaaaagcctcacttattgaagtgaaaacgtgtacatggcccaagagtcatacattatggtctaatggagtactagaatccgatatgataattccaaaatctctagcaggcccaatctctcaacacaattacagacctggatatcatactcaaaccgctggaccatggcacttaggcaagctagaacttgattttaattattgcgagggtacgacggtcgtgatcaccgagtcttgtgggacgagaggacctagtcttcgcactaccacagtcagtggtaagttaatccatgagtggtgttgtcgcagttgcactttaccacctcttaggtatatgggagaagatggatgctggtatggtatggaaatacgacctataagcgaaaaagaagaaaatatggtaaaatccctggtgagtgctggctctggtaaagttgacaattttacgatgggcgtactgtgccttgcgatcctgtatgaagaggtaatgagaggtaagtttgggaagaaacacatgatagccggtgtattcttcacatttgttctgcttctttctggtcaaattacatggagagacatggcacatacattgattatgataggttctaatgctagcgatagaatgggaatgggggttacctatttagcccttatcgccactttcaaaattcagccgtttctagccctaggattctttctaagaaaacttacctctcgagaaaatcttctattaggggtaggattagcaatggccactacactccaattaccggaagatatagaacagatggcgaatggcattgcattaggtctaatggctttgaaactaattacacagttcgaaacctatcaactttggactgctctggtcagcttgacttgtagcaacacaatatttactctaacagtagcgtggagaacagccaccctaatactggcgggagttagtctattaccagtatgccaaagttcatcgatgcggaaaacagactggctacccatggcagtagctgctatgggagtacccccactccccctttttatattctcattaaaggacacattaaaaagaagatcgtggcctttaaatgaaggagtaatggcagttgggctcgtgtcaatcttagcctcgtccttactacgtaatgacgtccctatggctggccccttagtagccggtggacttctgatagcttgttatgttataacaggtactagcgcggacttaacagttgagaaagcggcagatgttacctgggaagaagaagcagaacaaacaggagtgagtcacaatttaatgattactgtagatgacgacggtacaatgagaataaaagatgatgaaacggaaaacatattaactgttttactcaaaacagctctactaatcgtttctggcatatttccatactctatccccgcgaccttattagtgtggcatacatggcaaaagcagactcaacgaagtggcgtcctgtgggacgtaccaagtcctcctgaaactcaaaaagcagagctagaggaaggagtatataggataaaacaacaaggtatattcggtaagacacaagttggggtcggtgtgcaaaaagaaggtgtatttcacacgatgtggcatgttacccggggcgccgttcttacacataatggtaaacgtttagaaccgaattgggcttctgtcaagaaagacttaattagttatggtggtggatggagactcagcgcccaatggcaaaaaggagaagaagtgcaggttatagccgtggaaccaggcaaaaacccaaagaattttcaaaccatgcctggaacatttcaaacgacaacaggtgaaattggcgcaatagccctcgatttcaagcctggtacgagtggaagtccaatcataaatagagaaggcaaagtagttggcctgtacggaaatggtgtagtcaccaaaaacggtggatatgtaagcggcattgcacaaacaaatgcagaacccgacggaccaacgcctgaactcgaagaagaaatgtttaagaaaagaaatcttacaataatggatttgcatccaggatcagggaagacaaggaagtacttgcctgctatagtgcgcgaagccattaaaagaagattaaggactcttatcttggcacctaccagggttgtcgcagcagaaatggaagaagctctaaaaggtctaccgataagataccaaactaccgcaacaaaaagtgagcacacaggaagggagattgtagacctgatgtgtcatgccacgtttacgatgcgtcttttatcaccagtaagggtgcccaactacaacttgatagttatggacgaggctcacttcaccgacccagcaagtatagcagcgcggggatatataagtacaagggtaggaatgggtgaagctgcagcaatttttatgacagcaaccccacctggaactgcagacgccttcccgcaatctaatgcacctatacaagacgaggaacgtgacatacccgaaagatcatggaatagtggaaatgaatggatcacagacttcgctggaaaaactgtatggtttgtgccctccatcaaggctggtaacgatattgcaaactgcctgaggaagaatggcaagaaagtgattcagctatccagaaagactttcgatacagaatatcaaaagacaaagttaaacgattgggacttcgtagttacaaccgacatttcagaaatgggcgccaacttcaaggcagatagagtgatagacccccgtaggtgcctaaaaccggtaatcctaaccgacggccctgaacgagtaatattagctggacctatgccagtaacggcagcctccgcagcacagaggcgaggaagggtgggtcgaaatccacaaaaagaaaatgatcaatatatattcacaggtcaaccgttgaataatgatgaggatcatgcacactggactgaagcgaagatgctactagataatataaacacaccagaaggtattataccagcactatttgaacctgagagagaaaagagcgcggccatagatggagagtacagactaaaaggagaatcaagaaaaactttcgtcgaattgatgagaagaggggaccttcctgtttggctcgctcataaggtcgcatcagaaggcataaaatatacagaccgcaaatggtgttttgatggacaacgaaataatcagatcctagaggagaatatggacgttgaaatctggacgaaagaaggagagaagaagaaactgagaccgagatggctggacgcacgtacatacagtgatcccctcgcactaaaagaatttaaagacttcgcagccggccgtaaatctatcgcattagatttggtcactgagataggacgtgtgccctctcatctagcacaccgaactagaaatgcattagacaatctagtaatgttacatacatcggaacatgggggtcgcgcctatagacatgctgtggaggaactacccgaaaccatggaaacccttttactactaggtcttatgatcttattgactggtggagcgatgctatttttaataagcggaaagggcattggaaaaacctcaattggactaatctgtgtaatagcatcctctggtatgttatggatggcagaagttccactacagtggatagcaagcgctatagtattagagttctttatgatggtcttgttgattccagaaccagaaaagcaaaggactccccaagataatcagctggcatatgtggttatcggaatcctcacgctggctgccattatcgctgcaaatgaaatgggccttttagaaacaactaaacgggatttaggtatgtcgaaagaacccggagtggtatccccaacgagctatctggacgtagatctacatcccgcaagtgcatggacgttatatgctgtagctaccacagtcattactcctatgttgagacacacaatcgaaaattctactgccaatgtctcattagcagccatagccaatcaagcagtggttcttatgggcctggataaaggctggcccatcagtaagatggatctaggagtcccccttttagcactaggttgttatagtcaggttaaccctttaaccctaacagcagcggtacttctcctaataacacattacgctattatcggaccaggcttgcaagccaaggcaacaagagaagcacaaaagcgtaccgccgccggtataatgaaaaacccaacagtggacggaataatgacaatcgacttagatcctgttatttacgattctaagtttgaaaaacaactgggacaggttatgctattagttctttgcgccgtgcaattattgttaatgcgcacgagctgggcattgtgcgaagccctgaccttggcaacaggtcccataacaactctttgggagggtagcccgggaaaattctggaatacaactatcgcggtgtctatggccaatatatttaggggaagttatctggccggtgcggggctagcattctcaataatgaaaagtgtaggaacaggaaaacggggaacaggatcgcaaggtgagactctaggcgaaaaatggaagaagaaattgaatcaactctcacggaaagaatttgacttatataagaaatcaggaataacggaagtagatcggacggaggcgaaagaaggattaaagagaggcgagacaactcatcatgccgtttctagggggtcggcaaaacttcaatggtttgtggagagaaacatggttgtccctgaagggagagttatagatcttggctgtggtagaggtggttggagttattattgcgccggactgaagaaagttactgaagtaagaggatatacaaaagggggaccgggacatgaggagccggtccctatgtcgacatacggatggaatatagttaaattaatgtctggtaaggatgtattttatttaccacccgaaaaatgcgatacgttgttatgtgatattggagaatcatcaccgtcaccgacagtagaagaaagccgtactattcgagtcctaaaaatggtagaaccatggcttaagaacaatcaattttgtatcaaagtattgaatccttatatgcctactgttatcgaacacctagaaaggctacaacgcaaacacggtggcatgttagtaaggaatcctctatcaagaaattcaacacatgaaatgtattggatctcaaacggtactggaaacatagtctcctcagttaatatggtatcaaggctacttcttaaccggtttaccatgactcatagaagaccgactatagaaaaagatgtggacctaggtgcagggacaaggcatgttaatgccgagcccgaaacgcctaatatggacgttataggcgaaagaatcaaacgaataaaagaggaacacaatagtacatggcactatgacgacgaaaatccatacaaaacatgggcctatcatggctcttatgaggtcaaagctacgggtagcgctagctccatgataaatggagtagtaaaactgttaactaaaccgtgggatgtggtaccaatggttacacaaatggccatgactgacacaaccccttttggacaacaaagagtattcaaggaaaaggttgatacacgtacaccacgtccaatgcctggcactaggaaagtcatggagattaccgccgagtggctatggcgaacactgggcagaaacaaacgaccgaggctctgcacacgagaggagtttaccaagaaggtcagaacaaatgcagctatgggtgctgtatttaccgaagaaaaccaatgggatagcgcgaaagctgctgtggaagacgaagaattttggaagctagtcgaccgagaaagagaactccataaactgggaaaatgtggatcatgtgtatacaacatgatgggcaaaagagagaagaaattgggagagttcgggaaggcaaaaggctcaagggcaatatggtatatgtggttgggggcacgatatcttgaatttgaggcactcgggttcttaaacgaagaccattggtttagccgtgaaaattcatattcaggcgtcgaaggggaaggactccataagttaggatatatattacgggatatcagtaagattcctggtggggcaatgtacgcagacgatacagcaggttgggatactagaataactgaagatgatctgcacaacgaagagaagataatacaacaaatggatcccgaacataggcaactcgctaatgccatatttaaactaacctatcaaaataaagtagttaaagtacaacgaccaacacccacaggaactgtcatggacataatctcaagaaaagatcaaaggggatcgggacaagtcgggacttatggacttaatacatttacaaacatggaagcccagctggtaagacagatggaaggggagggggtcctcacaaaagctgatctggaaaatccccacttacccgaaaagaagataacacaatggcttgaaacaaaaggcgtggaaaggttgaaaagaatggcaattagcggtgatgattgcgtagtaaagccaattgacgatagattcgcaaacgctttactggctctaaatgacatgggaaaggttcgtaaagacatcccacaatggcaacctagcaggggatggcacgattggcaacaggtgccattctgcagccatcactttcacgaactgattatgaaagatggacgcaaactcgtagttccttgtcggcctcaggacgagttaataggcagagctagaataagccagggggcaggatggtccctacgagagacagcgtgcctcggtaaggcttatgctcaaatgtggagtctaatgtatttccatagacgggatttacgcttagcatcgaacgccatctgttcggccgttcccgtacattgggtcccaacttctagaaccacatggagtatacacgcacaccaccaatggatgactactgaggacatgctgaccgtatggaatcgcgtctggatagaagaaaatccatggatggaggataaaactccagtaactacctgggaaaatgttccgtatttaggcaagcgagaagatcagtggtgcggatcacttatcggcctgacttctagagcaacttgggcacaaaacattttaacagcaatacaacaggtgcgatcattaataggcaacgaggaatttttggactatatgccatcgatgaaacgatttagaaaagaagaagaatcagagggggccatttggtaa

SEQ ID NO: 23542 - RNA, 9873 nt, synthetic construct
  misc_feature 1..9873: note = derived and/or modified CDS sequence (opt6) from DENV-3__JQ411814__SS-prME
  source 1..9873: mol_type = other RNA
acgagtctttgtttaatgatgattctcccggcagcattagcatttcacctgacgtctcgtgacggggaaccccgaatgatagtaggtaaaaacgaacgcggcaaatctctactgtttaaaactgcaagtggcatcaatatgtgtactttaatagcaatggatctcggcgaaatgtgcgatgacaccgtaacttacaaatgtccgcacatcacagaagtagaaccggaagatatagattgctggtgtaatttaactagcacatgggtgacctatgggacgtgcaatcaagctggtgaacatcgccgggacaaaagatccgtagcgcttgcacctcacgtcggcatgggactagatacacgaacccaaacatggatgagcgctgaaggggcctggagacaagtagaaaaagtggaaacttgggcactcaggcaccctggttttacaatactagccctctttctcgctcattatatagggacatctttaacacaaaaagtagtcatcttcatcctacttatgctagtaacaccttccatgactatgagatgcgttggtattgggaaccgagactttgtcgaaggattatctggagcaacatgggtagacgtcgtattggaacacggcgggtgtgtaacgacaatggccaaaaacaaacccactttagatattgaactacagaaaactgaagcaacccaactagccacattaaggaaattatgtatcgaaggaaaaataactaatatcactacagacagcagatgtccaacacaaggagaagcggtcttacccgaagaacaagatcaaaactacgtatgcaaacacacatacgtagatagagggtggggcaacggatgcggactcttcggaaaaggaagtttggttacatgcgcaaaatttcaatgtctcgaaccgatagaagggaaagttgtacaatatgagaacctaaaatatactgttatcattaccgttcacactggagatcaacatcaagtgggtaacgaaacccaaggagtaactgcagagatcactccccaagcgagtacaactgaagccattctaccagaatacgggaccctaggcttagaatgttcaccacgtacaggtttggacttcaacgaaatgatattacttaccatgaaaaataaagcctggatggtccatcgtcaatggttctttgatctgccactgccgtggacaagtggggctacaacggaaactccaacctggaaccgtaaagaactgctggttacgtttaaaaatgctcacgccaagaaacaagaagtagtggtgttgggctctcaagaaggcgcgatgcacaccgctctaacgggcgctacagagatacagaactcaggtggaacaagcatttttgcaggacatctgaaatgcagactaaaaatggataaattagaactaaaaggtatgagttatgcaatgtgcaccaacacattcgtcttgaagaaagaggtatcagaaacgcaacacggaacaatactaataaaagtagaatataaaggagaagacgccccgtgtaaaataccattttcaactgaagacggtcaaggaaaagcacataatggaagattgattacagcgaatcctgttgtaacaaagaaagaagaaccagttaatatagaagcagagcctccgttcggtgagtctaatatcgtcataggaattggggataatgctttaaaaattaactggtataagaaaggatcctcaataggaaaaatgttcgaagcaactgctcgcggagcgaggaggatggcgattctaggagatacagcatgggattttggaagtgtaggtggcgtgttaaacagtcttggtaaaatggtccatcagatattcggatccgcttatacggcattgtttagcggagtaagctgggttatgaaaattggaataggtgtacttttaacatggatcggacttaatagtaaaaatacgtcaatgtcgttttcatgcatagcaataggcataataaccctttatttaggtgcagtagttcaagctgatatggggtgtgtaatcaattggaaaggtaaagaattaaaatgtggaagtggaatcttcgtaacaaatgaagtacatacatggaccgaacagtataagtttcaagctgacagccctaaaaggctcgcaacagcgatcgctggggcatgggaaaacggagtatgtggtattagaagtacaacccgtatggagaaccttctatggaaacaaatcgcaaatgaattaaactacatattatgggaaaacaacataaaactaactgttgttgtaggagatactataggtgtgctggaacaaggaaaaagaactttgacgccccaacccatggaactaaaatattcgtggaaaacgtggggaaaagctaaaatagtgacagcagaaacacaaaatagttcctttataattgatggaccaaacactccggagtgcccgtcggctagtagagcctggaatgtttgggaagtagaagactatggatttggtgtctttacgactaacatatggttaaaactacgagatgtttacacacaactctgtgaccaccgtctaatgtcagccgctgtaaaagatgaaagagcggttcatgctgatatgggctactggattgagtcacagaaaaacggatcctggaaacttgaaaaagctagcctaattgaagtaaaaacatgtacgtggccaaaaagtcacacactgtggtcaaatggggtcctggaatctgatatgatcataccgaaaagtttagcgggtccgatatcacagcacaattaccgtccaggatatcatactcaaacagcagggccctggcacttaggaaaattagagttagatttcaactattgcgagggcacgacggttgtaataacggaaaattgtggcactcgaggaccttccttgagaacaactacagtatctgggaaactcatacacgaatggtgttgccggtcctgcaccttaccaccgttaagatacatgggagaggatggatgctggtatggaatggaaattagaccaatttcggaaaaagaagaaaacatggtcaaatccttagtctcagcagggagcggaaaggtagacaacttcacaatgggggttctgtgtctggcaatactatttgaagaagttatgaggggtaaatttggaaagaaacacatgatagccggtgtattattcacttttgttctactgttaagtggccaaataacatggagagacatggcacatacactaatcatgataggttcaaacgcgtctgatagaatgggcatgggagtcacatatttggccttaatagctacttttaaaatccaacccttcctcgcgctcggtttcttcttaagaaaattaacatccagagaaaacttacttttaggagtaggactagcaatggcaactaccctgcagttgccggaagatattgaacaaatggctaatggaatagctttaggtcttatggctctgaagttaataactcagtttgaaacataccaactatggactgcacttgtatcacttacatgttctaacacaatccttaccttaactgtagcttggcgaacagcaactctaattctagcaggagtatcactacttcctgtttgtcagtcgtccagtatgaggaaaaccgattggttgcccatgaccgtagcagcgatgggcgttccacccctacctttatttatatttagtttgaaagacaccctaaaaagaagatcatggcctctgaacgaaggtgtaatggccgtaggcctagtatctatattagcgtcgtctctgctgcgaaatgatgtaccaatggcaggcccacttgtcgcaggaggtttattaatagcttgctacgtgatcacaggtacatcggccgacttaacggtggagaaagcagcagatgtaacatgggaagaagaggcagaacaaacgggagtttcccataacttgatgataaccgtagacgacgatggtacaatgaggatcaaagatgacgaaacagaaaatattctgacagtcttactaaagacggcgttactaattgttagtggtatttttccatattctatacctgcgaccttattagtctggcatacatggcaaaaacagacacagcgtagtggagtcctctgggatgttccttcgcctccggaaactcaaaaagcagaactcgaagaaggagtgtatcgtataaagcaacagggtatcttagggaaaactcaagtgggcgttggtgttcaaaaagagggtgttttccatacaatgtggcatgtgactcgaggggccgtactaacgcacaatggcaaacgtttagaaccgaattgggcctctgtcaagaaagacctcattagttatggtggtggatggagacttagtgcccaatggcagaagggggaagaggtacaagtcattgctgtagaacccggcaaaaatcctaaaaactttcaaacaatgccaggtacgtttcagacaacaaccggagaaattggtgctatagcattagatttcaaacccggcacaagtggttcacctattataaatcgagaaggaaaagtggttggactctatggaaatggagtagttactaaaaacggtggttacgtaagcggaatagctcaaaccaatgccgagccagatggaccgactccagaactagaagaagaaatgttcaagaaaaggaatcttactataatggacctacacccgggatctggtaaaactagaaaatacttaccggcaattgttagggaagccatcaaaagacgtctacgaacgttaatactagcccctacaagagttgtggcagcggagatggaagaagccttgaagggtttaccaattagataccaaacaactgcaacgaaatcagaacatacgggacgagaaattgtcgacttaatgtgccacgcgacattcactatgcggctcttatcccctgtccgcgtcccaaattataatctcataattatggatgaagcacacttcaccgatccagctagtattgcggctagagggtatattagtaccagggtcggcatgggagaagcggctgcaatattcatgacggctacaccacccggaacagcggatgcatttccgcaaagcaacgcaccgatccaggatgaggaaagagatatcccagaaaggtcatggaatagtggtaacgaatggattactgattttgctggaaaaactgtttggtttgtaccgagtataaaagcaggtaatgatatagccaactgtttgaggaaaaacggcaagaaagtgatacaactaagtcgcaagacattcgatacagaatatcagaaaactaaattaaatgattgggactttgtagttacaaccgacatctcagaaatgggggcaaattttaaagcagacagagtcatagatccacgacgatgcctaaaacctgtgatccttactgatggcccagaaagagtaatattagcaggtccgatgcccgttacagcagcctcagcagcacaaaggcgtggaagggtaggaagaaacccacagaaggaaaacgaccaatacatatttacaggtcaaccacttaataacgatgaagatcacgcacattggaccgaagcgaaaatgctcctagataacataaacacacccgaaggaataatacccgctttattcgaaccagaaagagaaaaatcagcagctattgatggtgaatacagacttaaaggcgagtctcggaaaacatttgtggaacttatgaggcgcggggatttaccagtttggttagctcataaagtggcttctgaagggattaagtatacagacagaaaatggtgttttgacggacagcggaataatcagattttagaagagaatatggatgtcgaaatatggaccaaggagggtgagaagaagaaactaaggcctcgctggctagacgcgagaacatattcagatcccttggcgttaaaggaatttaaagactttgccgcaggcagaaaatcaatagcgttggatttagtcactgaaataggtagagtgccgtctcatcttgcgcataggacccgaaatgctctagataatcttgtaatgttgcacacaagcgaacacgggggccgagcgtataggcacgctgttgaagaactaccagagacgatggagaccttactcctgcttggtttaatgattttgttgacagggggagcaatgctatttttaataagtggaaaaggaataggcaagacttcaattggcctgatttgtgtaattgcgtcgtctggcatgttgtggatggcggaaattccattacagtggatagccagtgcaattgtcctagaatttttcatgatggtattgttaattccagaacctgagaaacaacgaacaccccaggacaaccagctggcatacgtggttataggtattttaaccttggctgctattattgcagcaaatgaaatgggcctactagaaacgacaaaacgggacttaggaatgtctaaagagccaggagtagtatcacctacaagctacctagatgttgatcttcatccggcgtcagcatggactctgtacgcagtggccacaaccgttattacacctatgttaagacacacgatagaaaactctactgcaaacgtaagtctagcagcaattgcaaaccaagcagttgtattaatgggactagataagggttggccgattagtaagatggacctaggtgtacccttattagcactaggatgttactcccaagttaatccactaactctaactgcagccgtattactactgatcacacattacgctattatcggcccgggcctccaggcaaaagcaacaagagaagctcagaaaagaacagccgctggcatcatgaagaacccaacagtagatggtattatgacaattgatctagaccctgtcatatacgattctaaatttgaaaagcaactcggtcaagtgatgttacttgttttatgtgcggtacaactacttctgatgagaacgagctgggcactttgcgaagccctgacgctcgccacaggtccaataactacgttatgggaaggatctcccgggaaattttggaacaccacaatagcagtaagcatggctaacatctttaggggaagttacctagcaggagcagggctagcctttagtattatgaagtcggtcgggaccggcaaacgcggaacggggagccaaggtgagacactcggagaaaaatggaaaaagaaactgaaccaactaagccgcaaagagttcgacctatataagaaaagcggaattacagaagtagacaggacagaggccaaagaaggtttaaagaggggagaaattacacaccatgctgtttcccgaggatccgcaaaattgcaatggtttgtagaaagaaatatggtaatcccagaaggtagagtaatagatctgggttgcggaagaggagggtggtcctattactgtgctggattgaagaaagtaacagaagtaaggggttatacaaaaggcggacctggtcatgaggaaccagtgcccatgtccacctacggatggaatattgtcaaattaatgagcggaaaagacgtattctatttgccaccagaaaaatgcgatactctcttgtgcgatattggggaatctagtccctcccctacagttgaagaatccagaaccatacgggttttaaaaatggtagaaccgtggctgaaaaacaatcagttttgtatcaaagtgctcaatccatatatgcctacagtcatagaacatcttgaacggcttcagcggaaacatggcggtatgcttgtcaggaatccattaagtaggaatagcacccatgaaatgtattggataagtaatgggacaggtaacatagtttctagcgttaatatggtttcgcggcttttgttaaacagatttacaatgacccatcgcagaccaaccatcgaaaaagacgtcgatcttggggcaggtacgaggcatgtaaatgccgaaccagagacgcccaacatggatgtcatcggggaaaggataaaacggataaaagaagaacataatagtacttggcattacgacgacgaaaatccatacaagacatgggcttaccatggaagttatgaagttaaggcaacagggtcggcttcttccatgataaacggcgtagtaaaactactaacaaaaccatgggatgtggttcccatggtaactcaaatggcaatgaccgatactacaccatttggacaacagagagtctttaaagagaaagtggatacaaggacgcctaggcctatgccaggtactaggaaggtaatggggataaccgccgaatggctgtggcgcacgctcggtaggaataaacgccctagactatgtactagggaagaatttactaagaaagtaagaactaatgcagctatgggagccgttttcactgaggaaaaccaatgggacagcgctaaagcggccgtagaagacgaggagttctggaagctcgttgacagagaaagggagctccataaactaggaaaatgtggctcctgtgtctataatatgatgggaaaaagggagaagaaactaggagaatttggaaaagcaaaaggttcgcgagcaatatggtatatgtggttaggtgcgagatacctcgagtttgaagcactcggctttctaaatgaggatcattggttctctcgtgacaactcgtactccggagtagaaggagagggtttgcacaaacttgggtacattttacgcgatatttcaaaaataccaggcggcgcaatgtatgctgatgatacagccggctgggacactagaataactgaagatgacttacacaacgaagagaaaattacacaacaaatggatcctgaacatagacaattggcaaatgcaatctttaagttaacctaccagaataaagtagtcaaagtgcaacgacccacaccaacaggtaccgttatggatataatatcaagaaaagaccaacgaggatccggacaagtagggacttacggtcttaatacgttcacaaacatggaagtccaactcgtacgacaaatggaaggagaaggcgtattaagcaaggctgacttagaaaatccgcatttaccagagaagaaaatcactcagtggttagaaacgaagggtgtagaacgtttaaagagaatggcgatatcaggcgatgactgcgtagtaaagcccatagatgatcgctttgcaaatgcattactagctttaaatgatatgggaaaagtaaggaaggatatacctcaatggcaaccctctaagggttggcatgattggcagcaggtccccttttgttcgcatcacttccatgagttaattatgaaagatggaaggaagctagtagttccatgtcggccacaagatgaactcattggcagagctagaattagccaaggcgcaggatggagcctacgagagacggcgtgcctaggaaaagcatacgcgcaaatgtggtcactaatgtatttccatcggagagacttacgattagctagtaatgccatatgttcagcagtacctgtacattgggtacctacttcacgtacaacatggtcaatccatgctcatcatcagtggatgacaacagaggacatgcttaccgtgtggaatcgggtttggatcgaagataacccctggatggaagataaaacgccagtaacaacttgggagaatgtaccttacttaggtaagcgtgaggaccagtggtgtgggagtttaattggattgacgagtagagcaacgtgggcacaaaatattcctaccgccattcagcaagttagatccttaataggaaacgaagagttcctggattacatgccgtcaatgaagcgtttcagaaaagaggaagaaagtgaaggggcaatatggtga

SEQ ID NO: 23543 - RNA, 9873 nt, synthetic construct
  misc_feature 1..9873: note = derived and/or modified CDS sequence (opt6) from DENV-3__KM190937__SS-prME
  source 1..9873: mol_type = other RNA
acaagtctttgtctaatgatgatgctaccagcaaccttggcattccacctaacttctcgcgacggggaaccaagaatgatagtgggtaaaaatgaaagggggaaatccctattatttaaaacggcgtcaggtataaatatgtgtacattaatagctatggatttaggagaaatgtgtgatgataccgtcacgtacaaatgcccacacattacagaagtagaacctgaagatattgattgctggtgtaatcttacttcaacgtgggtaacttatgggacttgtaatcaagctggcgaacatcgccgggataaacgatcagttgcaatagcaccacatgtgggaatggggcttgatacgagaacgcaaacatggatgtcagcggaaggagcatggagacaagtagaaaaagttgaaacttgggcacttagacacccaggatttacaattcttgcacttttcttggcacattacatagggacaagtctcacccaaaaagttgtcattttcattctgctcatgttggttaccccttcaatgacaatgcgttgcgtaggggtaggtaaccgggactttgtagaagggttgagcggcgctacatgggtagacgtggtcttggaacatggtggatgtgtaaccactatggccaaaaataaacctaccctcgacattgaattgcagaaaactgaagcgacgcaactagctacattaaggaaattatgtatcgaaggaaaaattacgaacattactacggactctcgctgtcctactcaaggtgaggcaatattgcctgaagaacaagatcaaaattacgtatgtaaacatacctacgtggacagaggttggggcaatggttgcggcttattcgggaaaggatccttagtaacatgcgctaaattccaatgtcttgaatcgattgaaggtaaagtagtccaacatgaaaatcttaaatatacggtaatcataactgtacatacaggagaccaacaccaagtaggtaatgagatgcagggtgtaacagcagaaattaccccgcaggcaagtaccgccgaggtcatcttaccggagtatggcacactaggactcgaatgtagtccgcgtacgggccttgactttaatgaaatgataagtctgactatgaaaaacaaagcatggatggtacatagacaatggtttttcgatttaccactaccgtggacgtcaggggctactgcagagacaccgacttggaacagaaaagaactattggtcacatttaaaaatgcgcatgccaagaaacaagaagtggttgtcctcggcagtcaagaaggtgctatgcatactgccctgacaggtgcaaccgaaatacagacatcaggcggaacgagtattttcgcaggtcacttaaaatgcagactcaaaatggataaacttgaactaaaaggaatgagttatgcaatgtgcctatcctcatttgtactgaagaaagaagttagcgagacacaacacggaacaattctaatcaaagtagagtataaaggtgaagatgccccatgtaaaatacctttttccactgaagatggacaaggcaaagctcataacggcagactcataacagccaacccagtagtaaccaagaaagaagaacctgtcaatatagaagccgaacctccatttggagagagcaacatagtaataggcatcggggacaaggctttaaaaataaattggtacaagaaaggttcttccataggaaaaatgtttgaggctaccgcacgcggagctagaagaatggctattctaggtgacacagcttgggacttcggaagtgttgggggagtactaaattcgctaggaaaaatggtacatcaaatattcggcagcgcatatactgcactctttggtggagtgagttggatgatgaaaatcggtataggggtattactaacttggatcggcctgaactctaaaaatacatcaatgtcctttagctgcatagctattggtataattacattgtatttaggtgccgtagtacaagcagacatgggctgcgttattaattggaaaggtaaagaattgaaatgtggttctggcatatttgtcacaaatgaagttcatacttggacagaacaatacaaatttcaggctgattctccaaaaagactcgcaacagctattgccggtgcatgggagaacggtgtatgtggaatccgatcaactacaaggatggaaaacctactgtggaaacaaatcgcaaacgaattgaattatattctatgggaaaataatatcaaattgaccgttgtagttggggatattactggagtactagagcagggcaaaaggactttaaccccgcaaccaatggagttaaaatattcatggaaaacctggggaaaagctaaaatcgtaacagcggaaacacaaaattcctcgttcattattgatggtcccagcacgccagaatgtccatcagccagccgagcttggaatgtatgggaagtggaggattacggctttggtgtttttacgacgaatatttggttaaaattaagagaagtgtacacacaattatgtgatcatcgtcttatgagcgcggcagttaaagatgaacgcgctgtacacgctgacatgggttactggatagaatcccagaaaaatggatcatggaaattagaaaaagcctcgttcattgaggtcaaaacatgtacatggcctaaatcacacacgttgtggtcgaatggagtacttgaaagtgacatgataattcctaaaagcctagcaggacccatctctcaacataatcataggcctggttaccacacacaaacagctggaccttggcatttaggaaaattggagctcgactttaactattgcgaaggaacgactgtagttatatccgagaattgtggtacacgtggtccttccttaagaacaactacagtttcaggtaaacttatccacgaatggtgctgccgaagttgcaccctgccacctcttcgctatatgggagaagacggatgctggtatggaatggaaataagacccataaacgaaaaagaagaaaacatggtaaaatccttagcatccgcggggagtgggaaagtagataatttcacaatgggagttctttgcctagctatactttttgaagaagtgatgcggggtaaatttggaaaaatccacatgattgctggagtactattcactttcgttttactcctaagcggacagataacatggcgtgatatggcacatacattaattatgattgggagtaacgcctcagaccggatgggtatgggcgtcacatacctagcgttaatagctacatttaaaattcaaccatttctagctttaggtttctttcttcgaaaactcacaagccgtgaaaatcttctactaggagtcggtctagcaatggctgctaccttgaggctgcccgaggatatcgaacaaatggcgaacggaattgcattaggattgatggcactaaaattaataacacaatttgaaacataccaactttggaccgccttagtaagcctgacgtgtagtaacaccatattcacattaacagttgcatggaggacagctacgttgatattagcaggaatatcattactgccggtatgccaatccagctcaatgcgtaaaactgactggctacccatgactgtcgcagcaatgggagcacaaccactccccttatttatcttctcattgaaagacacactaaaaagaagaagctggcccctaaacgaaggggtaatggcggtgggcttggttagcattctggcttcgtctttattaagaaatgatgtaccgatggcaggacctctggtggcaggaggtcttttaattgcctgttacgtgattacagggacaagtgccgatcttactgtggagaaagctgcggacgtaacttgggaagaagaagccgaacaaactggcgtctcccataaccttatggttaccgtcgatgacgacggtacaatgagaatcaaagacgatgaaactgagaatatactcacggtattactcaaaacagccttactgatagtgagcggtatatttccatattctattcccgcaacacttttagtatggcacacatggcagaagcaaacccaaagaagcggcgttttgtgggacgtaccaagtccaccggagacacaaaaagcggagttggaagaaggcgtatacaggatcaaacaacagggtatattcgggaaaacacaagttggggttggtgttcaaaaagaaggagtgtttcataccatgtggcatgttactcgtggagctgtattaacccacaatggtaaaagactggagcccaattgggctagtgttaagaaagatcttatcagttacggtggagggtggagattgtctgcgcaatggcaaaaaggggaagaagtacaagtgattgcagtcgagccgggaaagaatcctaaaaactttcaaacgatgcctgggatatttcagactacaaccggtgaaattggtgcaatagcgctagattttaaaccaggaacttcaggcagtcccataataaatagagagggtaaagtagtcggcttatacggaaatggagtggtaacgaaaaatggtggttacgtctctgggattgcacaaactaatgccgaacctgatggaccgactcccgagttagaagaggaaatgtttaagaaaaggaatttaacaatcatggatctacaccctgggtcaggaaagacccggaaatacctaccagctatagttcgggaagctattaaaagacgtctacgaacattgatattggctccgacaagagtagtagcggcagaaatggaagaggctttgaaaggactgccaatacgataccaaacgacagctactaagtcggaacacacgggacgtgaaatagtagacttaatgtgtcatgcaacatttacaatgagactactatcaccagtaagagtacctaattacaacctaataataatggacgaagcacattttacagatccagcctctatcgccgcacggggatacatctcaaccagggtcggcatgggcgaagcggctgccatatttatgacagcaacaccacccggtacagctgatgccttcccacaaagtaacgctccaatacaggacgaagaaagagacattccagaaagatcctggaactcaggtaatgagtggattacggattttgtaggaaaaaccgtatggttcgtacccagtattaaggccggtaacgatatcgcaaactgcctacgaaagaatgggaagaaagttatccaactaagtagaaagacatttgatactgagtatcagaaaacgaagctaaacgattgggactttgtagttaccacggacatatccgaaatgggagccaatttcaaagccgaccgagtaatagacccgaggcgatgtcttaaacccgtaatattaactgatggtcctgaacgggtgatcttggctggacctatgccagttaccgtagcatccgcggcccaaagacgaggaagagtaggaaggaacccacagaaagaaaacgaccaatacatttttatgggccaaccattaaataatgatgaagaccacgctcattggaccgaagcaaaaatgcttcttgataatataaataccccagaaggcattatacctgcattgttcgaacccgaacgtgagaaaagtgctgcaattgacggtgaataccgcctaaaaggtgagtcaagaaaaacattcgttgaacttatgcgtagaggcgatttgccggtatggctagctcataaagtggcaagcgaagggattaaatatacggacaggaaatggtgtttcgatggagaaaggaataatcaaatccttgaagagaacatggacgttgaaatatggacgaaagaaggggagaagaagaaattacgacctagatggctggacgctagaacttattccgaccctcttgctttaaaagagttcaaagattttgcggctggaagaaaaagtatagcattagacttggttacagaaattggcagagtgccctcacatttagctcaccgcacacgaaacgctttagacaatttggtaatgctacatacaagtgaacatggtggtcgagcatacaggcatgcggtagaagaacttccggagacaatggaaactctgttgctcttgggtctgatgatattattaacgggaggagctatgttattcctaatcagcggcaagggaattggcaaaacctcaatcggattgatatgtgttatagcatcatctggtatgctttggatggcagacgtaccgttgcaatggattgcctccgccatcgtgctggagttctttatgatggttttactaattccggagcccgaaaagcaaaggactccacaagataaccaattggcatatgtcgttattggaatcttaacactggcagcaatagtagccgccaatgaaatgggtctactagagactaccaaacgagatctcggtatgagtaaagagccgggagttgtctcgccgacttcttacttagacgtcgatttgcacccggcatcagcatggacattgtacgcagtagctacaaccgtgattaccccaatgctccgacatacaatagaaaattccacagcaaatgtatcactagctgcaatagcgaatcaggccgtggtgttaatgggtctggataaaggatggccgatatctaaaatggacttaggagttccgctgctcgccttagggtgctattctcaagttaatcccctaacgttagccgcggccgttcttctattagtaacacattatgcaataatcggtcctggtctccaagctaaagcaacaagagaagcacagaaaagaacggcagcaggcatcatgaaaaaccccacagttgacggaataatgacaatagacctagacccggtaatctacgattcgaaattcgagaaacagctaggccaagtaatgctcctggtactttgcgcggttcaactactactaatgaggacttcttgggcattatgtgaggtacttaccctagcaactgggccaattacaacgctgtgggaaggctcacctgggaaattttggaatactacaattgctgtgtcgatggcaaatatcttccgaggatcgtatttggctggagcaggactagcattttctattatgaagagtgtaggaacaggaaagcgtggaactggatcacaaggagaaactctcggtgaaaaatggaagaagaaattgaatcaattatctaggaaggagttcgacctatacaagaaatcaggaatcacagaggtagatagaactgaggcaaaagaaggtcttaaacgaggggaaataacacatcatgccgtatccagaggttccgcaaaactccaatggtttgtggaacgaaacatggtaattccagaaggacgagttatagacttaggatgtgggagaggtggatggtcgtactactgcgccggcttgaaaaaggtcacagaagttaggggatatacgaaaggaggtccaggacatgaggaacccgtcccaatgtctacctatggatggaacatagttaaattaatgtcgggtaaagatgtcttctatttgccaccagaaaaatgtgatacgttactatgtgacattggtgaatcgtctccatcgccgacagtggaggaatcgaggacaatacgagtactaaaaatggttgaaccttggctcaagaataaccaattctgtattaaggtacttaatccatatatgccaacagtgatcgaacacctggagagactacaaagaaagcacggcggaatgctagtaaggaaccccttaagtcgaaactcgactcacgaaatgtactggataagcaatgggacagggaacattgtttcaagcgttaacatggtttcacgtttattattaaatcgatttacaatgacacatcgtagaccaacaatagaaaaagacgttgatctaggtgccggaacacgccacgtgaacgctgagcccgaaacaccgaacatggatgttattggagaaaggattaagagaataaaagaggaacactctagtacctggcattatgacgatgaaaacccatataaaacatgggcatatcatggctcttatgaagttaaagctacaggatcggcttccagtatgataaacggagtcgttaaactgctcacaaaaccgtgggatgttgtaccaatggtaacccaaatggcaatgaccgacacaactcctttcggtcaacagcgtgtttttaaagagaaggtagatactcgaaccccacgtccaatgccaggaacacgtaaggttatggaaataacggcggaatggttgtggagaactttgggtaggaataaaaggccgaggctgtgtacgcgggaagaatttacaaagaaagttagaaccaatgccgcaatgggtgcagtctttacagaagaaaatcaatgggacagcgcgcgtgcggcagtagaagacgaagagttctggaaactcgtcgatcgggagagagaactgcacaaattaggcaaatgtggaagttgtgtctacaatatgatgggtaaaagagaaaagaaattaggtgagttcggcaaggctaagggttcgagagcgatatggtatatgtggcttggagcacgatacttggaatttgaagcgttaggattcctgaatgaggatcactggttctctagggaaaactcatactccggggttgaaggagaaggcctacataaactaggctatatactcagagatatatccaaaatacctggaggagctatgtatgcagatgacacagctggttgggacacgaggatcacagaagatgatctgcataatgaagagaaaattacgcaacaaatggatcccgaacaccgtcaactagcaaacgcaattttcaagctaacgtatcaaaacaaagttgttaaagtccaacgccctactcctaaaggtacagtaatggacatcatatcacggaaagatcaacgagggtcaggtcaggttggtacctacggcttaaatacattcaccaatatggaggcacaattgatacgtcagatggaaggtgaaggtgtattgtcaaaggccgatctagaaaaccctcatcccttagagaagaaaataacacaatggttagaaacgaaaggtgtagaacgattaaaacgtatggcaatttctggagatgattgcgtggtgaaaccaatcgacgacagattcgctaacgctctattagcattgaacgatatggggaaagttagaaaagacataccgcaatggcaaccttcgaaaggctggcacgactggcagcaagtacccttctgttcacaccattttcatgaactaatcatgaaagacggtagaaaattagtcgtaccatgtcgcccacaggatgaattaatagggcgtgcgaggatttcgcagggcgctggctggtccttacgcgagacagcctgtctgggaaaggcttatgcacaaatgtgggccttaatgtactttcacagaagagacttaaggttagcgtcaaacgctatatgtagtgcagtgcctgttcattgggttccaaccagccgcaccacatggtctatacacgcacaccaccagtggatgacgaccgaagatatgttaacagtgtggaatagagtttggattgaggataatccttggatggaagacaaaacaccggttaccacgtgggaagatgtaccatacctcggaaaacgagaagatcagtggtgtggttctttaataggcttgacatcaagagctacttgggcgcagaatatactaacagccatacagcaagttaggagcttgataggaaacgaagagttcctggattatatgccttcaatgaaacgatttagaaaagaagaagaaagtgaaggcgctatatggtaa

SEQ ID NO: 23544 - RNA, 9873 nt, synthetic construct
  misc_feature 1..9873: note = derived and/or modified CDS sequence (opt6) from DENV-3__JQ920487__SS-prME
  source 1..9873: mol_type = other RNA
acgtctttatgtttgatgatgatgctaccagcaacactagcttttcacttaacatcacgagacggagaaccaaggatgatagtaggtaaaaacgaaaggggcaaatcactattgtttaaaacagcgtcagggatcaatatgtgtacccttattgctatggatctgggggaaatgtgtgacgataccgttacatacaaatgcccactaataacggaagttgaaccagaagatatcgattgctggtgtaacctgacgagcacatgggtgacgtatggcacatgtaaccaggcaggagaacatagaagggacaaaagaagcgttgccttagctccacatgttgggatgggactagacaccagaacgcagacttggatgagtgcagagggtgcttggcgtcaagtggaaaaagtagaaacctgggcttttaggcatccaggatttacaattttagcattatttctagctcattacataggtacgtcgttaacacaaaaagtagtgattttcatattattaatgctagtgacccccagcatgactatgcgatgtgttggcgttggaaatagggattttgttgagggtctaagtggagccacatgggtggatgtagttttggaacacggaggttgtgtcacaactatggcgaaaaacaaaccaacactcgatatagaactacagaaaaccgaagcaactcaattggcaacattaagaaaactgtgcattgagggaaaaataactaatgttacaacagattctcgctgtccaacccaaggagaagccattcttcccgaagaacaagatcaaaactacgtttgcaaacacacttatgtagatcgaggatggggaaatggctgtggactctttgggaaaggcagcttagtcacatgtgctaaatttcaatgcttggaatcgatagaagggaaagcagtacagcatgaaaacctaaaatataccgtaatcataacagtgcatacgggagatcaacaccaagttgggaatgaaacccaaggtgtgacagcggagataacgcctcaggccagtaccgtggaagccattttgccggaatacggtacgcttggactagagtgttcaccaagaacgggtctcgatttcaacgaaatgatactccttacaatgaaaaacaaagcatggatggtccacaggcagtggttctttgaccttcccttgccttggacttcaggagctactacagaaacgcccacgtggaataagaaagaattattagtcacattcaaaaatgcacatgccaagaaacaagaggtagtagtattgggaagtcaggaaggagctatgcacaccgctctaacaggagcaactgaaatacaaaccagtggtggaacgtcaatatttgccgggcatttaaaatgcagacttaaaatggataaactggagctaaaagggatgtcttacgcaatgtgtttgaatgcctttgtgctcaagaaagaggtatcagagacgcaacatggaacgatactaataaaagtcgaatacaaaggtgaagacgcaccctgtaaaattcctttttcaactgaggacggacaaggaaaagcgcacaatggacgattgattacagcaaaccctatagtaactaaaaaggaagaaccagtaaatatagaggcagaacctccttttggagagtcgaatattgtcataggaataggggataaagcgttaaaaatcaattggtataaaaagggcagcagtatagggaagatgttcgaagcaactgctaggggcgctagacgtatggccatactaggtgacacagcctgggattttgggagtgttggtggcgtgctcaactccttgggaaaaatggtgcatcaaatttttggatcggcatatacagcactcttttccggagttagttggatcatgaagatcggtattggagtattactaacctggataggactaaatagcaaaaacacgtcaatgagtttctcatgcatagtgattggtataataaccttatacctaggagctgttgtacaagctgatatgggctgtgtaataaattggaaagggaaagaattaaaatgcggttctgggatctttgttacaaacgaggtacacacatggactgaacaatataaattccaagcggattcgcccaaaagactagcaacagccattgctggggcatgggagaatggggtgtgcggcattaggtctacaacgaggatggaaaatttattatggaaacaaattgccaatgaattaaactatattctttgggaaaataatataaaattaactgtcgttgtaggggatgttataggcgtactcgagcaaggcaaaagaacactaacaccacaacccatggaactaaaatattcctggaaaacttggggaaaagcaaaaatagttaccgctgagactcaaaattcttcatttattatcgatggacctaatacaccagaatgtccgtcagcgtcccgggcgtggaatgtatgggaagtcgaggattacgggtttggagtatttacgaccaatatatggctaaaattgagagaaatgtatacccagttatgcgatcatagattaatgtctgcagccgtaaaagatgaaagagccgtgcatgcagacatgggttattggattgaaagccagaaaaatggatcatggaaactagaaaaggcttccctaatagaggtaaaaacatgcacctggcccaaatcccacacattgtggagcaacggcgtattagaaagtgacatgataattcccaagagtctcgcaggacccataagccaacacaattaccgaccgggataccacacgcaaaccgcggggccttggcacctgggaaaacttgaattagattttaattactgcgaaggtacgacagttgtcatcactgaaaactgtggtacaagggggccaagtctcagaacgactacggtttcaggaaagttaatccatgagtggtgttgcaggagttgcacattaccaccgttgcgttatatgggagaggacggttgctggtatggcatggagattagaccgattaacgaaaaggaagagaatatggttaaatcattagtctcagcaggctcaggtaaagcggacaattttactatgggggtgttatgtttggctatcttatttgaagaagttatgagaggcaaattcggtaagaaacatatgattgcgggagcattattcacgtttgtactactcctgtccggtcaaatcacgtggcgagatatggcacacaccctaataatgattggttctaacgcctcagataggatgggtatgggtgtaacatacctggcgctgatagcaactttcaagatccaaccgttcttagcacttggcttctttctgaggaaactaacaagccgagaaaacctattactaggcgtaggactagcaatggctactacgttacaactaccggaagacatagagcagatggccaacggtatcgccctaggattgatggcccttaagttaataacgcaatttgaaacttatcaattatggacagctctcgtcagcctaatgtgttcgaacactatctttacactaacagtcgcctggagaactgcaactttaatattggcggtaatatccttactcccagtatgtcaatcctcgagcatgagaaagactgactggctcccgatgacagtggcagctatgggagtcccacccttgccattgtttatattttcgttaaaagatactctcaagcggaggagttggcctcttaacgagggagttatggcagttggcttagtatccattttggcaagctcgttcttacgtaatgatgtccctatggccggccctttggttgccggaggactacttatcgcatgctatgttataaccggtacctctgctgacttaacagtagaaaaagcagcggacgtaacatgggaagaagaggcggaacaaaccggagtcagtcacaacttaatgataacggtagacgacgatggaacgatgcgaataaaggacgacgagacagaaaatatactcacggtacttttaaaaactgcactgttaattgtaagtggaatatttccatatagcataccggctactctactcgtttggcacacatggcaaaaacaaacccaaaggtcaggcgttctttgggatgtgccaagcccgccagaaacgcagaaggccgagctggaggaaggagtttatcgaattaaacaacaaggaattttcggaaaaacacaggttggagtcggtgttcaaaaagaaggagtattccacacaatgtggcatgtaacgcggggtgccgtacttactcataatggtaaaagactagaacctaattgggccaatgtcaagaaagacctgataagttatgggggaggatggaaattgtccgcacagtggcaaaaaggagaagaagtacaagtaatagcagtagagcctggcaaaaacccgaagaacttccaaacaatgccaggaatatttcaaacaaccacaggtgaaattggcgcaatcgcactagatttcaaaccaggtacatcagggtcacccataataaacagagaaggcaaggtagtaggtttatatggaaacggtgtagtgactaaaaacgggggatatgtaagtggaatagcacagacaaatgcagaaccagatggaccaaccccagaattagaagaagagatgttcaagaaaagaaatctcactataatggacttacaccctggttcaggtaaaactcgaaagtatctgcctgctatagtaagagaagccataaaacgcagactgcgtacacttatactagcaccgacacgagtagtcgcggctgaaatggaagaagcgttaaaaggattgcctatcagatatcagactacagccacaaagagtgagcacacaggaagagagattgtagatttgatgtgtcacgcaacattcacaatgaggctcctatctccagtccgtgtaccaaattacaatctaatcgtgatggacgaggcacattttacagacccggcaagcatagcagctcgaggatacatttctaccagagtaggcatgggtgaagcagcagctatattcatgacagcaacgccaccgggtacagcggatgcctttccccagagcaatgcacccatccaagatgaagagagagacataccagaaagatcatggaacagcggtaacgaatggataacagatttcgcgggcaaaaccgtctggtttgtaccgtcaataaaggcaggcaatgacatagcaaattgcttgcggaaaaatggtaagaaagtgatccagcttagccgaaaaacattcgatacggaatatcagaaaacgaaattgaacgattgggattttgttgtgacaaccgatatcagtgaaatgggcgccaacttcaaagcggacagagtaatcgacccacgccgatgtcttaagccagtaattctaacggatggaccagagagagtcatactggccggaccaatgccagtaaccgtagcaagtgcggctcaacgaagaggacgagtaggtagaaatcctcaaaaagaaaatgatcaatacattttcactggacagcctcttaataacgatgaagatcatgcacattggacagaagcgaaaatgctgttagataacattaatacacccgaaggaattattccagcgttatttgaaccagaaagagagaaaagtgccgctatagacggagaatatcggttaaaaggagaaagtcggaaaacgtttgttgaacttatgagaaggggcgatcttcccgtatggcttgcacataaggtcgctagtgaaggaataaagtacacagatcgaaagtggtgtttcgacggtgaaagaaataatcaaatattagaggaaaatatggatgtagaaatctggacgaaagagggcgagaaaaagaaactccgtcccagatggctagacgctcgtacttatagtgatcccttggccttaaaagaatttaaagacttcgccgcaggtcgaaaatcaatagcccttgacttagtaacagaaataggtagagtgcctagtcatcttgcgcatcggacgaggaacgccctcgacaacctagttatgttgcataccagtgagcatgggggcagggcctaccggcacgctgtcgaggaactccccgaaacaatggaaacattactactgctaggattgatgattttattaaccggaggagcaatgttgtttcttattagtggaaagggaatcggaaaaacgtcaattggactgatatgtgtagtagcttcatcgggtatgctatggatggcagatgtgccattacaatggatcgctagcgcaatcgtactggagttctttatgatggtacttttaataccagaaccggaaaagcaacgaaccccacaagataatcagctagcttatgtagtaataggtatattgactctagcagctattgtcgcagctaacgaaatgggtctactcgagacaactaaaagagatctcggaatgtccaaggaaccaggagtagtttcaccgacctcatatttagatgttgacctacatccggcttctgcttggacactgtacgccgtagctacaacagtaataactcccatgttaaggcatacaattgaaaactcaactgcgaatgtaagtttagccgcaatagcaaatcaggcagtagtactcatgggattagacaagggctggccgataagcaagatggacttgggtgtacccctactagcactgggatgctactcacaagttaatccgcttacattaactgccgccgtattattgctagtaacccattacgcaatcataggtcccggtctacaagcaaaggccacccgagaagctcagaagagaactgcagctggtataatgaagaacccaactgtagatgggataatgactatcgatttggatccggtgatatatgattccaagttcgaaaaacaattaggacaagtcatgttactcgtcctgtgtgcagtacaattattattgatgcggacctcatgggcattttgtgaagcccttacattagcaactgggccaatcacaacactatgggaaggcagtccaggtaaattctggaatactactatcgccgttagtatggcaaacattttcagaggcagctatctggcaggagcaggtcttgcattttcgattatgaaaagcgttggaaccggcaagcgtgggacagggagtcaaggtgagactctaggtgaaaagtggaagaagaaacttaatcaactgtcaagaaaagaatttgatctgtacaagaaaagtggcataactgaagtagaccgcacagaagcaaaggaaggactaaagcggggtgaaataacccatcatgccgtgagcaggggtagtgccaagctacaatggtttgtggaacggaacatggtaataccagagggaagggtaatagatctcggatgtgggagaggcggatggtcatattattgtgctggactcaagaaagtcacagaagtcagaggatacactaaaggtggtcccggacatgaagaaccagttcctatgtcaacctatggttggaatattgtaaaattaatgtcaggaaaggacgtcttttacttgccacctgaaaaatgcgatacactattatgtgatatcggagagtcaagtccctcaccaacggtggaagaaagccggactattagagtactgaaaatggttgaaccatggctcaagaacaatcaattttgcataaaagtattgaacccatacatgccgactgttatagaacatcttgaaagattacaaagaaagcatggcggcatgttagtcagaaatccgttgtcaaggaatagtacgcacgaaatgtactggataagtaacggcaccggaaatatagtgtccagtgttaacatggtttctcgattactactcaatagattcaccatgacacatagaaggccaacaattgagaaggacgtagacctcggagctggtactaggcatgttaatgctgaaccagaaacacccaatatggacgtcatcggtgaacgtatccgccgaataaaagaggaacatagttcaacatggcactatgatgacgaaaatccatataaaacctgggcataccatggttcatatgaggtgaaggcgacaggatcggcatcatcaatgataaacggggtagtcaaattgctcacaaaaccctgggacgttgtcccgatggtcacacaaatggcaatgacagatacaacgcctttcggacaacagcgagtatttaaggaaaaagttgacaccaggacgccgcgtccgatgcctggaacaagaaaagttatggaaattacggcagaatggttatggagaacattgggaagaaataagagacccagattatgtacccgagaagaatttataaagaaagtgcgaaccaacgcggcaatgggcgcggtgtttacagaagaaaaccaatgggacagtgctcgtgctgcagtcgaagatgaagaattttggaaattagtggatagggaacgtgaactacataaattaggaaaatgtgggagttgtgtctataatatgatgggcaagcgagaaaagaaactaggagagttcggcaaagcaaaaggaagtagagcaatatggtatatgtggctcggagctagatacttagagttcgaggcactcggatttttaaacgaggatcattggttctcaagggagaacagccactccggtgttgagggggaggggctacacaaattgggttatatattacgcgatataagtaaaatacccggaggtgctatgtacgcagacgataccgcgggttgggacaccagaataacagaagatgatctacataacgaagagaaaattacgcaacaaatggaccctgaacatcgacagctagcaaacgcaatctttaagttaacatatcaaaacaaggttgtaaaagtacaacgacctacgccaaaaggcacggtgatggacataatatcacgaaaagaccaaagaggaagcggacaagtcggtacatatgggctaaatacattcaccaatatggaagcacagctaatacgacaaatggaaggagaaggggtcttatctaaagcagacctagagaatccacatttactcgagaagaaggttacacaatggctcgaaacaaaaggagtagaacgtctaaaaagaatggcgatttctggagatgactgtgtagttaaacccattgatgatagatttgcaaatgcactgttagctcttaatgacatgggtaaagtaaggaaagacattccccaatggcaaccgtccaaaggatggcatgattggcaacaagtaccgttctgcagtcaccattttcacgaacttataatgaaagatgggaggaagctagtggttccatgtagacctcaagacgaattaataggaagggcaaggatatcccagggagcaggatggtctctaagagaaacagcttgtttgggaaaggcttacgcacaaatgtgggcactgatgtactttcataggagagatctgcgactggcctcaaacgctatctgttcagccgtaccagtacattgggttcctacaagtcggacaacatggagtatacatgcacatcaccagtggatgaccaccgaagacatgcttactgtatggaacagagtctggatcgaggataacccttggatggaagataaaaccccagtaactacctgggaagatgtaccatatctaggtaaacgtgaagatcaatggtgtggatctctgattggcctgacttctagagcaacgtgggcccaaaatatcttgacggctattcagcaagtaagaagtctgataggtaacgaggaatttttagattatatgccaagtatgaagcggtttaggaaagaagaggaaagcgaaggagcaatttggtga

SEQ ID NO: 23545 - RNA, 9873 nt, synthetic construct
  misc_feature 1..9873: note = derived and/or modified CDS sequence (opt6) from DENV-3__JQ920488__SS-prME
  source 1..9873: mol_type = other RNA
acctcattgtgtctaatgatgatgctgccagctactctagcctttcatctaacatcacgtgacggagaaccacgaatgatagtaggcaaaaatgaaagaggtaaaagtttattatttaaaacagcatcaggaattaatatgtgcacattaatcgcaatggacctcggagaaatgtgcgacgacacagtaacttataaatgcccactaataacggaagtcgaaccagaagacatagattgctggtgtaacttaacgtcaacgtgggttacatatggaacatgcaatcaagctggagaacatagacgagataaacgatcagtagcacttgcacctcatgtgggtatgggactcgacacaagaacacaaacttggatgtcagcagaaggagcttggcgccaagttgaaaaagttgaaacgtgggcctttagacatcccggatttactattttagctttattcctggctcactatattggtacatcactgacccaaaaagtggttatattcattctcctgatgctagtaacaccgtcaatgacaatgcgatgtgtaggtgtgggtaaccgcgactttgtcgaaggtttgagtggagccacctgggtagatgtagttctcgaacatggaggatgcgtaactacaatggcgaaaaacaaacccacactagacatagaattacagaaaacagaagctacacaactagcaacattaagaaaactttgcatagagggaaaaatcacgaatgtaaccacggattctcgttgcccaacacaaggggaggcaatcttacctgaagaacaagatcaaaactacgtgtgtaaacatacgtacgtagatcggggatggggaaacggctgcggtctcttcggtaaaggttctttagtaacatgcgcaaaatttcaatgcctggaatctattgaaggaaaagctgtacaacacgaaaatctaaaatacactgtaattatcactgtacatacaggtgatcaacatcaagtaggtaacgagacacaaggcgtaactgctgagattactccgcaagcatcaacagtagaagccatactacctgaatacggaacactgggcttggaatgcagcccacgaaccggactagattttaacgaaatgattctgctcaccatgaaaaacaaagcctggatggtacaccggcaatggttctttgatctacccttaccctggacaagtggcgccacgacagaaacgccaacttggaataagaaagaactattagttacattcaaaaatgctcacgcaaagaaacaggaagtcgtagtattggggagccaagaaggtgcaatgcacactgcacttacgggcgccacagaaatacagacctctggaggcacttctatttttgctggtcacttaaaatgccggttaaaaatggacaaacttgaactaaaaggtatgtcctatgccatgtgccttaatgcgttcgtacttaagaaagaagtaagtgaaacccagcatggaaccattctaatcaaagtagaatacaaaggagaagatgccccctgcaaaatcccatttagtacagaggacggacaaggaaaagctcataatggaagattaataacagccaatccaattgtaactaagaaagaagaaccagtcaacatcgaggccgaaccaccattcggtgaaagtaacattgtcataggaataggggacaaagccctaaaaattaattggtataagaaaggatcatcaatcggtaaaatgtttgaggccacagcgcggggtgcaagacgaatggcaatattaggtgatactgcatgggattttggatccgtaggcggggtattaaacagcctaggcaaaatggtccatcaaattttcggaagtgcctacacagccctttttagtggggtctcatggattatgaaaattggcataggtgttttactaacctggatcgggttaaatagcaaaaacacaagcatgagtttttcctgtatcgtaatcggcataattaccttgtatctcggtgcagtagttcaagcagacatgggatgtgtaatcaactggaaagggaaagagcttaaatgtggtagtggtatttttgtcacaaacgaggtacatacttggacagaacaatataaatttcaagctgactcaccaaaacgattagctaccgccatagcaggggcctgggaaaatggagtatgcggaataagaagcacaacacgtatggagaacctgttatggaaacagatagctaatgaattgaattatatactgtgggagaataacattaaactcaccatagtggtgggtgacgtaattggagtcctggaacaaggtaaaagaacattaactcctcaaccgatggaacttaaatattcatggaagacttggggtaaagcaaaaatagtaacggctgaaacacaaaacagtagtttcataatagatgggcccaacacgcctgagtgcccatcagcactacgcgcatggaacgtttgggaagttgaagattacggttttggagtttttactacaaatatttggttaaagttgcgtgagaagtacactcaattatgtgaccaccgcttaatgtcggcagctgtgaaggacgagcgcgccgtccacgcagacatgggatattggatagaatctcagaaaaacgaaagttggaaactagaaaaagcctcactaatcgaagtcaaaacatgcacctggccaaagagtcacacactgtggagtaacggtgtacttgaaagtgacatgataataccaaagtcactcgcagggcctatatcacaacacaactacagacctggataccacactcaaacagccggaccatggcacctagggaaattggaattggattttaactactgtgaaggtacaacagtagttattacagagaactgtggtatccgtggcccatcactacgcacgacaacagtatcgggaaaacttatccatgaatggtgttgccgaagttgcacgcttccgccattacgctatatgggagaggatggatgctggtatggaatggaaatccgaccaatcaacgagaaggaagaaaacatggttaaatcattagtgagtgcaggaagtggtaaaacagacaattttactatgggtgtactttgtctagcaatactattcgaagaagtaatgcgaggtaaatttggtaagaaacatatgatcgccggcgctttgtttacattcgtcttactactaagcggccaaataacgtggagagatatggcacacaccttaattatgatagggtcaaatgcctcagatcgcatgggtatgggagtgacatacctggcactaattgccacattcaaaatacaacccttcttagccctaggcttctttttgagaaaactaacctctagagaaaatttgctactaggagttggtttagcgatggcgaccaccttgcaacttccagaagatatagaacaaatggccaatggtattgccttaggactaatggcattgaaattaataacccaatttgagacataccagttatggactgctctcatatcgcttatgtgttcgaatactatatttaccctaacagttgcatggagaacagctacgttaattttagcggtaatctcgctattgccagtctgtcaaagttcctcgatgcggaaaactgactggctccctatgaccgtggcagcaatgggggttcctcctctaccacttttcatattctcactaaaagacacgttaaaaagacggtcatggccgctaaatgaaggggtcatggcggtagggctcgtgtccattttggcttcttcgtttcttagaaacgacgtgccgatggcgggcccattagttgctggtgggctcttaattgcttgttatgtcataacaggaacttcagcagatcttacagttgaaaaagccgctgacgtgacatgggaagaagaagcagagcaaacaggggttagtcacaatctcatgataacagtagacgacgacggtacaatgcgaattaaggacgatgaaactgaaaacattttgacagtactcctaaaaaccgcgttattaattgtcagtggtatattcccttattccattcctgcgacattactggtctggcatacgtggcaaaaacaaacccaaagatccggtgtgctatgggacgtgcctagccctcctgaaacgcaaaaggcagaattagaagaaggcgtgtatcgtataaaacagcaagggattttcggaaaaacgcaagtaggtgttggggtgcagaaagaaggtgttttccatacaatgtggcatgtaacaagaggcgccgtattgacgcacaatggaaaacgtctggaaccaaattgggcaaacgttaagaaagatctaatttcatacggagggggttggaaactcggggcccaatggcaaaaaggagaagaagtgcaagttatagccgtcgagccaggcaaaaatccgaaaaactttcaaaccatgccgggtatatttcaaactaccactggtgaaatcggcgcaattgctttagattttaaaccaggaacaagcggtagtcctattataaacagggaaggcaaggttgttggtttatatgggaacggcgttgtcactaaaaacgggggctatgtctctggaatcgcacagactaatgccgagcccgacgggccaactccggagttggaagaggagatgttcaaaaagcggaacttgacaataatggacttacacccagggtcagggaaaacgagaaaataccttccagctatcgttagagaagcgattaaacgacgactcaggacactaattttggcgcccacacgagtcgtagcagcagaaatggaagaagccctaaaaggactacctatacgctatcagacaactgcgactaagtcagaacatacgggcagagaaatagtagacttaatgtgccatgccacgtttactatgagactgttgagtccagttagggtacccaattacaacttaatagtgatggatgaagctcacttcactgaccctgcctccattgcagccagaggttatataagcacaagggttggtatgggagaggctgctgcaattttcatgacggcgacccctcctggtactgctgatgcattcccccaaagcaatgccccgatacaagatgaagaacgtgacataccagaacgatcgtggaactccggtaatgaatggataactgattttgctgggaagaccgtgtggttcgttccgtcaatcaaagctggtaatgatattgcaaactgcctcaggaaaaacggcaagaaagtaattcaactctcaagaaagactttcgataccgaataccagaaaacaaagttaaatgactgggattttgtcgttacaacggatataagtgaaatgggagctaatttcaaagcggacagggttatagatcctagaaggtgtttaaagccagtaatattaacagatggccccgaacgcgtcatattagctggacctatgcctgtcacagtagcatcggctgcccaaagaagaggaagagtcggtagaaacagccagaaagaaaatgatcaatatatatttaccggtcagcctcttaataatgatgaagatcacgcacattggacagaagctaaaatgttacttgataacataaatacgcctgagggtataatcccagccctcttcgaacccgaacgagagaaaagtgccgccatagatggggaatatagactgaagggtgaaagccgtaagacttttgtagaacttatgcgccgaggagacttgccggtgtggctcgcacataaagttgctagtgaaggtattaaatatactgaccgtaagtggtgtttcgatggagaaagaaacaaccaaattttggaagaaaacatggatgttgagatttggactaaagaaggcgagaagaagaaattacgtccaagatggctagatgctagaacatatagtgacccactggctcttaaagaatttaaagacttcgctgcaggcaggaaatctatcgcgcttgatctcgttacagagataggaagagtaccctcacatcttgcccatcgaactagaaatgctctagataatttagtaatgctacatacatctgaacacgggggcagagcatatcgacatgcagttgaagaactgccagagacgatggaaacattacttctattagggctcatgatactattaacaggaggggcgatgctatttttaatatcaggaaaaggaataggtaagacatctataggattaatttgcgtagtggcaagctcagggatgctctggatggcagatgttcccctacaatggattgcaagtgctatagtcttagagtttttcatgatggttctccttatccctgagcctgaaaaacagcggacacctcaagataaccaacttgcttatgtcgtgataggcatattaaccctagcggcaatagtagccgcaaacgaaatggggttactggaaaccacaaaacgtgatctgggaatgtccaaagaacctggagtcgtatctccaaccagttatttagatgtagacctacacccagcatccgcatggacattatatgcggtagcaactacagtgattactccaatgctgagacacacaatagaaaatagcacagctaatgtgtcattagctgcaatcgcaaatcaagctgtagtgttaatggggttagacaaaggttggccaattagtaaaatggacctcggtgtacctttgttggctttaggttgctatagtcaggtcaacccgttaacactaactgctgcagtcctcttgctagttacccattacgctataataggtcctggtttacaagctaaggcgacaagagaagcacagaaacgcaccgccgcaggaatcatgaagaatccaactgtggatggaataatgacgattgacctagatccagtaatttacgatagcaaatttgaaaaacagttgggtcaagttatgttattggttttgtgcgcggtccagctacttttaatgcgcacaagttgggctttctgtgaggctttaactttagcgacaggaccaattactacactttgggagggctcgccgggaaaattttggaacactaccattgccgtctcaatggcaaatatatttagaggatcttacctggcaggagcagggctggcattctcaattatgaaatctgttgggacaggcaaacgtggcacaggttctcaaggagaaacgttaggcgagaagtggaagaagaaattgaatcaactatctcgaaaggagttcgacttatacaagaagtccgggataactgaagtagaccgcacagaagcaaaagaaggtttgaaaagaggcgaaattacacatcatgcagtaagccgagggtccgcgaaacttcaatggttcgtcgagcgaaatatggttatccccgaaggaagagtaatcgatctgggttgtggcagaggaggctggtcatattattgcgctggactcaagaaagtaacagaggtcagaggctataccaaaggagggccgggtcatgaagaacctgtccccatgtcgacctatggctggaatatcgttaaattgatgagtgggaaagatgtcttttatttaccgccggagaaatgtgacaccttattgtgtgatataggtgagagctctccaagtccaaccgttgaagaaagtaggacgataagagtattaaaaatggtagaaccctggttaaagaacaaccagttttgtattaaagtgcttaacccttatatgcccacggttatagaacacctggagcggcttcagcgtaagcacggtgggatgcttgttagaaatccattgtccagaaactctacgcatgagatgtattggatcagcaacggaactggtaatatagtctccagtgttaacatggtatcacgattactgttaaataggtttacaatgacacatagaagaccaacgatagagaaggacgttgaccttggagccggaacacgacacgttaatgccgagccagagacacctaacatggatgtaataggtgaaagaattagacgtataaaagaagaacattctagcacatggcactacgatgatgaaaacccttataagacatgggcataccacggaagttatgaggtaaaggcgaccggttcagcttcatccatgataaacggtgtagttaagttacttacaaaaccctgggacgtagtacccatggtaactcaaatggcaatgacagatacaacgccatttggtcagcaacgagtgtttaaagaaaaagtcgacacaaggacacctagacctatgcctggaacgagaaaagttatggaaattacagcagaatggttgtggcgaactttaggacgtaataagcgacccagactgtgtaccagggaagagttcattaaaaaggttagaactaatgcggcaatgggtgctgttttcacggaagagaatcagtgggattcagctcgagcagctgttgaggacgaagaattttggaagctagtggaccgcgaaagagaattacacaaattaggtaagtgcggttcatgcgtttacaacatgatgggaaaaagggagaagaaactaggagaatttggtaaggcgaaaggttcacgcgctatttggtatatgtggttaggagcaagatatctcgaatttgaggcactaggttttctgaatgaagaccactggttcagtcgagaaaatagccattccggggttgaaggagaagggttacacaaactggggtacatacttagggatatttctaaaataccaggtggagccatgtatgcagatgacacagctggctgggacacaaggatcactgaagatgacttacataatgaagagaaaataactcagcaaatggacccggaacacagacaacttgcaaacgcaatatttaaactaacgtaccagaataaagtagtcaaggtgcaaaggccgacacctaaaggcaccgttatggacataataagcagaaaagaccagaggggttcaggacaagtaggtacgtatggtcttaatacgtttacaaatatggaagcccaactaatacgacaaatggagggtgaaggggtcctcagtaaggcagacctagaaaatccgcacctactagagaagaaagtcacccaatggttggaaacaaaaggcgtagagaggttaaagcgtatggcaataagtggcgatgattgtgttgtaaaacccatcgatgacagattcgctaatgcattattggccttaaacgatatggggaaggtacgaaaagatattccccaatggcaaccctcaaaagggtggcacgattggcaacaagtacccttctgctctcaccatttccacgaattgattatgaaagacggacgaaaattggtggtaccgtgtaggccacaagatgaattaataggaagggctaggatttctcaaggggccggttggtcactgagagaaactgcatgccttggaaaggcctacgctcaaatgtgggctctaatgtacttccaccggagagatttaagacttgcctctaacgcaatttgtagcgcagtaccagttcactgggtaccaacatcaagaacgacttggagtatacatgcccaccatcaatggatgacaactgaagacatgctcactgtttggaatagagtttggatcgaagacaacccttggatggaagacaaaacaccggtgacaacatgggaagacgtcccatacttgggaaagcgggaggatcaatggtgcggctcattgattggattaactagcagagcaacgtgggcacaaaacatcctaacagccatccaacaggtacggagtttaataggcaatgaagaatttttagactatatgccgtccatgaaaagatttagaaaagaagaagagtccgaaggagctatatggtaa

SEQ ID NO: 23546 - RNA, 9873 nt, synthetic construct
  misc_feature 1..9873: note = derived and/or modified CDS sequence (opt6) from DENV-3__JQ920489__SS-prME
  source 1..9873: mol_type = other RNA
acttctctgtgcttaatgatgatgctcccagcaacattagcattccatttaacaagccgagatggggaaccgcgaatgattgtaggtaaaaacgaacgcggtaaaagtctattatttaaaacagcatcagggattaatatgtgcactttgattgccatggatttaggagaaatgtgcgacgatacggtaacgtataaatgccccttaatcacggaagttgaaccagaagatattgattgttggtgtaaccttacgtcaacatgggtaacctacgggacgtgtaatcaagctggtgaacatcgaagagataaaagatctgttgcactagcacctcatgtaggtatgggacttgataccagaacacaaacatggatgagtgcagaaggagcatggagacaagtagaaaaagtagaaacttgggcttttagacacccaggatttacaatattggcgttgttccttgctcactatattggaaccagtctaactcaaaaagtcgtcatattcatcttgctcatgctggttacacccagcatgacaatgagatgtgtaggagtgggtaatcgcgattttgtcgaaggtttgtcgggagctacatgggtagatgtcgttttagaacacggagggtgtgtcaccactatggccaaaaacaaaccaactttagacatagaactgcagaaaacagaagccacgcaattagctactctacgaaaactatgtatagaaggcaaaattacaaacattactaccgactcccgatgcccaacacaaggagaagctatcctacctgaagaacaagaccaaaattatgtgtgcaaacacacatacgtagatcggggttggggaaatggatgtgggcttttcggaaaaggatcgcttgtcacgtgtgctaaatttcaatgcctagaaagtatagaagggaaagcagtacaacacgaaaacttgaaatatacagtaattataacagtgcatacaggcgatcaacaccaagtaggcaatgaaacgcaaggtgttacagccgaaataacaccacaagcatcgactgtcgaagcgattttacctgaatacggaaccttaggattagaatgttctccacgtacgggattagattttaatgaaatgatacttcttactatgaaaaacaaagcatggatggtccataggcaatggttctttgatctcccattgccatggacaagcggagcgacaacagaaacaccgacttggaacaagaaagaactgttagtgacatttaaaaatgctcacgccaagaaacaagaggtagtggtcttaggcagccaggaaggtgcaatgcacacagcgcttactggtgcaaccgagatacaaacttctggaggaacatcaatattcgcaggacatttgaaatgccggcttaaaatggacaaacttgaactaaaaggaatgagttacgcgatgtgtttaaatgcctttgtactcaagaaagaggtttcagaaacacaacacggaacaatactaataaaagtagagtataaaggggaagatgccccgtgtaaaatccctttcagtaccgaagatggccagggtaaagcacacaacgggcgtttaataacggcaaaccctatagtaaccaagaaagaggagcctgtaaatatagaggccgaacctccatttggcgaatctaatattgtgataggaataggagataaagcattaaaaataaattggtacaagaagggtagttcaataggaaagatgtttgaagcgactgctagaggcgcacgtaggatggcgattctaggtgacaccgcatgggacttcgggtcagtaggaggagttttaaactcactaggtaaaatggttcaccaaatattcggatcagcatacacagctctcttttctggtgtgtcgtggattatgaaaattggtattggcgtgcttctaacctggattggtctaaattcgaaaaatacctcaatgagtttctcgtgcatagttatagggataattacactatatctaggtgcggtggtgcaagcagatatggggtgtgtcataaattggaaagggaaagaacttaaatgtggatctgggatatttgtaaccaacgaagtgcatacctggacagaacaatataaattccaagcagacagtcccaagcgactagcgaccgcaattgctggtgcttgggaaaatggagtttgcggtatacgcagcacaacccgcatggaaaatcttctttggaaacagatagcaaatgaactaaattacatactatgggagaacaatataaaattaacaatcgtagttggagacgtaataggtgttctggaacaaggcaaaagaactctcaccccacaaccaatggaactaaaatactcatggaaaacttggggaaaagcaaaaatcgtaacagcagaaacacaaaattcctcgtttataatagacgggccaaatacaccagaatgtccctcggcatcaagagcatggaatgtttgggaagtagaagattacggttttggtgttttcaccactaatatatggcttaaattgagagagaagtacactcaattatgtgatcatagattaatgagtgctgccgtcaaggacgaaagggccgtgcacgcagatatgggatattggatagaatctcagaaaaacggttcttggaaattagaaaaggcctcattaatagaagtgaagacttgtacgtggccgaaaagccacacactctggagtaatggtgttcttgagtcagatatgataataccaaaatcattagcaggtccaatatcgcagcataattatagacctggataccatacacaaacagccgggccatggcatctaggaaagttagaattagattttaattattgtgaagggactacagtagtcattacggaaaattgtgggatcagaggcccatcgttacggacgacaacagtaagcggcaaactaatacacgagtggtgttgtcgaagttgcacattaccaccccttcggtacatgggagaggatggttgctggtatgggatggagatccggccaattaacgaaaaagaggaaaatatggtaaaatcattggtaagcgcagggtcagggaaaactgacaattttaccatgggagttttgtgtctggcaattctgtttgaagaggtgatgcggggaaaattcggtaagaaacatatgatagcaggagcattattcacctttgtattattactcagcggacaaataacatggcgcgatatggcccacactctaataatgattggatccaacgcatcagatcggatgggtatgggggtgacatacttagcactaattgctacttttaaaattcaaccgttcttggctctagggttcttcttacggaaactcacatcgagagaaaatctcttgctaggagtgggtctggcaatggcaacaacgcttcaactaccggaggacatcgaacagatggctaacgggatcgcattagggctcatggcgttaaaattaattacacagttcgaaacctatcagttatggactgccctcattagtctaatgtgctcaaacacaatttttaccttaacagtcgcgtggcggacagcgacactgattctagctgttatcagcttgctgcccgtgtgtcaaagctcatcaatgaggaaaacagactggctaccaatgactgtagctgcgatgggagttccgccattaccattgtttatcttcagtctaaaagacacgctgaaacgccgaagttggccattaaacgaaggcgtcatggccgtcggtttagtgagcatactagcttcttcctttttgaggaatgacgtaccaatggcggggccactggttgcgggcggtctactcattgcctgttatgttatcacaggaacctcggcagatctaactgtagaaaaagccgccgacgtgacatgggaagaagaagctgagcaaactggtgtgtctcacaatcttatgataacagtagacgacgatggaactatgagaattaaagacgatgaaacggaaaacatactaacagttctactcaaaacagcattgttaatagtaagtggtattttcccatatagtattccagcaacacttttggtttggcatacgtggcaaaagcagacacaaaggagcggggtactatgggatgtacctagtccgccagagacacaaaaggcagaattggaagaaggcgtgtatcgcattaaacaacagggtatctttgggaaaacacaggtgggtgtaggcgtccaaaaggaaggtgtcttccatacgatgtggcacgtcacgagaggggctgtacttacacataacggtaaacggctagaacctaactgggctaatgtcaagaaagatttaatcagttatggcggtggatggaaattgagcgcccaatggcaaaaaggagaagaggtacaagtgatagcagtggaaccggggaaaaatcccaaaaattttcaaactatgccaggaatatttcaaactacaaccggtgaaataggagccattgcattagatttcaagcctggaacatccggatcaccaattataaatagagaaggaaaagtagtaggattgtatggaaatggagtagtcacaaagaacggtggatacgtttcaggcattgcgcaaacaaatgctgagcccgatggaccaactcccgagctagaagaagaaatgtttaaaaagagaaatttaacaataatggatctacatccaggaagcggtaaaactagaaaatatcttccagcgatcgtgagggaggccattaaacgccggttacgaactctcattttggcacccacaagagtagtcgccgctgagatggaagaagcgctaaagggacttccgatacggtaccaaacgactgcaacaaaaagcgaacacactgggagagaaatagtggacttgatgtgtcacgcaacgttcacaatgaggcttttatcaccagttcgtgtaccaaactataaccttatagtaatggatgaagctcacttcacagacccagcctccatagccgctaggggatatatatccacgagagtaggcatgggagaagccgcagcaatatttatgacagcgactccacctggtactgcagacgcttttccacagagtaacgcaccaattcaagacgaagaacgggatatacccgaacggtcatggaatagtggaaatgaatggataacagatttcgcaggaaagactgtgtggtttgtaccctccataaaagcgggaaatgatatcgcaaattgcttacgtaaaaacggtaagaaagtgatccagctaagtcgaaaaacattcgacacggaatatcaaaagacaaaattaaacgactgggactttgtagtaaccacggacattagtgaaatgggcgctaacttcaaagccgatagggtaattgatcccagaagatgtctcaagcctgtgatattgacggatggaccagaaagagtaatattagcaggccccatgccagtgactgtagcgagtgccgcgcaaagaagaggacgtgtgggacgcaattcacaaaaagagaatgaccaatatatattcacgggacaacccctcaataacgatgaggatcatgcacactggactgaagccaaaatgctactcgataatattaacacacccgaaggaattatcccagctttatttgaaccggaacgtgagaaaagtgcagcaatagatggcgaatatagacttaaaggtgaatctaggaaaaccttcgtagaactcatgagaaggggagatttaccagtatggctcgcacataaagtggcatcggaaggtataaagtacactgaccgaaaatggtgctttgatggtgaacgaaataaccaaattttagaagagaatatggacgtagaaatatggacgagagaaggagagaagaagaaactacgacccagatggctcgacgctagaacatatagtgaccctctagctttaaaagaatttaaagattttgcagctggaagaaaatcaatcgcattagatcttgtcactgaaattggccgagttccttcacatttagcacaccgcacgaggaatgcattggataacttagtaatgctgcacacatcggaacacggcggacgagcttatagacatgctgtggaggaattacccgaaacgatggaaaccttactattgttggggttaatgatcttactaacaggtggagcaatgttattcttgataagtggaaaaggtattggaaaaacttcaataggactgatttgcgttgttgctagcagtggaatgctatggatggctgatgtcccgctacaatggatagcttcagcaatagtccttgagttcttcatgatggtattacttattccagaacccgaaaaacagaggacaccacaagataatcaactcgcatatgtcgtaataggcattctaacattagctgcaatcgtagcagcaaatgagatgggattattagagaccacaaaaagagatcttggtatgagtaaagaaccaggagttgtaagccctacatcgtatttagatgttgacctacacccagcaagtgcctggaccctttatgcggtagcaactacagttataacgcccatgcttagacataccattgagaatagtacggcaaacgtcagcctcgcagcaatagctaatcaagcagtggttttaatggggcttgacaaggggtggcccatttccaaaatggacctaggggtaccactcttggctcttggatgttattcacaggtaaatccacttaccctaacggcggccgtattattattagtcacccattacgctataataggacccgggcttcaagcgaaagcaactagggaagcccagaaaaggacagcagccggcattatgaaaaatccaaccgtagatggaattatgacaatagacctagatccggtcatatacgatagtaaatttgaaaaacaactaggtcaagtaatgcttcttgtactatgtgcagtacaattactactgatgaggacttcgtgggctttctgtgaagcgttaacccttgctacaggaccaataacaaccttatgggagggatcaccaggaaaattttggaatacaactatagcagtgtctatggctaacatattccgtggtagttacttggcgggagccggtcttgctttctccataatgaagagtgtcggcactggtaaaaggggtaccggttctcaaggagagacattgggcgaaaaatggaagaagaaacttaaccagctgagtcgaaaagagttcgatttatacaagaaaagcgggataacagaagtagaccggattgaggcaaaagagggattaaaaagaggagaaataacccatcatgctgtctctagaggctcagccaagctgcaatggttcgttgagcgtaatatggtaattcctgaaggaagagtaatcgacctgggatgcggacgtggagggtggtcatactattgcgcaggcctgaagaaggttacagaagttcgcggctatacaaaaggtgggccagggcacgaagaacctgttcctatgtcgacatacggatggaacatcgtaaaactcatgtctggtaaggatgttttctatctccctcctgaaaaatgtgacacactattatgtgatattggtgaaagcagtccatcgcctacggtggaagaatctagaacgataagggtactaaaaatggtggaaccatggctcaaaaacaatcagttttgcataaaggttttaaatccatatatgcctacagtaatcgagcatctagagcggctccaaagaaaacacggtggcatgcttgtaagaaatccgctatctagaaatagcacacacgaaatgtactggatatctaatggcacaggcaacatcgtctcttcagttaatatggtatctcggctattactaaacagatttacaatgactcatagacgtccgacaatagagaaagatgtagacttaggtgctggtacacggcatgtgaatgccgagccagaaacaccaaacatgaacgtgatcggcgaaagaattagacgaatcaaagaggaacatagcagcacctggcactacgatgacgaaaacccctataaaacatgggcctatcatggatcctacgaagtcaaagccactggttcagcctcttcaatgataaatggtgttgttaaactactaactaagccatgggacgtcgtgcctatggtaacgcaaatggcaatgaccgacactacaccatttggacaacagagagtatttaaagaaaaagtagatacacgaaccccgcgaccgatgcctggtacacgaaaagtaatggaaataacggctgagtggttgtggagaacattggggcggaataagcggccaagactttgtacgcgggaagagtttataaagaaagtccggacaaatgctgcaatgggggcagtatttaccgaagaaaaccaatgggactcggcaagagcagccgttgaggacgaggagttttggaaattggtagaccgagaacgagaacttcataaattgggaaaatgtggttcttgcgtctacaatatgatgggaaaaagggagaagaaattaggagaatttggaaaagcaaaaggaagtagagctatatggtatatgtggttgggagcacgttacctcgagtttgaggctttgggtttcctaaatgaagaccattggtttagtagagaaaattcacacagcggggtcgaaggagaaggattgcacaagttagggtatatccttagagacatcagcaaaataccaggcggcgcaatgtatgctgatgatactgctggctgggatacacgaatcaccgaagatgatcttcataacgaggagaaaataacacagcaaatggaccctgagcatagacaattagctaacgctattttcaaattaacttaccaaaataaagtcgtaaaagtgcagagaccaacccctaagggcaccgttatggatataatctcgcggaaagatcaaaggggtagtggacaagtaggaacatatggattgaatacctttactaacatggaagcccagctaattagacagatggaaggtgaaggtgtactctcaaaggctgatttagaaaacccgcatttactagagaagaaagtgacgcagtggttggaaacaaaaggagttgaaaggttaaaacgcatggcgatatcgggtgatgattgtgtggttaaaccgatagatgaccgtttcgcaaacgctttactagcattaaacgatatgggtaaagtgagaaaagatataccacaatggcaaccctccaagggatggcatgactggcagcaagtacctttctgctctcatcactttcacgaactaataatgaaagacggtagaaaattggtagtcccttgtcgaccacaggacgaactcataggtagagctaggataagccaaggtgcgggttggtccctacgggaaactgcctgtctaggtaaagcgtacgctcagatgtgggcattgatgtacttccatcgacgtgatcttaggcttgcttcaaatgccatttgcagtgcggtgccggtccactgggttccgacaagtcgcactacgtggtcgatccatgcccatcaccaatggatgacaactgaagatatgctaacagtgtggaacagagtatggatcgaagacaatccttggatggaagacaagacacccgtaacgacttgggaggatgttccctacttagggaaaagggaagaccaatggtgtggaagtttaataggtctgacaagtcgtgcgacttgggcacagaatatcttaactgccattcaacaagttagatcacttattggcaacgaagagttcctagattacatgccgagcatgaagagatttagaaaagaagaagaatcggaaggagctatctggtaa

SEQ ID NO: 23547 - RNA, 9873 nt, synthetic construct
  misc_feature 1..9873: note = derived and/or modified CDS sequence (opt6) from DENV-3__KF824902__SS-prME
  source 1..9873: mol_type = other RNA
acatccctatgtttaatgatgatgctacctgcaacattagctttccacttgaccagcagggatggagaaccacgtatgatagttggcaaaaatgaacgaggaaaaagtttactatttaaaactgcatctggaattaacatgtgcacattaattgcaatggacttaggggaaatgtgtgatgataccgttacatataaatgtccactaatagcagaagttgaacccgaagatatcgactgttggtgtaatttgacgagcacttgggtcacgtatggaacatgcaatcaagcgggtgaacaccgaagagacaaacgatctgtggcgttagcgcctcatgttggcatgggattagacacgcgaacgcaaacgtggatgtccgcagaaggggcatggagacaggtagaaaaagttgaaacctgggcattacgtcaccctggttttactatattagctctatttctagcgcactatattggcacatcattaacacaaaaagtggtaatttttatattattaatgctggtaacacctagtatggctatgcgttgtgtcggggtaggaaacagagatttcgtggaaggactaagtggcgcaacctgggtagacgtggtactagaacacggaggctgcgtaactaccatggctaaaaacaaacccaccctagacatagaactccagaaaaccgaggcaacacaattagcaacgttgcggaaactatgtatagagggcaaaataactaatataaccaccgatagcagatgtccaactcagggagaagctattttgccagaggaacaagatcaaaattatgtctgcaaacatacttatgtagatcgcggctggggcaatggttgtggtctatttggaaaaggatcactcgtaacatgtgccaaatttcaatgcctagagtcaattgaaggtaaagtagtacaacacgaaaatttaaaatatacggtgacaataacagtacacacaggagaccagcatcaagtgggcaacgacacccaaggtgttaccgcagaaattactcctcaggccagtacagtagaagctatactgccggaatatggtacacttggactagaatgctctccgagaactggattagatttcaacgaaatgatattgttaacaatgaaaaataaagcctggatggttcatcggcaatggttctttgatttacccctcccgtggacctctggtgcgactacagagacgcctacctggaatagaaaagagttacttgtaacatttaaaaacgctcatgccaagaaacaagaagtggttgtgctaggatctcaggagggggccatgcatacagccctcacgggagctacagaaatccaaaactccggaggcacgtccatatttgctggacacctaaaatgcaggctaaaaatggataaattagagttaaaaggaatgagctatgcaatgtgtttgaatacgtttgtactaaagaaagaagtctcagagactcagcacggaacaatattaataaaagttgaatacaaaggagaagacgcgccatgcaaaattccgttctctactgaagatgggcaaggtaaagctcataatggccggcttatcacagcaaacccagtcgtgactaagaaagaggaaccggtcaacatagaagccgagcccccttttggagaatccaatatagtcataggaataggtgataaagcactaaaaatcaattggtacaagaaaggtagttcaataggaaaaatgtttgaagcgaccgcaagaggtgcccgcagaatggccatattaggtgatactgcttgggattttggctccgtagggggagtattaaactccttaggaaaaatggttcatcaaatatttggctcggcatatactgccctctttggtggcgtaagctggataatgaagattggaatcggagtcttgttaacctggatcggactaaattccaaaaatacatccatgtcgttcagctgtatagttattggtattataactttgtatctcggcactgtggttcaagccgatatgggatgtgtgataaactggaaaggtaaagaactaaaatgcggatcaggaatttttgtgactaatgaagtccatacatggacagaacaatacaagttccaggctgacagtcccaaaagacttgcaacagcaatagctggcgcttgggagaatggagtatgcggaatacggtctacaacccgaatggaaaacctgctttggaaacagatagcaaatgaattgaattatatactatgggaaaataatataaaattaacggtagtagtaggggatattattggtgtactggaacaaggtaaacgggccttaacccctcaaccaatggagttaaaatattcttggaaaacatggggaaaagctaaaattgttacagccgaaatacaaaatagctccttcattattgatggaccgaataccccagagtgcccttcagcctcacgagcttggaacgtatgggaagtagaagattatggatttggtgttttcactaccaacatatggcttaaacttagggaagtatatactcaaacctgcgaccatcgactgatgagcgctgcgataaaggatgagcgagcagttcatgccgatatgggatactggatagaatctcagaaaaatggaagctggaaattggaaaaagcctcgtttattgaggtaaaaacctgcacctggcctaaaacgcacacactatggtccaatggagtacttgaatcagacatgatcatacccaaatcactcgccggacctattagtcaacataatcacagaccaggctatcatactcaaacagccggcccttggcatttaggaaaattggaattagactttaattattgcgaaggtactacagttgtaatcactgaaaattgtggcaccagaggacctagccttaggacaacaactgtgtcaggaaaactgatacatgaatggtgctgcagatcatgtacactaccaccactaagatatatgggtgaggacggctgttggtacggcatggagattcgtcctataaatgagaaagaagaaaatatggtaaaatcacttgtatccgctggttcaggtaaggttgataattttacaatgggagtcttatgtctagcaatattatttgaagaagtaatgcgagggaaattcggtaagaaacacatgatagcgggggtgctctttactttcatgctactccttagtggtcaaataacttggagagacatggcacatactttaatcatgattggatcgaacgcctctgatcgaatgggaatgggcgtaacttatctagctctaatcgcaactttcaaaatccaacccttcttagcattaggattctttcttagaaaattgacttctagagaaaatttgcttttaggtgtgggcttagcaatggccactactcttcaacttcccgaagacattgaacagatggcgaatggcattgcgcttggactcatggcactaaagctaatcacacaattcgagacataccaactttggaccgcattagtttccctaacctgcagtaacacaatattcactttaactgtcgcatggcgaacggctacccttatattagctggagtttcgctcttgccagtatgccaaagctcaagtatgagaaaaactgactggttacctgtagccgttgcagccatgggtgtgcctccattacccctttttatctttagcttgaaggacacattgaaacgacgaagctggccattaaatgaaggcgtaatggcagtaggcttagtatctatactcgcctcatcactcctaaggaatgatgtaccaatggcaggaccgttagttgctggtggcttgcttatcgcttgttacgtcattaccggtacctcggcggatttgaccgtcgaaaaggctgccgatgtaacatgggaggaagaagctgaacaaacaggagtttcccacaaccttatgattactgtagacgacgatggaacaatgcgaataaaggacgacgagacagaaaacatcctaacagtattgcttaaaacggccttactgatagtaagtgggatctttccatacagcataccagcgactctcttagtatggcatacatggcaaaaacaaacacaaagaagtggtgttctctgggatgtcccaagtcccccggaaacccaaaaggcagaacttgaagaaggagtttatagaataaagcagcaaggaattttcggcaaaacacaagtcggtgtaggagtacagaaagagggcgttttccatacaatgtggcacgtaacgagaggtgcggtactaacacataacggaaaaagacttgaacctaattgggcaagcgttaagaaggatcttatttcatacggaggaggctggcgtctatcagctcaatggcaaaagggcgaagaagtgcaagtaatagcagttgaaccaggaagaaatcctaagaattttcagactatgccaggaatattccaaaccacaacaggtgaaataggtgccatagccctcgactttaaacctggaacaagtggctcgccaataattaatagagaaggaaaggtggtaggattgtatggaaatggcgttgtaaccaaaaatggcgggtatgtatccggaatagcccaagcaaacgcagaaccagaagggccaacacctgaattagaagaagagatgttcaagaaaaggaatttaacaattatggatttacacccaggttctggcaaaacgcgaaaatacttgcctgcaatcgtccgtgaagcgatcaaaagacgtctgcgcacattgatattagcacccacaagggtcgtcgctgctgagatggaagaagcactaaaaggattgccaatccgttatcaaacaacagccacaaaatcagaacataccgggcgtgaaatagtagttcttatgtgtcacgccactttcacaatgagactactctcgccggtaagggtgcctaattataacctgataataatggacgaagcacattttacggatccggccagcatagcagcaagaggatatatatctactcgtgttggaatgggagaagctgcggcgatatttatgacagccactccgccgggaactgcagaggcatttccacaatccaatgcccccatccaggacgaagaaagagatatacctgaacgcagttggaatagtggcaacgaatggattacagacttcgtcggcaaaacagtatggttcgtaccctcaataaaggctgggaacgatattgcgaactgtttgaggaaaaacggtaagaaagttatccagttatcaagaaaaaccttcgacacagaataccaaaagactaaactaaatgattgggatttcgttgtgacaacagacatttcagagatgggtgccaactttaaagctgatagggtaatagatccgcgaaggtgtttaaaacccgtgatacttacggatggtccagaaagagtaatactagccggaccaatgcctgttacagcagcgtccgcagcacaaaggaggggccgagtaggcagaaatcctcaaaaagagaacgatcaatatattttcatgggtcagccattgaataatgatgaggatcatgcacattggaccgaagccaagatgctattagacaatataaacactcccgagggaattatacctgcgttatttgagcctgaaagagaaaaatctgcagctatagatggagaataccgtttaaaaggagagtcaagaaagacatttgtagagttaatgcgaagaggggacctaccggtgtggctagcccataaagtagcttccgaaggaatcaaatatactgataggaagtggtgctttgatggggaaagaaacaaccagatattagaagaaaatatggatgtagagatctggacaaaagaaggcgaacgaaagaaactacgtccaagatggctcgacgctagaacatatagcgacccattagcgttgaaagagtttaaagactttgccgctgggcggaaatcaatagcattagacctagtaaccgaaataggcagagtgccaagccatttagctcatcgaacacgtaatgcgctagataacttagtaatgctccatacctcggaacacgggggcagagcttaccgacacgcagttgaagaattacccgaaactatggagaccttgttattacttgggttaatgatcctattgacaggaggtgcaatgcttttcctaatctcaggaaaaggcatcggaaagacgagcatcgggcttatttgtgttatagttagttctggaatgttgtggatggctgatgtcccattgcaatggatcgctagtgcaatagtattagagtttttcatgatggttctattaattccagagcccgaaaaacaaaggacgccacaagacaaccaactagcgtatgttgtaataggtatattaacactagcagcaattgtcgcagcaaatgaaatggggttgcttgaaacaacgaaacgcgatctaggcatgtccaaagaacccggtgtggtcagccccacaagttatctcgatgtcgacctacacccagctagcgcatggacgttatacgcggttgcaactacagtgataactccaatgctacgtcataccattgaaaattcgactgcaaatgtcagtttagcagccatagctaatcaggcggtagtgttaatgggattagacaagggatggcccatatctaaaatggacttaggagtacctctattagcactaggctgctattcccaagtcaatcctctaacacttacagccgcagtgttactgttggtaacccattacgcaattatcggacctggtttacaggcgaaggccacgagagaagcacagaaaagaaccgcggcgggtataatgaaaaaccccacagtagatggcataatgacaattgatctagacccagtgatctatgatagtaaatttgaaaaacagctaggtcaagttatgttacttgttctatgtgctgtacagttactattgatgcgcactagctgggccttatgcgaagctctcacactagctacgggtccaataacaactctttgggaaggaagtcccggcaaattttggaacacaacaattgcagttagcatggctaacattttccgcgggagttatttggcaggagctggattggcctttagtattatgaaaagtgtaggtacaggaaaaagggggactggctcacaaggtgagacacttggcgaaaaatggaagaagaaactgaatcagctatcgcggagagagttcgaattgtacaaaaagagcgggatcaccgaggtggatcggacggaggcaaaagaaggacttaagcgaggagaaaccacacatcatgctgtatcaagaggatcagcaaaactacagtggtttgtagaacgtaatatggtcataccggagggacgcgtaatagacttaggctgcggtagaggaggttggtcatactattgcgccggcttaaagaaagtcacagaagtgagaggttacacaaaaggtggcccaggtcatgaagaaccagtcccaatgtccacgtacgggtggaatacagtaaagctaatgagcggaaaagatgtgttctatctgccgccagaaaaatgtgatacactattatgcgatataggtgaatcgtccccttcaccaactgtcgaggagtcaagaactatacgagtgcttaaaatggtcgagccctggctcaaaaacaatcaattctgtattaaggtgttgaatccatatatgccaacagtaatcgagcatttggaaagactacaacgaaaacacggaggtatgttagttagaaatccactatccagaaactcaacacatgagatgtattggattagtaatggaactggcaatatagtatcatcggttaacatggtttcaagacttcttctaaaccgtttcacaatgacacaccgccggccaacgatcgaaaaagacgtggacctcggagctggtacaagacacgtgaacgctgaaccagagacaccgaatatggatgtaattggggagagaattaaacggattaaagaagaacatagctcaacatggcattatgatgatgagaacccctacaagacgtgggcctatcacggaagctatgaagtcaaagcgacgggaagcgcaagctctatgattaacggagttgtaaaactattgactaagccatgggatgtagtacctatggtcacacaaatggcaatgactgacacaactccgttcgggcagcaaagagtgtttaaggagaaagttgatacaaggacccctagaccaatgcctggaacacgtaaagtcatggagataacagcagaatggctttggagaacactaggtcgaaataagagacctcgtctatgtactagagaagagtttaccaaaaaggtcaggacaaatgcagcaatgggcgccgtctttaccgaagaaaatcaatgggaatccgcgagggccgcggtagaagacgaggaattttggaagttggtcgggcgagaacgagaattacataagctcggtaagtgtggttcttgcgtatacaatatgatgggaaaacgggagaagaaattgggggaatttggaaaagctaaaggatcgagagccatttggtatatgtggctaggtgcgcggtacctagaatttgaagcactaggatttttaaatgaagaccactggttctcacgggaaaattcatattctggtgtagaaggagaaggtttgcacaaattggggtacattttgagagatatatcaaaaattcccggtggagcaatgtatgcagacgacactgccggttgggatacaagaataacagaggacgatctacataatgaggagaaaattacgcaacaaatggatccggaacatcgacaattagcaaatgcgatttttaaactaacatatcaaaataaagttgtgaaagtccaaaggccgactccaaaaggaacagttatggacattatatcgagaaaggatcaacgtggatcaggccaagtaggaacgtatggcttaaacaccttcaccaatatggaagcacaactcataagacaaatggaaggggaaggggttttgtccaaagcagatttggagaatcctcaccttctagagaagaaaataacacagtggcttgaaactaaaggggtggaacgtcttaaaaggatggcaatcagcggggacgattgtgtcgtcaaacctatagatgatagattcgcgaacgctctgttagcactcaatgatatgggtaaagtccgaaaggatataccacaatggcaacctagcaaaggctggcatgattggcaacaggttcctttttgtagtcatcacttccatgaactcattatgaaagatggccgaaagttagtagtaccttgcaggcctcaagacgaactgattggtagggcacgaatcagtcaaggagcaggctggtcattaaaagaaactgcttgtctcggcaaggcatacgcccagatgtggtcattaatgtattttcatagaagagatctgcgactggcatcaaatgcgatatgttccgcagtaccggtgcattgggtaccaacttcaaggacaacatggagtatacatgcccatcaccagtggatgactacagaagacatgttaacagtgtggaatagggtttggatagaagacaatccatggatggaagacaagacaccagtaaccacatgggaagacgttccatatctaggaaagcgtgaggaccaatggtgcggtagtttaatcgggttgacaagtcgcgctacttgggcgcagaatattctcaccgcaattcaacaagttcgaagtttgataggcgacgaagagttcctagattatatgccctctatgaaaagatttcgcaaagaagaagaatctgaaggggcgatttggtag

SEQ ID NO: 23548 - RNA, 9873 nt, synthetic construct
  misc_feature 1..9873: note = derived and/or modified CDS sequence (opt6) from DENV-3__KF824903__SS-prME
  source 1..9873: mol_type = other RNA
accagtttatgcttaatgatgatgctaccagctactctagcgttccacctaacaagtcgagatggagaaccacgcatgatcgttggtaaaaatgaacgagggaaatctctattatttaaaacagcttccggcattaacatgtgcacccttattgctatggacttgggggaaatgtgtgacgacaccgttacatacaaatgtcccttaatagcagaagtagaacccgaagatatagattgctggtgtaatctaacttctacatgggttacgtatggtacatgcaaccaagcaggggaacatcgaagggacaaaagatctgtcgcactagctccacacgtaggtatgggtttagatacaaggacacagacatggatgtccgcggaaggagcttggagacaagtagaaaaagtagaaacttgggcactaagacatcctggttttactatattagctttgtttcttgctcattatattggaacttctctaacacaaaaagtagtcatcttcatattattaatgctagtaacaccatctatggcgatgcgatgcgtcggagtcggaaatagagactttgtcgaaggcttatcaggagcaacctgggtagatgtggttttagaacacgggggctgtgtcacgaccatggccaaaaataaaccaactttagatatagaacttcagaaaacagaagctactcaactagcaaccttgcgcaaactatgcatcgagggaaaaattacgaatattactacagattcgaggtgcccgacacaaggcgaagctatattgccagaagaacaagaccaaaactatgtttgcaaacatacgtatgttgataggggttggggcaacgggtgtgggttattcggcaaaggaagtttagtgacatgtgcaaaatttcaatgtcttgaaagcatagagggaaaagtggtccagcatgagaatctaaaatatactgttacaatcacagtacacacgggtgaccaacatcaagtaggtaatgatacgcaaggcgttacggcggagataaccccacaggcaagtaccgtagaagctatattgccagaatatggtacacttggtctggagtgttctcctcgtactggtctagacttcaacgaaatgattcttctaacaatgaaaaacaaagcatggatggtacatcgacaatggtttttcgatctaccgttgccatggacctccggcgcaaccaccgagacacccacatggaacaggaaagaactgctagtcacattcaaaaacgcgcacgccaagaaacaagaggtagttgtacttggatctcaagaaggcgccatgcatactgcacttaccggagcaactgaaatccagaactcaggaggtacatctattttcgccggacacttaaaatgtagactgaaaatggataaattggaattaaaagggatgagctatgcaatgtgcctaaacaccttcgtgctcaagaaagaagtttcagaaacacaacacggaacgatattgattaaagtcgaatacaaaggagaggacgctccttgtaagattccgttctcgacagaagacggtcaaggaaaagcccataatggtaggctcataactgcaaacccagttgtaactaagaaagaagaacccgtgaacattgaagccgaacccccatttggagaaagtaatatcgtcatcggaatcggtgataaagcacttaaaatcaattggtacaagaaaggtagttcaataggcaaaatgtttgaggcgacagcgcgtggggcacgacggatggctatattaggtgacacggcctgggattttggaagcgtagggggtgtactaaattcgttgggcaaaatggtccatcaaatattcggaagtgcatacacggcactttttggaggagtctcatggattatgaaaataggaataggcgtacttcttacatggatcggacttaacagtaaaaacacgagtatgagtttttcctgtatcgttatcggaattatcacattatacttaggaacggtcgtccaggccgacatgggttgtgtaataaattggaaaggtaaagagctaaaatgtggcagtgggatattcgtgacaaatgaagttcatacttggacagaacaatataaattccaggcagactctcccaaacgattagccacagctatagcaggcgcttgggagaatggcgtttgtggtataagaagtactacaagaatggaaaacttattatggaaacaaatagcaaacgagctgaactacattctctgggaaaacaatataaagctaactgttgtagtaggagatatcataggagttttggaacaagggaaaagagctctaacacctcaaccaatggagttgaagtacagttggaagacatggggcaaagcgaagatagtaactgcagagatacagaactcatcatttataattgatgggccaaacactccagaatgcccaagtgcttctcgagcatggaacgtatgggaagtggaagattacggtttcggtgtgttcaccacaaatatttggcttaaattaagggaagtgtacacacaaacatgcgaccataggttaatgagtgcagcgataaaagatgaaagagctgtacatgcagatatgggatattggatagaatcacaaaagaacggatcatggaaactggaaaaagcgagctttattgaagtcaagacttgtacttggcctaaatcacatacattatggagcaacggagttctagaaagtgacatgatcatcccaaaatcgctcgcaggtccaatttcacaacacaaccaccgtccaggatatcatacccaaacagctggtccctggcatttaggtaaactagagcttgattttaactactgcgaaggaacaaccgttgtgatcactgaaaattgtggaactagggggccaagtttacgaaccactacagtatctggtaaattgatacatgaatggtgctgtcggagttgcactttgccaccattacgctatatgggagaagatggatgttggtacggaatggaaatacgcccaattaacgaaaaagaagaaaacatggtgaaatcgcttgtcagcgcaggcagcggtaaggtagataattttacgatgggcgtactatgcttagcgattctatttgaagaagttatgaggggaaaatttgggaaaaagcatatgattgccggtgtactcttcacttttatgctgctacttagcggacaaatcacgtggcgggatatggcacacacacttatcatgattgggtcaaacgcgtcggatcgaatgggaatgggcgtcacgtaccttgcattaatagcaacttttaaaatacaaccttttctggcacttgggttcttcctacgcaaacttacatcacgcgaaaatctcctgttgggagtaggattagccatggcaacaacgttacaattaccagaagacatcgagcaaatggcaaatggtatagcactgggtttgatggcattaaaattaattactcaatttgagacttatcagttatggactgcattggtgagcttaacgtgtagtaatacaatctttacactaactgtagcttggagaacagcgacactcatcctggcaggagtatcattacttcctgtgtgtcaatcctcgtcaatgcgaaaaactgactggctgccagtagctgtcgcggcgatgggagtaccaccactcccattatttattttctcgcttaaagatacattaaaacggcgcagttggccactgaatgagggtgtcatggcagtaggcttggtcagcatactagcttcatcactcttacgtaacgatgtccccatggctggaccgttagtagcgggaggtttgttaatagcttgttacgtaataacggggacgtccgcagatttaacggtagaaaaggcagcagatgtaacatgggaagaggaggccgaacagactggggtttcacacaatctaatgataacggtagacgatgatggcacaatgcgaataaaagatgacgaaacggaaaatatattgaccgtgttacttaagacagcattactaatcgtgagtggtatattcccttactcaatcccggcaaccctcctagtctggcatacatggcagaaacagacccaacgaagtggagttttgtgggacgtaccatcacctccagaaacacaaaaagctgaattagaagaaggagtttatagaattaagcagcaaggaatattcggtaagacacaagtaggcgtaggcgttcaaaaagaaggggtctttcacaccatgtggcatgtgacacgaggagcagtgttgacgcataatggaaaaagactcgagccgaactgggccagtgtcaagaaagatctaatttcatacggaggaggctggagactgagtgcacaatggcaaaagggtgaagaagtacaagtgattgcagtagaaccggggaggaatccgaaaaatttccagacgatgccaggtatatttcaaacaacaacgggtgaaataggggcaattgctctggattttaaacctggaacgtccggaagtccaataataaaccgggaaggcaaggtagtcggtttatacggaaatggtgtggtaacaaagaatgggggctatgtcagcggaattgcacaggcaaatgcagaaccagaaggcccaacgccagagcttgaggaagagatgtttaagaaaagaaatctaacaattatggacctacacccgggaagcggcaaaacgcggaaatatttacccgcaatcgtaagagaggccataaaacgaaggttacgtactttaattcttgcaccaacaagagttgtagctgcagaaatggaagaagccttaaaaggattaccaattagataccagacaaccgctactaaatcagagcatactgggagggaaattgtagagtgcatgtgtcatgcgaccttcacaatgagactactatcacctgtaagggtacctaattacaatctgatcataatggatgaggcacatttcactgacccggcatcaatagcagcacgaggctatattagtacacgagtcgggatgggagaagcggcagcaattttcatgacagcaacgccaccaggaacagcagaggcttttcctcaaagtaatgcacctattcaagatgaagaacgggatataccggagcggtcctggaactctggaaacgaatggataacagattttgtaggcaaaaccgtctggtttgttccaagcatcaaagcgggcaatgatatagctaactgtctacgcaaaaatgggaaaaaggtgatacagctcagtagaaagacttttgatactgaataccaaaagactaaattgaacgattgggactttgtcgttacaacagacataagtgaaatgggtgctaacttcaaagctgacagggttatcgacccgagacgatgcttaaagccagtaatcttaactgatggtcccgaacgagtcattttagcaggacctatgccagtaactgctgcgagcgcagctcaacgaaggggtagagtaggtagaaatccacaaaaagaaaatgatcaatacatctttacaggtcaaccccttaataacgatgaggatcatgcacattggacggaagctaaaatgctcttagacaatataaatactccagagggaatcattcctgccctatttgagccagaaagagaaaaatccgcagcaatcgacggagaatatcgattaaaaggagaatcaagaaaaacatttgtcgaattaatgagaagaggcgatctacccgtatggcttgcacacaaagtggctagcgaaggaatcaaatacaccgacagaaaatggtgctttgatggagaaagaaataatcagatcttggaagaaaatatggatgtagagatttggacaaaagaaggagaaagaaagaaattaaggcccagatggttagacgctaggacatacagtgatccgttggcactgaaagagttcaaagacttcgcagcgggtcgaaaatcaattgctcttgatttggtcactgaaataggacgagttccctcgcatttggcccaccgcacacgaaacgcattagacaaccttgttatgctacatacatctgagcacgggggaagggcatatagacacgccgtcgaagaattacccgagaccatggaaactctccttctgcttggactaatgattctattaaccggaggcgcaatgttatttttaatttcagggaagggaatcggaaaaacatctataggccttatatgtgttatagtatcatccggcatgttatggatggctgatgttcctctacaatggattgcatcagccatcgtcttagaatttttcatgatggtattgctaattcccgagcctgaaaaacaaagaactccgcaagataatcagctagcatatgtagtaataggtattctcacgctagctgcgattgtagcagcaaatgaaatgggcttactggaaacaacaaagagagacttagggatgagcaaagaacccggagttgtgagtcctacttcatacttagatgtcgacctgcatccagcaagcgcatggactctatacgctgtagccactaccgtaataactcccatgttacgccatacaattgaaaatagcactgcgaatgtctctttagctgcgatagcgaatcaagctgtcgttcttatgggacttgacaaaggatggccaatatcgaaaatggatcttggagtacccttattagccttaggatgttatagtcaagttaacccgctaacgctcacggccgctgtactgctattagtcactcattatgcaataataggcccaggattacaagctaaagccactcgggaagcccaaaaacgcacagctgctggaataatgaaaaacccaacagttgacggaatcatgaccatagaccttgatcctgtaatctatgacagcaaattcgaaaagcagctagggcaagtcatgttactggtactttgcgccgtgcaactactacttatgcgaacctcctgggcattatgcgaagcattgaccctcgcaactggtcctatcacgaccctctgggagggatcgccagggaaattttggaatacaactattgcagttagcatggcgaacatttttcggggaagttatttagctggtgcaggactagcattttcaataatgaaatctgttggtacaggaaaacgcggcacaggatcacagggtgaaaccctaggggaaaaatggaaaaagaaactaaatcagctttccagaagagaatttgagctttataagaaaagcggtattacagaagtagatcgaacagaggcaaaagaaggtctaaagagaggtgaaacaacacaccatgcggtatctcgagggagtgcaaaattacagtggttcgtcgagcgaaatatggtcataccggaaggcagagtgattgatctaggttgcggtaggggaggttggtcttactactgcgcaggtctcaagaaagtcacagaagtgagaggttatacaaagggaggtccgggacatgaggaaccagtacctatgagcacctatggttggaacaccgtaaaactgatgtcgggcaaggacgtattttatctgccgcctgagaaatgcgatacactgctgtgcgacattggtgaatcaagtccgagcccaacagtcgaagagagtcgtactatccgggtattgaaaatggtcgaaccctggcttaagaataatcaattttgcataaaagtgctgaatccttatatgcctacagtgatagaacacctggagcgattacaaagaaagcatggagggatgctggttagaaatcctctatctaggaatagcacacacgaaatgtattggataagcaacgggacaggaaacatagtgagctccgtaaacatggtaagccgactacttcttaacagattcacgatgactcataggcgacctacaatcgaaaaagatgtagatttgggagctgggacaagacacgttaacgcggagccggaaacaccaaatatggatgtgatcggagagcgtatcaaacgaataaaagaagaacatagtagtacttggcattacgacgacgagaatccatacaaaacttgggcctaccatggttcatacgaggtcaaggcgacggggagtgcttcatcgatgataaatggggtagtaaagctgttgactaaaccttgggatgtggtccctatggtgacgcaaatggccatgaccgacaccaccccctttgggcagcaaagagtatttaaagagaaagtagacacgagaactccacgtccaatgcccggaacccgcaaagttatggagataacggcagaatggctgtggagaactcttggacgtaacaaaaggcctcggctctgcacgagggaggagttcactaagaaagtaagaacaaatgcggccatgggggccgtcttcaccgaggaaaaccaatgggaatcagcaagagcggctgttgaagatgaagaattttggaagctggtaggcagagagcgagaactacataagctcggtaaatgtggatcctgtgtctataacatgatgggcaaacgagagaagaaattaggtgagtttggtaaagccaaagggtctagagctatatggtacatgtggctgggagctagatacctggagtttgaagcattaggattcttgaatgaagaccattggtttagccgagaaaacagttactcgggagttgaaggtgaaggattgcacaaattaggttatatattacgggacatttctaaaattccaggaggagccatgtatgccgacgatacagccggatgggataccagaattacagaggacgatctccataacgaagagaaaatcacacagcaaatggaccccgaacacagacaacttgccaatgcaatttttaaactgacttatcagaataaagttgtaaaggtacaaagaccaactcccaagggtactgtcatggacataataagcagaaaagaccaaagggggagtggacaagtgggcacatacggtttaaatacattcaccaacatggaagctcagctgatccgtcaaatggaaggagaaggggtcctgtctaaggcagatttggaaaacccacatcttttagagaagaaaataacccagtggctagaaacgaaaggagttgaacggcttaaaagaatggcaattagtggggacgactgtgtcgttaaaccaatagatgatagatttgccaatgcattattagcgctaaatgatatgggcaaagtcagaaaagatataccgcaatggcaaccaagtaaaggctggcacgattggcaacaagttcctttttgttcacatcattttcatgaattaataatgaaagatggacgaaagctagttgtaccgtgtcgaccacaggacgaattaattgggcgagccagaatctcacaaggagcaggatggtctctcaaagaaacagcatgcttagggaaggcatacgcacaaatgtggtctctcatgtactttcacagaagagatcttcgattggcatcgaatgctatatgttcggcagtacctgtacattgggtccccacatctcgaacaacatggtccattcacgcgcaccatcagtggatgaccaccgaagatatgcttacagtatggaatcgtgtgtggatagaggataacccctggatggaagacaaaacaccagtaacaacttgggaagatgtgccatacttgggtaagagagaagaccaatggtgtggatctctgatagggctcacatcccgagcgacgtgggcccaaaacattctaacggcaattcaacaagtccgtagcttaataggagatgaagaatttttggattatatgccttcgatgaaaagatttagaaaagaggaagaatcggaaggtgctatatggtag

SEQ ID NO: 23549 - RNA, 9873 nt, synthetic construct
  misc_feature 1..9873: note = derived and/or modified CDS sequence (opt6) from DENV-3__JF504679__SS-prME
  source 1..9873: mol_type = other RNA
acttctttatgtttaatgatgatcttacccgctgcactagcattccacttaacttcacgagatggtgagccacgcatgatagtaggtaaaaatgaaagaggaaaatcacttttgttcaaaacagcctctggaatcaatatgtgtacattaatagccatggacctaggcgaaatgtgtgatgatacagttacctataaatgtccacatataactgaagttgaaccggaagacatagactgctggtgcaacttaactagcacctgggttacttacggaacctgtaaccaagcaggggaacacagacgggataaacgaagtgttgcattagcgccccacgtgggaatgggactggacacaagaactcagacatggatgtctgcagaaggagcatggaggcaagttgaaaaagtagaaacatgggcattacgacatccaggatttactatattagcattatttttagcgcattacataggaacaagtctaacacaaaaagtagtaatatttatcctcttaatgctcgtaacaccgtctatgacaatgcgatgcgtaggtgttggaaatagagatttcgtagaaggtctatccggtgcaacctgggttgatgtagtattggaacatggaggttgcgtgacaacaatggcgaaaaataaaccaactctagatattgagctgcagaaaacggaagctacccaacttgctacactcagaaaactttgtatagagggaaaaataaccaacatcactaccgacagtagatgtcccacgcaaggggaagcggtactacctgaagaacaagaccaaaattatgtgtgtaaacatacatatgtggatagaggttgggggaacggttgtgggttatttggaaaaggaagcctggttacgtgtgccaaattccagtgtctcgaaccaattgaaggaaaagtagttcaatacgaaaacctaaaatacacagttattattacagtacatacaggcgatcagcatcaagtgggcaatgagactcaaggagtaacggctgaaataacgcctcaggcgtcaacaacagaagcgattttgccagaatacggaactttagggctagaatgttcaccacgaactgggttagacttcaacgaaatgattttgttaactatgaaaaataaggcttggatggtgcatagacaatggttctttgatttgccactcccatggacatctggggccacaactgaaaccccaacttggaataggaaagaacttttagtaacattcaaaaacgcacacgcaaagaaacaagaagtggtagtactagggtcacaagaaggagcgatgcataccgcgttaactggcgcaacagaaatacaaaactctggtggcaccagtatatttgctgggcatttaaaatgcagattaaaaatggataaacttgaattaaaaggaatgagctatgcaatgtgcactaacacttttgttttgaagaaagaagtaagcgaaacgcaacacggaacaatacttattaaagtcgagtataaaggagaagatgcaccttgtaaaataccgttcagtactgaggacgggcaagggaaagcacataatggacgattaatcacagcaaatcctgtcgtcactaagaaagaggaaccagtaaatattgaggcagaacctccattcggggaatcaaatattgtcatcggcataggagacaatgctttaaaaataaattggtataagaaaggtagttcaattgggaaaatgtttgaagcaacggctcgtggagcacgccggatggcaatcctgggagatactgcatgggatttcggaagcgttggtggtgtactaaacagcctgggaaaaatggtacaccaaatatttgggtcagcatacaccgcgctgttctcgggtgttagttgggttatgaaaatagggatcggagttttattaacatggataggcttaaatagcaaaaatacatctatgagttttagttgcatagctatcgggataattaccctctatttaggcgctgtagtacaggctgacatgggatgcgtgatcaactggaaaggcaaagagcttaaatgcggatcaggaatatttgttacaaatgaagtacacacctggaccgaacaatataaattccaagctgacagccccaaacgattagcaacagtaattgccggtgcatgggagaacggtgtctgtgggatacgatctaccacacgaatggaaaatcttctatggaaacagattgcgaatgaattgaattatatactatgggaaaacaatattaaactaacagtcgttgttggagatacaattggagtgttagaacaaggcaaacgcaccttaacaccgcaacctatggagctaaaatactcgtggaaaacctggggtaaagcaaaaatagtgacagctgaaacacagaactcatcatttataattgacggtcccaataccccagaatgcccgtccgcaagtagggcatggaatgtttgggaagtagaagactacggttttggtgtctttacaacaaatatttggttaaaactcagggaagtttatacacaaatgtgtgatcatcgattaatgtcagcagcagtgaaagacgaaagagcagtacatgcggatatgggctattggatagaatcccagaaaaacggatcttggaaactagagaaagcctcacttattgaagtcaaaacatgtacttggcctaaaagccacacactttggtcaaacggagtgctcgaaagtgatatgattataccgaaaagtctagctgggccggtatcacaacacaattaccgtccaggataccacacgcaaaccgctggtccctggcaccttggtaaacttgagcttgactttaattactgtgaggggaccacggtagtgattacagaaaattgtggtactcgaggaccatctctgcggacaacaacagtttctgggaaacttatacatgagtggtgttgcaggtcttgcactttaccccctttaagatatatgggagaggatggatgctggtacggaatggaaatcagaccgatttcggaaagggaagagaatatggtaaagtctttagtatcggccggcagcggtaaggtagacaatttcaccatgggtgttctctgccttgcaattctttttgaagaggtcatgcgtggaaaattcggtaagaaacacatgatagcaggcgtattcttcacatttatgctactactgtccggtcaaattacatggagagatatggcacacacgctaataatgataggcagcaatgcctcggacagaatgggtatgggagtaacatacttggcactaatagcaacattcaaaattcagccgttcctcgcactaggtttcttcctaagaaaattaacttctagagaaaacctacttttaggagtaggtctcgcaatggctactactattcagcttccagaagatatagaacagatggcaaacggtatagccctaggtctgatggcgctgaaattaataacacaatttgaaacttaccaattatggacagctttaatctcgttgacttgtagtaataccatcttcaccctcacagtagcttggagaaccgcgacattgattctcgctggcgtttccctactccccgtgtgtcaatcaagcagtatgagaaaaactgattggttgcctatgacagtggccgctatgggagtcccacctctaccactttttatattttcgctaaaagacaccctcaaaagaagaagttggccattaaatgaaggtgtaatggctgttggtttagtcagtatcttggctagttccttacttcggaacgatgtacccatggcgggtcctttagttgccgggggcttgttaatagcgtgttacgttattacaggcacttctgctgacttgaccgtagaaaaggccgctgatgttacatgggaggaagaggccgaacaaacaggggtttcacataatttaatgataacagtggatgatgacggaacgatgagaatcaaagacgatgaaacggagaatatattaacagtgctcttaaagacagctctattgatagtcagtgggatattcccttattccatcccagccaccctattagtatggcatacatggcagaaacaaacccaaagaagtggggtactatgggacgtgcccagcccgcccgaaacacaaaaagctgagctcgaggaaggagtctacagaattaaacaacaaggaatcttaggcaaaactcaagtaggtgtaggagtacaaaaagaaggtgtttttcatacaatgtggcatgtcactaggggagctgtcctaacacacaacggaaaacgcttagaacctaattgggcgtccgtcaagaaagatttgatatcatacggaggtggctggagattatctgctcaatggcaaaagggagaggaagtacaagttattgccgtcgaaccaggaaagaacccgaaaaattttcaaactatgccaggtacatttcaaacgacaacaggagaaataggagccatagctttggactttaaacctggtacttcaggcagccctattataaatcgtgaaggcaaagtagtagggctatatggaaacggggtagttactaaaaacggtggatacgtaagtggtatcgcccaaactaacgcagagccggatggaccaacacccgaattagaagaagaaatgtttaaaaagagaaatttaacaatcatggacctccatccgggctctggaaaaacaaggaagtatttacccgctattgttcgagaggcaataaaaagaaggttaagaacactaattctagcaccaactcgcgttgtggcagccgagatggaagaagccttaaaagggttacctatccgctatcaaacaacagccaccaagagtgaacatactgggcgcgaaatcgtggacctcatgtgccacgccacatttacaatgcgcttactaagtcctgttcgtgtgccaaactataatttaataataatggatgaagctcactttacagacccagcctctatcgccgcaagaggatatatttcgactcgtgttggaatgggtgaagccgcagccatctttatgaccgccactcccccgggcactgctgatgcctttccccaaagcaacgcaccaattcaagacgaagaaagagatataccagaaaggtcttggaactctggaaatgaatggatcactgattttgcaggaaaaacagtatggttcgttccaagtatcaaggcgggtaacgacatcgcaaattgtctcaggaaaaatggcaagaaagtgatacaactaagcagaaaaacttttgatacagaataccaaaagactaaattgaacgattgggattttgttgtaaccactgatattagtgaaatgggcgcgaactttaaagcagatcgagtcatagacccaagacgttgtctaaaacccgtaattctaacagacggtcccgaacgggtaattctcgcaggccctatgcccgtaacagtggctagtgctgcgcaacgaagaggcagggttggtcgaaacccacaaaaagagaatgatcaatatatatttactggtcaaccactaaacaacgatgaggatcatgcccactggacggaggcgaaaatgctattagacaatatcaatacgccagaaggtatcataccagcattgttcgaaccagaaagagagaaaagtgcggcaattgacggagaatatcgattaaaaggcgaaagtagaaaaacatttgtagaactaatgaggagaggagatctgccagtttggctagcgcacaaagtagcgagtgaaggcataaaatacactgacaggaaatggtgctttgatggacagagaaataaccaaatattagaagaaaacatggacgtagaaatatggaccaaggaaggcgagaagaagaaactacgaccccgatggttagatgcaagaacttattccgaccctcttgcattaaaagaatttaaagattttgccgcgggcagaaaatctattgctttagatctagttactgagatcggtagagttccatcccaccttgcccacaggacccgaaatgcactggataacttagtaatgctacatacatcagaacatggagggagagcatatagacacgcagtagaagaactcccagaaactatggaaacactgctcctattggggttaatgatcttacttacaggaggtgccatgctttttcttatttctggtaagggcatcggtaaaacatctataggactgatctgtgttatagcgtcatcgggaatgttatggatggcagagatccctctacaatggattgcgtctgcgattgttttagagttctttatgatggttttattaattccagaaccagaaaaacaacgaaccccacaagacaatcagttggcttatgtcgtgataggcatcttgacactggccgcaataatagcggcaaatgaaatgggcttgctagagacaacgaaaagagatcttggaatgtctaaagaacctggagtagtttcaccaactagctaccttgatgtagacctacatccggcatcagcctggacgttatatgcagtggcgacaactgtaataactcctatgctccgacatacgatcgaaaattcaacagcaaatgtttcgttagccgcaatagcgaaccaagctgttgtgctaatggggttagacaagggatggccgattagtaaaatggacctcggtgtaccattattagcactgggttgttattctcaagtcaatcccctgaccctcactgcagccgttcttcttctagtaacacattatgctataataggtccaggcctgcaggccaaagccacacgcgaagctcagaaacgaactgcggccggtataatgaagaatcctactgttgatggaattattacgatcgatttagatccagtcatttatgatagtaaattcgaaaaacaattaggacaggtgatgctattagttttatgcgccgtacaactacttcttatgaggacaagctgggcactatgtgaagcattgacactagcaacaggccccataacaacactatgggaaggcagtcctggtaagttttggaatacaactatagcagtgtcaatggcaaatatattccggggcagttacctcgctggggcaggtctagcatttagtattatgaaaagcgtaggcacgggaaaacgaggcacaggaagtcaaggtgaaaccctaggtgaaaagtggaaaaagaagttgaatcagttgagtcgaaaagagtttgatctatacaagaaaagtgggataacagaagtcgatagaactgaagcgaaagaaggtttaaagagaggtgaaactactcatcatgcggttagtcgcggcagcgctaagttgcagtggtttgtagaacgtaatatggttattccggaaggacgcgtcatagatttaggctgcggacgtggtggatggagttactattgtgccgggctgaagaaagtcacagaagttaggggttatacaaaaggagggcccggtcatgaagaaccagttccaatgagcacgtatggctggaatattgtgaaattgatgtcagggaaagatgtattttacctacccccggagaagtgtgacaccttgttatgcgacataggggagagttctcctagccctactgtcgaagagagtcgaacaataagagtcttaaaaatggtggagccctggctgaaaaataatcaattttgtataaaggtgctaaatccgtatatgccggctgtcatagaacacctagaacgtctgcaaagaaagcatggaggcatgttagtccgtaacccgctgagccgaaattcaactcatgaaatgtactggattagcaatggtacagggaatatagtaagcagcgtgaacatggtgagccggttattgctgaacagatttacaatgacacatagaagacctacaatagagaaagacgtagatttaggagcggggacaagacatgttaatgccgagcctgaaacacctaatatggatgtgatcggagaaagaatcagaagaattaaggaggaacataactcaacttggcattatgatgacgagaacccttacaaaacctgggcttaccacggttcctatgaggttaaagcaacaggaagcgcttctagtatgataaatggtgttgtaaaactgttaaccaagccctgggatgtcgttccaatggtcacacaaatggctatgaccgataccacaccattcggtcaacaaagagtatttaaggaaaaagttgatacacgaacgcctcgaccaatgccgggcacacggaaggtcatggaaatcacagctgagtggttatggaggactctaggaagaaataaaagacccagactttgcacgagagaagaatttactaagaaagttagaacaaacgcggctatgggggcggtatttacagaagaaaaccagtgggactcggccaaagcagccgtcgaggatgaagagttctggaagttagttgacagagaaagggagttacataaactaggaaaatgtggttcatgcgtttacaatatgatgggaaagcgtgagaagaaattgggggagttcggaaaagctaaaggaagtcgagcaatatggtatatgtggctaggagcgcgatatctagaatttgaggcattaggtttcctaaatgaagatcattggttctcacgagaaaattcatattccggagtagagggagagggactgcataaactcggttacattcttcgagacataagcaaaattccaggcggcgcaatgtatgcggacgatacagcaggttgggacacgcgcataacagaagatgatcttcacaacgaagagaaaatcacacaacagatgaatcccgaacacaggctcttagcgaacgcaatattcaaattaacctaccagaacaaagtagtaaaagttcaaagacccactccgacgggtacagtaatggatattatttcaagaaaggaccaacgagggtctggacaggtagggacatatggcttaaatacattcacgaatatggaagcccagctggtaagacaaatggaaggagaaggagtcctatcaaaagcagatcttgagaatcctcacttacccgagaagaaaatcactcaatggttagagacaaaaggcgtagagcgcctcaaacgaatggcaatttccggggacgactgtgtagtaaaaccgatagacgatcgatttgcaaatgcgttactagctttgaatgatatggggaaagtaaggaaggatataccacagtggcagccaagtaagggctggcatgactggcagcaggtacctttctgttcacaccacttccatgaattaataatgaaagacggaagaaagttagtcgtaccatgtaggcctcaagatgagttaattggacgagctagaattagtcaaggcgcaggatggagtctgcgtgaaacagcctgcctaggtaaggcctacgctcaaatgtggtcgcttatgtacttccacagacgagacttacgtctggcatcaaacgctatatgtagtgctgttcctgtacattgggtacccacgtctagaacaacgtggagtattcacgcacatcaccaatggatgacgacggaagatatgctaacggtctggaaccgcgtatggatagaagataatccttggatggaagacaaaacacctgtcactacttgggaaaatgtaccttatttggggaaaagagaagatcaatggtgcggttcgctaataggtttaacatcacgcgcaacatgggcccaaaacattccaacagcaatacaacaagtaagatcattgatcggcaatgaagaatttttagattacatgccgagcatgaaaagattccgtaaagaagaagagagcgaaggagcaatttggtaa

SEQ ID NO: 23550 - RNA, 9873 nt, synthetic construct
  misc_feature 1..9873: note = derived and/or modified CDS sequence (opt6) from DENV-3__KC425219__SS-prME
  source 1..9873: mol_type = other RNA
acctcattatgtttgatgatgatactgcctgcagcactcgcttttcatctcacctcgcgagatggagaaccaagaatgatagtagggaaaaacgaaagaggaaaatcattactttttaaaactgcaagcggaataaatatgtgtacattaatagcgatggatttaggagaaatgtgcgatgacactgtaacatataaatgccctcacataactgaagtagaacctgaagatattgactgttggtgtaatcttacgtcaacctgggtaacatatggaacatgtaatcaagcaggggagagacgaagggataaaaggtcggtagcattagcgccacacgtaggaatgggactggacacacgtacacaaacatggatgtcggcagaaggggcctggaggcaagttgagaaagtagaaacctgggcgctcaggcatccaggtttcacgattttagcgttgtttctcgctcattacataggcacaagtctaactcaaaaagtagtgatatttatattactgatgctcgttacaccttcaatgacgatgagatgtgtaggcgtaggaaacagagattttgttgaaggtttatcaggagcaacttgggtagatgtagttcttgaacatggaggttgtgtgacaacaatggctaaaaacaaaccaacgcttgatatcgaattgcagaaaactgaggcgacacaacttgcgactctaaggaaactatgtatagaaggtaaaatcacaaatataactacagacagtagatgcccaactcaaggtgaagcagtattaccagaagaacaagatcaaaattacgtatgtaaacatacttacgtggaccggggctgggggaatgggtgtggcctttttgggaaaggatccttagtcacatgtgcaaaatttcaatgtcttgagccgattgaaggtaaagtagttcaatacgaaaatctgaaatacaccgtaataattaccgtgcacacaggagaccaacaccaagtaggcaatgaaacacaaggggtgacggccgagattaccccacaagcatcgaccacggaagcaatactaccagagtatggtacccttggactcgaatgcagtccaagaacaggtctagatttcaatgaaatgatattactaacgatgaaaaataaagcatggatggtacatcggcaatggttctttgacttgccactcccttggacgagcggtgcaacaactgaaacgcctacatggaacagaaaagaactactggtgacatttaaaaatgcgcatgctaagaaacaagaagttgtagtattaggtagtcaagaaggcgccatgcatacggctttgaccggagcgacagaaatacaaaacagcggcggcacgtcgatatttgccggacacttaaaatgtcggctaaaaatggataaactagagctaaaaggtatgtcctacgccatgtgcacaaatacttttgttctaaagaaagaggtaagtgaaacgcaacatggtaccatattaataaaagttgaatatagaggcgaggacgcaccatgtaaaattccattctctacagaagatggacaaggaaaagcacacaacggaagattaataactgctaatccagtagtaactaagaaagaggaaccggtgaatatagaggccgaaccgcccttcggcgaatcaaatatagttataggaatcggggataatgcactcaaaataaactggtataagaaaggaagctcgataggaaaaatgtttgaagctactgctagaggagcaagaagaatggctatacttggcgacaccgcctgggatttcggcagtgtaggcggagtcttaaactctcttgggaaaatggtacatcaaattttcggatcggcctatacagcactattttcaggagtatcatgggtaatgaaaattggcataggagtactattaacgtggatcggactcaatccgaaaaacacttcgatgtcgttttcctgcatagcaataggtattattaccttatatctaggtgcagtggttcaggctgacatgggatgtgtgattaattggaaaggcaaagaactcaaatgtggctccggcatatttgtcacaaatgaagtgcacacatggaccgaacagtataaatttcaggcagattctccaaaaagactagctacagcaatagcaggggcgtgggaaaatggggtatgtggaattagaagtacaacaaggatggaaaatctactgtggaaacaaattgcaaatgaattgaactatatcctatgggagaacaatattaaattaacggttgtagttggtgatataataggcgtattagaacaaggtaaacgaacattaactccccagccaatggaacttaaatacagttggaaaacatggggaaaagccaaaatagtcaccgcggagacacaaaacagtagtttcataatagacggaccaaacacaccagagtgtccgtccgcaagtcgtgcatggaacgtctgggaagttgaagactatgggtttggcgtctttaccaccaacatatggcttaaattacgagaggtttatacccagctctgtgaccatagattgatgagcgcagcagtaaaagacgaaagggctgtacacgctgatatgggttattggatagaaagtcagaaaaatggatcatggaaactagaaaaagccagccttatagaagtcaaaacatgtacttggccaaaatcacataccttatggagtaatggtgtactggaaagtgacatgataatacctaaatcactcgcaggacccatctcacaacataatcatcgccctggatatcatacacaaacagctggtccttggcatctcgggaaattagaattagattttaattattgcgaaggaacgactgtagttattacagaaaattgtggaaccaggggtcccagcttaagaacaacaaccgttagtgggaaattgatacacgaatggtgttgccggagctgcacgttaccaccattacgatatatgggggaagatggctgttggtacggtatggagatcagacccataagtgaaaaagaagaaaatatggtaaaaagtctggtatcagccggaagcggcaaagtggataatttcacgatgggagtattatgtttagccatactcttcgaagaggtaatgagaggaaaatttggcaagaaacacatgatagccggtgtgttctttaccttcgttttactactaagtgggcaaattacttggagagatatggcacatactttaatcatgattgggtccaatgcatccgatcggatgggaatgggcgtgacctatttagctttaattgctacgttcaaaatacaaccatttctagcactaggcttctttctcagaaaactgacatctagagagaacttactactcggagtgggattagcaatggcaacaactttacaattgcccgaagatatagaacaaatggcaaatggcattgctctaggtcttatggccctaaaattaataacacaattcgaaacttatcaactttggactgctttgatcagcttgacttgtagcaatacgatgtttacgctaacggttgcttggagaactgcaactcttatattagcaggcgtgagtctcctgccggtctgtcaatcttcttccatgagaaaaacagattggctacccatggcagtcgcagctatgggggttcctccactaccattatttatatttagtctcaaagataccttgaaacgacgttcgtggcccctaaatgagggggtaatggcggtaggattggtaagcatactagccagcagcctactcagaaacgatgtaccaatggcgggacctttagttgctgggggactgttaatagcgtgttacgtgataacaggcacatcagcggatctaactgtagagaaagctgccgacataacatgggaggaagaagcagagcagacaggtgtatctcacaatttaatgatcactgtagatgacgacggaacgatgagaattaaagatgacgagacggagaatattctaactgtactcctcaaaacagcgctcctaatagttagcggtgtctttccctattcgattcctgcgactttgctagtatggcatacgtggcaaaaacaaacccaaagatcgggagttctctgggatgtgccaagccctccagaaacacagaaagcggagttagaagaaggagtatacagaattaagcagcaaggtatcttcggtaagactcaggtcggagtgggcgttcaaaaggaaggtgtattccatactatgtggcatgtgacaagaggcgcagtactcacatataacggtaaacgattagagcctaactgggcatcggttaagaaggatttgataagttacggcggaggatggagattgagtgctcaatggcagaagggagaagaagtacaagtaatcgctgtagaaccaggcaaaaacccgaagaattttcaaaccatgccgggaacttttcagactacgactggagaaatcggagcaattgcactagattttaaaccaggtacatccggatcaccaataataaatagggagggaaaggtagttgggttgtatggcaatggagtggttactaaaaatggtgggtatgttagcggaatagcgcagacgaatgctgagccagatggtcctacacctgagctggaagaagaaatgtttaagaaacgcaacttaacaatcatggacttacatccaggaagcggaaaaactcgaaaatacctcccggcgatcgtacgtgaagcaattaaacgaaggctccgcaccttaatattagcaccaacacgtgttgtcgcagcggaaatggaagaggccttaaaaggcctacctatcaggtatcaaactacagccactaaatcagaacatacggggcgggaaattgtagacctcatgtgccacgcgacttttacgatgcgattactatcgccagtaagagtgccaaattataatttgataattatggatgaagcacactttacagaccccgcctctatcgcagcaagaggttatataagtacgcgagtagggatgggagaagcagccgctattttcatgacagcaacaccaccaggtactgctgatgcatttccgcagtctaacgcgcccattcaagatgaagaaagagacatcccggaacgaagctggaacagcgggaatgagtggattactgactttgctggaaagacggtatggtttgtgccatcgattaaggcaggaaacgatattgcaaattgtcttaggaaaaatggcaagaaagtaattcaactaagtagaaaaacatttgatacagaatatcagaaaaccaagttaaacgattgggactttgtagtaacaacagacatttccgaaatgggggccaatttcaaggcggatagagttattgatccgaggaggtgcctcaaacccgtcattttaacagatggtcctgaaagagtgatactggccggcccaatgcctgttactgccgcttcagccgctcaaaggcgtgggcgagtgggtagaaatcctcaaaaagaaaatgaccaatacatcttcacggggcaaccattaaataatgacgaggatcatgctcattggaccgaagcaaagatgcttctagacaatattaacacaccagaaggaattattcccgcactttttgagccagagcgagagaaaagcgcagcgattgacggtgagtatagactaaagggagagtcaagaaaaacatttgtagaattaatgaggcggggcgatttaccagtgtggttagcccacaaagttgctagtgaaggaattaaatacacggatagaaaatggtgttttgacggacaaagaaataatcaaatactagaagaaaatatggacgtagaaatatggacaaaagaaggcgagaagaagaaattaagacctagatggctagatgcccgtacctatagtgatcctctagccttaaaagaatttaaagattttgccgctgggcgtaagagcatagcgcttgatttagtaactgaaatagggagagtaccatcacatctcgcccaccgaacacgaaacgctttggacaatctagtgatgttacacacctcagaacatggagggcgggcataccgacatgctgttgaggagttgccagaaaccatggagacgttattgctattaggtttgatgatcctacttacaggtggagctatgctatttctgatatccggaaaaggaataggaaagacctccatcggactaatatgcgtaattgcatctagcggaatgctatggatggcagaaatacctctccagtggattgcaagcgccatagtattggagttctttatgatggtacttttaattccagaaccagagaaacaaaggacaccacaggacaatcaactggcatacgtcgttataggaatcttaacactcgcagcaataatagcagcgaacgagatgggtctactggaaacaacgaagagagatctcggtatgtccaaagaacctggcgttgtttctccaacgtcatatttagacgtcgaccttcatcccgcttctgcatggacgttgtacgccgtagcaactacagttataactccgatgctgcgacacactattgaaaacagtacggccaatgttagcctagcggctattgcaaatcaagccgtagttttaatgggcttagataaaggatggccaatatcaaaaatggatttaggagttccattactcgccttaggatgctattcgcaagttaatcctctcacactaacggcagctgtcctcttgttgattacccattatgcaataataggaccagggctccaagccaaagctactcgcgaagctcagaaaagaacagcagcaggaataatgaagaatcccacagttgatggaataatgacgatagatctggatcctgtcatatacgactcaaaattcgagaagcaacttgggcaagtgatgctcttagttctttgtgccgttcagttattgttaatgcggacaagttgggccctatgcgaggcattaacgttagcaacaggaccaattactacgctatgggagggctcaccaggtaaattttggaatactacaatagctgtttcgatggccaatatttttagggggtcatatttagcaggagctgggttagcatttagcattatgaaaagcgtaggaaccggtaaacgaggtactgggagccaaggagagaccttgggggaaaaatggaagaagaaactaaatcagctatctcgtaaggaatttgatttgtacaagaagtcaggaataactgaagtagatcgaacagaagccaaagagggcttaaaaagaggggaaataacgcaccatgccgtcagccgtggatcggcaaaattgcaatggttcgtagaacggaacatggtaataccagaaggtagagtcattgatttgggttgcggcaggggaggctggagttattattgcgctggtttgaagaaagttactgaagtgcgtggatatactaagggtggacccggccatgaagaaccggttcctatgtcaacgtatggatggaacatagttaaacttatgtcaggtaaagacgtattttacctacccccggaaaagtgtgacacattgctatgcgacataggtgaatcatccccgagtcctactgtggaggaaagtcgaactattagagtattaaaaatggtagagccatggctaaagaacaatcagttttgcattaaagtgttaaacccctatatgcctaccgtgatagagcatttagagcgattacaaagaaaacacggtgggatgctcgtacgcaatccactcagcaggaacagtactcacgagatgtactggatctccaatggtacgggcaacattgtagcgtccgtaaacatggtctcccgtcttttacttaatcgttttacgatgactcaccgccgccctacgatagagaaagacgtagatctaggagcaggcacaagacatgtaaatgccgaaccggaaacaccaaacatggatgttataggagaacgaatcaagaggataaaggaggaacacaattcgacttggcattatgatgatgagaacccttataagacctgggcttatcatggctcttacgaagtcaaagctacaggctccgctagtagtatgataaatggggttgttaaacttttaaccaaaccttgggatgtagtccctatggtcacccaaatggcaatgacggacacaaccccattcggacaacaaagggtttttaaggaaaaagtagatactaggacacccaggtcgatgcctggtacgcgaagagtaatgggcatcacagcggaatggctttggagaacattagggagaaataagaagccgcgcctatgtaccagagaggaatttaccaagaaagttaggacaaacgcagcaatgggtgccgtatttactgaggaaaaccaatgggactctgcaaaagctgcagttgaggacgaggatttttggaagctcgtagaccgagaacgggaattgcataaattaggaaaatgtggcagctgtgtatataatatgatgggaaagagagaaaagaaacttggtgagttcggcaaagccaagggtagtcgggccatttggtatatgtggttaggagcacggtaccttgagttcgaagcactcggattcttgaatgaagaccattggttcagcagagaaaactcttacagtggggtagagggagagggccttcataaactaggatatatactacgagatataagtaaaatacctggaggagccatgtacgcagatgatactgctgggtgggacacacgaattacagaagatgatcttcataacgaagagaaaataacccaacaaatggatcctgaacacagacaactggctaatgcaatatttaaactaacatatcaaaataaagtcgtcaaggtacagagaccaacgccaacaggaacagttatggacataatatcacgaaaagatcagaggggttcaggacaagttggtacatacggattgaacacctttacaaatatggaggcgcaacttattagacaaatggaaggcgaaggcgttttatcaaaagcagatctggaaaacccgcatttgcccgagaagaaaataacacaatggctagagactaagggagttgaacgactgaaacgtatggcaatctccggagacgattgtgtagtaaagccaatagatgatagatttgcaaatgctctcctagcactcaacgatatgggaaaggtcagaaaggatataccacaatggcaacccagtaaaggttggcatgattggcaacaagtcccattttgctcacatcattttcatgaactcataatgaaagatggacgaaaattagtagttccatgtagaccccaagatgaactaataggacgggctcgaataagtcaaggagccgggtggtcattgcgcgaaacggcctgccttggtaaggcttatgcccaaatgtggagtcttatgtactttcataggcgagatttaagattggcctctaacgccatctgtagtgcagtccctgtgcattgggtaccaaccagccgaacgacttggagtattcatgcgcaccaccaatggatgacaacagaagatatgttgacagtgtggaatcgcgtatggatcgaggacaacccttggatggaagacaaaacaccagtgactacttgggaaaatgtgccctatttaggaaaacgcgaagatcaatggtgtggatctcttatcggattgacgtcaagggctacatgggcacaaaacataccaacagccatacaacaggtaaggagtttaataggtaacgaagaatttcttgactatatgccatccatgaaacgattcagaaaagaagaagaatcagagggggcaatttggtag

SEQ ID NO: 23551 - RNA, 9873 nt, synthetic construct
  misc_feature 1..9873: note = derived and/or modified CDS sequence (opt6) from DENV-3__AY858037__SS-prME
  source 1..9873: mol_type = other RNA
actagcttatgcttaatgatgatgttaccagtaacattggctttccatttaacaagcagagatggtgaaccaagaatgatagttggtaaaaatgaacgaggaaaatcactgcttttcaaaacagcaagtggaattaacatgtgtacactaatcgcaatggatttgggtgaaatgtgtgacgatacagtaacatataaatgccctctgataacggaagtagaaccagaagatatagattgttggtgtaatctgacaagtacgtgggtaacatatggaacgtgtaatcaagccggagagcacagacgggataaacgttctgtagcgctggcaccccatgtaggaatgggcctggacacaagagctcaaacatggatgagcgccgaaggagcgtggcgtcaagtagaaaaagtcgaaacatgggcatttcgtcatccaggttttacaattcttgctcttttcctagcgcattatatcggcacgtcattaactcaaaaagtagttatttttatactattaatgctggtgacaccttccatgactatgagatgcgtaggagtaggtaatagggattttgttgaaggattatcgggtgcaacatgggtagacgtagtcttagaacatgggggatgtgtaactaccatggccaaaaataaacctactttggacatagaattgcagaaaactgaggcaacacaacttgctacactaagaaaattatgtatagaaggcaaaataacaaacgtcacaactgactcacgttgcccaacacaaggagaggcaatcttacccgaggagcaagaccagaattatgtatgtaaacatacttatgtagacaggggttggggaaatggatgcggtttattcggtaaagggtcgttagtaacatgtgcaaaattccaatgcttagaatcaatcgaagggaaagtcgtacaacatgaaaatctgaaatacactgttataatcacagtacacactggagaccagcatcaagtaggaaacgaaacacaaggggtaacggcggaaatcacgccacaggcttcaacagtggaggcaattttgccggaatatggaacactaggtctagagtgttcaccccgtactggactagatttcaacgaaatgattttactcacgatgaaaaataaagcctggatggttcatagacagtggttcttcgatttaccacttccatggacatcaggggctacaactgaaacgccgacctggaataagaaagaactcctcgttacattcaaaaatgctcatgctaagaaacaagaagtagtagttttagggtcacaagagggggcaatgcacacagctttaacaggagcaacagaaatacagacaagcggaggaaccagtatatttgcaggccatctcaaatgtaggttaaaaatggacaaactggaactaaaaggcatgtcatatgctatgtgttcgaatgcattcgtcttaaagaaagaagtcagtgaaacacagcacggaacgatactaatcaaagttgaatataaaggagaagatgccccttgcaaaatccctttttcaactgaggacgggcaaggaaaagctcataatgggaggctcataaccgccaatccagtagtaacgaagaaagaagaacctgtcaatatagaagctgagccaccgtttggtgaaagtaacatcattataggtataggggatcgtgcgttgaaaattaactggtataagaaagggtccagtataggaaaaatgttcgaagctaccgcaagaggggctagaagaatggcaatacttggggatacggcatgggatttcggaagtgttgggggagtgcttaatagcttagggaaaatggtacaccagatatttggcagcgcgtatactgccttattcagcggtgtttcatggatcatgaaaatagggatcggagtcttgttaacttggattggtttgaactctaaaaacacctctatgtcatttagttgcatagtaataggcatcataacactatatctgggagctgtggtacaggcagacatgggttgtgtaataaattggaaaggaaaagaacttaaatgcggttcgggaattttcgtaactaatgaagttcacacatggacagaacaatataaattccaagccgactcccccaaacgattagccaccgcaattgcaggagcttgggagaatggggtatgcggaattagatcaactacgagaatggagaacctactatggaaacaaatagctaatgagttaaattacatcttatgggaaaataatatcaaactaacagtagtcgtgggtgatataataggagtgttggaacaaggaaaaagaacgctcacaccacaaccgatggaattgaaatactcgtggaaaacgtgggggaaagccaaaatagtcacagcggaaacccagaactcctcatttataatagatggccccaatactccagagtgccccaacgcatctagggcatggaatgtatgggaagtagaagattacggatttggtgtattcacgacaaatatatggctcaaactccgcgaaatgtatacccaactctgtgatcatcggttgatgtccgccgccgtgaaagatgagagggcggtacatgcagatatgggttattggattgaaagtcagaaaaacggttcgtggaagttagaaaaagcgtcactcattgaggtaaaaacctgtacatggccaaaatcacacacactatggagtaatggggttttggaaagtgatatgattatccctaagagcttagcaggtcctatttcacaacataattatagaccggggtatcacacccagaccgcaggaccttggcatctaggtaagttagaactggattttaactattgtgaagggactaccgtagttataactgaaaattgtggtacacggggaccttctttacggacaaccaccgtctctggaaaattaatacatgaatggtgctgtcgttcctgtactcttcctcctttaagatatatgggcgaagacggatgctggtacggaatggaaataagaccaataaatgagaaggaagaaaacatggtgaaatcattagtaagtgctggtagtggaaaagtagataattttactatgggcgtactttgtctggcaattttatttgaagaagttatgagaggtaaattcggcaagaaacacatgatagcgggtgtgctgtttacctttgttttattactcagtggtcaaattacatggcgtgatatggcgcgtactttgataatgattggttcaaatgcctccgacaggatggggatgggtgtaacttaccttgcgctaattgcaacatttaaaatacagccctttctcgcactgggattctttttacggaaattgacaagtagggaaaatctactactaggagtagggttagcaatggctactacgcttcaactaccggaagatatcgaacaaatggccaacggaatcgcccttggattaatggctttaaaattgataacgcagttcgagacttaccaactatggactgccctcgtatctctaatgtgttctaataccatatttactttaaccgtggcatggaggaccgctacattaatactagccggcatcagtttgttcccagtctgccaatcctccagtatgcgaaaaactgattggctaccaatgactgtcgcagcgatgggtgttccaccattacccttatttatattttcattaaaggacacacttaaaagaaggtcatggccactaaatgaaggcgtgatggctgtaggcctagtaagtattcttgcgtcttctctattgcgtaacgatgtacctatggccggtcccttggtcgctggaggattattaatagcatgctatgttattacgggtacaagtgccgaccttacggtggaaaaagcagcagacgtaacatgggaagaagaggctgaacaaacgggggtgtcacataaccttatgatcaccgttgacgatgacgggaccatgagaataaaagatgatgaaacagaaaatattttgacggtactattaaaaacggcacttctaatcgtgagcggcatattcccgtacagtattccagcaaccttgctagtgtggcatacttggcagaaacaaacacaacgttctggagtattatgggacgtaccaagcccgccagaaactcaaaaagctgagcttgaggaaggagtttatcgtatcaagcaacaaggaatctttggaaaaacccaggtcggagtaggtgtacaaaaagaaggtgtgtttcacactatgtggcatgtcacaagaggcgctgtgctgacctacaatgggaagcgtctagagccaaactgggcaagtgtcaagaaagatttaatctcatatggcggtgggtggcgacttagcgctcagtggcagaaaggagaagaagtacaagtaatcgcagtagaaccaggcaagaaccctaaaaatttccaaactatgcccggaatattccaaacaacgaccggagaaataggggccatagcactagattttaaaccaggtacgtcaggatcccctattattaatagagagggcaaagtagtcggcttatacgggaatggcgttgtgaccaaaaatggaggttatgtttcaggcattgcacaaacaaatgcagaaccagatggacccacgcctgaactggaagaagagatgttcaagaaacgaaatctaaccatcatggatctacaccccgggtctggaaaaactcgaaaatacctcccggcaatcgtccgagaggcgataaaaaggagattaagaacattaatacttgccccaaccagagtagtagctgctgaaatggaagaggccttgaaaggtcttccgatccgctatcaaaccacagcaacgaaaagcgaacacactggtaaagaaatagtcgatctgatgtgccacgctacattcacaatgagattattgagtcccgtccgggttcctaattacaacctaattattatggatgaggcacatttcacggatcccgcatctatcgctgcaaggggctatataagtacgagagttggaatgggagaagcagcagcaatattcatgactgcaactccaccaggaacagctgatgcatttcctcaaagtaatgctccaatccaggatgaagaaagagatatacccgaacgcagttggaactcaggcaacgattggattacagactttgccggcaagacagtctggttcgtgccctccattaaagcaggtaacgatatagctaattgtttacgaaagaacggcaagaaagttatacaactgagccgcaagacttttgacactgaatatcagaaaactaaactcaatgattgggactttgttgtaacgacagacataagtgaaatgggtgcaaactttaaggcagacagagtaatagacccacgaagatgcttgaaacctgtgatacttactgacggaccagagcgcgttatactcgctggtcccatgccagttacggttgcatcagcagcacaacgaagaggcagggtaggtcgcaatccacaaaaagaaaatgatcaatacatttttactggacaaccactgaacaacgatgaggaccacgctcattggacagaggccaaaatgttattagacaacattaacaccccggaaggtataataccggcactttttgaacctgagagggagaaatcagctgcaatagatggagaatatagactaaaaggagaatcaagaaaaacatttgtagaactaatgcgtcgcggagacttaccggtctggctcgcgcataaagtagcctcggagggaataaaatatacagatagaaaatggtgttttgacggtgaaagaaacaatcaaattctagaagaaaacatggatgtagaaatttggacaaaggaaggagagaagaagaaactacgaccaaggtggttggatgcaagaacatactccgacccattggcattaaaagagtttaaagattttgcagcaggtagaaaaagtattgcactagatttggtaactgagatagggcgagttccatcgcacctagcacatagaactaggaacgcacttgacaacctagtaatgctacataccagcgaacatgggggcagagcctacagacacgctgtagaagaattaccagaaaccatggaaacacttctattgcttggattgatgatacttcttaccggtggagctatgctctttctcataagtgggaaaggagttggtaaaactagcattggtctaatttgtgtagtggcatctagcggaatgttatggatggcagatatcccattacaatggatagcttcggccatagtgttagaatttttcatgatggtacttttaataccggaaccagaaaagcaacgcacaccgcaagataatcagttagcgtacgttgtaataggaatcttaactttagcagcaattgtcgctgcaaacgaaatgggacttctagaaaccactaaacgcgatttaggaatgagcaaagagccgggggtcgtatctccgacatcgtatttagatgtagacttacatcccgcttccgcttggactctatacgcagtagcgacaacagtgattactcccatgttacgacatacaatagaaaatagcacagctaatgtaagtttagctgctatagcgaaccaagctgtcgtactaatgggattagataaaggttggccaatatcgaaaatggacctgggggtgccgctcctagcgttaggctgttattcgcaagtcaatcctttgacattaacagcagcagtacttctgttggtgacacactatgccataattggtccagggctacaagcaaaagcgacacgagaagcacagaaaagaactgcagcgggtataatgaagaacccgacagtggacgggataatgaccatagatctggatccggtaatatacgatagtaagtttgaaaaacaactaggacaagtaatgctcctagtactatgtgccgttcaattactattaatgcgcacaagttgggctttttgtgaagccctaactttagcaacagggccgataacaacattatgggagggatcaccgggcaagttttggaatacgaccattgcggtaagcatggcaaatatctttagaggcagttacttagccggagctggtttagctttcagtattatgaagagtgttggaaccggtaagcgtggaactggatcgcagggtgaaaccctgggagaaaagtggaagaagaaacttaaccaactgtcccgaaaagaatttgacttatacaagaaatctggtataactgaagttgacagaactgaagcgaaagaaggactgaaaagaggagaaatcacacaccatgctgtcagccgtggctccgctaaacttcagtggtttgttgagaggaatatggtcattccagagggaagagtgatagacctgggttgtgggagaggaggttggtcttactattgtgccggcctcaagaaagtcacggaagttaggggttacaccaagggaggtccgggacatgaagaaccagttccgatgagtacgtatggatggaatattgttaaacttatgtcaggtaaggatgtgttctatctgccaccagaaaagtgtgacactttgctttgtgatatcggagaaagtagtccaagtcccacagtagaagagtcgaggactataagggtgttaaagatggtcgagccatggcttaaaaataaccaattctgtatcaaggtgctaaacccatacatgcctactgtaatagaacacctagagagactgcaaagaaaacacggaggtatgctagttaggaacccactcagtagaaactcaactcatgaaatgtattggatttccaacgggactggcaacatagtttcgtcggttaatatggtatcaaggctactactcaataggtttacgatgacgtatagaagaccaacaatagaaaaagatgttgatctaggtgcagggacaagacatgtaaatgccgaacctgagacacccaatatggatgtcataggagagagaataagacgaataaaggaagaacattcttccacatggcattatgatgatgaaaatccttacaaaacatgggcatatcacgggagctacgaggtcaaagctacaggatcggcaagcagtatgattaatggagtagtaaaactattaacaaaaccatgggatgtagtacctaccgtaactcaaatggctatgacagacactacaccgtttggccagcaacgtgtattcaaagaaaaagtggacactcgtacaccgaaaccgatgcctggaacaagaaaagttatggaaattacggcggaatggttatggagaacacttggaagaaacaaaagacctcgactatgcactagagaagaatttaccaagaaagtgcgcaccaacgcggctatgggagccgtatttacagaggaaaatcagtgggattctgcgcgagccgcagtggaagacgaggaattttggaaactggtagatagagaacgggaattacacaagctaggaaaatgtgggtcatgtgtttataacatgatgggcaaacgagagaagaaattaggggagttcggaaaggcaaaaggatcacgagcaatatggtatatgtggttgggggcaagatatctggaatttgaagcattgggattcctaaacgaagatcactggtttagtagagaaaacagctactccggtgtagaaggtgagggattgcacaaattaggatatattctcagagacattagtaaaattcccggcggggcaatgtacgctgatgataccgcaggatgggacactagaattacagaagatgacctccacaatgaggagaaaattacgcagcaaatggatcccgagcaccggcaactcgccaatgcaatatttaaactaacgtatcaaaacaaagtagtcaaagtccagcgacctacacctaagggaactgtaatggatataatctcccgtaaggatcagcgtgggtcgggccaggtcggcacttacggtttgaatacctttacaaatatggaagcccaattaataagacaaatggaaggtgaaggggttttatcaaagacagacctagaaaatccacatttgttagagaagaaaataacccaatggttggagactaagggggtagagagattaaaacgtatggcaataagcggagatgactgcgttgtcaagccgattgatgatagatttgcaaatgccctactcgcactgaatgacatgggaaaagtaagaaaagacatcccgcaatggcaaccgtccaaggggtggcatgattggcaacaagtacccttttgctcgcatcactttcatgagttaataatgaaggacggtagaaaattagtagtaccttgtcgaccacaagacgaactcatcggccgagctagaatatcccaaggtgcaggctggagtttaaaagagacagcttgcttaggcaaggcttacgctcaaatgtgggcacttatgtatttccaccgaagggatctgagattagcgagtaacgcaatatgcagtgcggtgccagtccactgggtaccaacatcgcgcacaacatggtctatccacgcacaccatcaatggatgacaaccgaggatatgctaacagtctggaaccgggtttggatagaggacaatccttggatggaggataagacaccagtaacgacatgggaagacgtaccgtacctaggtaaacgggaagatcaatggtgtgggagtttaataggacttaccagtagagcgacatgggcacagaacatacttacggcaatccaacaggtcagatccttaataggaaatgaagaatttttggattatatgccaagcatgaagcgatttagaaaagaggaagagtcggaaggcgctatatggtga

SEQ ID NO: 23552 - RNA, 9873 nt, synthetic construct
  misc_feature 1..9873: note = derived and/or modified CDS sequence (opt6) from DENV-3__KJ737429__SS-prME
  source 1..9873: mol_type = other RNA
acatctctgtgcctaatgatgatgttacctgctacactagcatttcacctgacaagtcgtgatggcgaacccagaatgatagtggggaaaaatgaaaggggcaaaagtctactatttaaaacagcatccggtataaacatgtgtaccctcatagctatggatcttggtgaaatgtgtgatgatactgtaacttacaaatgcccacttattgctgaagtagaaccagaagatatagattgctggtgtaaccttacaagcacatgggtaacctacggaacatgtaatcaagctggagaacacagaagggataaaagatccgtggccctggcaccacatgtaggaatgggtttagatacaagaacgcaaacttggatgtcagcggaaggtgcatggagacaagtagaaaaagtcgaaacctgggctttaagacaccccggatttacaattctagcattattcctggcgcattatattggaacaagtctaacacaaaaagttgttatttttatattattaatgttagttactcccagtatgactatgagatgtgtcggagttggtaatagggatttcgtagaaggattatctggagctacctgggttgacgttgtgttggaacatggtggttgcgtaaccacgatggcgaaaaataaacctacgttagatatagaattgcagaaaacagaagcaacacaactagctaccctgcgaaaattgtgcatcgaaggaaaaatcaccaacattaccactgattcacgatgtccgacacagggtgaagctatccttcccgaagaacaagaccaaaattatgtttgtaaacacacgtatgtagaccgcggatggggtaatggttgtggactttttggcaaagggagcctagtgacgtgtgccaaatttcagtgtctagagccaatagaaggcaaagtagtacaatatgaaaacctcaaatacaccgtaatcataacagtgcacacaggcgatcaacatcaagtaggaaacgatacacagggggtaacagtagaaataacacctcaagcaagtacagtcgaggcagttctacccgaatacggaactttagggctcgaatgctcgccacgcactggtctagacttcaacgagatgattctactcacaatgaaaaacaaagcctggatggtgcatagacagtggttctttgatttgcctctaccatggacaagcggagctaccacagaaacacctacttggaatcgaaaagaacttttagtaacattcaaaaacgcacacgctaagaaacaagaagtagtggtactaggtagtcaagaaggtgctatgcacacagctctaactggagccactgagatacaaaacagtggaggaacgtcaatatttgcggggcatcttaaatgtaggctgaaaatggataaactagaattgaaaggaatgagctacgctatgtgcctaaacacttttgttctaaagaaagaggtttcggaaacgcaacatgggacaatacttataaaagtggaatacaaaggcgaagatgcgccatgtaaaatacctttttcaacggaagacggacaaggaaaggcccataatggacgattgataacagctaatcccgtagttacgaagaaagaggagcccgtaaatattgaagctgagccaccttttggcgaaagtaatatcgtaattggtataggagataaggcattgaaaataaattggtataagaaaggcagctccatcggaaaaatgtttgaagctacagcaagaggagccagacgaatggcgattctaggagatacggcatgggactttggatcagttggaggagtattaaactctttaggaaaaatggtgcatcaaattttcggaagtgcttataccgcgttatttagtggagtaagctggataatgaaaataggtattggcgttttactaacatggattggacttaattccaagaataccagtatgtcctttagttgcatagtaataggtataatcacactttacctgggcgcagttgtacaggctgatatgggttgcgtaattaactggaaaggaaaggaacttaagtgcggatcaggaatattcgtaactaacgaggtacatacctggactgaacaatataaattccaagcggacagcccgaaaaggttagccacagcaatagccggagcttgggaaaatggagtttgcggtattcgcagcacaacaagaatggaaaacttattatggaaacagatagcaaacgaactgaattatattctttgggaaaataatataaaattaaccgtagtcgttggagatataataggtgtattagaacagggtaaacgtacacttacaccacagccaatggaattgaaatattcatggaagacctggggtaaagcaaaaattgtgaccgctgagactcagaacagttcatttattatcgacggtcctaacaccccagaatgcccgtccgctagccgcgcttggaatgtgtgggaagtggaagattacggttttggagttttcaccacgaacatctggctaaaactcagagaagtgtacactcagagctgcgatcatcgattgatgtcagcagcaatcaaggacgaaagagctgtacatgcggacatggggtactggatcgaaagccaaaagaatggtagctggaaattggagaaagcatcatttatagaagtaaaaacatgtacttggcccaagtcccataccctttggagcaatggagtattagaatcggacatgatcattccgaagtcattagcaggccccatatctcagcacaaccatcgtcccggctatcatacacaaaccgctggtccttggcatcttggcaaactggaattggattttaattattgcgaaggcacaactgtagtcataaccgaaaactgcggaacccgaggaccctctttaagaacaacaacagtttctggtaagttaatacatgaatggtgttgtaggagttgtactctaccacctttaagatatatgggcgaagacggatgttggtacgggatggagatcagaccaattaacgaaaaggaggagaacatggttaagtccctcgtttcggctggctcagggaaagtagataactttacgatgggagtattatgtctagccatactatttgaagaagttatgcgtgggaaatttggtaagaaacacatgatagcaggcgtcttgtttacattcgttttgttactatctggacaaattacttggagggatatggcacatacactgattatgattggatcaaatgcttctgatcgaatgggtatgggagtaacttacctagctttaatcgctaccttcaaaatacaaccattcctggccttgggattctttttaaggaaattaacgagtcgagaaaatcttttgctaggagtagggttggctatggctactacgctgcaattacccgaggacatagagcaaatggctaatgggatagcactcggtttgatgacactaaaattgatcacacaattcgaaacttaccaattatggacagctttggtttctctaacttgcagtaacacaatattcacgctaacagtcgcgtggcgaacagcaactttaatattggctggtgtctcgctcctaccattatgtcaatcaagcagtatgcgaaaaacagattggcttccaatgacggtagcggcaatgggtgtaccaccgctacccctatttatattcagcttaaaagatacgccaaaaagaaggtcatggccacttaatgaaggcgttatggcggttggacttgtttcaattctagcttcatcccttctaagaaacgatgtacctatggcaggacctctcgtagcgggaggattactaatcgcttgttatgtgataacaggaacaagtgccgatctaacggtagaaaaagccgcagatgtaacatgggaagaagaggccgaacaaacaggggtttcccacaatctaatgatcacagtggacgatgatggtactatgagaataaaagatgatgaaactgaaaacatacttactgtactactcaaaacagcactgttaatagtgtccggaatcttcccatattctatccctgcgacactgctggtatggcacacttggcaaaaacaaacacaacgaagcggcgtcttgtgggacgtaccctcaccaccagaaactcaaaaggcagaactggaggaaggggtctatagaattaaacaacaaggtatctttggtaaaactcaagttggggtcggagtacaaaaagagggagtgttccatacgatgtggcatgtaacacgaggagctgttttaacacataatggtaaaagacttgaacctaattgggcctcagttaagaaggaccttatttcgtacgggggcggctggagactaagtgcacaatggcaaaaaggagaagaagttcaagtcatcgcagtcgaaccaggtaagaaccctaaaaatttccaaactatgccaggtatctttcaaacaactactggggaaataggagctatagcgctagattttaaacctggaacatctggaagcccgatcattaaccgcgaaggtaaagtagtagggctatacggaaatggcgtggtaactaaaaacggaggatacgtgagtggaatagcacaaactaacgccgaaccggacgggcccaccccagaattggaagaagaaatgttcaaaaagagaaacctcaccataatggacctccatccgggaagtggaaagaccaggaaatacttaccagcgattgtaagagaggcaattaagcgccgcttacgaacgctcatattagcccctacacgtgtagtggcggctgaaatggaagaagccttaaaaggactaccaatacgatatcaaacgacagccactaagtcagaacacaccggccgggagatagtagatctcatgtgtcatgcaacgtttacaatgagattactatcaccagtgcgagtaccaaattacaatttaataatcatggatgaggcccactttactgatcccgctagtattgctgcaagaggatacatatcaacccgagtgggaatgggtgaagcagcagcgatattcatgacagccactcctcctggcactgcagaggcttttcctcagtccaatgcgcctatacaggatgaagagagggacatacccgaaagaagttggaactctggaaatgaatggattacagattttgtcggaaaaacggtttggtttgtgccctctattaaggcaggtaatgacatagctaattgcttgagaaagaatggaaagaaagtgatccagctctcaagaaaaaccttcgataccgagtaccagaaaacaagactaaatgactgggattttgttgtaacaacagacatcagtgagatgggtgcgaacttcaaagccgacagggtgatagacccacggagatgcctaaaacctgtgattcttacagatggaccggagcgcgtgatattagcagggcctatgcccgttacagcagcatccgcagcacaacgaagaggcagggtaggaagaaatccacaaaaagaaaacgatcagtatatattcacaggacagcctttgaataacgatgaggatcatgctcactggacagaagctaaaatgttattagacaatataaacaccccagagggaattataccggcacttttcgaacccgaacgggagaagagtgcggctatcgatggagaatacagactgaagggtgaaagtcgaaagactttcgtcgaacttatgaggcggggcgatttgccagtttggttagcacataaggtggcttcagaggggattaaatatactgatagaaagtggtgttttgacggagaacgtaataatcagatcttagaggaaaatatggacgtggagatatggaccaaagaaggagagcgtaagaaattaagaccccgttggctagacgcaaggacttacagcgatcctttggcactgaaagagtttaaggactttgcggctggtcgtaaatcgattgctttggatttagtcacagaaattggccgcgtgccatcacacctagcacatagaactaggaacgcactagacaacttagttatgttgcatacctcagaacacggcggacgtgcttatagacacgcagtagaggaattaccggaaacgatggagacacttttactactcgggctcatgattttactaactgggggtgctatgctatttctcatctctggaaaaggtatagggaagacaagtattggactaatatgcgtgatagtaagttctggaatgttatggatggccgatgtccccctacaatggatagcttccgctattgtgttagaatttttcatgatggtattgctgatcccagaacctgagaagcaaaggacgccacaggataatcaactggcatacgtcgtaataggaatattaacattagctgcaatagtcgctgcaaacgagatgggacttctagagacaaccaagagagacctaggcatgtcaaaagaaccgggggtagtctcgccaacgagctatttggatgtagatctgcatcctgcttccgcatggactctatatgcagtagcaacaacagtcatcacgccaatgttgcggcatacaatagaaaatagtacagctaatgtttcgcttgcagcaatagcaaaccaggcggttgtactcatgggattggataagggatggcccataagcaagatggacttgggagtgcctctacttgcattagggtgttattcacaagtaaatcctctgacccttacagccgcagtgctattactcgtgactcattacgcaattatagggccaggtttacaggcaaaagctacacgggaagctcaaaaacgaactgccgcgggaattatgaagaaccctaccgtggatggaattatgacaattgatttggatccagttatatatgatagtaaatttgaaaagcagctcggacaagtgatgctgctagtactgtgtgcagtacaacttctcctcatgcgcacttcctgggcactctgtgaagcgctcacattagccacagggcccattacgactctctgggaaggtagcccaggtaagttttggaacaccacaatagccgtatcgatggcaaatatattcagaggttcatatctagctggagcaggtttggcattcagtataatgaaatcggtggggactgggaggagaggtacaggaagtcaaggggaaactctgggtgaaaaatggaagaagaaactaaaccagctgtcgcgtaaagagtttgatctatataagaagtctggaataaccgaagtagatcggaccgaagcaaaggaaggattgaagagaggagaaacaacacatcatgcggtttctcgaggtagcgcgaagttacaatggtttgtagaaagaaatatggtaatacccgagggacgcgttattgacttaggttgcggaagaggcggctggtcttactactgcgcggggttgaagaaagtaacagaggtcagagggtatacaaaaggcgggcctggtcatgaagaaccagtccctatgtcgacatatggctggaacattgtcaagctcatgtctggtaaagatgtcttttacctaccacccgaaaaatgtgataccctattatgtgatataggcgaaagttccccatctccaacagttgaagagagtaggacaataagagtgctaaaaatggtcgaaccctggcttaaaaataaccaattttgcattaaggtactaaatccatacatgccaacggtgatagagcacctagaaagacttcaacgcaaatatggtggcatgcttgttcggaacccattaagcagaaacagtactcatgaaatgtactggatatccaatggcacggggaatatcgtctctagtgtaaacatggtatccagattactattaaacagatttacaatgactcatagaagaccaacgattgaaaaggacgtggacttaggagctggcactagacacgtaaatgcagagccggagacaccgaatatggatgtaattggtgaaagaattaaacggattaaagaagaacacagctctacgtggcattatgatgatgaaaatccatataaaacttgggcgtatcatgggtcttatgaggtgaaagctacaggctccgcgtcaagtatgatcaatggagtagttaagttgttaactaaaccatgggatgtagtccccatggttacacaaatggcgatgacggacactacgcccttcggtcaacaacgagtatttaaagaaaaggttgacaccaggacgccaaggccaatgcctggcacgcgtaaggttatggaaataaccgcagaatggctctggcgaactttaggacgaaacaagaaaccaagactatgtaccagggaagagttcaccaagaaagttagaacgaatgcggctatgggggcggttttcacggaggaaaaccaatgggatagcgcacgcgcagcagtggaagacgaggaattttggaagttagtcgatagggaaagagaattgcacaaactaggtaaatgcgggtcatgtgtctataacatgatgggcaaaagagaaaagaaacttggggaatttggaaaagcgaaagggagtagagcaatctggtacatgtggttgggcgcacggtacctcgagtttgaagctctcggtttcctaaatgaagaccattggttcagtcgagaaaactcctattctggtgtagagggcgaaggattacataaactgggttacatcctaagggacattagcaagatacccggtggagctatgtatgcagatgatactgcaggttgggataccaggataactgaagatgatttacacaatgaagagaaaatcactcaacagatggaccctgaacatagacagttagccaacgctatattcaaactaacctaccaaaataaagtggtgaaagtccaaaggccaacaccaaagggaactgtgatggacataataagtcgaaaagatcaaagaggctcaggacaagtagggacatatggtttaaatacattcacaaacatggaagcacaactggttaggcaaatggaaggagagggagtgcttagcaaagccgatctcgagaatccccatttactcgaaaagaaaatcactcaatggctagagacaaagggagtggaaagattgaaaagaatggctatctctggagatgattgcgtagtaaaacctattgatgatagattcgcaaatgctctcttagccctaaacgacatgggcaaagttcgaaaagacatacctcaatggcagccttcgaaaggatggcacgattggcagcaagtaccattttgctcccatcattttcatgaattgattatgaaagatggaagaaagttagttgtaccatgtagaccacaagatgaactaattggaagggcacgaatttctcaaggtgctggatggagccttaaggaaaccgcgtgtttagggaaggcttatgcacaaatgtggagcctcatgtactttcacagaagagatctcagattagcatccaacgcaatatgttcggccgtaccagtacactgggtgccgaccagcagaaccacgtggtctatccatgctcatcaccaatggatgaccacggaagacatgcttacagtttggaatagagtctggatagaggacaatccgtggatggaagataaaaccccagttacaacctgggaagatgtcccgtacttaggaaagcgagaagatcaatggtgtggttcattaataggtctgacatctcgagctacatgggcgcaaaacattctaacagcaattcagcaggtcagatcactaataggtgatgaagaatttctggactacatgcctagtatgaaacgatttcgtaaagaagaagaatcagaaggagccatttggtaa

SEQ ID NO: 23553 - RNA, 9873 nt, synthetic construct
  misc_feature 1..9873: note = derived and/or modified CDS sequence (opt6) from DENV-3__DQ863638__SS-prME
  source 1..9873: mol_type = other RNA
acgtcgttatgtttaatgatgatgttaccagcaacacttgcatttcatttaactagcagagacggggagccccgaatgattgtaggtaaaaatgaacgtggaaaatcattactcttcaaaactgcgtccggaatcaatatgtgtacattaatcgctatggatctgggcgaaatgtgcgatgacacagtgacatataaatgcccccacatagcggaagtcgaaccggaagatatagactgctggtgcaatctaacttcaacgtgggttacatatggtacctgtaaccaagcaggggagcatcgaagagataaacgttcagtagctttggctccacatgtcggaatgggattagacaccagaacgcaaacatggatgtccgccgaaggcgcttggaggcaagtagaaaaagtagagacatgggctttgagacacccgggtttcacaattttggcattattcctagcgcattacatcggaacgagtctaacacaaaaagtcgttatattcatattgttgatattagtaacaccatcaatggccatgcggtgtgtaggcgtcggtaatagggattttgtagaaggtttatccggtgcaacatgggtagatgttgtattagaacatggtggatgtgttacaacaatggccaaaaacaaaccaacattagacatagaattgcagaaaacagaagcaactcaacttgcaacacttagaaaattatgtatagaaggtaaaatcacaaacataactacagattctagatgtcccactcaaggggaagcaatcctcccagaagaacaagatcaaaattatgtctgtaaacatacgtatgtggacagaggatggggaaacggttgtgggttgttcggcaaaggctcgctggtaacttgtgcaaaatttcaatgcctagaaagcatagaaggaaaagtagttcaacacgaaaatttaaaatacacagttataataacagtccacaccggggatcaacatcaagtgggaaacgagacacaaggagtaactgcagaaataacgccccaggcttcgaccgtggaagcaatattacctgagtatggaaccttgggtttggagtgtagtccacggacaggtctagactttaacgaaatgatcctactaaccatgaaaaacaaagcatggatggtgcatcgccagtggttctttgatttacctttaccgtggacatctggagcgacgactgaaacccctacatggaataggaaagaattgctcgtcacgtttaaaaacgcccacgccaagaaacaggaagtcgttgtcctaggaagtcaagaaggtgcaatgcatacagcgctcactggtgcgacagaaatccagaatagtggaggaactagcatatttgccggacatttaaaatgtcggctgaaaatggacaaattagaattaaaaggtatgagttacgctatgtgtttaaacacgttcgtcttgaaaaaggaggtttctgaaacacaacacggaaccattttaattaaggtagaatataagggagaggatgctccttgcaaaattcctttttctacagaagatggacaaggcaaagctcacaatggacgacttataactgctaatcccgttgttaccaagaaagaagaaccggttaatatagaagcggaaccgccgtttggtgaatcaaatatcgtaataggcatcggtgataaggcactaaaaatcaattggtataagaaaggttcaagtatcggaaaaatgttcgaggcaaccgcaagaggtgctagaagaatggctatacttggagatacagcatgggacttcggttcagtagggggtgtgcttaatagtttaggaaagatggtacatcaaatctttggaagcgcttacactgccctgttttcgggggtcagctggataatgaaaataggaattggggtgctgctaacatggatcggtttaaactccaaaaatacaagcatgagctttagttgcatagcgatcgggataattacgttatacctaggagccgttgtgcaagcggacatggggtgcgtaataaactggaaaggaaaagaattaaaatgtggatcgggaatattcgttacgaatgaggtacatacatggactgaacagtataagtttcaagccgacagtccaaaaaggctggcaacggctatagcgggggcatgggaaaacggagtatgtggaataagatcaacaaccagaatggagaatctattatggaaacaaattgcaaatgagctcaattatatattgtgggagaacaacattaaacttaccgtagtagtaggagacattataggagttttagaacaggggaaacgtactttaacccctcagcctatggaactgaagtattcatggaaaacttggggcaaagcaaaaatagtaactgcagagactcaaaattctagttttataatagacggacctcacactcctgaatgtccaagagctagcagagcatggaatgtatgggaagttgaggactatggatttggtgtgttcaccacaaacatttggctaaaattgcgagaagaatatacgcagttgtgtgaccatcgcttaatgagtgcggcagtgaaagacgaacgtgcagtccacgccgatatgggttattggatcgaatctcagaaaaatggctcttggaaattagaaaaagcaagtcttattgaagtaaaaacgtgtacttggcctaaaagtcatactttatggtctaacggtgtgttggaaagcgacatgataattccaaaaagtctggctggaccgattagccaacataaccatagaccagggtaccatacccaaacagctggtccatggcacctaggaaaacttgagttagacttcaactattgtgagggtacgacggtagtaataactgaaaattgtggcacaagaggtccatcgttaagaacaacgactgtgtctggaaaattgatacacgagtggtgctgtcgaagttgcactttaccacctttgaggtatatgggcgaagatggatgttggtatggaatggagataagaccaataaatgaaaaagaagagaacatggttaagtcgctagcatcggccggaagcgggaaggtagataattttaccatgggatttctatgtttagccattctatttgaagaagtcatgagggggaaatttggtaagaaacatatgattgcaggagtttttctcacatttttgctcttattatcgggtcaaatcacatggagagacatggcacacacattaatcatgataggatctaatgccagcgacagaatgggtatgggtgttacatatttagcattaattgccacgtttaagatacaaccttttctagcgttaggcttctttttgagaaagctaaccagcagggaaaactttttacttggagtgggtttagctatggccactaccttacaactacctgaagatattgaacaaatggcaaatggcatcgcattggggttaatggcgctaaagctaataactcaatttgaaacatatcaattgtggacagcactcgtgtcgttaacgtgttcaaatacaatatttactttgaccgtcgcatggagaacggcaacgttgattttggccggcgtctctctactgcccgtatgccaaagttcctccatgagaaaaacggactggttaccgatggcggtggctgcgatgggtgtacctccgcttcctctgtttatattcagccttaaggacactttaaaacggagatcttggcctctaaatgagggtgtaatggcggttggcttagtgagtatcttagcatcgtcattattaaggaacgatgtaccaatggctgggcccttggtggcaggaggattactaatagcatgttacgtgataacaggaacatctgcagacttaacagtagaaaaagcggcggatgtcacttgggaggaagaagcggaacaaactggtgtgtcccataatctaatgatcacagttgatgatgacggaactatgcgtataaaggacgatgagactgaaaatatattaacggtactgttaaagactgcactactcatagtaagtgggatatttccttattcgattcctgcaacgcttttagtatggcatacatggcaaaaacaaacccaaaggagcggagtcttgtgggatgtaccatcaccacccgaaacgcaaaaagctgagttggaagaaggagtctacagaataaaacaacaaggcatatttggaaaaacccaagttggagttggggttcaaaaagagggtgtatttcacacgatgtggcatgtgaccaggggtgcagtactaacgcacaacggaaaaagactggagccgaactgggctagtgttaagaaagatctcatatcttacggaggtgggtggcgactgtcggcacagtggcaaaaaggagaagaagtgcaagtcattgccgtcgaaccgggtaaaaaccccaaaaattttcagacaatgccaggaatttttcaaacaaccaccggagaaattggtgccattgcactcgactttaaacccgggacaagtggatctccaataattaaccgtgaaggaaaggtggtaggactatatggaaatggagtagtaactaaaaacggaggatatgtatctggtatagcacaaactaacgcagagccagatggaccaacaccagaattagaggaagaaatgttcaagaaacgcaatcttaccataatggatcttcacccaggttccggaaaaactcgaaagtacctacctgcaattgttagggaggcaattaagagacgtttacgaactctgatccttgcaccaacgcgggtagtagctgcagaaatggaagaagccctaaaaggtttacctattcgctatcaaacaaccgctactaaatcagaacatacaggcagagagatagtagaccttatgtgtcatgccacattcactatgcgactactttcaccggtcagagtaccaaactataatttgattattatggacgaagcacacttcactgatcctgcatctatagcagcacgtggatatatttcgaccagagttggtatgggagaagctgcagcaattttcatgacagccacaccaccaggaactgccgacgcctttcctcaaagtaacgcacctattcaagatgaagaacgagatatacccgaacgatcttggaacagtggtaacgaatggataactgattttgtgggaaaaactgtgtggtttgttccatccataaaagcaggtaatgatatagccaactgtcttaggaaaaatggaaagaaggtgatacaattatctagaaaaacatttgatactgagtatcaaaagacaaagctaaacgactgggactttgtagtaactacagacattagcgaaatgggggctaattttaaagcggaccgagttatagatccccgccgatgcttaaaacccgtaatattaacagatggacccgagcgcgtcatactggcaggacctatgccggtaaccgcagcgtctgcagcccagagaagaggacgtgtgggaaggaatccccaaaaggagaacgatcagtacatatttagaggccaaccattaaacaacgatgaagatcacgctcactggacagaggcgaagatgttactagataatattaatacgcccgaaggcattattccagccttatttgaacctgaaagagagaaaagtgctgctatagacggagaatatagactaaaaggagagtcgaggaaaacttttgtcgaattaatgcgaagaggagatctgccagtctggctcgcccacaaagtagcctcggagggaatcaagtacacagatcgtaaatggtgcttcgatggtgaacggaataatcagatattagaagaaaatatggatgttgagatttggacaaaagaaggagaaaagaagaaattaagaccaaggtggctagatgcgcgaacatattcagatcctctagcacttaaagagtttaaagattttgcagcaggtagaaaaagcattgcattggacttggtgacagaaataggacgggtgccatcgcacctagcacataggacaagaaatgccctagataatctggtcatgttacatacctccgaacacggtggtagggcatatcgacatgcagtagaggaactgccagaaactatggaaacgctacttttgttaggactaatgatattgctcacaggaggtgccatgttattcttaataagtggtaaaggaataggtaagacatccatcggattaatttgtgtgatagcatcgtccggaatgttatggatggccgatgtcccgttacaatggatagcttccgcaatcgtgttagagttctttatgatggtattattgattcctgaaccagaaaaacaaagaactcctcaagataatcaactagcatatgttgtcataggaattttaacgctagctgcaatcgtagctgcaaatgaaatgggcctattggaaacgacaaagagagacctagggatgtcaaaagagcctggagtagtatcaccgacaagctatttagatgtcgatctgcaccctgctagcgcatggacactatatgctgtagccacaacggtgataacaccaatgttgcggcatactattgaaaattcgacagcaaatgtttcactcgccgctattgcaaaccaagccgtagttttaatggggctagacaaagggtggcccatctcaaaaatggacttgggagtcccattattagctcttggttgttatagtcaagtcaacccactaacccttactgccgccgtattgctcctagccacacactatgccatcataggtccgggtttacaggcgaaggctactcgagaagctcaaaagagaacagcagcgggcataacaaagaaccccaccgttgatggcataatgacaatagatctcgatcctgtaatatatgacagtaagtttgaaaaacaattaggacaggtcatgttattagtgttgtgcgcggtgcaacttctcttaatgagaacgtcatgggcattatgcgaggcattaacacttgccacgggccccattacgacattatgggagggaagccctgggaaattttggaatacgacgatagcagtaagcatggcgaacatatttcgcggtagctatttggcaggcgctggtttagcattttcaattatgaaaagcgtaggcacaggcaaaaggggaaccggttcacaaggtgaaactctaggtgaaaaatggaagaagaaactcaaccaacttagtagaaaggagtttgacttatacaagaaatcaggcataaccgaggtcgatagaacagaggccaaagaaggcctaaaacgtggtgaaataacacgacatgcggtatcaaggggtagcgcaaaactacaatggttcgttgaaaggaacatggttataccagaaggtcgagtgatcgatttaggctgtggaaggggaggttggtcatattactgcgcaggactcaaaaaggtcactgaagtgagaggatatacaaaaggagggcctggccatgaagaaccggtgccaatgagtacatatggttggaatatagtgaaattaatgtcaggcaaagacgtattctatttacctcccgaaaagtgtgatacgctcttatgtgatatcggcgaatcatcgccctcaccaacagtagaagagtcgcgtacaataagagtccttaaaatggtagaaccatggctaaagaacaaccaattctgcataaaagtgttaaacccttacatgccaacagttatcgaacatctcgaaaggctacaacgaaaacatggtggaatgctcgtaagaaatcctctaagtcgtaattccactcatgaaatgtactggataagtaacggtacgggaaatattgtgtccagcgtaaacatggtaagtagactattgttgaacaggtttacaatgacacatcgaagacccaccatagaaaaagacgtagatttaggagctggcacgagacatgttaacgctgagccagaaaccccaaatatggacgtcataggtgaacgtataaaacggatcaaagaagaacacaattcaacatggcattatgacgacgaaaacccatacaagacatgggcgtaccatgggtcatatgaagttaaggccacaggctctgctagcagcatgatcaatggagttgtaaaattattaacaaaaccttgggatgttgtacctatggtaattcaaatggcaatgacagatacgacaccctttggacagcaaagagtattcaaagagaaagtagatactagaactccccgtcctatgcctggaactagaaaagtcatggagataactgccgagtggctatggcggaccttaggtagaaacaagcggccacgtttatgtacacgtgaagagtttaccaagaaagtacggacgaatgcagcaatgggagcggtctttaccgaagaaaatcagtgggattctgccagggctgcagttgaagatgaagaattttggaagctagtggatagagagagggagctgcataagttaggtaagtgcggatcctgtgtatataacatgatgggaaagagggagaagaaattaggcgaatttggaaaggcgaaaggaagtagggcgatctggtacatgtggttaggagctaggtatctagaatttgaagcactagggttctttaatgaagatcattggttttctagggaaaactcctatagtggagtagaaggggaaggacttcacaaattaggttatatattacgtgacataagcaaaattccaggtggtgcaatgtacgcagatgacactgcagggtgggatacgcggattaccgaggacgatttacacaacgaagagaaaatcacacaacagatggatcctgaacatagacaattggctaatgcaatatttaaactgacttatcaaaataaagttgtaaaagtccagagacctacccctaaaggcactgtaatggatattatttctcgaaaagatcaaagaggaagcggtcaagtgggtacgtacggattaaacacgtttaccaatatggaagcccagctcgtacgtcagatggagggagaaggagtcttatcaaaagcggaccttgagaatccacacctcttggagaagaaaataacacagtggctagaaacgaaaggtgtagaaagattgaaacgcatggcaattagcggcgacgattgtgtggtaaagccaatagacgacagatttgccaacgcattactggcactaaatgatatgggaaaagtcagaaaggatatcccccaatggcaaccatctaagggatggcacgactggcagcaggttcccttctgctcacaccatttccatgaactaataatgaaagatggaagaaaacttgttgtcccatgtcgaccacaagacgagctgataggacgagcgcgaatttccagaggtgctggttggtcactgaaggaaacagcatgcctaggaaaggcatacgcgcaaatgtggtcactcatgtatttccaccgacgcgacctacgattagcaagcaatgccatatgctccgcagtaccagtacactgggttccaacatctagaacaacgtggagtattcacgcacatcatcaatggatgacaactgaggatatgttaacagtttggaatagggtatggatcgaggataatccatggatggaagataaaactcccgtgacaacttgggaagatgtaccatacttaggtaaaagggaagatcaatggtgcggcagtctaatagggttgacaagccgtgctacttgggcacaaaatatcttaacagctatacaacaggtaaggtccctcatagggaatgaagaatttttagactatatgccatcaatgaaacggtttaagaaagaagaagaaagtgagggagccatttggtag

SEQ ID NO: 23554 - RNA, 9873 nt, synthetic construct
  misc_feature 1..9873: note = derived and/or modified CDS sequence (opt6) from DENV-3__KJ737430__SS-prME
  source 1..9873: mol_type = other RNA
acaagtctttgtcttatgatgatgttaccagcgactttagcatttcacttaacgagtcgagacggtgagccccgtatgatagtaggcaaaaatgaaaggggtaaatccttgcttttcaaaacggcaagtggaataaatatgtgtacactgatagctatggacctaggtgaaatgtgcgatgatacagttacttacaaatgccctttgattgcagaggtcgaaccagaagacatagattgttggtgtaatttaacttctacctgggtcacatatggaacctgtaaccaagcaggagaacacagacgcgataaaagatcagttgcactagcaccgcatgtgggaatgggactagatacgaggactcaaacctggatgagtgcagaaggtgcatggaggcaagttgagaaagtcgaaacatgggccttaagacatcctggctttacaatactagcactgtttctagcgcactacattggaaccagtctcactcaaaaagttgtaatttttatcctactaatgctagtaacaccgagcatggccatgagatgtgtaggagtcggtaacagggacttcgtagaaggtttaagtggagctacttgggttgacgtagttctagaacatgggggatgtgttacaactatggccaaaaataaaccaacgctggatatcgagttacagaaaaccgaagctacgcaactagcaactctaagaaaactatgtattgaagggaaaataacaaatataacgacagattctcgctgtcccacacaaggggaagcgatactaccagaagaacaagatcaaaattatgtatgtaaacatacatacgtagaccgaggttggggtaatgggtgtggattatttggcaaaggtagtttagtgacttgtgcaaaattccaatgccttgagagcatagaaggtaaagtcgtgcagcatgagaacttaaaatacaccgtaataataacagttcatacaggtgatcagcatcaagtaggaaacgatacgcaaggagtaacggtggaaatcacaccccaggcctcaacggttgaggccatacttccagaatatggcacattaggcttagaatgcagcccaagaactggattagatttcaatgaaatgatcctattaaccatgaaaaataaggcttggatggttcaccgacaatggtttttcgatcttccacttccatggacgtctggtgcaacaacagaaactccgacttggaacagaaaagagttactcgtgacgtttaaaaacgctcatgccaagaaacaagaggtagtggtgctaggaagtcaagagggggcgatgcacacagccttgaccggtgccacagaaatccaaaatagcggcgggacaagtatatttgccggccatttaaaatgcagattaaaaatggacaaattagaactcaaaggtatgtcatatgcgatgtgcttgaacacgttcgtacttaagaaagaagtctcagaaacacaacatggtactatcttaataaaagttgaatataaaggagaagacgccccgtgcaaaatccctttcagcacggaggatggtcaaggtaaagctcataacggaagactgatcactgccaatccagtagttaccaagaaagaagaaccagttaatatcgaagcagaaccaccattcggtgaatcgaatatagtaatcggcataggtgataaagctctcaaaataaattggtataagaaagggtcttcaataggaaaaatgtttgaagcaacagcacgaggagctcgccgtatggccattctaggtgataccgcatgggatttcggctcagtaggtggcgttttaaatagtcttggtaaaatggtacatcaaatatttggatcggcatatacagcactcttttctggggtgtcgtggataatgaaaataggaatcggtgttttattgacctggataggccttaattctaaaaatacatcaatgtcattttcatgtatcgctatcgggataattacactatatctcggtgcagttgtacaggcggacatgggctgtgtaataaattggaaagggaaagagctcaaatgtggaagtggtatttttgtgacaaatgaagttcacacatggacagaacaatataaatttcaggcggattctcctaaacgccttgccactgcaattgctggagcatgggaaaatggagtttgcgggatacgatctactacgaggatggaaaacctactctggaaacagattgcgaacgaactgaattatatactctgggaaaacaatataaaattaactgtagttgtaggagatataatcggagtcctggaacaaggaaaaagaaccttaactcctcagcctatggaattaaaatatagttggaagacctggggtaaagcgaaaatcgtaacagcagaaacccaaaacagttcattcataatagacggtcctaataccccagaatgccctagcgccagcagagcgtggaatgtatgggaagtcgaagactacgggttcggtgtatttacgactaacatatggctcaaactgagggaggtttacacacaatcatgtgaccacagactaatgtctgccgctatcaaagatgaacgagcagtacatgcagatatgggctattggatagagtcacagaaaaatggcagctggaaacttgagaaagcctcgtttatagaagtcaaaacatgtacatggccaaaaagccacacactttggtcaaatggcgtgttagaatccgacatgattatccccaagagcttggcgggcccaatatcacaacataatcacagacccggctatcatactcaaacggcagggccctggcatttagggaaactagaattagattttaactactgcgagggcaccactgtcgtaattaccgaaaattgtgggacacgaggtcccagcttaagaactacaacggtaagcgggaaattaatacatgagtggtgttgccgctcgtgtacgttgccaccattacggtatatgggcgaggatggatgctggtatggcatggaaataaggccgatcaatgagaaagaggaaaatatggttaagagcttagtgtcagcaggctcagggaaagtagataactttactatgggtgttctatgtttagctatcctctttgaagaagtgatgcggggtaaatttggaaagaaacacatgatagcaggcgtactatttacctttgtcctactactaagtggtcaaataacatggcgagatatggcccatacactaattatgattggatcaaacgcaagcgatcgtatgggaatgggggtaacatatttagcgctcatagcgacattcaaaatccaacctttcttagctttaggattctttctccgaaaactaacatctagagagaacttgctactcggggttggattggcaatggcaacaaccctacagctacccgaagacatagagcagatggctaatggaatagcgttggggttgatggcactcaaactgataactcagtttgaaacataccaactatggaccgccttagtatcacttacatgcagtaatacgatcttcactctgacagtggcttggaggactgctactttgatattagcaggagtttcgctgttgcctgtctgtcaatcttcctctatgcgcaaaactgattggttgccgatggctgttgcagcaatgggagtaccaccattacctctatttatattctcactaaaagacaccctaaaacggcgtagttggcccctaaatgagggggttatggccgttggtttagtatctatactagcatcatcgctgttaagaaatgatgtaccgatggctggcccattagttgcgggaggactgctaatagcatgttacgtgatcacaggaacaagtgcagacctgacggtggaaaaagcagctgacgttacatgggaagaagaagcagaacaaacaggggtaagccataatctaatgattaccgtcgacgacgatggtacgatgagaataaaagatgatgaaaccgaaaacattcttacagttttactgaaaactgccttacttatagtaagcggaatattcccgtattccatcccagccacactattagtatggcatacatggcaaaaacagacacaaagaagtggagtcttgtgggatgtgccgagtcctccggagacccaaaaggcagaattggaggaaggtgtgtatcgtattaaacagcagggaatttttggcaaaacacaagtaggagtaggagtacaaaaagaaggggtattccatactatgtggcacgtgacgagaggggccgtcctaacgcacaatggtaaaagacttgaacctaattgggcatctgtgaagaaagatttaatttcttatggcggtggctggagattaagtgcacaatggcaaaagggagaagaagttcaagtcattgcggttgaaccaggcaaaaatcctaagaactttcagaccatgccgggtatatttcaaactacaactggtgaaattggggccatcgcgctagattttaaaccaggtacatccggaagccccattatcaatcgtgaaggaaaagtagtagggttatacggtaacggagttgtgactaagaatggagggtacgtaagcgggattgctcaaaccaacgctgagcctgacggacccaccccagagctcgaggaagagatgtttaagaaaagaaatttaacaataatggatctccatcccggatcaggcaaaacacgaaagtaccttccagctatcgttagagaggctatcaaaagacgtttgcggacgcttatactcgctccaacaagagtagtggccgctgaaatggaggaagcattaaaagggttacctataagatatcaaaccacggcaacgaaaagtgaacatacaggacgagaaatcgtagatctaatgtgccatgctacttttacaatgcgacttcttagcccagtacgagtccctaactataatttaattataatggatgaagcacactttaccgatcccgcttctatagcagcacggggatatatatcaactcgcgttggaatgggtgaagcagcagccattttcatgacggcgactccacctgggacagcggaggcattcccacaatcaaacgccccaatacaagatgaagaaagagacatcccagaacgaagctggaactccgggaatgagtggataacagattttgtaggcaagacagtttggttcgtacctagtatcaaagctggaaatgacatagccaattgtctcaggaaaaatgggaagaaagtaatacagctaagccgcaaaacatttgatactgagtatcaaaagacaaaacttaacgattgggattttgttgtaacaaccgatatatcagaaatgggggcgaattttaaggcagatcgagttatcgatccccgacgatgtttaaaaccagttatccttactgacggaccagaacgagtaatattagcaggccctatgccagtgaccgcagcatcggcagcacaaagaagaggccgggttggtagaaatcctcaaaaagaaaacgatcaatacatcttcacaggacaaccactaaataatgatgaggaccatgctcattggacagaagccaaaatgctactagataacataaatacgccagaaggcataatccccgctctgttcgagcccgaaagagaaaaatcggcagcaatagatggagaatatagactaaaaggagaatcgaggaaaacctttgtagaattgatgcggcggggagatctccctgtctggttggctcacaaagttgcaagcgaaggaataaaatatactgatagaaagtggtgttttgacggagagaggaataatcaaattttagaagagaatatggacgtagaaatatggactaaagaaggagaaaggaagaaattacggccacgctggttggatgcgcgaacttactccgatcctctagccttaaaggaatttaaagacttcgcggcgggaagaaaatcgattgcactcgacctagtcacagaaattggacgggtacctagtcatctagcacaccggactagaaatgccttggataatttagtaatgttacatacatcggaacatggaggtagagcgtaccgacatgctgttgaagaattacccgagacgatggaaacgcttctgctgctagggttaatgattctattgacaggtggagccatgttattcttaattagtggcaaaggcataggaaaaacatctatcggactgatttgcgtgattgtaagctctggaatgttatggatggctgatgttcctttacaatggatagcatctgctattgtattagagttctttatgatggtgctattgataccggaaccagaaaaacaaagaacgccgcaagataatcaattagcgtatgtcgttatagggatactgacccttgcagcaatagttgcagctaatgagatgggactgttagaaacaacaaaaagagatctgggaatgagcaaggaaccaggagtagtatcacctacaagttatctagatgtcgacctccatcctgcttctgcatggacattgtacgcagtagctacgacagtaataacaccaatgttacgacatacaattgaaaatagcacggccaacgtaagtctagcggcaatagcaaatcaggctgtagtcttaatgggattagacaaaggctggccaatttccaaaatggatttaggtgtcccattacttgctctcggttgttactcacaagtgaatccccttacactaactgcagcagtacttttacttgttacacactatgcaattatcggaccaggattacaggcgaaagctactcgtgaagcacagaaaaggacggcggcgggtatcatgaaaaatccaaccgtggatggaataatgacaatagatctagaccctgttatatacgatagtaagtttgagaagcaattaggccaagtcatgctcctagtcctatgtgccgtccagttactccttatgcgtacatcatgggccctatgtgaagctctgacgctcgcaacgggcccaataacaactttatgggaaggaagcccgggaaaattctggaacacaacgattgcagtctccatggcgaatatctttcgaggaagctacctcgctggagccggattagcatttagtattatgaagtcagtaggtaccggaaaaagaggtacgggctctcagggtgagacacttggtgaaaaatggaagaagaaattaaatcagctgtcaagaaaagaatttgatctatataagaaatcggggatcacggaggtcgaccggactgaagcgaaagagggcctcaaaagaggggaaacaacacaccatgcagtaagtagaggtagcgcaaagttacaatggttcgtagaaaggaatatggtgatcccagaaggacgtgttattgatttgggatgcggaaggggaggctggtcctattattgtgcgggtttgaagaaggtgactgaagtacgaggatatactaagggcggacccggacatgaggaacctgttccaatgagtacatatggatggaatatagtaaaattaatgagtggaaaagatgtcttctatctgcctcctgagaaatgcgatacgctactatgcgacatcggggaatcaagtcctagcccaaccgttgaagaaagcagaaccatcagggtcctaaaaatggtggaaccctggctcaaaaataaccaattctgcataaaagtcctaaacccatatatgccaactgtaatagaacacttggaaagactccaaagaaaatatgggggtatgttggtaagaaatccgttatcaaggaatagtactcatgaaatgtattggatatcaaatggaacaggaaacatcgtgagctccgtaaatatggttagtcgcttattactcaatagatttaccatgactcacaggcgacctacaatagaaaaggatgtagacttaggcgctggaacgagacatgtgaacgctgaacccgaaactccaaatatggatgttatcggagaaagaataaaacgaattaaagaagaacattctagtacatggcattacgatgatgaaaacccatataaaacctgggcgtatcacggctcttacgaagttaaagctacaggctcggcctcttcaatgattaatggagtcgtaaaacttctaacgaagccttgggacgtagttcctatggttatacaaatggcgatgactgacacaacaccatttggtcaacaaagagtatttaaagaaaaggtagacacacgaacacctcgtccgatgcctggaactaggaaggtgatggaaataactgcagaatggctctggagaacacttggtcgaaataagcgaccacgactatgcacaagagaagaatttacgaagaaagtacgtacaaacgcagcgatgggtgcagtattcactgaagaaaaccaatgggactccgcgcgtgccgctgtagaagacgaagagttttggaaacttgtggatcgggaaagagaattgcataaattagggaaatgtggttcttgcgtttacaacatgatggggaaaagggagaagaaattaggagaatttggaaaggcaaaaggctcacgcgcaatttggtatatgtggctcggagctagatatcttgaatttgaagcattgggttttctaaacgaagaccattggttctccagagaaaactcatattcgggggtagagggcgaaggtcttcataaactaggatacatattacgtgatatatccaaaatacctggtggagcaatgtacgcagacgatacagctggttgggacactagaataacggaggatgatctccacaatgaagagaaaatcacacaacaaatggatccggaacatagacaattggcaaatgcgatatttaaattaacctaccaaaataaggtcgtcaaagtgcagcgccccactcccaaaggtaccgttatggatatcatctcacggaaagaccagcgaggcagcggacaggttgggacttacggactcaatactttcacaaacatggaggcacagctagtccgccaaatggagggcgagggcgtactcagcaaagctgatttagaaaatccgcatctactagagaagaaaattacacaatggcttgaaacaaaaggtgtagaacgccttaagcgcatggcaatatccggcgatgactgtgtagtaaaaccaatagatgatcgattcgctaacgcactcctagcactaaatgacatgggtaaagttcgtaaagatataccacaatggcaaccgtctaaaggttggcatgattggcaacaagtacccttctgtagccaccattttcatgaattgattatgaaggatgggaggaaattagttgtaccgtgtagacctcaagatgaactaattggtagagctaggataagccaaggtgcaggttggtcgttaaaagaaactgcttgcttgggtaaggcgtatgcacaaatgtggagtttgatgtatttccataggcgggatcttagactagcctcgaatgctatctgttcagctgtacctgttcattgggtcccgacatcaagaacaacttggagtatacatgcgcaccatcaatggatgacaaccgaggacatgttaacggtttggaacagggtatggattgaggacaacccatggatggaggacaaaacgccagttaccacttgggaggatgtcccgtatctaggaaaaagagaagaccaatggtgtggtagcttaattggattaacaagtagagctacatgggcacaaaatatattgacagctatacagcaagtcagatccttgatcggtgatgaggagttcttagactatatgccgagtatgaaaagatttcgaaaagaagaagaaagcgaaggtgccatctggtag

SEQ ID NO: 23555 - RNA, 9873 nt, synthetic construct
  misc_feature 1..9873: note = derived and/or modified CDS sequence (opt6) from DENV-3__AY858040__SS-prME
  source 1..9873: mol_type = other RNA
acctcactatgcctaatgatgatgttaccggctacccttgcgtttcaccttacatcgagagacggggaacccagaatgatcgtagggaaaaacgaacgaggcaaaagtctgctgtttaaaacagcatcaggtatcaatatgtgtaccctaatagcgatggatttaggagaaatgtgtgatgacactgtgacttataaatgtcccctaataacagaagtggaacccgaagatatagattgttggtgtaatctaaccagtacttgggtgacatacggtacttgtaaccaagctggggaacatcgaagagacaaaagatcggtggctttagcgcctcacgtcggaatgggtctagatacacgtgcacaaacatggatgtcagcagaaggagcgtggcggcaagtagaaaaagtcgaaacctgggcctttcgacaccctgggttcacaatactagcactattcttggctcattatatcggtacatccctaacccaaaaagttgtgatattcatattattgatgcttgtgacgccgagtatgacaatgcgctgtgtcggagttggaaatcgcgactttgtagaaggcttaagtggcgcaacatgggtagacgtagtattagaacatggcggttgcgtgaccaccatggctaaaaataaaccaaccttagacatagaattgcagaaaactgaagctacacaattagccacattaagaaaactgtgtatagaaggcaaaataaccaacgtgaccactgacagtcgatgtccaacccaaggtgaggcaatcctaccagaagaacaggaccaaaattatgtatgtaaacatacatacgtggatcgtggatggggaaatggatgtggcctatttggaaaaggctctcttgttacatgtgccaaatttcagtgcctagaactaatagaggggaaagtagtccagcatgagaaccttaaatatacagttatcataactgttcatactggggatcaacaccaagtgggaaatgaaactcagggagtcacagcagaaatcaccccgcaggcatcaacggtggaggcaatcctacccgaatatggaacgctaggtctagaatgctcaccaagaacaggattagactttaacgaaatgatattactaacaatgaaaaataaagcatggatggtacaccggcaatggttctttgacttaccattgccctggacgtctggggcgactactgaaacgccaacgtggaataagaaagaactgttggtgacatttaaaaacgcccatgccaagaaacaagaagttgtcgtactaggtagtcaagagggtgcgatgcataccgcattaaccggcgcaacagaaatccagacgagtggtggaacatctatatttgccggccatttgaaatgtaggctaaaaatggacaaattggagctcaaaggcatgagctatgcaatgtgttctaatgcatttgtactaaagaaagaagttagcgaaacacaacatggaacaattctcatcaaagttgaatacaaaggagaagatgcaccatgcaaaatccccttttcaacagaggacggccaaggcaaagcacataatggccgcctaattacagcaaaccccgtagttaccaagaaagaagaaccagtcaacatcgaggccgagcccccttttggagaatcaaatatcattattggaattggggacaaagcacttaaaattaattggtacaagaaaggatccagtatcggcaaaatgtttgaagcaaccgcaagaggggcacgaaggatggcaatattaggggacaccgcctgggatttcggatccgtaggtggggtattaaattctttagggaaaatggttcaccaaatttttggaagtgcatatactgcacttttctccggagtatcatggataatgaaaattggaattggggtattattaacatggataggactaaatagcaaaaacacatctatgtcattcagctgtatcgtgataggcataattactctatatttaggtgccgttgtccaagcagacatgggctgcgtaataaactggaaaggcaaagaattaaaatgtggctctggcatttttgttaccaacgaagttcacacctggaccgaacaatataaatttcaagccgatagcccgaaaagattagcgactgctatagcaggagcatgggaaaacggagtctgcggaattaggagtacaacgcgaatggaaaatttactatggaaacaaatagcgaatgaacttaattatatactatgggaaaataatattaaactaacggtcgtagtaggcgatatcataggggtattagagcaaggtaaacgaacactaacgccccaacccatggaattaaaatattcttggaaaacttggggaaaagcaaaaatagtcacagcggaaaagcaaaattcatcattcattatagatggaccaaatactcctgaatgcccaaatgcatcgagggcgtggaatgtctgggaagttgaagattacggtttcggagtatttacaacgaatatatggttaaagttaagagaaatgtacacacaattatgcgaccataggctcatgtcggcggcggttaaagacgaacgagcagttcatgcagatatggggtactggatagagtcccagaaaaatggtagttggaaactcgagaaagctagtctcatagaagtaaaaacctgcacatggcccaaaagtcatactctttggtcaaacggcgtattagaaagcgatatgattatacccaaaagtttagcgggcccaatatctcaacataactaccgaccaggctatcatacacaaacggctgggccatggcatctaggaaaactcgagctcgactttaattactgtgaagggaccacagtcgtcataacggaaaactgtggtactcgaggaccttctttacgtacaacgacagtgtcaggtaaattgattcacgaatggtgttgtcgaagctgcaccttacctccactaaggtacatgggtgaagacggttgttggtacggaatggaaatacggccaattaacgagaaggaagaaaatatggtaaaatccctggtttcagctggcagcggaaaagtagataacttcacgatgggagtactatgtttggcgattctgtttgaagaagtgatgaggggaaaatttggcaaaaagcatatgatagccggagtcttgttcaccttcgttcttcttctaagcgggcaaataacctggcgagatatggctcgaacattgataatgataggctcaaacgcatctgatcgtatgggaatgggagtcacatacttagccctgatcgctacctttaaaatacaaccctttctagcgctaggattctttttgagaaaattaacttctcgcgaaaatcttctacttggtgtaggcttggctatggcgaccacacttcaactcccagaagacattgaacaaatggctaatggaatagcattaggcttgatggctttaaagttgataacacaatttgaaacgtatcaactctggactgccctagtatcgttaatgtgctcgaatacgatcttcacacttacggtagcatggagaacagcaacgctcattctcgctggaatttctttgatgccagtatgtcaatcgtcatcaatgagaaaaaccgattggttaccaatgacagtggcagctatgggtgtaccacctctaccactattcattttctcattgaaagacacattgaaaaggaggagttggcccctaaatgagggagtaatggccgtaggcctcgtttctattttagcatcatcgctactgcgaaacgacgtaccaatggctggaccgttagtagctgggggattgttaatagcatgctatgttattacaggtacatctgcagatctcacagttgagaaagcggcagatgtcacttgggaggaagaggcagagcagacgggtgtcagtcacaatctgatgatcacggtagacgatgatgggactatgagaattaaagatgatgagacggaaaatattctaacagttttgttaaagacagcactcctgattgttagtggaatatttccatatagtataccggcaacgctcttagtatggcacacatggcagaaacaaacccaaagatcaggggtattgtgggatgtacccagtccacctgaaacacaaaaagcagaattagaagaaggtgtgtatcgaataaaacaacaaggtatcttcggtaaaacgcaagttggcgtaggagtgcagaaagagggcgttttccatacgatgtggcatgttacaagaggggcagtgttgacgtacaacggtaaacgattagaacccaattgggcatcagtcaagaaagatcttataagctatggtggcgggtggcgactttctgcctactggcaaaaaggtgaggaagtacaagtcatcgcggtagaaccgggtaaaaatcccaaaaattttcagacaatgcctggtatttttcaaacaacaacaggggaaatcggggcaattgcactagattttaaacccggaacatccggatcacctattatcaatcgagaaggaaaagtagtaggactctatggcaatggagtggtgactaaaaatggcgggtatgtaagtgggatcgcacagaccaatgcagaacctgatggaccgacaccagaactagaagaagaaatgtttaaaaagaggaatctgacaattatggatttgcatccaggttcaggtaaaactaggaaatatctgccggcaatagtacgagaagctattaagcgtagattacgcacgttaatactggctccaacaagagtcgtggccgcggagatggaggaagcacttaagggactgcctgtaagatatcagactaccgcaacaaaaagcgaacatacagggaaggaaattgtggatttaatgtgtcacgccacattcactatgagactactaagtccggtaagagtacctaattacaaccttataattatggatgaagctcacttcaccgaccccgccagcattgctgcaagaggatacatatccactcgcgtaggaatgggggaagccgctgcgatatttatgacagcaacaccacccggaacagccgacgcatttccgcaaagcaatgctcctatacaagacgaagaacgagacataccagaacgtagttggaactcaggcaatgactggataaccgactttgcaggtaaaactgtatggtttgtaccaagcattaaggctggaaacgatatagctaactgtcttaggaagaatggtaagaaagtaatacaattatctcgaaaaacttttgatacagaataccagaaaaccaaacttaatgactgggatttcgttgtaacaacagatatctcagaaatgggtgcaaatttcaaggccgatcgcgtcatcgaccctcgaagatgccttaaaccagttatcctaacagacggtccggaacgagtaatcctggcaggaccgatgcccgtaacagtagcttccgctgcacagcgtcgaggtagggtaggaagaaacccacaaaaggagaacgatcaatatattttcacaggccaacctctaaataatgatgaggaccatgctcattggactgaagccaaaatgctattagataacattaatacacccgaagggattataccggcgttattcgagccggaaagagaaaaatcggcggccatagatggtgaataccgaccaaaaggagaatctcgtaagaccttcgtagaactgatgcgacggggagatcttccggtctggttagctcataaagtagcttctgagggcataaagtataccgatcgtaaatggtgttttgatggagaaaggaataatcaaatactagaagaaaatatggacgtagaaatctggacgaaagaaggtgagaaaaagaaactgagaccccgctggctagatgcacgaacgtatagcgatcctttagcactaaaggaatttaaggatttcgctgcaggaaggaaatctatagcactagacctggtaacagaaattggacgtgtaccgtcccacctggctcacagaactagaaacgcattagataacttggtaatgctccatacctcagaacatgggggcagggcatataggcacgctgtggaagaattacccgaaactatggaaactctcttactcctaggtctgatgatactattaactggcggtgctatgctctttttgataagtggaaaaggagtcggaaaaacgagtataggattgatctgtgtagtagccagctctggcatgttgtggatggctgacatcccattgcaatggatagcaagcgctattgtgttagagttctttatgatggtgctactcatcccagaaccagaaaaacaacgtacaccacaagacaatcagctagcatatgtagtaatcggcatacttacactcgcagcaatagtggccgcgaatgaaatgggcctattagagacaacaaaaagagatctcggaatgtctaaagaaccaggagttgttagcccaacgagctatcttgatgttgatttgcatcccgcgtctgcttggacgttatacgctgtagctactacagtcattacgccgatgcttagacataccatcgaaaattcaacagcaaatgtgagtttggctgcaatagctaaccaagcagtcgtattaatgggtttggacaaaggctggcccatatcaaagatggatctcggggtaccacttttagcgttaggctgttactctcaggtgaacccgcttactttaacagcagccgttttattactcgtaacacactatgctattatcggccctggtcttcaagctaaagctactcgcgaggcgcagaaaagaacagccgccggcataatgaaaaaccctacagttgatggaataatgactattgacttagatccggtaatttatgattcgaaatttgaaaaacaactaggacaagtaatgctattagtactctgtgcagttcaattacttcttatgagaacttcatgggcgttttgcgaagcattaacattagcgacaggaccaataacaacattgtgggaaggttcaccaggaaaattttggaacactacgatagccgtatccatggcaaatattttcagaggcagctatctcgccggagcaggcttagcgttcagtataatgaaatccgtaggaaccggcaaaaggggaactggtagccaaggagaaactctcggtgaaaaatggaagaagaaactgaatcaactatccagaaaagaatttgatctttacaagaaaagtgggatcacagaggtagatagaactgaagcaaaagaaggcttaaaaagaggagaaatcactcatcacgcagtgtcccggggctctgctaaactacaatggtttgtagaaagaaacatggtcattccagaaggtcgcgtaatagatctagggtgtggacgaggcggctggagttattattgtgcgggtctaaagaaagttaccgaagtccgaggctacaccaaaggaggaccgggacatgaagaaccagtccctatgagtacgtatggttggaatattgtcaagctcatgtcgggtaaagatgttttctatctaccccctgaaaaatgcgacactcttttatgtgacattggggagtcatcacccagtccaacggtcgaagaaagcagaacaataagagtattaaaaatggtagagccatggctcaaaaataaccaattctgtataaaagtcctaaatccctatatgccgacggttatagaacatttagagcgacttcagagaaaacacggaggaatgctggtgcgaaacccactgtcccgtaattccacacacgaaatgtactggatatcgaatggcacaggaaatatagtgagctccgtaaacatggtttcaagattgttgcttaatagatttaccatgacatatagacggcccacgatagagaaagatgtagatctaggcgctggaacgcgtcacgttaatgctgaaccagaaactccgaatatggacgttataggtgaacgcatacgccgaataaaagaagaacactcatcaacatggcattatgacgatgagaacccatacaaaacatgggcttatcacggaagttatgaagtgaaagccacaggatctgcgtcttcaatgatcaatggtgttgttaagttacttaccaaaccatgggatgtcgtgccaacagtaacacaaatggctatgacggatactacacctttcggacagcaacgggtattcaaagagaaagtcgatacaaggacgcccaaaccaatgccaggaactagaaaggtcatggagatcactgcagaatggttatggagaacgctaggcaggaataagcgaccacggttatgtacacgcgaagagtttacaaagaaggtacgaactaacgcagcaatgggtgcggtctttacagaggagaatcaatgggattctgcccgagccgccgtggaagacgaagaattttggaaattggttgatagagaaagagaactccacaaacttggtaagtgcggtagttgcgtctataatatgatggggaaacgggagaagaaacttggtgagttcggaaaagccaaagggagccgcgcaatatggtatatgtggctcggagcaagatacttagaatttgaagcgttagggtttcttaacgaggatcactggttttctagagaaaatagttactctggagtagaaggtgaaggtctacacaaattgggttatatattacgggacatatctaagataccgggaggcgctatgtatgcggatgatacggcgggttgggatacacgtataacagaagatgatttacacaacgaggagaaaataacccagcagatggagcctgaacaccggcaactggcaaacgcgatctttaaattaacctaccagaataaagtagtcaaagtccaaagacccacacctaaaggcaccgtgatggatataatctctcgaaaagatcaacgtggctccggacaagttggtacatatggcttgaatacgtttacgaacatggaagcccaattaatccgccaaatggagggtgaggatgtgcttagcaaaacagatctagaaaacccccatctactagagaagaaaattactcagtggttggaaacgaaaggagtagaacgccttaaacggatggcaatatcaggagatgactgtgtagtgaaaccaatagacgacagatttgcaaacgcactcttggcgttgaacgacatgggaaaagtcaggaaggacataccccaatggcagccaagtaaaggttggcatgactggcagcaggtaccattttgcagtcaccactttcatgaacttattatgaaagatggccgtaaacttgtagttccatgtagaccccaagacgaactaatcggaagggcaaggatatcccaaggtgcgggatggtctttgaaggaaaccgcttgcttaggcaaggcttatgctcagatgtgggcgctgatgtactttcaccgaagagacttaaggctagccagcaatgcaatatgttcagcagtaccagtacactgggtaccaacgtcacgaaccacgtggtcaatacacgcacaccatcaatggatgactaccgaagacatgttaacagtatggaatcgtgtctggatcgaagacaatccttggatggaagataaaacgcccgtaacaacttgggaagatgtaccatacttggggaaaagggaagaccagtggtgtgggtctctaataggactcacaagtagagcaacatgggcgcagaatatactaacagctatacaacaggtaaggtcgctaatcgggaatgaagaatttttggattatatgccgtcaatgaaacgtttccgaaaggaggaggaatcggaaggagccatatggtga

SEQ ID NO: 23556 - RNA, 9873 nt, synthetic construct
  misc_feature 1..9873: note = derived and/or modified CDS sequence (opt6) from DENV-3__AY858041__SS-prME
  source 1..9873: mol_type = other RNA
acttccttgtgtcttatgatgatgttacccgctactctcgcatttcacctcacaagtagggacggggaacccaggatgatcgtagggaaaaacgaacgaggaaaatcattactcttcaaaacggcgagtggaataaacatgtgcactctcatagcaatggacttaggggaaatgtgcgacgatacagtgacgtataaatgccctctaattactgaagtggaacccgaagacattgactgctggtgtaatctgacatcaacatgggttacgtatggtacttgtaaccaagccggggagcacaggcgagacaagaggtcagtagcccttgccccacatgtaggtatgggattagatactagagcccaaacctggatgtcagcagaaggtgcatggagacaggtcgaaaaagtagaaacgtgggcattccgtcatccagggttcacgattcttgcgctattccttgcgcactacattggaacgagtttaacacaaaaagtcgtaattttcatcttacttatgctagttactccaagcatgaccatgcgctgtgtaggtgtaggaaacagagattttgtagaaggactaagcggggcaacttgggttgatgtagtgcttgaacacggaggatgtgtaaccacaatggctaaaaataaacccacgctagatattgaattacagaaaactgaagcaacacaattagcaacactccgcaaattatgtatagagggaaaaattacaaacgtaacaacagacagcagatgtccaactcaaggggaggctattctaccagaggaacaggatcagaactacgtttgtaaacacacgtacgttgatcgtgggtgggggaatggttgcggccttttcggtaaaggtagcttagtcacatgtgccaaatttcagtgccttgaactgatagaaggtaaagttgtacaacatgagaacttaaaatatacagttatcataaccgtgcacacaggtgaccagcatcaagtaggaaatgagacgcagggcgtgacagctgagataacaccacaagctagtactgttgaagctatactacccgagtatggtactctaggactggaatgttcacctcgtacgggactagattttaatgagatgattctattaacgatgaaaaacaaagcatggatggtacataggcaatggtttttcgatctaccactgccttggacttccggagcgaccacggagacacccacatggaataagaaagaactcctagtgactttcaaaaatgctcatgctaagaaacaggaagttgttgttctcggatcacaggaaggagcgatgcacacagctttaacaggtgcgacagaaattcaaacatcaggaggaacctcaatcttcgcaggtcatttaaaatgtagattaaaaatggacaaattagagctcaaaggaatgtcatatgcaatgtgtagcaacgctttcgtacttaagaaagaagtgtccgagacacaacatggcacgattttaataaaagttgagtataaaggtgaggacgccccttgtaaaatacctttctccacggaagacggacaaggccaagcacacaatggtagattaatcacagcaaacccagtggtgaccaagaaagaagaaccggttaacattgaagcagagtcaccgttcggagaaagcaacataataattggaatcggagataaagcgctaaaaatcaattggtataagaaaggatctagcataggtaaaatgttcgaagcaactgcaaggggtgcaagaaggatggccattttaggagataccgcttgggatttcggcagtgtcgggggagtattaaacagcctcgggaaaatggttcaccagatcttcggatccgcttataccgccttgtttagcggagtgtcgtggataatgaaaattggcattggtgttctcttaacatggattggactaaatagtaaaaatacaagcatgagtttctcatgtatcgtaataggtataataaccttatatttaggtgcagtagtacaagccgacatgggctgcgtaataaactggaaaggtaaagaactaaaatgtggaagcggcatattcgtaaccaacgaggttcatacctggacagagcaatataaatttcaagcagattctccaaaaagattagccactgccatagctggagcctgggaaaatggggtatgtggtatacggagcaccacccgcatggaaaatctattgtggaaacaaatagcaaatgaattaaattatatactttgggaaaacaatataaaactgacagtagttgtgggagatattataggcgtattagagcaaggaaaacgcacattaaccccgcaaccaatggaactcaaatatagttggaaaacatggggaaaggcaaaaatcgtaacagcagaaatacaaaatagttcattcataatcgatggacccaacacaccagaatgtcccaacgccagtcgtgcatggaatgtttgggaggtggaggattatggtttcggagtcttcacgaccaatatctggttaaaattaagggaaatgtatacacaactatgtgaccatcgtctcatgtcggcggctgtaaaagatgaacgggcagtacacgctgatatgggctactggattgaaagtcagaaaaacggctcatggaaactggagaaagcatctcttatagaagtcaaaacatgcacttggccaaagagtcacacattatggtcgaatggagtactagaatccgatatgatcataccaaagagtctagctggaccaatatctcaacataactatcgcccgggttaccacacgcagacagccggaccatggcatttaggaaaacttgagctagacttcaattactgtgaaggtaccaccgtcgttatcactgaaaattgcggaacaagaggaccgagcctcaggacaactacagtgagtgggaaacttatacatgaatggtgctgcagatcgtgcacattgcccccattgagatatatgggagatgatggttgttggtatggtatggagataagacctattaatgaaaaggaggaaaatatggtcaaaagtttagtgagtgctggaagcggaaaagttgataattttaccatgggtgtattatgtctagcaatactatttgaggaagtcatgaggggtaagtttgggaagaaacacatgattgcaggagtattgtttatgtttgtgttactactatcaggtcaaatcacctggcgcgacatggcaagaacactaatcatgataggttccaatgcgtcagacagaatggggatgggggttacttacttggcactcatagcaacatttaaaatccaaccttttcttgcactagggtttttcttacgaaaattaactagcagagaaaacttactgttaggagttggtctagcgatggcaaccacattacaactcccagaagatatcgaacaaatggcaaacggtatagcattgggattaatggcgttaaaattgatcactcaatttgaaacttaccagctatggacagcactggtttcacttacgtgtagtaacacaatattcacgttaacagttgcttggaggacagcgacacttatattagcaggcatatcgctcttgccggtttgtcaatcttcgagtatgcgaaaaactgattggcttccaatgacagtagctgcaatgggagtacccccactaccgctattcatattttcattaaaagatacattaaaaaggcgttcatggccgctaaacgagggggttatggctgttggactggtcagcatactagcctcaagtctgttaagaaacgacgtccctatggcaggaccgctagtagcaggaggacttttaattgcatgctacgtaattacaggaacctcagctgatcttacggtagagaaagcagccgatgtcacatgggaagaggaagccgagcaaactggtgtaagccataatctaatgattacagtcgacgacgacggtaccatgcggataaaagatgatgaaactgaaaacattttaacggttttgttgaaaacagctctcttaatagtaagtggcatattcccatacagtatcccagcgacattattggtgtggcacacttggcaaaaacaaactcaaagaagcggtgtattatgggatgtaccttctcctccggaaactcaaaaagccgagttagaagaaggcgtatatagaatcaaacaacaaggaatcttcggaaaaacacaagtaggggtaggggtccaaaaagagggcgtcttccatacgatgtggcacgtgacaagaggcgctgtactcacctataacggaaaacggcttgagccaaactgggccagtgttaagaaagatttaataagttacggaggaggctggagattaagtgctcaatggaagaagggagaggaagtacaagtaatagcagtggaacccggcaaaaatcccaagaatttccagacaatgccaggtattttccaaactacaacaggtgaaataggagcgatagccctcgactttaaacccggcacgagcggatctcctataattaatagagaaggcaaagtcgtaggtttatacggtaatggtgtcgtcactaagaatggtggatatgtgtccggaatagcgcagaccaatgccgaaccagacggtccaactcccgaattggaagaagaaatgtttaagaaacgtaatctaaccataatggaccttcatcctgggtcaggtaaaacacgaaaataccttccagcgatagtacgggaggcaattaaacgacgcctgagaaccttaattctagcacctactagagtcgtagcggccgaaatggaggaggctttgaaaggactacctatacgataccaaaccaccgcgacaaagtctgaacatacgggaaaagaaatcgtggatttaatgtgtcacgcaacctttacaatgcggttactatctccggtacgagttccaaactataatttaattattatggacgaggcacactttaccgacccggcttcaatagcagctagagggtatatttctactcgtgtcggcatgggagaagctgcagccatattcatgacggccaccccgccaggaactgcggatgctttcccacagtcaaacgcgccaatccaagatgaagaaagggatattccggaacgtagttggaacagtggtaatgactggattactgacttcgctgggaaaacagtctggttcgtaccatcgatcaaagcaggaaacgatatcgcaaattgcttacggaaaaatgggaagaaagttatacagctgtcacgtaagacatttgatactgaatatcaaaagacaaagctcaacgattgggattttgttgtaacgacagacatctcagaaatgggagcaaacttcaaagctgacagagtcatagatccaagaagatgtctcaaacctgtaatattaactgatggcccagagcgtgtaattcttgcaggacccatgccggtaacagtggcaagtgcggctcaaagaagaggaagagtgggacgaaatcctcaaaaggaaaatgaccaatatatttttaccggacaacctctaaataacgatgaagaccacgcacattggactgaggccaagatgctgttagataatattaatacacccgaagggataataccggcgttatttgaacccgagagagagaaatcagcggcgatagatggtgaataccgattaaaaggcgagtcccgtaagacttttgtagagttaatgcggagaggagacttacctgtctggctagcgcacaaggtagcaagcgagggaatcaaatatacagatagaaagtggtgctttgacggcgaacgcaataaccagatcctggaggaaaacatggatgtggagatatggacgaaagaaggcgagaagaagaaattgagacctagatggctggacgcaagaacatatagtgacccattagcactaaaggaatttaaagattttgcggcaggtcgtaaatcaatagctctagacttagtgacagaaatcggacgtgttccaagtcatttagctcacagaactagaaatgctctcgacaacctagtaatgctacatacatctgagcacggtgggcgcgcgtatcgacacgcagtagaagaactgccagaaacaatggaaactctacttctacttggattgatgatacttctcacaggcggtgcaatgctgttcttgatatcaggtaaaggagtaggaaaaacaagtataggactaatatgtgtagtagccagcagcggaatgctctggatggccgatataccattgcagtggatcgctagcgctatcgtactcgagttctttatgatggttctcctaatacctgagccggaaaaacaaagaacaccccaagacaaccaactagcatatgttgtgattggaatattaacattagcggcaattgtagcagcaaatgagatgggactattagaaacaaccaaaagagatctagggatgtcaaaagagcccggagtagtttcaagtacttcatatctagatgttgacttacatcctgcaagtgcatggaccttatacgcagtagcgacaactgtaattaccccaatgttgaggcacaccattgaaaatagtaccgctaatgttagcttagcagcgatagcaaaccaagcagtggtactgatgggattggacaaaggatggccaatatctaaaatggatctaggagtcccacttttggctctgggctgctactcgcaagttaatcccctaacattaaccgcagcagtactactattagtcacgcactatgccataataggtccaggactacaagccaaggcaactagggaagcacagaaacgtactgcggctggtattatgaaaaatcctacagtcgatggtattatgacaattgatttagacccagtcatttacgactcgaagtttgagaaacaactgggccaagtaatgttacttgtgttgtgcgcagtacaactactactgatgcgaacctcgtgggctttttgcgaggcattgacgttagccaccggtcctataactactctatgggaaggatctcctggcaaattttggaacactacaattgcggtcagtatggccaatatttttcgtggttcttatcttgccggtgctggactagcattttccattatgaaatccgtaggcacgggcaaacgtggtacaggatcacagggcgaaacattaggtgaaaaatggaagaagaagttaaatcaactttcgaggaaagagttcgatctctataagaaatctggaatcactgaagtagacagaaccgaagcaaaagaaggtctaaaacgaggagaaattacgcatcacgctgtcagtagaggctctgccaagctgcaatggtttgtagaaagaaatatggtaatcccagaagggcgcgtaatagatctaggctgcggcagaggaggttggagttactactgcgcagggttaaagaaagtaacagaggtacgtggttatacaaaaggaggtccggggcatgaagaacctgtacctatgagtacatatggatggaatatagtcaaattaatgtcaggaaaagacgttttctacttaccaccggaaaaatgtgatactttgctctgcgatataggcgagtcatcgccctctcctacagtagaggaaagccgcacaatacgagttttaaaaatggtggaaccatggctcaaaaataatcagttctgcataaaagtactaaatccatacatgccgacagttatagaacatttagaaagattgcaacgaaaacatggtggaatgctagtacggaatcccctctcaagaaacagcacccatgaaatgtattggataagcaatggcacaggaaacatagtgtcatcagttaatatggtgtcgaggctgttattaaatagattcacaatgacttacagaagaccaacgatagaaaaagatgttgacctaggggccggtacccgacacgtgaacgcggaacctgaaacaccaaacatggatgtgataggcgagagaatcagacgtatcaaagaagaacattcatcaacttggcactatgatgacgagaatccttacaaaacgtgggcctaccatggcagttacgaagtaaaagcaacgggtagcgcatccagtatgataaacggagtagtaaaacttcttacaaaaccttgggatgttgtacctactgtcacccaaatggcgatgacagatacaacaccatttgggcagcagagagtatttaaagaaaaggtagacactagaacaccaaaaccaatgccgggaacacgtaaagtaatggaaataacagcggaatggttgtggaggacgttaggacggaataagagaccaaggctgtgcacacgggaagagttcactaagaaagtaagaacgaatgcagcaatgggtgcagtattcacagaagagaaccagtgggactccgcaagggcagcagtagaagacgaggagttttggaagctagttgatagagagcgtgagcttcacaaacagggaaaatgcggaagttgtgtatacaatatgatgggaaaacgcgagaagaaattgggtgaatttggcaaagccaaaggcagcagggccatctggtacatgtggcttggggctagatatctagaatttgaagcactaggtttccttaatgaagatcattggttttcccgcgaaaattcatactctggagtagaaggagaaggcttacacaaacttggatatatacttcgagacatatctaaaattccaggtggcgccatgtatgcagacgatactgccggatgggacaccaggatcacagaagatgatttacataatgaggagaaaataacccaacaaatggatccagaacatagacagcttgctaatgctatttttaaactaacatatcagaacaaagttgttaaagtacagagacccactccaaaaggtaccgtgatggacataatatcgaggaaagatcagcgtggatcaggtcaggtcgggacttatggattgaacacattcactaacatggaagcacaattaataaggcaaatggagggggagggggtactgtcaaaaacagatcttgaaaaccctcatcttttagaaaagaaaataacgcaatggcttgaaacaaaaggagttgaaagactaaaaagaatggcgatctcaggtgatgattgcgtggtaaaaccgattgatgatcgcttcgctaatgcactcctagctctcaatgacatgggcaaagtacgtaaagatataccccaatggcaaccctcaaaggggtggcatgattggcaacaagtacccttttgttctcatcactttcatgagctaataatgaaagatggacgcaaattggtagttccctgtagaccgcaagatgaacttataggtagagctcgaatctctcaaggagctggatggtcattaaaggaaacagcatgtctcggaaaggcttatgctcaaatgtgggcgttaatgtattttcaccgtcgcgatctacgtcttgcatctaacgcgatttgcagcgctgtaccagtacattgggtgccaacttccagaaccacgtggtctattcatgcacatcatcaatggatgacgactgaggacatgttaaccgtttggaatagagtatggatagaagataacccatggatggaagataagaccccggtcaccacctgggaagacgtgccatatttaggaaaaagggaggatcagtggtgcggttcgcttataggccttacctcgcgagcaacatgggcacaaaatattctaacagctatacaacaggttcgatcgttgataggcaacgaggaatttttggattacatgcctagtatgaaacgcttcagaaaagaagaagaatcggagggtgcaatatggtag

SEQ ID NO: 23557 - RNA, 9873 nt, synthetic construct
  misc_feature 1..9873: note = derived and/or modified CDS sequence (opt6) from DENV-3__KC261634__SS-prME
  source 1..9873: mol_type = other RNA
acttcaatttgcctgatgatgatgttacctgcgaccctggcgtttcacttaacgagtagagatggggaacctcgtatgatagttgggaaaaacgaacggggaaaatccttactgttcaaaacggcaagtggaatcaatatgtgcacactaattgcgatggatctaggagaaatgtgtgatgacacagttacgtataaatgcccgttgatagcagaagtagaaccggaagacatagactgttggtgcaatctgacatccacctgggtaacatatggaacgtgcaaccaagcgggagaacaccgacgggataaacgatcggtagcattggcacctcatgtgggaatgggattagacacccgcacccaaacgtggatgagtgcagaaggcgcatggagacaagttgagaaagtggaaacatgggccttacgacaccctggattcacaatactggcacttttcctggctcactacattggaacaagtctaacccaaaaagtagtaatttttatcctactgatgctagttacaccaagcatgactatgcgttgcgttggtgtgggaaaccgcgattttgtagaaggattaagtggagcgacatgggttgacgttgtcctagagcatggtggctgtgttacaaccatggcgaaaaatagaccaacgcttgatatcgagctgcagaaaactgaggcaacccaactagcgacgttaagaaaattatgcatcgaaggaaaaatcaccaacataacaaccgattccagatgtcctacgcaaggtgaagcagttttaccagaggaacaagatcaaaattacgtatgcaaacacacatatgtagaccgaggttggggcaatggttgtggactatttggtaaaggttccttagtaacttgtgcaaaatttcaatgcctagagccaattgagggaaaagttgtacaatacgaaaatctaaaatacacagtaattataaccgtacatacaggagatcaacatcaagtcggaaacgatactcaaggggtaaccgtagaaataactcctcaggcatccacagtagaagcagtcttgcccgagtacggaaccctcggactagaatgctcgccaagaacaggacttgattttaacgaaatgatcctattgacaatgaaaaataaagcgtggatggtccatcgacaatggttctttgatctgcctctaccgtggacatctggagctacgactgaaacacctacgtggaatagaaaagagctattagtaacgtttaaaaacgctcatgctaaaaagcaagaagtagtagtattagggtcacaggaaggcgccatgcatacagcacttaccggcgctacagagatacaaaacagcggcgggacttctatatttgctggtcatcttaaatgtcggctcaaaatggataaacttgagctaaaaggtatgagttatgcaatgtgcttgaacacattcgttctcaagaaagaagtaagtgaaacacagcacggtacgatcctcataagagttgaatacaaaggagaagatgccccttgcaaaatcccattttcaacagaagatggacaaggaaaagctcataacggacgtctaattacagcaaatcccgtcgtaaccaagaaagaggagccagttaacatagaagcagagccgccttttggagaatcaaacattgtaataggtacgggggataaagccctaaaaattaattggtataagaaaggttcatcaatcggaaagatgtttgaagcaactgctcgaggcgcaaggcgaatggctattttaggcgacacagcatgggactttggcagtgtagggggcgtgttaaactctctaggaaaaatggcacaccaaatattcggaagcgcgtacactgcactttttagtggagtcagttggattatgaaaataggcataggtgtgctactaacatggataggactgaatagcaaaaacacgagtatgagtttttcatgtattgtgataggaattataaccctatatctgggtgctgtagtgcaagcagatatggggtgtgtcataaactggaaaggaaaagaattaaagtgtggtagcggcatctttgtaacaaacgaagtgcacacttggacggaacaatacaaattccaggcagactcgccgaagcgtttagctacagcaatagcgggagcttgggagaatggagtttgtggaatacgcagtacaacgagaatggaaaatttgttatggaaacaaatagctaatgaattgaattatatattatgggaaaataacataaaactcacggtagttgtcggagatataataggtgtgttagaacagggcaagcgaacactaaccccacaacctatggaattaaaatattcatggaaaacgtggggcaaagccaaaatagttacagcagaaatacaaaattcctctttcataattgacggaccgaatacgccagagtgtccttctgcaagtagagcatggaatgtttgggaggtggaagactatggtttcggagtctttacaactaatatctggcttaaactaagagaagtatacacccaatcctgcgatcataggctaatgagtgcagctataaaagatgaaagagccgtacacgcagatatgggatactggattgagagtcagaaaaatggatcatggaagctagagaaagcatcatttatagaagttaagacatgtacctggcctaaatcacacacattatggagtaatggcgttctagaatcagacatgataattcccaaatcccttgcgggccctatatctcaacacaatcatcgaccgggttatcatacacagacagcaggaccctggcatctaggcaaactggagctagactttaattattgcgagggaactacagtagttatcacagaaaattgtggaacccgtggacccagcttacgaacaacgaccgttagtggcaaactcatacacgaatggtgttgtagaagttgtactttacctccgttgaggtatatgggagaagacgggtgctggtatggtatggaaatcagaccaataaacgagaaagaagagaacatggtaaaatcattagtgagtgctggtagtgggaaagtcgacaattttacaatgggtgtattatgtttagctatattattcgaggaagtaatgagagggaagttcggtaagaaacacatgatagttggagtcttattcacattcgtgttactactttcgggtcaaataacttggcgagatatgacgcataccctcattatgataggtagcaacgcatctgaccggatgggtatgggcgtaacctacctcgccttgattgcaacctttaaaattcagcccttcttagctttgggtttctttcttcgtaaacttacttcgcgcgagaacctacttctaggtgtagggttggcaatggcaacaaccctccagctacctgaggatatagagcagatggctaacggtattgctttggggttgatgacactaaaactaataacccaatttgagacataccagctatggactgccctggttagcttaacttgtagcaatacaatattcaccttaacagtagcctggcgaacagccacattgattttagcaggagtatcgctattaccgttatgtcaatcaagcagcatgaggaaaaccgattggcttcctatgactgtagcagcaatgggtgtcccaccactaccactttttatttttagcttaaaagatgcacccaagaaaagatcatggccattaaatgaaggagttatggccgtaggtttagtaagtatattggctagcagcctacttagaaacgacgtaccaatggctgggccgttggtagcaggcggtcttttgatcgcctgttatgtcataacagggacatcggctgatttgacagttgagaaagcggctgatgttacttgggaggaggaagccgagcaaactggagtgtctcataacctaatgatcaccgtagacgatgatggaacaatgcgcataaaagacgacgaaacagagaacattttgacagtgttgctgaaaacggcattgcttattgttagcgggatatttccatacagtataccagcgacacttttggtttggcatacctggcagaaacaaacacaaaggagcggggtgctttgggatgtcccatctcccccggagactcaaaaagcagaattagaagaaggcgtctatagaataaaacaacaaggcatctttggaaaaacacaagtaggagtcggggttcaaaaggaaggtgtctttcacacaatgtggcacgtaacacgaggtgctgttttaacacataacggaaaacggctcgagcccaactgggcttcggtcaagaaagatctaattagttacggaggaggatggcgcctgagcgcgcaatggcaaaaaggcgaagaagtacaagtcattgctgtagaaccaggcaaaaacccgaaaaattttcaaactatgcccggaatattccaaacaacaaccggcgaaataggggcaattgctctggacttcaaaccgggtacttcgggcagtccaataatcaatagagaaggcaaggttgtaggcctctatggtaacggagttgttactaaaaacggagggtatgtatcaggtatcgcccaaactaatgcagagccagacggccccactccagagttagaagaagagatgtttaagaaaagaaatcttacaataatggatttgcatcccggttctgggaaaacaagaaagtatcttcccgcaatagtgagggaagcaattaaaaggagactacgaacactgatcctggcaccaacaagggtcgtagccgcggaaatggaagaagcattaaaaggactgcccatacgctaccaaacgacagctacaaaatccgaacacactggacgtgaaatcgtcgatctgatgtgccatgctacatttacaatgagactattgtcaccagtgcgtgtacctaattataacctaattatcatggacgaagctcattttactgacccagcaagtatagctgcaagagggtatatctctactcgtgttggaatgggagaggctgcagccatttttatgacagccacgccaccagggacagcagaagcatttcctcaatctaacgcaccgatccaagatgaagagagagacatacccgaacgatcatggaatagtggtaatgaatggataacagatttcgtaggaaagaccgtttggtttgttccttcaattaaagcaggaaatgatatagcaaactgcttaaggaaaaacggcaagaaagtaatacaactttcccgaaagaccttcgatacggaataccagaaaacgcgtttaaatgactgggattttgtcgtaacaaccgacatctcagaaatgggtgcgaatttcaaagccgacagagtaatagatccacgtagatgtctaaagccagtcatcctaaccgacggcccagaacgcgtaatccttgcgggaccaatgcctgtaacagctgcaagtgccgcgcaaagacgtggacgggtagggagaaatcctcaaaaagaaaacgatcaatatatattcacaggacagcccttaaacaatgacgaggatcacgcccactggactgaggctaaaatgttgctcgacaacattaataccccggagggaattattcctgcgttgttcgaaccagagagagaaaaatcagcggcaatagacggtgaatacagattaaaaggagaatcacgaaaaacgtttgtagaactcatgagaagaggagacttaccggtttggttggcacacaaagtggcaagtgaaggtattaaatacacagaccgcaaatggtgcttcgatggtgaacggaacaaccaaatcttagaagaaaatatggacgtcgaaatctggactaaggagggcgaaaggaagaaactgagaccacgatggctggatgcaaggacatactcagatcccctcgcattaaaagaatttaaggattttgcagcgggaagaaaaagtatagctctagatctggtaacagaaatcgggagagttccaagtcatttagctcatcgtacaagaaatgccctagacaacttagtaatgttacataccagtgaacatggaggtagagcgtaccgacatgccgttgaagaacttccggaaacaatggaaacactactactactagggctcatgatattgctaacagggggagctatgctctttttaatttccggaaagggaattggcaaaacgagcattgggctcatatgcgtaatagtatcatcaggcatgctatggatggcagacgtacccctacaatggattgcctctgcaattgttttagaatttttcatgatggttttgctaataccggagccagaaaagcaaagaactccacaagataaccaattagcttacgtcgtaattggaatacttacccttgccgccattgtagccgcgaatgaaatgggactgctagaaacgactaagcgagatttgggtatgagcaaagagcccggcgcggtttcgtcaacaagctacctagatgttgatctacacccagcatcggcctggactctatatgctgtggcaacgacagtaataacgccaatgttacgacacacgatagaaaactccacagccaatgtatctttagcagctattgcaaatcaagccgttgttttgatgggacttgataaagggtggcccatttcaaaaatggacctaggagttcctttattggcactgggctgttactctcaagtaaatccattaacactaactgcagcagtgctattattggtcacacactacgcaattatcggaccagggctacaagctaaagcaaccagagaagcccaaaaacgtactgctgctggtattatgaagaatccaacggtggatggcattatgacgatagatttagacccagtgatctacgatagtaagtttgagaagcaacttgggcaggtaatgctactggttttgtgtgccgtgcaattacttttgatgagaacaagttgggcgctgtgtgaggctttaactttggcaacagggccaataacgaccttgtgggaagggtcaccggggaaattttggaatacgactatagcagtatctatggcgaatatatttcgcggatcatatctagctggcgcgggtcttgcgttttcaataatgaaatcggtaggaacaggcagaagaggcacaggtagccagggagaaaccctgggggaaaaatggaagaaacgattaaatcaattatcgcggaaggagttcgacttatataaaaagtcaggcataactgaagttgatagaacagaagctaaagaaggtcttaaacgcggcgaaacaacgcaccacgcagtttcaagaggatcagcgaaattacaatggtttgtagagagaaacatggtaattccagagggccgcgttatagatctaggatgtggaagaggcggatggagttactattgtgccggcctgaagaaagtcacagaagtacgagggtatacaaaaggaggtccgggtcatgaagaacctgttccaatgagtacatatggatggaatatagtaaaacttatgagcgggaaagatgtattctaccttcctccagaaaaatgtgatacactcttatgtgatataggagaatcatcgccaagtccaacagttgaagaatcacgtacaatacgtgttctcaagatggtagaaccctggctcaaaaataatcaattttgtattaaagtgctaaacccatatatgcccacggtaattgaacatctggaacgtctccaacgaaaatatggagggatgcttgttaggaaccccttaagtcgaaactcaacgcatgagatgtactggattagcaacggcactggcaatattgtatcctctgtaaacatggttagtcgattactattaaatcgctttacaatgacacatagaagaccaacgatggaaaaagatgttgacctcggagccggaactcgacatgtcaacgccgagccagaaactcctaatatggacgttattggggaaaggataaaaagaataaaggaagaacattcaagtacgtggcattatgatgatgaaaacccatacaaaacatgggcttaccacggctcatacgaagtaaaagctacagggagcgcatctagtatgattaacggagtagtcaaactactcacaaaaccttgggacgtagtacctatggtaacccaaatggccatgacagatactactccttttggtcagcaacgagtatttaaagaaaaagtagacacacgaacacctcggcccatgccaggaaccagaaaagtgatggagataactgccgagtggttatggaggactttaggaagaaacaagaaacctcgactttgcacgagggaagagtttacgaaaaaggtcaggaccaatgcggccatgggcgcggtattcacagaggagaaccaatgggatagtgccagagccgccgttgaagatgaagaattttggaaattagtggacagagaacgtgaactgcatagattaggaaaatgtggatcttgcgtgtataacatgatgggtaaaagggaaaagaaattaggagagttcggaaaagcaaaaggtagccgagcgatatggtatatgtggctgggcgcacggtatctggaatttgaagcgttaggatttttgaatgaagaccattggttcagcagagagaacagttatagtggagttgaaggagaaggattgcataaattggggtacatactaagagacatcagcaaaattccagggggagcgatgtatgcagacgacacagccgggtgggacacaagaatcacggaggacgatctacacaacgaagagaaaataacacagcaaatggatccagaacacagaagactagctagcgctatttttaaactcacatatcaaaataaagtagtcaaagtacagcgacccacccccaaaggcacggtaatggatatcattagtagaaaggaccaaagagggtccggacaagtaggaacctatggcttaaacacatttaccaatatggaggcacagctggtcagacaaatggaaggcgaaggagtgttaagtaaggcagacttggaagatccacatttacttgagaagaaaatcacacaatggctagagacaaaaggagtcgagcgattaaaaaggatggctatctctggagatgactgtgtggtaaaaccaatagatgatagatttgcaaacgcacttctagcccttaatgatatgggaaaagtaagaaaagatatacctcaatggcaaccttctaaaggatggcatgactggcaacaagttccattctgttcgcaccattttcacgagctaataatgaaagacggaagaaaattagtagtaccatgtcgtccgcaagatgaattgataggcagagctagaatcagccaaggagcaggatggagcctcaaagaaactgcctgtctaggaaaagcatatgcccaaatgtggagcttgatgtattttcaccgtcgagacttaagacttgcgtccaatgcaatatgctcggctgtaccagtccactgggtgccaacatctagaactacatggtccatacatgcacatcaccaatggatgaccacagaggacatgttaacggtatggaatagagtatggatagaagataatccttggatggaagataaaaccccagtaacaacctgggaggatgtaccttatcttgggaagcgggaagaccaatggtgcggaagtctaataggtttaacctccagagcaacctgggcacagaacatattaacagcaatacaacaagtacgcagtctaattggggatgaggaatttttagactacatgccatcaatgaagcggtttcggaaagaggaagaatcggaaggtgcaatatggtaa

SEQ ID NO: 23558 - RNA, 9873 nt, synthetic construct
  misc_feature 1..9873: note = derived and/or modified CDS sequence (opt6) from DENV-3__JN662391__SS-prME
  source 1..9873: mol_type = other RNA
acgagcttatgccttatgatgatactgcctgcagccctagcatttcacttaacatccagagatggagaacctaggatgattgttggcaaaaatgaaaggggaaaatctcttttatttaaaacagcatctgggattaatatgtgtacattaatagcgatggacctgggtgaaatgtgtgacgatacggtcacttataaatgtccacatattacagaagtagaacctgaagatatagattgttggtgcaatctaactagcacttgggttacctatggaacatgcaaccaagcgggtgaacatcgtagagataaaagatcagttgcactcgcaccacatgtgggtatgggcttagacacccgaactcaaacttggatgtcagcagaaggtgcgtggcgacaagtcgaaaaagttgaaacatgggcgctaagacaccccggatttacaatcttagcattattcttggcacattatatcggaacaagtctaacgcaaaaagttgtgatctttattctgctaatgctagtgactccgagcatgacaatgcgttgcgtaggagtagggaatagggactttgttgaaggactcagcggtgctacctgggttgatgttgtattagaacacggaggatgtgtcacaactatggctaaaaataaaccgacccttgatatagaacttcagaaaactgaagcaactcaactagcaacactaagaaaactgtgtatagaaggcaaaataactaatatcactaccgacagtcgatgccctactcaaggagaagcagtcttacctgaagaacaagatcaaaactatgtatgtaaacatacatatgtggatagaggttggggtaatggatgtggacttttcggaaaaggaagtttagtaacatgcgcaaaatttcaatgcctagaaccaatagaagggaaagtcgtccaatatgaaaatctcaaatacacggtcataattaccgtccatacaggtgatcaacatcaagtcgggaacgaaacacaaggagtgacagcagaaataacaccgcaggcaagtaccacagaagccattctccccgaatatggtacattaggactcgaatgttcaccacgtacagggctggattttaatgaaatgattctattaactatgaaaaataaggcttggatggtacatcgtcaatggttcttcgacctaccgttgccttggaccagtggagcaaccacagagacccctacctggaaccgaaaagaactattagtaactttcaaaaatgcacatgctaagaaacaagaagtggtagtcctggggagtcaagaaggagcaatgcacacagcattaacaggggctactgaaatacaaaactccggaggaacaagcatatttgcagggcaccttaaatgtcgtttaaaaatggataaacttgaattgaaaggtatgtcatatgctatgtgtacaaacacgtttgtacttaagaaagaagtctctgagacacagcacggtacaatattaatcaaagtagaatacaaaggagaagatgctccatgtaaaataccattttcaaccgaagatgaacaagggaaagcccacaatggtagactcattacagctaacccagtcgttaccaagaaagaagaaccggtcaatattgaagcggaacccccatttggggagtcgaacattgttattggtattggagacaatgcattaaaaataaattggtataagaaaggatcctcaattggtaaaatgttcgaagcgacagccaggggagcaagaagaatggcgatacttggtgacaccgcatgggatttcggttctgtaggaggggtcctaaactcccttggtaaaatggtccaccaaatattcggcagcgcatatacggccctattttctggagttagttgggttatgaaaataggaatcggagtactgttgacttggattggcctaaacagcaaaaatacttcaatgtcgttttcatgtatagctattggtattataactttatatttaggagcggtcgtgcaagcagacatgggatgcgtgatcaattggaaaggtaaagaactaaaatgtgggtctggtatttttgtgaccaatgaagtccacacttggacagagcaatataaattccaagccgactctcccaaaagactcgcaacagcaatagcaggagcttgggaaaacggggtttgtgggatacggagtactacaagaatggagaatttattatggaaacaaatagcgaatgaactgaattacatactatgggaaaacaacattaaacttacagtagtagtcggcgatactataggagtactagagcaaggaaaacgaacgctaaccccacaaccgatggaattgaaatatagctggaaaacctggggaaaggctaagatagtaactgcagaaacgcaaaatagtagttttataatagatggaccgaatacgccagaatgcccaagtgcatctcgggcgtggaacgtttgggaggttgaagactacggtttcggagtattcacaaccaacatttggctaaaattaagagaggtttatacacaaatgtgcgatcataggttaatgtccgccgcggtcaaagacgagcgtgctgtacacgcagacatggggtactggattgaatcacagaagaatggttcatggaaacttgaaaaagcatcactcatagaagttaagacctgcacatggccaaaatctcacactctatggtctaatggggtgttggaatcagatatgatcatcccaaaaagcctcgcaggaccaatttcccagcataattataggcctggttatcacacgcaaacagctggcccatggcacctcggaaaattagaactagattttaattattgtgaagggacaactgtagttataacagaaaactgcggaaccaggggaccatctctacgtacaactacggtaagcggcaaacttattcatgaatggtgctgcagaagctgtacgttgcctccgttaaggtatatgggtgaggatgggtgttggtacgggatggaaataagaccaatatcggaaaaagaagaaaatatggttaagtcactcgtaagtgcaggtagtggcaaagttgataactttactatgggcgtgttatgtctggcaattctctttgaagaagtaatgagaggaaaatttggcaagaaacatatgattgccggagtcttcttaacttttatgctcttgttatcaggtcaaattacatggagagatatggctcatacactgattatgattggaagtaatgcatccgacaggatgggcatgggcgttacctatctagcactaatcgctacctttaagatacaaccatttttggcactgggattcttcctccggaagttgacaagtcgagaaaatttactattaggagtcggactagccatggcaacaacaattcagttaccggaggacatcgaacaaatggcgaatggaatagctcttgggctaatggccctcaaattaataacgcaatttgaaacatatcaactttggacggccttgatttcactgacatgttccaacaccatatttacactaacagttgcatggagaacagcaactctcatcctcgcaggagtatcgctactgcccgtctgtcagtctagctccatgcgcaaaaccgactggcttcctatgacagtcgcagcaatgggtgtccctccattacctttgtttatcttttctcttaaggacactttgaaacggagaagctggccgttaaatgaaggagtcatggccgtaggattagttagcatactggctagttccttattaagaaatgatgtcccaatggcagggcctttagtggcagggggcttgttgatcgcgtgttatgtaattactggcacttcagcagacttaactgtagaaaaggcagctgacgtgacatgggaagaagaagcagaacaaactggtgtctctcacaacttaatgataactgttgatgatgatggcactatgaggattaaagacgacgaaactgaaaacattttgacagtattattaaaaactgcacttctaatagtatctgggatatttccttattccataccagccacgttgcttgtatggcatacatggcaaaaacaaacgcaaagaagcggagttttatgggacgtgccctcacccccggagactcaaaaggctgagcttgaagaaggggtttacaggataaaacaacagggaatactaggaaaaacacaagtaggagtaggcgttcaaaaggaaggggtgtttcacaccatgtggcacgtcactagaggcgcagtactcacacacaatggaaagcgactggaaccaaattgggcgagtgtgaaaaaggacttgatttcttatgggggaggatggcgtttatcggcgcaatggcagaagggtgaggaagtacaagtgattgcggtagaacctggtaaaaatcccaaaaacttccagactatgccaggtacgttccaaacaaccaccggagaaataggtgctatagcgttagattttaaaccaggaacgagcggatcacccataattaaccgggaaggaaaggtcgtggggttgtacggtaatggagtcgttaccaaaaacggcggatacgtttctggaattgcgcaaaccaacgcagaacccgatggccccacgccagaactggaggaggaaatgttcaagaaaagaaatttgactataatggacctacacccaggaagcggtaaaacaaggaaatatttgccggcaatagttagagaggctataaaacgtaggcttagaacgcttatcttagcccccacgagagtcgtagctgcagagatggaagaagcacttaagggattacctatccggtaccagactacagcgacgaagtcagagcatacagggagagaaatagtggacctaatgtgtcacgctacattcaccatgagattactttctcctgtgcgggttccaaactataacttgatcataatggatgaagcgcactttaccgatcccgcctctatagcagctagaggatacatatccaccagagtaggaatgggagaagcggcagcaatcttcatgacagctactcctcccgggacggccgatgcgtttccacaatcaaacgcccctatacaagacgaggaaagggacataccggagcgatcttggaacagcggtaatgaatggataaccgactttgcaggtaagacagtctggtttgtacctagtataaaagctggaaacgatatcgctaactgccttaggaaaaatggaaagaaagtaatacaacttagtagaaaaacctttgacacagaataccaaaagactaagctgaatgactgggattttgtagttacaaccgacatttctgaaatgggcgccaatttcaaagcagacagggtcattgacccaagaaggtgtctaaaaccagtaatactaacggacggaccagaaagggtcattttagctggcccgatgccagttacggttgcaagcgccgcgcaacgacgcggaagggtgggaaggaatcctcaaaaagaaaatgatcaatatatcttcacaggtcaaccattaaataatgatgaagatcatgcgcattggacagaagccaaaatgctgttagataatataaacaccccagaagggatcataccagccttgtttgaaccggaaagagaaaaatcagctgcaattgatggtgaatatcgactaaaaggggaatctcgtaaaacattcgtggaattgatgaggaggggtgacttacccgtttggttagctcataaggtagcttcggaaggaattaaatatacagatagaaaatggtgtttcgatggacaacgaaataatcaaatcctggaagaaaacatggacgtagaaatatggacgaaagaaggagagaagaagaaactgcgacccaggtggttagacgcgagaacatactcagacccgttagctctcaaagaatttaaagattttgctgcgggccgcaaatcaatagcattagatttggtaacagagattggaagagttccgagccatcttgcacatcggaccagaaacgccctggacaatctggttatgcttcatacaagtgaacatggaggtcgagcgtatagacacgcagtagaggagctcccggaaaccatggaaacacttttattactaggacttatgattttattgactgggggagccatgttgttcctcatttccgggaagggtataggtaaaacttccattggcttaatatgcgttattgcctctagcggtatgttgtggatggctgagattccattgcagtggattgcctcagctatcgttctagagttctttatgatggtactcctaataccggagccagagaagcagcgaacgcctcaggacaaccagttagcctatgtcgtcataggaatattgacgcttgctgcaataatagcggcaaacgaaatgggcctgctagaaacgacaaaaagggacttaggaatgtcgaaagagccaggagtagtgagccctacaagttatttagatgttgatctgcacccggcgagtgcctggactctatatgcagtagcgacaaccgtcatcacccctatgttaaggcatactatcgaaaatagtacggcgaacgtttctttagccgcaatagcgaaccaagccgtggtgttgatggggttagacaagggatggcctatctccaaaatggatctaggagttccattattggcattaggatgttactcacaagtaaatccactcacgttaacggcggctgtactattattagtcacacattatgcaataataggacctggtcttcaggcaaaagcaactagagaggcacagaaaagaacagctgccggaattatgaaaaatcctacggttgatgggataataacaatagatttagacccggtcatatatgattctaagttcgaaaagcaactagggcaagttatgctacttgttttatgcgcggtacagttactgttaatgcgaacaagttgggccttatgtgaggcacttactctagcaacaggaccaataacaaccctatgggaaggaagcccgggcaagttttggaatacaacaattgcagtatccatggcgaatatatttagaggaagttatttagctggcgctggccttgctttcagcatcatgaaatcggttgggacaggtaaacgcggcaccgggagtcaaggagaaactttgggggaaaaatggaagaagaaattaaatcagttatcgcgaaaagaatttgatttgtacaagaaaagtggcatcaccgaagtagatcgaacggaggccaaagaagggttaaaacgcggagaaactactcatcacgcagtttcccgcggttcagctaaacttcagtggttcgttgagagaaatatggtcattcccgagggaagagtgatagatctgggatgtggcagaggaggttggtcttactactgcgcgggtctcaagaaagttaccgaagtgcgtggttacacaaaaggtggaccaggacacgaggaaccagtgccaatgagcacgcatggatggaatatagtaaaactaatgagcggcaaagatgttttctacctccctccggagaaatgtgatacattattgtgcgacattggtgaatctagcccaagtccaaccgtagaagaaagccggacgattcgcgtactaaagatggtagaaccatggttaaagaacaatcaattttgcataaaggttctgaatccctatatgcctgcggtaatagaacacttagaaaggctccaaagaaagcacggcggtatgcttgtaaggaaccctctatccagaaatagtactcatgaaatgtattggatctcaaatggcacgggtaacattgtatcatcagttaatatggtatcaagactactcttaaacaggtttacaatgacgcatagacgaccaacgatagaaaaagacgtcgatctcggcgccggcacaagacatgtaaatgcagaaccagaaacacccaacatggatgtaataggggaacgcatacgccgaataaaagaagaacacaactccacgtggcactatgatgatgaaaatccctataaaacttgggcctaccatggatcttacgaggtgaaggctaccggaagcgcgtcatctatgataaatggagtagtaaaattacttacgaaaccatgggatgtagtccccatggtcacgcaaatggcaatgacagacacgacgcctttcggacaacagagagtattcaaagaaaaagtagacacaagaacaccaaggcctatgcccggaacgcgaaaggttatggagattactgcagaatggttgtggcggaccctaggccggaacaaaagaccccggttatgtactagagaagagtttacaaagaaagtacggactaatgccgcaatgggtgcagtattcacagaggaaaaccaatgggatagcgcaaaagcagctgtcgaagatgaagagttctggaaactcgtagatagagaacgtgagttacacaaactaggaaaatgcggatcttgtgtttataatatgatgggaaaaagagagaagaaactaggcgaatttgggaaagcaaaaggatcacgggcgatatggtatatgtggcttggagctagatatttagagtttgaggcactagggttcttaaatgaggatcattggtttagtcgtgaaaattcatacagtggagtagaaggggaaggactgcacaaattgggttacatactgagagatatatcaaaaattccgggaggggctatgtacgcggacgacacagcaggttgggatacgcgaattacagaggatgatctgcacaatgaggaaaagattacccaacaaatgaatccagagcatagactattagcgaatgctatttttaagttaacatatcaaaataaagttgttaaagtacaaagacccacacctactgggacggtaatggacataatttcacgcaaggatcaaagaggttcgggccaggtaggaacatacggactcaatacttttacaaatatggaagcacaattagtacgccaaatggaaggtgaaggtgtattgagtaaagcagatttagaaaacccgcacctaccggagaagaaaataacacagtggctagaaactaaaggagttgaaagacttaagagaatggctataagtggtgacgattgtgtcgtcaaaccaatcgatgatagattcgctaacgcgttattagcgctaaatgatatggggaaagttagaaaagatatcccacaatggcaaccgtcaaaagggtggcacgactggcagcaggttcccttttgtagccaccattttcacgaacttatcatgaaggacggaagaaagctagtcgtaccgtgtcgacctcaagacgaattaattggtagagctaggatctcccagggggcaggttggtccttaagagaaacagcatgtcttggtaaggcttacgcacaaatgtggagtctaatgtactttcataggagagatctgagattagcttcaaatgccatatgttctgcagtaccggttcactgggtaccgacgtcgcgtacaacctggagtattcatgcgcaccatcagtggatgacaacagaagatatgctaaccgtttggaacagggtatggatagaagataatccctggatggaagacaaaaccccggttacaacttgggaaaatgtgccttatcttggaaagcgcgaggaccaatggtgcggttcattgataggtctcactagccgcgcgacttgggcacaaaacatttcaacagcaattcaacaagtccgaagtttgataggtaacgaagaatttttagactatatgccatcaatgaaacgttttagaaaggaagaagagtccgaaggcgcaatatggtaa

SEQ ID NO: 23559 - RNA, 9873 nt, synthetic construct
  misc_feature 1..9873: note = derived and/or modified CDS sequence (opt6) from DENV-3__AY858043__SS-prME
  source 1..9873: mol_type = other RNA
acatcgttatgtctaatgatgatgcttcctgcaacactagcatttcatttaacatcgcgagatggagaaccaaggatgatagtggggaaaaatgaaagaggaaaaagtttactatttaaaactgcgtcaggaataaacatgtgcacactaatagctatggatctaggtgaaatgtgtgacgataccgtaacatataaatgtccactaataacagaagttgagccagaagatatcgattgttggtgcaacttaacttcgacctgggtgacatacgggacatgtaatcaagcaggagaacaccgtagagacaaaagaagtgtggcgctggccccgcacgtagggatgggactagatacaagagcccaaacatggatgtcagctgaaggagcttggcgtcaagcagaaaaagtagaaacctgggccttacgtcacccaggttttacaatactagctttgtttcttgctcactatatcggcacatctctaactcaaaaagtcgtcatttttatattgctaatgttagtgacaccaagtatgaccatgagatgcgtcggagtaggaaatcgagatttcgttgaagggcttagcggggctacctgggtagatgtagtcttagaacatgggggatgcgtaacgacaatggctaaaaacaaacctacgctagacatagaacttcagaaaacagaagcgacacagcttgctaccctaagaaaactatgtatagaaggaaaaataacgaatgtaacaacagatagccgatgccctacacaaggagaagccatattaccggaagaacaggaccagaattacgtatgccgtcatacatatgtagataggggctggggaaatggatgtggcttattcggtaaaggttctttagtcacatgtgcaaaatttcagtgccttgaattaatcgaagggaaagtcgtacagcatgagaacttaaaatatacagtgattataaccgtgcacaccggggaccaacaccaggttggtaatgaaactcaaggtgttacagcagaaatcacgcctcaagcctcaacggttgaggcgatactccctgaatatgggactttaggattggaatgttctccaagaactggattagattttaacgaaatgattttactgacaatgaaaaataaggcttggatggtacacagacaatggttctttgacctccctctgccttggacatccggcgcaactactgaaacacctacatggaataagaaagaactgttggtcacgttcaaaaacgcgcacgccaagaaacaagaggtagttgtactaggatcacaagaaggtgcgatgcatacagcgctcacaggagccacggaaattcaaaccagtggcggtacaagcatctttgcgggacatttaaaatgtagattaaaaatggacaaacttgaacttaaagggatgtcatatgcgatgtgttctaacgcatttgtactaaagaaagaagtaagtgaaacccaacatggtacaattctaataaaagtagaatataaaggcgaggacgctccatgtaaaataccattctcaacagaagatggacaaggtaaagtgcataacggacgcttgattacggccaacccagtcgtgactaagaaagaagaaccggttaacattgaagcggagccgccattcggggaaagcaacatcattattggtataggagacaaagcccttaaaatcaactggtataagaaaggatcatcaatcgggaaaatgtttgaagcaactgcaagaggagcaagacggatggcaatacttggcgatacagcctgggacttcggatcagtaggaggggtactcaactccctcggcaaaatggttcatcaaatctttggctcagcatacacagctctctttagtggagtatcttggatcatgaaaataggcataggcgttctgcttacatggatcggacttaattccaaaaacacctcaatgagcttttcttgtatagtgattggaatcataactttgtacttaggagccgtcgttcaagcagatatgggatgtgtgataaactggaaaggtaaagagttgaaatgcggttcaggaatctttgttacgaatgaagtccacacatggacagaacaatataaattccaggctgacagtcctaaacgactagccaccgctatagcaggagcatgggagaatggagtgtgcggaatcaggagtacgactcgaatggaaaacctattatggaaacagatcgctaacgaattgaattatattctatgggaaaataatattaaactaacagtggtagttggggacatcataggagttttggaacaaggcaaaagaacacttacaccacagccaatggaactaaaatattcttggaaaacgtggggcaaggccaaggtagtaactgctgaaatacagaatagttcattcatcatagatggccctaataccccagaatgtcccaatgcaagtcgtgcatggaacgtatgggaagtagaggattatggctttggtgtgttcacaaccaatatatggctaaagttaagagaaatgtatactcaactatgtgatcaccggttaatgtcagcggcagttaaagacgaaagagctgtacatgccgacatgggatattggatcgaatctcagaaaaatggcagttggaagctcgaaaaagcatcgttaatagaagtgaaaacatgtacttggccaaaaagccatactttatggtcaaatggcgtattagaatctgacatgattatccctaagagtctagcaggtcccattagtcaacacaattatagacctggataccatactcaaactgccggaccttggcatctcggaaaacttgagcttgactttaattactgtgaaggcacaacagtggttatcacagaaaattgtggaactagaggaccttccttgagaacgacaacagtcagcgggaagttaatacacgaatggtgctgcagaagttgtacgttacccccattacgctatatgggcgaggatggttgctggtatggcatggaaataagaccaattaacgagaaggaagaaaatatggttaaatccctagtttcagcaggttctggaaaggttgataactttacaatgggtgtactctgtttagcgatactgtttgaagaagtaatgagaggaaaatttggcaagaaacatatgatagcaggagtactcttcatgtttgttttattactttctggtcaaataacctggagagacatggctagaacgttaatcatgatcgggagtaacgcatcagacagaatggggatgggagtaacttacttagcacttattgcaacgtttaaaatccaaccctttctcgcattaggattctttttgagaaaactaaccagccgggaaaatctcctccttggagttggtctggccatggccaccactctccaattaccggaagatattgagcaaatggctaatggtattgctttagggttaatggcgctaaaactaataactcaatttgaaacatatcaactttggacagcactggtaagtctaacctgttcaaacacaatcttcactttaaccgttgcttggcgtacagcaacacttattttagcgggtattagcttgctacccgtatgccaatctagttcaatgaggaagaccgattggctccccatgacagtcgcggctatgggggtgccccctttaccactattcatctttagtctcaaagatacgctcaagcgtaggagctggccgttaaatgagggggtaatggctgtcggcctagtctcaattctagcgagctctttattacgaaatgacgtcccaatggccgggccattagtcgcgggaggtctattaatagcatgctatgtaattactggaacgagcgcagacttaacagttgaaaaagctgcggatgttacttgggaagaagaggctgaacaaaccggcgtaagccataatctaatgataacagtagatgacgatggaacgatgaggatcaaagatgacgaaactgaaaacatacttacggttttactaaagaccgcactccttatagtttcaggaatttttccatattctataccggcaacactattggtatggcatacatggcaaaaacaaacgcaaaggtcaggcgtattatgggacgtaccatctcctcctgagacacaaaaagcagaacttgaagaaggcgtttacagaataaagcaacaaggaatcttcggaaagacccaagtaggggtaggagtccaaaaagagggagtatttcacacaatgtggcatgtgacaaggggcgcggtcttgacttataacggcaaaagattagagcctaattgggcaagtgtcaagaaagatttaatatcatatggtggcggatggcggcttagcgcacaatggcgaaaaggagaggaagtacaagtaatagcggtggaaccgggcaaaaatcctaaaaattttcaaactatgccagggatcttccaaaccactacaggagagataggagcaatagccctagactttaaaccaggcacatctggatctccaataataaatagagagggcaaagtagtaggcttgtatggtaatggggttgtaaccaaaaatggtggttacgtatcaggaatagcacagacaaacgctgaaccggacggtccaacaccggaactagaagaagagatgtttaagaaacgaaatctgaccatcatggatctccacccaggaagtggaaagacaaggaagtatctgccagcgatagtgagagaagcaattaaaagacgtctcagaacactaatcttagctcctacgagggtagttgccgcagaaatggaggaggcactaaaaggattacctatacgctatcaaaccaccgcaacaaaaagcgaacacacaggaaaggaaatagtcgatctaatgtgccatgctacttttacaatgcgcttattatcgccagtgagagtgcctaattataacttaataataatggatgaagcacactttacagatcccgcatccattgctgcacgaggatatatttcaactcgagttggaatgggagaggcggctgccatcttcatgacggcaacaccgcctggaaccgcagatgcattccctcagtctaatgcaccaattcaagacgaagagagagatataccagaacgatcgtggaactcaggtaatgattggatcaccgactttgccggaaagaccgtttggttcgtaccatccataaaggcaggcaatgacatcgcaaactgcttaaggaaaaatggaaagaaagtgatacagctgtccaggaaaacctttgatacagaatatcagaaaactaaattaaatgattgggactttgtagtcacaactgatatctcagaaatgggcgcaaattttaaagcagatagggttatcgacccaagaaggtgcttgaagcccgtaatattaacagacggaccagaaagagttattttggcaggcccgatgcccgtcacagtcgcatcggcagcacaacgtagagggagggttggcagaaaccctcagaaagaaaatgatcaatacatctttacaggtcagcctttaaacaatgatgaggaccacgcccattggacggaggctaaaatgctgttggataatatcaatactccagaagggattatacctgcattgtttgagccagaaagagaaaagagcgcagctatagacggtgagtatcgtctgaaaggcgaaagtagaaagaccttcgtggaactcatgagacgtggggatttacccgtttggctcgcgcacaaggtagccagcgaaggtattaaatacactgatagaaaatggtgctttgatggagaaagaaacaatcaaatcctcgaggagaatatggacgtagaaatttggacaaaggaaggtgagaagaagaaacttcgtccacgatggctcgatgcaaggacatacagtgacccgttggctcttaaggagttcaaagattttgccgctgggcgaaaatctatcgcattagacttagttactgaaattggacgtgttcccagtcacctcgctcatagaacacgcaatgcgttagataatctagttatgctccacacctctgagcacggaggtcgggcatataggcatgccgtagaagagttaccagaaacaatggaaacatttttgctcttaggattaatgatactcttaaccggtggtgctatgttattcctaatcagtggaaaaggggtcggaaagacatcaatagggttaatttgcgtagtagctagcagtgggatgttatggatggcagatatacctttacaatggatcgcatctgcaattgtcttagagttctttatgatggtactactcataccagaacctgaaaaacaacgaacaccgcaggacaatcaattggcttatgtagtgattggcattctgacgttggccgctattgtcgctgctaatgagatggggcttctagaaacgactaaacgtgacttaggaatgtctaaagaacctggtgttgtatcgcctacaagttatcttgacgtagatctccacccggctagtgcttggacattatacgcagttgcaacgactgttatcacaccaatgttacgtcatacgatcgagaactccacagcaaacgtttcacttgcagcaatagccaatcaggcggtagtattgatggggctcgacaagggttggccaatatccaagatggatctaggtgttcctttacttgccttaggatgctatagtcaagtgaacccgctcacgttaactgcagccgttctcctcttagttacacactatgcgataatcgggccgggcttacaagctaaggcaacgagagaagcacaaaaacgaactgctgcaggtattatgaagaacccaactgtagatggcatcatgactatagatttagacccagtaatatatgacagcaagtttgaaaaacagttaggacaagtgatgctcctagtactgtgtgccgtccagttactattaatgaggacctcctgggctttttgcgaggcattaacactagccacaggtccaattactacattatgggagggttcgcccggaaagttctggaacacaactatcgctgtatcaatggcaaacatattccggggtagctatttagcgggagctgggctagctttctcaataatgaaatcagtaggtacaggtaaaaggggcacaggaagtcaaggagaaactcttggagaaaagtggaagaagaaattaaaccaactttctcgtaaagaatttgatctctataagaaatcaggtataactgaagttgacaggactgaagcaaaagaaggtcttaagcggggagaaaccacacaccatgcagtcagtagaggttctgcaaaactacaatggtttgtggaaagaaacatggttattccagaaggacgagtaatagacctcggctgcggaagagggggatggtcgtactattgtgcaggtcttaaaaaggtaacggaagtccgaggctatacaaagggcggtccagggcacgaggaaccagttccaatgtcaacctatggttggaacatagttaaattaatgtcggggaaggatgtattctatctacccccagaaaaatgtgatactttattatgtgacattggagaatcatcaccaagccctacagttgaagagagtagaactattagggtattaaaaatggtcgaaccatggctgaaaaacaaccaattctgtattaaagttttgaacccttatatgccaactgtaatcgaacatctcgaaagattacaaagaaaacatgggggaatgctggtgcgtaatcctctatcacgtaatagtacgcatgaaatgtactggatatcaaacggaactggaaatatcgtctctagcgtaaatatggtctcccgacttttattgaatagatttacaatgacataccgtagacctacaatagaaaaagatgtcgacttaggggcaggaacccgacatgtcaatgccgaacctgaaaccccaaacatggatgtaatcggtgaacgaatacggagaatcaaagaggaacatagttcaacatggcactatgacgatgagaatccgtataaaacctgggcttaccatggcagttatgaggtcaaagctaccggaagtgcatctagtatgataaatggagtcgttaaactgctaaccaaaccatgggatgtagtacccacggtaactcaaatggcaatgacagataccacgccttttggacagcaaagagtttttaaagaaaaggttgacacacgtactcctaaaccaatgccaggaaccagaaaagttatggaaataacagcagaatggctctggcgaaccctaggtcgaaataaacgaccaagattatgcacgcgagaggaatttactaagaaagtgcgaactaacgcagcaatgggggccgtttttacggaagagaatcaatgggacagcgccagagcagcagtggaagacgaagaattttggaagctcgttgaccgcgaaagggaacttcataaacaaggaaaatgtggctcctgcgtctacaatatgatgggaaaaagggagaaaaagctaggagagtttgggaaagcaaaaggctctagagctatttggtacatgtggctaggtgcaaggtacctcgaatttgaggctcttggctttcttaacgaagatcattggtttagccgagaaaatagctatagcggagtagaaggtgaggggctgcataagctcggttacatcctacgagacataagcaaaatacctggcggcgcaatgtacgctgatgacacagctggctgggatacacgcattacagaagacgatctccataacgaagagaaaattacacaacaaatggaccctgaacatcgacagttagcgaacgcaatttttaagttgacatatcaaaataaagtagttaaagtccaacggcccactcctaagggcactgtaatggatatcatcagtcgtaaagaccagagaggttctggccaagttggaacgtacggactaaatacatttactaacatggaagctcaactaataagacaaatggaaggcgaaggtgtattgagtaaaactgatttggaaaacccgcacctcctggaaaagaagataatacagtggctcgaaacaaagggcgttgaacgactgaagagaatggcgatttcaggagacgattgtgtagtcaaaccaatagacgatcgctttgctaatgccttactagcattaaatgatatgggaaaagtaaggaaagatatacctcaatggcaaccatctagagggtggcatgattggcaacaagtaccattctgcagtcaccacttccatgaactaataatgaaagacggtaggaaattggtagtaccttgtaggcctcaagatgagcttataggtagagcgcgaataagtcagggagctggctggagtcttaaagagactgcatgtctaggtaaggcttacgcacaaatgtgggctctaatgtattttcacaggcgagatcttagacttgcctctaatgcaatctgttctgcagtaccggtccattgggttcccacctctaggacaacttggtcaatacacgctcaccatcaatggatgacaacagaagatatgcttactgtatggaaccgagtttggatcgaagataacccctggatggaagataaaacgcctgtaaccacctgggaagacgtaccttatttagggaaaagagaagatcaatggtgcggatccctaataggtcttacgtcacgagctacctgggcgcaaaatatactaaccgcaattcaacaggttcgttctctgatcgggaacgaggaatttcttgactatatgccaagtatgaagagattccgaaaggaagaggagtcagagggggcgatatggtaa

SEQ ID NO: 23560 - RNA, 9873 nt, synthetic construct
  misc_feature 1..9873: note = derived and/or modified CDS sequence (opt6) from DENV-3__AY858044__SS-prME
  source 1..9873: mol_type = other RNA
acttcattatgtctaatgatgatgttaccagcaactctagcatttcatttaacctctagagatggagaacccagaatgatagttggcaaaaacgaacgcggaaaatcactactatttaaaactgcaagcggaataaatatgtgcactctaattgcaatggatttaggtgaaatgtgtgacgacacaataacatacaaatgtccactgataactgaggtcgaaccagaagatatagactgttggtgtaatttaacatcaacatgggtgacttatggaacctgtaaccaagcgggtgagcacagaagggacaaaagaagtgtagccttagctccgcatgttggaatgggtctggatacacgagcgcaaacttggatgtctgcggaaggggcgtggaggcaagttgaaaaagtagaaacatgggcatttcgtcatcctggatttactatcctcgcattatttctggctcattatattggtacttcgctaacccaaaaagtcgttatatttatcttgctgatgttagtcacgccctcaatgactatgcgttgcgttggagtaggaaatcgcgactttgttgaaggactgtctggagcaacatgggttgacgttgtattagaacatggagggtgcgtcaccacaatggctaaaaataaaccaacattagacattgaattgcagaaaactgaagcaacacaactggcgactcttcgaaaattgtgcatagaaggtaaaatcactaatgtaactacggattcaagatgcccaacacaaggagaagcaattctaccagaagaacaagaccaaaattatgtctgcaaacatacctatgtggacaggggatggggaaacgggtgtggtttgtttggaaaaggtagcttagttacttgcgcaaaattccaatgtcttgagctaatcgaaggaaaagttgtacaacacgaaaatctcaaatacacagtgatcataacggtccacacgggagaccagcaccaagtaggaaacgaaacacagggagttacagctgagattacaccacaagcatcaaccgtagaagcgatacttcccgaatatggtacattaggtctagaatgcagccctcgaacaggtttagatttcaatgaaatgatattgcttaccatgaaaaataaagcatggatggtccacagacaatggtttttcgatcttccattaccatggacatccggagctactacagagactcctacatggaacaagaaagaactattagtgacttttaaaaacgcacatgctaagaaacaagaagtggttgtgttagggagtcaagaaggggctatgcacacagcattgacaggtgcaacagagatccaaacatccggtggaacaagtatattcgcgggacatctgaaatgccgattaaaaatggacaaattagaacttaaaggtatgtcatacgctatgtgttcaaatgcctttgtgctcaagaaagaagtgtcagaaacacaacatggaacaattttgatcaaagtagaatacaaaggtgaggatgccccatgtaaaatccctttctctacagaagatgggcaaggcaaagcacataacggtcgtttgataaccgctaaccccgttgttactaaaaaggaggaacctgttaacatagaagcagaaccgccttttggagaatccaacataataataggcatcggagataaggctttaaaaataaattggtataagaaaggtagtagtattggaaaaatgtttgaagctacggctcgaggcgcgaggcgtatggcaatacttggtgatacagcctgggacttcggtagcgttggaggagtgttaaattcgctaggcaagatggtccatcagatattcggatctgcttacacggctttattctcaggggtcagctggataatgaagataggtattggcgttctattgacttggattggattaaacagcaaaaatacttcaatgagttttagttgtatcgtaattggtataataacactttacttaggggcggtagtacaagcagacatggggtgtgtgatcaattggaaagggaaagaactaaaatgtggttctggtattttcgttactaacgaggtacatacatggacagaacaatataagtttcaagccgactcaccaaagagactcgctaccgcaatagctggagcttgggaaaatggagtatgtgggatccgttcgacaaccagaatggaaaatcttctatggaaacaaatagcgaatgagctcaattacatactctgggagaataatataaagttaaccgttgtagtcggagacatcattggagttctagaacaaggcaaacgaactctcacacctcaacccatggaactaaaatattcgtggaaaacttggggaaaagcaaaaatagtaactgcagaaatccaaaacagctctttcatcatagatggtcctaataccccagaatgtcctaatgcttcccgagcatggaacgtctgggaggtagaagactacggttttggagtatttacaactaatatttggttaaaactgcgggaaatgtatacacaactgtgtgaccatagactcatgagcgctgctgtaaaagatgaacgagctgtgcatgcggacatgggttattggattgaatctcagaaaaatggttcatggaaattagaaaaagctagtctgattgaagttaaaacgtgcacttggcctaaatcgcataccctctggagtaacggagttcttgaatcagacatgataattccgaaatcattagcaggacccattagccaacataattatcggccaggctatcacacacaaacagcgggcccgtggcatctaggaaagctagaacttgatttcaattactgcgaagggacaaccgtcgttatcacggaaaattgtggaacaagaggaccaagccttcgaacaacaaccgtcagtggcaaattgatacacgaatggtgctgccgttcatgtacattgccgccgctccgctatatgggagaagacggttgttggtatgggatggagataagacctataaatgaaaaagaagagaatatggtaaagagtcttgtttctgcaggttctggaaaagtggacaactttactatgggcgtcttatgtctagccatccttttcgaagaagtgatgcgagggaaatttgggaagaaacatatgattgccggtgtactttttatgtttgtgctcttgctaagtgggcagatcacatggagggacatggcaagaactctcattatgattggatcaaatgcaagcgacagaatgggcatgggagtaacatatcttgcattaatagccacatttaaaattcaaccctttttagcacttggattctttttaaggaaacttacatcccgggaaaacttattgcttggtgtaggacttgccatggcaactacattacagctacccgaagacatagaacaaatggcgaatggcatagctctaggattaatggccctcaaacttataacacaatttgagacatatcaattatggactgccttagtatcacttacctgtagcaacacaattttcacacttacggttgcttggcggacagcaacactaattttagcaggtatcagcttgcttccagtatgtcagtcatcatcaatgaggaaaacggattggctgcccatgacagttgctgcgatgggagtcccacccttaccactattcatattctcactaaaagataccttaaaacgcagaagctggccgttaaatgagggggtgatggccgttggcctagtaagcatattagctagttcattactaagaaacgatgtacctatggcggggccattggtagctggcgggttacttattgcatgttatgtgataacaggaaccagtgcagatttaacagtcgaaaaagcggctgatgttacatgggaagaggaagcagaacaaactggggtaagtcataatctaatgataacagtggatgatgatggcaccatgagaattaaagatgacgagactgaaaacatactgaccgtattattaaagaccgcactattaattgtttcagggatatttccttacagtatccccgcgacactgctcgtatggcatacatggcagaaacaaacacagagaagtggtgtattatgggatgtccctagtcctccggaaacccagaaggccgagttagaagagggagtttatagaattaaacagcagggaatattcggcaaaacacaagtaggggttggggtccaaaaagaaggtgtgtttcatactatgtggcatgttacaagaggagcagttctcacatacaatggaaagagactagaaccgaactgggcctctgtcaagaaagatctgatttcttatggtggaggatggcgcctgagtgcccaatggcagaaaggcgaggaagtacaggtaattgcagtcgaacctgggaagaatcccaaaaattttcaaaccatgcctggcatatttcaaacaactactggagaaataggagcaatcgcattggattttaaaccaggaacaagtggatcacccatcataaatcgagagggtaaggtagtaggtctatatgggaatggtgtagtcactaagaacggcggttacgtcagcggaattgcgcagacgaatgctgaaccagatggtccaacgcctgaattagaggaagagatgtttaagaaaaggaacttgactataatggatctacacccagggtcaggtaaaacgagaaaataccttcctgcaattgtaagagaagccattaaaagacgacttcgtaccttaatactggcacctacgagggtggttgcagcagagatggaagaagccttaaaaggtcttcctataaggtaccaaacaacggcaacaaaatcagaacataccggaaaggaaatcgtagatttgatgtgccacgcgacgtttactatgagactgttatccccagtgagggtacctaattataacctaattatcatggatgaagcacacttcacggaccctgctagtattgcggcaagaggatacatttctacacgggtcgggatgggagaagcagcagccattttcatgacggctactccgccagggacggccgatgcgttcccacaatctaacgctccaatccaagacgaggaacgggacattccagaacgcagctggaacagtggaaatgattggataacagattttgcagggaaaaccgtctggtttgtaccaagcattaaagcaggaaatgatatagcaaattgcttaaggaaaaatggcaagaaagtaatccaattgtcaaggaaaacatttgacacagaatatcagaaaactaaactaaatgactgggacttcgtagtgacgacagacattagtgagatgggggcgaacttcaaggcagatcgtgtaatcgatccacgacgatgtctgaagccagtcatactgacggacggacccgaacgagtgatactagcgggcccaatgccagttacagtagcatcggcagctcaaaggaggggaagagtcgggagaaacccacaaaaagaaaacgaccaatacatatttacgggacaaccattaaataatgatgaagatcacgcgcactggaccgaggccaaaatgttactcgacaacataaatactccggaagggataatccctgctttgttcgagccagaacgggagaagtcagcagccatagatggggaatacaggcttaaaggggagtcacgtaaaacattcgtagaattaatgagaagaggagatctcccggtatggttggcgcataaggtagcatcagagggtattaaatacaccgacagaaaatggtgcttcgatggagaaagaaataaccaaatcttggaagaaaatatggacgttgagatttggacgaaagaaggggagaagaagaaattgcgcccacgatggttagatgcaagaacatactcagatcctttggcattaaaagaatttaaagacttcgcagctggcaggaaaagcatcgcattagacttagttacagagattggcagggtcccctcacacttagcccatagaacaagaaatgctttagacaatttagttatgttacatacatccgaacacgggggcagagcgtaccgacacgccgttgaagaactaccagaaactatggaaacattattgttactaggtctaatgatactgttaacaggcggagctatgctttttcttatcagtggaaaaggagtaggaaaaacttcaataggcctcatatgtgtagtagcatcctctggtatgctttggatggcagatataccgcttcagtggattgcttcagcgatcgtattagagttctttatgatggtcttattgatcccagaaccagagaagcaacggaccccacaggacaaccagttagcatacgtcgttatagggatactgacactagctgcaatagtagctgccaatgaaatggggcttttagaaacgacaaaaagagaccttggaatgtcaaaagaacctggagtagtttcccctacaagttacctagatgttgacctccatccagcatcagcgtggaccctttacgcagttgcaacaactgtaataaccccaatgttgagacatacgatagaaaattcaaccgctaacgtatcattagctgcaattgcaaatcaagcagttgttttaatgggattagataagggctggccgattagcaagatggacctaggtgtaccgctcttggcactgggatgctactcacaagtaaatccattgaccttaactgccgcagtattattattggtaacacactatgcgatcatcggacccggattacaagctaaagcaacaagagaagcgcagaaaaggactgctgcaggaataatgaaaaacccaacagtggatggaattatgactatcgatctcgatccagtaatttatgatagtaaattcgaaaagcaactagggcaagtaatgttactcgtattgtgtgcggtgcaattactattaatgagaacatcatgggcattctgcgaagcactaacattagcaacgggtccaataactactctctgggaaggttcgcctggaaaattttggaatacaacgattgctgtctcaatggcaaatattttcaggggttcgtatctcgcgggcgctgggttagccttcagtataatgaaaagtgtggggaccggcaagcgcggaacagggtcccaaggagaaacattgggtgaaaagtggaagaagaaattaaaccagttatccagaaaagaatttgacttatataagaaatcaggtatcaccgaggtagatcgaacagaagcgaaggagggcctaaagcgtggtgagactacacaccatgctgtcagtcgagggtcagccaagttgcagtggtttgtggaacgaaacatggtaataccagagggcagggtgattgatttgggatgcggtagagggggttggtcgtattactgcgcaggactaaagaaagttacagaagttagggggtacacaaaaggtggcccaggtcacgaggaacccgtgcccatgagcacatatggatggaacattgtaaagctgatgagcggaaaggacgtgttttatctcccgccggaaaaatgtgatacattattatgcgatatcggagaatccagtccatcgccaacagttgaggaatctcggactatacgcgttcttaaaatggtggagccatggcttaaaaataatcaattctgtataaaggttctaaacccctacatgcccacagtgattgagcaccttgaacgtctacagcgcaagcacgggggtatgctcgtcagaaatccactaagtagaaattccacacacgaaatgtactggatctcaaatggaacaggcaacatcgtatcatctgtgaatatggtttctagattgcttctcaacaggttcactatgacataccgtaggccaacaattgaaaaagacgtagatctcggcgcaggaacaagacatgtaaacgccgaacccgaaacacccaatatggatgtcataggcgaaaggattcggagaataaaagaagaacacagctcaacttggcattatgacgacgaaaatccttacaaaacttgggcctatcatggttcatatgaagtgaaagcaactggctccgccagctcaatgattaacggggtagtaaaactattaaccaaaccttgggacgtggtaccaactgttacacagatggcaatgacagatacaactccattcggtcaacaaagagtttttaaagaaaaagtagatactcgaaccccaaaacccatgccggggacaaggaaggttatggaaatcaccgccggatggttgtggcgtaccttaggtagaaacaagcgtcctagactctgtacgagagaggaatttaccaagaaagtgagaacgaatgctgctatgggagcggtattcacagaagagaatcaatgggactccgcgagggcggcggtagaagatgaagaattttggaaattagttgatcgcgaaagagagttacacaagcaaggtaaatgtggatcttgtgtctataatatgatgggcaagagagagaaaaagctaggtgaatttggtaaagcaaaaggcagccgcgcaatatggtatatgtggctaggcgcaagatatttagagttcgaagccctagggttccttaacgaagaccactggtttagtcgagaaaattcatattccggggtcgaaggtgagggattacataaactaggctatattctacgagacatctcgaaaatccctggaggggcaatgtacgctgacgatactgcaggatgggacactcgtataacagaggatgatttacataacgaagaaaagataacccaacaaatggacccagagcaccgtcaactggctaacgcgattttcaaattaacctaccaaaataaagttgtgaaagtacaaaggccaactccaaagggtacggtaatggacataatttcaagaaaagatcagagaggatctggtcaagtcggtacctatgggctaaatactttcactaacatggaggcacagctgatacgacaaatggaaggggaaggtgtattatcaaaaactgatttagagaacccacatctgttagagaagaaaattacacaatggttagaaactaaaggtgtagaacgactaaaacgaatggccataagcggagatgattgtgttgtaaagccaattgacgataggtttgcaaatgccttgttagcactcaatgacatgggtaaagtaaggaaagatataccccaatggcaaccctctaaaggttggcatgattggcaacaagtcccattttgcagtcaccactttcacgaactaataatgaaagatggcagaaaacttgtagtcccgtgcagacctcaagacgaacttataggcagagcgagaatatcccagggggcaggttggtcgcttaaggagactgcttgcctaggaaaggcttacgcgcaaatgtgggcactaatgtattttcatagaagagacctaagactagctagtaacgcaatttgttccgcggttccagtacattgggttccaacttcaaggaccacgtggtccatacacgcccatcatcaatggatgacgacggaggatatgttaactgtttggaacagagtatggatcgaagacaacccttggatggaagacaaaacccctgttaccacttgggaagatgtaccgtacttaggtaaacgagaagaccagtggtgcggatcattaataggactcacttcgcgcgccacatgggcgcaaaacattttaacagcgattcaacaagtccgtagcctaataggtaatgaagagtttcttgactacatgccgtcaatgaaacgattccgcaaggaggaggaaagtgaaggcgctatttggtaa

SEQ ID NO: 23561 - RNA, 9873 nt, synthetic construct
  misc_feature 1..9873: note = derived and/or modified CDS sequence (opt6) from DENV-3__AY858045__SS-prME
  source 1..9873: mol_type = other RNA
acttccctctgtttaatgatgatgttacccgcaactctggcttttcacctaaccagtcgtgatggggaaccccgtatgatcgttggtaaaaatgaaagaggaaaaagtttgcttttcaaaacggcatcagggataaatatgtgcacccttatagcgatggatcttggtgaaatgtgcgacgatacaattacttataaatgcccgctgatcactgaagtagaacctgaagatatcgattgttggtgtaacctaacttcaacatgggtaacatacggcacatgtaaccaggccggtgaacacagacgagataaacgttccgttgcattagccccgcatgttgggatgggattagatacaagagcacaaacatggatgtcagcagaaggggcttggcgacaagtggaaaaagttgagacatgggcatttaggcatccgggtttcacaatactagccctatttctcgcacactatataggtacctctctcacccaaaaagtagtgatatttattttactcatgctagtaacaccctctatgacaatgagatgtgtaggtgtcggtaatagagactttgtagaaggattaagcggtgcgacatgggtcgacgtagtattggagcatggaggctgcgtcactacgatggccaaaaataaacccacactagatatcgaattacagaaaacggaagccacacaactcgccacattacgaaaactctgcatcgaagggaaaattactaacgtaacaactgacagccgctgtcccacacaaggggaagcgatactaccagaagaacaagatcaaaattatgtctgtaaacatacatatgttgatcgtgggtggggaaacggttgcggtttattcggtaaaggatctttagtaacctgcgccaaatttcaatgtctcgaactaatagaaggcaaagttgtccaacatgagaatctcaaatatactgtgataataaccgtacacacaggcgaccagcaccaagtcgggaatgagactcaaggggttacggcagaaatcacaccccaagcaagtacagtcgaggcaattcttccagaatacggtacactaggattagaatgttcacctagaacaggtttagacttcaatgaaatgatcttgttaactatgaaaaacaaggcttggatggtacatcggcaatggttctttgatcttcccctaccatggacaagcggagcgaccaccgaaacaccaacttggaataagaaagagctacttgtaacctttaaaaacgctcatgccaagaaacaggaagtcgtggtattgggctcccaagaaggcgccatgcacacggcacttactggagctacagaaattcaaacgtctggtggtacttccatctttgcgggccatctaaaatgtagattaaaaatggataaattagaattaaaaggtatgagctatgccatgtgttctaatgcatttgtgctgaagaaagaagtctccgaaacacaacacggaacaattctaataaaagtagaatacaaaggcgaggatgctccctgcaaaataccattttcaacagaagacggtcaaggtaaagcccataacggccgactgataacagcaaacccagttgtaactaagaaagaagaaccggtaaacatagaagctgagccaccttttggcgagagcaacataatcatcggcataggagataaagccctgaaaattaactggtacaagaaaggatcctcaattggcaaaatgtttgaagctacagcaagaggagccagacgaatggcgatcttgggagataccgcatgggatttcggaagtgtcggaggagtcctaaattcgcttggcaaaatggtgcatcaaattttcggatccgcatacacagcgatatttagcggagtgtcttggatcatgaaaatagggataggggtattgttaacgtggatcgggttaaacagtaaaaatacctccatgagtttttcatgtatagtaataggaatcatcacactatatctcggggctgttgttcaagcagacatgggatgtgttataaactggaaaggtaaagaattaaaatgcggatcaggaatctttgtaacgaacgaagtacacacatggactgaacagtataaattccaagcggattcaccaaaaaggttagccaccgctatagctggagcttgggaaaacggagtgtgtggcataaggagtacaacccgtatggaaaacttgctatggaaacagatcgccaatgaactcaactatatattatgggaaaataatattaaacttactgtagtagtcggagatataataggagtcctcgagcaaggaaagagaacacttacaccgcaaccaatggaactgaaatattcttggaaaacatggggcaaagcaaaaattgttacagcagaaatacaaaacagctccttcatcatcgatggacccaacactccagaatgccctaatgcaagcagagcttggaatgtatgggaggtggaagactatggattcggagttttcacaactaatatatggctaaaactacgtgagatgtatacgcagctctgcgatcatagattaatgtctgcagcagtaaaagatgaacgagctgtacatgcagacatgggttattggatagaatcacagaaaaacggctcctggaaattagaaaaagctagcctaatcgaagtaaagacttgtacatggcctaaatcacatactctctggagcaacggtgttcttgaaagcgacatgataattcccaagtctttagctggaccaatctcacaacacaattatagaccaggttaccacactcaaacagcgggaccatggcatttaggtaaattagagttggactttaattattgtgaaggaacgacagtagtaattaccgagaattgcgggacacgaggtccgagcctcagaactacaacagttagcggaaaactaatacacgagtggtgttgtagatcctgcacgcttccgccactgaggtacatgggagaagacggttgctggtatggaatggaaataagaccaataaatgaaaaagaagaaaatatggtaaaatcattagtttctgcaggttcaggcaaagtagacaattttactatgggagtcttatgtttagcaatattattcgaagaagtgatgagaggaaagttcgggaagaaacatatgatagctggagttttatttatgttcgttttactcctcagtggccaaataacatggagagacatggcaagaacattgatcatgatagggtccaacgcctcagacagaatgggaatgggagttacatatttggcgcttattgctacgttcgagatacaaccttttctagcactgggcttctttcttaggaaattgacatcacgagaaaatttattgctgggagttggcctagcaatggcaacgacactgcaactaccggaagatatagaacagatggctaatggaatagcacttggattgatggcactcaaactcataacgcaatttgaaacgtatcaattatggacagcactggttagcctaacatgttctaatacaatttttacactgacagtcgcatggagaaccgctacattgattttggctggaatatcgctattgcccgtctgccaatcgagctcaatgagaaaaactgattggttgccaatgacagtggcagcaatgggagtaccacccctcccccttttcatcttctcactcaaagacactttaaaacgaagaagttggccactgaatgagggcgttatggctgtaggacttgtcagcatacttgcatcaagtctgttaagaaacgacgtaccaatggccggtcctttagtcgctggaggtttattaatagcttgttatgtaataacgggtacttctgcggacctcacagtagagaaagcagcggacgtgacatgggaagaagaagcggaacaaacgggggtgtcacacaatctcatgataactgtcgatgacgatggtacaatgcgtataaaagacgacgaaactgagaatattcttaccgttctattgaaaacggcactgcttatagtctccggaatttttccctacagtatacccgctactttattggtttggcatacttggcaaaaacaaacgcaaagatcaggtgtgctctgggatgtcccaagtccacccgaaacacaaaaagccgaattggaggaaggggtctatcgcattaaacaacagggaatattcggaaaaactcaagttggtgttggagttcaaaaagaaggagtttttcatacaatgtggcacgtaacaagaggggctgtgctaacctataacggtaagcgactagaacccaactgggccagcgtcaagaaagacctaatatcctacggaggcggttggaggttatcagcacaatggcaaaagggcgaagaagttcaagtgatagcagtagagccgggcaaaaatcccaaaaattttcaaactatgccaggtatttttcaaaccacgacgggagaaataggtgcaatcgcactagacttcaagccaggaacttcaggatcacctataatcaatagggagggtaaagtagtcggactatacgggaatggggttgtcactaagaatgggggatacgtctcaggtatagctcagacgaacgctgagcctgacggtccaacacccgaattagaagaagaaatgtttaagaaacgaaatctaaccattatggatcttcatccaggatcaggtaagacacggaagtatctcccagctattgtaagagaggctataaagcgaagattaagaacgctaatccttgcacctacacgagtcgtagcggcagagatggaagaggctttaaagggattacctatacgttatcaaacaactgcaactaagagtgaacatacagggaaagaaatcgtagatttgatgtgccacgcaacattcacaatgagactgttgtcacccgtccgggtacctaactacaacctgataataatggacgaggctcattttacagatcctgctagcatagcagcccgtggatatatctcgacacgcgtaggaatgggtgaagcagcggctatattcatgaccgccacaccaccaggaacagccgatgcatttccacagagcaacgcacccatacaagacgaagaacgagatattccagagagatcctggaatagcggaaacgactggataactgattttgctggtaaaacggtttggtttgtcccttcaatcaaagctggcaacgacattgcaaattgtttaagaaagaacgggaagaaagtcatacaattaagtcgaaagacatttgatacagagtaccagaaaactaaactaaatgattgggatttcgtggttacaacagatataagtgaaatgggcgctaactttaaagcagatcgagtcatagacccgagaagatgcctaaagccagtaatactaacagatggtccagaaagagtgatactggcaggcccaatgccagtaactgtagcgtcggccgctcaaagaagaggtcgagtaggaagaaatcctcaaaaagagaatgatcaatacatttttacaggtcaacccttaaacaatgatgaggatcatgcacattggacggaagcaaagatgcttctagacaacatcaacacaccagaagggataattcctgccttatttgaaccggaacgcgagaaatccgcggcaattgatggcgaataccgtttaaaaggtgaatcaagaaagacctttgtagagctaatgagacgaggcgacctaccagtgtggctagcgcataaagtggcatcagaaggaattaaatacacggataggaaatggtgttttgatggagaacgaaataatcagatacttgaagaaaatatggacgtagagatttggacaaaagaaggagagaagaagaaacttcgcccaaggtggctagacgccagaacctactctgaccctttagcactaaaagaatttaaagactttgcagcaggtagaaagtcgatcgctttggacctggttacagagataggtagagtgccatcacacttggcacatagaacgcgtaacgcacttgataacttagttatgttgcatacaagtgaacacggagggcgagcgtatagacatgcggtcgaagaacttcctgagacgatggaaacattacttctattgggtttaatgattcttttaacaggaggtgctatgttattcttaatatcgggaaagggtgtaggtaaaacctcaattggattgatatgtgtagtagcatctagcggaatgctttggatggctgatattccgttacaatggatagcatctgccatagttctagaatttttcatgatggtactattaattccagaacccgaaaaacagaggacaccccaagataatcaactagcttacgtagtaataggaatcttaacgctggcagcaatagtagccgccaacgaaatgggcctattagagacaacaaaacgcgacctgggaatgtcaaaagaacccggtgttgtaagcccaacaagttatttagatgtagacttacacccagcgagtgcttggacattatacgccgtggccacgactgtcataacaccaatgctacggcatacgatagaaaattccacagcgaatgtgagcctggctgcaatcgccaatcaggctgttgttttaatgggtttagataaaggatggcctatatctaagatggatttaggggtcccattactagcactaggttgttactcacaagtcaatcctttgaccctaaccgcggcagtactcttattagtaactcactacgcgattatcggcccgggattgcaggctaaagcgactagggaagcacaaaaacggaccgcggcagggattatgaagaacccgactgtagatgggataatgaccattgacttagatcctgtaatctatgattcaaaatttgagaagcaattgggtcaggtaatgctattagtactatgtgccgtgcaactactgctaatgagaacaagttgggcgttttgtgaggcacttacactagctaccgggcccattactacactatgggaaggttccccaggaaaattttggaatactactatcgcggtaagcatggctaatatctttagaggatcatacttggccggagccggactcgcattttcgatcatgaagtcagtcggaaccggtaaaagagggacaggctcacaaggcgaaaccttaggcgagaaatggaagaaaagacttaatcagctttctcgaaaagaatttgatctgtataagaagtccggaatcacggaagttgatcgtacagaggcaaaggagggattgaaacgaggcgaaattactcatcacgcagtgtctaggggctcagcaaaattacaatggttcgtagaaagaaatatggtcattcccgagggaagagtgatagatttagggtgtggaagagggggttggagttattattgtgctggccttaagaaagtaactgaagtcaggggatatacaaaaggtggccccggccatgaggaaccagttcccatgtcaacgtatggatggaatattgttaaattaatgagcggaaaagacgtattttacctccctcctgagaaatgtgatacactactttgcgatattggtgaatcaagtccatctcccactgtagaagagtctagaactataagagtcctaaaaatggtagaaccgtggttaaagaataaccagttttgtatcaaagttcttaacccgtacatgccaacagtaatagaacatctagaaagacttcagagaaagcatggagggatgttagtacgtaaccccttaagcagaaattcaacacacgaaatgtattggatctcaaacgggacaggaaatatagtatcaagcgttaatatggtatctaggctccttttaaacagattcaccatgacatacagaagacctaccatagaaaaagatgtagacctgggcgcaggaactcggcacgttaatgcagaaccggaaacacctaatatggacgtaataggcgaaaggatcagaagaatcaaagaagaacatagtagcacgtggcattatgatgatgagaatccatataaaacttgggcctaccatggttcctacgaagtaaaagcgacaggctcagcatcatcgatgataaatggagtcgtcaagctattaacaaaaccatgggacgtcgtaccgacggtaactcaaatggcaatgacggacacaaccccgtttggtcaacaacgagtttttaaagaaaaagtggataccagaactcctaaacccatgccagggactcgcaaagtaatggaaataactgcggggtggttatggcgaacattgggccggaacaagcgaccgcgcctttgtacaagagaggaatttacaaagaaggtcagaactaacgcagctatgggagcagtctttacagaggaaaatcagtgggactcagcgcgtgcagctgtggaagacgaagagttctggaaattggtggacagagaaagagaactccacaagcaaggtaaatgcggaagctgtgtatacaatatgatggggaagagagagaagaaacttggtgagttcggtaaggctaaaggaagtagagcaatatggtacatgtggctcggagctcgctatcttgaatttgaagcactaggatttttgaatgaagaccactggttcagtagagaaaactcatatagtggggtagaaggagagggcctccataaacttgggtacatattaagagatatatcaaaaatcccgggaggcgcgatgtatgcggatgatacggcaggatgggatacgagaataacggaagatgacctacataatgaagagaaaatcacacaacaaatggaccccgaacatcgtcaactagctaatgcgatttttaaattaacatatcagaataaagtagtaaaggtacaacgacccacaccaaaaggaaccgttatggatataataagccgtaaagatcaacggggaagtggtcaagtcggtacatacgggctcaacacattcacaaatatggaagcacaactaattcgccagatggaaggcgaaggcgtactttcaaaaactgatttagagaatccacatttattagagaagaaaattacacaatggttggaaactaagggagtggaaagattaaaaagaatggcaatctccggagatgactgtgtagttaaacccattgatgatcgcttcgctaacgctttattagccctaaacgatatgggaaaagttaggaaggatatcccccagtggcaaccttcaaaaggctggcacgattggcagcaggtaccattttgtagccatcattttcacgagttgataatgaaagacggaaggaaactggtggtgccatgtagaccacaagatgaactaataggacgggcaagaatatctcagggtgcgggatggtcactcaaagaaacggcttgtttgggtaaagcatacgctcaaatgtgggcgttaatgtacttccacagacgagacctaagattggcatctaatgcgatatgctcagccgttccagtacattgggtgccgacttctaggacaacatggtcaattcatgcgcaccaccaatggatgacaaccgaagatatgcttactgtatggaatagagtgtggattgaagataacccttggatggaagacaaaacaccggtaacaacctgggaagatgtgccatacctgggaaaaagagaagaccaatggtgtggatcattaattggcctcacaagtcgggcgacctgggctcaaaatatcctcaccgccatacaacaagtccgaagcctcatcggaaatgaagagttcctggattacatgccaagtatgaagcgatttcgcaaagaagaggaaagtgagggcgcaatatggtaa

SEQ ID NO: 23562 - RNA, 9873 nt, synthetic construct
  misc_feature 1..9873: note = derived and/or modified CDS sequence (opt6) from DENV-3__AY858046__SS-prME
  source 1..9873: mol_type = other RNA
acaagtttatgcctaatgatgatgttgccggcgactttggcgtttcatctaacatcccgagatggtgaaccaagaatgatagtcggtaaaaatgaaagagggaaaagcctactatttaaaacggcatcaggtataaacatgtgcactctaatcgcgatggatttaggggaaatgtgtgacgatacaataacatataaatgcccattaattacagaagttgaaccagaagatatagactgttggtgtaacctcacatctacatgggttacttatggtacgtgtaatcaggtcggggaacacagacgcgacaagaggagcgtagcattagctccacatgtggggatgggattagatacacgtgcgcaaacttggatgtccgcagaaggtgcatggagacaagtagaaaaagtcgaaacttgggcattccgacacccagggttcactatattggcattgtttctggcacattacataggaacatcattaacacaaaaagttgtaatcttcatactattaatgttagtcacaccaagtatgaccatgcgatgcgttggtgttggaaatcgagactttgttgaaggattaagtggggcaacgtgggtcgatgtcgttttggaacatggtggatgtgtaaccacaatggccaaaaataaaccaacgttggatattgaactccagaaaacggaagcgacacaattagcgactttacgaaaactgtgtatagaaggtaaaataacaaatgtcacaacagattcacgatgtccaacacaaggagaagctatcctcccagaagaacaagaccaaaattatgtatgtaaacacacatatgtcgatagaggatgggggaatggatgcggcttattcggaaaaggttcacttgtaacatgtgcgaaattccaatgcttagaattaatagaaggaaaagtcgtccaacatgaaaatctaaaatatacagtgataattaccgttcacacgggggatcagcatcaagtaggcaacgaaacccaaggcgtcacagcagaaataaccccgcaggcttcaacagtagaagccatcttacctgaatacggaactctgggattagaatgttcaccaagaactggactagacttcaatgaaatgattcttctcacgatgaaaaataaagcgtggatggtacatcgtcaatggttctttgatttacctttgccgtggacatctggcgcaacgactgaaacgccgacctggaataagaaagaattgctagtaacattcaaaaacgcgcatgctaagaaacaagaagttgtcgtacttggctcacaggagggggcgatgcatacagcgttgacaggcgcaactgaaatacaaacgtctgggggaacaagcattttcgccggccacttaaaatgtagattaaaaatggacaaattagagttaaaaggaatgtcatatgccatgtgttcgaatgcattcgtgttaaagaaagaagtctctgaaactcagcatggtactattctaatcaaagtggagtataaaggcgaggatgctccatgcaaaataccattttcaacggaagacggccaaggtaaagcacataatgggaggttgataaccgctaacccagtagtaactaagaaagaggaacctgtaaacatcgaagcagaaccaccctttggggaaagcaatattatcattggtataggagataaagcgctaaaaattaactggtataagaaaggttcaagcatcggtaaaatgttcgaagcaacagcaagaggagcaagacgaatggccattctaggagatacggcatgggattttggttctgtaggaggagttctaaattctttaggtaaaatggtccatcaaattttcggctcagcctacactgcattgttctcgggtgtctcgtggataatgaaaataggcattggcgtattactcacctggataggtttaaatagcaaaaacacttctatgtcatttagttgcatagtaataggaataatcacactgtatttgggggctgtagtgcaagcagatatgggatgcgtaattaattggaaagggaaagaattaaaatgtggatcagggatctttgtcacaaatgaagtgcatacgtggactgaacagtataaatttcaagccgattcaccaaaaagattagccacggcaatagcaggggcatgggaaaatggggtatgcggaattagatcgaccacaagaatggaaaatcttttgtggaaacaaatagcaaacgaattaaattacatactgtgggagaataacattaaactaacggtcgttgtcggcgatattattggagtcttagaacagggtaaacgtacattaacacctcaacctatggaactcaaatatagttggaaaacttgggggaaagctaaaatcgtaactgcagaaattcaaaatagttcgttcataatagatggacctaatactccagaatgtccaaatgcttcacgtgcctggaatgtatgggaggtggaagattacgggtttggtgtcttcacaaccaatatctggctcaaattaagagaaatgtatacacaactatgtgatcatagattgatgtcagctgcagtaaaagatgaaagagcagttcacgctgacatggggtactggattgagtctcagaaaaatggaagttggaagctagaaaaggcttcactaatagaagtaaagacatgcacgtggccaaaaagccatacattgtggtcgaatggagtattagaatcagacatgatcattccaaaaagtctagcgggtccaataagtcagcataactaccgtcctggttaccacacgcagacagcaggaccatggcatctgggcaagttggaattggattttaactactgcgaggggaccacggtcgtaataacggaaaattgtggcacgaggggaccttcgcttaggacaacaactgttagcggtaagttgatacatgaatggtgctgtagaagttgtactttaccacctctacgatatatgggagaagacggatgctggtatggaatggaaatacgaccaataaatgagaaagaggagaacatggtaaaatctttggtaagtgcaggtagcgggaaagtcgacaatttcacaatgggtgttctctgcctagcaatcctgtttgaagaagtgatgcgcggaaaattcggcaagaaacacatgatagccggagtacttttcatgtttgtattattattatccggtcagataacatggagagacatggccagaactttaataatgattggtagcaatgcaagcgatcgtatgggcatgggggtgacctatttagcattaatcgctacattcaaaattcagccgtttctggcacttggattctttttaagaaaactgaccagtcgggaaaatttgttactcggtgtgggtttggctatggcgactacactacagctgccggaagatatagaacaaatggccaatggaattgcacttggtttaatggcactaaaattgattacccaatttgaaacttaccaattatggacagccttggtaagtttaacttgctcaaatactatttttaccttgactgtagcatggagaacagctactttaatcctcgctggtatatctttattacccgtgtgtcaatcttcaagtatgcgcaaaacagactggttaccaatgaccgttgctgcaatgggtgttcctccactaccgctgttcatcttttcgctaaaagacactctaaagcgcaggagttggcctttaaatgaaggcgttatggcggtaggattggtgagcatactagcgtcatcattactcagaaacgatgtacccatggccggacccctagttgccggtggtttgcttatagcgtgctatgtaatcacaggtacaagtgcagatctaacagttgaaaaagcggcagatgtaacttgggaggaagaagcggaacagaccggagtaagtcataacttaatgatcactgtggatgatgacggtacaatgcggataaaagatgacgaaacagagaatatactaaccgtactacttaaaacagcactgctaatagtatcgggtatttttccgtattcgataccagcgacccttcttgtatggcatacatggcaaaaacagacacaacgatcaggagttctctgggatgtaccgtcgccccctgaaacccaaaaagcagaactagaagaaggcgtatatcgcataaagcaacagggcatattcggaaaaactcaggtaggtgtgggggttcaaaaggagggagtatttcatacaatgtggcatgttacacgcggcgcagtgcttacatacaatggaaaacgactggaaccaaattgggccagtgtcaagaaagatctgataagctatggtggaggttggaggctatctgcgcaatggcagaaaggagaagaagttcaagttatcgctgtagaacccggcaaaaaccccaaaaattttcaaaccatgccgggaatcttccagacaacgacgggcgagatcggagccattgcactcgattttaaacctggaacaagtggcagtccaataattaatagagaaggaaaagtagtgggattatacggtaatggagtagttacgaaaaacggagggtatgtatcggggatcgctcaaacgaatgccgaacctgatgggcccactcctgaattagaagaagagatgtttaagaaacgcaatttgacaatcatggatttacaccctggctcgggcaaaactagaaaatatctccctgccattgttcgagaggccataaagcgtcgactaagaacactaatcttggctcctaccagagttgtggccgcggaaatggaggaagccctaaaggggctcccaatacgttaccaaacaacggctacaaaaagtgaacataccggaaaagaaatagtagacttgatgtgccatgcgacatttaccatgaggctgttgtccccggtgcgagtgcccaactataatctaataataatggacgaggcacatttcacagaccccgcaagtatagccgctcgtgggtatatatccactcgagttggaatgggtgaagcagcagcaatatttatgacagcaacgcctccagggactgcagatgcgtttccacagtcgaatgcaccaatccaagacgaggagcgcgacatcccggaaaggtcatggaactccgggaacgattggataacggacttcgcaggtaaaacagtttggttcgtcccgagcatcaaggccggaaatgatattgctaattgcctgaggaaaaatggaaagaaagttatacaactaagtcgcaaaacttttgatacggaatatcagaaaactaagctaaatgattgggattttgttgttacaactgacataagtgagatgggtgcgaatttcaaagcagaccgtgtaatagatcctcggcgctgcctaaaaccggtaatcttaacagatggaccagagagggtcatactggcaggtcctatgccggttacagtagcaagtgcggctcaaaggaggggcagggttggccgtaacccccaaaaagaaaatgatcaatatatatttacaggacaaccgttgaacaatgatgaagaccacgctcactggacagaagcgaaaatgctcctcgacaacataaacactccggaagggattattccagcgctttttgaacccgaacgtgaaaaatctgcagctattgatggggaatatagattaaaaggagaaagccgaaaaacattcgttgaactgatgcggcgtggggatttaccggtgtggttagcacataaagtagctagtgagggcataaaatataccgacaggaaatggtgctttgacggagagcgtaataaccaaatcctagaggaaaatatggacgtggaaatatggactaaagaaggtgaaaagaagaaattacggccacgatggctggatgcaagaacgtacagcgatccacttgccttaaaagagttcaaagactttgcggctggaaggaaaagtatagcgctagacctcgtgaccgaaataggaagagtcccatcacatttggcacacagaactcggaacgctttagacaatttagtcatgttgcacacttcagaacatggaggaagggcctataggcacgccgttgaggagttacccgagacaatggagaccttgctcctattaggactaatgattttattaacgggaggggcaatgttatttctaatctcaggtaaaggggtaggaaaaacaagtatcggccttatctgtgtggtagcttcaagtgggatgttgtggatggcagacatcccattacaatggatagctagtgctatagtgttagagttctttatgatggtcttactaatacctgaacctgaaaaacaacgcacaccacaagataatcaacttgcctacgtagtaattggtattctaacgttagcagcaattgttgctgctaatgagatgggtatgttagaaacaaccaaacgtgatttaggcatgtcaaaagaaccaggggtcgtgtcgcctacatcttatctagatgtagaccttcatccggcttcggcatggaccctatacgcagtagcaacaactgtgattacgcctatgttacgacacaccatagaaaactctactgcaaacgtcagcctagcagctatcgccaatcaggcagtagttttaatgggtttagataaaggatggcctatatccaaaatggaccttggagtgcccctacttgccctagggtgttatagccaagtaaacccacttactctaaccgcagctgtgctattattagtaactcactatgccataataggacctggtttacaagccaaagcaaccagagaggcacagaaacgcaccgccgcaggtattatgaaaaatccgactgtagatggtattatgactatcgacttagaccccgtaatttatgattcaaagtttgaaaaacaactaggccaagttatgctcttagtcttatgtgctgttcaacttctacttatgagaacatcgtgggccttttgtgaggcactaaccttagctactggacccataactaccctatgggagggaagtccaggcaaattttggaatacaacaattgcagtgtccatggccaacatttttagaggatcctatttagcaggagccggattagcgttttcaatcatgaaaagcgttggaacagggaaacgaggaacaggttcacagggagaaacattaggagaaaaatggaagaagaaactaaaccaactatctagaaaagaatttgacctatacaagaaaagcggtataacggaggtggatcgaacagaagcaaaggaaggcttaaggcggggcgaaataacgcaccatgcggtatctagaggttctgcaaaactacaatggttcgtggaacgtaacatggtaatcccagaaggaagagtgattgatctaggttgtggaaggggtggctggagttattattgcgctggtcttaaaaaggtaacagaagttcgtggttataccaaaggcggaccaggccatgaggagcctgtaccaatgtccacctatggttggaatatagttaaactaatgtccggaaaggacgtattttatctaccaccagaaaaatgcgatacattactgtgcgatattggtgaatcatcgccatcgccaaccgtcgaagaatctagaacgataagggttttaaagatggtagaaccatggctcaaaaacaaccagttctgtatcaaggtactcaatccgtatatgccaacagtcatagaacacctagagagactacaacgaaaacatggagggatgttagtaaggaatccactatctagaaacagtactcatgagatgtattggatatcgaacgggacgggcaatatagtctcttcagtaaatatggtatcaagattgctactaaataggtttaccatgacatatagaagaccaacaatagaaaaagatgtcgatctaggtgctgggacgcgacatgttaacgctgaacctgagacccctaacatggatgttatcggggaaaggattcgaagaattaaagaagaacatagtagcacgtggcattacgacgacgaaaacccatacaaaacctgggcatatcatggttcttacgaagtaaaagcaactggaagcgcgagttccatgattaatggtgtagttaaactattaacaaaaccatgggacgtagtgcctactgtgacacaaatggcaatgactgataccacacctttcggtcaacaaagggtttttaaggagaaggttgatacccgaaccccaaaaccgatgcctggaactaggaaggctatggagattaccgctggatggctttggagaacgttagggcggaacaagagaccaagactgtgtacgcgagaagagtttacgaagaaagtacgtacaaatgccgccatgggagcggtctttaccgaagaaaatcagtgggactccgcaagagcggcagtcgaagatgaagaattttggaaactggttgacagggagagggaattacataaacagggcaagtgtgggtcctgcgtttataatatgatgggcaaacgcgagaagaaattaggcgagttcggcaaagcaaaaggatctcgcgccatttggtatatgtggcttggagcgagatacttagagttcgaagccctaggatttttaaatgaggatcattggttttcacgcgagaatagttattcaggtgtcgaaggagaagggttacataaattaggttatatactaagagatattagtaagatacctggcggggcaatgtatgccgatgatacggccggatgggacacacgtataactgaggatgacttacacaatgaggagaaaataacgcaacaaatggacccggagcacagacaattggccaatgctatttttaaactaacttatcaaaacaaagtcgtaaaagtccagcggccgacacccaaaggtacagttatggatatcataagccgcaaggatcaacgcggttcaggacaggtcggcacatatgggttgaatacatttacgaatatggaagtccaactcatcaggcaaatggagggtgagggagttctatccaaaactgatctggaaaatcctcatttattagagaagaaaatcacacagtggctggaaacaaaaggcgtcgaaaggttgaagaggatggcaattagtggagacgactgcgtagttaagccaatcgatgatcgatttgcaaatgccttgctcgcgttaaatgatatgggaaaggtgagaaaggacataccgcaatggcaaccctctaaaggatggcatgattggcaacaggtccccttctgtagtcatcattttcatgaattaattatgaaggatggtagaaagctagtcgtcccatgcagaccacaagacgagttaatcggacgagcaagaatttctcagggagcagggtggagtcttaaagaaacagcatgtttgggtaaggcttatgcacagatgtgggcgctaatgtactttcatcgacgagatctaaggctggcttccaatgcaatatgtagcgcggttcccgttcattgggtgccaacaagcagaactacatggtcaatacacgcgcatcatcaatggatgacaactgaagatatgttaaccgtctggaacagggtatggatcgaagataatccttggatggaggataaaacccccgttacaacgtgggaagacgtaccatatttaggtaaaagggaagatcagtggtgtggcagcttaataggattaacgtcgcgcgcaacatgggcgcaaaatatcctaaccgcaatacaacaggtcagatcattgattggtaatgaagaatttcttgattatatgccttcaatgaaaaggttccgtaaagaagaggaatcagaaggagcaatctggtag

SEQ ID NO: 23563 - RNA, 9873 nt, synthetic construct
  misc_feature 1..9873: note = derived and/or modified CDS sequence (opt6) from DENV-3__AY858047__SS-prME
  source 1..9873: mol_type = other RNA
acctcactatgtctaatgatgatgttaccagcaactctcgcttttcacttaacttcgagagatggagaaccgagaatgatcgtaggcaaaaacgaaagagggaaatctttactatttaaaactgcgtctggaataaacatgtgcacgctcattgctatggatcttggggaaatgtgtgatgacacagtgacctataaatgtccattaattaccgaagtagaaccagaagatatagattgttggtgcaacttaacaagtacatgggtaacatacggaacatgtaaccaagcaggagaacatcgaagagataaacgatcagtagcgctggccccacacgtaggaatgggattagacacgagggcacaaacatggatgtcagcggaaggtgcctggaggcaagtagaaaaagtagaaacgtgggcgttccgtcacccaggatttacgatactggctttgtttctcgcgcactatataggaacatcgttaacgcaaaaagtagtgatatttatacttctcatgctagttacgccatcaatgacaatgagatgcgtaggggtaggtaacagagattttgtggaaggattatccggtgcaacatgggtggatgtcgtcctagagcacggcggatgtgtgacgacaatggctaaaaataaacctacattagacatagagctacagaaaactgaagcaacacaacttgccactttacgcaaattatgcattgaaggaaaaataacaaacgtgacaaccgacagtaggtgtccaactcaaggcgaagcaatattaccagaagaacaagaccaaaactatgtgtgcaaacacacctatgtagacagagggtggggtaacggatgcggactgttcggaaaaggcagtttagtgacttgtgcaaaatttcaatgcctagaattaatcgaaggaaaagtcgttcaacacgagaatcttaaatacacggtcattataaccgtacacacaggtgaccaacatcaagtgggaaacgaaacccaaggtgtcacggcagaaataacccctcaagcaagtactgtagaagccattttaccggaatatggaactctaggtctggaatgcagtcctcgcaccggactggactttaatgagatgatattactaacgatgaaaaacaaagcctggatggtacacaggcaatggtttttcgacttaccccttccttggacttctggtgctacaacagaaacacctacgtggaataagaaagaattgctcgtaacatttaaaaacgcacacgcgaagaaacaagaggtagttgtattaggctcacaagagggagcaatgcacaccgcattgacaggggcaactgaaatacaaacgtcagggggaacatccatctttgccggacatcttaaatgtcgattaaaaatggacaaactcgagttgaaaggtatgagctatgcaatgtgcagtaatgcatttgttctaaagaaagaggtctctgagactcaacatggtacaattctgattaaagtagaatacaaaggagaggacgcgccatgtaaaattccattctctactgaggacggtcaaggaaaagcgcacaacggacgattaatcacggcaaatcccgtggtaacgaaaaaggaagaaccagtgaacattgaggcagaacctccgttcggtgagtcaaatatcataattggcataggtgataaagcattaaaaatcaactggtataaaaaggggtcatctataggtaaaatgttcgaagcaactgctaggggagcacgcagaatggcgattctaggggacaccgcatgggactttggatcagtcggaggagtactaaacagcttgggcaaaatggtccaccaaatatttggatcagcttatactgcactcttcagtggagtgtcctggatcatgaaaataggaataggagtactcctcacatggataggtctcaactccaaaaacacaagcatgagcttttcatgtatagtcattggaatcatcacactatacctgggagctgtagtgcaggctgacatgggatgtgtaataaattggaagggtaaagaacttaaatgcggaagtggaatatttgtcaccaatgaggtgcatacatggacggagcaatacaagtttcaggcagatagccctaagcgtctagccacagctatagccggagcttgggaaaatggcgtctgtggaatcaggtcaaccactcgcatggaaaatctgttatggaaacaaatagctaatgaactaaattacatactttgggaaaacaacattaaactaaccgttgtggtcggggacatcataggtatattagaacagggaaaacgaacattaactccccagccaatggaactcaaatattcctggaaaacgtggggcaaagccaaaattgtgactgcagaaattcaaaatagtagctttatcatcgacggaccgaacacgcccgaatgtcctaatgcctccagagcttggaacgtttgggaggtggaagactatggttttggcgtatttacaacaaatatctggctaaaattacgagaaatgtactctcaactgtgtgatcacagactcatgtcagctgccgttaaagatgagagggcagttcatgcagatatgggttattggatagagagtcagaaaaacggttcatggaaactagagaaagcgtcacttatagaagtaaaaacttgtacctggcctaaaagtcacaccttgtggtcgaatggtgtattggaatctgacatgataataccaaaaagtttagcagggccaataagtcaacataactatcgcccgggctaccacacgcaaacagcgggcccatggcacctaggcaaactagagttagattttaattattgtgaaggaaccaccgtcgtaatcactgaaaattgtggtactaggggaccatcacttagaacaacaactgtgtccggaaaactaatacatgaatggtgctgtagaagttgtactctccctccacttaggtatatgggagaagatggctgttggtatggcatggaaattagacccattaacgaaaaagaagaaaacatggttaaatccctcgtttcagcaggatctggaaaagtagacaatttcaccatgggagtattatgcctcgctatcttatttgaagaagtaatgaggggaaaatttggcaagaaacacatgatagcaggagtactgtttacatttgttttactactctcaggccaaattacctggcgcgatatggcaaggacgcttattatgataggatcaaacgcctcagaccggatgggaatgggcgtaacctatctagcgctaatcgctacttttaaaatccaaccatttctagcattaggctttttcttaaggaaactgacgagtagggaaaaccttttactgggagtgggtttagcaatggcaacaacattacaattaccagaagatatcgaacaaatggccaacgggatagcactaggtttaatggcattaaaattaataacccaattcgagacttatcaactgtggactgcacttgtctcattaatgtgctctaatacgatctttaccttaacggtggcatggcgaactgcaactttgatacttgcaggaatctcacttttgcccttatgccagtcgagtagtatgcgaaaaacagattggctaccaatgactgtagcagcaatgggcgtacccccattacctttatttatcttctctctaaaggacactctcaaaaggagatcgtggcctctgaatgaaggcgtgatggccgtgggattggtcagtatactcgcgtcatctttacttcgaaatgatgtcccaatggcggggccattagtcgccggaggactgctaatcgcgtgttatgtcatcactgggacctctgccgatcttactgtagaaaaagcagccgacgtgacatgggaagaagaagccgaacagacaggagttagtcataatttaatgataacagtcgacgacgatggaacgatgagaattaaggatgacgagaccgaaaatatactaacagtacttttaaaaacggcattattaattgttagcggcatatttccttactcaataccagcgacattactggtatggcacacatggcagaaaagaactcaacgttctggtgtactgtgggacgtcccaagtccgcccgaaacccaaaaggcagaattagaagaaggagtgtataggataaaacaacaaggaatcttaggaaaaacacaagtgggcgttggggtacaaaaagaaggagtgttccacacaatgtggcatgtaacacgaggtgcagtactaacctataatggtaaaagattagaacctaattgggcttcggtcaagaaagatctcatcagttatggcgggggttggagattatcagcacagtggcaaaagggagaggaagtgcaagtaatagctgtcgagcctggcaaaaaccccaaaaatttccagacaatgcccggtattttccaaaccacaactggagaaattggagctattgccttagattttaagcctggaacatcaggtagcccaattattaatagagaaggcaaagtggtaggcttatacgggaacggggtagtgactaaaaatgggggatacgtcagcggaatagcccagacaaacgcggaaccagacggaccaacacctgaattggaagaggaaatgtttaagaaaagaaatctaaccataatggatttacatccaggaagcggaaaaacaagaaaatacctccccgcaatagttagagaggccattaaaagacggcttagaacacttattctagcgcccacacgcgtagtggccgctgaaatggaggaggcattaaaaggattacccattagataccaaacgactgcgacaaaaagtgagcacacaggcaaagaaattgtagatctaatgtgtcatgctacatttactatgcgactactttctcctgtccgagtgccgaactataacctaatcatcatggacgaagcacacttcacagatccggcatcaatcgccgcgagaggctacatatcaaccagagtgggaatgggagaggctgctgcaattttcatgacagctaccccaccgggaactgcagatgcttttccccaaagtaatgcaccaatccaagacgaagaaagagatattcctgaaagatcgtggaatagcggtaatgactggataacggactttgctggtaagacagtgtggttcgtaccgtctatcaaagctggtaacgacatagcaaattgtttgagaaagaatggtaagaaagtaatacaattatctcgaaaaacgttcgacaccgaataccagaaaacgaaattaaacgactgggacttcgtcgttacaacagacatttcagagatgggagctaacttcaaggcagaccgagttatagacccacgccgatgcctcaaaccagtaatattaactgacggaccggaacgagtaatacttgccggcccaatgcctgttactgtagcatctgctgcacaacgccggggtagagtagggcgtaatcctcaaaaagagaacgaccagtacatttttacaggccagcctctcaacaacgacgaagatcatgcacattggacagaagcaaaaatgctattagataatataaacacacctgaaggtatcatccctgcactattcgaacccgaaagagaaaaatcagcagcaatagatggtgaatataggctaaaaggagagtcgagaaagacatttgtggaactaatgagaagaggagatctgccagtctggcttgcacacaaggtcgcgtcagagggtataaagtatacggataggaaatggtgtttcgacggcgaaagaaacaaccaaattcttgaagaaaatatggacgtcgaaatatggacaaaagagggcgagaagaagaaattgagaccgagatggctagatgcaagaacttactcagatccgctagcattaaaagaatttaaagactttgcagctggtagaaaatcaatagcactagacttagtaacagaaataggacgcgtcccttcccatttagcgcaccgaaccagaaatgcgttagataatttggtcatgttacacacctcagaacatggaggcagagcttatagacacgccgtagaggaactaccagaaaccatggagactttattactactcggattgatgatactactaacagggggagtaatgttatttctaatttcgggtaaaggagttggaaagacgagtattggtttaatctgtgtggttgcgtcttcaggtatgctatggatggctgatattcccttacagtggatagccagcgcaattgtacttgagttcttcatgatggtattgttgattcctgaacccgaaaaacaaaggacaccacaggacaatcaacttgcatacgttgtcatcggaatattgacattagccgcaattgttgcagcgaacgaaatggggttgctcgaaactacaaaacgagaccttggaatgagtaaagagcccggagttgcatcaccgacgagctatttagacgttgacctacatcctgccagtgcatggacattgtacgcagtagctacaacagtaataactcccatgttacgtcacactatagaaaattcaacagccaacgtttcattagccgctatagccaaccaagcagtagttctcatgggtctagacaaagggtggccgatatcaaaaatggatctaggagttccactacttgctttgggctgttatagtcaagtcaatccgctcaccctcaccgctgctgttctgcttttagtaactcattatgccataatcggccctggcctacaagctaaagcaactagagaggcacagaagagaacagcagcgggaataatgaaaaacccaactgttgacggaataatgactatagatctcgacccagtaatatatgactcaaaatttgagaaacaattgggacaagttatgttactggttctatgtgcagttcaattattactgatgagaacaagttgggcgttttgcgaggcgctaacattagctacaggccctatcactacattatgggaaggttctccaggcaaattctggaatacgaccatagcggttagtatggctaatatttttcgaggaagttatttagcaggagccgggttagcatttagcattatgaaatctgtcgggacaggtaaaagaggtacaggcagtcaaggtgagaccttgggagaaaaatggaagaagaagctaaaccaattatcacgtaaagagttcgacctttacaagaaatcagggataacggaagtcgaccgaaccgaggcgaaagaaggtctgaagagaggtgagataacccaccacgccgtgagtagaggttctgcgaaactacaatggttcgtggaaagaaatatggtcataccggaaggtcgggtgattgatctaggatgcgggagaggtggttggtcatactattgcgcggggctcaaaaaggtgactgaggttagaggttatacgaaaggtgggccgggacacgaagaacctgtaccaatgtcgacctatggttggaatatagtcaagttaatgtcaggcaaagatgtattttacttaccaccggaaaaatgcgacacactgttgtgtgatataggggaaagttctccgagtccgacagtcgaggaatcccgtacaatccgggtcttaaagatggtcgaaccctggttgaagaataatcagttttgtataaaagtcttgaatccatacatgccagcagtgattgaacacttagaaagactacaaaggaaacatgggggtatgctagtaagaaatcctctttcacgtaacagcacacatgaaatgtattggatctcaaatggaacgggaaatattgtaagttctgtaaacatggtcagtcgattgctcctcaacagatttactatgacttaccgtcgacctaccattgaaaaagacgtcgacctaggggccggaactcgacacgtcaacgctgaaccagaaaccccaaacatggatgtcattggtgaaaggattcgccgaataaaagaagaacatagttccacatggcactatgatgacgaaaatccatataagacatgggcgtaccatggaagttatgaagtaaaagcgacaggcagcgcatcatcgatgattaacggagttgtaaaattgcttacaaaaccatgggacgtcgttcctacagtaacccagatggctatgacggatacgacgccgtttgggcaacaacgagtatttaaagaaaaagtagatactagaactccaaaacctatgcctggcactagaaaagtaatggaaataaccgcagaatggttatggaggaccttaggtcgcaataagcggcccaggctatgtacgagggaggaatttacaaagaaggtccgcacgaatgcggcaatgggagcggtttttacagaagaaaaccagtgggattctgcaaaggcagctgttgaagacgaagaattttggaaattagtagatcgagaaagagaattacacaaacttggaaagtgtggcagctgcgtatacaacatgatggggaaacgtgagaagaaattgggtgagtttggaaaagctaagggaagccgcgctatttggtacatgtggttaggagcacgctacctagaatttgaagcactaggattcctaaatgaagaccactggttttcacgagaaaacagctacagtggagttgaaggtgaagggctgcacaaactaggctatatactacgagatattagtaaaataccaggaggggctatgtatgcagatgataccgcaggatgggataccaggataacagaagacgatctacataatgaagagaaaataactcagcagatggatccggagcaccggcagctcgcaaatgctatttttaagttaacatatcaaaacaaagtagttaaagtacaacgacctacacccaagggaacagtaatggatatcatttcgagaaaagaccaacgagggagcggacaagtaggaacatatggcctcaatacgttcacaaatatggaggcacaactaattagacagatggaaggcgaaggcgtcttaagcaaaactgacttggaaaacccgcatttattagagaagaaaataacacaatggttggaaacgaaaggagtggagcgcctgaagagaatggcgataagtggtgatgactgtgttgtaaagccaattgatgacagattcgcaaacgctctattagcactaaatgacatggggaaagtacgcaaagacataccccagtggcaaccaagcaaagggtggcatgactggcaacaagtgccattctgtagtcatcactttcatgagcttataatgaaggatggcagaaaattagtagtaccgtgccgcccccaagacgagttgataggcagagcaagaatatctcaaggagcaggatggtccttaaaggaaacagcttgcttaggcaaggcttatgcccaaatgtgggcactgatgtacttccataggagagatctaagattagcttcaaatgcgatatgctcggccgtaccggtacattgggtaccaacgtcgagaacgacatggagcattcatgcccaccaccagtggatgacaactgaagatatgctcatagtttggaacagggtatggatcgaagacaacccatggatggaagataaaacgccggtcactacgtgggaggatgttccatacttaggaaagcgagaagatcaatggtgtggctcattaatagggctgacgagtcgagcgacctgggcccaaaacatactgacagctatacaacaagtaaggtcgttaataggtaacgaggagttcttggactacatgccatcaatgaagcggtttcggaaagaggaagaaagtgaaggtgccatatggtaa

SEQ ID NO: 23564 - RNA, 9873 nt, synthetic construct
  misc_feature 1..9873: note = derived and/or modified CDS sequence (opt6) from DENV-3__HQ332170__SS-prME
  source 1..9873: mol_type = other RNA
acatcattgtgcttgatgatgattctgcctgcagctctagcatttcatctaacttctagggacggtgaaccacgaatgattgtaggcaaaaatgaacgcgggaaatctttattatttaaaaccgcttcaggtattaatatgtgcacgctgatagcaatggatctgggagaaatgtgcgatgacacagtaacctataaatgcccacatataactgaagttgaacctgaagatattgattgctggtgcaatttaacatctacgtgggtaacctatggtacctgcaatcaagcaggagaacaccgacgagataaacgtagtgtagcacttgctccccacgtaggaatgggcttagacactagaacgcaaacatggatgtccgcggaaggagcatggcgccaagtagaaaaagtagaaacatgggcgttaaggcatccaggcttcacaattttagcattatttctcgcgcactacattgggacctccttaacgcaaaaagtagtgatatttattctgctcatgctagtaaccccatcaatgactatgagatgcgtgggagtaggaaatcgagactttgttgaaggcttatccggagcgacctgggtagacgtagtattagaacatggtggttgtgtaacaacaatggctaaaaataaaccaactttggacattgaactacagaaaacagaagcaacgcaattagcaaccctcaggaaattatgtatagaaggcaaaatcacaaacatcacaaccgattccaggtgtcccactcaaggagaagctgtactaccagaagaacaagatcaaaactacgtatgcaaacatacgtacgtagaccgtggctggggtaatggttgcggtctctttggaaaaggttcgctcgttacgtgtgctaaatttcaatgtttggaacctatagaaggaaaagttgttcaatatgaaaacttaaaatatacagtgattattacagtacataccggagaccaacaccaagtaggcaacgaaacacaaggggttacagctgagatcaccccacaagcatccacaacagaagctatattgcctgaatacggtacgctaggtctcgaatgctcaccacgaacagggttagactttaatgaaatgatacttttaaccatgaaaaataaagcatggatggtgcacagacaatggttcttcgatctcccattaccctggacaagcggggctacgacagaaactcctacatggaaccgcaaagaacttctagtgacatttaaaaatgcgcatgccaagaaacaagaagtagtcgtactaggaagccaagagggtgcaatgcacaccgcattaactggggcaacagaaatccaaaactctggtgggacatctatctttgccgggcatttaaaatgcagactaaaaatggataaactcgaacttaaaggcatgtcatatgctatgtgcacgaacacctttgttttaaagaaagaggtctcagaaacacaacatggtaccatactcatcaaagtagactacaaaggagaagacgttccttgtaaaattccattttctacggaagacggacaaggcaaagctcacaatggtcgactcattacagctaatcctgtagtgaccaaaaaggaagaaccagtaaacatagaagcagaaccaccgtttggcgaatcaaacatagtcattggtattggcgataatgcgcttaaaataaattggtataagaaaggcagcagtataggtaaaatgtttgaagcgaccgcacgtggtgcacgaaggatggctatactaggcgatacagcatgggatttcggatctgtaggtggtgtattaaattcgttgggcaaaatggtccatcaaatcttcggatcagcatacaccgcacttttctctggcgtctcatgggtaatgaagattggaataggagtcctactaacgtggattggtctaaattccaaaaatacgtctatgtcgttctcctgtattgctattggtattataacgctttatctaggagcggttgtacaagcagataccggatgtgtgattaactggaaaggcaaagaattaaagtgtgggagcggtatcttcgtaactaacgaagtgcatacatggactgaacaatataaatttcaagcggacagccccaaaaggctagcaacggccatcgccggagcatgggaaaatggcgtgtgtgggatccggtctaccacaagaatggaaaatctattgtggaaacaaatcgcgaacgaattaaactatattttgtgggaaaacaacataaaattaacagtagtagttggagatataatcggagtactggaacaaggaaagcgaacattaactccacaaccaatggaactaaaatattcatggaaaacatggggaaaagccaagattgttacagcagagactcagaactcatccttcataattgacgggcccaatactcctgaatgtccgagcgcctcaagggcctggaacgtatgggaggtcgaagactatggctttggagtatttacaacaaatatatggctcaaactaagagaggtctatactcaacaatgcgaccatagacttatgagtgcagctgtcaaagatgaacgagcagtgcatgcagatatgggctattggatagaaagccaaaagaatggttcatggaaactcgaaaaggcttctctaatagaagtaaagacgtgtacttggccgaaatcccatactctttggagtaatggggttctagagagtgacatgataattccaaagtcacttgcaggtccaatctcacaacacaattatcgtcccggatatcatacacagacagcaggaccatggcaccttggaaaattggagcttgattttaattactgtgaaggaaccactgtagtaattacagaaaattgcggaacgagggggccttcattgcgcaccacaactgtctctggcaaactaatacatgaatggtgctgccgttcttgcacattaccaccattgagatacatgggcgaggacggttgttggtacggtatggaaatacgaccaattagtgaaaaagaagaaaatatggtaaaatcgctcgtcagtgctggaagtggcgaggtagacaattttacaatgggggtattatgtcttgctatactattcgaggaagtaatgagagggaagtttggtaagaaacatatgattgccggtgtgtttttcacgttcgttttacttttaagtgggcagattacatggagagacatggcacacaccttaattatgataggatcaaatgccagtgatcgcatgggaatgggagtaacatacctagcattaatcgcaacttttaaaatacaaccctttttggcccttggattctttctaagaaaattgacgtctagagagaatctcctcttgggagtcggtctagctatggctacgactttgcaattaccagaggacattgaacaaatggcaaatggaattgccctagggctaatggccctaaaattgataacgcaattcgagacgtaccagctatggacagcactaataagtttaacatgctctaacaccatattcacactaacagtagcatggagaacagcaacgttaatacttgcaggggtatccctattacctgtatgtcaatcatcctcgatgcgaaaaaccgactggcttcccatgacagtagcagcaatgggcgttccgccattacccttatttatcttttctttgaaggataccctaaaacgaaggtcgtggccactaaatgaaggtgtaatggcagtcggattagtatccattttagctagctcgttactgaggaacgacgtacctatggcaggaccattggtagcaggcggattacttattgcttgttatgtaataaccggaacatcagcagatctaactgttgagaaggccgcagatgtaacatgggaagaagaggcagagcaaactggggtgtcgcataatttaatgatcacagtggatgacgatggtacaatgagaatcaaggacgacgagactgagaatattctaacagtactcctgaagacagctttgctaattgtatctggcatattcccatattcaattccagctacactattagtatggcacacatggcaaaaacaaactcaaagatcgggggtactatgggacgttcctagcccacctgaaacacagaaagctgaactagaagaaggagtgtatcgcataaaacaacagggaatatttggtaaaacacaggtgggagttggcgttcaaaaggaaggggtattccatacaatgtggcacgtgacaagaggagccgtacttacttacaatggaaaaagattagaaccaaattgggcatcggtcaagaaagatttaattagctacggagggggctggaggctctccgcacaatggcaaaaaggtgaggaagtacaagttatagctgtcgaaccaggcaaaaatccgaaaaatttccaaacaatgcctggaacgtttcaaactacaactggagagattggggctatagcgttagatttcaaaccagggacttcaggtagtccaataatcaatcgagaaggcaaagtggtcggactgtacggaaatggagtagtaaccaaaaatggtggatatgtaagcggaattgcccagacgaacgcagaaccagacgggccaacacccgaacttgaggaagaaatgttcaagaaaagaaatctaacaattatggacctccatccaggatccggaaaaacccgcaaatatcttcccgcaatagtgagggaagccataaagagacggctgagaacgttaatactagcaccaaccagagtcgttgccgcagaaatggaagaggctttgaaaggactcccaattcgctaccaaacaacagcgacgaaatccgaacacacaggtcgcgagatagtggatcttatgtgtcatgcgacctttacgatgaggctcctctcccctgttagggtacccaattacaatttaatcataatggacgaggcacacttcacagatccagcgtccatagcggctcggggatacataagtactagagtaggtatgggagaagccgcggcaattttcatgacggccacgcctcctggcactgcagatgcatttccacagtccaatgctcctatacaggacgaggaacgagatatacccgaaagatcgtggaactcaggaaacgagtggataactgattttgcagggaaaactgtctggtttgtaccatcgataaaggctggtaacgatatcgcgaattgtttacgcaagaacggcaagaaagtaatccaacttagtcgcaagacttttgatacggaataccagaaaactaaactcaatgattgggattttgtagtcaccacagatatatctgagatgggagccaattttaaggctgatagagtaattgacccgcgacgctgcctaaagccggtgatacttactgacggtcctgagagagtaattttagccggtccaatgccagtcaccgcagcaagtgccgcgcaacgaagggggagagtgggtagaaatcctcaaaaagagaatgatcaatacatctttactggtcaaccacttaataatgatgaggatcacgctcactggacggaggcaaaaatgttactagataatattaacacaccggaaggaatcattccagccttatttgaaccagagagggagaaaagcgctgccatagatggagaatataggctcaaaggcgaaagccgcaagacctttgtggaattaatgagacgtggagatcttcctgtctggctagcgcataaagttgcaagtgaaggtataaagtacacggaccgaaagtggtgctttgatggccagaggaacaaccagatactagaagaaaatatggatgtggaaatttggacaaaagaaggagagaagaagaaattgcggccgcgatggttggatgccagaacgtacagtgatccactagctttaaaagaatttaaagactttgcagccggccgaaaatccatcgccttggacttagtaacagaaatcggccgagttcccagccatttagctcacagaacacgaaatgcattggacaatttagtaatgttacatacgtcggagcatgggggaaaagcctatcgacatgccgtagaagaactaccagaaactatggagacgctattacttcttgggttaatgattctactcactggcggagcgatgctgttcttgataagtgggaaagggatagggaaaaccagtattggattgatttgtgtgatagcgagttcaggaatgttgtggatggctgaaataccacttcaatggattgcatcagcgatagtattagagttctttatgatggtattactaatacctgaaccagaaaaacaaaggacccctcaggataatcaattagcatatgtcgtcataggtatcctcacattagcagccataatagctgctaatgagatgggtttactagagacaacaaaacgtgacttgggaatgagcaaagaacctggagttgtgtcaccgacttcatatctcgatgtcgacttgcatcccgcaagcgcttggacgctatatgcagtagcaacaaccgtaatcacgccaatgttacggcacactatagaaaatagtactgcaaacgtcagcttagcggcaatcgctaaccaagcagtagtactgatgggcctcgacaaaggatggcccatatctaaaatggatttaggggtgccactacttgcgctgggttgttacagtcaagtcaatccacttactttaacggcagcggtcttactcttaataactcattacgcaatcattggcccgggactacaagcaaaagctactcgagaagctcagaaaaggactgcagctggcataatgaaaaaccctacggtagatggaattatgactattgacctggaccctgtcatatatgacagcaaattcgaaaaacaactgggtcaggtaatgctgttagtattgtgcgctgtccaattactattaatgcgaacatcttgggcattatgtgaagcgctaacattagcgaccggtcctataacaacactgtgggagggatcacccggaaaattctggaacacgacaattgctgtatctatggcgaacatttttagaggaagctatttggcgggagcagggcttgcgttttctatcatgaaatcagtaggaacaggaaagagaggcacgggatcccaaggagagacactaggtgagaaatggaagaagaaattaaaccaactgagtcgaaaagaatttgacctttacaagaaatctggaataacagaggtcgatcggaccgaagcaaaagaaggactaaaaagaggcgaaataacccaccatgcggtaagcaggggtagcgctaaactccagtggtttgtagaacgaagtatggtaatacctgagggtagggttattgatctcggctgcgggagaggaggatggagttattactgtgcaggcctaaagaaagtgactgaggttcgaggctatacaaagggaggtccaggacatgaagaacccgtgcctatgagtacatatgggtggaacattgtaaaattaatgagtggaaaagatgtcttttatttacctccagaaaaatgcgacacccttctgtgtgacatcggagaatcatctccttcgcccactgtagaagaatcgaggacgataagagtattaaaaatggtagaaccctggctcaagaataaccaattctgcattaaggtacttaatccatacatgcctacagtaatagaacacttagagagactccaaagaaagcatggcggtatgctagtcagaaatcctttgagtaggaatagtactcatgagatgtattggatcagtaatggtacgggtaatatagttgcttccgttaatatggtaagcaggttattgctgaataggtttacaatgacccatagaagaccaactattgaaaaagatgtggatttgggcgcaggaacaagacatgttaatgccgaaccagaaacaccaaacatggacgtaataggtgaaagaataaagagaataaaggaagaacacaatagcacatggcattatgatgatgaaaacccctataagacatgggcgtatcatggctcttatgaagtaaaagcaacaggctcagcctcatcgatgattaacggtgttgttaagctattaacgaaaccatgggatgttgtcccaatggttactcaaatggctatgactgacacgacaccttttggacaacaaagggtatttaaagagaaagtagacactcggacgccaaggagcatgccagggacacgtcgggtgatgggaattacagctgaatggctatggagaacgttaggaaggaataagaaaccacgactgtgtacaagagaagagttcaccaagaaagtacgaactaatgcagccatgggagctgtatttacagaagagaaccagtgggattcagcgaaggccgcagtcgaagacgaggatttctggaagctggtagaccgcgaaagggagttacataaattaggaaaatgtggatcatgcgtatataacatgatgggtaaaagagaaaagaagttaggtgagttcgggaaagctaaaggatcaagagcaatttggtatatgtggttaggagcgagatacttagagttcgaagccctagggtttcttaatgaagaccattggtttagccgggagaactcatactcaggtgtagaaggagaaggattacacaaattgggctatatccttcgtgacatatctaagatacccggcggagcaatgtacgccgatgatacagctggctgggacaccagaattactgaggatgatcttcacaatgaggaaaagataacccaacaaatggacccagaacacaaacaactagccaatgcaattttcaaactcacatatcaaaacaaagtagttaaagtacaaagacctactccaacaggaacagttatggatataataagccgaaaagaccagcggggttcgggtcaagtaggtacatacgggctaaatacgttcactaacatggaagcacaactcattcgacaaatggaaggagaaggcgtactttcaaaagcagatcttgagaatcctcatctgccggagaagaaaataacacagtggctggaaacaaaaggagttgaacgacttaaaaggatggcaatatcaggggatgattgtgtagtaaaaccaattgatgatcgctttgcaaatgcactcctagcactcaacgacatgggaaaagtccgtaaagatataccacaatggcaaccttcaaaagggtggcacgactggcaacaagtgcccttttgttcacatcactttcacgaactaataatgaaagacgggcgaaaattggtcgtaccgtgtcgaccgcaagatgaacttatcgggagagctcgaatatcacaaggagctggatggtcactccgcgaaacggcttgtctgggcaaagcatacgcacaaatgtggtcgctaatgtacttccatagaagagatttgcgactagcatcgaatgcgatttgtagtgcggtacctgtacactgggtgcctacatctcggacgacctggagtatacacgcacaccatcaatggatgacgacagaagatatgttaacagtttggaatagagtatggatcgaagacaatccctggatggaagataaaacaccagttactacatgggaaaatgtcccttacttaggcaaacgagaagaccagtggtgcgggtcattaataggactaacttcgcgagctacgtgggcccaaaatatacccacggcgattcagcaagtaaggtcactcataggtaatgaagaatttctcgattatatgccttcaatgaaaagattcagaaaagaggaagaatcagaaggagcgatctggtaa

SEQ ID NO: 23565 - RNA, 9873 nt, synthetic construct
  misc_feature 1..9873: note = derived and/or modified CDS sequence (opt6) from DENV-3__AY858038__SS-prME
  source 1..9873: mol_type = other RNA
acttccttatgcttgatgatgatgttacccgcaacgttagcgtttcacctgacttcaagagacggtgaacctagaatgatcgttggcaaaaacgaacgaggtaagtccctattatttaaaactgcaagcggtataaacatgtgtacattgatagctatggacctaggcgaaatgtgcgatgatacggtaacatacaaatgcccattaataacagaagttgaaccagaagatatagattgctggtgcaacttaacatccacttgggtaacgtacggaacatgcaaccaagcaggggaacatagaagagataaaagatcggtagctctagctcctcatgtgggcatggggctagataccagaacccaaacttggatgagtgctgaaggtgcgtggagacaggtagaaaaggtagaaacctgggcattccgacatccgggttttactatactagcactattccttgcacattacatcggaacatcactgacgcaaaaagtcgtgattttcattctcttaatgctagttacccctagcatgactatgcgttgtgtgggagttggcaatagggatttcgttgaaggcttgtcaggagctacttgggtggatgtagttctcgaacacggaggatgcgtcacaacaatggccaaaaataaaccaacattggacatcgaattacagaaaacagaagcaacgcaattagcaacacttcgtaagctctgcatagaaggaaagataacaaacgtaaccaccgattccaggtgccccacacaaggagaagcaatactaccagaagaacaagatcagaattatgtgtgcaaacatacatacgtcgatagaggatggggcaacggttgtggactattcggaaaaggatctcttgtcacatgtgcgaaattccagtgcctagaatcaatagaaggcaaggtagtacaacatgaaaacctaaaatatactgtgatcatcacagtccatactggcgaccagcaccaagttggaaatgagacgcaaggggtcactgcagaaataacaccccaagctagtacagtagaagcaatcttgccagaatacggtacactaggattagaatgtagtcctcgtactggtctcgatttcaatgagatgattctactaacgatgaagaataaggcttggatggtacaccggcaatggttcttcgacttgccattaccctggacgtcaggtgccacaacagagacacctacctggaataaaaaggaattactggtcactttcaaaaatgcgcacgctaaaaagcaagaggtggtagtgttagggagtcaagagggagcaatgcatacggcattaacgggtgctactgagattcaaacgtcaggcggtaccagtattttcgctggacatttaaagtgccgacttaagatggataaactcgaattgaaagggatgtcctacgcaatgtgcctgaacgcatttgtactaaagaaagaggtatcggaaactcagcacggcacaatactcataaaagtggagtataaaggagaagacgcaccgtgcaaaataccattctcaactgaggacggacaaggtaaggcgcacaatggacgattgatcacagcgaatcctgtggttactaaaaaggaagaacccgtcaatattgaagcagagccaccatttggagaatcgaacatcgtaataggcataggggataaagcgctgaaaattaactggtataaaaagggatcttcaataggaaaaatgttcgaagcgacagccagaggcgctcgaagaatggctatactaggcgataccgcctgggattttggaagtgtaggaggtgttctaaattctttgggaaaaatggtgcaccaaatatttggatcagcatacacagcactattttcaggcgtaagctggataatgaaaattggtataggagtgctccttacatggatcggattaaattccaaaaacaccagtatgtcatttagttgtattgcaatagggataataacgttatatctgggagccgttgtccaagcagatatggggtgtgttatcaactggaaaggaaaagaactcaagtgcggttctggcatatttgtcacaaacgaagttcacacatggaccgaacaatacaaattccaggctgactccccaaaaagactggccacggcaatagcaggggcatgggaaaatggcgtatgcggtattcgtagcactaccaggatggagaatctcttatggaagcaaattgctaacgagctaaattatatattatgggagaataatattcgattaactgtcgttgtaggtgacactataggtgtacttcaacaaggtaaaagaaccctaccaccccaaccaatggaattaaaatactcatggaaaacatggggcaaagccaaaatagttacagcaaaaacacaaaactcttcatttataatagatgggcctaatactccagagtggccatctgctagtagagcatggaacgtatgggaggtagaagactatggattcggtgtattcactacaaatatatggctaaaattacgggaaatgtacacacagctgtgtgatcatcggcttatgtcagctgcagtcaaagacgaacgagcagttcacgctgacatgggatattggatagaatcacagaaaaacgggtcatggaaactagagaaggccagtttgatagaagtaaaaacatgcacgtggccaaagagccatacactgtggtctaatggcgtgctagaaagcgacatgattatacctaagtctttggctggtccgatatcgcaacataattacagacctggttatcacacccaaacggcaggaccttggcacttagggaaactagaactcgactttaactattgcgaagggacaaccgtagtgattacagaaaactgcggcacaagaggtccaagtctccgaacaaccacagtgagtggaaagttaatacacgaatggtgctgccgctcatgtacactaccaccattaagatacatgggcgaagatggttgctggtacgggatggaaatacgcccgataaatgaaaaagaggagaacatggttaaaagcctcgttagtgccggtagtggcaaagtagacaactttactatgggcgtgctttgtttggccatattgttcgaagaagtaatgagaggaaagtttggcaaaaagcatatgatcgcgggagttttatttacatttgtgttattattaagtggccaaattacttggcgcgatatggcaagaacactgataatgataggaagcaacgcaagtgatagaatgggaatgggggtaacttatctcgccttaatcgctacgttcaaaattcagccattccttgcattgggtttctttttgaggaaactaacttcccgtgaaaacctattactaggggttggtctagctatggcaacaactttacaattgcctgaagacatcgaacaaatggcgaatggcattgccttgggtctaatggccttgaaattagtaacccaatttgaaacatatcaattatggacagctctagtttcattaatgtgtagtaatacgatatttactctcaccgttgcctggagaacagcaaccctgatcttggcaggcattagtttgttaccggtatgccagtccagctccatgagaaaaacagattggttacccatgactgttgcagccatgggcgtaccaccactacccttattcattttctcccttaaagatacactaaaacgaaggtcatggcccttaaatgaaggtgtaatggcagtcgggttagtctcaatactagccagttcccttttgcgaaatgatgtccctatggccggacccctcgtagccggtggcctgttaatagcatgttacgtaattacaggtacatctgcagacttaactgtagaaaaagccgctgacgtcatttgggaagaagaagcagaacaaacaggggtttctcacaatttaatgataacagtagacgacgacgggaccatgcgcataaaggatgatgagacggagaacattttaacagtattactcaaaaccgcactacttatagtctcaggaatctttccttacagcataccagcaacactattagtttggcacacgtggcaaaagcaaacacaacgatctggagtactctgggatgtaccttctccaccggaaactcaaaaggcagaattagaggaaggcgtgtacaggatcaaacaacaaggaatatttggtaaaacgcaagttggagtaggagtccaaaaagaaggagtttttcatacgatgtggcacgttactcgcggtgcagttctcacgcataatggtaaaaggttagaacctaactgggcatcagtcaagaaagacctgatctcatacggaggtggctggagactcagtgcacaatggcaaaaaggggaggaagtgcaagttatcgcggtcgaaccaggcaagaatcccaaaaactttcaaacaatgcccggaatatttcagactacaaccggagaaataggggcaattgctctggattttaaaccaggaacttcaggttcgcctattattaatcgtgaaggtaaagttgtcggtttatatggcaatggagtagtgaccaaaaacggcggttatgtttcaggaattgcacagactaacgctgaaccggacggaccaactccagaattagaagaagaaatgtttaaaaagcgtaacttgacaataatggatctgcatccgggtagtggtaaaacacgaaaataccttccagcaataatacgagaagcgataaaaagaaggctaaggacccttatactagctccaacgagagttgtcgcggcggaaatggaagaagcattgaaaggactaccgataagataccaaacaacggccacaaaatctgaacacactggcaaagaaatagttgacctaatgtgccatgcaacttttacaatgcggctactaagccccgtcagagtacccaattataacttgataataatggatgaagcccatttcactgaccctgcgagcattgccgcacgcggatatatttcgactcgagtgggcatgggagaagctgcagcaatatttatgactgcgactccacctgggaccgcagatgcttttccccaatctaacgcacctattcaagatgaggaaagagatatacctgaacgatcatggaatagtggcaatgactggataaccgactttgccggcaagactgtatggttcgtcccaagcataaaagcaggaaatgatattgccaactgtctaaggaaaaacggaaagaaagtcatacagctgagtcgtaaaacatttgacactgagtatcagcgaactaaattaaacgactgggatttcgtggtaacaactgacattagtgaaatgggtgcgaatttcaaggccgacagggtaattgatccccgacgttgcttaaaacctgtcatactaacagatggacccgaaagagtcatattagccgggccaatgcctgtgactgttgcaagcgcagcgcaacgacgaggacgagtaggacgaaatccacaaaaagagaacgatcaatatatctttaccggacaaccactaaacaacgatgaagaccatgcacattggactgaagcaaaaatgctacttgacaacattaacaccccagaaggaataatcccagcactgtttgaaccggaacgcgaaaagagcgcggcaatagatggggaatatagactaaaaggcgaaagtagaaaaacatttgttgagctgatgaggcgaggcgacttaccagtatggttggcacataaagtagcatctgagggcataaagtatacagatcgaaaatggtgctttgatggtgaaagaaataatcaaatactagaagaaaatatggacgtagaaatctggaccaaggagggcgagaaaaagaaattacggcctcgttggctagatgcacgaacatatagtgatccactagctctaaaagagttcaaagatttcgcggctggaaggaaatcgatagctctagacctggtgactgaaatcggccgggttccatcacatttggcccatagaactagaaatgctctagataacctagttatgttacacacgtctgagcacggagggagagcataccgtcatgcggtagaagaactccccgaaacgatggagacattattactgctcggtctaatgattttattaaccgggggcgcgatgcttttcttaatatcagggaaaggtattgggaagacttcaataggcttgatatgcgtggtagcgtcatcgggcatgttatggatggcagatgtgcctcttcagtggatcgcttctgccatagtgttggaatttttcatgatggttttattgattccagaacctgaaaaacaaagaacaccccaagacaaccaattagcctatgtggtcatcggaatcctaacactagccgcaattgtagcggccaatgaaatgggacttttagaaaccaccaaaagagacctgggaatgagtaaagaaccaggagtggtttcaccaacatcctacctagatgtagatcttcatccagctagtgcatggactttatatgcagttgcaacaactgtgataactccgatgctacgtcataccatagaaaactcaacagctaacgtttcccttgcggcaatagccaatcaagcagtggtacttatgggtcttgataaagggtggccgatctctaaaatggatctaggagtgcctctattagctttagggtgctactcacaggtcaacccattaacgcttaccgccgcggttttactgctagtaactcattatgctataataggaccgggtttacaggcgaaggcaaccagggaagcacagaaacggacggcagcgggtataatgaagaacccgacagtagatggtataatgacaatagacttagaccctgtaatctacgactctaaatttgagaaacaattagggcaagtcatgttactcgtactatgtgcagtacaattgcttctgatgagaacaagttgggcgttctgtgaagcccttactttggcgacaggcccgatcactacattgtgggaaggtagccctggaaaattttggaacaccacaatcgcggtaagcatggccaacatttttcgaggaagttacctcgcgggagcaggattagcattttcgataatgaaatcggtaggcacaggaaaaagaggtaccggcagtcaaggagaaacattaggggagaaatggaaaaagaaactaaatcagttatccagaaaagagttcgatctatataagaaatctggaattacagaagtagatcgtacagaagcgaaagaaggattgaagagaggagaaataacacaccatgcagtgtcacgtggttcagccaaattgcaatggtttgtagaaagaaatatggtgataccggaaggacgcgtaatagatctcggctgcggaaggggagggtggtcatactactgtgcaggactcaagaaagtaacagaagtgagaggctatacaaaaggtggtccgggacatgaagaaccggtgcctatgtcaacctatggatggaatattgtaaagttaatgagtggtaaagatgtattttaccttcctccagagaaatgcgataccttattgtgcgacattggagaatcaagtccaagccctactgtagaagaaagtcgtacgattcgtgtacttaagatggtagaaccatggttgaaaaacaatcaattttgtatcaaagtcttaaatccttacatgccgactgtaatcgaacatttagaaaggttacaacgcaagcatggcgggatgttagttaggaatcccttaagtagaaattcaacacatgaaatgtactggataagtaatggaacaggaaatatcgtttccagtgtaaatatggtatctaggctgctgttaaataggttcacaatgacgcacagacgacccacaatagaaaaggatgtcgacttgggtgccggaacacgtcatgtaaatgcggaaccagagacaccaaatatggatgtaattggagaaaggatcagaaggatcaaagaagaacactcctctacttggcattacgatgatgaaaatccttataagacctgggcgtatcatgggagttatgaagtgaaagctaccggttcagcaagcagtatgataaatggagtagtaaagttgcttacaaagccttgggacgtggtccctactgtaacacaaatggcaatgactgacacaacacctttcggtcaacagagagtatttaaagaaaaagtggacacaagaacacctagaccaatgcccggtacccgtaaagtaatggagataacagctgaatggctttggaggactttaggccgaaataaaagacctcggttgtgtaccagagaggaatttaccaagaaagtaaggacaaacgcagcgatgggagcagtgtttacagaagagaatcaatgggatagcgcccgagccgcggttgaggatgaggagttctggaaactggttgatcgagaaagggaactccataaattaggaaaatgtggatcctgtgtttacaatatgatgggtaaacgcgagaaaaagttaggagaatttggaaaagcaaaagggagtcgcgcaatatggtacatgtggctaggagcgcgctatttagaatttgaagccctgggcttcttgaacgaagaccactggtttagtcgagaaaactcctactccggcgtagaaggagagggtctacataaattgggatatattcttagagatatctcaaaaataccaggtggcgccatgtacgctgatgataccgcaggttgggatactcgaataactgaagatgatctgcacaatgaagagaaaattacgcaacaaatggatcctgagcatagacaattggccaatgctatattcaaattaacgtatcaaaacaaggtagttaaagtgcaacgtccaacccctaagggtacagttatggatataataagccgaaaagaccagagaggaagtggccaagtaggtacttacggactaaatacattcacaaacatggaagcacaattaattagacaaatggaaggggaaggagtcctgagcaaagccgatctagaaaatccacacctacttgaaaagaagataacgcaatggcttgaaaccaaaggagtagagagactcaaaaggatggcaatttcaggtgacgattgcgtggttaaaccgatcgatgacagatttgcgaatgctttattagccttgaatgatatgggcaaagtacggaaagatataccccagtggcaaccgagcaaaggctggcacgattggcaacaagtccccttttgtagccatcatttccacgagctgatcatgaaagatggacggaagctcgtagttccgtgtcgaccacaagatgaactaatcggacgggctaggatatcacaaggtgcaggatggtcattaaaagaaactgcttgtttgggaaaagcatacgcgcaaatgtgggcacttatgtacttccaccgaagagatcttcgcctagcatcaaatgcaatatgctcggctgtaccagtacattgggtgccaacgagcagaacaacatggtcgatacacgctcaccaccagtggatgactactgaagatatgttaacagtttggaacagggtgtggatagaagataatccatggatggaagataagacaccggtaactacttgggaggatgtcccttatctaggaaaaagagaagaccaatggtgtggtagcctaataggtttaaccagccgtgcgacgtgggcacagaatatcctaacggcaatacaacaagtaagatccctgataggaaatgaagagttcttagattacatgccatcaatgaaacgatttaggaaggaggaagaaagcgaaggagccatctggtga

SEQ ID NO: 23566 - RNA, 9873 nt, synthetic construct
  misc_feature 1..9873: note = derived and/or modified CDS sequence (opt6) from DENV-3__AY858039__SS-prME
  source 1..9873: mol_type = other RNA
accagtctttgcctcatgatgatgctcccggcgacgttagcatttcatctcacgtcgcgagatggggaacctagaatgattgttggtaaaaatgaacgtgggaaaagcctcttatttaaaacagctagtggaattaacatgtgcacattaatagcaatggatctcggggaaatgtgtgatgacacagtaacgtataaatgtcctcttatcacagaggttgaaccggaagatatagattgttggtgtaacttaacctcaacatgggtcacttatggaacatgtaatcaagcaggagagcaccgacgcgacaaaagatcagtcgcattagctccccacgtgggaatgggactggacacacgtgcacaaacatggatgagcgcagagggtgcatggagacaagttgaaaaagttgaaacatgggcattccgtcacccaggatttacgattcttgcactgtttttagcacactatatcggaacttcgctcacacaaaaagtagttatcttcatacttttaatgttggtaacaccttcaatgaccatgcgttgtgttggagtcgggaatcgagactttgtagaaggcctatcaggtgccacatgggttgatgttgtactcgagcatggagggtgtgttactactatggctaaaaataaacccacactggatattgaactgcagaaaacagaggctacacaattagcaacgctaagaaaattatgcatcgaaggcaaaattacaaatgtcactacagattcccgatgccctacacaaggagaggcaattctaccggaggaacaagatcaaaattacgtctgcaaacatacatatgttgatagaggttggggcaatggctgcggattatttggtaaagggagcttagtgacatgtgcgaaatttcaatgtttagaactcatagaaggcaaagttgtacaacatgaaaatttaaaatataccgtaattataaccgttcacactggtgatcaacatcaagtaggcaatgaaacccaaggagtaaccgcagaaataacaccacaggcatccactgtagaagcaattctacctgaatatggcacgctagggttagagtgttcaccccgaaccggactcgatttcaatgaaatgatattactcaccatgaaaaacaaggcttggatggtacatcgtcaatggttctttgacttacctcttccttggacatctggtgctacaacagagactcctacatggaataagaaagaattgctagtaacgtttaaaaatgcgcacgccaagaaacaagaagttgtcgtattgggatctcaggaaggtgcaatgcataccgctttaacaggggctacagaaatacagacttctggaggcacctcaatcttcgctgggcatctcaaatgcagacttaaaatggacaaactggaattaaaaggaatgagttatgctatgtgttcaaatgcttttgttcttaagaaagaggtaagcgaaactcaacatggtacgatattgataaaagtagaatataaaggtgaagatgcgccatgtaaaattccattttccacagaagacggtcagggaaaagcacataatggcagacttatcacagcgaaccctgtcgtaactaagaaagaagaaccagtgaatattgaagctgagcctccattcggggaatctaacataattattgggattggagacaaagctctaaaaataaactggtacaaaaagggcagttctataggtaaaatgtttgaagctactgccaggggcgcacgacggatggctatactcggagacactgcttgggacttcgggtccgtgggcggagttctaaattcactaggaaagatggtacaccaaatttttggcagtgcatacaccgcgctattttctggagtaagctggatcatgaagataggcataggagtgcttctaacatggataggactaaattctaaaaacacatctatgagcttcagctgtatagtaataggcataatcacattatacttgggtgctgtagtacaagccgacatgggttgtgttatcaattggaaaggtaaggagttaaagtgtggctccggaatttttgtaacgaatgaggtacacacgtggacagagcaatacaaatttcaggcagattcaccaaagagactggcaacagctattgctggggcatgggaaaacggggtatgtggcattagaagtacaacaaggatggaaaatcttctctggaaacaaattgccaatgaattaaactatatactgtgggaaaataatataaaattaaccgttgttgtaggcgatatcatcggggtactcgaacaaggtaagcgaacgttaaccccacaacctatggagttaaaatattcatggaagacatggggaaaagcaaaaatagtgaccgcggagattcaaaacagcagctttataatcgacggtcctaacacaccggaatgccccaatgcaagtagagcatggaatgtttgggaagtggaagattacggatttggagtgtttacgacaaatatatggttaaaacttagagaaatgtatactcaattatgcgaccatcgattgatgtcagctgcggttaaggatgagcgtgcagtacatgcagatatgggatattggatagagagtcagaaaaatggatcatggaaacttgaaaaggcttcgttaatcgaagttaagacttgtacatggccaaaatcccatacactgtggagcaatggtgttctagaatcagacatgataatcccaaagtcacttgcgggaccaataagtcagcacaactaccgaccaggttatcatactcagacggcaggtccttggcaccttggaaagctggaattagatttcaattattgcgaaggaacaacggtcgtaataacggagaactgtggcacacggggaccttctttgcgaacaacaaccgtaagcggaaaactaatacatgagtggtgttgtagatcctgtaccctaccccctttacgctacatgggcgaagacggatgttggtacggcatggagattagaccgataaatgaaaaagaagagaatatggtcaaaagtctagtaagtgccggatcggggaaggtggataattttaccatgggtgtcctctgtctagcaatactattcgaagaagtgatgagaggaaaattcggcaagaaacatatgattgccggtgtactctttatattcgtactattgctatcaggtcaaataacatggcgggacatggcaaggaccctaataatgataggctcgaacgcgtcggacaggatgggtatgggagtaacgtatttagcactaatcgcgacattcaaaatccaaccatttttagccctcggcttctttttacgaaagctaacctctagggaaaacttgttactaggggtgggtttggcaatggcaactacattacaactaccagaggatatcgagcaaatggcaaacggaatcgccttaggactaatggcgctaaaacttatcacacaatttgaaacataccaactatggacagccctagtctcattaacatgctcaaatacgatatttacacttaccgtcgcatggagaacggctacactcattctcgcaggaatatccctattacctgtctgccaatcatcatcgatgaggaaaactgactggctaccaatgacagtggcggctatgggggtaccaccaagtcccctctttatttttagtctcaaagacacattgaaaagaaggagctggcctttgaatgaaggcgttatggctgtagggctagtatctatactggcatccagtttgttgagaaacgatgtcccgatggcgggacccctagttgcgggcggactactaatagcctgctacgtaataacaggaacaagtgcggacttaacagtagaaaaggccgccgacgtcacatgggaagaggaagccgaacaaacaggggtaagtcacaatcttatgataacggtcgatgatgatggaactatgcgaataaaagatgatgaaacggagaatattttgacagttcttttgaagacggcattattaatagtgtcagggatctttccttatagcatacccgcgaccctactcgtatggcatacgtggcaaaaacaaacacaacggagtggagtactatgggatgtcccgagtcctccagaaacacagaaggcagaattagaagaaggagtataccgaatcaaacaacgaggcatttttggaaaaactcaagttggagttggggtacagaaagaaggagtatttcatactatgtggcatgtaaccagaggagcagttctaacttacaacgggaaacggctcgagcctaattgggcgtccgtgaagaaagatctaatatcttacggtggtggatggagattaagtgcacaatggcaaaaaggtgaagaagtccaggtaatcgcggtagagccaggcaaaaatccgaaaaacttccaaaccatgcccggaatttttcaaacaactaccggcgaaatcggcgcaattgcactggattttaaaccagggaccagtggatcaccgataataaatcgggaaggtaaagttgtcggactctacggtaatggagtagttaccaagaatggtggctatgtatcaggcatagctcaaactaacgcagaacctgatggaccgacgcctgaacttgaagaagaaatgttcaaaaagagaaatttaaccataatggatttacatcctggaagcggtaagacccgaaaataccttccagcaattgtacgcgaagcgatcaaaagacgactacgaacattaatattggcacctacacgggtagttgccgctgaaatggaggaggctttaaaaggcctgccaataaggtatcaaacaacggctaccaaaagcgaacacacaggcaaagagatcgttgacttaatgtgtcacgctacttttactatgagactattaagccctgtcagggtacctaattataacttaattattatggacgaagcccatttcactgatcccgcaagtatagcagcccgcggttacattagcacaagagtgggtatgggtgaagcggcagcaatattcatgacagcgacgccccctggaactgctgatgcgtttccacaaagtaacgcgccaattcaagacgaagaacgtgacatacccgaaagatcatggaactctggaaatgattggataactgattttgctgggaagacagtatggttcgtaccgtccattaaggctggaaatgacattgccaattgtttgagaaagaatggaaagaaagtgatccaactcagtcgtaaaacattcgatactgaataccagaaaacaaaactaaatgactgggacttcgtcgtcactactgacatctcagaaatgggtgcgaattttaaagcagacagagttatcgaccccaggagatgtcttaaacctgttatcctgacagatggaccagaacgagtgatacttgcaggccctatgccggtgacggtagcgtcagctgctcaacgacgtggtcgggtaggcagaaacccgcaaaaggaaaatgatcaatacatatttactggacaacctttaaataatgatgaagaccacgcacattggacggaagcgaagatgttattagataatataaacacaccggaaggaatcattcccgcgctatttgagccggaacgagagaaaagcgcagcaatagatggtgaatatcgactcaagggagaatcccgaaaaacgttcgtagaactaatgcgaagaggcgacctaccagtgtggttagctcataaagttgcatctgaaggcattaagtacaccgatagaaaatggtgtttcgatggagagagaaataaccaaatattagaagaaaatatggatgtcgaaatttggacaaaagaaggggaaaagaagaaattacgtccccgctggctcgatgctcgtacctatagcgatcctttagcattgaaagaatttaaagattttgccgcaggcagaaaatctatagctctggaccttgtaacagaaatagggcgcgtaccaagccacttagcacacaggacaagaaatgccttagacaatttagttatgttacacacctccgaacatggagggcgcgcctatagacatgccgttgaagagttgcctgaaactatggaaaccctattattactgggtcttatgattctcctcaccggtggagcaatgttgtttttgatatccggtaaaggggtaggtaagacatccataggattgatctgtgtggtcgctagtagcggaatgctctggatggccgacatacctttgcaatggatcgctagtgcaattgtcctagaatttttcatgatggtactattaatcccagagccggaaaaacagcggacgccacaagataaccagctagcatatgtagtcatcggaatattaacattagcggcaatagttgctgctaatgaaatggggttactagagaccacaaagagagatttaggaatgagtaaggagccaggagttgtaagtcccacgagttacttggatgtagacttacatccagccagcgcgtggactctttatgccgtcgcaacaacagtcataacccctatgttacgacatacaattgaaaatagtacagcgaacgttagtttagctgctatagctaatcaggctgttgtactgatgggtttagacaaaggatggccaataagcaaaatggacttaggagtaccactcctggcactaggatgctatagtcaggttaatccattaaccttgacggcagctgttcttttactggtcacccattatgcgattataggtccgggactacaagcaaaagcgacaagggaagctcaaaaacggacagcagcaggtataatgaaaaacccaacagttgatggaataatgactatagatctggacccagtaatatacgactcaaaatttgaaaaacaattggggcaggttatgctattagttttatgtgctgtacaattacttttaatgagaacgtcatgggcattctgcgaggctttgactttagctacaggaccgattaccacgttgtgggaaggctcacctggaaagttttggaatacaacaatagcggtatcaatggcaaatatttttagaggttcatatttagcaggagcaggactcgccttcagtattatgaagtccgtaggtactgggaaaagaggcacaggttcacaaggagaaacgttaggagaaaaatggaagaagaaattaaaccaactatcgcgaaaggagttcgatctgtataagaaaagtggtattacagaagttgatcgaacggaagcgaaagaagggttgaagcgtggcgaaataacgcatcatgcagtatcacgtggaagcgcaaaactccaatggttcgtagagagaaacatggtcatcccagagggacgagtcattgatttaggttgcggtcgtggcggctggtcgtactattgcgccggactaaagaaagtaacggaagtaaggggttatacgaaaggcgggccaggccacgaagaaccagttccaatgagtacatacggctggaatatcgtaaaactaatgtcagggaaagacgtattttatctaccaccagaaaagtgtgacacactactatgtgacataggagagtcctcaccaagcccaactgtagaagaatcaagaactataagagtcctaaaaatggtcgaaccgtggttgaaaaacaatcagttttgtatcaaggtattaaacccatacatgccaactgtaatagaacacctggagcgattacagcgtaaacacggaggaatgttagttagaaatccactatctcgcaattcaacacatgaaatgtactggatatctaacggtactgggaatatcgtgagtagtgtaaatatggtaagtagattactattaaacagattcaccatgacgtacagaagaccaacaatagagaaagacgttgaccttggagcggggactagacatgttaatgctgaaccagaaacgcctaatatggacgtcatcggcgaaagaatcaggcgtataaaagaagaacatagctcgacttggcattacgatgacgagaatccctacaaaacctgggcctatcacggatcatacgaagtaaaagccaccggatctgcgagctcgatgatcaatggtgtcgtcaaattattaaccaaaccctgggacgtagtacctacagtaacacaaatggcaatgacagataccacgccattcggacagcaacgcgtatttaaagaaaaggttgatactagaacaccgaaacccatgcccggtacacgcaaggttatggaaatcacagcagaatggttatggcgtacattggggagaaataagagaccaaggttatgcacgagagaagaatttaccaagaaagtgcgcacgaacgccgcgatgggcgccgtttttacagaagagaaccaatgggatagtgcaagagctgctgtagaagatgaagaattttggaagctggtcgaccgcgagagagaactacacaaacttggcaaatgtggatcatgcgtatacaatatgatgggcaaaagagagaagaaactaggagaatttggtaaagccaaaggctctagagcgatctggtatatgtggctcggagcaagatacttagagttcgaagcgttaggatttttaaacgaagatcactggttcagtcgggaaaatagttatagtggcgtcgaaggcgaaggattacataaacttggctacatcctaagagatatatccaaaatacccggaggagcaatgtacgcggatgatactgctggatgggatacaagaataacagaagacgatctacataatgaagaaaagatcacccaacaaatggatccggagcacagacaattagcaaatgcgatatttaaattgacataccaaaacaaagtagttaaagtacaacgacccactcctaaaggaacagtcatggacatcatctcgcggaaagaccaacgtggaagtgggcaagtggggacttacggcttaaacacattcaccaatatggaggctcaattaattcgacaaatggaaggggaaggtgtattgagtaaaactgatttagaaaatccacacttgctagagaaaaagataacacagtggctggaaaccaagggagtggaacgattaaaacgtatggccattagtggcgatgactgcgttgtaaaaccgatcgacgaccgatttgcaaacgcactcttagcattaaatgatatgggtaaggttagaaaggacataccgcaatggcaacctagtaaaggttggcatgattggcaacaagtcccattttgttctcaccattttcatgaattgataatgaaggacgggcgaaaattagtagtaccatgtcggccacaagatgaattgataggaagggcgagaataagccaaggtgcgggatggtcgctaaaggaaacagcatgtttaggtaaagcatatgcacaaatgtgggcgctcatgtattttcatcgtagggacctacgcctcgccagcaacgcaatctgcagcgccgttccggtccattgggtacctactagccgaacgacctggtcgattcatgcccatcatcaatggatgacaactgaagacatgttaactgtttggaatcgcgtatggattgaagacaacccctggatggaagacaaaacccccgtaacaacatgggaagacgtaccttatctagggaaacgtgaggatcagtggtgtggtagcttaataggattaacctccagggcaacatgggcacaaaatatacttactgcaatacaacaagttaggagcttgatcggaaatgaagaatttcttgattatatgcccagcatgaaaagattcagaaaagaagaagagtcagaaggtgctatatggtaa

SEQ ID NO: 23567 - RNA, 9873 nt, synthetic construct
  misc_feature 1..9873: note = derived and/or modified CDS sequence (opt6) from DENV-3__JN368477__SS-prME
  source 1..9873: mol_type = other RNA
acttctttatgtttaatgatgatgttacctgcaaccttagcttttcatctgacaagtcgagacggtgaacctagaatgatcgtgggcaaaaatgaaagaggaaaatcactgttgttcaaaactgctagcggcataaatatgtgcacgttaatagccatggaccttggcgaaatgtgcgatgatactgttacatataaatgtccactaatcgcggaagttgaacctgaagatatagattgctggtgcaatttaacaagtacttgggtaacgtatggcacttgcaatcaagccggcgaacatcgtagagataaaagatccgtcgcactcgcaccacatgtgggcatggggttggacacacgcacacaaacatggatgagtgcagagggagcatggcgtcaagtggaaaaagttgaaacttgggcccttcgccacccagggttcactatactcgctctatttctagctcactacattggaacatcgctgacacagaaagtagtaatattcatactattaatgttagttacaccaagtatgaccatgcggtgtgtaggtgtaggtaatcgcgactttgtagaagggttaagtggcgcaacatgggtggacgtcgtcctagaacatggaggctgtgtcactacgatggccaaaagtaaaccaacactagacatagaattacagaaaacagaagcaactcaactagcaaccttgcgtaaactgtgcatagaaggtaaaataactaatattacaaccgactcgagatgccctacacaaggtgaagctacattaccagaagaacaagaccaaaactacgtatgcaaacatacctatgtagaccggggttggggcaatggatgcggattattcggaaaaggttctctagtgacatgcgcgaaattccaatgtctagaaccaatagaagggaaagtagttcaatatgagaacttaaaatacactgtaataattactgtacacacgggggaccaacatcaagtggggaacgacacccaaggtgtaactgtagaaataacaccacaagcatccactgtggaggcggtcctacctgagtacggaacattaggactagaatgtagtccaaggacgggcctcgattttaacgaaatgatattacttactatgaaaaataaggcttggatggtgcatcgtcaatggttcttcgatttaccgttaccatggacatctggcgctacgacagagacgcctacttggaatcggaaagaactattagtgacctttaaaaacgcacacgctaagaaacaagaggtggtcgtcctaggaagtcaagagggtgccatgcatacagcattaaccggagcaacagaaattcaaaacagcggaggtaccagtatatttgcgggacatctaaaatgccggctgaaaatggacaaattagagctgaaaggaatgtcgtatgctatgtgtttaaatactttcgtccttaagaaagaagtttctgagacacaacatggtaccatactaatcaaagttgaatataaaggcgaggacgcgccttgcaaaataccatttagtacagaagacggacaaggtaaagcacataatgggagattaatcacagcaaatccggtggttaccaagaaagaagaaccagtaaatatagaagccgaacccccttttggagaatcaaacatagtcataggcatcggtgataaagcgcttaaaataaattggtacaagaaaggttcatcaatcggcaaaatgtttgaggccacggcaagaggggcaagaaggatggcaatactgggtgacaccgcctgggactttgggtcagtcgggggagtactaaattctctcggaaaaatggtacaccaaatcttcggtagtgcctatacggccctattttcaggtgtctcgtggatcatgaaaataggcatcggagtgctacttacctggataggactaaacagtaaaaatactagcatgagcttctcctgcattgttatagggataattacactgtatcttggtgcagtggtacaagctgacatgggttgtgtaatcaattggaaagggaaagaattgaaatgcggaaatggtatcttcgttaccaatgaagttcacacttggacagaacaatacaaatttcaagctgacagtccaaaaagactagcgacagctattgccggtgcatgggaaaatggtgtttgcggtattagatccaccactagaatggaaaatctcttatggaaacagatagctaatgaacttaactatatattatgggagaacaatatcaaactgactgtggtagtcggagatataattggagtattagaacaagggaaaaggacgttaactccacaaccaatggaactgaaatattcctggaaaacgtggggaaaagctaaaatagtaacggctgagacccaaaattcgagcttcattatcgacggaccaaacacacccgaatgtccaagcgcatcccgtgcatggaatgtttgggaggtagaagattatggtttcggcgtgttcacaacgaatatatggctaaaattaagggaagtttatacgcaatcgtgtgaccatcgacttatgtccgccgcaataaaagatgaaagagccgtacatgccgacatgggttattggatagaaagtcagaaaaatgggtcttggaaactagagaaggcttcgttcatagaagtaaaaacctgcacttggccaaagagccacacattatggagtaatggagttttagaatcagatatgataataccaaaatctttggctgggccaatatcacaacataatcataggcccggttatcatacacaaactgccggcccttggcacctaggaaaactagaattagattttaactattgtgaaggcacaactgttgttatagcggagaattgtggtacccgcggaccgtcattgcgaaccacgacagtttctggcaaactaatacacgagtggtgctgcagaagttgcactcttcctccattaagatacatgggagaagacggatgttggtacggaatggaaatacgaccaattaacgaaaaagaggaaaatatggtgaaaagcctagtttcagccggaagtggaaaagtagataatttcactatgggtgtcttatgcttagcaatcctgttcgaagaagtaatgcgaggcaaattcgggaagaaacatatgatcgcaggcgtgttgtttacatttgttttactattatcaggtcaaattacatggcgcgatatggctcacactttaatcatgattggttctaatgcatctgatagaatgggaatgggagtcacacatttagcactgatagcgacgtttaaaattcaaccatttttagcactaggattctttctgagaaaattaacgtcacgagaaaatcttttactaggagtgggtttggctatggcaacaaccctgcaattgcctgaagatatagaacaaatggcgaatggaatcgctttgggtttgatgacattaaagctgatcactcaattcgaaacataccaattgtggacggcgctcgtaagtctaacctgtagtaatactatttttactttaacagttgcatggcggactgcaaccctcattctggcaggagtaagtcttctccccctatgccaatcgagctcaatgcgtaaaactgattggctcccaatgacagtcgcagcgatgggagtccctccgcttccactatttatattctcattaaaagatacacctaagcgtaggtcttggccactaaacgaaggagtaatggccgtaggactcgtgtcaattctggccagcagtttgttaaggaacgatgtcccgatggctggtcccttagtcgccggtggattactcatagcatgttatgtcataactggtaccagcgcagacctgactgttgaaaaagcagcagatgttacatgggaagaggaagctgaacaaacgggcgtgagccataatttgatgataactgtggacgacgacggtactatgaggataaaagatgacgaaactgaaaacattttaactgttcttttaaagacggcgctattaatagttagcggcatttttccatattcaatacccgcaaccctattggtatggcatacatggcagaaacaaacacaacgatcgggtgtactctgggatgtcccttcacccccggagacgcagaaggcagaactcgaagaaggggtttacagaataaagcaacaaggtatcttcggaaagacacaagtaggcgtcggtgtacagaaggaaggagtattccatactatgtggcacgtgacaaggggagccgttcttactcataatggaaaacgactagaaccaaactgggcgtcggtgaaaaaggatttaatttcttatgggggtggatggcgactatcagcacaatggcaaaaaggagaagaagtacaagtcatcgctgtagaaccgggaaagaaccctaaaaattttcaaacaatgccaggaatatttcaaacaactactggtgaaataggagccattgcacttgacttcaaaccaggaacgtcagggtcccctatcataaatcgcgaaggaaaagtagtaggcctctatgggaacggcgtagtaaccaaaaatggtggctacgtgtcagggattgcacaaacgaatgcagaaccagatgggccaactccagaactagaagaagaaatgttcaagaaaagaaacttaacgataatggatcttcaccccggcagtggaaagacaaggaaatacctccctgcaatcgtacgagaagcaatcaaacgaagactccgaacgctaattttggcaccaacaagggttgtggctgccgaaatggaggaggctttaaaaggattaccgataagatatcaaactactgcaacgaaaagcgaacacacaggtcgcgaaattgtagatctaatgtgtcatgcaacttttacaatgcgacttctgtcacctgttcgagttccaaactacaatttagtaataatggatgaagcccactttactgatccagcctcgatagctgctcgtggctacatatctactcgagtgggcatgggggaagcggcagccatttttatgacagccacaccccctggaacagctgaggcttttccccagagcaatgccccaatacaggacgaagaaagggatattccagaacgcagttggaacagtggtaatgagtggataaccgactttgttggaaagacagtatggtttgttccctcgattaaagccggtaatgacatcgctaattgcctacgtaaaaacggtaagaaagtcatacagctatcgcgcaaaacgttcgacacagaatatcagaaaactagattaaatgactgggattttgttgttactactgacatctcggagatgggagcgaattttaaagcagatagggttatagacccaagacgttgtttaaaacccgtaatacttacagacggacccgagagagtgatacttgcaggccccatgccggtaacagcagctagtgcggcacaacgtaggggtagagtaggacgaaatccacaaaaagaaaatgatcaatacattttcacaggtcaaccgttaaacaatgatgaagatcacgcacattggaccgaagccaaaatgttgctagataatattaatacaccagagggaataatacctgcgttgttcgaaccagaacgggaaaaatcggccgcaattgatggagaataccgtcttaaaggagaatctaggaaaacttttgtagaactgatgaggagaggggacctcccagtatggttggcacataaagttgcatcagagggtataaaatatacagacagaaaatggtgttttgatggagaacgaaacaatcaaatattggaggaaaacatggatgtcgagatatggactaaagagggtgaaagaaagaaacttagaccgcgatggctggatgcaagaacttacagtgaccctctagcacttaaggagttcaaagattttgcagctgggcggaagtctattgcgttggatctagtaacggaaataggaagagtgccaagccatcttgctcaccgtacacggaacgcccttgacaaccttgttatgctgcacacatccgaacacggtggacgtgcgtacaggcatgcggtagaggagcttccagaaaccatggaaactctcttacttctaggacttatgattcttctaactggaggggctatgttatttctcatctcaggcaaaggaattggaaagacatcaatcggccttatttgcgtaattgtctcgtccgggatgttatggatggctgatgtgccactccaatggatagctagtgcaatagttttagaatttttcatgatggtcttactaataccagaaccagaaaagcaaaggactccacaagataatcaattggcatatgtagtcattggtatactaacgttagcagcaattgttgctgcaaatgaaatgggcttactagaaacaacaaaacgtgatttgggaatgtcaaaagaaccaggtgttgtatctcccacgtcttacttagatgtcgacctacatcctgcttctgcctggaccttatatgcggtcgccacaacagtaattacaccaatgttaaggcacactattgaaaactcgacagcaaacgtcagtcttgcagcaattgcaaatcaagccgttgtactgatgggcttagacaaaggatggcctatatcaaaaatggatttaggcgtaccattgctcgctctgggatgttattcccaagtaaatcctttaacactgacagcagcagtattattgctagtcacccactatgcaatcatcggcccaggacttcaagctaaagcgacgagggaagctcagaaaagaacagccgccgggattatgaaaaaccctacggtagacggaataatgacgatagatctggatccggtaatatatgattcgaagttcgaaaaacaactaggacaggtcatgcttttagtactatgcgcggtgcaattactattgatgaggacatcatgggctctatgtgaagcattaaccctggctacaggtccgataacgacgctatgggaaggttcgcccggtaaattctggaataccacaattgcagtaagtatggcaaatatttttaggggaagttacttagccggagcgggtctcgccttctcaataatgaagtcagtagggacaggacggcgcggaactggatcacagggtgagacacttggcgaaaaatggaagaagaaattaaaccagctatcccgtaaagaatttgatttatacaagaaaagtggaataacggaggttgataggaccgaagcgaaagaaggtttaaaaagaggcgaaacaactcatcatgccgtttcaagagggagcgctaagttacagtggtttgtcgaacggaatatggtgataccagaaggaagagttatagatctgggttgtggaagaggaggatggtcatattactgtgcaggactcaagaaagtaactgaggtaaggggttacaccaagggagggcctggtcacgaagaaccggtacctatgagtacatacggatggaacatcgtaaaattgatgtccggtaaagatgtattttatctcccaccagaaaaatgtgataccctattatgcgacataggagaatctagcccatcaccaacagtcgaagaaagccgaaccatacgtgttctaaagatggttgaaccatggcttcgtaataaccagttttgtatcaaggtgctaaatccatacatgccaacagtcatagaacacttagaacggctacaaagaaaatacggtggaatgctagtccgtaacccgctatctagaaactcaacccatgaaatgtactggatatcaaacggcaccggcaatatagtatcatcagtcaacatggtttcaagattattactcaacaggttcacaatgacgcaccggagacccaccattgaaaaagacgtagacctaggtgctggcactcgacacgttaatgcggaaccagagactcccaatatggacgtaataggagaacgcataaaaagaattaaggaagaacacagcagtacatggcattatgacgatgaaaatccatacaaaacatgggcataccacggcagctatgaggtaaaagcaacaggatcagcctcatctatgataaatggcgttgtaaaactactgacgaagccttgggacgtagtcccaatggtaacgcaaatggctatgactgacacaacgccatttgggcaacaaagggttttcaaagagaaggtggatacccgaacaccacgaccaatgcccggaacaagaaaggttatggagattacagcggagtggctttggaggacattaggacgaaacaagaaaccacggttgtgtactagagaggagtttaccaagaaagtaagaactaacgctgcaatgggagcagtgtttacagaagagaatcaatgggactccgcaagagctgccgttgaagatgaggaattttggaaattagtagacaaagaacgtgagcttcataagctaggaaaatgtggaagctgtgtgtacaacatgatgggcaagagagagaagaaacttggggaatttggtaaagcaaaaggatcaagagcaatctggtatatgtggttaggtgcaaggtatttggagttcgaagcactaggattcctaaacgaagatcactggttcagcagggagaatagctacagcggtgtagaaggcgagggactgcacaaattaggttacattcttagagatatatccaagattcccggcggcgcaatgtacgcagatgacactgcaggatgggacaccagaattacagaggacgacctacacaacgaagagaaaattacacagcaaatggatccgggccatagacagctagctaatgcgatttttaaacttacttaccaaaacaaggtggtaaaagtacaaagacctactcctaaaggtacagtaatggacatcatttcgaggaaagatcaacgtgggtcaggacaagtagggacttatggacttaataccttcacaaatatggaggcccagttagttcgccagatggaaggcgaaggtgttttgagcaaagcggatttggaaaatccacacctacttgagaagaaaataactcagtggttagaaactaaaggtgtagaacgtttaaaaaggatggccatatcaggagatgactgcgttgtcaaacccatagacgataggttcgctaacgcattactagcactaaatgatatggggaaagtcaggaaagatatacctcagtggcaacctagtaaaggttggcatgattggcaacaagtaccattttgtagtcaccattttcatgagttgataatgaaggatggacggaagctagtggttccgtgtaggccgcaagacgagttaattggtcgcgcacgaatttcacaaggtgcaggctggagcttaaaagagaccgcatgcttaggcaaggcctacgcacaaatgtggagtttaatgtatttccaccggagagacctgcgcctggcatcaaatgcgatatgttcagctgtacccgtacattggataccaacatcaagaactacgtggagcattcatgcacatcaccaatggatgaccacggaagacatgcttacggtatggaaccgagtttggattgaagacaatccctggatggaagataagacaccagtaacaacatgggaagacgttccatatctcgggaaacgtgaagatcaatggtgtggcagtttgatcggtctaacctcacgggccacgtgggcccagaatatcttaactgcaatacaacaagtaagaagcctaattggagatgaggagtttcttgattacatgcccagtatgaaacgttttagaaaagaagaggaaactgaaggagctatatggtga

SEQ ID NO: 23568 - RNA, 9873 nt, synthetic construct
  misc_feature 1..9873: note = derived and/or modified CDS sequence (opt6) from DENV-3__EF643017__SS-prME
  source 1..9873: mol_type = other RNA
acatcactgtgcctaatgatgatactaccagcagcactcgcatttcacctaacatcaagagatggagaaccaagaatgatagtgggtaaaaatgaaagaggaaaatcattgctattcaaaactgctagtggaataaatatgtgcacactaatcgcgatggacttaggagaaatgtgtgatgacacagtaacttacaaatgcccacatataacagaagttgaacctgaagacatcgattgttggtgtaatcttacgtcgacctgggtaacttacggaacttgcaatcaggcaggagagcgcagaagggataaaaggagcgttgcattagctccacacgtaggaatgggattagatacacgaacccaaacatggatgagcgccgaaggagcttggaggcaagtagaaaaagtcgaaacgtgggcactaagacacccaggctttacaatcttagcgctatttttagcacactatatagggacctccctgactcaaaaagtggttattttcatattgttgatgttagtaacacctagtatgactatgagatgcgttggagttggcaatcgtgattttgttgaaggcctatcaggcgcgacgtgggtagacgtggtccttgaacatggaggttgcgtgactactatggccaaaaacaaaccaacattagacatagaacttcagaaaaccgaagcaactcagttagcaacactcagaaaattatgtatcgaaggaaaaataacaaacataacaaccgactccagatgtccaacccaaggagaagccgtgctccctgaggaacaagatcagaattacgtgtgcaaacatacgtacgtcgatagagggtggggtaacggatgcgggttatttggcaaagggagcttagtaacgtgcgctaaatttcaatgcctagaaccaatcgagggtaaagttgtccaatacgaaaatctaaaatataccgtcattatcaccgtacatacaggtgaccagcaccaagttggaaatgaaacgcaaggggtgactgcggagataactcctcaagctagtacgacagaagcaattctacctgaatacggcacattaggcctcgaatgctcaccaagaacaggtctagattttaatgagatgatactattaacaatgaaaaataaggcctggatggtccatcgccaatggttctttgatttgccccttccatggacgtccggagctaccactgaaaccccaacatggaaccgaaaggaattacttgttacgttcaaaaatgctcacgccaaaaagcaggaggtagttgtactaggatcgcaagaaggtgcaatgcatacggcgcttacgggagcaactgagatacagaactctggaggaacatcaatattttccgggcatctaaaatgtcgattgaaaatggataaattggaattaaaaggaatgagctatgcgatgtgcactaatacgtttgttttgaagaaagaagtatcagagactcaacatggaacgatattaataaaagtagaatatcgtggcgaagatgccccctgtaaaataccgttcagtaccgaagacggtcaaggaaaagctcacaatggacgattgataacagcaaatcccgtagtaaccaagaaagaagaaccagttaacatcgaagcagaaccaccattcggagaatcaaacatagtaattggtattggcgacaatgcattgaaaataaattggtacaagaaagggagctctatcggaaaaatgtttgaagctacagccaggggtgcgcgaaggatggcaattctaggggacacagcttgggatttcggttcagttggcggagtgttaaattcgttaggaaaaatggttcatcaaatattcggcagtgcatacactgccctatttagtggcgtctcctgggttatgaaaataggaataggagtattactaacatggataggcctgaacagcaaaaatacaagtatgtcgttttcttgcatagcaattggaattataacactctatctgggagcggtcgttcaggcagatatgggctgtgttattaattggaaaggtaaagagctaaaatgcggatctgggatatttgtaaccaatgaagtgcatacgtggactgaacaatacaaattccaagcagattcgcctaaaagattagcgacagcgatagctggagcttgggaaaacggagtatgtggaatacgaagtacaacaaggatggaaaacttattatggaaacaaatagcaaatgagttaaattacatcttatgggaaaataatattaaacttactgtagttgttggtgatattataggcgtacttgaacaagggaagagaacactaacaccacaacctatggaactaaaatacagctggaagacatggggtaaagccaaaatagtgacggcagagacccaaaatagctcgtttataatagatgggcccaatacaccagaatgtccaagcgcctcgagagcttggaatgtttgggaagttgaagattacggcttcggtgtttttaccactaatatttggctaaaactgcgcgaagtatacacccaactttgcgaccacagactgatgagtgcagctgtaaaggatgagagagcggtacatgctgatatgggatactggatcgaatctcagaaaaacggatcatggaaacttgagaaagccagcttaattgaagtaaagacttgcacatggccaaagtctcacaccttatggtctaatggagtcttagaatcagacatgataacaccaaaatcattggcgggaccgattagtcaacataatcacagaccaggataccacactcaaacggcaggaccatggcaccttggaaaactggaattagattttaattattgtgaaggtacaacagttgtaataactgagaattgtggaacacgtgggccgtcactacgaactacaacagtctccgggaaattgatacacgaatggtgctgtcgctcttgtacgctcccaccattgaggtatatgggagaagacggttgttggtatgggatggagatcagacctataagcgaaaaagaagagaacatggtaaagagcttagtaagtgcaggttcagggaaagtagacaactttactatgggcgtactctgtttagcaatactatttgaagaagtaatgcgtggtaaattcggcaagaaacacatgatcgcgggtgtattcttcaccttcgttctgctgctttcgggacaaatcacctggagggacatgacccacacgttaattatgattggatctaacgcatcagaccgtatgggaatgggcgtgacctacctggcactaatcgcgacattcaaaatccaaccatttctcgctctcgggttctttttaagaaaactcacgtcacgtgaaaaccttttactgggcgttggccttgccatggcaactacactacagctaccagaagatatagaacaaatggcgaacggaatcgcactaggtttgatggcgctaaaattaataacacagtttgagacttaccaattatggacagcgttgatatcgttaacctgcagtaacacaatgtttactttaactgtcgcgtggcgtactgcgacacttatcctagctggtgtatcattactacccgtgtgccaatcaagtagtatgcggaaaactgattggctcccaatggccgtcgcagcaatgggcgtctctccactacctttatttattttcagcttaaaagatacattgaaacgacgttcgtggcccctaaatgaaggcgttatggcagtaggcctagtctcaatactcgcttcatcacttctgagaaatgacgtccccatggcaggaccgttggtagcaggcggattactaatcgcctgctacgttattaccggaacctcagccgatttgacagttgaaaaggccgctgatataaccagggaagaagaagctgagcagacaggagtgtcgcataatctaatgactacagttgatgatgatggaactatgcgaattaaagacgacgaaactgagaacatactgacggtattattaaagacagcacttctaatagttagtggtgtatttccatactcaattccagcaaccctgctagtatggcatacttggcaaaagcaaacacaacggtccggggtgctatgggacgttccaagccctcccgaaacacaaaaggccgagttagaagaaggagtataccgaataaaacagcagggaatcttcggaaaaactcaggtgggggttggcgttcaaaaagaaggggtatttcataccatgtggcatgtgactcgcggtgccgtattgacctataacggtaagcgtttagagcccaactgggctagcgtgaagaaagacctaatttcttatggagggggctggagactatcagcgcagtggcaaaagggggaagaggtgcaagtgattgcagtggaacctggcaaaaatcccaaaaatttccaaactatgcccggaacgtttcaaacaacaacaggagagataggcgctatcgcactagattttaagcccggcacatctggatctcctatcataaatcgtgaaggtaaagtggtcggattatacggtaatggtgttgtcacgaaaaacgggggatacgtaagcggaatcgcacaaaccaacgccgaaccagacggtccgacaccagaattagaggaagagatgttcaagaaaagaaatctcactataatggacttacaccctggcagcgggaaaacaagaaaatatttgcctgccattgtacgggaagctatcaaaagaagactaagaaccttaatactcgcccctacaagggttgtggctgcggaaatggaagaagctctaaaagggctacctattcgctaccaaactaccgcaactaaatcggaacacaccggcagggaaatagtcgatctgatgtgccatgcaacgttcaccatgcgtctactctcccctgttcgtgtgcccaattacaatctaattatcatggacgaagcgcatttcactgaccctgcaagtatcgcagctagaggctatatttcaacccgagtcggaatgggggaagcagcagctatattcatgaccgctacaccgccggggacagctgatgctttcccccaatctaacgcaccgattcaagatgaagaaagagatataccagagagaagctggaactcaggtaatgagtggatcacagattttgctgggaaaaccgtatggttcgtaccttccataaaggctggtaatgatattgctaattgcttgcgtaaaaatggtaagaaagttattcaactcagtcgtaaaacattcgatactgaatatcagaaaacgaagctaaatgattgggacttcgttgtaactacagatatatctgaaatgggtgccaacttcaaagcggatagagtcatagatcctcgtcgatgccttaagccggttatcttgacagacggtcctgagcgcgttatattggcgggtcctatgcctgtcacagccgcatctgctgctcaaaggcgaggacgagttggtagaaatcctcaaaaagagaacgatcaatatatattcacagggcaacctttgaacaatgatgaagaccacgcgcattggacagaagctaaaatgctgctagataacataaatactcctgagggaataatccccgcactttttgaaccggaacgagagaaaagtgcagctatagatggagaatacaggcttaaaggtgagagtcgtaaaacctttgtagaattaatgcgtcggggcgacctacctgtgtggttagcacataaggtcgcatcagaaggaattaaatacactgatcgaaaatggtgcttcgacggacaacgaaacaaccaaatattagaagagaatatggatgtagaaatatggacaaaggaaggtgagaaaaagaaattaagaccccgttggctagacgcaagaacgtactcggatcctcttgcgttgaaagaatttaaggactttgctgcaggacgaaaatccatagctctagatcttgttacagagataggtcgtgtaccttcacacctagcacacagaacaaggaatgcgttggataatctagttatgttacacacatctgaacacggaggtagggcttacaggcacgcagtcgaagaattaccagaaaccatggaaaccctcttgcttttaggattaatgattttattaacaggtggcgcaatgctgtttttaatatctggcaagggaattgggaaaacgtctataggattaatctgcgtgatagcatcaagcggcatgtcgtggatggcagaaattccactacaatggatagcgtctgcaattgtactagagttcttcatgatggttcttttaataccagaaccagaaaaacaacgcacaccgcaagataatcaactcgcctacgtagtaattggtatattaaccctggcagccatcattgcagcaaacgaaatgggtttattagaaactaccaagagggacttaggaatgtccaaagaacccggagtagtgtctccaacaagctacttagatgtagacttacacccagcctccgcgtggaccctatacgctgtagctacaacagtaataacaccaatgctaagacacactatagaaaatagcacagctaatgtctcgttggcagcaatagccaaccaagccgtcgtactcatgggtctagacaaaggatggccgataagtaaaatggatctaggagtgccactacttgcactgggatgctattctcaagtgaatcccttaactctaaccgctgctgtgttattattaatcactcattacgcaatcatcgggccaggcttgcaggcgaaggctacccgagaagcacaaaaacgcacagcagcagggataatgaagaatccaaccgtagatggtataatgacgatagacctcgacccagttatttatgacagtaaattcgaaaagcagttgggtcaagtaatgctattggtactctgtgctgtgcagctgcttctgatgcgaacaagttgggctctttgtgaggcattaactctggcaactggcccaataaccacgctttgggaggggagccctggtaaattctggaacactacgatagcagtgtccatggcaaatatatttcgggggagctaccttgcaggagtcggactcgcattctcgataatgaaatcagtaggaactggaaaaagaggaactggttcacaaggggaaacactgggtgaaaaatggaagaagaaactaaatcagctgtcacggaaagagttcgacttatataagaaatcaggaatcacagaagtagatagaacagaagcaaaggaaggtcttaaaagaggagagatcacgcatcatgcggtatctagagggtcagcaaagttacaatggttcgtggagagaaacatggtaattcctgagggccgagtaattgatctcggttgtggacgtggaggttggtcttattattgcgctggactcaagaaagtaacagaggtacgaggttacaccaaaggtggtcctggccacgaagaacctgtcccaatgagtacatatgggtggaatatagtaaaattaatgtctggaaaagacgtgttttatctcccaccagagaaatgcgatacgctattgtgcgacattggtgagtcatcaccaagtccgaccgttgaagaatcaagaactattagagtactaaaaatggttgaaccctggctgaaaaacaatcagttttgcataaaggtactaaacccctatatgcctacagtaattgaacatttggagagattacagaggaaacacggtggaatgctagtacgaaatccactatctagaaattccacgcacgaaatgtattggatttcaaatggaactgggaacattgtagcttctgtaaatatggtaagtagactgttattaaaccggttcactatgactcatcgtcgtcccacaatagaaaaggacgtagacttgggcgcaggcacgcgacacgtaaatgccgagccagaaacccctaatatggatgttataggagagaggataaaacgaattaaggaggaacataattccacctggcactacgacgatgaaaatccttataaaacttgggcttatcatggctcctatgaagtcaaagctactggaagcgccagtagtatgataaatggggtagttaaacttcttactaagccctgggatgtcgttcctatggttacccaaatggcaatgacggacaccacgcctttcggtcaacaaagagtttttaaagaaaaagtcgatactcggactccacgaagcatgccaggtacacggcgagtaatgggcataaccgcggagtggctgtggcgaacgttaggtagaaataagaaaccgagattatgtacgcgagaagagttcactaagaaagttaggaccaatgctgcaatgggagcagtattcacggaagagaatcaatgggacagtgccaaggctgcagtggaggatgaagatttttggaaacttgtagacagggaaagggaactacataaactaggaaaatgcggatcttgcgtctataatatgatgggcaaacgtgagaagaaattaggtgaatttggcaaagctaaagggtcgagggcaatatggtatatgtggctgggtgcacgttatctggagtttgaggccttgggttttctaaatgaagatcattggttttctcgcgaaaattcttactccggggttgaaggtgaaggcctgcataaactaggttatatcctaagagatatatctaagatcccgggtggagcaatgtatgcagatgatactgccggttgggacactcgcattaccgaggatgatttacataatgaagagaaaataacacagcaaatggatcccgaacaccgccaattagcaaacgccatatttaaacttacataccaaaacaaagtagtaaaagtacaaagaccgacaccaaccgggacagtaatggatattatatcaagaaaagatcaaagaggaagtgggcaagtgggcacctatgggttaaataccttcacaaatatggaagctcaattaatcaggcaaatggagggagaaggggttctaagtaaggcagatttggaaaatcctcatctgccagagaagaaaatcacccaatggctcgaaacgaaaggggttgagcggttaaaaaggatggccatcagtggagatgactgtgttgttaaaccgatagatgatcgattcgcgaacgcgttgctagcattaaatgacacaggcaaagtaaggaaagatataccccagtggcaaccgagtaaaggttggcatgattggcaacaagtaccattctgcagtcaccatttccatgaacttatcatgaaagatggccgaaaacttgtagtgccatgccgacctcaggacgagttaattggaagggccagaataagccaaggggctggctggtcattacgagaaacagcatgtttagggaaagcatatgcacagatgtggtctcttatgtattttcatcgacgcgacctgagactagcaagtaacgcaatctgttcagcagtgcctgtacattgggtccctacctcaagaactacatggagcatacacgctcatcatcagtggatgacaacagaagatatgttgacagtttggaaccgagtatggatagaagataacccatggatggaggataaaactccagttaccacttgggaaaatgtaccgtatctagggaaaagagaagatcaatggtgcggttctttaatcgggttaacaagccgagcaacatgggcccaaaatatccccacggccatacaacaggtcaggtctctaattggcaacgaagagttcctggactatatgcctagtatgaaacgttttaggaaagaagaagaatcggaaggagccatttggtga

SEQ ID NO: 23569 - RNA, 9873 nt, synthetic construct
  misc_feature 1..9873: note = derived and/or modified CDS sequence (opt6) from DENV-3__DQ675519__SS-prME
  source 1..9873: mol_type = other RNA
acatcgatatgcttaatgatgatgttaccagctacactagcattccatcttacatcaagagatggagaaccgaggatgatagtaggcaaaaacgaacgcggtaaatcattacttttcaaaactgcctccggtattaacatgtgtacactcatagcaatggatctgggagaaatgtgtgatgatacagtcacgtataaatgccctttaataacagaagtcgaaccagaagatatagactgctggtgtaatctcacatcaacttgggtgacgtatggaacatgtaaccaagctggagaacatagacgagataaaagatctgtagctttagccccacatgtaggaatgggtttagacacacgaacacaaacatggatgagtgcagaaggtgcatggaggcaagttgaaaaagtagaaacttgggcctttcgacatccaggattcacgattctggcgttatttcttgcacactacataggaacaagtttaactcaaaaagtagtaatctttatattattaatgctagtcactccaagtatgacgatgagatgtgtaggcgtgggaaatcgcgacttcgtagaaggtctatctggggccacatgggtcgatgtcgtgttagaacatggaggatgtgtaaccacaatggctaaaaacaaaccaacacttgatatagaattacagaaaactgaagctacgcaacttgcaaccttaagaaaattatgtatagaaggaaaaataaccaatgtcacgacagacagcagatgtccgacccaaggtgaagccattctaccggaagaacaagaccaaaactacgtttgcaaacacacatatgttgatcgaggatggggaaacggctgtgggttattcgggaaagggagccttgtgacttgcgcaaaattccaatgcttagaatctatagaaggcaaagtcgtacagcatgaaaatttgaaatatacggtaattattacggtgcatactggtgatcaacaccaagttgggaatgaaacgcaaggagtcactgcagaaataacaccacaagcgagtacagtagaagcaatactaccggaatatggaactttaggtcttgaatgttcgccaagaacagggctagactttaatgaaatgatattattaaccatgaaaaataaggcttggatggtacatcgacaatggttcttcgacctacctctaccatggacaagtggtgctactacagagacgccaacttggaacaagaaagagctattagtaacatttaaaaacgcccatgctaagaaacaagaggttgttgtattgggctcccaagaaggcgctatgcacacagctttaacaggagcgacggaaattcaaaccagcggtggtacatcgatttttgctggtcatttaaaatgtagacttaaaatggataaactagaactaaaaggtatgtcctacgcaatgtgtttaaatgcattcgtcctgaagaaagaagtaagtgaaacccaacatgggaccatattaataaaagtcgaatacaaaggagaggatgcaccttgtcggataccattttctacagaagatgggcagggcaaagcacacaacggtaggttaatcactgcgaaccctgttgttacaaagaaagaagaacctgtaaacatagaagctgaacccccttttggtgaaagtaacatagttataggtattggggataaagcattgaaaataaattggtacaagaaaggatcttccattggcaaaatgttcgaagcaactgcgcgaggagcccgacgtatggctattctaggcgacactgcttgggacttcggttctgttggaggagttttgaatagtctaggaaaaatggtacaccaaatatttggatcagcttatacagcgctattctctggtgtgagttggataatgaaaattgggatcggtgtcctgctaacatggataggcctaaatagcaaaaatacttcaatgtcgttttcttgcattgtaatagggataatcacgctatatttaggggcagtggtacaagcagatatgggttgtgttattaattggaaaggtaaagaactgaaatgcggaaacggcatttttgtaactaacgaagttcacacatggactgaacaatataaattccaagctgactcaccgaaaagattggctacagctatcgcaggcgcttgggaaaacggcgtgtgcggtatcagatctacaacacgaatggaaaatctactttggaaacaaatagctaatgaattaaattatatcctttgggaaaacaatatcaagttaactgtagtcgtaggggacattataggggtacttgaacagggaaaacgtaccctaacaccacagccaatggaattaaaatacagttggaagacttgggggaaagcaaaaatcgtcacggcggaaacacagaactcttcatttattatagacggtccaaacaccccagaatgtccctccgcatctagggcttggaacgtgtgggaggtagaagattacggttttggcgtgtttacgacaaacatttggttgaaacttagagaagtgtacactcaattgtgcgaccaccgcctcatgtcggctgcagtaaaagatgagagggccgttcatgcagacatgggctactggattgaaagtcagaaaaacgggagctggaaactagagaaagcatcactaatcgaggtgaagacgtgtacgtggccaaaatcccatacattatggtctaatggcgtattagagagtgatatgattattcctaaatcacttgccggaccaataagtcaacacaaccacagaccaggataccacacacagacagcaggaccctggcacttgggaaagttagaacttgactttaattattgtgagggaactacagtcgttataacagaaaattgtggaacaagaggtccatcccttcgaacaactacagtgtctggaaagctaatccacgaatggtgttgccggtcatgcaccctacctcctttgagatatatgggagaagatggctgctggtatggcatggagattcgacctataaatgaaaaggaagaaaatatggtaaagtcacttgttagcgcaggtagcggcaaagttgacaatttcacaatgggtgtattatgcctagctatattattcgaagaagtcatgagagggaagttcggtaagaaacacatgatagctggtgttttatttacattcgttctattgttaagtggacaaatcacatggagagacatggcccatacgctgattatgataggcagcaatgcttcagataggatggggatgggcgtcacatatttagcgcttatcgcaacattcaaaatacagccttttctagcgttgggattcttcttacggaaattaacatcaagggaaaatttattactaggcgtaggacttgctatggcaacgactttacaattaccagaagacatagaacagatggcaaatggcgttgctttaggtctaatggccttgaagttaataacacaattcgaaacatatcaattatggacagctttggtctccctcatgtgcagcaacaccattttcacattaacagtagcatggagaacagcaaccctaatattagcgggtatctctttacttccggtttgtcagtcgagttcaatgagaaaaacagattggctccccatgaccgtagcagcaatgggagtaccgccgttaccattattcatattttcactaaaagatactctaaaaaggagatcatggcctcttaacgaaggcgttatggccattggcttagtttccatattagcaagcagcttgctacgtaacgacgttccaatggcagggccattagtagctggaggtttattaattgcatgctacgtaattacagggacaagtgctgacttgacagtcgaaaaggctgctgatgtaacttgggaagaagaggccgaacaaaccggggtttctcataatctaatgataacagttgacgatgatgggacgatgcgaataaaagatgacgaaacggagaatattttgactgtacttctcaagactgcattattaattgtctctggaatcttcccgtatagcatcccagcaactctattagtctggcacacatggcagaagcagacgcaaaggtctggtgtactgtgggatgttccttcaccacctgagacgcaaaaagctgaattagaagaaggagtgtatagaatcaaacaacaaggaatctttggaaaaacacaggttggtgtaggaatacagaaagaaggcgtgttccacacgatgtggcatgtgactaggggcgctgtgttgacgcataatggtaagagattagaaccaaattgggctagtgtaaagaaggatttaatttcttatggtggaggctggagattaagtgctcagtggcaaaagggagaagaggtccaagtcatagctgttgagcctggcaaaaatcctaaaaactttcaaactatgccaggaatttttcagacgactactggagaaattggcgccatagctcttgactttaaaccaggtacaagcggatctccaataattaatagagaaggcaaggtagtcggattatatggaaacggcgtggtcactaagaatggaggatatgtctcaggaatagcacagacaaatgcagagccagacggcccaacacccgagcttgaagaagagatgtttaagaaaagaaatctaacaattatggatttacacccagggagcgggaaaacacggaaatatttgccgacaatagttcgggaagcgataaagagacgactaagaacacttatactagcccctacacgagtagttgctgccgaaatggaagaagccttaaaagggttaccaataagataccaaacaacggccacaaaatctgagcacacagggaaagaaatagtggacctcatgtgccatgctacattcacaatgcgcttattatccccagtaagagtacccaactacaacctgatcatcatggatgaagctcatttcacagatccagcttcaatcgcagctaggggatacatttcgacgcgtgtaggaatgggagaggcagcggcaatatttatgacggctaccccacctggaaccgccgatgctttcccacagagcaatgcacccatacaagatgaagagagagatatacctgaacgtagctggaatagcggtaatgaatggattaccgatttcgtggggaaaaccgtttggttcgtcccatcaatcaaagcaggaaacgatatagcaaattgcttaaggaagaatggcaagaaagtaatccaactaagtcgaaagacattcgacacagaatatcagaagacaaaactcaatgactgggatttcgtagtaacaacagatataagtgaaatgggagcgaatttcaaagcagacagagtaattgacccaagacggtgtttaaaaccagtaatattaacggacggacctgaaagggtgatattggcaggcccgatgccagttaccgtagcttcagcagctcaaaggagaggccgggttggacggaatccacaaaaggagaacgaccaatatatttttaccggtcaacccctaaacaacgatgaggatcatgcacactggacagaagcaaaaatgctcttggataatatcaacacacccgaaggtataattccagcacttttcgaaccggagcgcgagaaatcagccgccattgatggagaatataggttaaagggagagtcgagaaagaccttcgtggaactcatgcgaagaggggacttaccggtctggttagcacataaggttgcgtccgagggtataaaatatacagatagaaaatggtgtttcgatggagaaaggaataatcaaatactagaagaaaatatggacgttgagatatggacgaaagaaggagagaagaagaaattaagaccacgatggctcgacgcccgcacctactcagatccactcgctttaaaagagtttaaagattttgctgccggaagaaaaagtatagcgcttgatttggtaacggagataggcagagttcccagccatcttgcatataggacgaggtcagcattggataatttagtcatgctgcatacaagcgaacatggtgggagggcttatcgacatgcagtggaggaattaccagaaacaatggagacgctattattactagggctcatgattttattaacgggaggtgctatgctatttttaatctcaggtaaaggcataggaaaaacatctatcggtttaatttgcgtagtagccagtagtggtatgctatggatggccgatgtacccctccaatggatagcatcagctatagtgttggagttctttatgatggttcttcttataccagaaccagaaaagcaaagaacgccacaagataatcaattggcgtacgttgtgataggtattctcacattagctgcaattgttgccgccaacgaaatgggtcttctagaaacaacaaaaagagatttaggtatgagtaaagaacccggagtcgtgagtcctacaagttacttagacgtcgatctgcatccagcaagcgcatggacactctatgctgtcgctacaacagtaataaccccaatgctccgacacacgatagaaaatagtacggcaaacgtaagcctcgccgccatagctaaccaggccgtagttctgatgggtctagataaaggttggcctatttctaaaatggatttgggggtaccactcttagccctcggatgttattctcaagttaaccccttgacactcacagctgctgttttacttttggtgacccactatgcaattattggacccggcctacaagcaaaagcaactcgagaagcacaaaagaggactgcagccggtattatgaagaatccaacggtagacgggataatgacgatagatttggaccccgtaatttacgactcaaaattcgagaagcaacttggtcaagtaatgctgttggtactatgcgctgtccaactgttgcttatgcggacatcttgggcattttgcgaggctcttacgctagcaacgggtccaattactacactgtgggaagggagtcctggtaaattttggaacaccaccatagccgttagtatggccaacattttccgtggcagttatttagccggagcaggtttagctttctccataatgaaaagtgttggcactggaaaacggggcacaggatcacaaggagagactttaggagaaaaatggaagaagaaattaaatcaattgtccagaaaagaatttgatttgtataagaaatcgggtattaccgaagtggacagaactaaagcaaaggagggactaaaacgaggagagacaacgcatcacgcagtctcaagaggatcggcgaaacttcaatggtttgttgagcgaaacatggtgatccccgaaggaagagttattgatcttggctgtggccgaggcggatggtcgtattattgcgccggtctcaagaaagtaacagaagttagagggtatacgaaaggaggaccagggcacgaagaaccagtgcccatgtctacgtatggttggaatatagtaaaattgatgagtggtaaagatgtgttctatctgcctccagaaaaatgcgacaccctgttatgcgatattggcgaaagctcaccaagtccaacggtcgaagaaagtagaacaataagagtactgaagatggtggaaccgtggcttaagaacaatcaattttgtataaaagtactcaatccgtacatgccaactgtgatagagcatcttgaaagacttcaacgaaagcatggtggaatgcttgttagaaacccactttcaagaaactctactcatgaaatgtattggatatcaaacggaactggaaatatagtctccagcgtaaacatggtctcaagacttttactaaaccggtttacaatgacacacaggcgcccaaccatagaaaaagacgtggatttaggtgctggtacacgtcacgtcaacgccgaaccagaaactccaaacatggacgtgataggggaaagaatcagaagaataaaggaagaacacagttcaacgtggcattacgacgatgaaaatccgtataaaacatgggcatatcatgggtcctatgaagttaaagctacaggatcagctagctctatgataaacggagtagttaaactattaacaaagccatgggatgtagtaccaacagtaacgcagatggctatgacagacacaacgccttttgggcaacaacgggtatttaaagagaaagttgatacaagaactcctagacctatgccaggaacacgaaaagtaatggagatcacagccgaatggctatggagaactttaggccgcaataaacgaccacgcttgtgtactcgggaagagtttaccaagaaagtacgtacgaatgctgctatgggtgcagtatttactgaagaaaaccaatgggacagtgctagagcagctgttgaagacgaagagttctggaaattagtagatcgggaacgtgaactacacaaattaggaaaatgcggctcgtgcgtatataatatgatggggaaaagggagaagaaacttggggaatttggtaaagctaaaggatcgagagcaatctggtacatgtggctgggagcaaggtacttagagtttgaggcattgggatttctaaatgaagatcattggttcagccgggaaaactcatattctggagtggagggagagggtttacataagctagggtacatcctcagagatataagtaaaactccaggcggagctatgtatgccgacgacactgcgggatgggacacgcgaattaccgaggacgatttacacaacgaggagaaaattactcaacagatggatcccgaacataggcaattagctaatgctatttttaaattaacctatcaaaacaaggtagtaaaggttcagcgtcctacaccaaagggaacggttatggacattataagccgcaaagaccaaagaggtagcggtcaggtcggcacttatggtcttaacacgtttacaaatatggaggcacaactcataagacagatggagggagaaggagttttatcaaaagcagatctggaaaatccccatttacccgagaagaaaatcacccaatggcttgagactaagggcgtggagcgacttaaaagaatggccattagcggcgatgactgcgtggtcaagccgattgatgataggtttgcgaatgctttattagcattaaacgatatgggaaaggtaagaaaagatatacctcaatggcaaccgtcaaagggatggcatgattggcaacaggtacccttctgctctcatcacttccatgaacttataatgaaagatggccgaaagttggtagtcccatgcagaccacaagacgaattaatcggtcgagcaaggatatcccaaggggctggctggtcacttaaagagacagcctgtttgggcaaggcatatgcacaaatgtggtcattaatgtacttccatcggagggatctgcgactggcttctaatgcaatttgctccgcagtaccagtacactgggttccgacgtcgagaacgacttggagcatacatgcccaccaccagtggatgacgactgaagatatgttaactgtatggaacagagtgtggatcgaggacaatccatggatggaggacaaaactccagttacaacatgggaagacgtaccatatctcggcaaacgggaagaccaatggtgtggcagcttaataggacttaccagtagagcgacatgggcacaaaatattttaaccgcaattcagcaagttagaagtttgatcggaaacgaagagttccttgattacatgccatccatgaaacgattcagaaaagaagaagaatcggagggagctatatggtaa

SEQ ID NO: 23570 - RNA, 9873 nt, synthetic construct
  misc_feature 1..9873: note = derived and/or modified CDS sequence (opt6) from DENV-3__DQ675521__SS-prME
  source 1..9873: mol_type = other RNA
acctcattttgtctgatgatgatgctacccgctactctagcattccacctaacatctagagatggagaaccaaggatgattgtaggcaaaaatgaaaggggtaaatcgctcctatttaaaacggcctcaggaatcaacatgtgtacgttaatcgcgatggatcttggtgaaatgtgtgacgatacagttacctataaatgtccactgattgcagaggttgagccagaagacatagattgctggtgtaatctaacatctacatgggtgacttacggaacatgtaatcaagctggcgaacatcgacgagacaaaaggtcagtggctttggcacctcatgtaggcatgggcttggatacccggacacaaacttggatgagtgcagaaggtgcttggaggcaagtagagaaagtagaaacctgggcgttgagacacccgggctttacaattctcgcgctatttctagcacattacataggaacttcacttacgcaaaaagtggtaatatttatcctattgatgctagtgaccccgtctatgacaatgcgttgtgtcggtgtaggcaacagagatttcgttgaaggtctctcaggtgcaacctgggtagacgtggtactcgaacatggcggatgtgtgactacaatggcaaaaaacaaaccaacgttagacatagaattacagaaaacggaggccacccaactagccacattacgaaaattatgcatagaaggtaagattaccaatataactactgatagtcggtgccctacacaaggagaagcaatactaccggaagagcaggaccaaaattacgtatgtaaacatacgtatgtagatagaggctggggtaatggctgtggactgtttggcaaaggtagtttggtaacttgtgcaaaattccaatgtctcgaacctatagaagggaaggtcgtacaatacgaaaatctaaagtatacagttattataacagttcatactggcgatcaacatcaggtaggtaacgatacgcagggggtaacggtagagattactccacaggccagcactgtagaagcagtactccctgaatacggaacattaggcctagaatgcagtccaagaacaggattagattttaatgagatgatattgctgactatgaaaaacaaagcttggatggttcatagacaatggttctttgacctaccattgccatggacgagcggcgctactacggaaacccctacgtggaacaggaaggaattactagtgacatttaagaatgcccacgcgaaaaaacaagaggtagtggtgcttggctcgcaagaaggagcgatgcacactgctctaacaggtgcaacagagatacaaaattcaggaggaacctcgatatttgcgggacatctgaaatgccgacttaagatggacaaactggagttaaaaggtatgagttacgcaatgtgcttaaacacatttgtattaaaaaaagaggtatctgaaacacaacacggaacaattttaataaaagtcgaatataaaggtgaggatgcaccctgtaaaataccatttagtaccgaagatgggcaaggcaaagcgcataatggtcgattaatcacagcaaatccagtagtgacaaagaaagaagaacccgtaaatatagaagctgaaccaccctttggagagagtaacatcgtaataggaataggtgataaggctttaaagatcaattggtataagaaaggaagcagcataggtaaaatgttcgaagctacagcacgaggagcacgaaggatggcaatattgggggatacagcgtgggattttggatcagtaggaggggtacttaactcactaggaaaaatggtacatcaaattttcggatctgcctacaccgccttattttcaggagtctcctggatcatgaaaattggtataggcgtgttattgacctggataggcttaaacagtaaaaacacgtcgatgagttttagttgcatagtaataggaataatcactttgtatttaggtgcagttgtacaagccgacatgggatgtgtaatcaactggaaaggtaaagagctaaaatgcggatcagggatatttgtcactaatgaagtacatacttggacagaacaatataaattccaagctgattcgccaaaaaggttagcgacggctatcgcaggagcatgggaaaacggagtctgcggaatacggagcacaacaaggatggaaaacttactttggaaacagattgcgaacgaactcaattatatactatgggaaaataacattaaactaacagtagtggtgggtgatatcatcggcgtgttagaacaaggaaaaagaaccctaacacctcaacctatggaattaaaatacagttggaagacttggggcaaagccaaaattgtcactgccgaaattcaaaactctagcttcataattgatggacccaatacaccggaatgcccctcagcttcccgcgcatggaatgtatgggaagtcgaagactatggatttggcgtttttacaacaaatatatggttaaagcttagggaaatgtatacacaaagctgcgatcataggctaatgagtgctgcaataaaagatgaacgtgccgtgcatgctgacatgggttattggatagaaagccaaaaaaacgggagttggaaactcgaaaaagcatcattcatcgaagttaaaacatgtacttggccgaaaagccacacattatggagcaatggggtattagagagtgatatgatcattcctaaatcgttagcaggcccgatatcgcagcataatcaccgtcctggatatcatactcaaacggcaggaccctggcacttaggtaaattggaactagatttcaattattgcgaaggaacaaccgtcgtaattactgaaaattgcggtactcgtggtccatcattgaggaccacaacagtatcgggcaaacttatccacgaatggtgttgcagaagttgtacattgccccctctgaggtatatgggagaagatggctgttggtacggaatggaaataaggcccataaacgaaaaagaagaaaacatggtcaaaagtttggtgagcgcgggttcaggaaaggttgacaatttcacaatgggagtattatgtcttgcgattctgtttgaagaagtaatgcgaggtaaatttggaaagaaacacatgatagttggagtattatttacttttgtgcttctcctatctggacaaattacgtggagggatatggcacatactcttataatgatcggctcaaacgcaagtgataggatgggaatgggagtaacttacctggctttaatagcgaccttcaaaatccagccttttttggcgttagggttcttcctcagaaaactaacttcgcgagaaaacctgctgctcggagtcggtctggcgatggcgactaccctccaactaccagaagatattgagcaaatggcgaacgggatagctttgggtttgatgacattgaagcttataacgcagttcgaaacttatcagctatggacagctctggtatcactgacctgctcaaataccatttttactttgacagtcgcatggagaacggctactttaatattagctggtgttagtctattaccgctgtgccagtcgagctccatgcggaaaaccgattggctcccgatgactgtagcggctatgggcgtccctccactcccactattcatattttcactaaaagacacacctaaaagaagaagctggccgcttaatgagggtgtaatggcagtcggtctagtgtctatccttgcatcatctttgttacgaaacgacgttccgatggcaggccccttggtagcgggaggactactaattgcgtgttatgtcataacaggaacttcagcggaccttacagtagaaaaagcagccgatgtgacatgggaggaagaggcggaacagacgggagtgtcacataatttgatgataactgttgacgacgatgggaccatgaggatcaaggatgacgagactgaaaatattttaactgtactcttgaaaactgcactcttaatcgtaagcggaatatttccctatagtataccggcaactctcctcgtatggcatacatggcaaaaacagacccagagaagtggagtgttatgggacgtaccatcgccgcctgaaacacaaaaagcggaactagaagagggggtgtacagaatcaagcagcaggggatttttggaaaaactcaagtcggcgtgggggtacaaaaggagggtgtatttcatacaatgtggcatgtcactagaggcgcagtattaacccataatggaaaaaggctagaacctaattgggcttccgtaaaaaaagatctaatcagctatggaggcggatggcgactaagtgcacaatggcagaaaggagaagaggtgcaggtgattgcggtggaaccgggtaaaaatcccaaaaactttcagacaatgcctggtatattccaaaccaccactggtgagattggcgctatcgcactagacttcaaaccaggaacatcaggatcacctatcattaacagagaagggaaagtagttggtttatatggtaatggagtggtaacaaaaaacggagggtacgttagtgggatagcgcaaacaaatgctgaaccagacggaccaacaccagaactagaggaggagatgttcaagaaaagaaatctgaccataatggatttgcaccccggaagcgggaaaactcggaagtatctcccagcaatagtcagggaagcgataaagaggcgactgcgaacactaatattagcacctacgagagttgttgcagcggaaatggaagaagcactaaaaggcttaccaattaggtaccaaacgactgcaactaaaagcgagcatacagggagagaaattgtagatttgatgtgtcatgcaaccttcaccatgagactattatcacctgtacgagttcccaattacaacctcataattatggacgaggctcactttactgacccagctagtattgcggcaagaggctatatatcgacaagggtgggtatgggagaggcagccgcaatcttcatgactgcaactccgcctggaaccgctgaagcatttccgcaatcaaatgctccaatccaagatgaagagcgagacattccagaaaggtcatggaattccggaaatgaatggattacagacttcgtaggaaaaaccgtttggttcgtcccatcaataaaagcagggaacgacatagcaaattgtttgcgaaaaaatggtaaaaaagtgatccagctaagtagaaaaacgtttgatactgaatatcaaaagactcgactgaatgactgggatttcgttgtaaccacggacatttccgagatgggagcaaactttagagcagacagggtgatagaccctaggcgatgcttaaaacccgttattcttacagatggccccgagagagtcattttagctggaccaatgccggtaacagctgcttcagcagcacaaagaagaggacgcgtaggaagaaacccgcagaaagaaaacgatcaatacattttcacgggacagccactcaataatgatgaagatcacgctcattggactgaagcaaagatgctactagataatatcaatactccagaaggtataatacctgctttatttgaaccagaacgtgaaaaaagtgccgctatagacggtgaataccgcttaaaaggggaatcgcggaagacctttgtagaattaatgagacgtggagacttaccagtatggctagcgcacaaagttgcatccgaggggataaaatacactgacaggaagtggtgttttgatggagaacgaaacaaccaaatcctagaagaaaatatggatgtggaaatttggactaaagaaggagaacgaaagaaattgaggccacggtggttagatgcacgtacatattcagacccactggcccttaaagagtttaaagattttgcggcaggaaggaaatccattgcattagatctagtcacagaaattggtagagttccgagccacttagcccacagaacacgaaatgcactagataatttagttatgctacatacgtcggaacatggcggtagagcgtatcgtcacgcagtagaagaactaccagagaccatggaaacgttgttattacttgggttaatgattctgcttactggcggcgcaatgttattcttaatatcaggcaagggaataggcaagacatcgatcggcttaatatgtgttatagtaagttcaggaatgctatggatggccgatgtaccattacaatggatagcgtcagcgatagtactcgaatttttcatgatggtactcctgatccccgaacctgaaaagcaaagaactcctcaggataaccaactggcctatgtcgttattggtattttgactctagctgcaatagtcgccgccaacgaaatggggctcctggaaactacgaaacgagacctaggtatgtctaaagaaccaggtgtcgtaagccctacaagctatcttgatgtcgatctgcatccagcgtcagcatggactttatacgcggtagcaacgacagtgatcacgcctatgttaagacatactatagaaaactctaccgccaacgtgtccctagccgcaatcgccaaccaggccgtagttttgatgggattggataaaggatggcctataagcaaaatggacctgggagtaccattattagccttaggttgctatagtcaggttaatcccctcacactcactgctgcggttctcttattagtaacgcattatgctataatcgggccaggattacaagcaaaagcaacccgggaagcacagaaacggactgcagcgggtatcatgaaaaatccaactgtcgatggaataatgactatagatctggatccggtaatatatgactcgaaattcgaaaaacaactaggacaagtaatgttactagtattatgtgcggtacaactcttactcatgagaacgtcttgggcactatgtgaagcattgacccttgccaccggtccaataaccacgctctgggagggaagccctggaaaattctggaacacaacaatagccgtttcaatggcgaatatatttcgcggaagctacctagcaggcgctggacttgctttttctataatgaagagcgtaggcacaggaagaagaggtacgggaagccaaggagaaaccctaggcgaaaaatggaagaaaaaactaaatcaattgagtagaaaagaattcgatttatataaaaaaagtggtattacagaagtcgaccgtacagaagccaaagaaggattgaaacgtggtgaaacaacacatcatgcggtgtccagaggaagtgcaaagcttcaatggtttgtagaacgtaatatggttatccctgaaggacgtgtcatcgatttagggtgtggacggggaggatggtcatattactgtgcaggtttaaaaaaagttacggaagttagaggatatacaaaaggaggaccaggccatgaggaacctgtaccaatgagcacctatggttggaacatagttaagctaatgtccggaaaagatgtgttttacttaccacccgagaaatgtgatacactattatgtgatatcggtgaatcctctcccagcccaacagtggaagagagtaggacaattagggtcttgaaaatggttgagccatggctgaagaacaaccagttttgtataaaagtcctaaatccttatatgcctacggtaatagagcatctagaaaggttacaaagaaaatatggaggaatgctagtgagaaaccccctttctcgaaatagcacgcatgaaatgtattggatatccaacggaaccggaaatatagttagctcagtaaatatggtatctcgtttgcttctgaatcgattcactatgactcaccgaaggccaacgatcgagaaggacgttgacttaggagctggcacaaggcatgttaatgccgaaccagagacgccgaatatggacgtaataggggaaaggataaaacgcatcaaagaagaacattcttcaacttggcattacgacgatgaaaatccttacaagacatgggcttaccatggatcctacgaagtcaaagccacaggttcagctagtagtatgattaacggggtcgtcaaattgttgacgaagccgtgggatgtagtcccaatggtaactcaaatggcaatgacagatactactcctttcggacaacagagagtattcaaagagaaagtagatactaggacaccacggccaatgccaggaacccgaaaagttatggagataaccgcggaatggctgtggagaacgctggggagaaataaaaaaccaagactatgtacgagggaagaattcacgaaaaaagtaagaacaaatgctgccatgggagcagtatttacagaggagaaccagtgggactctgcgagagcggcagtcgaagatgaagagttttggaaactagtagaccgagaaagggaactacacaaactgggaaaatgtggttcgtgtgtttataatatgatgggcaaacgggaaaaaaaacttggagagttcggaaaagcaaaaggatctcgcgcaatctggtatatgtggttaggtgctagatatttagaatttgaggcactaggatttctaaacgaggaccactggttctcgcgtgaaaatagctattcaggagtagaaggtgaaggtctacataagttgggttatattttgcgtgatatcagtaaaataccaggtggagccatgtacgcagacgatactgccgggtgggacacacgcataacggaggatgatttacataatgaagagaaaataacgcaacagatggacccagagcacaggcaattggcaagcgcaatattcaaattgacttatcagaacaaagtagtcaaagttcaaaggccaactcccaaagggacagttatggatatcatttccagaaaagaccaaagaggaagtggtcaagtaggtacctacggattaaacacatttacgaatatggaggctcaactcgtacgacagatggaaggcgaaggagtattatccaaagcagaccttgagaatcctcatttactagaaaagaaaattacccaatggttagaaaccaagggtgtagaacggctgaaaaggatggctatatcaggagatgattgtgtagtaaaaccaatagatgaccgattcgctaatgctttactagctttaaacgatatgggaaaagttcgtaaagacattccgcagtggcaaccctctaaaggatggcacgactggcaacaggtacccttttgctcgcaccattttcatgaattaattatgaaggatggacgcaagttagtagtcccatgcaggccccaagatgaactaatcggcagagcccggataagtcagggtgcaggttggagcttgaaagagactgcttgtctaggcaaggcgtacgctcagatgtggtccttaatgtattttcatcggcgcgacctaagacttgccagtaatgcgatatgctcagctgtcccagttcactgggtccctactagccgtacaacgtggagtattcacgcacaccaccagtggatgactactgaagatatgctcacagtatggaatagagtatggattgaggataatccatggatggaagacaagacacctgtaactacttgggaagacgtaccatacttgggcaaacgagaagaccagtggtgcggctctctaattggccttacatcaagggccacttgggcgcaaaacatactcacagccatccaacaggtgagatcactgataggagatgaggaatttctagactatatgccatccatgaagcgatttagaaaagaagaagaaagcgaaggggcgatttggtaa

SEQ ID NO: 23571 - RNA, 9873 nt, synthetic construct
  misc_feature 1..9873: note = derived and/or modified CDS sequence (opt6) from DENV-3__DQ675522__SS-prME
  source 1..9873: mol_type = other RNA
acgtcattttgtctaatgatgatgctgccggcaactcttgcgttccatttaacaagcagagacggtgaacctaggatgatcgttgggaaaaatgaaagggggaaatctctactgtttaaaacggcatcagggataaatatgtgtaccttaatcgcaatggacctaggagaaatgtgcgacgacaccgtcacttataaatgccctttaatagcagaggttgaacccgaggacattgattgctggtgtaacctaacaagcacatgggtaacttacggcacatgtaatcaagcgggtgagcatcgaagagataaacgtagcgtggcgcttgcaccacatgtaggaatgggcttagatactaggactcaaacctggatgtccgcggagggagcttggagacaggtcgaaaaagtagaaacatgggctctcaggcacccgggcttcactatcctagcgttgttcctagcacattatataggtacctcactaacccaaaaagtagtaatatttatattactaatgttagtaaccccctcaatgacaatgcgatgtgtaggcgttggcaatagagacttcgtcgaaggattgtcaggagcaacatgggttgacgtagtattagaacacggtggatgtgtgacgactatggctaaaaacaaacctacactcgacatagaactacagaaaaccgaagccacacaattagcaacactacgaaaattatgcatagaaggtaaaataactaatattacaaccgacagtaggtgccctacacagggcgaagctattttaccagaagaacaagatcagaattacgtatgcaaacacacatacgtggatcgaggatgggggaacggatgcggactattcggaaaaggaagcctagttacatgtgctaaattccaatgcctagagccgatcgaaggaaaagttgtccaatacgaaaacttaaaatacactgtaattataactgtacacacaggagaccaacatcaggttggcaacgatactcagggagtgacagtagaaataacaccgcaagcatctacagttgaagccgtattaccagagtatggtacattgggcctcgaatgcagtccgagaaccgggttggactttaatgaaatgattttgttaacaatgaaaaataaagcctggatggtacatcgacaatggttctttgacttacccttgccctggacaagtggcgcaacaactgaaacacccacatggaacaggaaagaattgttagtaacgttcaaaaacgcccatgcaaagaaacaagaagtcgtcgtcctcggtagccaagaaggagccatgcacactgctcttaccggagcaaccgaaatacaaaattcgggaggcacaagtatcttcgcgggtcacttaaaatgtagactaaaaatggataaattagaactaaaaggcatgagttatgctatgtgtttaaatacctttgttttgaagaaagaagtaagtgagacgcaacatggtacaatcctaataaaagtagaatacaaaggagaagatgcgccatgcaaaattccattttcgactgaagacgggcaaggaaaggcacacaacggacgcttaataaccgccaatccagtagtgaccaagaaagaagaacctgttaatatagaagccgaacctccttttggtgaaagcaacatagtaataggcataggagataaggcgttaaagataaattggtataagaaaggttcatcgataggtaagatgtttgaagcaactgcccgaggcgcaagaagaatggccattttaggagatacagcttgggattttggtagcgtcggtggggttttaaatagtctaggaaaaatggttcatcaaatctttggaagtgcgtacacggccctcttttcaggagtatcgtggataatgaaaattgggataggagttttattaacatggatcggacttaatagcaaaaatacatcgatgagtttctcttgtattgttattgggatcattaccttgtatctaggcgctgttgttcaagccgacatgggatgtgtgataaattggaagggaaaagaactcaaatgtggaagcggaattttcgtaacaaatgaggtccacacgtggactgaacagtacaaattccaagctgactcgccaaaaagactagcaacagctattgcaggggcatgggaaaatggagtatgtggcatcagaagtaccacgagaatggagaatctgttgtggaaacaaatagctaatgagcttaattacatactatgggagaataacattaaattgaccgtagtcgtcggagatataatcggggttcttgaacaggggaaaaggacgctaacaccacagccgatggagttaaaatattcatggaagacctggggaaaagcaaaaatagtgacagcggaaatacaaaactcctcatttataattgatggccctaatactcctgaatgtccttcagcaagcagggcttggaatgtctgggaggtagaagattatggatttggagtcttcacaacgaatatttggttgaagctacgcgaaatgtatacacaatcgtgtgatcatcgacttatgtccgccgcaataaaagatgaaagagctgttcatgcagacatgggatattggatcgagtctcagaaaaacggttcatggaaactagaaaaggcttcattcatagaggtaaaaacctgtacatggcctaaatcacacactttatggtctaatggcgtgcttgaaagtgatatgattattccgaaatcactcgcaggacctatatctcaacacaaccatagacctggttatcatactcaaaccgcaggcccatggcacttaggaaaactagaattagatttcaattattgtgaaggcaccactgtagttataaccgagaactgtggtactaggggcccttcactcagaacaacaacggttagtggcaaattgatacatgagtggtgctgtcgatcctgcactctacctccgcttcgatatatgggagaggacggttgctggtatggaatggaaataagaccaatcaacgaaaaagaagaaaatatggttaagagcttagtttcagcaggaagcggtaaagtcgacaactttactatgggagtactctgtttagcaatcctttttgaagaggtaatgcgaggtaaattcggcaagaaacatatgattgtaggagttttgttcacgttcgtgttattattgagcggtcaaataacttggcgagacatggcacacacgctaataatgataggaagtaacgcttccgaccgtatgggtatgggcgtgacctatcttgcactcattgcaacattcaaaatacaaccgttcttggcactcggattcttcctaagaaaattaacgtcaagagaaaatcttctgctaggtgtaggtctggcgatggcaactacactacaattgccagaagacatcgaacaaatggcgaatggaatagcactaggcttgatgacattaaaactcataacacaatttgaaacttatcaattatggacagcgttagtatctcttacgtgttctaatacaatcttcacactcacagttgcatggagaacagcaactctaatcttagctggagtttcacttcttcccctgtgtcaaagctcaagcatgcgtaaaactgattggctgccaatgaccgtagcagccatgggagtacccccacttcctttatttatattcagcctaaaagatactcctaaaagaaggagttggcccttaaacgaaggcgttatggctgtaggcttagtttctatactcgcgagcagtcttttgcgcaatgatgtacctatggccgggccccttgttgccggaggtctactaatagcgtgttacgtcattacaggaacgtccgcagacctcactgtcgaaaaagcagcagatgtcacttgggaagaggaagccgaacagacaggcgtatcacacaacctaatgatcaccgtggacgatgacggtaccatgagaataaaagacgatgaaacggagaatatactgaccgttcttttaaaaacagctctcttaattgtatccggaatttttccatattcgatccctgccactctattagtttggcacacctggcaaaagcaaactcaacgatcaggagtattgtgggatgtaccgagtccccctgagactcaaaaagctgaactcgaggaaggagtgtatcgtattaaacaacaaggtatttttggaaaaacccaagtcggagtgggagttcaaaaagaaggtgttttccacacgatgtggcatgttacgcgtggcgcagtcctcacccacaacgggaaacgcctcgagccgaattgggctagcgtgaagaaagacctaatatcatatggaggtggctggagattaagtgctcagtggcagaagggagaagaagtccaagtaatcgcggtagaacccggaaagaatccgaagaatttccaaacaatgccaggcattttccaaactaccacaggagaaataggagcaatagcattggattttaaaccaggaacttctggtagtcctattataaatcgcgaaggcaaagtagtaggattgtacggtaatggagtagtaactaaaaatggaggatatgtgtcagggatcgctcaaactaatgcagaaccagacggtcccactccggaattggaggaagaaatgttcaagaaaagaaacttgacaattatggaccttcatccaggttccggcaaaaccagaaaataccttccagctatcgtcagagaagcgataaaaagaagactgcgaacgctaatattggctcccactcgagttgtagccgcggaaatggaagaagccctaaaaggtttaccgatcagataccaaactactgctacaaaatctgaacatacagggagagagatagtagatttaatgtgtcatgcaacatttacaatgaggttattaagtcctgttcgcgtacctaattacaatctaataatcatggatgaggcacattttactgatcctgcgagtatagccgctcgagggtatataagtacaagagtcggtatgggagaagcagcagcgatctttatgacagctacccctccaggaacggcggaagcattcccgcaaagcaatgcaccgatccaagatgaagaaagagatatacccgaacgatcttggaactccggaaatgaatggataaccgacttcgttggaaaaacagtatggtttgttccgtcgattaaagcaggaaatgacatagcaaattgcctaaggaaaaacggtaagaaagtaatacagttatcccgtaaaactttcgacactgagtatcagaaaactcgacttaatgactgggattttgtagtgaccactgacattagtgaaatgggagctaatttcaaagccgaccgtgtcatagatcctaggcgatgtttaaaaccggtcatattgacggacggtccagagagggtaatactcgcaggaccaatgccggtaacagcagctagtgccgcacaaaggcgcgggcgggtaggaagaaatccacaaaaagaaaatgaccaatacatatttacgggtcaaccccttaacaatgatgaagatcacgcccattggactgaagctaaaatgctattagataacataaacacacctgaaggtattattcccgctctattcgagccagaacgagagaaaagtgcagctatagatggggagtaccgcttaaaaggagaatcgagaaaaacattcgtagagcttatgcggaggggtgatctacctgtgtggctggcacacaaagtagctagtgaagggataaagtatactgatagaaaatggtgcttcgatggtgaaagaaacaaccagatactagaagaaaatatggacgtagaaatatggacaaaagaaggcgagagaaagaaattgagacctcgatggttggacgctagaacatactcagatccgttagcattgaaagaatttaaagactttgcagccggaagaaaaagcatagcacttgaccttgtaacagagattggacgagtccctagccatcttgcccatcgtacccgaaatgctctcgataacttagtaatgttacatacatccgaacatggagggagggcatacagacatgcagtggaagaattgccggaaacgatggaaacattacttctacttggtcttatgattttattaactggtggcgcgatgctatttttaataagtggaaaaggtattggcaaaacgagtatcggattaatttgcgttatagtcagttcgggtatgctatggatggctgatgttcctttgcagtggattgccagcgctattgtactagagttcttcatgatggttctactgataccggaaccggaaaaacaaagaactccccaagacaaccagttagcatacgtagtgattggcatattgactctagcggctatagtagctgcgaacgaaatgggacttttagaaaccacgaaacgcgacctgggtatgtccaaagagcctggtgtggtgagcccaacttcctatttagatgtcgatttacaccctgcgtctgcctggactctatacgcagtagccaccacggtaataacaccaatgttacgacatactatagaaaactcgacagccaatgtgtcactggccgccattgctaatcaggcagtggtcctcatgggtttagataagggttggcctatttccaaaatggatctaggcgtccctctcctcgccttgggttgttattcccaagtcaatccattaacactaacggctgcagtacttctcctagtgacacattacgccattattggaccggggttacaagcgaaagccactagagaagcccaaaagagaacggcagcgggtattatgaaaaatccaacagttgacggcattatgacaatagatttagatccagtaatatatgattcaaagtttgaaaaacagctcggacaagtaatgctacttgtattatgtgcggttcaactactgttaatgcgaacctcgtgggcactatgtgaggctttaacattggcaacaggaccgattacaacattatgggaaggaagtccggggaaattttggaatacaactatagccgtgtctatggctaacattttcagaggatcatatctagccggtgctggactagctttctctataatgaaatcggtaggtacaggaagaagaggaacaggatcccaaggggaaaccttgggagagaaatggaagaagaaattaaatcaattatcaagaaaagaatttgatctatacaagaaatcaggaattactgaagtcgatcgtacagaggcaaaagaaggcttaaagagaggggaaactacgcatcacgccgtatctaggggttctgcaaaattacaatggtttgttgaaaggaacatggttattccggaaggtcgtgttattgatctcggttgcggtagaggtggttggtcttactactgtgcaggcctaaagaaagttacagaagtacggggatacacaaaagggggaccgggtcacgaggaaccagtacccatgagcacctacggttggaacattgtcaaattaatgtcgggcaaagacgtgttctatctccctccagaaaagtgtgatacattattgtgcgatataggagagtcaagtccaagccctacagttgaagaatcccgcacaataagagtattaaagatggtggaaccatggctcaaaaataaccaattttgtattaaagtcctaaatccatacatgcctactgttatcgaacacctagagcgattacaaagaaaatacggaggaatgctagttcgtaacccattgtccagaaattcaacacatgaaatgtactggataagcaatggcacaggaaatattgtttcgtcagtgaatatggtttcccgactattgcttaacagattcactatgacacaccgtaggcccactattgaaaaagatgtagaccttggtgcaggaacccgccatgtaaacgcagaacctgaaacccctaatatggatgtcatcggagaaaggataaaaagaataaaagaggaacattcatcaacatggcactatgatgacgaaaacccatacaaaacatgggcctatcacggatcatacgaggtcaaagctactggcagcgctagtagtatgataaatggcgttgtaaaattattaactaaaccatgggatgtggtccctatggtaacacaaatggccatgacagatacaacaccgtttggccaacagcgagtttttaaagaaaaagtagatacacggacaccacgtccaatgccgggaacacgtaaagttatggaaattactgcagaatggttatggaggactctcggacgtaacaagaaacccagattgtgtacacgggaggagttcacgaaaaaggtccgcacaaatgcagcaatgggcgccgtatttacagaggaaaaccagtgggacagtgcacgagcagccgttgaggacgaggaattttggaaactcgtagatagagaaagagagctgcataagttgggaaagtgtggatcttgcgtctacaacatgatggggaaaagagaaaagaaattaggagagttcgggaaggccaaaggctcgagagctatttggtatatgtggctaggagccaggtacctcgaatttgaagcactaggattcttaaatgaagatcactggttttctcgagagaactcttactcaggcgtcgagggagaaggtctgcataaattaggatatattctcagagatattagtaaaattccgggtggtgcaatgtatgccgatgataccgctggatgggacacaaggataactgaggatgatttgcataatgaagagaaaatcacacaacaaatggaccccgagcatagacaactcgcctcagcgatatttaaattaacgtatcaaaataaggtcgtgaaagttcagagaccaactcctaagggcacggtcatggacataatttcgaggaaggaccaaagaggttcaggccaagtaggcacctatggattaaacactttcacgaatatggaagcgcaattagtaagacaaatggagggagaaggagtgcttagcaaagcagatctggagaatcctcatctgttagagaagaaaattacacaatggctcgaaacgaaaggagtggagcggctgaagcgcatggcaatttctggtgacgattgtgtagttaaacccatagacgatcgctttgcaaatgcactactagctctaaacgacatggggaaagtcagaaaggatataccccaatggcaaccatccaagggatggcacgactggcaacaagtgccgttctgcagccatcactttcatgaattaataatgaaagatggtagaaaattagtcgtaccatgtcgccctcaagatgagttaatcggacgggcgcgaatttcacaaggcgcaggatggtccctgaaagaaacagcatgcctcggtaaagcatatgcacaaatgtggagtctaatgtattttcacaggcgagacttaagacttgcctcaaatgcaatatgcagtgcagtacccgtacattgggtccccacaagtcgtacgacatggagtatacatgctcaccaccagtggatgacgactgaagatatgcttacggtgtggaatagagtttggattgaggataatccttggatggaggacaaaactccagtaacgacatgggaggatgttccatacttgggaaagcgtgaagatcaatggtgcgggtcactcataggcctgacttcgagggcaacatgggcccaaaacattcttacagctatccaacaagttagatcgttaataggagacgaagagttcttagattacatgccatcaatgaaaagatttagaaaggaagaagaaagtgaaggggcaatttggtga

SEQ ID NO: 23572 - RNA, 9873 nt, synthetic construct
  misc_feature 1..9873: note = derived and/or modified CDS sequence (opt6) from DENV-3__DQ675527__SS-prME
  source 1..9873: mol_type = other RNA
actagcttttgcctaatgatgatgcttccagcaacactcgcattccacttgacttcgagggacggtgaaccaaggatgatagtaggcaaaaacgaacggggtaaatctcttttgtttaaaactgcctcaggaatcaatatgtgtacccttattgcaatggacctgggagaaatgtgtgatgatactgtcacttacaaatgcccattaattgccgaagtagagccagaagacatcgactgctggtgtaacttaacctctacttgggttacatatggcacatgcaatcaagcaggagaacatcggagagataaaaggtctgtagcactagcgccacacgttggaatgggtctagacacaaggacacaaacgtggatgagtgccgaaggggcatggagacaagttgaaaaagtcgaaacttgggcgttaaggcacccaggttttactatactcgctctatttttggcacactacatcgggacaagtctcacacaaaaagtcgtaatctttatattactaatgcttgttaccccaagcatgaccatgagatgtgttggggtgggaaatcgagattttgtagaaggactcagtggggcgacgtgggtggatgtagtgctagaacatggaggatgcgtaacaacaatggcgaaaaacaaacctacccttgatatcgaattacagaaaacggaagcaactcaacttgcaactttaagaaaactatgcattgaagggaaaataaccaacattactaccgatagccgctgtcccacacagggagaagcaatacttccagaagaacaagaccagaattatgtgtgtaaacatacttatgttgatcgcggatggggtaatggatgtggactattcggtaaaggtagccttgtcacttgcgctaaattccagtgcctagaacccatagaaggaaaagtcgtacagtatgaaaatttaaaatacacggtcatcataacagtgcacacaggtgaccaacatcaggtcggaaatgatactcagggagtaactgtcgaaataacacctcaggcaagcaccgtggaagcggtattacctgaatacggtaccctcggactagaatgctcaccaagaaccggattggatttcaacgagatgattctactaactatgaaaaataaggcttggatggtacatcgtcagtggttctttgatctgccgcttccatggacaagtggggcaacaaccgaaacacctacttggaataggaaagaattactcgttacattcaaaaatgcacacgccaaaaagcaagaagttgtagtattaggctcacaagaaggagcaatgcacacggcactcacgggggctactgaaatacaaaattctgggggtacaagcatttttgcaggtcatttgaagtgtcgattgaaaatggacaaactcgagttaaagggaatgtcatatgcaatgtgtctaaacacattcgtcctaaagaaggaagtttctgaaactcaacatggcacgattctcataaaagttgaatacaaaggtgaagatgctccctgtaaaatcccattctctacagaagatggacaaggaaaagcgcacaatggaagactaattacagctaatccagtagtgactaagaaggaagaaccagtaaatatagaagcagaacctcccttcggagaatcgaatatagttataggtataggagataaagctctaaaaattaactggtataagaaaggaagcagtataggaaaaatgttcgaagcaacagccagaggagcgagaagaatggccattttaggcgacacagcatgggattttgggagtgtaggaggagttctaaactcgcttggcaagatggtacatcagatcttcggctcagcctacacagccttattctctggagtaagctggatcatgaaaataggtatcggtgtattgctaacatggataggtctaaattctaaaaatacttccatgagcttctcatgtattgtaatcgggatcattacattgtacctcggtgcggttgtacaagctgacatgggatgcgtaataaattggaagggcaaggaactaaaatgtggcagcggtatcttcgtgacaaacgaagtacacacatggacggaacaatataaattccaagcagacagtccaaaaaggctggcaacagcaatagccggggcctgggagaacggggtttgtggaataagatccactactagaatggaaaacttattatggaaacagatagctaatgaactgaattatatcctgtgggaaaataacataaaactcactgtagtagttggggatataatcggggtcctcgaacagggcaaacggacccttacaccacagcccatggaacttaagtactcttggaaaacctggggtaaagctaaaatagttacagctgagatccagaatagttcgtttataatagacgggccgaatactcccgaatgcccatcagcatctagagcatggaatgtctgggaggttgaggactacggatttggagtgttcacgacgaatatctggttaaaactaagagagatgtatacccagagttgtgaccacaggttgatgtcagcagccataaaggatgaacgcgcagtacacgcagacatgggatactggatcgagagccagaaaaatggctcgtggaaactagaaaaagcctcgtttattgaagtaaagacgtgtacgtggccaaaaagtcatacattatggagcaatggagttctcgaaagcgacatgatcataccaaagagtctagccggacccatatcacaacataatcataggccaggttatcatacacaaacggcaggtccgtggcatctcggtaaattagagctagatttcaactactgcgaaggcacaacagtcgtcataacagaaaactgtggaacaagaggtccttctctacgaacaacgacggtgtccggaaaattaatacatgagtggtgttgtcgatcatgtacactaccacccttacgatatatgggggaagatgggtgctggtacggaatggaaattcggcctataaacgaaaaggaagaaaacatggtgaaaagtttagttagcgccggatcaggaaaagttgacaattttaccatgggtgtactatgccttgcaatactttttgaggaagtaatgaggggaaaatttggcaagaaacatatgatcgtaggagtcctattcacatttgtactccttttaagcggtcaaataacttggagggatatggcacacacactaattatgatcggatctaatgcatcagacagaatgggtatgggagtaacatacttggcgcttattgcaacattcaaaattcagccattccttgcactgggcttctttctacgcaagctcaccagtagagaaaatcttttgctcggggtgggactggccatggctacgaccttacaactacctgaagacatagagcagatggcaaatgggatcgctttaggacttatgacgttaaagctcattacacaattcgaaacgtaccaactttggaccgctctagtaagtttaacctgctcgaatacaatattcactctaacagtggcctggaggaccgcaacattaattctagcaggcgtgtctctattaccactctgccaatcatcatctatgcgaaaaaccgactggctaccgatgactgtcgcagcgatgggagtgccaccacttcctctattcattttctccttaaaggatacaccgaaaagaaggagttggccactaaatgagggagtcatggcagtaggactcgtaagcatcttggcgagttcgctcttaagaaacgacgtacctatggctggacccttagttgccggtgggttactaattgcatgttatgtcataacaggaacgagcgctgatttgacggtagagaaagcagctgatgtaacttgggaagaagaagccgaacaaactggagttagtcataacctaatgataacagtagatgacgacggtactatgagaataaaagatgatgaaactgaaaatatcctgacagtcttactcaaaactgcactgttaattgtcagtggaatatttccttacagtataccagcaacattacttgtatggcacacgtggcagaagcaaacacagagatctggagtcctctgggatgttccctctccccctgagacacagaaagccgaattggaagaaggagtttatcggattaaacagcaaggaatctttggcaaaactcaagtaggggtgggcgtacaaaaagaaggggtttttcacactatgtggcacgtcactcgaggagctgtcttgacgcataacggtaaaagacttgaaccaaattgggcatccgtcaagaaagacctaatatcatacgggggtggatggagactttcagcccagtggcagaaaggggaagaagttcaagtgatcgccgtagaacctggtaaaaatccaaagaattttcaaacaatgccgggaatattccaaacaacaacaggagaaataggagctattgcgttagattttaaaccgggaactagcggctctcctatcattaatcgggaaggaaaagttgtagggctctatggtaacggagtagttacgaaaaatgggggatatgtaagtgggatagcacaaacaaacgcagaaccagatgggccgaccccagagttggaagaagaaatgtttaagaaaaggaatctaacaataatggacctccatccaggatcaggcaaaaccaggaaatacctacctgctatagtgcgcgaagctattaaaagaagattacgaacgcttattttagcacctacaagagttgtagcagcagagatggaagaggcccttaaaggactgccgataagatatcaaacaacagctaccaagtcggaacatactggtcgcgaaatcgtagacctaatgtgtcatgcaacctttaccatgcgcttgctgtcaccggtaagagttcccaattataatctgataataatggatgaagctcatttcacagatcctgcatctattgcagctcggggatatatatcaaccagagtaggaatgggagaagcagctgcaatattcatgacagcaaccccaccaggtacagcggaagcatttccgcagtctaatgcacccatccaagatgaagaacgagacatacctgaacgatcatggaacagtggtaatgaatggattacagatttcgtcggcaaaaccgtatggtttgtaccttcaataaaagctggaaacgacattgcaaactgtttaaggaaaaatggcaagaaagtgattcaactgtcccgcaaaacattcgatacggaatatcaaaagactcgactaaacgattgggattttgtagtcacaacagatatatcagaaatgggagcaaattttaaagcagatcgagtaatcgatccgcgtaggtgcttgaaaccagttatactaacagacggtcctgagcgtgtgatacttgctgggccaatgccagtaaccgcagctagtgcggctcagaggagaggacgtgtgggaagaaatccacaaaaggaaaatgaccaatatatcttcaccggacagccattaaataacgatgaagatcacgctcactggacagaagctaagatgttattggataatatcaacaccccagaaggaattatcccagcacttttcgaaccagagagggaaaaatccgcagcaatagatggagaatacagactcaaaggtgaaagtcggaaaacctttgtagagttaatgcgaagaggagacttaccagtttggctcgcgcataaggtagcatcagaaggaataaagtacacagaccgaaaatggtgttttgatggcgagagaattaaccagatattagaagagaatatggatgtagagatatggacaaaggaaggtgaacgtaaaaacttgagaccgaggtggttggatgctcgcacgtatagcgacccattagcattaaaagaatttaaagatttcgccgccggtagaaaatctattgcgttggacctcgtaacggaaataggtagagttccaagccatctagctcatcggactaggaacgcattagacaatctcgtcatgctgcatacaagtgaacatggaggacgagcataccggcatgcagtagaagaactacctgaaacaatggaaacactattgttactaggcttaatgatcttgctaacaggtggtgcaatgttattcctgatttctggaaaaggaatcgggaaaacaagtattggtcttatttgtgtaattgtaagtagcggaatgctctggatggcggatgttccactacagtggatagcctccgctatcgtccttgagttctttatgatggtgttgctaattcctgaaccagaaaagcagagaactcctcaagataatcaactagcatatgttgttattggaatcctaacgctcgcagcaatagtggcagctaatgaaatggggttacttgaaacgaccaagcgtgacctaggtatgtctaaggaacctggagtagtttcaccaacgtcatatttagatgttgatttacacccagctagtgcatggactttgtacgctgtcgccacgacagtgatcacgccgatgctgcgacatacgattgaaaacagcactgctaatgtatcgctagcggcaatcgccaatcaggctgttgtgctcatgggactagacaagggctggcctattagtaaaatggacttgggcgttccactgctagcactggggtgctattcacaagtgaatccgctgacgcttaccgcagccgtcctacttttagtaacccattacgcgatcatcggacctggcttgcaagctaaagctacacgcgaagcgcagaaacgaacagcggctggaattatgaaaaatccaactgtagacgggataatgacaattgatcttgaccctgtcatatacgactcaaaattcgagaaacaactcggccaagttatgctactcgttctttgtgccgtacaacttctattaatgagaacaagctgggctttatgtgaagcacttactctcgctactggtcctataacgactttgtgggagggatcgccaggcaaattttggaacacaacgattgcggtaagcatggctaatatattcagaggtagctatctggctggtgcgggcctagccttttcaataatgaaaagtgtaggaacaggtagacgagggaccggctcacagggggaaactctcggagaaaaatggaaaaagaaattgaatcaattatcccgtaaagaatttgacttatataaaaagtcggggataacggaggtagaccgaactgaagcaaaggaagggctgaaacgaggggaaactactcatcacgcagtcagtagaggatcagcaaaactgcaatggtttgttgaaagaaatatggttattccagaaggccgagtaattgatctagggtgtggccggggtggttggagctattactgtgcaggtctaaagaaagtaacggaggtaagaggatacacgaaaggagggccggggcacgaggaacctgtaccaatgtctacttatggctggaacatagtgaaattaatgagcggcaaagatgtcttttatctgccaccagaaaaatgcgacaccttattatgtgatattggtgaaagctctcctagtcctaccgtagaagagtcaagaacaatacgagtactaaaaatggtagaaccatggttgaagaacaatcaattttgtataaaagttttaaacccctatatgccaacagttattgaacatttagaaagacttcaacgaaaatatggaggtatgctcgtgagaaatccattaagcagaaattcaacacatgaaatgtattggatatctaatgggactggcaacatagtatcatcagtaaatatggtatccaggctcctattaaaccgattcacaatgactcataggcgtccaacaatagaaaaggacgtagacctaggagcaggcaccagacatgtgaatgccgaacccgaaacgcctaacatggatgtcataggggaacgtataaaaagaatcaaggaagaacattcatcgacatggcactacgatgatgagaatccgtacaaaacatgggcctatcacggtagctatgaagtaaaagcaactggatcagccagttcgatgataaatggggtggtaaagctgctaacaaaaccgtgggacgtagtccctatggtcacacaaatggcgatgacagacactacaccatttgggcagcaaagagttttcaaggaaaaagtagacaccaggactccgcgaccaatgccaggcacgagaaaggtaatggagatcacagcggaatggctgtggagaacattaggaagaaataaaaagcctcgtctatgtacccgagaagaatttactaagaaagttcgtacgaatgcggctatgggggctgtttttacggaagaaaatcaatgggacagcgcccgcgcagcagtggaagacgaagaattttggaaacttgttgatcgagagagggaattacataagttggggaaatgtggatcatgtgtatacaacatgatgggaaaacgagagaagaaattaggagaatttggtaaggcgaaaggatccagagcaatttggtatatgtggcttggagcaagatatttagaatttgaggccttgggattcctgaacgaagatcactggttttctcgtgagaactcatatagtggggtcgagggggagggcctccacaaattaggttacatcctccgtgacatatcaaagattccaggaggagcgatgtacgcggatgatacagcaggttgggatacaagaataactgaagatgatctccataacgaagagaaaattacgcagcaaatggacccagagcaccgacaattggccagtgctattttcaaacttacatatcaaaataaagtcgtgaaagtacaaaggccaactccaaaaggaactgttatggatattatctctcgcaaagatcaacgtggaagtggacaagttggcacctatggccttaacaccttcacaaatatggaagcacaattagtcaggcagatggagggagaaggggtcctctcaaaggcagatctggagaacccccacttacttgagaagaaaataactcagtggttagaaactaagggtgtcgaacgattaaaaaggatggctataagcggtgacgactgcgtggttaaaccaattgatgaccgttttgcaaacgccttgttagccctcaacgatatgggcaaagtaagaaaggatataccgcagtggcaaccaagcaaaggatggcacgattggcaacaggttccattttgtagtcaccattttcatgaactcataatgaaagacgggagaaaattagtcgtgccctgtcgacctcaagatgaactaataggcagagccagaatcagccaaggagcaggatggtctttgaaagaaactgcttgcctcggaaaagcgtacgcgcagatgtggtcacttatgtatttccatagacgtgacctcagactagcaagcaatgcgatttgctccgcagtgccagtacactgggtaccaacaagccgtacaacgtggtcaatacatgcgcaccaccaatggatgacaacagaagacatgttgacagtatggaatagagtgtggatcgaagataatccttggatggaagacaaaactcctgttacgacctgggaagatgtcccatatttaggaaaacgagaagatcaatggtgcgggtcattaatcggtcttacttcccgtgcgacatgggcacaaaacattttaactgcgatccaacaagttagatctcttataggagatgaggagttcctagactatatgcctagcatgaagaggtttagaaaagaggaagaatcggaaggagcaatttggtga

SEQ ID NO: 23573 - RNA, 9873 nt, synthetic construct
  misc_feature 1..9873: note = derived and/or modified CDS sequence (opt6) from DENV-3__DQ675528__SS-prME
  source 1..9873: mol_type = other RNA
acatccttctgtttaatgatgatgctaccggctacacttgcgttccatttaacttcacgagatggagagccgagaatgattgtgggcaagaatgaaaggggcaaatcgcttttattcaaaacagcaagtggaattaacatgtgtactttgatagcgatggatttaggagagatgtgtgatgacacagtaacctataaatgtcccttaatcgccgaggttgaaccagaagatatcgactgctggtgtaacttaacaagtacatgggtaacctatgggacatgcaaccaagcaggagaacatagacgagacaagcgttccgttgctttagcaccccacgtagggatgggcttagatacaagaactcaaacgtggatgagcgcagaaggggcttggcgacaagtagaaaaagttgagacatgggcattgagacatccaggatttacaatactcgcattattcctagctcactatattggaacctctctgacccaaaaagtagtaatttttatcctactaatgctagtaacccctagtatgacaatgaggtgcgtaggagtaggcaatcgtgatttcgtagagggattatcaggggccacttgggtcgacgtggtattggagcatggcggctgtgtgacaaccatggcaaaaaacaaacccactctagacatagagcttcaaaagacagaagctacccaactagcgacgctcagaaagttgtgtatagagggtaaaataacgaacatcacaacagattcaaggtgtcccacccaaggagaggccattctgcccgaagagcaagatcaaaattatgtatgtaaacatacctatgttgaccgaggttggggtaacgggtgcgggttgtttgggaaggggagtctagtcacttgtgcaaagtttcaatgtcttgagcccatagaggggaaagttgtacaatatgaaaatttaaaatacactgtaattataactgttcataccggggaccaacaccaagtaggtaacgatacccaaggtgttactgtcgaaattactccacaagccagtaccgtcgaagcggtactccccgaatacggaacactgggtttagaatgctccccgcgaacaggtttagactttaatgaaatgatacttctaacaatgaaaaataaggcctggatggttcatcgacagtggttctttgatctgcctcttccatggacatctggagcaacaactgaaactccaacctggaatcgaaaggagctactggtgacttttaaaaatgcgcacgctaagaaacaagaagtagtggtattaggatctcaagaaggagccatgcacacagtattgaccggcgctacagaaattcaaaattcggggggtaccagcattttcgctggtcatttaaagtgtcgattaaaaatggacaaactggagttaaaaggaatgagttatgcaatgtgtttaaatacattcgtactaaagaaagaagtctctgaaactcaacacggaacgatattaatcaaagtcgaatataagggtgaagatgccccatgtaagataccgttctcaactgaggatggccaaggcaaagcacataatggccgtctcattactgcaaatccagtagtcactaaaaaagaagaaccagtaaacatcgaggctgaacctccttttggggaatcaaatatcgtaataggaatcggagacaaagcattaaaaataaactggtataagaaaggatcatccattggcaaaatgttcgaagcgaccgcacggggagctagaaggatggcaatactcggtgatactgcatgggattttgggagtgttggtggggtactaaattctttgggtaaaatggttcaccaaatttttggatctgcttacacagcgctctttagtggagtaagttggatcatgaaaatcgggataggagtactattaacgtggataggtctgaacagtaaaaatacatctatgtccttttcatgcatagtcatcggcataatcactttatatctgggagctgtagtacaagctgacatgggttgcgtcataaactggaaaggaaaagagttaaagtgcggctcgggtatattcgtaactaatgaagttcatacatggacagaacaatacaagtttcaggcagactctccaaaaagactagcaactgccatagccggagcatgggaaaacggagtatgcggcataagaagtacgacccgaatggaaaatctattgtggaaacaaattgcaaatgaactaaactacatattatgggaaaataatatcaaactaacagtagtagttggtgatattattggtgtgttagaacaaggtaaacggacacttacaccacaaccaatggaattgaaatactcgtggaaaacgtggggaaaagccaagatcgtaaccgctgaaatacaaaattcttctttcataatagacggtccaaacacaccggagtgtcccagcgcaagtagagcatggaatgtatgggaagtagaagattacggcttcggagtttttacaaccaacatctggctcaaattacgtgaaatgtacacgcaatcctgcgatcacagattaatgagtgccgcaataaaggacgaacgagccgtacatgccgacatggggtattggatagaaagtcaaaaaaacggttcgtggaaactagagaaggctagttttatagaagtaaaaacatgtacatggcctaaaagtcacactctatggtcgaacggggtattagaaagtgatatgataatacctaaatcattagctggcccaattagtcagcataatcatagaccaggctatcatacccagaccgccggtccctggcacttaggaaaattggaactggattttaactactgcgagggcactacggttgtcattacagagaattgcggtaccagaggaccctcactacggactaccactgtaagtggaaaattaatccacgagtggtgttgtagatcatgcacgttgccacctctcaggtacatgggggaagatggatgttggtatgggatggaaataagaccaataaatgaaaaggaagaaaatatggtaaaatccctggtaagtgcaggtagcggtaaggtcgataacttcacaatgggagtactctgtttggctatcttattcgaggaagtcatgagaggtaaattcggaaaaaaacatatgatagtaggagtcctatttacgttcgttctcttattatcgggtcaaattacgtggagagatatggcccatacgttaatcatgattggaagtaatgcgagcgaccgaatgggaatgggagtaacttatctagctttgatagcaacgtttaagattcaaccattcctagccttaggtttcttcctaagaaagttaacctcacgggagaatctactattaggtgtaggattagcgatggcaaccactctacagctccccgaggatatagaacaaatggccaatggaatcgctttaggattaatgactctaaaattaatcacacaatttgaaacctaccaactatggactgctttggtctccctgacatgttctaatacaatatttaccctgacggttgcgtggcgaacagccacattaatactagcaggagtatccttattgccattatgccaatcaagttcaatgagaaagacagactggctcccgatgacagtagccgctatgggagttccgccattaccactattcattttttcgctgaaagacaccccgaaaagacgctcatggccattgaatgaaggagttatggcagtaggactggtaagtatactagcttccagtctattgcggaacgacgtacctatggccggacctcttgtagccggagggttactaatagcatgctatgtaatcacaggaacctcagcggatttaactgttgaaaaggcggctgatgttacctgggaggaagaggctgaacaaactggagttagtcataatttaatgatcaccgtagacgatgatggaacaatgagaataaaagatgatgagactgagaatatactaactgtattattaaaaaccgcgttattgatagttagcggaatctttccttacagcattccagccacactattagtgtggcacacatggcagaaacaaacacaaagatcgggcgtactgtgggacgtacccagcccacctgagacacaaaaagcagaactcgaggaaggagtataccgaataaaacagcaaggaattttcggaaaaacacaagtaggcgttggtgttcaaaaagaaggtgttttccatactatgtggcatgttacaagaggcgcagtcttgacgcataatggaaagagacttgagccaaactgggcaagtgtcaaaaaagatctcatatcatatggtggtgggtggagactatccgcacaatggcaaaaaggagaagaagtacaagttattgcggtcgagcctggaaaaaatcctaagaacttccagacaatgcccggtatcttccaaacaactactggagaaataggtgctatagctttagacttcaaaccaggcacatcgggcagccctattattaatagagaaggaaaagtagtcgggctatatggaaacggtgtagtgactaagaacggtggatacgtttcaggaattgcgcaaacaaatgcagagcctgatggtccaacaccagaacttgaagaagaaatgtttaaaaaaaggaatcttaccataatggatcttcatcctggatctggaaaaacacgcaagtatttacccgctattgttcgcgaagctataaaacgcagattgcgtacattaatcctcgcccccaccagagttgtggcagcagagatggaagaagcgctgaaaggattgccgattagataccaaactactgcgacgaaatcagaacatacaggcagggaaatagtggatctaatgtgccacgcgacctttaccatgcggttactgagccccgttagagtgcctaattataatctaataataatggacgaggcacattttacagatcctgctagtattgctgcacgtggatatatcagcacacgagtaggcatgggtgaagccgcggcgatttttatgacggcgacaccgcctggtaccgcagaagccttccctcaatctaacgccccaattcaagacgaagaaagagacatccctgaacgatcatggaactcaggaaatgaatggattacggatttcgtaggcaaaactgtttggtttgtaccttcgataaaagcaggcaatgatatcgcaaactgtttacgaaaaaacggcaagaaagtaatacaattaagtcgaaagacttttgatacagaatatcaaaaaacaagactaaacgactgggactttgtggttacaaccgatatctctgaaatgggggcaaattttaaagcagatcgtgtaattgacccccgaaggtgcttaaaacctgtaatcctgacagatggtccagaaagagtcatactggcaggtcccatgcctgtaacagcagcttccgcggcacaaaggcgtggccgagtagggaggaacccgcaaaaggaaaacgaccagtatatcttcactggtcaaccactaaataacgacgaagaccatgcacattggacagaagctaagatgcttctagataacattaatactcctgaaggcataatcccggcacttttcgagcccgaacgagaaaaatcagcggcaattgacggcgaataccgactaaagggtgaatctagaaaaacatttgttgagttaatgcggcgaggagatctacctgtatggttagcacataaagttgcatcagaagggataaaatatactgacaggaaatggtgtttcgacggtgaacgaaacaaccaaatattggaagagaatatggatgtcgaaatctggaccaaggagggagaaagaaaaaaactaagaccaaggtggttggatgcgaggacatattctgacccgctagctctaaaggaatttaaggactttgcagcgggaagaaaatcgattgcactcgatctggtgaccgaaatcggtagggttccgtcacatcttgcacaccggacccggaatgcactagataatcttgttatgctacatacctcggagcacggcggtcgagcttataggcacgctgtagaagagctacccgaaaccatggaaaccctgcttctactaggactgatgatcctgctgactggtggagctatgctattcctgatttcagggaaagggataggtaaaacgtcaattggattaatatgcgtaattgtaagctcgggcatgttgtggatggccgatgtgcctttgcaatggatagcctcagcaattgtcttagaatttttcatgatggtattacttattccagagccagaaaaacaaagaacaccacaagataaccaacttgcctatgtagtaatcggtatactaacactcgcagctatcgtagcagcaaacgaaatgggtctattagaaactacaaaaagggatcttggtatgtccaaagaacccggtgttgtctcaccaacgagttatttagacgttgacctccatccggcctcagcttggacgctgtatgcggttgcgacaacagtgattacacctatgttgcggcacaccatagaaaattcaacagctaacgtctcacttgcggcaatagctaatcaggctgtggtcctaatgggtctagataaaggatggccaatctctaaaatggatttaggggtaccattgcttgcactaggctgttacagtcaagtcaatcccctaacactaactgctgcagtattactactcgtaacacattacgccataataggcccaggtttgcaagctaaggcaaccagggaagcccaaaaacgaacagccgcgggtataatgaaaaatcctacagtagatggaataatgaccattgatctggatccagttatatatgacagcaaatttgaaaagcaattaggacaagtaatgctactagtgttatgcgctgtacaacttctacttatgagaacatcatgggctttatgtgaggcacttacccttgcgacggggcctataacaacactatgggaagggtctccaggaaaattttggaacaccacgattgctgtttctatggcgaatatatttcgtggatcatacttggcaggagcaggcttagcattctctattatgaaatccgtgggaactgggcgaagaggtactggatcccagggtgagacactaggagaaaaatggaaaaaaaagttgaaccaactcagtaggaaagagtttgacctatataaaaagtctggtattactgaagtggatagaacagaagcaaaagaaggcttgaaacggggagaaacgactcaccacgcagtcagcagaggaagcgcaaaactacaatggttcgttgagagaaacatggtcataccagaaggacgagtgatagacttagggtgcggtagaggtgggtggagctactactgcgcgggtctaaagaaagttacggaggttcgtggttatacaaaaggaggtcccggacatgaagagcctgtgccaatgtcaacttatgggtggaatatagtaaaacttatgtcagggaaggacgtattttatctcccgccagagaaatgcgacacactactctgcgatataggagagtcgtcaccctcaccaaccgtcgaagaaagccgtacaatacgcgtcctaaaaatggtcgaaccgtggctcaagaataaccaattttgtattaaggtcttaaacccatacatgccaactgtgattgaacatttggagagacttcaaagaaaatatggaggaatgttggtacgcaatccactctccagaaacagtacgcacgaaatgtattggattagtaatggaacaggcaacatcgttagtagcgtaaatatggtaagccggctattattgaataggttcacaatgacacatagaagaccgaccatagaaaaagatgtagatttaggtgctggtactcgccacgtgaacgcagagcctgaaacacctaatatggatgttataggtgaaaggataaaaagaattaaggaagaacacagttcgacatggcattatgatgatgaaaatccttacaaaacatgggcttatcacggaagttatgaagtgaaggcgacgggttcagccagttctatgataaacggggtggtaaaacttctaacgaaaccatgggacgtggtgccgatggtaactcaaatggcaatgactgacacaacacctttcggtcaacaacgcgtattcaaagagaaagtcgatacaagaaccccgcgaccgatgcccggtacgagaaaggtaatggaaataacagcggaatggctatggcggacgttaggtcggaataagaaaccgagattatgcacacgtgaggaatttactaaaaaagtgagaacaaatgcagcaatgggagcggtatttacagaagaaaatcagtgggatagcgcaagggctgccgtggaagatgaagaattctggaaattagtcgatagagagagggagctacataaactcggaaaatgcggttcttgcgtatacaacatgatgggcaaaagagaaaagaagttaggtgagtttggaaaagcaaaaggaagtcgagctatttggtacatgtggctaggcgccagatatctagagtttgaagcactaggatttcttaatgaagatcactggttctcgagggaaaactcttactcaggcgtggaaggagaaggattgcataagttaggttatatattaagagatatcagtaaaattccaggaggggcaatgtacgcagacgataccgcaggttgggacacaaggataacagaggatgatttacacaacgaagaaaagataacacaacagatggatccggaacaccgtcaacttgcttctgcaattttcaaactaacctaccaaaacaaagttgttaaagtacaacgtccaactccaaagggaacagtaatggatattatatcacgaaaagaccagagaggatcaggtcaagttggtacatacgggttaaacacattcaccaacatggaggcacaactggtaagacaaatggaaggagaaggcgtattatctaaagccgatttagaaaacccacatcttctagagaaaaagataacccagtggctagagacgaaaggagtagaacgactaaagagaatggccatttcaggcgacgattgtgtagttaagcctattgacgaccggtttgcaaatgctttactagcattaaatgacatgggaaaagtaaggaaagatatccctcaatggcaaccatccaaaggatggcatgattggcaacaggtaccattttgttctcatcactttcatgaattaataatgaaggatggccgcaaattagtggtcccttgcaggcctcaagacgaacttatcggccgcgccagaattagtcaaggtgctggttggtcccttaaagaaacggcgtgcttaggcaaggcatacgcacaaatgtggtcgctaatgtattttcatagaagggatttacgattagcgtcaaatgcaatttgtagcgcggtaccagtccattgggtgccaacatcacgaaccacatggtcaatacatgcacaccatcaatggatgacaacggaagatatgcttactgtttggaacagagtatggatagaagataatccctggatggaagataagactccagtgaccacatgggaagatgtcccgtacctcggaaaaagagaagaccaatggtgtggcagtctaatcggattaacaagcagggctacatgggcgcaaaacattcttacggcaatacaacaagtaagatcattaataggagatgaagagtttctcgactacatgccaagtatgaaacgatttaggaaagaagaagagtccgaaggtgctatatggtag

SEQ ID NO: 23574 - RNA, 9873 nt, synthetic construct
  misc_feature 1..9873: note = derived and/or modified CDS sequence (opt6) from DENV-3__DQ675530__SS-prME
  source 1..9873: mol_type = other RNA
acatctttttgcctaatgatgatgttaccggcaacattagcatttcatttaacctcaagagatggagaaccaagaatgattgttggtaaaaatgaaagaggaaaaagtctactatttaaaaccgcatctggcataaatatgtgcacattaatagctatggacttaggggaaatgtgcgacgacacagtaacgtataaatgcccgctaattgctgaagtcgaaccagaagatatagattgctggtgcaatctaaccagtacgtgggtgacttatggcacatgtaatcaagcaggggaacatcggcgcgacaaaaggtcggtagcgttagcacctcacgtaggcatgggccttgacactaggacacaaacttggatgtcggcggaaggggcatggcgtcaagtcgaaaaagtggaaacttgggcattgagacaccccgggtttacgattttagctctatttctagctcattatataggaacttcacctacacaaaaagtagtgatttttattttgttgatgttggtaacaccatctatgacgatgaggtgcgtcggggtcgggaacagagacttcgtagaaggactcagtggcgctacgtgggtagacgtagtattagaacatggtggatgcgtcacgacaatggccaaaaataaaccaaccttagacattgaactacagaaaactgaagcgacacaattagcaacacttcgcaaattatgcatagaagggaaaataacaaacataaccactgattctcgatgtcccacgcaaggcgaggctatccttcctgaagaacaagatcaaaactacgtgtgcaaacacacgtacgttgatagaggctggggcaatggctgcggattgttcgggaaaggaagccttgtaacgtgcgcgaaatttcaatgtctagagcccattgaaggtaaagtagtgcaatatgaaaacttgaaatacacggttatcataacagttcatactggagaccaacaccaagtagggaacgacacacaaggagtaacagtcgaaataaccccacaagcaagtaccgttgaagccgttctcccagagtatggcactttaggacttgaatgcagtccaagaactggcctagacttcaatgaaatgatattactaacaatgaaaaacaaggcttggatggtacatagacaatggttctttgatcttccactaccatggacaagtggggctaccactgaaacgcctacctggaatagaaaagaattactggtaacatttaaaaacgcacacgccaagaaacaagaagtagttgtcctcggttctcaagaaggagcaatgcacacagcactcactggagccaccgaaatacaaaacagtggagggacaagtatatttgcgggccatctcaaatgcagactaaaaatggacaaactcgagcttaaaggaatgagctacgcgatgtgcttaaatacttttgtgctcaagaaagaggtaagtgaaacccaacacggtacaatacttattaaagtcgaatacaaaggtgaagatgcaccatgcaaaattcccttctcaacagaagatggccagggaaaagcgcacaatggtagactcattacagctaaccctgtagtaacaaagaaagaggaaccggtgaatatcgaagccgaacccccttttggggagtccaatatagtcataggcattggagataaagccctaaagattaattggtacaaaaaggggtccagtattgggaaaatgttcgaagcaacagcgcgtggcgcaagacgaatggcaatactaggggatactgcatgggattttggaagtgtgggaggagttctaaatagtctaggcaagatggtgcaccaaatatttgggtcagcatacacggctttattcagtggggtatcatggataatgaaaatagggatcggtgtattgttgacctggattggattaaacagcaaaaatacttccatgtctttttcatgtattgtgataggtataataacactatatttgggcgctgttgtccaggcagatatgggatgcgttataaactggaaaggaaaggaattaaaatgcggcagtgggattttcgtaactaacgaagtccatacctggacagaacaatataaattccaagccgatagtcccaaaaggttggctactgccattgccggtgcatgggaaaatggtgtttgtggtatacggtcaacaacaaggatggaaaacttattatggaaacagatagcaaacgaattgaactacattctatgggagaacaatatcaaactaactgtagtcgttggggacatcataggggtccttgaacagggtaaaaggacattaactccccaacccatggaactaaaatactcatggaaaacatgggggaaggctaaaattgtaactgccgaaatacagaacagttcattcatcatcgatggtccaaatacgccagaatgtccgagtgcttctagggcctggaatgtctgggaagtagaggactacggcttcggagtatttacgactaatatctggctgaaattaagggaaatgtatactcagtcgtgtgaccatagactgatgtcagctgcaattaaagatgaaagggccgttcatgctgatatgggttactggatagaatcacaaaagaacgggagttggaaactcgaaaaagctagtttcattgaggttaaaacttgtacttggcctaaaagtcatacattatggtctaacggggtccttgaatctgatatgataattcctaagagtcttgcgggaccaataagtcaacacaaccatcgaccaggctatcatactcaaacagcaggaccttggcacctaggaaaacttgagttggattttaactactgtgaaggtacgactgttgtgattactgaaaattgcggtactcgaggtccttcgttaaggaccacaactgtaagcggcaaattgatacacgaatggtgttgccgaagctgtacactcccaccattgagatatatgggggaggatggatgttggtacggaatggaaatcagacctatcaatgaaaaagaagaaaatatggtcaaatcacttgtaagcgccggaagtggtaaggtcgataactttactatgggggtactttgtttagctatcctttttgaagaagtaatgagaggaaaatttgggaaaaagcatatgatagtaggcgtgttattcaccttcgtgttattgctgtcaggacaaattacctggcgcgatatggcacatacattgataatgataggatctaatgcatccgaccgaatgggtatgggtgtaacatatttagcattaattgctacgtttaagattcaaccgttcctagccctaggattcttcctacgtaaattaacaagtcgggagaatcttttgctcggagtgggattagccatggcaacaacattacaactaccggaagatattgaacaaatggcaaatggaatagcactaggactaatgaccctaaaactaattacacaatttgagacatatcaattatggactgcgctagtatcactaacctgttcaaatactatttttacattgaccgtggcatggagaacagccacactaattctagcgggagtatcacttttaccattgtgtcaatcaagctcaatgcgaaaaacggattggttaccaatgacggtagcggcaatgggagtcccacctttaccattgttcatattttcgttaaaagacacacccaagcgacgaagctggccacttaacgagggtgtgatggcagtagggctagtatcaatcttagcttcaagcctattaagaaacgatgttcccatggctgggccgttggtcgcaggaggtctactaattgcgtgctacgtcattactggtacctcggccgacttaacagtcgagaaggccgctgacgtaacttgggaagaggaagcggaacaaacaggtgtttcacacaatttaatgataacagtagatgacgatgggaccatgcgaataaaagacgacgagacagagaatatcttgactgtcttactcaagacagccctattaatcgtaagcggaatatttccttattcgattccagcaacattattggtttggcatacgtggcagaaacaaacgcagagaagtggagttttatgggacgtgccctcaccacctgagactcaaaaagcagagttagaagaaggtgtgtatagaataaagcaacaaggaattttcgggaaaacacaagtgggtgttggagtacagaaggagggggtatttcataccatgtggcatgtaacccgaggggctgtattaactcataatggtaaaaggttggaaccaaactgggcaagtgtcaagaaagatttaatttcgtatggaggtggatggcgactatccgcacagtggcaaaaaggagaggaagttcaagtaatagcggtcgaaccaggcaaaaatcccaaaaattttcaaacaatgccaggaattttccaaactacgaccggagaaataggagccatagcactcgactttaagccgggaacatcaggctcaccaatcattaaccgggagggaaaagtggtaggactatatggaaatggtgttgtaactaaaaacggagggtacgtaagtggaatagcacaaactaatgcagaaccagacgggccaactcctgaattagaagaagaaatgtttaagaaaagaaatttaacaataatggaccttcatcctgggagcggaaagacccgtaagtacttacctgcaattgtgcgtgaagcgataaaaagaagactccgcacactaatattagcaccaactagagtcgttgccgcggaaatggaagaggctttaaaaggtcttcccatacggtatcaaaccactgcaacaaagagtgaacatactgggcgagaaatagttgacctaatgtgtcatgcgacttttactatgcgtttgctttctcctgtcagggtaccaaattacaacctaattatcatggacgaggctcacttcacagatcctgcatcaattgctgcaagaggttatataagcaccagagtaggtatgggtgaagcagctgcgattttcatgacggccactcccccgggtacagccgaagcattcccacaatcgaacgccccaatacaggacgaagaacgtgatatacccgaacgaagttggaactcaggaaatgaatggataactgattttgtagggaaaaccgtatggttcgtaccatccatcaaagctggtaacgacatagcaaattgtctgaggaaaaatggaaagaaagttatacaattatctaggaaaacttttgatacagaatatcagaaaacacgattaaatgattgggactttgtggtgaccactgatatctctgaaatgggtgcgaattttaaagcggacagagtcattgatcctcgcagatgcttaaaaccggtgatcctaactgatgggcctgagagagtaatattagccggccctatgccggtaacagcagcatctgccgctcaaagaagaggcagggttggtagaaatcctcagaaagagaatgaccaatatatcttcacaggccagcctctaaacaatgacgaggatcatgcgcattggactgaagcaaaaatgctacttgacaatatcaacacgccggaaggcataattccagcactcttcgaacccgaacgagagaaaagtgcagcgatagatggtgagtatagattaaaaggtgagagtcggaaaacatttgtagaattaatgcgccgaggagacctcccagtatggttagctcataaggtagcctcagaaggaataaaatatacggatagaaaatggtgttttgacggcgaacgaaacaatcagattttggaagagaatatggatgtcgaaatttggacaaaggaaggggaacgaaagaaactacgacctagatggctcgacgctaggacctatagcgatcccctagcattaaaagagttcaaagattttgccgctggtcgaaaatctatagcattggacctcgttaccgaaattggaagagtgccgtctcatttagctcacagaactagaaatgctttagacaatttagttatgctacatacgtccgaacatggagggagagcttatagacacgctgtggaggaactccctgaaacaatggagactttattgctattaggcctcatgatattgctaacaggaggggcaatgctttttctaataagcggaaaagggattgggaaaacctcaattggtttgatatgtgttattgtctctagcggaatgttgtggatggcagatgttccactacaatggatagcatcggcgatcgttctggagttctttatgatggtattactaataccagagcctgaaaagcaaagaacgccccaagataatcagttagcatatgtcgtaataggtatattgacgttagcagcaattgttgctgcgaacgaaatgggcctacttgaaacaacaaaacgtgatttaggaatgagcaaagagccaggtgtcgtatcacccacttcctaccttgacgtagatttgcatccagcttctgcgtggactttgtatgcagtagccactactgtcattacacctatgttacgtcatacaatcgaaaattcaactgcgaatgtttctctcgcagcaatagcaaatcaagctgtagtattaatggggttagataagggttggccgataagcaaaatggatttaggcgtacctcttctagctcttgggtgctatagtcaggttaaccctttaactttaacggctgcagttttgctacttgtaacacactatgcaataattggccccggactccaggcaaaggcaacgcgcgaagcacagaaaagaacggcagcaggaattatgaagaaccctactgtagacggcattatgacaattgatttagatccagtgatatacgacagtaaattcgagaagcaattaggacaggtcatgctactcgtattgtgcgctgttcaactactcttaatgaggacgagctgggccttatgtgaagcactaacattggcaactggcccgattacgacactatgggagggtagcccaggtaagttttggaatactaccatagcggttagtatggcgaatattttccgaggaagttaccttgcaggcgctggtttagccttcagtatcatgaaaagtgtaggcacgggtagacgaggcacaggaagtcaaggcgaaacacttggagagaagtggaagaagaaactaaatcaattatctcgaaaagaatttgacctttacaagaaaagtggaataacggaagtagacagaactgaagctaaagaagggttgaaacgcggggagactacgcaccatgcagtatctagagggtccgcgaaattacaatggttcgtagagaggaatatggtgatccccgagggccgagtaatagacctaggttgtggacggggtggatggagttactactgtgccgggttgaagaaagttacagaagttcgtggatacacaaaaggaggacctggacatgaagaaccagtgcccatgagcacttacggatggaatattgtcaaattaatgtcaggcaaagatgtattctatctcccgcctgaaaaatgtgacactctactctgtgacataggtgagtcgagcccatcaccaactgtcgaagaatcaagaactataagagtgttaaaaatggtggaaccatggctcaaaaataatcagttttgcattaaagtacttaatccatacatgccgacggtgatagaacatcttgaaagattacagcgaaaatatggaggaatgcttgtaagaaatccattatcacgcaacagtacccacgagatgtattggattagtaacggtacaggcaacatagtaagtagcgtgaacatggtcagtcggcttttactaaacaggtttacaatgacgcatagaagaccaactatagaaaaggacgtcgacctgggagctggcacaagacacgtaaatgctgagcctgaaacaccaaatatggacgttataggagagcgcattaagaggatcaaagaagaacacagtagcacctggcattatgacgatgagaacccttacaaaacatgggcttatcatggtagttacgaggttaaagctactggtagtgcctcgtctatgattaacggggtagttaagttattaacgaagccttgggatgtagttccaatggttacgcaaatggcaatgacagatactacaccatttggacagcaaagagtattcaaagaaaaggtggatacaagaactccgcgacccatgccagggacgaggaaagttatggagataacagcagagtggctatggcgaacattaggtcgtaataagaaacctagactttgtacaagggaagaatttaccaagaaagttagaacaaatgccgctatgggagcagtttttacggaggaaaatcaatgggacagtgcaagagcggctgtagaagatgaagaattttggaagctagttgatagagagcgagaactacataaacttggtaagtgtgggagttgtgtgtataatatgatgggaaaacgagagaagaaattaggggaatttggtaaggcaaaaggttcccgagctatttggtatatgtggctgggtgcccgctatttagaatttgaagccctaggattcttgaatgaagaccactggttctcacgagaaaatagttactctggagtcgagggagaagggttacataaattaggatatatacttcgtgacatctcaaaaatacccggtggcgccatgtatgcggatgacactgcaggctgggacacacgtataacggaggacgatttgcacaacgaagagaaaattacacaacaaatggatccagaacatcgacaactggcctcagctatatttaagttaacatatcagaataaagttgtaaaagtacagcgtccaacgcccaaaggtacggtcatggacataatttcgagaaaagatcaacgtggcagtgggcaagttggaacatatggcctgaacacttttacaaatatggaagctcagctagtacgacaaatggaaggggaaggtgtactatcaaaagcagatctagaaaatccgcacctattagaaaagaaaattactcaatggttggaaacaaaaggggttgaaaggctcaaaaggatggcaatttcaggagatgactgtgtagtcaaaccaatcgacgatagattcgctaatgcactgctagcgttaaatgatatgggaaaggtaaggaaagatatacctcaatggcagccaagtaaaggatggcacgactggcaacaagtacccttctgctcgcaccattttcatgaattgataatgaaagatgggcggaaacttgtagtcccatgccgaccgcaagacgaacttataggtagagctaggatttcgcagggtgctggctggagccttaaagaaacagcttgtttgggtaaggcttacgcacaaatgtggagtctaatgtatttccaccgtagagacttacgactagcttcgaatgctatctgtagtgctgtacctgtacattgggttcctacgtcgagaacaacatggtccatacacgcacatcatcaatggatgacgacagaggatatgctgacagtatggaaccgagtgtggattgaggataatccttggatggaggataaaactccagtaactacttgggaagatgtgccttaccttggcaaaagagaagaccaatggtgtggatcacttataggtttaacaagccgagctacatgggctcaaaacattttgactgcgattcaacaggtccgtagtttaataggagacgaggagttcttagattacatgccatctatgaaaaggttcagaaaggaagaagagagcgagggggctatatggtag

SEQ ID NO: 23575 - RNA, 9873 nt, synthetic construct
  misc_feature 1..9873: note = derived and/or modified CDS sequence (opt6) from DENV-3__DQ675533__SS-prME
  source 1..9873: mol_type = other RNA
actagcctatgcttaatgatgattttaccagcagcattagcttttcatttaacatctagggatggtgaaccccgaatgattgtagggaaaaacgaaagagggaaaagtttattatttaaaaccgcaagcgggattaatatgtgtaccctgattgcaatggatttaggggaaatgtgcgatgacaccgtaacttataaatgcccccatataacggaagttgaacccgaagatattgattgttggtgtaatttaacttctacttgggtaacttatggaacctgtaatcaagcaggagaacatcgaagagataaaagaagcgtggctcttgcgccgcatgtaggaatgggattagatacacggactcaaacatggatgtctgcagaaggggcttggcggcaagtagagaaagtagaaacttgggccttacgacatccaggttttactatcctagctttatttcttgcccactatattgggacgtcgcttacacaaaaagtcgtaatatttatacttttaatgctagtgacaccaagcatgaccatgcgctgtgtaggggtagggaatagagattttgtagagggactctcgggcgctacatgggtagatgttgtattagaacatgggggatgtgtcacaactatggccaaaaataaacctactcttgacatagagttgcagaaaacagaagccacacaactagcaactcttcgtaaactctgtatagagggtaaaatcacaaatattactactgactcaagatgtccaactcagggtgaagctgttttacctgaggaacaagatcaaaattatgtttgcaaacatacctacgtagaccggggttggggaaacggttgtggtctttttggtaaaggctcattggtcacatgcgcaaaattccaatgtctagaacctatagaaggtaaagtagtccaatatgaaaatctaaaatacacagttataataaccgttcacaccggtgatcaacaccaagttggcaatgaaacacaaggagtaacagcagaaattacacctcaagcatcaactcacgaagctctactgccggaatacggaacgttaggattagaatgctctccccgcacaggcttggattttaacgaaatgatcctactaaccatgaaaaacaaagcgtggatggttcatcgacaatggtttttcgacctgccgctcccctgggcctccggagcgactaccgagactccaacttggaatcgaaaggaactcctagtaacatttaaaaacgctcatgccaagaaacaagaggtagtggttttggggtcacaggaaggggcaatgcacacggcattaaccggagcaactgagatccaaaattctgggggaacctcaatatttgctgggcatttaaagtgtagattgaaaatggacaagttggaacttaaaggaatgagttacgccatgtgtacaaatacatttgtcctgaaaaaggaagtgtcggagacgcagcacggtacaatacttatcaaagtggaatataaaggggaagatgcaccttgtaaaatcccattttccacagaagacggccaaggcaaggctcacaatggacgcctaattactgctaaccccgtggtgaccaagaaagaagaaccagtaaacattgaagcagaaccaccattcggcgaatcaaatatcgtaataggtattggggataatgctctaaaaataaactggtacaagaaaggctcgtctattgggaaaatgttcgaggcaacagccagaggggcacgaagaatggctatcttgggagatacagcatgggacttcggttccgttggaggagttttaaatagtttaggtaaaatggtacaccaaatcttcgggagtgcatatactgcactcttctctggtgtatcctgggtaatgaaaatcggaataggcgtgctattgacttggattggtttaaactctaaaaatacatcaatgtcatttagttgtattgctatcggaattataacactctatttaggggctgtagtccaggcggacatgggatgtgtaatcaattggaaaggaaaagaattgaaatgcggatccgggatctttgtgacaaacgaggtacatacctggacggaacaatataaatttcaagctgattccccaaaaagactggcgacagcaatagctggtgcatgggaaaatggcgtgtgcgggataagatcgactactagaatggaaaatttgttatggaagcaaatcgcaaatgaattaaattatattctttgggaaaataacattaaactaactgttgtagtcggagacacgttaggagtactcgaacaaggaaaaagaacattaacccctcaacctatggaattgaagtattcttggaagacttggggaaaggcaaaaattgtcaccgctgaaacacagaactctagttttataatagatggtccgaatacacctgaatgtccaagtgcgagtcgtgcctggaacgtatgggaagtagaggattatggatttggcgtctttactacgaacatatggctgaaattacgcgaagtatacactcaactgtgtgatcaccgtttaatgtctgctgcagtgaaagacgaacgagcagtccatgccgatatgggctattggatagaaagtcaaaagaatgggtcatggaaactagaaaaggcttccttaatagaggtaaaaacgtgtacttggcctaaatcgcatactttgtggtcgaatggagtcttagaaagcgacatgattataccgaaatcgctagctggacccatctcacaacacaactaccgcccgggctatcatactcaaactgcagggccgtggcatctaggcaaactagaattagattttaattactgtgaaggtacaacagtagtaatcactgaaagttgtggaacaagaggaccgtcactgagaacaacaactgtgtctgggaagctaatccatgaatggtgttgtcggtcttgcactcttcctccactcagatacatgggagaagacggatgttggtacggcatggaaatacgtccaatcagtgaaaaagaagaaaatatggtcaaatctcttgtatcggcgggatcgggaaaagtagataatttcacgatgggtgttctttgtctagcaattctatttgaagaagtcctaagaggtaaatttggcaagaaacatatgatagcaggagtgttctttacgtttgttttactactttcaggccaaatcacttggcgagatatggctcacactttaattatgattggttcgaatgcatcggacaggatgggtatgggggtaacatacctcgcattaatcgcaactttcaaaatccagccctttttagcattgggattctttctcaggaaacttacgagtagggaaaatctcctcctcggtgtgggactagccatggcaaccaccttgcaactacctgaagatatcgaacaaatggcgaacggcatagcgctaggtttaatggctctaaagttaataacgcaattcgagacatatcaactttggacagccttagttagcctcacatgttctaatacaattttcacacttacagtggcatggaggacagcaacgctaatattagccggtgtcagcttattaccggtatgtcaaagcagcagtatgcgtaaaactgactggctacctatgacagttgccgccatgggagtaccacccttaccattactaatcttctcccttaaagatacgctcaagcgaaggtcttggccattaaatgaaggtgtgatggcagtcgggctagtaagtattttagcgagttccctactacgaaatgacgtacccatggctggacctttagtcgccgggggtttattaattgcttgttatgtaattacagggacatctgctgatctcacggtagaaaaagcagcagacgttacatgggaggaagaagcagagcaaaccggagtaagccacaatttaatgataacagtagacgatgacggaaccatgagaattaaagacgacgaaaccgaaaatatactaaccgtcctattaaaaaccgccctattgatcgtaagtgggatatttccctacagcatacctgccacgctcttggtgtggcatacttggcaaaagcaaacgcaaagaagcggtgttttatgggatgttccatctccgccggaaacgcagaaagcagaattagaagaaggggtatatagaatcaaacaacaaggaatctttgggaaaacccaagtaggtgtaggcgtccaaaaagaaggagtattccatacaatgtggcatgttactcgcggtgctgtactaacacacaatggaaagcgcctagaaccaaactgggcgagtgtaaagaaggaccttatttcttatggaggcgggtggagattaagtgcgcaatggcaaaaaggtgaagaggtacaggtaatagctgtagagccgggaaagaaccctaaaaattttcaaactatgccaggaactttccaaactacgactggagaaatcggagctatagcattagacttcaaaccgggcaccagcggctcccctattattaatagagaagggaaagttgtgggattatacggcaacggagttgtaaccaaaaacggtgggtatgtgagtggaatagctcagacaaacgcagagccggatggaccaactccagaactggaagaggagatgttcaagaaaaggaatctcacaataatggatctccacccaggaagtggaaagacacggaaatacttaccagctatcgtcagagaagccattaagcgacgactacgaactctcatactagctcccacgagagttgttgcagcagaaatggaggaagcattaaaagggctcccaatcagataccaaacgacggcaactaaatcagaacatacaggaagagaaattgtcgatctaatgtgccacgccacatttacaatgcgacttttatctccggtccgagtacccaattataatttaattataatggacgaagcgcacttcaccgacccagccagtatagcggcgcgaggctatataagcacccgagttggaatgggagaagcagcagccatatttatgacggcaacgccacctggcactgcggatgctttccctcaatccaatgcgccaatccaggatgaagaacgagacataccagaacgttcatggaatagcggaaacgaatggattacagacttcgctggaaaaactgtgtggttcgtcccttcaattaaagccgggaatgatatcgcgaattgcctacgtaaaaacgggaaaaaggtaatacaactttcgaggaaaacgtttgacactgagtaccagaaaacaaagctaaatgactgggacttcgtagtcactacggatataagtgaaatgggcgcaaatttcaaagctgatagagtaatagacccaaggagatgtttaaaaccagttatattaactgacggaccggaaagagtaatattagcaggaccgatgcctgtcaccgcagcgtcagccgcgcaacgacgcggacgagtaggtcggaacccacaaaaagagaacgatcaatacatttttactggtcaaccgctaaacaacgatgaagatcacgctcactggacagaagctaaaatgctacttgacaacatcaatacccctgaaggcataattcctgcactcttcgagccagaaagagaaaagagcgcggcaatagacggtgagtatcgattaaaaggcgaaagccgaaaaacttttgtcgaacttatgagaagaggggaccttcctgtttggttagctcacaaagttgccagtgagggaataaagtatactgaccggaaatggtgctttgacggcgaaagaaacaaccaaatcttagaggaaaatatggatgttgaaatttggacaaaggaaggagaacgtaagaaattacgaccgaggtggctagacgctcgtacatacagtgaccctttagccctcaaagagtttaaagactttgcagccggacgaaaatcgatagcgttggatctggtaaccgaaattggtcgagtaccgtctcacttggcacatagaactagaaacgccctagacaacttagtgatgctgcacacatcagagcatggaggtcgagcttacagacatgcagttgaagaattacctgaaactatggaaacattattgctgctcgggttaatgatattgctgacaggaggagctatgttgttcttaatatctggaaaaggaatagggaaaaccagcataggattaatctgcgtaattgcatcttctgggatgttgtggatggctgaagtgccattacagtggatagcaagtgctatagtgttggagttctttatgatggtccttcttatcccagaaccagaaaaacaaaggacaccacaagataatcaattagcttacgttgtaataggtatattaaccttggcggccataatcgctgcgaatgaaatgggacttctagaaacaacgaaacgggatttaggaatgagcaaagaaccaggcgtggtaagtccaacgtcatacttggatgttgatttgcaccccgcctcagcgtggacattatacgccgttgcaacaactgtgataactcctatgttaaggcataccattgaaaattctaccgctaacgtatcattggctgcaatagctaatcaagcagtggtacttatggggttagacaaaggatggccaatttccaaaatggatctgggagttcccttacttgcccttggatgttacagccaggtaaatcccctaacattaacggcggctgtattgctattgattacccattacgctataataggcccaggcttgcaagcgaaagcaactagagaagcgcagaaacggacggcagccggaatcatgaagaacccaacagtagacggtatcatgactatagatctagaccctgttatatacgactcaaaatttgaaaaacagttgggccaagttatgttactcgtattgtgtgctgttcaattactacttatgcgtacaagttgggcattatgcgaagccttgacactcgcgactggaccaattacgactctatgggaaggttctcctggaaagttctggaatacaacgattgcagtatctatggctaatattttcagaggaagttacctagccggtgcaggactcgccttctctataatgaagtcagtaggcaccggaaaaagaggaacagggtcacaaggggaaacactaggtgaaaaatggaagaagaaattaaatcagttaagccgaaaggagtttgatctctataagaaatcaggaattactgaagtagacaggactgaagccaaagaaggattgaaaagaggagagacaactcatcatgccgtaagccggggttctgctaaattacaatggttcgttgaacgcaacatggttgttccggaaggtcgggtaatagatcttggatgcggcaggggcggctggagctattattgcgcaggacttaaaaaggtcaccgaggtacgaggatatacgaaaggagggccagggcacgaagaacctgtaccaatgtcaacctacggctggaacatagtgaaattaatgtcgggaaaagatgtattctatttaccaccagaaaaatgcgacactctactatgtgacattggagagagcagtccgagtcccacagtagaggaatccagaacaatacgagtccttaagatggtggaaccttggcttaaaaataatcaattttgcatcaaagttctgaatccgtacatgcccacagtaattgaacatctagaaagactgcaacgtaagcatggagggatgttagttagaaacccgttgagtagaaattccacgcatgagatgtactggatatcaaacggtactggaaacatagtatcaagcgtcaacatggtatcacgtctattgctcaatagatttacaatgactcaccgcaggcctaccatagaaaaagatgtcgacttaggtgcaggcacaagacacgtcaatgcagaacccgaaacaccaaacatggatgtaattggggaaaggataaagagaatcaaagaagaacacaattcaacctggcactacgatgacgaaaacccttataaaacttgggcttaccatggcagctacgaggtcaaggctacaggttcagcatcttctatgatcaatggagtagtaaaattgcttactaagccatgggacgtagtaccaatggtaacgcaaatggcaatgacagatacaactccattcggacaacaaagggtatttaaagaaaaagtagacactaggacccctcggccaatgccagggactcgaaaggtcatggaaataacagccgaatggttatggagaacgctgggacgcaacaaaaggccaagattatgtacgagagaggagttcaccaaaaaggtaaggacaaacgctgcgatgggcgctgtgttcactgaagaaaaccaatgggattcagcaaaggctgctgtagaagacgaagagttctggaaattggtagatcgcgaaagagaactgcataaattaggtaaatgtggttcgtgcgtttacaacatgatgggaaaaagggaaaagaaacttggcgaatttggcaaagctaaaggaagtagagctatttggtatatgtggctgggggccagatatctagagttcgaagccttgggctttttaaacgaagaccactggttctccagagaaaactcgtattctggagttgaaggagaaggattgcataaattaggttatatattaagggacataagcaagatccctggaggggcaatgtacgcggacgatactgcgggatgggatacacgtatcacagaagatgatttacacaatgaagagaaaattattcaacaaatggatccagaacatcggcaacttgcaaacgctatatttaagctcacttatcaaaataaagtagttaaagtgcagcgccccacaccgacaggaacagtgatggatattatcagtagaaaagaccaacggggtagtggccaagtcggaacttacgggttaaatacttttacaaatatggaggcgcaattggtgcgccaaatggaaggagaaggcgtgttaacaaaggctgatttagaaaacccacatctcctcgagaagaaaataacacagtggttagaaacaaaaggtgttgaaaggctaaaaagaatggccattagtggagatgattgtgtagtaaaaccaatcgatgacagatttgcaaacgcgcttctcgcactaaatgatatgggaaaagttcggaaagacatcccccaatggcagccatcaaaaggttggcacgattggcaacaagttcccttctgttctcaccactttcatgagcttatcatgaaagatggccgaaagttagttgtgccatgtcgtccgcaagatgagcttataggcagagctcgcataagccaaggcgcagggtggagcttaagagagacagcttgtttgggcaaagcatatgcgcaaatgtggtcgcttatgtatttccatcggcgagatttaagactagcatcaaacgcaatatgttctgcggttccagtgcactgggtgccaacaagtagaacaacttggtccatacatgcacatcaccaatggatgacgacagaggatatgttaacagtctggaacagagtatggatcgaagaaaacccctggatggaagataagacgcccgtgaccacatgggagaacgttccttatctaggaaagcgcgaagatcaatggtgtgggtcacttataggtttaacgagtagagccacttgggcgcagaacatcccaacagcaatacaacaagtacgaagcctgataggcaatgaagagtttttagactatatgcctagtatgaaaagatttagaaaagaagaagagtcagaaggcgcaatttggtaa

SEQ ID NO: 23576 - RNA, 9873 nt, synthetic construct
  misc_feature 1..9873: note = derived and/or modified CDS sequence (opt6) from DENV-3__AY744677__SS-prME
  source 1..9873: mol_type = other RNA
acaagcctttgcctaatgatgatgttaccggcaactcttgcattccacctaacaagcagagatggggaacccaggatgattgtaggcaaaaatgaaagaggtaaaagtttattattcaaaactgctagcgggataaatatgtgcacattaatagcaatggatttaggggaaatgtgtgacgacacagttacctataaatgcccacttattacggaagttgaacccgaagatatagattgttggtgcaatttgacttccacatgggtcacatacggtacatgtaatcaagcaggagaacatcgcagggataaaagaagcgtagctctagcaccgcatgtaggtatggggcttgatacaagaacacaaacctggatgagtgctgaaggagcttggagacaagtagagaaagtagaaacttgggccttccgacatccagggtttacaatactagccttattcttggcccactatataggtacatctttaacacagaaagtagtaatattcatactactaatgttagtcactcccagtatgacaatgcgttgcgtaggtgttggaaatagggactttgtagagggtttgagtggtgcaacatgggtggacgtcgtcttagaacacggaggatgtgtaactacaatggccaaaaacaaaccaacgttagatatagaacttcagaaaacagaagccacacaattggcaaccttgaggaaactatgcattgagggcaaaataacaaacgttacaactgattcgaggtgtcctactcaaggagaggctatcctgccagaagaacaagaccagaattatgtatgtaaacatacatacgtcgacagaggttggggaaatggatgcggtttgtttggaaaaggatctctagtcacgtgtgctaaatttcaatgtttagaatcaatcgaaggtaaagcagttcaacatgaaaatcttaaatataccgtcattattactgtccacactggagatcaacaccaagtaggcaatgaaacacaaggagttacggcagaaatcacccctcaagctagcactgtcgaagctattcttccggaatacggtacgctaggtctggaatgtagtccacgaactgggctagattttaacgaaatgatcttattaaccatgaaaaacaaggcttggatggtacataggcaatggtttttcgatttgcccttaccatggacatcgggagcaacaacagagactcccacgtggaataagaaagaactattagtaacattcaaaaacgcccatgctaagaaacaagaagtggttgtcctgggaagccaagaaggcgcaatgcatactgccttaactggagcgaccgaaatacagacaagtggtggaacgagcatatttgccggccatttgaaatgtagattgaaaatggacaaattggaattgaaaggaatgagttatgcgatgtgcttaaacgcttttgttttgaagaaagaagtaagcgagacccagcacggcactatactaatcaaagtagaatataaaggtgaagatgcgccatgcaaaatacccttttcgactgaagacggccaagggaaagcgcacaatggtcgattaattaccgcaaacccaatagtaaccaagaaagaagaacctgtaaatatagaagcggaacctccttttggtgaatcaaacatcgttataggtataggcgataaagctctaaaaattaactggtataaaaagggatcttcaataggaaaaatgttcgaagcgacagctcgaggcgcacgaagaatggctatattaggggacacagcctgggactttggctcagtaggaggagtgctaaattctctaggaaaaatggtacatcagatattcggaagtgcgtacacagctctattcagtggagtaagttggattatgaaaatcggaataggcgtactacttacatggatcgggttaaattccaaaaacacaagtatgtcgtttagttgtattgtaattggcatcataacgctttatcttggagctgtcgtacaagcggatatgggttgtgttatcaactggaagggaaaagaattaaaatgcggcagcggaatctttgtaacaaacgaggtacacacctggaccgaacaatacaagtttcaagcagattcgccaaaacgattagcaacagcgattgctggagcttgggaaaatggtgtatgtggtatacggagtacaacgagaatggagaatctactatggaaacaaatagcgaacgaattgaattatatcctatgggagaataatattaaattgacgatcgttgttggagatgtaataggagtactagaacagggtaagcgaaccctgactccacaaccaatggaattgaaatactcgtggaaaacatggggcaaagcgaaaatagtgacagccgaaacacaaaatagctcatttataattgatggaccaaataccccagagtgcccctccgcatcgagggcctggaatgtttgggaagtggaagactatggtttcggtgtctttaccactaatatttggctaaaattacgtgaaatgtacacacaactatgtgaccatagattaatgtctgcggctgtaaaagatgaacgagcggtccatgcagatatgggatattggatagagtcgcagaaaaacggatcgtggaaattagaaaaagcaagcctgatagaagtaaagacatgtacatggccgaaatctcacacattatggagtaacggagttcttgaatcagacatgattataccaaaatcattagccggtccaatctcccaacataattatcgcccaggatatcacacccaaacggcaggtccttggcatctcggaaaacttgaattggactttaactactgtgaaggaacgacagtagtaattacagaaaattgtggcacccgaggtccaagtttaagaactaccacagtttctggaaaacttatacacgaatggtgttgcaggtcatgcacgttacctccacttagatacatgggagaagatggctgctggtatggtatggaaatcagaccgattaacgaaaaagaagagaatatggttaagagtctggtatccgcaggtagtggaaaagcagacaacttcacaatgggagtattgtgtcttgccatactatttgaagaagtcatgcgcggtaaatttggcaagaaacatatgatagctggtgcactattcacatttgttctactcctatctggacaaataacatggcgtgacatggcccatactctaataatgatcggatctaacgcatcagataggatgggaatgggagtaacatatctcgcactgatagcaacatttaaaatccaaccttttcttgcattgggattctttttgcgcaaattaacatccagagaaaatttactattaggagttggtttagcaatggcaacaactcttcagttgccagaagatatcgaacaaatggctaatggtatagcattggggctcatggcattaaaacttataacacaatttgagacctaccaactgtggacagcattagtaagcctcatgtgtagcaacacaattttcactctaacggtagcatggagaacggcaactctcattctcgcagtgataagccttctacccgtttgccaatcgtcaagtatgagaaaaaccgactggttacccatgactgtagctgccatgggggtgccaccccttccattattcatcttttctttgaaggatacactaaaacgccggtcttggccactaaatgaaggtgtaatggcagttggactcgtttcgatactcgcaagttcatttttgcggaatgatgtaccaatggccggaccacttgtagccggcggtttgttaattgcctgttatgtaatcacaggtacaagcgccgatctcaccgtagagaaggcagcggatgtaacttgggaggaagaggcggaacaaactggagtatcacataacctaatgatcaccgttgatgatgatggaactatgagaattaaggacgatgagacagagaatatcttgaccgttctactcaaaacagctctactaatcgtatctggaatattcccatacagcattccagcaactctcttggtatggcatacatggcaaaaacaaacgcagaggtcaggagtattgtgggacgttcctagtccaccggagacccaaaaagcggaattggaagaaggtgtatatcgtataaaacaacagggcatctttggtaagacacaagttggagttggcgtccagaaggaaggagtatttcacacaatgtggcatgtcacgcgaggggctgtgttaacccacaacgggaaacgtctagaaccaaattgggctaatgttaaaaaggaccttataagttatggaggagggtggaaactatccgctcaatggcaaaaaggcgaggaagtacaagtcatagcagtcgagccagggaagaatccgaagaactttcagacaatgcctggcatatttcagactaccactggagaaataggagccatcgcacttgattttaaaccaggaacatcaggatcaccaattattaatcgcgagggcaaagtagtaggcctctatggtaacggggttgtgaccaaaaatgggggatacgtctcaggcatcgcacagacgaacgctgaaccagatggacctactccagaacttgaagaagaaatgttcaagaaacgcaatttaacaatcatggacctacaccctggaagtggaaaaacacgaaagtacttaccagcgatagtgagagaagcaattaaaagaagacttaggacccttatacttgcaccaactagagttgtagcagcggaaatggaagaagcacttaaagggctaccaatacggtaccagacaacagcgacaaaatcagagcatacaggtagagaaattgtagacttaatgtgtcatgccaccttcactatgcgactcttgagtccagtacgcgttcccaactataatctaatagttatggatgaagcacactttacagatccagcaagcattgcggcaagaggttatatttcaacacgggtcggtatgggtgaggcagccgcaatttttatgacagcaaccccgccaggaactgctgatgcatttccccaaagtaatgccccaatccaagatgaagaaagagacataccggaaaggtcctggaatagtggaaacgagtggataacggattttgctggaaagacagtatggtttgtaccaagcatcaaagccggaaatgatattgccaattgtctacggaaaaatggtaagaaagtaatacagctctctagaaagacatttgacactgagtatcagaagacgaaattgaatgattgggattttgtagtcacaaccgatatatcggaaatgggagcaaattttaaggctgatagagttatagatccaagacgctgcctaaaaccggtaatactaacagacggccctgaacgtgtaatattagcaggacccatgccagttactgtcgcatctgccgcgcaaagacgtggccgtgtcggacgaaatccccaaaaagaaaatgatcaatacatttttacagggcaaccacttaacaatgacgaagatcatgctcactggacagaggccaaaatgttactcgataacataaatacaccagagggaattatcccggccctatttgaaccagaaagagagaaatcagcagcaatcgacggtgagtaccgacttaaaggagaaagtaggaagacattcgttgaattgatgcgaaggggtgatttaccggtttggctagcacataaagttgcatcggaaggaataaaatatacagaccgaaagtggtgttttgacggagaaaggaacaaccaaattctggaagaaaatatggacgtagagatttggactaaagagggagagaagaagaaattgcgaccacgatggctagatgcaaggacgtactcagacccattagctttaaaagaatttaaagatttcgctgcagggaggaaatccatcgcgctggatttagtcaccgagataggacgagtaccaagccatttggcacaccgaaccagaaacgcgttagataacctagtgatgctccatacgagtgaacatggaggtcgagcatatagacatgccgttgaagaattgccagagaccatggaaacgctattgttattagggctcatgatcctattaaccggaggggctatgttatttcttataagcggaaaaggaataggaaaaaccagtataggcttaatatgtgttgtagccagtagtggaatgttatggatggcagatgtcccacttcaatggatagcatcagcaatagtactggagttctttatgatggttcttcttataccggaaccagagaagcaaagaacacctcaggacaaccaactcgcatacgtcgtcataggaatattaaccttagctgctatcgtagctgcgaatgaaatggggttactggagaccacaaaaagagacttagggatgagcaaagaacctggcgtagtatctcccactagctaccttgacgtcgatctgcatcctgccagcgcctggacattatacgcagttgcaacgactgtgataaccccaatgttaagacatacgatcgaaaacagcactgcaaacgtgtcacttgcggcgatagcaaatcaagcggtagtgttaatggggttggataaaggttggccaatctcaaaaatggacttgggagtaccattacttgcactagggtgctatagtcaagtcaacccgctgacattgacggcagctgttctactcttagttacccattatgcgatcataggaccagggttacaagcgaaagctacaagggaagcacaaaaacgaaccgcggcgggtatcatgaagaaccctactgttgatggtattatgacaatagatctcgaccctgtaatatatgatagcaaattcgaaaagcagctcggccaggtcatgctattagtattgtgtgcagttcaacttctgcttatgcgtacctcgtgggcattttgtgaagctctcacattagccactggtccgataacgaccttgtgggaagggtcgcctggaaaattctggaacacaacaatagcagtgtcaatggccaatatattccgaggctcatatttagccggcgcaggtcttgcattttcaattatgaagagtgtagggactggaaaacgaggtacaggatcacaaggtgagacactgggagaaaagtggaaaaagcgattgaaccaactctccaggaaagaatttgatttatataagaaaagtggaataacagaagtagatcgcacggaagccaaagagggtttaaaaagaggagaaataactcatcatgccgtgtcgagaggcagcgcaaaactgcaatggttcgttgaaaggaatatggtgatacctgaagggcgggtaatagatcttggctgcggacgtggaggttggagttattactgtgctggtctcaagaaagtgacagaggtaagaggatacactaaaggaggacctggtcacgaggaaccagttccaatgagcacttatggttggaatatcgttaaactaatgtcgggtaaggacgtattttatctacccccagaaaagtgcgatacattactttgcgacataggagaaagcagcccaagccccacagtagaggaatccagaacgatccgagtcctaaaaatggtcgaaccttggctcaaaaacaaccaattctgtataaaggtattaaacccatatatgccaaccgtaatagaacatctggaaagactgcaaagaaaacatgggggcatgttagttcgcaatccactttcgcgaaactccacccatgaaatgtattggatatccaatgggacaggaaatatagtatcctcagtaaacatggttagtcgtctcctcctaaatcggttcacaatgacacatagacgaccgacaatagaaaaggatgttgacttgggagctggcacacgacacgtcaatgctgagcccgaaaccccaaatatggatgttattggcgagagaatacgtcggatcaaagaggagcatagttccacgtggcattacgacgacgaaaatccctataaaacatgggcttaccatggttcttatgaagtcaaggcaactggatcagcctcgagcatgataaatggcgttgtgaaactgctcacgaaaccctgggatgttgtcccaatggttacacaaatggctatgaccgatacgactcctttcggccagcagagggtattcaaggagaaagttgatacacggacaccacgaccaatgcctggtacacggaaggtcatggagattacagcagaatggctgtggaggacattaggcaggaacaagagacctaggctatgtacgagagaggagtttataaagaaagtaagaacaaacgccgctatgggagctgtttttacagaagaaaatcaatgggactctgcaagagccgcagtcgaggacgaggagttctggaagctagtagacagagaaagagagctacataaattgggcaaatgcggaagttgtgtttacaatatgatgggtaaacgggagaagaaattaggagaatttgggaaggcaaaaggatccagggcaatctggtacatgtggttaggggcaaggtacctagaatttgaagcattgggatttctaaatgaagatcactggttctcccgagaaaattcatattctggtgttgagggagagggtcttcacaaactaggttatattttaagggatataagcaaaataccaggtggcgcgatgtacgcagatgacactgctgggtgggatacacgaataactgaggatgatttacataatgaagagaaaattactcaacaaatggaccccgaacaccgacaattagctaatgcgattttcaaactcacatatcagaataaagtagtaaaggtgcaaagacccacacctaaaggaaccgtgatggacattatctctcggaaagatcagagaggctctggacaggtaggaacctatgggttaaataccttcactaatatggaagcacagctaatacgacagatggagggagaaggagtcttaagcaaagccgacttagaaaatcctcatcttctggaaaagaaggtcactcaatggctcgaaactaaaggtgtcgagcgcttaaaaagaatggccatttcaggagacgactgtgtcgtcaaaccgatagatgaccgatttgcaaatgcactgttagcactaaatgacatgggtaaagtaagaaaagacataccacaatggcaaccgagtaaaggatggcacgactggcaacaagtaccattttgcagtcatcatttccatgaattaattatgaaggatggacgtaagttggtagtgccttgccgaccacaggatgagttaataggacgagcacgaatatcacagggtgcaggctggagtctcagagagacagcatgcttaggaaaagcgtacgcacaaatgtgggcactcatgtatttccaccgtagagatctgagattagcttctaacgctatttgtagtgctgtccctgtgcactgggtgcctacatccagaactacttggtcaatacatgcacaccatcaatggatgaccaccgaagatatgttaactgtttggaacagggtgtggattgaagacaatccttggatggaagataaaacaccagttacaacatgggaagatgtgccatatctcggaaaaagagaagaccaatggtgcggatcgctaatcggactgacttcccgagcaacctgggcccaaaatatattaactgcgatacagcaggtacgtagtctcattgggaatgaagaatttctagattatatgccctccatgaaaaggtttcgtaaagaagaggaatcagaaggcgctatatggtaa

SEQ ID NO: 23577 - RNA, 9873 nt, synthetic construct
  misc_feature 1..9873: note = derived and/or modified CDS sequence (opt6) from DENV-3__AY744678__SS-prME
  source 1..9873: mol_type = other RNA
acgtctttatgcctcatgatgatgttgccagcaactctagcgtttcatctcacgtcacgagatggagaacctagaatgattgtgggcaaaaatgaaagaggaaaaagtttactatttaaaactgctagtggtattaatatgtgtacactcatagcaatggatttgggagaaatgtgcgatgatacggtaacctacaaatgtcctctcataacagaagtggaaccagaagacatcgattgctggtgtaacctaacaagcacttgggtaacatatggaacatgtaatcaagcgggagaacacaggagagacaaacgaagcgtagcactagcaccacatgtaggtatgggacttgatactagaacacaaacatggatgagtgccgaaggagcgtggagacaagtggaaaaagtagaaacatgggcttttaggcaccctggctttactatactcgctctctttctagcacactatataggcacatcactcacccaaaaagtagtaatatttatacttctcatgctagtaactccatccatgacaatgcgatgtgtaggtgttggtaacagagattttgtggaaggattaagcggtgcaacctgggtggacgtagttctagaacatggagggtgtgttactacgatggctaaaaataaaccaaccttggatatagaactacagaaaactgaagcaacgcaacttgcaacattaagaaaactatgtatagaaggcaaaataaccaacgtaactactgatagtcgttgtccaacacaaggggaagcaatacttcccgaagaacaagaccaaaactatgtgtgtaaacacacatatgtagaccgtggatgggggaatgggtgtggactatttggaaaaggatcactcgtcacttgcgcaaaattccaatgtttagaaagtatagaagggaaagctgtacaacacgaaaaccttaaatacaccgtaataattacagtccatacaggagatcagcatcaggtaggaaatgagacacaaggcgttactgccgaaataacaccccaggcttccacagtagaagcaatattacccgaatacggtacgcttgggctcgagtgtagtccacgtaccgggctagattttaatgaaatgatactcttaaccatgaaaaacaaagcatggatggttcatagacaatggtttttcgaccttccactaccatggacaagtggtgccacaactgagaccccaacctggaacaagaaagaattactcgtcacatttaaaaatgcccacgccaagaaacaagaagtagtagtgttagggtcccaagagggggctatgcatactgctttaacaggcgcaactgaaatccaaaccagtggaggaacatcaatatttgcagggcatttaaaatgtagactcaaaatggataaactagaactaaaaggtatgagctatgcaatgtgcctaaatgcattcgtactaaagaaagaggttagcgaaacacaacatggtactatcctaattaaagtagaatataaaggtgaagatgcgccttgtaaaataccgtttagcaccgaagatgggcaaggtaaagcacataatggacgcttaataactgcaaaccctatagtgactaagaaagaagaaccagtcaatatagaggcagaaccacctttcggtgagagcaatattgtgataggcattggtgacaaagcactgaaaataaattggtataagaaaggatcttcgatcggtaaaatgttcgaggctacggcccgcggtgcacgtagaatggcgatactaggtgatacggcatgggactttggcagcgtaggaggtgtgctaaattccttgggaaaaatggtgcaccaaatattcggatcagcgtatacagcactatttagtggagtttcatggatcatgaaaattgggattggtgtattactgacgtggataggactcaactcgaaaaatacctcaatgtcatttagctgtatcgtcatcggaataattaccctataccttggagctgttgtccaagctgacatgggttgtgttattaattggaaaggaaaagaattgaaatgcggtagtgggatatttgtaaccaatgaagtccacacgtggacagaacagtataaatttcaggccgatagtcccaaaagattagcaaccgcgatcgcaggagcatgggaaaatggcgtatgcgggattcgtagcaccacaagaatggaaaatcttctctggaaacagatagcgaatgaactgaattacattctctgggaaaacaacataaaactgacaattgtggtaggcgatgttatcggtgtgttggaacaaggaaaaagaacattaacgccacagccaatggaactaaaatactcatggaaaacatggggaaaagcaaaaatagtaacagccgaaacacaaaatagttccttcattatagacggaccaaatactcctgagtgtccttcagcaagtagagcatggaacgtctgggaggtagaagattatggatttggtgtattcacaacaaacatatggcttaaactaagagaaatgtatacccaactttgtgatcatagactaatgtctgccgcagttaaagatgaaagagcagtccacgcggatatgggatattggatagaaagtcagaaaaacggaagctggaaactggaaaaagccagcttgatagaggtaaagacctgtacgtggcctaaaagtcatacgttatggtctaatggtgttcttgaaagcgatatgattatcccaaagtccctcgctgggccaataagccagcataattacagacctggatatcatacccaaacagcaggaccatggcatctaggaaaattggaactggactttaattactgtgagggaacaaccgtagtaatcacagaaaattgcggcacacgcggaccttctttaaggaccactacagtatcaggcaaacttatacatgagtggtgctgtcgttcctgtacgctgcccccgctgaggtatatgggggaggacggatgctggtacggaatggaaatacgacccattaacgagaaagaagaaaacatggtaaaaagcctggtctctgcaggaagcggcaaagcagacaattttaccatgggcgtgttgtgcttggcaatcttatttgaagaagtaatgcgcggaaagttcggcaagaaacacatgatcgcaggagcattgtttacctttgtcctactattatcgggacaaattacatggcgcgacatggcccacacacttattatgattggatcaaacgctagcgataggatgggaatgggcgttacttatctcgccttaatagcgacttttaaaatacaaccattccttgcattaggattcttcttaagaaaactaacatctcgagagaacctactactaggagtaggccttgcaatggcaacgactttacaactacccgaagatattgagcagatggcaaatggtatcgctcttggtctcatggcacttaaattaatcacccaatttgagacttaccagctctggacggcactcgtttcgttgatgtgttcaaatacgatatttactctaactgtagcgtggaggacggccactctaatacttgctgtaattagtctgctcccagtatgtcaatcttcatccatgcgaaaaaccgattggcttccgatgacagtcgcggctatgggcgtgccacctctgccgttatttatattctcactaaaagacactctcaagagacgatcatggccactaaatgaaggtgtaatggctgtaggtttagttagcatacttgcttcaagtttcttacgtaatgacgttcccatggctgggcctcttgtagcaggaggtttattaatcgcgtgctacgtgattaccggaactagcgcagatcttacagtggaaaaagctgcagatgtgacttgggaagaagaagccgaacagactggtgttagtcataatttaatgataactgtagacgatgatggcactatgcgcattaaagatgacgaaactgagaatatacttacagtactgttaaaaacggcattattaatcgttagcggtatatttccttactcaataccggccacattattagtgtggcacacgtggcagaaacaaactcagagatctggagtactctgggatgtaccaagcccgcctgaaacacagaaagcagaactcgaagagggggtctaccgcattaagcaacagggtatatttggcaagactcaagtaggggttggagtacaaaaggagggtgtgtttcatactatgtggcacgtaacgaggggtgctgtacttactcacaacggaaagagactagaacctaactgggcaaatgtcaagaaagatctgatcagttacggtggaggatggaagctaagcgcgcaatggcagaagggagaagaagtgcaggtaatagcggtcgaacctgggaaaaaccccaaaaactttcagacaatgccaggtatttttcagaccaccacgggagagattggtgccatcgctcttgacttcaaacccggaacaagtggctcacccattataaatcgagagggtaaagtggtgggactatatggcaatggtgttgtaacgaagaacggaggttatgtcagcggtatagcacaaactaatgccgaacccgacggcccaacgcccgaactagaagaagaaatgtttaagaaaagaaacctaactattatggacctacatccaggatcaggcaaaaccaggaaatatctaccagcaattgtacgcgaagcaataaagcgtcgattaagaactctcatactagctccaaccagagtggtcgccgcagaaatggaagaggcattaaaaggcttacccataagatatcaaaccacggcaaccaaatcagaacatacaggaagagaaatcgtggatttaatgtgccacgcaacattcacaatgagacttctctcccccgtccgcgtccccaactataacctcatcgtgatggatgaagcgcattttacggacccagcctccatcgccgccaggggttacatatcaacaagagtaggtatgggcgaagctgcagcaatctttatgacggcaacaccaccaggaacagctgatgcatttccacaatcaaatgctccaatccaagacgaagaaagagacattccagagagaagttggaactcgggtaacgaatggataacagactttgcaggcaagacagtctggttcgtacccagtattaaagccggaaatgacattgccaattgtttaaggaaaaacggaaagaaagtgatacaactatcaagaaaaactttcgatactgaataccagaaaacaaagctaaacgattgggacttcgttgtaacaaccgatataagcgaaatgggtgctaacttcaaagccgatcgagtaattgatccacgtcgatgtttaaagcctgtaattttgactgacgggcctgaacgagtaatcctggcgggacccatgcccgtaacagtcgcgtcggcggctcaacgaagagggcgagtaggaaggaaccctcaaaaagaaaacgaccaatacatattcacaggccaaccattaaacaacgatgaagatcacgcacactggactgaggccaaaatgttattagacaacataaatacaccagaaggaattatccctgcattatttgaacctgagagggagaagagtgccgcaatcgatggtgaatatagattgaagggtgagtcaagaaaaactttcgtagaactaatgcgaaggggagatttaccagtctggctcgcacataaagttgcatctgaaggaattaaatatactgaccgaaaatggtgttttgacggtgaacgaaacaaccaaattctggaagaaaacatggatgttgaaatatggacaaaagaaggcgagaagaagaaactgagacctagatggttagacgctcgaacttattcggatccactagcattgaaggaatttaaagatttcgcagccggtcgcaaaagcatagctttagatttagtcactgagataggtcgagttccctcacacctagctcacagaacccgcaatgcattagataatttggtcatgctccacacatcagaacatgggggacgggcatacagacacgctgtagaagaattacctgaaacgatggaaacacttctcctgttgggtcttatgatcttgctaacgggaggtgcaatgttatttttaataagtggtaaaggaattggaaaaacatcgataggcttaatatgtgtggttgcatcaagtggaatgttgtggatggccgacgttccattacaatggattgcttcagcaatagttttagaatttttcatgatggttttattaatccctgaacctgagaagcaaagaacccctcaggacaatcaattagcatatgtggtgatagggatcctgactctggcagctatcgtggctgcaaacgaaatgggtctcctcgaaactacaaaaagggacttaggaatgagcaaagagccaggagttgtttcacctacatcttatctagatgtcgatttacatcctgccagcgcatggacactgtatgcagtcgcaacaacagtgattactcctatgctccgacacactatagaaaactcgacagcaaacgtttcgctagctgcaatagcaaatcaagcagtagtattaatgggactagacaaaggttggccgatctctaaaatggacttgggggtacctctactagccttaggatgttattcacaagtgaatccactcacgttgaccgccgcggtactacttctagttacacattatgcaatcataggcccgggtctgcaagctaaggcaactcgtgaggcccaaaagagaactgcggccgggataatgaaaaatcctactgtggatggaatcatgaccatagacctggatccagtaatctacgattcgaaattcgagaaacaactaggtcaggttatgctattagtattgtgcgctgtacaactactattgatgagaacatcgtgggctttctgcgaagccttaacgttggcaactggacccatcacaaccctatgggaaggatcacctggaaaattttggaacactaccatcgccgttagtatggccaatatcttcagaggatcgtacctagcaggggccgggttagcattcagtataatgaaatccgtcggaaccggaaaacggggtactgggtcacaaggagagaccctaggagaaaaatggaagaagaaattaaatcaattaagtcgtaaagaatttgatctttacaaaaagagtggcattaccgaagtagatagaacagaggcgaaagagggtctgaaaagaggagaaatcacacatcatgctgtatcacgaggatctgcaaaattgcaatggttcgtggaacgcaatatggttatccctgaaggacgcgtgatcgacttaggatgcggacgcgggggttggagttactactgcgcgggtttaaagaaagtcactgaagttagaggatatactaaagggggaccagggcatgaggaaccagtaccaatgtcaacttatggctggaatattgtgaagttaatgtccggaaaggacgtgttttatcttcctccagaaaaatgcgacactcttttgtgcgacataggagagtcatcaccaagccccacagtagaagaatccagaacaatcagagtattaaagatggttgaaccgtggcttaaaaataatcaattctgcattaaagtactaaatccatatatgccaaccgttatagaacatctagaaagactacaaagaaaacatgggggaatgctagttagaaacccgctatctcgtaatagtacgcatgagatgtattggatatctaatggaacaggaaatattgtttcttcagtcaatatggtaagccgattattactaaacagattcacgatgacgcatcgcagacctactatagaaaaggacgtagatctaggcgctggcacccggcatgtaaacgctgaacctgaaacaccgaatatggatgtaattggtgaacgtataaggagaataaaagaggaacattctagcacatggcactatgatgatgaaaacccttataaaacatgggcataccacggttcttatgaggtcaaagcaaccggtagtgccagtagtatgataaatggagttgtaaaacttctaactaaaccatgggacgttgtgccaatggtgacccaaatggctatgaccgatactacgccatttggacaacaacgagtttttaaggaaaaagtagatacccgcacgccacgacctatgcctggtactcgtaaggttatggaaattactgccgaatggctgtggagaacgttagggaggaataaacgacctcgcctatgcacaagagaagagttcataaagaaagtaagaactaacgcagcgatgggcgcagtgttcacggaagagaaccagtgggactcagccagggcagctgttgaggacgaggaattttggaaattagttgatcgagaaagagagctacataaactaggcaaatgtggcagctgtgtttacaacatgatgggtaagcgtgagaagaaactaggagagtttggtaaagccaaaggttcaagagcaatttggtatatgtggctaggtgccaggtatctagaatttgaagctctcggatttttaaatgaagatcactggttttcaagggagaactcatattcaggagtggagggagaaggactacacaaattaggatacatcctaagggatatctctaaaattccaggtggggccatgtatgctgatgatacagcagggtgggatacgagaatcacggaggatgacttacataacgaggagaaaataacacaacaaatggatccagaacatagacaactagcaaatgctatattcaaactgacctatcaaaataaagttgtaaaggtgcagcgaccaacaccaaaaggaacggtaatggacataatctcaagaaaagatcaacgagggtcaggtcaagtagggacatatggccttaataccttcacgaatatggaagcccagttaatcagacaaatggaaggcgaaggagtactatctaaggcggatcttgaaaatcctcaccttcttgagaagaaagtaactcaatggttagaaacgaaaggagtggaaagattgaaacggatggcgatatcaggagacgattgcgtagtaaagcccatcgatgaccgatttgcttcagcgttgctagcattaaatgatatgggaaaagtccgtaaagatatcccacaatggcaaccctcaaaagggtggcacgactggcaacaggtcccgttttgttcgcatcactttcacgagctaataatgaaggatggtcggaaattagtagtgccatgcaggccacaagatgaattaataggtagagcaaggattagccaaggagcgggatggtccctacgagaaaccgcttgcttaggtaaggcttacgcgcaaatgtgggcactaatgtacttccacagaagagatttgcgcctcgcgtcaaacgctatatgttccgcagtcccagtgcattgggtacccacttcaaggactacttggagtatacatgcccatcatcaatggatgacaacagaagatatgttgactgtgtggaacagagtgtggattgaagacaacccgtggatggaagacaaaaccccagtcaccacctgggaggatgtaccatacttgggaaaaagagaagaccaatggtgtggctcgttgatcgggctgacatccagggcaacatgggcccaaaatatcctaacggctattcaacaagtaagatcccttataggcaatgaagaatttctagactacatgccaagtatgaaacggttccgtaaagaagaggaaagtgaaggtgctatatggtga

SEQ ID NO: 23578 - RNA, 9873 nt, synthetic construct
  misc_feature 1..9873: note = derived and/or modified CDS sequence (opt6) from DENV-3__AY744679__SS-prME
  source 1..9873: mol_type = other RNA
actagcttgtgtctaatgatgatgctgccggctacattggcttttcacttgaccagccgcgatggagaacccagaatgatcgtgggtaaaaatgaacgaggaaaaagtctgctttttaaaacagcatcgggaataaatatgtgcaccttaatagcaatggatctaggggaaatgtgtgacgatacagtaacatataaatgcccgttgataacagaagtagaaccagaagatattgattgttggtgtaacttaacaagcacatgggttacatatggtacatgcaaccaagcgggtgaacatcgaagagacaaacggtcagttgcactagcacctcatgtaggaatgggattggacacacgaacacaaacctggatgtcagcagaaggtgcttggagacaagtagagaaagtagaaacatgggctttccggcatccgggttttacaatactagcattatttttagcacactacattggaacctcgttaacacaaaaagttgttatatttatactattaatgctagttacacctagcatgacaatgcgatgcgtcggagtaggaaatcgagacttcgtcgaaggattgtcaggtgccacctgggtagacgtcgtattagagcatggagggtgcgttaccactatggctaaaaacaaaccaacactagatattgaattacagaaaactgaggctacccaacttgcaacattacgtaaactctgcattgaaggtaaaataacgaatgtcacaaccgatagtaggtgtcctacacaaggagaagcaatattgccagaagaacaagatcaaaattatgtgtgtaaacatacctacgtcgatcgaggttggggtaatggctgtggtctgtttggtaaagggtccctggtaacatgtgctaaatttcaatgtctagaatctatcgaaggaaaagtggtacaacatgagaacttgaaatatactgtcataataaccgtacataccggtgatcaacaccaagtaggaaatgagacacaaggtgttacagcagaaataacgcctcaggccagtacagtggaagcgatattaccggagtatggtacattaggccttgaatgtagcccccgtaccgggttagattttaacgaaatgatactacttacaatgaaaaacaaagcctggatggttcatagacaatggttctttgaccttccactcccctggacttctggggccacgactgagacgcctacttggaataagaaagaattactggtcacgttcaaaaacgcacacgcgaagaaacaagaagttgttgtactaggatctcaagaaggtgcaatgcacactgctttaactggagccaccgaaattcagacatccggtggtacatcaatatttgctggtcaccttaagtgccgattgaaaatggacaaactggaactgaaaggcatgtcatatgcaatgtgcctaaacgctttcgtactgaagaaagaagtatcggaaacacaacatggaaccatacttataaaggtggaatataaaggagaagacgcaccatgcaaaattcctttcagcaccgaagatgggcaaggaaaggctcacaacggcagactaattactgccaatcctatagttaccaagaaagaagaaccagtgaacatagaagctgaaccacctttcggagaaagtaatatagtaatcggaattggagataaagcattaaaaataaattggtataagaaagggtctagtataggtaaaatgtttgaagccacagctcggggagcacgacgcatggctatattgggggacacggcttgggactttggatccgttggaggagtccttaactccctcgggaaaatggttcatcaaatattcggcagcgcctataccgcactcttctcaggagtatcgtggattatgaaaatcggtataggagtactgttaacctggataggactaaacagcaaaaatacatcgatgagtttcagctgtattgtaatcggcataataacactttacttgggagctgtagttcaagcagatatgggttgtgttatcaattggaaagggcaagagcttaagtgcgggagtgggatattcgttaccaatgaggttcacacatggactgaacaatacaaattccaagccgatagccctaagagactagcgaccgcaattgccggtgcttgggaaaacggagtttgtgggattaggtctacaacgcgtatggagaacttactatggaaacaaatagccaatgaattaaactacatattatgggagaacaatatcaaacttaccgtagtagtcggcgatgtaataggcgttttagaacagggaaaaagaacgttaactccccaaccgatggaattaaagtattcatggaaaacgtggggaaaggcgaaaatagtaacagcggaaactcaaaatagcagttttattattgatggtccaaatactcctgagtgtcccagcgccagtcgagcctggaatgtatgggaagtagaagactacggttttggtgtattcacaacaaacatctggttaaaactaagggaaatgtacacccaattgtgtgaccatcgtttgatgagtgcagcagtaaaggacgagcgagcagtacatgcagacatgggatattggatcgaatctcagaaaaatggttcatggaaacttgaaaaggcttctttaatagaagtgaagacatgcacctggcctaagagccatacgctttggtcgaatggagtattagaatcagacatgatcatacctaaaagtctagccggtcctataagccaacacaattatcgacccggctaccatacacagacagcgggcccatggcatctcggaaaattagagctagacttcaattattgtgaaggcacaaccgttgtaataactgaaaattgtggcactcgaggaccaagtcttagaacgaccacggttagtggtaaactaattcatgaatggtgttgtagaagctgtactctacctccactaagatacatgggtgaagacggatgttggtatgggatggaaatccgccccataaatgagaaggaggagaatatggtaaagagcttagtgtccgcaggcagcggtaaagcggataactttacgatgggagttttatgcctggctatactttttgaggaagtcatgcgagggaaatttggcaagaaacacatgattgcaggagcgttgttcaccttcgtattgctactatccggacagatcacatggagagatatggctcatactttaataatgattggatcaaacgcaagtgacagaatgggaatgggtgtaacttacttagcactgatcgctacattcaagatccaaccgtttttagcacttggattctttctcagaaaattaacaagccgagaaaacctattgttgggggtaggccttgcaatggcaacgacactccaattaccagaagatatcgagcagatggcaaacgggatcgcacttggacttatggcccttaaattaataacacaatttgaaacttatcaactttggacagcgctagtatcattaatgtgttcaaatacaatatttacactaactgtggcctggcgcacagctacacttattttagctgtaatttctctattacctgtgtgccaaagtagttcaatgcgcaagactgactggcttcctatgacagtagctgccatgggtgttccaccactaccattattcattttcagtttaaaggacacattaaaaagacgtagttggcctcttaatgagggggtcatggctgtcggcttagtatctatcttagcgagtagcttccttcgtaacgacgtacccatggccggtccattggttgcaggcggcctgcttatcgcatgttatgtaattacagggacatctgcagatctgacggtcgaaaaagcagcagacgttacgtgggaagaagaagcagaacagacaggtgtctcgcataatttgatgattacagttgatgacgatggaacgatgcgtattaaagacgatgagactgaaaatatattaacagtattactaaaaactgcgcttttgatcgtaagcggaatatttccatattcaataccagctaccttgttggtgtggcatacatggcaaaaacaaacccaaagatctggtgtattatgggatgtaccctctccaccagaaacacagaaagcggaactagaagaaggcgtatacagaattaaacagcagggaatctttggaaaaacacaagtaggagttggcgtccagaaagaaggggttttccatacaatgtggcatgtaactagaggtgcagttttaacgcacaatggaaaacggctagaaccaaactgggcaaatgtgaagaaagacctaatcagttacggtggcggctggaaactatctgcacaatggcagaagggtgaagaagttcaagtgattgcagttgagccaggcaaaaaccccaagaacttccagacaatgccaggcatctttcaaaccactactggcgagattggagcaatagcattagattttaaaccgggaacctcagggagtcctattattaaccgagaaggaaaagtagtaggattatatggtaacggggtcgtaactaagaacggcggttatgtaagtggaatcgctcaaactaatgctgaacctgacggacccacgccggaattagaggaagaaatgtttaaaaagaggaatctaacaatcatggacttgcatcccggctcaggaaaaactagaaaatacttacccgcaattgtacgagaggccatcaaaagaagactacgaacactgatacttgcacctacccgcgtcgtcgcagcggaaatggaagaagcactgaaaggattaccaattaggtatcaaactactgcaacaaagtcagagcatacgggacgcgaaatagtcgacctaatgtgccacgcaacatttactatgaggttacttagtccagttagggtaccaaattataacttgatagtcatggatgaagcgcacttcacagacccagcttccatagcggcacgaggatatataagtacgagagtcggaatgggcgaggcagctgccatcttcatgacggccacacctccaggaactgccgacgcattcccacaatcaaatgcgcctatacaagacgaagaaagagatatccccgaaagatcctggaatagcggtaatgaatggatcacagatttcgctggaaaaactgtctggttcgtcccatcaataaaagcaggtaatgatatagcaaactgtctacgtaaaaatggtaagaaagtgatacagttaagcagaaagacatttgataccgaatatcagaaaaccaaactaaatgattgggattttgtagtaacaactgatataagcgaaatgggagcaaactttaaggcggatcgggtaatcgaccctcgcagatgtcttaaaccagtaatccttactgacggtcccgaaagggtaatattagcaggtccaatgccagttactgtagcaagtgcagctcaaaggagaggcagagttggcagaaatccgcaaaaagaaaatgatcaatacattttcactggccaacccttaaataatgatgaagaccatgcacactggacagaggcaaaaatgctactcgacaacataaacacccccgaaggaataattccagcattatttgaaccagaaagagaaaaatccgcggccatcgatggtgaatatcgcttaaaaggggaaagcagaaaaacattcgtagagctaatgagaaggggcgatctacctgtatggctggcacataaagttgcaagtgagggcataaaatacacagacagaaagtggtgcttcgacggagaacgaaacaatcagatattggaagaaaatatggatgttgagatttggacaaaagaaggagagaaaaagaaattaagaccgcgttggcttgatgcacgcacctactcggatcccctcgctctcaaagagttcaaagactttgccgcgggtaggaaatcaattgctttagatcttgttactgaaataggacgcgtaccaagtcaccttgcacaccggacacgtaacgcattggacaatttagtaatgctacacacatccgaacacggcggtagagcgtacagacacgcagtagaggaattaccagaaacaatggagacattactactactaggacttatgatattattaacaggtggggcaatgttattcttaattagtggcaaaggaataggtaaaacgtctataggcttaatttgcgtagtagcatcaagcggaatgttgtggatggcggatgtacccttacaatggattgcatccgcaatagtgctcgagttctttatgatggtcctactaattcctgaacccgagaaacaacgcacgccacaagataatcaattagcttacgtagttattggcattcttactctagcagctatcgtagcggcaaatgaaatggggctgttagagaccacaaaaagagatctggggatgtcaaaagaaccgggggttgtttcgccaacttcatacctagatgttgatctccatcctgcctctgcatggacattatatgcggttgccacaacagtaatcactcctatgctgaggcatactattgaaaattccacagccaatgtctctctggctgccatagccaaccaagctgtagttttaatgggattagacaaaggatggccaattagtaaaatggaccttggggtgccattattagcactaggctgttatagccaagttaatcctttgacactaactgcggcagtgctcttgctcgtaacacattacgcgataataggtcccggtctacaggctaaagctaccagggaggcacagaaaagaacagcagctggcattatgaaaaatccgacagtagatggaataatgaccatagacttagatcccgttatttacgacagcaagttcgagaaacaattaggtcaagtaatgctcctagttctatgtgcagtacaacttctattgatgcgaacgtcctgggcattttgtgaggccttgactttagcgacgggtcctattacaactttatgggaaggttctccgggcaagttttggaacacaacgatagcagttagtatggccaacattttccgtggatcatacctcgcgggcgcaggactggcttttagtataatgaaaagtgtgggaacaggaaaacgaggaaccgggagccaaggtgaaacactcggggaaaaatggaagaagaaattaaatcaactatcacgcaaggaatttgacctttataaaaagtcaggtattaccgaggtcgaccgaacggaagcaaaagaaggactaaaacgaggtgaaataactcaccacgcggtctcaagaggttcagcaaagctacagtggtttgtcgaacgaaatatggttattcctgaaggcagagtaattgacttaggatgtggtcgaggcgggtggagttattattgcgctggtcttaagaaagtaaccgaagttcggggatacactaaaggcggaccaggacacgaagaacccgtgccaatgtcaacttacggttggaatatcgtaaaactaatgtcgggaaaagatgtattttacttacctcccgaaaaatgtgacacactattatgtgatataggggaatctagcccatcgcctacggtcgaagaaagtagaaccattagagtactaaaaatggtagaaccttggctgaaaaataatcaattttgcattaaagtgctcaacccctacatgccaacggtaattgagcacctggagaggttacagcgaaagcatggtggaatgctagtaaggaaccctctgagtagaaattcaacacacgaaatgtactggatatctaacggtactggaaacatagtatcatctgtcaacatggtatctcgtttattactaaatcggtttactatgacccacagaaggccaacaattgagaaagatgttgatctaggtgcaggaacgcgacacgtaaatgctgagcctgaaacaccaaacatggatattataggcgaacgaatacgtagaataaaagaagaacattcctcaacgtggcactatgatgacgaaaatccatataagacttgggcatatcatggatcctacgaagtaaaagcgaccggttctgcatcctcaatgatcaacggagtagttaaactcttaacaaaaccctgggatgtagtaccaatggtaacccaaatggctatgacagatacgactccgttcggtcaacaacgtgtatttaaagaaaaagtagatacaaggacaccaaggcccatgcccggaacaagaaaagtcatggagataacggctgaatggctatggaggacattaggacgtaacaaacgaccacgtttatgcactagagaagagttcatgaaaaaggttagaacaaacgcggcaatgggagcagtatttacagaagaaaatcaatgggattcggcacgtgcagctgttgaagatgaagagttctggaagctagtggatagggaacgggaacttcacaagctcggtaaatgcggaagctgcgtatacaacatgatgggtaaacgtgaaaagaagttaggggagttcgggaaagcgaaaggttcgagagcaatatggtacatgtggcttggagcccggtatctcgaatttgaggctttaggatttttaaacgaagatcattggttttcaagagaaaactcatactcaggtgttgagggcgaaggcctgcataaacttggatatatacttagagatatcagtaaaatcccaggcggtgccatgtatgcggatgatacagccggatgggataccaggattaccgaagatgatctacataatgaagagaaaataacacaacaaatggatccagaacataggcaattagctaatgcaatattcaaactgacatatcagaataaagtcgtaaaggtccaaaggcctacgccaaaaggtaccgtgatggacattatctcacgaaaagatcagagaggtagtggacaagtcggaacttatggacttaatacttttactaatatggaagcacaacttattagacaaatggagggagaaggagtattatctaaagcagacttagaaaatccccatctactagagaagaaagttacgcaatggttagaaactaaaggtgtggaacggctgaaacgaatggccatatctggagatgattgtgtggtaaaaccaatagatgatagattcgcaaatgctctattggcactaaacgatatgggaaaagttcggaaagatatcccacaatggcaacccagcaaaggttggcacgattggcagcaagtgcccttctgcagtcaccattttcacgaattaattatgaaagatggccgtaaattagtcgtgccttgtagaccacaagatgagctaattggcagagcaaggatatcacaaggagcaggatggtcactcagagagacggcatgtcttggaaaagcatacgcgcaaatgtgggcgttgatgtacttccatagaagagatttacgtttagcctcgaacgctatctgctctgctgtaccagttcactgggttccgacttccaggacgacttggtctattcatgctcaccatcagtggatgactacagaagacatgctcactgtttggaacagagtatggattgaggataacccttggatggaagataagaccccggtctccacttgggaagatgtgccgtatttgggaaaaagagaagatcaatggtgtggatccttgattgggttaaccagtcgagcaacatgggcacagaatatattaacggcaattcagcaagtaaggagtctcattggaaatgaagaatttctagattacatgcctagcatgaagcgctttcgtaaggaagaagaatctgagggagcaatatggtag

SEQ ID NO: 23579 - RNA, 9873 nt, synthetic construct
  misc_feature 1..9873: note = derived and/or modified CDS sequence (opt6) from DENV-3__AY744680__SS-prME
  source 1..9873: mol_type = other RNA
acaagcctatgtttgatgatgatgttacccgccactctagcatttcacctgaccagtagagacggagaacccagaatgattgtcggcaaaaatgaacgtggaaaatcattattatttaaaactgcgtccgggattaatatgtgtacgcttattgctatggatttaggagaaatgtgcgacgataccgtaacatataaatgcccacttattacagaagtcgaacccgaagatatagattgttggtgcaatctcacatctacttgggtaacatatggaacctgcaatcaagctggagaacaccgaagggacaaacgctcagttgcattagctccacatgttggtatgggactcgataccaggacacaaacttggatgagtgcagaaggagcttggagacaagtagaaaaagtagagacatgggcgtttcgccatcccggattcactatacttgcgctattcttggctcattatataggtacaagcctcacacagaaagtagttatatttattctcttaatgttggtaacaccctcaatgacaatgagatgtgtaggggtgggcaatagagattttgtagagggactctctggtgctacatgggtggacgtggtgctagaacacggcggttgcgtgacgacgatggcgaaaaataaaccaacgttagacattgagcttcagaaaactgaagcaacacaacttgcaacattaagaaaattatgtattgaaggaaaaataaccaatgtcacaacagattctaggtgccccacacaaggagaagctatactgccagaagaacaggaccaaaattatgtatgcaaacatacatatgttgacagaggctggggaaatggctgtggcttgttcggaaaaggatcactggtaacgtgcgcaaaatttcaatgcttggagtcaattgaaggaaaagcagtacaacacgaaaatttaaaatatacggtaatcattactgttcatactggggatcagcaccaagtggggaatgagacacaaggagtcacagcggaaataacaccacaagcatcaacagtagaggcaatcttacctgaatatggaaccttaggacttgagtgctcacccaggactggtttagatttcaatgagatgatactacttacaatgaaaaataaagcctggatggttcacagacagtggttctttgatctaccactaccatggacgtccggggccacaactgaaacaccaacatggaacaagaaagaacttttagtcacattcaaaaacgcacatgcgaagaaacaagaagtagtcgttctcggaagtcaggaaggtgcaatgcatactgcattaacgggagcgaccgaaatacaaacaagtggtggtacaagtattttcgccggacaccttaagtgcagattaaagatggataaactagaactaaaaggaatgtcctacgctatgtgcttgaacgcttttgtgttgaagaaagaagtctcagagactcagcatggaaccatattaatcaaagtagaatataaaggggaagatgcaccttgtaaaataccattttcaactgaagatggacaaggaaaggcgcacaatgggcgattaattactgcaaatcccattgttactaagaaagaagaaccagtaaatatagaagctgaaccgccgtttggtgaatccaacatagtgattgggataggggacaaagcactaaaaattaattggtataagaaaggaagttctattggcaaaatgtttgaagctacagctcgcggggcaagaaggatggcgattttaggtgacactgcatgggattttggttcggtcggaggtgtcctaaattctttaggtaagatggtacatcaaattttcggatcagcgtataccgctctattcagtggtgtttcttggataatgaagattgggataggagtcctgttaacatggatcggacttaattctaaaaacacttctatgagcttcagttgcatagtgattggaataattacgctctatttaggagcagtagtacaagcagacatgggatgcgttattaattggaaagggaaagaactgaaatgcggaagtggaatctttgtaacaaatgaggtccatacttggaccgaacaatacaaatttcaggcagacagccccaaacgactcgccactgccattgccggcgcttgggagaatggggtatgcggtatccgatcaacgaccaggatggaaaatttactttggaaacagatagcgaacgagctgaattatatattgtgggaaaataatattaaactaactatcgtcgtcggtgacgtgattggagtcctagagcaggggaagaggacattaacaccacaacccatggaattaaagtattcctggaagacatggggtaaagctaaaatagttaccgcggaaactcaaaatagctcgtttataatagatgggccaaacactccggaatgtccttcggcgtctcgtgcatggaatgtctgggaagtcgaagattacggatttggagtattcacaacgaacatatggctaaaactacgagagatgtatactcaattgtgtgatcatcgattaatgagcgcggcggttaaagacgagcgtgcagtgcatgcggatatgggatactggatagaaagccagaaaaacggaagttggaaattagaaaaggcatcattgattgaggtgaaaacatgtacatggcccaaaagtcacacgctatggtctaatggtgtactagaaagtgatatgatcatacctaaatctctagccggaccaatatcacaacataattatcgaccaggatatcacacacagaccgcgggaccgtggcatttaggcaaattagagttagactttaactactgcgaaggaaccaccgtagttattacagagaattgcggaacacggggtccaagtttgagaactacaacagttagcggtaaactaatacacgaatggtgttgccgtagctgtaccctaccgccattaagatatatgggtgaggacggatgttggtatggaatggaaattagaccaattaatgaaaaagaagagaatatggtcaaatcgttagtatccgcaggcagtgggaaagctgacaattttacgatgggagtgctttgtttggcaatactatttgaagaagttatgcgaggaaaatttggcaagaaacacatgatagcaggagcactctttacctttgtgttgttgttatcaggtcagattacctggcgagatatggcacacacattaattatgataggctctaacgcctctgacagaatgggaatgggggtcacatacttagctcttatagcgacatttaaaattcaaccgttcttagctctaggattctttttgagaaagttgacatcacgagaaaatctactgctcggtgtcgggttagcaatggctactacattacagttacccgaagacatagagcagatggctaatggaattgcgttggggctcatggccctgaaacttatcactcagtttgagacctaccagttgtggacagctctagtttcccttatgtgctcgaatactatattcacactaacagtagcttggagaaccgctacactaatattggcagttatatctttactacccgtttgtcaaagctctagcatgaggaaaacagactggttacccatgacagtggcagcaatgggtgtgccaccccttccattgttcatattttctctaaaagacacactcaaaagaagaagttggccattgaatgaaggtgttatggcggtggggctggtcagtatattggcttcatctttcctcagaaatgatgtccctatggctggaccattagtcgctggtggactacttatagcatgctatgtaattacaggtacaagcgcagatttgaccgtagaaaaggctgcagacgtaacatgggaagaagaagcggaacagacgggcgtatcacataatttaatgattactgtggatgatgatggtaccatgagaataaaagacgatgaaaccgagaatattttaacggttcttctaaaaacggccctactaatcgtcagtggcatctttccatactcaattccagcaaccttgttggtgtggcacacgtggcagaaacaaacacagagaagtggagtactttgggacgttccaagtccacctgaaacgcaaaaggccgaattagaagagggagtctatcgaatcaaacaacaaggtatcttcggaaaaacacaggtaggggttggagttcaaaaagaaggagtattccacaccatgtggcatgttacaagaggggcagtactaacccataatggtaaacggttagagccgaactgggcaaacgtgaagaaagaccttatatcgtacggtggcggctggaaactttcagcccaatggcaaaaaggtgaagaggtacaagtcatcgcagtcgaaccgggcaaaaatcctaaaaatttccaaacgatgccaggaatatttcaaacgactacaggagaaataggagcaatcgcacttgattttaaaccaggtacaagtggatctccaataataaaccgagaaggtaaagttgttggactctacggtaacggagtagttacaaagaacggcggttacgtctctggcattgctcaaacaaacgcggaaccagacgggccaacccctgaattagaggaggaaatgtttaagaaaaggaatttaactataatggatttacatcctggaagtggaaagacacgcaagtatctccccgccatagtaagagaagccattaaaagaaggttgcgcactttaattttagctccaactcgagtcgttgccgcagaaatggaggaagcactaaaaggattaccgatacggtatcaaacgacggcgactaaaagtgaacatacgggaagggaaattgtggatctgatgtgtcacgctaccttcacgatgagattgctctcaccagtacgagtccccaattataatctaatagtaatggacgaagctcattttacagacccagcgtcgattgcagccaggggctacataagtacaagagtaggaatgggtgaagcagctgccatattcatgactgcgacaccacccgggaccgccgatgcctttccgcaatccaacgcccccatccaagacgaggagagagacattccagaaagaagctggaactcgggcaacgaatggattaccgattttgcaggcaaaacggtctggtttgtaccttctataaaagcaggcaatgatatcgcaaactgcctgaggaaaaatgggaaaaaggtaatacagttaagtagaaaaactttcgataccgagtaccagaaaacaaagctgaatgattgggatttcgtggtaaccactgatatatctgaaatgggcgcaaattttaaagcggaccgcgtgattgacccccgaaggtgcctaaaacctgtaatattaacggatggtccagaaagggtaatactagcagggccgatgccagtgacggtagcgtcagcagctcagagacgaggccgagttggacgaaatccccaaaaagaaaatgatcaatatatctttacaggtcaaccattgaacaacgatgaagaccatgcccattggactgaggcaaaaatgctactagacaacatcaatactccggaaggtataattccagcgctttttgagcccgaacgagagaaaagtgcggcaatagacggagaataccggctaaagggagaatctcgcaagacttttgtagaacttatgaggaggggagacctaccagtttggctagcacacaaggtagcttcagaaggtataaagtatactgataggaaatggtgctttgatggagaacgcaataatcaaatactcgaggaaaatatggacgtagaaatatggactaaagagggagagaagaagaaactacgtccacgttggttggacgcacgaacatacagtgatcctttagctctaaaagaatttaaagatttcgcggcgggaagaaaatctatagcattagatcttgtcactgaaattggtagagtaccgtcacatctggcacatcgaacaagaaatgccttagacaacctagtgatgctacatacatctgagcatggaggtagggcctacagacacgccgtagaagaattaccagagacgatggaaacactactgttattagggctaatgatcctgcttacaggaggggccatgttatttctgatatccggaaagggcattggaaaaacgtcaattggccttatatgtgtggttgctagctctgggatgctctggatggccgatgtgccattacaatggattgcaagtgcaattgtgctagagttctttatgatggtcctattaataccagaaccagaaaaacaacgaacaccacaagacaatcaactagcttacgttgtaataggtatattaacattagcagcgattgtagcagcaaacgaaatgggactattggaaacaacgaaaagagacctaggaatgagcaaagaaccaggagtcgtttcccctacgagctatctcgatgtagacttgcatcccgcaagcgcgtggactttatatgcagtagctaccactgtgatcacgccaatgttaaggcacacaatagaaaatagtacagcaaatgtatcgctagctgcaatagcaaaccaagccgtggttttgatgggattggataaaggatggcctataagcaaaatggatttaggagttccgctactcgcattgggttgctactctcaagtaaaccctttaacgctaacagcagccgtactactcctagtaacccactacgcgattataggacccggattgcaagccaaggccacgagagaggcacagaagcgaaccgcggcaggaataatgaagaacccgaccgttgacggaatcatgactatagatctagatccggtaatttatgatagcaaattcgaaaaacaattaggccaggtaatgttactggtactatgtgcagtacaattactactaatgaggacctcttgggcattttgtgaggcgttaacccttgcaaccggaccaatcaccacgttgtgggaaggaagcccgggcaaattctggaatactacaatcgcagtcagtatggccaatatctttagaggatcatatttagctggagcagggcttgcatttagtattatgaaatccgtgggtaccggtaaaagggggacagggtcccagggagaaacattaggtgaaaaatggaaaaagaaactcaaccagcttagtaggaaggaatttgatttgtacaagaaaagtggtataacagaagtagatcgaactgaagctaaggaaggtttaaaacgaggggaaataacacatcatgcagtctctcgggggtccgcaaaattacaatggtttgtagaaagaaacatggtcatcccagaggggcgagttatcgacctaggatgtggaagaggcgggtggagttattattgtgcaggattgaaaaaggtaacggaggtacgcggatacacaaaaggagggccaggacacgaagaaccggtgccgatgtctacatacggatggaacatagtgaaactaatgtcgggcaaagatgttttctatttaccccctgaaaagtgcgacacgctactttgtgacattggagagagttcaccaagccctacagtagaggagtcaagaaccattcgagtattaaaaatggtagaaccgtggctaaagaataaccagttttgcataaaagtacttaatccgtatatgccaacagtaatagaacatttagaacggctgcaaaggaaacacggaggaatgctagtaagaaaccccttaagtcgaaattctacgcatgaaatgtactggattagcaatgggactggaaatattgtatcgagcgttaatatggtgtctagacttttactaaacagatttactatgacacatagacgacccacaattgaaaaagatgttgacttgggagctggaacaagacatgtaaatgcagaaccagaaacaccaaatatggatgttatcggagagcgtatccgccgcataaaagaagaacacagctctacctggcattacgacgatgaaaatccatataaaacatgggcatatcatgggtcatacgaggtaaaggcaaccgggtccgctagtagtatgataaacggagtggtcaagctgttgacaaaaccatgggatgtagtgccaatggttacccaaatggcaatgacagatacaactccattcggtcaacaaagagtattcaaagagaaggtagatacccgaactccaaggccaatgccagggacaagaaaggtcatggagataacagcagaatggctttggcgaacactaggacgcaataagcgaccaaggttatgcacgagagaagaatttatcaagaaagtgcggactaacgcagccatgggtgccgtatttaccgaagaaaatcaatgggattccgcgcgagctgcagtagaagatgaagaattttggaaattagttgatagagaaagggagttacataaattaggtaaatgcggcagctgtgtttataatatgatggggaaaagagagaagaaattaggagaatttgggaaagcaaaaggatccagagctatatggtacatgtggttaggtgcgagatacttagaatttgaagcacttgggtttctcaacgaagatcattggttttcccgagagaatagttacagtggggtcgaaggcgaaggtttacataagctcggatacattcttagagatatttcaaaaattccgggcggcgccatgtacgctgatgacaccgcgggctgggatacaagaataacagaagatgatttacacaacgaagaaaagatcactcaacaaatggatccagagcatcgacagcttgcaaatgctatctttaaattgacctatcaaaataaagtagtaaaggttcaacggccgactccaaagggtacagtgatggatataatctcacgtaaagatcaacgcggtagcggtcaagtaggaacctatggtttaaatacctttaccaacatggaagcacagttaatcaggcagatggaaggagaaggagtcttaagcaaggcggacttagaaaatccgcatttacttgagaagaaagtaactcaatggttagagaccaaaggcgtagaaaggttgaaacgcatggcaatctcaggcgacgattgcgtcgtaaaaccaatagacgatagatttgcgaatgctttattagcgttaaacgatatggggaaagttagaaaagacattccacaatggcagccttcaaaagggtggcatgactggcaacaggttcctttttgttctcaccatttccatgaattaattatgaaagacggcagaaaactggtggtgccatgccgaccccaggacgagttgattggacgagcccgaatatcacagggcgcaggttggagtctcagagaaacagcatgtctaggtaaagcatatgcgcaaatgtgggcactgatgtattttcataggcgtgatctacgactggcaagtaatgctatttgttcggcggttccagtgcattgggttccaacaagtcggacgacatggtcaattcatgcacaccatcagtggatgacgacggaggacatgttaactgtgtggaaccgagtttggatcgaagataacccgtggatggaagacaaaacaccagtcacaacttgggaagacgttccatatttggggaaaagggaagatcaatggtgcggcagcttgatagggttgacaagcagggccacctgggctcaaaatatactcactgctattcagcaggttcgatcgctaataggtaacgaagagttcttagattatatgccctcaatgaaaagatttagaaaagaagaggaaagtgaaggagccatatggtaa

SEQ ID NO: 23580 - RNA, 9873 nt, synthetic construct
  misc_feature 1..9873: note = derived and/or modified CDS sequence (opt6) from DENV-3__AY744681__SS-prME
  source 1..9873: mol_type = other RNA
acttcattatgcttgatgatgatgcttccagcaactctcgctttccaccttacttcaagagatggtgaaccacggatgatcgtaggcaaaaatgaaagaggaaaatctcttttattcaaaactgcatcaggaataaacatgtgcacattaatcgcaatggatctcggtgaaatgtgcgatgatactgtaacatacaaatgtccattaattactgaagttgaaccagaagacattgattgttggtgtaacctaacatcgacgtgggtgacatatggaacctgtaatcaagcgggagagcataggcgtgacaaaagatcagtagcattagctccacacgtgggaatgggtttagatactcggacacagacgtggatgagtgcagaaggggcatggaggcaggttgaaaaagtcgaaacctgggcgttcagacatcccggatttacaatacttgcattatttttagcccattacataggaacctcactaacccaaaaagtagtcatttttatattgttaatgcttgttaccccatctatgaccatgaggtgcgtaggagtcggaaatagagactttgtagaaggattaagcggtgcgacttgggtagatgttgtacttgaacacggtggttgtgtaactactatggctaaaaacaaaccaacgcttgatatagaattgcagaaaactgaagccacgcaactcgcaacacttagaaaattatgcatcgaaggacgtataacaaatgtgacgactgattctcgttgtccaactcagggtgaagctattctgccggaggaacaagaccagaactacgtatgtaaacatacctatgttgatagaggatgggggaatggatgtggattattcggaaaaggcagcttagttacctgtgccaaattccaatgcctagaatcgatagaaggaaaagcggtacaacatgagaatctcaaatatacagtcataattacagttcacacaggggaccaacatcaagttggttcggagacgcaaggagtaacggcagaaatcacgccacaagcaagtactgtggaagcgatattacccgaatacggaacgttaggattagaatgtagcccacgaacaggtttagatttcaatgaaatgatccttcttacaatgaaaaataaagcatggatggtacatcggcaatggttctttgatcttccactgccatggacttcgggcgcaacaactgagacaccaacatggaataagaaagaactattagtaactttcaaaaatgcgcacgccaagaaacaagaagtggtagtgttagggtcacaagagggtgcaatgcacaccgcactcactggcgcaaccgaaatacaaacatcgggcggaacaagtatatttgcaggacatttaaaatgtcggctaaaaatggataaattagaattgaaaggaatgtcatatgcaatgtgccttaatgcttttgtactcaagaaagaagtctctgaaacccaacacggaactatattgattaaagtggagtacaaaggcgaagacgctccatgtaaaattccattttcaactgaagatggtcaaggcaaagctcataatgggcggcttattacagcgaatccaatagtaactaagaaagaggaaccagtgaatattgaagcagaaccaccttttggagaatcgaacatagtcattggcattggcgacaaagcactcaaaattaactggtacaagaaagggagttcaataggaaaaatgtttgaagctacagctagaggcgctcgccgaatggccatactgggcgacacagcatgggattttggaagtgttgggggagtcttaaatagtcttggtaaaatggtacaccaaatttttggaagtgcctacacagccttgttttctggcgtttcatggataatgaaaatcgggataggagtcctattaacctggatcggtctaaattccaaaaacacaagtatgtctttcagctgtatcgttataggaataattacattatatttgggcgccgtcgtacaggcagatatggggtgcgtcatcaactggaaagggaaagaactcaaatgtgggtctggtatctttgtcacgaatgaagtccatacatggaccgaacaatataaattccaagctgattcaccgaagcgattggccacggctatagctggcgcatgggaaaatggtgtatgcggcattagaagcacaacaaggatggaaaacctactgtggaaacaaattgccaatgaattaaattacatattatgggaaaacaacataaagttgactatcgtagttggcgacgtaataggagttttagaacaaggaaaaaggacattgacaccccaaccaatggagttaaagtactcttggaaaacatggggaaaggccaaaatagtgaccgctgagacccaaaatagtagctttataatagatggacctaatacacccgaatgtccgagtgcgtcacgagcatggaacgtatgggaggttgaagattatggattcggcgtatttacaactaacatttggcttaaattacgagagatgtacacgcaactgtgcgatcatcgtctcatgtctgcagctgtcaaagatgaacgtgcagtccacgctgatatggggtattggattgagtctcaaaagaacgggagttggaaactcgaaaaagcctcgttgatagaagtcaaaacgtgtacctggccaaaaagccatacgctttggtccaacggagtgttagagagcgatatgataatcccaaaaagtttagcgggcccgataagtcaacataactacagaccaggatatcacacacaaaccgcgggcccttggcacctaggtaagttagaattagacttcaactattgcgaggggacaacagttgtaattacagagaattgtggaacaaggggaccgtcacttcgaactacaacagtctcaggaaaactaattcacgaatggtgttgtcgatcgtgcactctcccacctctacgttacatgggtgaagacgggtgctggtatgggatggaaatccggccaataaacgaaaaagaggaaaatatggtaaaatcattagttagcgctggatcaggcaaggcagataattttaccatgggagtgttgtgtttagcaatcttgtttgaagaagtgatgagaggtaaattcggtaagaaacatatgatagccggtgcactgtttacatttgttttgttactttccggtcagataacctggagagatatggcgcacacacttataatgattggtagtaatgcaagcgaccgaatgggaatgggcgttacttatttagccctaatagccacattcaaaatccaaccatttctggcacttggatttttcttacgaaaactgacatcgagagagaatctattgttaggtgttggattagccatggcaacgacattacagttacccgaagatattgagcagatggctaacgggatagcattaggtcttatggctctaaaactaataacacaatttgagacttatcaactctggactgctctcgtatctcttatgtgttcaaacactatatttacgctgaccgtagcatggagaacagccactttgattttagccgtgatttcccttttacccgtttgtcaatcatcatctatgagaaaaacagactggctacctatgacagtggcggcaatgggtgtgccgccacttccactatttatattctcccttaaagacacccttaaaagaagaagttggccccttaacgagggtgtgatggctgtaggcttagtgtcgatcctagcatccagttttctgagaaacgacgtacctatggcagggcctttggtagccggtggattgcttatcgcttgttatgtaataaccggcacaagcgcggacctcacagtagaaaaagccgctgacgttacttgggaggaggaggcagaacaaactggcgtaagccataatttaatgataacagtagacgatgacggaactatgcgaattaaagacgacgaaacagaaaacattttgacagtcctactaaaaaccgcgctcctgatagttagcggcatttttccttatagtattccagcaacattacttgtatggcatacttggcaaaaacaaacccaaaggagtggtgtattatgggacgtaccgagcccaccagaaactcaaaaagccgaactagaggaaggtgtttatcgcattaaacaacaaggtatttttgggaaaacacaagttggagtcggcgtacaaaaagaaggagttttccatacaatgtggcatgtaacccgaggggcagtactcacgcacaacggtaaaaggttagaacccaactgggcgaatgttaagaaggatttgatatcttatggtgggggatggaaactctcagctcaatggcaaaagggggaggaagtacaggtcatcgctgtggagccgggcaaaaaccccaaaaattttcaaacaatgccaggtatatttcaaacgacaacgggggaaataggcgcaatcgcattggatttcaaacctggcacaagtgggtcacccatcattaacagggaaggtaaagttgttggcctatatggcaacggagttgttaccaagaatggaggatatgtaagtggaattgcgcaaacaaacgccgaacccgatgggcctacaccagaattagaagaagaaatgttcaagaaacgaaatctgacaattatggacttgcatccaggctcgggaaagacaagaaagtacctccctgctatagtcagagaagcaattaagcgcagacttagaacattaattcttgcgcctacacgagtagtggctgccgaaatggaagaagcgttaaagggcttacctataagatatcagacgacagctacaaaaagcgaacataccggtagagaaatagttgacctaatgtgccacgcgacatttaccatgcgtctgttatccccagtacgcgttccgaactacaacttaatagtaatggacgaagcacattttactgatccagcaagtatcgcagcacgagggtatatttcaacaagggtaggaatgggggaagctgctgccatattcatgactgctacacctccaggtacagcagatgcgtttccacagtccaatgcgccaatccaagacgaagaaagagacattccggaacgcagctggaactcggggaatgaatggataaccgactttgcgggaaaaaccgtatggtttgtcccgagtatcaaagcgggcaacgacatagctaactgcttaaggaagaacggtaagaaggtcattcagctttccaggaagactttcgataccgagtatcagaaaaccaaacttaatgattgggacttcgtagtcaccacggacatcagcgaaatgggagcgaattttaaagctgatcgtgtaattgacccacgtagatgtcttaaaccagtgatattaactgatggacctgagagagttatcttggcaggcccaatgcccgtaacagtcgcaagtgctgcacaaagacgagggcgtgtaggtagaaatccacaaaaggagaatgatcaatatatatttactggtcagccgttaaacaacgatgaggatcacgcacattggacagaggcgaaaatgctattagacaatattaatactcccgagggaataattccagctcttttcgaaccagaaagagagaaaagcgcagcaatagatggagaatatagactaaagggagaatctcgtaaaacatttgtggaactcatgagaagaggcgatcttccagtttggcttgcacataaagtcgcatcagaaggaattaaatatacagacagaaaatggtgcttcgatggcgaaagaaataaccagatactcgaagaaaatatggatgtagaaatatggacgaaagaaggagagaagaagaaactgcggccgcgttggttggatgctaggacctatagcgatccactagcgctgaaagaatttaaggactttgcggctggtcgtaaatcaattgctctcgatctcgtaactgaaattggcagagtgcccagccatttagcacacaggacaagaaatgccctggacaaccttgttatgctacatacctcagaacatggaggacgtgcatacagacacgctgtcgaagaattacccgaaaccatggaaactctacttttgcttggactaatgatattgctaacaggcggtgctatgctatttttaattagtggaaaaggaatcgggaaaacatcaataggtcttatatgtgtagtcgcgagcagtggaatgctttggatggcagatgttccattacaatggattgccagtgccatcgtattggagttctttatgatggtcttactgatacccgagcccgagaagcaaagaacgccgcaagataaccagttagcttacgtagtgataggaatattaacgcttgcagccattgtcgcagctaacgaaatgggtctgctggaaactacaaagagggaccttggaatgagcaaggagcctggagtggtctcaccgacctcctatttggacgtggatctacacccagcttcagcatggacgctatacgctgtagccacgacagttatcacccctatgttgcgacatacaattgaaaattcaacagctaacgtgtcgttagccgcaatagcaaatcaagctgttgtgttaatgggactagacaaggggtggcctatctctaaaatggacttgggtgttccgttgctagcacttggatgctatagccaagtcaatccattaacgcttacagctgcggtcttactattagtaacacactacgccataataggtcccggcctccaggctaaagcgacacgagaagcccaaaagaggacggccgctggaataatgaaaaatcccacagtagatgggataatgaccatagaccttgatcctgtcatatatgactctaagttcgagaaacaactcggtcaagtaatgttattagtcctgtgcgcagtccagctcctcctgatgagaacatcgtgggcattctgtgaggccttaacccttgcaaccggcccaataacaacgttatgggaagggagtcctggaaagttctggaatacaactattgctgtaagtatggcaaacatattcaggggtagttacctagcgggtgcaggattagcgttttcgataatgaagtctgtaggaacaggtaagcgcggcaccggaagtcaaggggaaacgctaggtgaaaaatggaagaagaaactgaatcagctttcacgtaaagaatttgatctctataaaaagagtggtataactgaagtagacagaaccgaagcaaaagaaggcctaaaaagaggtgagattacacatcatgcagtatccagagggtccgcaaaattacaatggtttgttgagagaaatatggttattcccgagggtagggtcatcgaccttggctgcggaagaggtggttggtcgtactactgtgccggactaaagaaagtaacagaagtaagaggatatacaaagggcggacccggccacgaagaaccagtccccatgagcacttatggatggaatatagtcaaattaatgagtggaaaggacgtattttatttaccacccgagaaatgtgacaccttgttatgcgacataggtgaatcctctccatcaccaacggtcgaagaatctaggacgataagggtgttgaaaatggttgaaccatggctcaaaaacaatcaattttgcatcaaagttctaaatccatatatgcctactgtgatcgaacaccttgaaagattacaaagaaaacacgggggtatgcttgtacggaatcccctttctagaaactcgacccacgaaatgtactggataagcaatggtaccggcaatattgtttcgagtgtcaatatggtctcgagactgcttttgaacagattcaccatgacccatcgtcgtccaaccattgaaaaagacgtagacttgggggcgggaacaagacatgtaaatgctgaacctgaaacgccaaatatggatgtgataggggaacggattcgtagaatcaaagaagaacatagctcaacgtggcactatgacgatgaaaacccctataagacatgggcttatcatggaagctatgaggtaaaagcaactggtagtgcatctagtatgattaacggagtcgtgaagttactcacaaaaccatgggacgtcgtgcccatggtaactcaaatggctatgacagacacaacgccctttggacaacaacgggtattcaaagagaaagtagatactagaacgccgagaccaatgccaggcaccagaaaggtcatggagataacagcagagtggttatggcggactttgggcagaaacaaaagacctaggttatgtaccagagaagagttcattaagaaagtacgtacgaatgcggcgatgggggcagtcttcacagaagaaaatcaatgggactccgcgagggccgctgtggaagatgaggagttctggaagttggtagatagagaaagagaattacacaaactaggaaaatgtggaagttgtgtgtataatatgatggggaaacgagagaagaaattaggtgagttcggaaaagccaaaggaagcagggcaatatggtatatgtggctcggagcaagatatttagagttcgaagcgttaggttttctcaatgaggatcactggttctcaagggaaaacagttattcgggagttgaaggagaaggattacacaaactcggatatatacttagagacatttcaaagattccgggtggggcgatgtatgcggatgatacagctggttgggacacaagaattaccgaggatgatcttcataatgaagagaaaataactcaacagatggacccagaacaccgtcgtcttgccaatgcaatttttaaattaacctaccaaaataaagtcgttaaagtgcaacgaccaacaccgaaagggacagtgatggatataatttcaagaaaagatcaaagagggtccgggcaagtgggaacgtacgggcttaatacattcacaaatatggaggcacaactaataagacaaatggaaggcgagggagtattatccaaagcagatctagaaaatcctcacttgttagaaaagaaagtgactcagtggcttgaaacgaaaggagtggaacgattgaaaagaatggcgatatctggcgacgattgcgtagttaagcctatagacgatcgattcgcaaacgcactcctagctttgaatgacatgggcaaggttcgaaaggatataccgcaatggcaaccaagtaaaggctggcatgattggcaacaagtgccattttgttctcaccatttccatgaattaataatgaaagatgggcgcaaattagtagtaccttgcagaccgcaggatgagttaatcggacgtgcacgtatatcacaaggagctggatggagcttaagagaaacagcatgcctagggaaggcctacgcgcaaatgtgggcattgatgtattttcatcgaagggatctgaggttggcctccaacgcaatatgttccgcagttccagttcattgggtacctacttcgcgtacaacgtggagcatacacgctcaccatcagtggatgacgaccgaggacatgttaactgtttggaacagggtatggatagaagacaatccatggatggaggataaaacccccgtaacaacgtgggaagatgttccgtacctagggaaacgcgaagatcaatggtgtgggtcacttattggattaacaagtagggccacttgggctcaaaacattctaacggctatacaacaagttagaagcctaattggcaacgaagaatttttagattatatgccatctatgaagagatttcgaaaagaagaagaaagtgagggagcaatatggtaa

SEQ ID NO: 23581 - RNA, 9873 nt, synthetic construct
  misc_feature 1..9873: note = derived and/or modified CDS sequence (opt6) from DENV-3__AY744682__SS-prME
  source 1..9873: mol_type = other RNA
acgagtttatgtctaatgatgatgctaccagcgactctggcgtttcaccttacaagcagagatggcgaacctcgaatgatcgtaggcaaaaatgaaagaggtaaaagtctgttatttaagaccgcatccggcataaacatgtgtacactaatagcaatggatttaggggaaatgtgtgatgatacagtgacgtataaatgtccattaataacagaagtcgaaccagaagatattgactgttggtgtaatctaacaagtacatgggtgacatatggcacatgcaaccaagcaggagaacatcggcgggataaacgtagtgtggctcttgcaccccatgttggtatgggactagacacacgtacgcaaacatggatgagcgcagaaggtgcatggcgccaagttgaaaaagtagaaacatgggcgttcagacaccccggctttactatattggcattattccttgcccactatataggaacaagtctcactcaaaaagtagttatattcattctactgatgctagtaacaccgagcatgacgatgcggtgcgtgggcgtgggaaatagagacttcgtcgaaggtttatcgggcgccacctgggttgacgtagtcttagagcatggagggtgtgttacaacaatggccaaaaataaaccaactctagatatagaattacagaaaacggaggcaacccaattagctacactaagaaaactctgtatcgaaggaaaaataacaaatgtaacgaccgattcccgttgccccacacaaggagaagccattctaccagaagaacaagatcagaattacgtttgcaaacatacttatgttgaccgaggatggggcaacggctgcggtttatttggtaaaggatcactggtgacgtgcgcaaagtttcaatgtctagaatcaattgaaggaaaagcagtccaacatgaaaacctcaaatatacagtcaccataactgtacacaccggcgaccagcaccaagtcgggaacgaaacacaaggagtgacagcggagattactccgcaagcatcaaccgtggaagcaatcctacctgagtatggtaccttgggtttggaatgtagcccaaggacaggcttagacttcaatgaaatgatactgttaaccatgaagaataaagcctggatggttcaccggcagtggttctttgatttaccgttgccatggactagcggcgcaaccacggagacaccgacttggaataagaaagagctccttgtaactttcaaaaacgctcatgcgaagaagcaggaagtggtggtattagggagtcaagagggtgcaatgcacacagcattaacaggagcaacagaaatacaaacgtcgggcggtacaagtatttttgccggccacctaaagtgcagattgaagatggataaactagagttgaagggtatgagctacgctatgtgtttaaacgcattcgtcctgaagaaagaggtatcagaaacgcagcatggaacaattttaataaaagttgagtacaaaggcgaagatgctccgtgtaagattccgtttagtacagaggatggacagggtaaagcacataacggacgtctaataacagctaatccgattgtgactaagaaagaagaaccagtcaacatagaagccgaacctccattcggtgaatctaatattgtaattggcataggtgacaaagctctaaaaataaattggtacaagaaaggatcctcaattgggaaaatgtttgaggcaacggcacgaggtgcccgccgaatggccatactcggagatacagcatgggatttcggtagtgtaggtggggtattaaattccctcggtaaaatggttcaccaaatatttggaagtgcctatactgccctattttcgggagtcagctggatcatgaaaataggaatcggtgttctgcttacctggatagggctaaatagcaaaaacacctcaatgtctttttcatgtatagttatagggataataactttatatttaggcgctgtagttcaagcggacatgggatgtgttataaattggaaaggtaaggaactaaaatgtggtagcggaatcttcgtgaccaatgaagtacacacctggacagagcaatacaaatttcaagccgactcaccaaaaagactagcaactgcaatagcgggtgcttgggaaaatggagtatgtggtattagatcgactacgcgaatggaaaatctactatggaagcaaatagcaaatgaacttaactacatattatgggaaaacaatatcaagttaacgatagtcgttggggatgtaataggagttctagaacaagggaaaagaactcttaccccgcagcccatggagctaaaatattcatggaaaacttggggaaaagcgaaaatagttactgcagaaactcaaaattcttcatttattatagacgggcctaacactccagagtgcccttcagcatctcgtgcgtggaatgtttgggaggtagaagactatggttttggggtctttacaacaaatatatggctgaaattaagggaagtatatactcaactgtgtgatcatcggctaatgtccgctgctgtaaaagatgaacgagccgtacacgcagatatggggtattggatcgaaagtcagaaaaacgggtcatggaaactagaaaaagcctcactaatcgaagtaaaaacgtgtacgtggcctaagtcgcacacactttggtcaaacggagtgcttgaatctgatatgataataccaaagtccttagctggccctatatcgcagcataactatcgaccaggctatcacacccagacagccggaccatggcatctaggtaaactggaactagatttcaattattgcgaagggacaacagtagtcatcacagagaactgtggtacacgcggaccaagcctacggactacgacagtctccgggaagttaatacacgagtggtgttgtcgtagttgtacactgccaccgttaaggtacatgggtgaagacggttgttggtatggtatggaaataagaccaataaacgagaaagaagaaaacatggtcaaatccttagtaagtgcaggaagcggcaaagcggacaattttactatgggcgtgctctgtctggcaatcctatttgaagaagtcatgagaggcaaatttggcaagaaacatatgattagcggtgcgctgtttaccttcgtattactactatcagggcaaatcacctggcgggacatggcgcacacactaataatgattgggtctaatgccagtgatagaatggggatgggagtaacatatttagcattaatagcaacattcaaaatacaaccattcctagcacttggtttctttttgagaaaattaacatctagggaaaatttacttttaggtgttggtttagcaatggctacaacactgcaacttccagaagatatcgaacaaatggcaaatggcatcgctctaggtctcatggcgctaaaactaataacgcaatttgaaacgtatcagctatggacagcacttgtatcactgatgtgcagtaacactatatttactctgacagttgcatggcggactgcaacactcatactcgctgtcatctctcttttgcccgtatgtcaatcttcttccatgaggaaaacggactggctccccatgactgtcgcagcgatgggagtaccacctctgcccctattcatctttagcctaaaagatacactaaaacgcagaagttggccgttgaacgaaggagtcatggctgttggattagtctcgatccttgcatcatcattcttaagaaatgacgtaccgatggcgggacctttggtagcgggtggcctattgatagcctgttatgtgataactgggacatctgctgatctgactgttgaaaaggcagcggatgtaacttgggaagaggaagcggaacaaacaggagtttctcacaatctaatgatcactgtagacgacgatgggacgatgcgcattaaagacgatgaaacagaaaatatcttaacagtactactaaaaacagcactactaattgtatccggaatattcccatattcaatccctgcaacgttgttagtttggcatacatggcagaagcaaacacaacgatctggcgtactgtgggatgtgccgagtccccctgaaacgcaaaaagcagaattagaagagggtgtataccggataaagcaacaaggtatattcggtaaaacacaagttggcgtcggagtccaaaaagaaggagtgttccatactatgtggcatgttacacgaggcgcggtactaacacataacggcaaacgcttagaaccaaactgggcgaacgttaagaaagatttgatttcatatggaggtgggtggaaactttctgctcagtggcaaaagggagaggaagtacaagtaatagcggtcgagcccggaaagaatccgaaaaactttcagaccatgccaggtatatttcaaaccaccactggagaaatcggagcgatagctcttgatttcaaacctggaacgtcaggttcccccatcataaatcgtgaaggaaaagtcgtaggcctatacgggaatggagtcgtaaccaaaaacgggggatacgtaagtggaattgcacaaaccaacgcagaaccagatgggccaaccccagaactagaagaagaaatgtttaagaaacgaaacttaacaataatggaccttcatccaggttctggtaaaactcgaaaataccttccggctatagtccgcgaggcaataaaacgaaggttaaggactctgattctagcacccacgcgagtagttgccgctgaaatggaagaggcccttaaaggactaccgattaggtatcaaactaccgccacaaaatcggaacatacaggtcgtgaaattgttgatctaatgtgccatgccacattcacaatgaggctactatcgcctgtaagagtcccgaattacaatttaattgtcatggatgaagcacactttaccgatccagcttctatcgcggcgagggggtatataagcacacgagtaggcatgggggaagcagcagctatattcatgactgccactcctccaggaactgcagatgcatttccacagtcaaatgcaccaattcaagatgaagaaagagacattcctgaaagatcatggaatagtggcaacgaatggataacagatttcgcaggcaaaacagtatggttcgttccaagtataaaagcaggaaacgatatcgcgaattgtcttaggaaaaacggcaagaaagttatacaactaagtagaaaaacgttcgacactgagtaccagaaaactaaattgaacgattgggacttcgtagtaacgaccgatatctcagaaatgggagcaaacttcaaagcagatcgggtaatagaccctagaaggtgcctaaaacctgtcatactgactgatggtcccgaacgtgtaattttggcaggcccaatgcccgtaacagttgcgtcagcagcgcagcggcgcggtcgcgtgggtagaaacccacaaaaagagaacgatcaatacatcttcactggacaaccactaaacaatgatgaagaccatgctcattggacagaagctaaaatgttattagataatatcaacacgccagagggcatcataccagcattgtttgaaccagaacgcgagaaaagtgcggctatagacggggaatatcggttaaaaggcgaaagtcgaaaaacatttgtagaactaatgagacggggagacttacctgtttggctggcacacaaggtagcatcggaaggaatcaaatatacagacagaaaatggtgttttgatggagagaggaataatcaaattttagaagaaaatatggatgttgaaatatggacaaaagaaggggagaagaagaaattacgtccgagatggctagacgctcgcacctactccgatccacttgccttgaaagagttcaaggatttcgctgctggtagaaaaagtattgcattagacttggtaacagaaatcggtagagtcccttcacatttggctcaccgaacgcgtaacgccttagataacttggttatgttacatacgagtgagcacgggggtagagcgtaccgtcacgctgtagaagagttgcctgaaacaatggaaacgttattacttcttgggttaatgatattacttacgggaggcgcaatgctatttttgattagtggtaaagggatcggcaaaacctcaataggtttaatttgtgtagtggcaagcagtggaatgttgtggatggcagacgttccattacaatggattgcttcggcaatagtccttgagttctttatgatggtgttattaatcccagaaccagaaaagcagcgaactcctcaagacaaccaattagcatatgtagtcatagggatcctcaccctagctgcaatagtggctgcgaatgaaatgggtttattggaaaccacaaaaagagacttaggcatgtccaaagaaccgggtgtagtttcacctacttcttatctagatgtggatttacatcccgcgagtgcatggacgctttatgctgttgccactaccgtcataacccctatgctacgccacacaatagaaaactctactgcaaacgttagtctagcagcaatcgcgaaccaagcggtggtactaatgggattagataaaggttggccaatttcgaaaatggatttgggcgtaccgttactagcgttaggatgctatagtcaggttaacccattaactttaactgcagctgttctattacttgtaacacattatgcaattattggacctggcttgcaggccaaggctacacgcgaagcacaaaaacgcacagcagctgggatcatgaaaaatccaaccgtggacggaataatgacgattgacttagatccggttatttatgacagtaaatttgaaaaacaactcggacaagtaatgctactggtcttatgcgccgtacaattacttctcatgaggacgtcatgggctttctgcgaagcgctcacattggcaacaggacctattactactttatgggaaggtagtccaggtaaattctggaacactacgattgcagtttcaatggctaatatatttagggggtcatacttagcaggagcaggtctcgcattcagtataatgaaatccgttggaacgggaaaaagagggacaggatcacaaggggagactctaggcgaaaagtggaagaagaaactaaatcaactatcaagaaaagaatttgatttatacaagaaatctggaataactgaggttgatagaactgaagctaaagaaggactaaaaagaggagaaataacacaccatgccgtaagtcgaggaagtgccaaacttcaatggtttgtcgagaggaacatggttataccggaagggagggtaatcgacctgggatgtggaagaggaggttggtcgtactattgcgccggattaaagaaagtaacggaagttaggggatatactaaaggcggtcctgggcatgaagaaccagtgccaatgagcacctatggttggaatatcgttaaattaatgtctggtaaagatgtattttatttaccccctgaaaagtgtgatacacttctatgcgatatcggtgaatcttcaccatctccgacagttgaagaaagtaggacaataagagtactgaaaatggtggaaccttggttaaagaacaatcagttctgtataaaagtgctaaacccatatatgcccacagtcatagaacatctagaaaggctacaaaggaagcacggaggcatgctggtaagaaacccactttcacgaaattccacacacgagatgtactggatatctaatggaaccggtaacattgtatctagcgtcaacatggtttcgcggctactgctcaataggtttacaatgacccatagacgaccgacaatagaaaaggatgtcgacttaggcgcaggtaccagacatgtaaatgcggaacccgagacaccgaacatggatgtgatcggagaaaggattcgtagaattaaggaagaacactcatcaacttggcactatgacgatgagaatccttataaaacctgggcgtaccatgggtcttatgaagtgaaagccacaggatctgcatctagcatgataaacggggtagtgaaattgctcacaaaaccttgggatgtagtgccgatggtaacacaaatggcaatgacagatacaaccccttttggccaacaacgagtgtttaaggagaaagtcgataccaggactccaagaccgatgcctggaacgaggaaagtgatggaaataacagctgaatggctatggcgaacgctaggtcgaaataaacgtcctagactgtgcacacgagaagagtttataaagaaagttcgcactaatgctgctatgggagcagtgttcacagaggagaaccagtgggacagtgcacgagcagccgttgaagatgaggaattttggaaactggttgatagagaaagggaacttcacaaattaggaaagtgcggatcatgcgtatacaatatgatgggaaaacgtgagaagaaactaggtgagttcggaaaagcgaaaggtagcagggctatatggtatatgtggcttggcgctcgatatttagagttcgaagccctaggatttcttaatgaagaccattggttttctagagaaaattcatattcgggagttgagggcgaaggactacataaacttggatatatattaagagatatctcaaaaattccgggaggtgctatgtacgcagacgatactgcaggatgggatacccgaattacagaagatgacctgcacaatgaagagaaaataactcagcaaatggatcctgaacacagacaacttgcaaatgccatatttaaattgacctatcagaacaaagttgttaaagtccaacgacccactcctaaaggaactgtcatggacataataagtcgaaaagatcaacgtgggtctggtcaagtgggcacttatggcctcaatacttttactaacatggaagcacaactaataaggcaaatggaaggagaaggggtgctatcaaaagctgatttagaaaacccttatctgctagaaaagaaagttactcaatggttagaaactaaaggagtcgaaaggcttaaacgcatggcaattagcggcgacgactgcgtagttaaaccaatagacgacagattcgctaacgcacttttagcattaaatgatatgggaaaggtcaggaaagatattccgcagtggcaaccgagtaaaggatggcatgattggcaacaggtacctttttgttcacaccattttcatgaattaatcatgaaagatggaagaaagttagtcgtgccttgtagaccacaagatgaactaatagggagagcccgtatttctcaaggtgccggctggagcctaagagaaacagcttgcctaggaaaagcatatgcacaaatgtgggcgctgatgtattttcacagacgagacttaagactagcaagcaatgcaatttgtagcgctgtcccggtacattgggtacctacgagccgaactacgtggtccatacacgctcatcaccaatggatgaccactgaggatatgcttacagtctggaatagagtttggatagaagataacccttggatggaggataaaacgccagtaaccacatgggaggacgtgccctacctcggaaaaagagaagaccaatggtgcggaagccttataggccttaccagtagggctacctgggctcaaaatatattaactgccatacaacaagtaaggagtttgattggaaatgaggaatttctcgattacatgccaagtatgaagagatttagaaaagaggaagaatcggagggcgcaatttggtaa

SEQ ID NO: 23582 - RNA, 9873 nt, synthetic construct
  misc_feature 1..9873: note = derived and/or modified CDS sequence (opt6) from DENV-3__AY744683__SS-prME
  source 1..9873: mol_type = other RNA
acttcgctatgtctaatgatgatgttacccgctaccttagcatttcatttgacgtcacgagatggtgaacctcgaatgatagtaggcaaaaacgaacgtggaaaaagtttgttatttaaaactgcatcaggtattaacatgtgtacgttaatagcaatggatttgggagaaatgtgcgatgatactgtcacgtataaatgtcccttaataaccgaagtggagcccgaagacattgactgttggtgtaaccttactagcacatgggttacttatggtacctgtaatcaagcaggggaacatcggagagacaaacgcagcgtagccctagcaccgcacgtgggaatgggtcttgatacaagaacgcaaacgtggatgagtgcagaaggagcttggcgacaagttgaaaaagtcgagacgtgggcttttagacaccccggttttactatactagcactatttctggcacattatattggcacctcattgacacaaaaagtagttatttttattttactaatgctggtaaccccgagtatgacaatgcgctgtgtaggtgtagggaacagagacttcgttgaaggtttatccggcgcaacttgggtagatgtagtacttgaacatggtggttgtgtaaccacaatggctaaaaacaaaccgacacttgacatcgaattgcagaaaacggaagcaacacaattagccacattacgcaaattgtgcatagagggaaaaattactaatgtgacgacagattcgcgttgcccaactcaaggggaagcgatactcccggaagaacaagatcaaaattatgtgtgtaaacacacgtacgtagatcgaggctggggaaatggatgcggattatttgggaaaggaagtctagtcacttgtgcaaaatttcaatgtttagaatcaattgaaggaaaagccgtacaacatgagaatctaaaatacaccgtgatcataactgtccacactggagatcaacatcaagtaggaaatgagacacagggagttaccgcagaaatcactccacaggcttcaactgtagaggcgatactacctgaatacgggacgctcggtcttgaatgtagcccgaggacgggcctagactttaatgagatgattcttttaactatgaaaaataaagcctggatggtgcatcgacaatggtttttcgatttaccactgccgtggacatcaggggcgactacagaaaccccaacttggaataagaaagaattgttagttacatttaaaaatgcgcatgccaagaaacaagaagtagtagtattaggtagtcaagaaggagcaatgcacacagctcttaccggggcaacagagatacaaacctccggtggaaccagcatcttcgccggacatctgaaatgtcgattaaaaatggacaaattagagttgaaaggaatgagttatgctatgtgtttaaatgctttcgtgttaaagaaagaagtaagcgaaacacaacatggtacgatattaattaaagtagagtataaaggggaggacgcaccatgtaaaattcccttttcgaccgaggatggacagggcaaagcgcataatggacgtctcataacagccaaccctatcgtaacaaagaaagaagaacccgtaaacattgaggcggaacctccttttggcgaaagtaacatagttataggaataggggataaagcattgaaaatcaactggtacaagaaagggtcatcaattggaaaaatgtttgaagcaacagccaggggcgcacgaaggatggctattctcggtgacaccgcgtgggacttcggaagcgtaggaggagtactaaattcattagggaaaatggtacatcagatatttggatctgcatacactgcacttttcagcggcgtatcgtggataatgaaaatcggaataggcgtactactaacatggataggactgaacagcaaaaatacatcgatgagcttctcttgtatagtgatagggataataacgctatacttaggagcagtagtgcaagcagacatgggatgtgtaattaactggaaaggcaaagaacttaaatgtggatccggaatatttgttacaaacgaagttcacacatggactgaacaatataaattccaagcagacagccctaaacggcttgctaccgcaatcgccggtgcatgggagaatggggtatgcggcatacgatccacaaccaggatggagaatttactatggaaacaaatagcaaacgaactaaactacatattatgggaaaataatataaaactaactatcgtcgtaggggatgtaataggagtgcttgaacaggggaaacggactttaacgccacaacctatggaactaaaatattcttggaaaacatggggtaaagctaaaattgttactgcggaaacacaaaattcttcattcattatagatggtccaaacacgcctgaatgcccctctgccagccgtgcatggaatgtttgggaggtagaagactatggatttggagtctttaccacaaatatatggctaaaactaagggaaatgtacacacaactctgtgatcaccgcttaatgtcagctgctgtaaaagatgagagagcagtacatgcagacatgggctattggatagagtcacagaaaaatggtagttggaaattggaaaaagctagtttaatagaagtcaaaacatgtacttggccaaaaagtcatacgctatggagcaatggcgtattagagtcggatatgataatacctaaatctttggcggggcctatatcacagcacaattacagacctggatatcacactcaaacagcgggtccttggcatctcgggaaattggaactagacttcaattattgcgaaggcacaacagttgtaattacggaaaactgtggcacaagaggcccgagtcttcgaactactaccgtatcaggtaaattaatacacgaatggtgttgtaggagttgcacactaccaccactgcgatatatgggcgaagatgggtgttggtacggaatggaaattaggcctatcaacgaaaaagaagagaacatggtaaaatcgctagtatcggcaggatcagggaaagcagacaatttcacaatgggagttttatgccttgctatcttgtttgaggaggttatgagaggaaaattcggcaagaaacatatgatcgccggtgcactatttaccttcgtactacttttatccggacaaatcacttggagagatatggcccataccttaatcatgataggctctaacgcttcagatcgaatgggtatgggcgttacctatttggcactaattgctacatttaaaattcaaccatttcttgctcttggatttttcctacgaaaattgacgtctcgagaaaacctacttctaggagtcggtcttgcgatggctacgaccctacaactgccagaggatatagagcaaatggcaaatggaatcgcactaggtctcatggccttaaaactcataacacaattcgaaacctaccaactgtggaccgcattggtgtccttgatgtgttccaatacaatctttacactcacagtagcatggaggacagcgacactaatattagccgttatatccctattgcccgtgtgccagagtagcagtatgagaaaaacggattggctaccaatgaccgtggctgcgatgggagtgccaccgttgcccctctttatattttctctcaaagacacacttaaacggcgcagttggccgttgaacgaaggagtaatggcagtaggcctcgtatccatcttagccagcagttttcttcgcaatgatgtcccaatggccggaccccttgttgctggaggtttgttaatagcctgttacgtaataacaggcacgtcagccgatttaaccgtcgaaaaagcagcagacgtaacttgggaggaagaagcggaacaaacaggagtttctcacaatttaatgataactgtggatgacgatggcaccatgagaattaaagacgacgaaacagaaaatatactaactgttctacttaaaaccgcactattaatcgtctctggtatatttccatactcgataccggccaccctactggtttggcacacttggcaaaaacaaacgcaacgcagtggagtactctgggatgtccctagtccacccgaaacacaaaaagcggaattagaagaaggagtttatagaataaagcaacaagggattttcggaaaaactcaagtaggcgtcggggttcaaaaggaaggggtattccataccatgtggcacgtaacaagaggagcagtcttaacacacaatgggaaaagactagaaccgaattgggcaaacgtcaagaaagaccttattagctacggaggcggctggaaattaagtgcacaatggcaaaaaggagaagaagtacaagttattgcagtggaaccagggaagaacccgaaaaattttcaaacaatgccgggaatatttcaaacgacgacaggcgaaattggtgctatagcgttagattttaaaccaggtactagcgggagtccgattataaatcgtgaaggaaaagttgtaggactatacgggaatggggtcgtaacaaagaacggcggttacgttagcggaattgctcagactaatgctgaaccagacggaccaacccctgaattggaagaagaaatgtttaaaaagagaaatctaacaatcatggaccttcacccaggttctgggaaaacgaggaaatatctgccagcaatcgtaagagaagcaataaaacgaagacttcgcacactgatattagctcctactagagtagtcgcagcagaaatggaagaggctttaaaaggactccctataaggtaccaaacaacagctacaaaaagtgaacataccggtcgagaaatagttgatcttatgtgccacgctacatttacaatgaggcttctaagtccagtccgagtccctaattataacctcatagttatggacgaggcccactttactgatcccgcaagcatagctgcacgaggttatattagcaccagagtaggaatgggtgaagcagccgccatattcatgacggcaacaccacccggtacagctgacgcttttccacagagcaatgcaccaatccaagacgaagaaagagatataccggaaaggtcctggaactctggaaacgaatggataacggatttcgccggaaaaaccgtgtggtttgtcccctctataaaagcaggcaacgacatagcaaattgtctgcgtaaaaacggaaagaaggtgatacaattaagcagaaaaacatttgatacggaatatcagaagacaaaattaaatgattgggattttgtagtaacaacagatatatcagaaatgggagcaaactttaaagcagacagagtcattgatccgaggaggtgcttaaaaccagtgatattaacagatgggcccgagagagttatacttgctggtccaatgcctgttaccgttgccagtgctgcgcaaaggaggggaagagtaggaagaaacccccagaaagaaaacgatcaatatatattcaccggccagcctcttaacaatgacgaggaccacgcacattggaccgaagcaaaaatgcttttagataatataaatactcctgaaggtattatacccgccctgttcgagccggagcgtgagaagagtgcagctattgatggtgagtatcgactgaaaggcgaaagtcgaaagacattcgtcgaattaatgcgtagaggagatttaccggtatggctcgctcacaaggtagcgtcggagggtattaaatatacagatcgcaaatggtgtttcgacggtgaacgtaataatcaaattctcgaagaaaatatggacgttgaaatatggactaaagaaggagagaagaagaaacttcgcccgcggtggttagatgcaagaacatattccgacccgctagctttgaaggaatttaaagactttgcggcagggcgtaaatcgattgctctggatctggtaactgagattggtagggtaccttctcatcttgcacaccgaaccaggaacgcactcgacaatctagtcatgcttcatacctcagagcatggtgggcgggcatatcgtcatgcagtcgaagaacttccggaaactatggaaactcttttgctattagggttaatgatactcttaaccggtggagctatgttatttttgatcagtggcaaaggaataggaaaaacaagtatcggattaatatgcgtagtagccagctcaggaatgctatggatggcggatgtaccgctccagtggatagcgtcagccatagtattggagttctttatgatggtattactaatacctgaaccggaaaagcaaagaactcctcaagataaccaactagcatatgttgtaataggcatattgacactggcagctatagtagcagcaaatgaaatgggtctacttgagacgacaaaaagagacttaggcatgagcaaggaaccaggggtagttagccccacaagctatttagacgtagaccttcatcctgcatctgcatggactctttatgctgtcgcaacgacggttataactcccatgttacgtcatacaatcgagaatagcactgcaaatgtaagtctggcagctatcgcaaaccaagctgtagttctaatggggctagacaaagggtggcctatttcgaaaatggatctaggggtgccattgttagcgttaggatgctattctcaagtaaatccgctaactctaactgctgccgtattgcttctggtaacgcattatgcgattataggtccgggtctacaggcaaaggcaaccagggaagcacagaaaagaacggcagccggaattatgaagaaccccaccgtggatggaatcatgacgatagacttagacccggtgatttacgatagtaaatttgaaaaacaactgggtcaggttatgctcttagtattatgtgcagtccaattattactcatgcgtacaagctgggccttttgcgaagcattaaccctagctacaggccctatcacgacattgtgggaaggatccccaggcaaattctggaatacgacaattgctgtctccatggcaaacatttttagaggatcttacctagccggagcaggtcttgcgttctcgatcatgaaaagcgtcggaaccggcaaacgaggaactggaagccaaggtgaaacattgggcgaaaagtggaagaagaaacttaaccaactatcgcgtaaagaatttgacctatacaagaaatcggggattacagaagtcgatagaacggaagcgaaagaagggttaaaacgtggagaaattacacaccatgcggtgagtagaggaagtgcaaaattgcaatggttcgttgaaaggaatatggtgataccggaggggagagtaatagacttaggttgtggacgtggaggttggagttactactgtgctggtctgaaaaaggttacggaggttcgaggatatactaaagggggaccaggccatgaagaacccgtacctatgtcgacttacggttggaatatagttaaactcatgtcagggaaagatgtcttctacttaccacccgaaaaatgtgatacccttctatgtgatattggtgaatcctcaccaagtccaacggtcgaggaaagccgaacaatccgagtgttaaaaatggttgaaccgtggttgaaaaataatcaattttgtattaaggtactaaacccatatatgccgactgtaatagaacacctagaacgattgcaaagaaagcacgggggtatgcttgtaagaaatccattaagtagaaattcgacacatgaaatgtattggatttcgaatggaaccggcaacatagtgtcgtctgtaaatatggtgtcaaggttactattaaatagatttactatgacccatagaagaccaactattgagaaggatgttgatttaggagctggaactagacatgtgaacgcagaaccagaaacaccaaatatggacgtaattggagaacgtatcagacggattaaagaggaacacagctcaacgtggcattacgatgacgaaaatccatacaaaacatgggcataccatggaagttatgaagttaaagctacggggagtgcctcgtcaatgataaacggtgtagttaagttgttgacaaagccttgggatgtcgtgccgatggttacacagatggcgatgacagatacaaccccttttggccagcaaagagtattcaaagagaaagtagatacacgaactccgaggcccatgccaggtactagaaaagttatggaaattactgcagagtggctatggagaaccctagggagaaacaagaggcccagattgtgcacgcgcgaagaatttatcaagaaagttagaactaatgctgcaatgggtgcagttttcacagaagaaaatcaatgggattccgcaagggcagccgttgaagacgaggaattttggaaactggtcgacagagaaagagaattacataaactaggaaagtgcggatcctgtgtatacaacatgatgggaaaaagagagaagaaattaggtgaatttggaaaggccaaaggcagtcgagcgatatggtacatgtggctaggtgcaagatttttagagtttgaagcactcggatttttaaacgaagaccactggttctcaagggaaaactcatatagtggagtagaaggcgagggattacataagctaggttacatattaagggacatatcaaaaataccaggaggagctatgtacgcagatgatacagctggttgggatactagaattacagaggacgatttacacaacgaggaaaagatcacccaacagatggatcccgaacatagacagctagcaaatgctatattcaaactaacatatcaaaataaagttgtaaaagtccaaagaccaacaccaaagggtacagtgatggacatcatatccagaaaagaccagcgcggaagtggacaagttggtacgtatgggttaaacacttttactaatatggaagctcagcttatacgacaaatggaaggagaaggcgtcctgtcgaaagctgatttggaaaatccacacctattagagaagaaagtaactcaatggctagaaacaaaaggagtagagaggttaaagcgaatggctattagcggggatgattgtgttgtaaaaccgatagatgatagatttgccaacgcattactggcactcaacgacatgggaaaagttagaaaagatataccccaatggcagcccagcaaaggatggcatgattggcaacaggttccgttttgttcgcaccactttcatgagttgatcatgaaagacggacgaaagctagtagttccctgtagacctcaagatgaattgatcggtcgtgcgagaataagtcagggcgccgggtggtctctcagggaaactgcctgtttaggtaaagcctatgctcaaatgtgggcgttgatgtatttccacagaagagatctaagactcgccagcaacgcgatttgcagtgcggtaccagttcattgggtacccacgagtaggactacttggtcgatccatgcccaccaccaatggatgacaactgaagacatgcttaccgtttggaacagagtttggatagaggacaacccatggatggaagacaaaacgccagttactacatgggaggatgtaccttacttaggaaagcgagaggaccagtggtgtgggtcacttatcggcttaacgtccagagcaacttgggctcaaaacatattaactgcgatacagcaagtaagaagcctaattggaaacgaagaatttcttgactatatgcctagtatgaaaaggtttcgcaaggaagaagaatcggagggtgctatatggtaa

SEQ ID NO: 23583 - RNA, 9873 nt, synthetic construct
  misc_feature 1..9873: note = derived and/or modified CDS sequence (opt6) from DENV-3__AY744684__SS-prME
  source 1..9873: mol_type = other RNA
acttcgttgtgtctaatgatgatgctaccggcaactctagcattccacctaacttctcgtgacggtgaaccgcgtatgatagttggtaaaaatgaaaggggtaaatctttactattcaaaacagcgagtggaataaatatgtgtactttaattgcaatggacttaggcgaaatgtgtgacgatactgttacttacaaatgtccattgataactgaagtggaacccgaagacatagactgttggtgcaaccttacctctacctgggttacatatggtacatgcaaccaagcaggggaacaccgaagagacaaaagatccgttgcacttgcaccacatgtaggaatggggctagatacgaggacccaaacttggatgtctgcagaaggagcatggcgacaagtagaaaaagtagaaacgtgggcattcagacaccccgggttcacgatcctggcactgtttttagcgcattacattgggacgtcactaacccaaaaagttgtgatctttatattattaatgctagtaactcctagtatgacgatgcgttgtgtaggtgtgggcaatcgagactttgttgaagggttaagtggagcaacatgggtggacgtagtgctagaacatggagggtgtgttactacaatggctaaaaataaacctactcttgacatagaattgcagaaaactgaagcgacacaattagctacgttacgaaaactatgtatagaaggcaaaatcacaaatgttacaactgattctagatgccccacgcaaggcgaagctattttacctgaagaacaagaccaaaattacgtctgcaaacacacctatgtcgaccgaggatggggaaatggttgtggtctattcggcaaaggcagtctcgtcacttgtgccaaattccaatgccttgaatcaattgaaggtaaagcagtccaacatgaaaatcttaaatataccgtaataataaccgtacacacaggtgaccagcatcaagttggaaatgaaacacaaggtgtaaccgctgaaataactccacaggcttccacagtagaagcgatactaccagagtacggcactttaggtttagagtgttcacccaggactggattagattttaatgaaatgatacttttgacgatgaaaaataaggcttggatggtacaccgtcaatggttctttgatttacccttaccatggacaagcggagcaactactgaaacaccaacgtggaataagaaagaactattagtcacatttaaaaacgctcatgccaagaaacaagaagtggttgttctgggaagtcaagagggggctatgcatacagcactaactggtgctacggaaatacaaacttccggaggaaccagtatttttgcaggtcatttaaaatgccgactcaaaatggataaacttgaactgaaaggaatgtcttatgctatgtgccttaacgcatttgttcttaagaaagaggtgtctgagacacagcatggaacaatactaatcaaagtagagtacaaaggagaagatgctccgtgcaaaataccattttccacagaagacggccaaggcaaagcacacaatggaaggcttattacggcaaatcccattgtcaccaagaaagaagaaccagtgaatatagaagcagagcctccttttggcgaaagtaacatagttataggaattggggataaagctctgaaaatcaattggtataagaaagggtcaagtataggtaaaatgttcgaagctacagctaggggagctcgaagaatggccattttaggagatactgcgtgggacttcgggagtgtaggtggagttctaaattcactaggtaaaatggtgcatcagatcttcgggtctgcgtacactgcactattttccggagtatcatggataatgaaaatcgggataggagtattattgacttggataggtttaaatagcaaaaatacaagtatgagtttctcatgcatagttatcggaattataacgctatatttaggcgcagttgtccaagccgacatggggtgtgtgataaattggaaaggtaaagagctaaaatgtggtagtggtatctttgtcacaaatgaagtacacacctggaccgaacaatacaaattccaagccgacagtccaaaaaggttggccactgcaatagcaggagcttgggaaaacggtgtttgtggcataagatccacaacgagaatggagaacttactgtggaaacagattgcaaacgagttaaactacatcttatgggagaacaatattaaattaacaatagtagtcggtgatgtcataggggttcttgaacaaggcaaacgtacactcacgccacagccaatggaactaaagtattcttggaaaacatggggtaaagccaaaattgtaacagcagagacccaaaatagctcatttatcatagatggaccaaacacgccagaatgtccatctgcaagccgagcgtggaatgtctgggaggttgaagactacggtttcggcgttttcacaactaacatatggcttaaactaagagaaatgtacacccaattatgcgaccacaggcttatgagtgcagcagtaaaagatgaacgggctgtgcatgctgatatgggatactggatcgaatctcagaaaaatgggagctggaagctagagaaagcatcgttaatagaggttaaaacttgtacctggcccaaaagccatactctttggtccaatggagtgttggaatcagatatgattatacctaaaagcctagctggtccgatatctcaacataactacagaccaggataccatactcaaacggcaggtccatggcatctaggtaaattagaattagacttcaattactgtgaaggcaccaccgtagtaattacagaaaattgtggaacacgagggccatcacttagaaccacaaccgtgtcaggtaaattaattcatgaatggtgttgccgttcatgtacattaccaccattaagatatatgggagaggatggatgctggtatggtatggaaatccgcccaataaatgaaaaagaagaaaacatggtaaaaagcctcgtatcagcaggatccggaaaagcagataatttcacgatgggagtgttatgtctagcaatactattcgaagaagtgatgagaggaaagtttggcaagaaacatatgatcgcgggagcgctctttaccttcgttttattactcagcggtcaaattacgtggcgagacatggcacacacattgataatgatcggaagtaacgcgtcagatcggatggggatgggtgtaacttatctggctcttatagctacatttaaaattcagccattcctagctttgggtttctttctgagaaagttaacatctcgcgaaaatttactgttaggtgtaggcttagcaatggcaaccaccttacaattaccagaggatatcgaacaaatggccaatggtatagcccttggactcatggctttaaaacttataacacaattcgaaacctatcaattatggactgccttagtttccttaatgtgttctaacaccatctctacacttactgttgcatggaggacagcaacactcatcctagcagtaatttcgttactacctgtttgtcagtcaagttcgatgcgtaagacagattggctgccgatgacagtcgctgcaatgggggtaccacccctaccgctgtttatcttttcccttaaggacacgttaaaaaggagatcatggccactaaatgaaggggtaatggctgtagggctagtaagtatactcgcatcatctttcttacgcaatgacgtgcccatggcgggacccctggtagctggaggattgcttatagcgtgttatgtgataactggaactagcgcggatctaacagttgagaaagcagctgatgtaacttgggaagaagaagcagaacaaactggtgtctcacacaatcttatgataactgtcgatgacgacgggactatgcgtatcaaagatgatgaaacggagaatatactaacagtgctcctaaaaacagccttacttattgttagcggaatatttccatactcaattccagcaactttacttgtctggcacacctggcaaaaacagacccaaaggagtggagtgttgtgggacgtcccatcacctccagagacacaaaaagcggaactagaagaaggcgtctatagaataaaacaacaaggtatatttggcaaaacacaagtgggggttggagttcagaaggaaggagtttttcacaccatgtggcacgtcacacgaggggcagtactcacgcacaatggaaaacgtcttgaacctaattgggcaaatgtgaagaaagacctaatatcctatgggggaggatggaaattaagcgcacaatggcaaaaaggggaggaagtacaagtgatagccgtcgaacccggtaaaaaccccaaaaattttcaaacaatgcctggtatatttcagactacaacgggtgaaatcggtgcaatcgcattagattttaaaccaggtacaagtggttcacccataattaatagagaggggaaggtagtgggtctttatgggaacggtgtagttactaaaaatggtggatacgtctcaggcatagctcaaacaaatgcggaaccagatggtccaacgccagaactagaggaagaaatgtttaaaaagcgaaatctgaccatcatggatctacatcctggcagcggaaagacaaggaaatatttaccggcaatagtaagagaagccattaaaaggcgattgcggacgttaatattagcacccacaagggtagtagcggcggaaatggaagaggctttgaaagggcttccaattagataccaaacaacagccacaaaatcagaacataccggtcgggaaatagtagatcttatgtgtcatgccacttttacaatgcgattgttgagtccagtgagggtccctaattataaccttatcgttatggatgaagcacactttacagatccggcaagtatagctgcaagaggatacatatcgacacgagtaggcatgggtgaggcggctgctatatttatgactgcgacgccacccggaacagcggacgcatttccccaatcaaatgctccaatacaagatgaggagagagacataccagagaggagttggaactcaggtaatgagtggatcaccgattttgcaggaaaaaccgtatggtttgtacctagcataaaggctggtaacgacatagccaattgtctaaggaaaaatggaaagaaagtgatccaactgtccagaaagacatttgacacggaatatcagaaaactaaactcaacgattgggatttcgttgtgacaacagacatatctgagatgggagctaattttaaagcggacagagtaatagaccctcgccgatgcttaaagccggttatacttaccgatggacccgaacgtgttattcttgcagggccaatgccagttaccgttgcaagcgctgcacaaagacggggacgagttgggagaaacccacaaaaagaaaatgatcaatatatcttcacaggacagcccctgaataatgacgaagaccacgcacattggaccgaagccaagatgttgctggataatatcaatacacctgaggggattattccagcactattcgaaccagaaagagagaaatccgctgcaattgatggcgagtaccggctaaaaggagaatccagaaaaacattcgtggaactaatgaggagaggtgacctaccagtatggttagctcataaagtagcttcggaaggcataaaatatactgatagaaaatggtgttttgatggagaaagaaacaatcagattttagaagagaacatggatgtcgaaatctggacaaaagaaggagagaagaagaaactaagaccacggtggttggatgctagaacttattcagaccctcttgctctcaaagagttcaaagatttcgcagcaggaagaaaaagtatagcattagatttagtgacagaaataggccgagtaccttcgcaccttgcacataggactagaaatgcattggataatctcgtaatgttacatacatcggaacacggcggacgggcataccgacacgcagttgaggaacttccagaaacaatggaaaccctactcctattaggccttatgatcctactgaccggcggagctatgttatttctaatttcgggcaaaggcataggaaaaacgtcaatcggactcatatgtgtggtggcgagtagcggaatgttgtggatggcggacgtgccactacaatggatagccagtgcaatcgtattagagttcttcatgatggtgttgttaatccctgaacccgaaaaacaacggacgccacaagacaatcaactcgcatatgtagtaatagggattttgacactagcagctatcgtcgcagcgaacgagatgggcctcttggaaaccactaaaagagacctcggaatgtctaaggaacccggcgtagtatcaccaacctcatacctcgatgtcgacctacacccagcatcagcatggacactctatgcagttgctacaacagtaataactccaatgttacggcacacaatcgaaaacagtactgctaatgtttcactggcagctatagcaaaccaagctgtcgtattaatgggtctagacaaaggttggccaattagtaaaatggatttaggcgtaccgctattagcactaggttgttatagtcaagttaatcccctaactcttacagctgcagtgctattattggtcacccactatgcaatcattgggccagggctacaagctaaagctactcgtgaagcacagaaacgaacagcggcaggcattatgaaaaaccctacagttgatggaatcatgacaattgatctagatccagtaatatatgattcaaaatttgaaaaacaactcggccaagtaatgctacttgttctctgtgctgtacaattattactaatgcgaacttcttgggcattttgcgaagccctcacattggctactggaccaataactacgctgtgggaaggttcaccaggaaagttttggaacactacaatcgctgttagtatggccaacatattccgaggcagttatcttgctggggccggattagcatttagcattatgaaatctgtggggaccggcaaacgtggaacaggctcacagggtgagacattgggtgaaaagtggaagaagaaactgaaccaactatctaggaaagagttcgatctatataagaaatcgggcataacagaagtagaccgcacggaagcaaaggaaggacttaaaagaggtgagataacgcatcatgcagtaagtagaggctcggccaaattacagtggtttgtagagcgaaatatggttataccggaagggagagtcatcgatttaggttgtggcagaggtggttggagttactattgcgcaggtctcaagaaagttacagaagtgcgaggctacactaagggaggtccaggacatgaagaaccagttccgatgtcaacatatggttggaacattgtaaaacttatgagtggaaaggatgtattttatttgccacctgaaaagtgcgataccctattatgtgatataggggaatcgagtcccagtccaactgtcgaggaaagcagaacgatacgcgtattaaagatggttgagccgtggcttaaaaacaatcagttttgcattaaagtcttaaatccatatatgcccactgtaatcgaacacttggaacggttacaaaggaaacatgggggaatgttagtcagaaatccattatcaaggaactctacacatgagatgtactggatctctaatggtactggaaatatcgtctcctcagtcaatatggtgtccagactattactaaaccgattcacaatgactcataggcggccaaccattgaaaaagatgtcgacctaggtgccggcacccgtcacgttaatgcagaaccagaaacaccgaacatggacgtgataggtgagcgcatacgtagaataaaagaggagcactctagcacgtggcattatgacgatgaaaatccatataaaacatgggcctatcatgggagttatgaagttaaagccactggatccgcgagttctatgatcaatggagtagtgaagctgttgacgaagccatgggacgtggtgcctatggtgacacagatggccatgaccgacactacaccatttggacaacaaagagtctttaaagaaaaagttgatacgagaaccccgagaccaatgccaggaacacgaaaagttatggaaataacagctgagtggttgtggagaacgttaggacgaaacaaaagaccccgcttgtgcacaagagaagagttcatcaagaaagtaagaacaaatgcagctatgggtgcggtcttcaccgaagaaaatcaatgggattcagccagagccgcagtagaagatgaagaattttggaagctagtcgaccgtgaacgcgaactacataaactgggcaaatgcggtagttgcgtgtataacatgatgggaaaaagagagaagaaactaggagagttcggtaaagccaaaggttcgagagctatttggtatatgtggttaggagctagatacctggaatttgaagctctgggattccttaatgaagaccattggttttcccgtgaaaacagctattcgggagtcgaaggggaaggattacataaattaggatacatattaagagatatctctaaaatacccggcggtgcgatgtacgccgatgacactgctggatgggatacccgcataaccgaggatgatctacacaatgaagagaaaattactcaacagatggatccagaacatagacagcttgcaaatgctatttttaaacttacatatcaaaacaaagttgtgaaagtacagaggccgacaccgaagggcacagttatggacatcatttcaaggaaagatcagagaggaagcggacaagtaggaacatacggtctgaatacattcacaaatatggaagcacagttaattcgacagatggagggtgagggagttctaagcaaagcagaccttgagaatccacatcttttagaaaagaaagtcactcaatggttagagaccaaaggcgttgaacgcctaaaacgcatggcaatttcaggagatgattgtgtagttaaacccattgatgataggtttgccaacgctcttttggcattaaatgatatgggaaaagtgaggaaggacattcctcaatggcaaccttcgaaaggttggcacgattggcaacaagttccattctgcagccatcattttcatgaattaataatgaaagacggccgaaaattagtggttccgtgcagaccgcaagatgaacttattggacgggcgagaatatcacaaggtgcaggctggtcattaagggaaacagcctgtctagggaaagcatatgcacagatgtgggctctcatgtattttcatagacgtgatctccgtttagccagtaacgcaatttgttccgcagtgccagttcactgggtccccacatctaggacaacgtggtcaatacatgcccaccatcaatggatgacaactgaagacatgctcacagtatggaatcgagtgtggattgaagataatccatggatggaagacaaaacaccagttacaacgtgggaagatgtaccttatcttggcaaaagagaagatcaatggtgcggcagtttaattggcctgacttcgagagctacatgggcacaaaacatacttactgcgatccaacaagtaagatcattgataggaaacgaggagttccttgactatatgccatcaatgaaaaggtttaggaaagaagaggaaagcgaaggcgccatatggtaa

SEQ ID NO: 23584 - RNA, 9873 nt, synthetic construct
  misc_feature 1..9873: note = derived and/or modified CDS sequence (opt6) from DENV-3__AY744685__SS-prME
  source 1..9873: mol_type = other RNA
accagtctatgcttaatgatgatgcttccagcgactcttgcatttcatcttacttcccgcgacggagaaccacgaatgatcgtgggcaaaaacgaacgaggtaaatctttgctttttaaaacggcgtcaggtataaatatgtgcaccctaatcgcaatggacctaggagaaatgtgtgatgacacagtaacttataaatgtccattgataacagaagttgaacccgaagacattgattgctggtgtaatcttacctccacatgggtcacatacgggacatgtaaccaggctggagaacacagaagggacaaacgtagtgtagcattagccccacatgtaggtatggggcttgataccaggacccaaacgtggatgtccgcagaaggggcatggcgtcaggtcgaaaaagtagagacgtgggcatttagacatccaggttttacaatactggcactgtttctggctcactatatagggacgtcgctaacgcaaaaagtcgtaatatttatactgctaatgctagtaacaccaagtatgactatgagatgtgtaggggtaggaaaccgtgattttgtagaaggactatcgggtgcaacatgggtagacgtggtacttgagcatggtgggtgtgtaactacaatggctaaaaataaaccaactctggatattgaactgcagaaaaccgaagctactcaactagctacgctacgtaaattgtgcattgaaggaaaaataacaaacgtgacaaccgactcgcgctgtccaactcaaggagaagctatactaccagaagaacaagaccaaaactatgtatgtaaacacacttacgttgatagaggatggggaaatggatgcgggctttttggcaaagggagtctagtaacatgtgcgaaatttcaatgtcttgaaagcatagaaggaaaagctgtacaacatgaaaatctaaaatatacagtaataataacggtccacacgggagaccaacatcaagtagggaacgagatgcagggagtcacagcagaaataactccgcaggcctctacagttgaagctattctacccgaatatggaacactaggcttagaatgtagcccacgcaccggactagatttcaatgaaatgattctattaactatgaaaaacaaagcatggatggtacataggcaatggtttttcgacttaccccttccgtggacttctggagctactacagaaacaccaacctggaacaagaaagaattattagtaacctttaaaaacgcacatgcgaagaaacaagaggttgtggtgttaggatcgcaagaaggtgccatgcatacagcactaacgggggcaacagaaattcaaacttccggaggaacaagcatcttcgcaggacacttgaaatgccgactaaaaatggacaaattggaactaaaaggcatgtcgtatgccatgtgtctcaacgcatttgtcctcaagaaagaagtttccgagacgcagcacggtactatattaataaaagttgaatacaaaggtgaagacgcaccttgtaaaataccattctcaaccgaagacggtcaaggaaaagcacacaacgggcgtctaattactgcgaatcccatagttactaagaaagaagaacccgtgaatatcgaagcagaacccccatttggagaatctaatatcgttattggaattggcgacaaggctttaaagataaattggtataagaaaggaagttcaataggaaagatgttcgaggcgacagccagaggtgcacgacggatggcgatattaggagacactgcatgggatttcggatcagtgggcggagtattaaattcactaggaaaaatggtccaccagatttttggaagtgcgtatacagctctattttcaggcgtgagttggataatgaaaataggaataggagtactcctcacatggataggattaaattctaaaaacgcgtctatgagtttcagctgtattgtaatcggaatcataacgttatatctgggagctgtggtgcaagcagatatgggttgcgtaataaattggaagggcaaagaactaaagtgtgggtctgggatatttgtcacaaatgaggtacacacgtggacagaacagtataaattccaggctgattcacctaaaaggttagccacagcaatcgccggggcatgggagaacggagtgtgcggtataagatctacaacgcggatggaaaatctgttatggaaacaaattgccaacgagctaaattatattttatgggaaaacaatataaagctgacaattgtagttggtgatgtaatcggagtcttggaacaaggtaaaagaacattgacgcctcagccaatggaactaaaatattcatggaaaacatggggaaaagcaaaaatagtaacagccgaaacacaaaatagctcatttatcattgacgggccaaatacgcccgaatgccctagtgctctccgcgcatggaatgtatgggaagtagaggattatggattcggagtatttacaaccaatatctggttgaagttaagagaaaaatatacacaactttgtgatcatcgactaatgtctgcagcagtaaaagatgaaagagccgtacatgcagatatgggctattggatagaatcgcagaaaaatggttcctggaaattagaaaaggcgtcacttatagaagtaaaaacttgtacatggccaaaaagccacacgttatggagcaatggagtgttagaatcagatatgatcataccgaagagtctagcgggaccaatctcccaacataactatcgtcccggataccatacacaaacagccggaccgtggcatcttggaaaattggaactagattttaattattgcgagggtacaacagtggtaataaccgaaaactgtggtattcgaggacccagcctgaggacaactactgtatcaggtaaacttatacacgaatggtgttgcaggagctgtaccctaccaccacttcgctacatgggtgaagatggatgttggtatggtatggaaattcgaccaataaatgaaaaagaagaaaatatggtaaaaagtctcgtcagtgcaggatcgggcaaaactgataacttcacaatgggtgtcctttgcttagcgattttatttgaagaagtaatgagaggcaaatttggcaagaaacacatgatagccggtgcactatttacgtttgtgctcttactaagcgggcaaataacttggcgcgatatggcccatacgttaataatgattggcagtaatgcttcagatcgtatgggaatgggggtaacatatttagcactaattgcgacatttaaaatacaacctttcttagcattaggcttctttttaagaaaactaacttcgcgagaaaatctcttattaggagtaggtctcgcaatggcaacaacgttacaacttccagaggatattgaacaaatggcgaatggcatagcattaggtctaatggcactgaaattaataacacaatttgagacatatcagttgtggactgcattgattagcttaatgtgttctaacactatctttacgcttacagtcgcatggcgaacggcaacgctgattctggcggtaatttcactgttgcctgtctgtcagtcttcatcaatgcgtaaaactgactggcttcccatgaccgtcgccgccatgggtgttcctcccctgcctctattcatcttttctctaaaagatacgttaaaacgcagaagctggccgttaaatgagggggtgatggcagttggcttagtatcaattttagcatcttcattcctcagaaatgatgtaccaatggcggggccgcttgtagcaggcggtcttctaattgcttgttacgtgataacaggtacatccgcagatctaacagtcgaaaaagctgccgacgtgacatgggaggaagaggcggagcaaaccggtgtgtcacataatctcatgattacagtcgacgatgatggcacaatgagaattaaagatgacgaaaccgaaaacatcttaacagtgttgttgaaaaccgcacttctcattgttagcggtatttttccatatagtatacctgcgacactccttgtttggcacacatggcagaaacaaacacaaagatccggagtactctgggacgttccatctccacccgaaacacagaaagcagagctagaagaaggggtatatagaattaaacaacagggaatttttggcaaaacacaagtcggtgttggggtacaaaaagaaggagtattccatacaatgtggcatgtaacaaggggagccgtcctaacacataatgggaaacgcctcgaacccaactgggccaacgtcaagaaagatttaattagttacggaggcgggtggaaactttctgcccaatggcaaaaaggtgaggaagtccaagttattgcagttgaaccaggcaaaaaccccaaaaattttcaaacgatgccgggaatttttcagaccaccacaggagaaataggagcaatagcgctggactttaaaccaggtacatcgggaagtccaatcattaacagagaagggaaagttgtcgggctttacggtaacggtgtcgtcacgaaaaatggtggttacgtaagcggcatagctcaaacaaacgcggaaccagacggaccaactccggagttagaagaggagatgtttaagaaacgaaatttaaccattatggatctacaccctggatccgggaaaacaagaaaatatctaccagctattgttcgtgaagctattaaaagacgcctgagaacgctaatattagcacctactagagtagtagcagccgaaatggaggaagcactgaaagggctaccaatacgataccaaactaccgcgactaaaagtgaacacacggggagagaaatagttgacctgatgtgtcatgcaacctttacaatgcgactattaagtccagttcgagtaccgaactataatcttatagtaatggacgaagctcactttacagaccctgcaagcatagcagcccgcggatatatcagtactcgggttggtatgggggaagcggcagcaattttcatgacagctacgcctcctggaacagccgacgcatttcctcagagtaatgcacctattcaggacgaggaacgagatataccagaaagatcctggaatagcggaaacgaatggatcacagatttcgctggtaaaacagtgtggttcgttccgagtataaaggccggtaatgatatcgcaaattgtcttaggaaaaatggaaagaaagtaatccagcttagtagaaaaacctttgacacagagtatcagaaaacgaagttaaatgattgggacttcgtggtgaccactgacatatctgaaatgggtgctaacttcaaagcagatcgtgtaattgatccacgaagatgcctgaaaccagtaattctaaccgacgggcctgaaagggtaatcctcgccggaccaatgccagttacagtagcttccgcagcacagcggagagggagggttggacgaaactcacaaaaagaaaacgatcaatacattttcacgggtcaaccattgaacaacgatgaagatcatgcacactggaccgaggccaaaatgttattagacaatataaacactcctgaaggcataatcccagcactattcgaaccggaacgtgagaagagtgccgccatagatggagaatatcgccttaagggagagtcgcgaaaaacattcgtagagctaatgcggagaggcgatcttccggtctggcttgcgcataaagtcgcttccgaagggataaaatataccgacagaaaatggtgctttgatggggaacgtaacaaccagattcttgaggagaatatggatgttgaaatttggactaaagaaggcgagaagaagaaattaaggcctagatggcttgatgcaaggacatattccgatcctctagcactaaaggaatttaaagatttcgctgcaggtcgaaaatcaattgctctggatttagtaacagaaattggacgagtccccagccacctagctcacaggacccgaaacgccctggataatttagttatgttacacacaagtgaacacggaggacgagcatatagacatgctgttgaagaacttcccgaaacaatggaaacattgcttcttttaggcctaatgatactgctaaccgggggtgccatgctctttctcataagtggcaaaggaatcgggaaaacatctattggcctaatctgcgttgtagcatcgagtggtatgctttggatggcggatgtaccactacaatggatagcatctgctatagtcctagagttcttcatgatggtattacttataccagaacctgaaaaacagcgtacaccccaagacaatcaattagcatacgtagtgataggcatactaacgttagcagcaatagttgcagcaaatgaaatgggacttcttgaaaccactaaaagagatctaggtatgagcaaagagccaggagtcgtatcccctacgagttatttagatgtcgacttacaccctgcttcagcatggacactctatgcggttgctactaccgtaattacgcctatgttaagacatacaatagagaatagcacagcaaacgtctcactcgcagcgatcgctaatcaggccgttgtgcttatgggtcttgacaagggatggccaatttcaaaaatggacttaggtgttccactgttagctctaggatgctattcacaagtaaatcctcttacattaacagcagctgtcttgttgctcgtgacacactatgctataattgggcctggcctccaggctaaagctacgagagaagcacaaaagagaacagctgctggcataatgaaaaatcccactgtcgatggcattatgacaatcgatcttgacccagtaatctatgattcgaagtttgaaaaacaactgggtcaggtgatgcttcttgtactctgtgcagtgcaattacttctcatgagaaccagttgggctttttgcgaagcactaacgctcgcaacaggccctatcacgactttatgggaagggtcaccaggcaagttctggaataccacaatcgcagtcagcatggctaacatatttcgaggatcttatctagccggtgctggtttagctttctctatcatgaaatctgtcggtacaggcaaacgaggaaccgggagccagggggaaacgctcggagagaaatggaaaaagaaattgaatcagcttagtcgtaaagaatttgatctatataagaaatctgggataaccgaagtcgaccgtacagaggccaaagaagggctgaaaagaggtgaaataactcaccatgctgttagtagaggaagcgcaaaattacaatggtttgtagagagaaacatggtaataccggaagggagagtaatagacctaggctgtgggaggggtggttggtcttattattgcgccgggctcaagaaagtaaccgaggtaagaggatataccaaagggggtccaggtcatgaagaacctgtaccaatgtccacctatggatggaacattgtaaaattgatgtcggggaaggatgtcttttaccttccacctgagaagtgtgatacattactgtgcgacataggcgagtcgtcaccctcccctaccgttgaagagtcaagaaccatcagagtactcaaaatggtcgagccttggctcaaaaataatcagttttgcattaaggtcttgaatccgtatatgccaactgtaattgaacatctggaaagactacagcgaaaacatgggggtatgttagtaagaaatcctctttctcgtaacagtacacatgaaatgtattggatatcgaatggtacaggaaacattgtatcaagcgtgaacatggtgagtcgactcttattaaataggttcaccatgacccaccgaagaccgacgatagaaaaagacgtagatctaggtgcaggaacgcgtcacgttaatgcagaaccagagacacctaatatggacgttataggagaacgaatacgcagaattaaggaggaacattcatcaacatggcactatgacgacgaaaacccatataagacatgggcttatcatggatcgtatgaggtaaaggcaactggaagtgcaagcagtatgattaacggagtcgtgaaactgctgacaaaaccatgggatgtggttccaatggtaacacaaatggctatgacggatactaccccatttggccaacagcgggtatttaaggaaaaagtcgatacaaggacccccaggcctatgccgggtacccgaaaagttatggaaataaccgcagaatggctatggagaacgttaggaagaaacaaaagacccagactatgtacccgtgaagaatttataaagaaggtacgcactaatgctgctatgggcgctgtattcacagaagagaatcagtgggatagcgcacgggctgcggtagaagacgaagagttttggaaattagtggacagggagcgtgaactacataaactaggcaagtgcgggtcctgtgtatacaacatgatggggaagagagagaagaaactaggagagttcggaaaagcaaaagggagcagggcaatatggtatatgtggctaggtgcaaggtatcttgagttcgaggcactaggattcttaaacgaagatcattggttctctagggaaaacagtcatagcggcgtagagggggaaggattacacaaactcggctatatattacgcgatatttcaaaaatcccagggggtgcaatgtatgcggatgataccgcggggtgggacacaagaataacagaagatgacttgcacaatgaagagaaaattactcaacaaatggatcctgagcataggcaacttgcaaacgctatctttaaacttacctatcagaataaggtcgtaaaagttcaacgaccaacaccgaagggaaccgttatggatataataagcaggaaggatcagcgtggaagcggtcaggttggtacttacggacttaataccttcactaacatggaagcacagttaatcaggcagatggagggtgagggtgtcctttcgaaagcggatctagaaaaccctcatctactcgagaagaaagtaacacaatggctagagaccaaaggagtggaaagactaaagaggatggctataagtggtgatgactgcgtggtgaaacctattgacgatcgtttcgctaacgcactgctagcattaaatgatatggggaaggtacgcaaagatattccgcagtggcagccatcaaagggatggcacgattggcaacaggttccattctgttcgcaccattttcatgaattaattatgaaagatgggagaaaacttgttgttccatgtaggccccaagatgaactcatagggagagcccgtatttcacaaggcgccggctggtcactcagagaaaccgcctgtttaggaaaggcttatgcccaaatgtgggcgctaatgtattttcataggagagatttaagattagcatctaacgctatctgttcagcagtgccagttcactgggtgccaacaagtagaactacttggagcatccacgcacaccaccaatggatgaccacagaggatatgctaactgtgtggaacagagtgtggatcgaagataatccttggatggaagacaaaacacccgtaactacatgggaagacgtaccgtatctcggaaaaagggaagaccaatggtgtggatctctgataggtctcacatcacgagcaacgtgggcacagaatatactaacagcaatacaacaagttagaagcctaataggaaatgaggaatttttagattacatgccgagcatgaaaaggtttagaaaagaggaagaatcagaaggagctatttggtaa

SEQ ID NO: 23585 - RNA, 9873 nt, synthetic construct
  misc_feature 1..9873: note = derived and/or modified CDS sequence (opt6) from DENV-3__AY876494__SS-prME
  source 1..9873: mol_type = other RNA
acatctttatgcttaatgatgatgttaccggcaacgttagcttttcacttaacaagtagagacggagaacccagaatgattgtcgccaaaaacgaacgaggaaaatctttgctctttaaaactgcaagcggcataaacatgtgtacactaattgcaatggatcttggagaaatgtgtgacgacacagtaacatacaaatgcccattgattgcagaagttgaaccagaagacatagactgttggtgtaaccttacatcaacttgggtaacgtatgggacctgtaatcaagcgggtgagcacagaagagataaacgctccgtagcacttgctccacacgtgggcatgggtttagatacgagaactcaaacctggatgtcagctgaaggggcatggagacccgtcgaaaaagtagaaacctgggctttacggcatcctgggttcacgatattagcgttgttcctggcgcactatattggaacatctctcacacaaaaagttgtaatatttatacttttaatgttagttacaccttcaatgactatgcgatgtgtcggagtgggaaatcgtgattttgtagaaggactctctggtgcaacatgggtagacgtagttttggagcatggaggatgcgtcactacaatggccaaaaacaaaccaacattggatatagaattgcagaaaactgaagcaactcaactcgctacactacggaaactatgcatagaaggaaaaataaccaatgtgacaacggattcacgatgtccaacccaaggtgaagctatccttccggaggaacaagaccaaaattatgtttgcaaacacacctatgtagacagggggtggggaaatggatgtggcttattcggtaaagggtcgttagtaacatgtgcaaaatttcaatgtctagagcccattgagggaaaagttgtacaacacgaaaatttaaaatacaccgtgattatcacggtccatacaggtgaccaacatcaggtgggaaacgacacgcaaggtgtaactgtggagattactccgcaggcaagcacagcagaagctatactgccagaatacggaactctagtgttagaatgttcgccaagaacaggtctagactttaacgaaatgattctcctcacaatgaaaaataaggcatggatggtccatagacaatggttctttgacttacctctaccgtggacgtcaggtgcaacaactgagaccccaacttggaatcgtaaagaattactggtgacgtttaaaaatgcacatgccaagaaacaggaagtggtagtgctaggctcccaagaaggtgctatgcatacggcactcacaggcgctacagaaatccaaaatagtggaggtacgagtattttcgctggacatttaaaatgccgtttaaaaatggacaaactcgagctaaaaggtatgtcctatgctatgtgtctcaatacatttgtcctaaagaaagaggtatcggaaacacaacatggtactatattgattaaggtggagtataaaggagaagatgcaccatgtaaaataccatttagtacagaagatggacaaggtaaagcacataatggacgacttattacagctaatccagtagttactaagaaagaagaaccagtcaatattgaagcagaaccacctttcggtgaatccaatatagtaattgggataggggacaaagctcttaagataaactggtataagaaaggcagctcgatcggcaaaatgtttgaagctacggctagaggtgcgaggagaatggcgattttaggtgacaccgcatgggatttcggctcggtcggtggagtcttaaactcactaggaaaaatggtccaccaaatttttggatccgcttatacggctttgttttctggagtatcgtggattatgaagataggtataggtgtgttattaacgtggataggacttaattctaaaaatactagcatgagtttctcctgtatcgtaatcggaattataacattgtatttaggagcagtcgtacaagctgatatgggatgtgttataaactggaaaggtaaagaactgaaatgtggatcaggaatatttgtaacaaatgaagtacacacttggaccgagcaatacaagttccaggcggacagtcccaaaaggctagcaacagcgatagctggtgcatgggagaacggtgtatgtggtataagatcaactactaggatggaaaatttattatggaaacaaatagcaaacgaactaaactacatcctatgggaaaacaatatcaaattgactgtggtcgttggagacataattggagttttagaacaaggaaaaaggactttaacgccccagccgatggaactgaagtatagttggaaaacatgggggaaagcaaaaatagtgacagccgagacacaaaattcaagttttataatcgacggaccgaatactccggaatgtccctctgcatcaagggcgtggaatgtatgggaagtagaagattacggcttcggggtgtttactacaaacatatggctcaaacttcgtgaagtttatactcaatcgtgtgaccatcgcttaatgtctgcagccattaaggacgagcgagcagtacatgccgatatgggttactggattgaaagtcagaaaaacggcagttggaagttagaaaaagcgagctttatagaggtaaaaacatgtacatggccaaaaagtcatactctttggtccaacggtgttctagaatcagatatgataatacccaagagtttagcaggacccattagccaacataatcaccgcccaggatattatactcaaacagccggaccatggcatttaggcaaactagaattggactttaattattgtgaaggtacgacggttgtaataacagaaaattgtggtacacgaggaccaagccttagaacaacaacagtctcaggaaagctaatacatgaatggtgttgtagatcatgcacgttaccaccccttagatatatgggagaagatggctgttggtacggaatggaaattcgtccaataaatgaaaaagaagagaatatggtaaaatctttagtgtctgcaggatcgggaaaagtggacaatttcaccatgggggtattgtgtttagcgatcctcttcgaggaggtgatgcgaggaaaatttggtaagaaacatatgatcgccggtgttctttttacgttcgttctattattaagtggacaaataacatggcgtgatatggcacacacactgataatgataggttctaacgcttctgatcgcactgggatgggagtaacatatttggcattaattgccacctttaaaattcaacccttcctggcactgggcttctttctgaggaaattaacttcgcgtgagaatttgcttctcggtgtaggtctagcaatggcaactacactccaattgcctgaagatatagagcagatggcaaatggaatagcgttagggctaatgaccctaaaattaataactcaattcgaaacatatcaactatggacagcattagtatcactaacatgttcaaatactattttcacattgacagtagcatggcgaacggcaaccctgatattagctggcgtatcattattaccactttgtcagagttctagcatgagaaaaacagactggttgcctatgacggtagctgcaatgggcgtacctccgctacctttatttatattttcattgaaggatacaccaaagagaagaagttggccattaaacgaaggagttatggccgtgggtttggttagcatactagcatcatcactcctgagaaatgatgtgcccatggcggggcctctagtcgcaggaggactcctgattgcatgttatgtaataactggaacgtcagcagatttaacggttgagaaagctgcagatgtaacatgggaagaagaagccgagcaaacaggagtaagtcacaacttaatgatcacagtagacgatgatggaacgatgagaataaaagatgatgaaaccgaaaacatacccaccgtactacttaaaactgcactactcatcgtttcaggaatttttccatacagcatcccagcaacgttgctcgtatggcacacatggcaaaagcaaactcaacgctcgggagtgttatgggatgtgccaagtccacccgagacacaaaaagccgaacttgaggagggagtatatcgaataaaacagcaggggatatttggtaaaactcaggtgggggtaggagttcaaaaagaaggagtatttcatacaatgtggcacgtgactaggggtgcagtgctcactcataacgggaagaggcttgaaccgaactgggcctccgtaaagaaggatctcatctcgtacgggggaggatggcgactatcggctcaatggcaaaaaggagaggaggtccaagtgattgctgtggagcctggtaagaatcccaaaaatttccagactatgcccggaatattccaaaccactaccggagagatcggtgctattgctcttgactttaaaccgggcacaagtggctctccaattataaatcgggaaggaaaagtggtaggtttatacggcaacggcgtagtgacgaaaaacggcggctatgtctctggcatagctcaaacgaatgcggaaccagacgggcctacccctgagcttgaagaggaaatgttcaaaaagcgtaacttaactattatggacctacacccaggctcaggcaaaactaggaaatatcttcctgccattgttagggaggcgattaaaagacggttaaggaccttaattcttgcaccaacgcgagtggtggcggcggagatggaagaagcattaaaagggctccccattaggtaccaaacaaccgccacgaaatcagagcatacaggacgagagatagtcgatcttatgtgccacgcaacattcacgatgcgtctattaagcccagtgagggtacctaattataatctaataattatggatgaagcgcatttcacggaccctgctagtattgcggccagaggatacatatcaactagggttggtatgggagaggcagccgctatattcatgacagcaactccacctggaacagcagaagcgtttccacaaagcaacgcgcccatacaagatgaagaacgcgacatccctgaaagatcttggaactcggggaatgaatggattactgattttgtagggaaaactgtatggtttgtccccagtataaaagcgggtaacgatattgcgaattgtctacgtaaaaatggcaagaaggttattcagctttcacgcaaaacattcgatacagaatatcagaaaacaagactcaatgattgggatttcgtggttacgacagatatatcagagatgggagccaatttcaaggcagatagggtgattgacccacgaaggtgcctgaaaccggtaattttaactgatggtcccgaaagggtaatccttgcaggacctatgcccgtaacagcagctagtgctgcacaacgtagaggcagagttggtagaaatcctcaaaaagaaaacgaccaatatatttttaccggacagcccttgaacaacgacgaagatcacgcacactggacagaagccaaaatgttgttggataacataaacacacccgagggtataattccagcactcttcgagcccgagagagaaaaatctgcagctatcgacggtgagtataggttaaaaggtgagtcacgcaaaacttttgtagaattaatgagacgtggagatttaccggtttggttagcacacaaagtcgcatcagagggaattaaatacaccgacagaaaatggtgttttgatggtgaaagaaataatcaaatactcgaggaaaatatggacgttgaaatctggacaaaagagggtgaacgtaagaaattgagaccacgttggctagatgctcgaacgtacagtgacccgctagctctaaaagaatttaaggatttcgcagcaggacgtaagtctatagccttagacttggtgactgaaattggacgagtcccgtcacatttagcacacagaactcgcaacgcacttgataatcttgtcatgttacacacgtccgaacatggtggtcgagcctatcgacacgcagttgaggagcttccagaaactatggagactctattactattgggactcatgatacttttgacagggggagcaatgttatttctaatatccggaaagggaatcggaaaaacatcaataggattgatctgcgtcattgtatcaagtggtatgctgtggatggctgatgtccccctgcaatggattgcatcagcaatcgtactagagttcttcatgatggtcctactaatacctgaaccagaaaaacaacgtacaccacaagataatcaattagcttatgtagtaataggaatcctaacacttgcagctatagtagctgctaatgagatggggctactagaaacaacaaaaagggatctaggaatgtcaaaggaaccgggtgtggtatcacctacaagctacctagatgttgatctccatcccgctagcgcctggacattatacgccgttgcaacgacagtaataaccccaatgttaagacacacgattgaaaattcaacagcaaatgttagtttggcggcaatagcgaatcaagcagttgttttaatgggactagacaagggttggcctatttcaaaaatggatttaggcgtcccacttttagcattaggttgttacagtcaagtaaaccctttaacactaaccgccgcagtactcttgttagttacgcactatgccataattggccctggcttacaagctaaggcaactcgagaggcgcagaaaagaaccgcagctggcatcatgaagaaccctacagtagacggaattatgacgattgatttggacccagtaatatacgattcaaagttcgaaaaacaattggggcaggttatgctattagtcctatgcgctgtgcaacttctacttatgaggacatcgtgggcattatgtgaagcccttacacttgctacaggacccataacaaccttatgggagggatctcctggaaaattctggaacactaccatcgcagtctccatggctaatatattccgtggatcctatttggccggtgcaggattagcatttagtataatgaaatccgtcggtacgggcaagagaggaacaggtagtcagggtgaaacactaggcgaaaaatggaaaaagaaactaaatcaactcagccgtaaagagttcgacctctataagaaatctggcattacagaagtagatcgtaccgaggcaaaagaaggactgaagaggggcgagactactcatcatgctgtaagtcgtggaagtgctaaattacaatggttcgtcgagcgaaacatggttataccagagggacgcgtcatagacttaggatgtggacgcggcggctggtcctattactgtgcgggcctaaagaaagtaacagaagttagaggatataccaagggaggtccaggccatgaagaacccgtacccatgtctacttatgggtggaatatagttaaattaatgtccggcaaagatgtattctatctacccccagagaagtgtgacacacttttgtgcgacataggtgagagttcgccaagtccgacagtggaggaatccagaaccattagagtactaaagatggtcgaaccatggttgaaaaacaatcagttttgtatcaaagttcttaacccctacatgccaacagttatcgaacatttagaacgtctgcaaagaaagtacggaggaatgctagttagaaacccattgagcagaaatagcacacatgagatgtactggatttcaaatggaacagggaacatagtctcaagtgtaaatatggtgtctaggctgctattaaacagattcacaatgacacaccgcaggcccacaatagaaaaagatgttgacctaggcgctgggacgcgtcatgttaatgctgagcctgagacaccaaacatggacgtgatcggtgaaaggataaaacgaatcaaagaggaacattcgtccacttggcattacgacgacgaaaacccatacaagacgtgggcatatcatgggagctatgaagtgaaagcaaccggctcagcttcatcaatgatcaatggggtagtaaaactactcacaaaaccctgggatgtcgttccaatggtaacacaaatggctatgacagatacaacgccatttggacagcaaagggtgtttaaagaaaaagttgatactagaacaccaagaccgatgccaggtacaagaaaagttatggagataactgcagagtggctttggcggactttaggacgaaacaaacgcccaagattgtgtacccgtgaagaatttaccaagaaagtacgtacaaatgcagcgatgggtgcagtattcacggaagaaaatcaatgggacagtgcgagagccgcggtcgaggacgaagaattttggaacttatgggaccgagaacgtgaattgcataaattaggaaagtgcggctcttgtgtttacaatatgatgggtaaaagggaaaagaagttgggagagttcggaaaagcaaaaggaagcagagcaatatggtatatgtggttaggagcacgttatctggaatttgaagccctaggatttttgaacgaggatcactggttttcgagagaaaattcgtattctggtgtcgaaggagagggactccacaaattaggatatatattaagagatatcagcaaaattcctggtggagctatgtatgcagatgatacggctggttgggatactcgaataacggaggatgacctacataatgaggagaaaataacacaacaaatggacccggaacaccgacagttagcaaacgcaattttcaagttaacgtaccaaaataaagtagtaaaggtccaacggccaacacccaaagggactgttatggacataattagccgtaaagatcaaaggggatcaggacaagttggtacatatggtctaaatacgttcacaaatatggaggcacaattagttcgccaaatggaaggagaaggcgtgttatcaaaagcagatctcgaaaatccccatcttcttgagaagaaaataaccccatggttggaaccaaagggagtagaacgtttgaagagaatggcgatatcaggcgatgactgcgttgtcaaacctatagatgacagattcgctaacgcactcttggcattgaacgacatggggaaggtgaggaaggacatccctcaatggcaaccttcgaaaggatggcatgattggcaacaagtcccgttctgcagccatcacttccacgaattaattatgaaagatggccggaagctagtggtgccttgtagaccacaagacgaactaatagggagagctcgtatttcacaaggcgcggggtggtcgctaaaggagactgcatgcttaggcaaggcttatgctcaaatgtggagcctaatgtacttccaccgtcgagacttgagattggcatcaaacgctatctgctcagcagtacctgttcattgggtcccaacttcaagaacaacatggtcaatacacgcgcatcaccaatggatgactacagaagatatgctaacagtgtggaatcgagtatggatagaagacaatccttggatggaagataaaacacctgtgacgacttgggaagacgtgccgtaccttggcaaacgtgaagatcaatggtgtgggtcactaatagggctaacaagccgtagcacgtgggcacagaatattttaactgctatacaacaagttcgctctttaataggagatgaagaatttttggattatatgccatcaatgaagcggtttcgcaaagaagaagaaagtgaaggtgcaatatggtga

SEQ ID NO: 23586 - RNA, 9873 nt, synthetic construct
  misc_feature 1..9873: note = derived and/or modified CDS sequence (opt6) from DENV-3__AY923865__SS-prME
  source 1..9873: mol_type = other RNA
acctcactgtgtttaatgatgatgttaccagcgacacttgcttttcatctgacaagtagagatggagaaccacgtatgatagttggcaaaaacgaacggggaaagagcttattatttaaaactgcgtcaggaataaacatgtgtaccctcattgcgatggatttaggagaaatgtgtgatgacacggttacctataaatgtccacttatcgctgaagtagaaccagaagatattgactgctggtgcaacttaacaagtacatgggttacttatggaacatgtaaccaagctggagaacataggcgtgacaaacgttcagtcgctctggccccacatgttgggatgggacttgatacacgcacacaaacatggatgtcggcagaaggtgcttggcgacaagttgaaaaagttgaaacgtgggcactgagacaccctggtttcacaatccttgcattatttctagcacactacatcggaacgtctttaacgcagaaagtcgtaatattcattcttctgatgttagtgacaccgtcaatgactatgagatgtgtcggagtaggtaatagggattttgtagaagggttatccggagctacatgggtagacgtagtattagaacatggagggtgtgtaaccactatggccaaaaataaaccgacgttagacatagagcttcagaaaactgaagctacgcaactagcaacacttcgaaaactctgcattgaaggcaaaataactaatattaccacagggagtcgttgcccaacacagggtgaagcaatattaccagaggagcaagaccaaaattatgtttgcaaacatacttatgtggatcgcggatggggaaatggttgcggattgtttggtaaaggtagcctggtcacatgtgcgaaattccaatgtttagaacccatagaagggaaagttgtacaatatgaaaatcttaaatatacggttatcataacggtgcatacaggggaccaaccacaagttggcaacgatactcaaggtgtaacagttgaaataaccccacaagcgagtacagtagaagcagtcctccttgaatacggtacacttggattgaaatgctcaccaaggacggggctcgattttaatgagatgatcctacttaccatgaaaactaaagcatggatggttcacaggcagtggttcttcgatctacccttaccctggacaagcggcgctacgacagaaacgcccacatggaaccgtaaagaactattagtcaccttcaagaacgcacatgccaagaaacaagaagtggtcgtgttaggaagtcaagaaggtgcgatgcatactgcactcactggggcaactgaaattcaaaattcgggaggcactagcatatttgcaggacatctgaaatgccggctaaaaatggataaattagaactgaaagggatgagctatgcaatgtgccttaatacgtttgttctaaagaaagaagtatccgaaacccaacacggaactatactcataaaagtggagtataaaggcgaagatgcaccttgtaaaatacccttctctactgaggacggccaaggcaaggcgcataacggaaggttaataacagcaaatcctgttgttaccaaaaaggaagaacctgttaacatagaagcagagccaccattcggggaatctaatatagtcattgggataggtgacaaggcattaaagataaattggtataagaaagggagtagcatcggaaaaatgttcgaggcgacagcccgaggtgcccgtagaatggccatactaggtgataccgcatgggattttggttctgtaggcggagttcttaacagtcttggaaaaatggttcatcagatattcggaagcgcttataccgcactgttttccggagttagctggattatgaaaataggcataggagtactgttgacatggatagggctaaatagtaaaaatacatcaatgagcttttcctgtatcgtcataggaataataaccttatatctaggtgccgtcgttcaagcagacatgggatgtgtaataaattggaaaggaaaagaacttaagtgtggttctggaatatttgtgactaatgaagttcatacatggactgaacaatataagtttcaagccgactcaccgaaacgattggcgacggcgattgcaggagcatgggaaaatggggtatgcggtatacgctcaacaacaaggatggaaaatttactatggaaacaaatagccaatgagcttaattatatcttatgggagaataatataaaattaactgtagttgtaggagacataattggtgtgttagaacaaggcaaaagaacactaacaccccaaccgatggaattgaaatactcatggaagacatggggaaaggctaaaatagtaactgcagagacacaaaatagctcatttataatagatgggcctaatactcccgaatgtccttcagcatcgcgtgcttggaatgtatgggaagttgaagactatggcttcggagtatttacaaccaacatttggttaaaattacgggaagtatatactcaaagctgtgaccataggttaatgtcagccgccatcaaagacgaaagagccgtacatgcagacatgggttattggatagaatcacagaaaaatggctcttggaagttggaaaaggcatcattcatagaagtaaagacgtgtacttggccaaaaagccatacgctatggtccaacggggtactagaaagtgatatgataattcccaaatccttagcggggcctatatcgcagcacaatcatagaccaggataccacacccagaccgcaggtccatggcatttaggaaaactcgagctagatttcaattattgtgaaggtacaactgtagtgattactgaaaactgcggtacaaggggaccatccctgagaactaccacagtgagcgggaaattaattcacgaatggtgttgtcggtcttgcacactacctccgctcagatatatgggagaagatggatgctggtatggaatggaaattagacctatcaatgaaaaggaagagaatatggtaaaatcgctggtatcagcgggtagcggaaaagtagacaactttaccatgggcgtactatgtttagctattctattcgaagaagtaatgaggggtaagtttggcaagaaacacatgatagcgggagtcctatttactttcgtattactgttaagcggacagattacttggagggatatggcgcatactttaattatgatagggtcgaatgcaagcgatcgcatggggatgggggtaacctatttagctctaattgctacatttaaaatacaaccatttctagcactagggttcttcctgcgaaaattaacctcgagggagaatttattgcttggggtaggattagctatggctacaacattacaacttccggaagacattgaacaaatggcaaacgggatagcgttaggtctcatgaccctaaaattaatcacccaatttgaaacataccagctgtggaccgctctggtatcattaacttgtagtaatactatttttactctaacagtcgcatggcgcaccgcgactcttattctggcaggcgtgtcactactgcctctatgccaaagctcaagtatgcgtaaaacagattggttgccaatgactgtagctgctatgggggtgccaccactacccttatttatattcagtcttaaggataccccaaaaagacgaagttggcctttgaacgaaggagtaatggcggtgggtttagtatcaatacttgcatcgtcactgttaagaaatgatgttcccatggctggacctttagttgctgggggattattgattgcctgctatgttatcacgggaacatcggctgatctaacagtggaaaaagcagcagatgtaacatgggaggaagaagcagaacaaactggagtcagccacaatttaatgattacagttgacgatgatggaacgatgaggataaaagatgacgaaactgaaaatattttaacggttttacttaagactgcattactgatagtatccggcatttttccatactcgattccagcaacgctccttgtctggcacacttggcaaaagcaaactcaacgcagtggagtactatgggacgtacctagcccaccagaaacccagaaagcagaacttgaagaaggagtgtatagaatcaaacaacaaggcattttcggaaaaacacaagtaggagtaggcgtacaaaaggagggcgtgttccacactatgtggcatgtgacgaggggtgccgtcctgacccataatgggaaaagattagaaccaaattgggcatctgtaaagaaggacctcattagttacggtggcggatggcgcctatcagcacaatggcaaaaaggtgaagaagtccaggtaatcgccgtggagcctggcaagaatccaaagaattttcaaactatgccgggaatttttcaaaccaccacaggagaaattggtgcaatagcgctagattttaaaccgggtacttcgggttcaccaatcataaatagagagggaaaagtagtaggactttatggaaatggggtcgttactaaaaatggaggatatgtgtccggtattgcacagacgaatgcggaaccagatggacctacaccagaactagaagaggaaatgtttaaaaagcgcaatcttacaattatggaccttcatcctggtagcggaaaaacgagaaagtacttaccggcgatagtacgagaagcgataaaaagaagactaagaacattaatactagcaccaacaagggtcgtagccgcggaaatggaagaagcgctaaagggccttcctattagatatcaaacgactgctactaaatcagagcatactggtagggaaattgtcgacctaatgtgtcacgccacttttactatgagacttctgagtcctgtaagagtccccaattacaatttgattataatggatgaagcacactttaccgaccctgcatctatagcggcaagaggatacataagtactagagttggtatgggcgaagctgcggcaatttttatgacagcaacgccgccaggtacagctgaggcgtttccacaaagtaacgctcctatacaagatgaggaaagggatataccagaacgatcttggaactcagggaacgaatggataacagactttgtaggaaaaacagtctggttcgtcccaagcattaaagctggaaatgatatagccaactgtctacgcaaaaatggcaagaaagtaatacaactatccagaaaaaccttcgataccgaataccagaaaacaagacttaatgattgggactttttagtgactacagacatcagtgaaatgggagccaactttaaagcagatagagtcattgatccaagaaggtgtttaaaaccagtaatcctaacggacggacctgaacgagtaattttagccggaccaatgcctgtaacagctgcatcggccgctcagcgccggggtagggtaggtaggaacccgcaaaaggagaatgaccagtatatatttaccggtcaacccttgaataatgatgaggatcatgcacattggacggaagctaaaatgttacttgataatatcaatactccagaaggaattatacccgcgctttttgaacctgaaagagagaaaagcgcggcgatagatggagagtatcgtcttaaaggtgaatcaaggaagacatttgttgaactgatgaggcgcggagatttacctgtgtggctagcacataaggttgcctctgagggtatcaaatatactgacagaaaatggtgctttgacggtgaaaggaacaatcaaattttagaggaaaacatggatgtcgaaatctggacaaaagaaggagaaaggaagaaattacgaccacgctggttggacgccagaacctactccgatcctctagctttgaaagagttcaaagatttcgcagcaggtcggaaatctatcgccttggatttagtaacggaaataggaagagttcctagtcacctagcacatcgtacaaggaacgctttagacaacttagtaatgctacatacaagtgaacatggagggagagcttatcgacatgcagttgaggaattaccagagaccatggaaacacttcttctcctcggcttgatgattctactaaccggcggagcaatgctgtttctgatttcaggaaagggaatcgggaagacatctatagggctaatttgtgtaatcgtatcctcgggcatgctgtggatggcggacgtgcccctacagtggatagccagcgcaatagttctagagttctttatgatggttctactcattcctgaacctgaaaaacaacgaactccacaggataaccaattagcatacgttgtaattggtattcttactttagcggctatagtggcagctaacgaaatgggcctcttagaaaccacaaagagggacttgggtatgagcaaagaaccgggagtagtttctcccacgagttatctagacgttgaccttcatcctgcaagtgcctggacattgtatgcagttgctactactgtgatcactccaatgttaagacatacaatagaaaactcaacagctaacgtgtccctagcagcgattgcgaatcaggctgtcgtactcatgggtttagacaaggggtggcccatctctaaaatggatcttggagtgcctctacttgctttaggttgttacagccaagtaaacccattaacccttactgcagccgtccttcttttagtaacacattatgctataattggtcccggcttacaagctaaggcgacccgcgaggcgcagaagagaaccgcggcgggtataatgaagaatccgaccgttgacggcataatgactattgatttggacccagtcatctatgactctaaatttgaaaagcaattaggtcaagtgatgctattggttctttgcgccgtacagttactactaatgaggacaagttgggccttatgcgaggctttgaccctggcaaccggaccaataactactttatgggaaggtagcccgggcaagttctggaatacgaccatagccgtatcaatggcgaacatatttcgaggtagctatttagcaggaaccggccttgcattttccattatgaagtccgtcggtacaggtcgccgaggaacgggcagccaaggagaaacattgggagaaaaatggaagaagaaactcaatcaactaagccgaaaagaatttgatttatataagaaatcagggattacggaagtggatagaacagaagcaaaagaagggctcaaacgtggcgaaactacccaccatgcagttagcaggggaagtgcgaaattacaatggtttgtagaaagaaacatggtaatacccgaaggaagggtaatagatctaggttgtggaaggggcggctggtcgtactactgcgcaggactaaagaaagttactgaggtaagggggtatactaaaggaggcccggggcatgaagaacctgtccctatgagtacatacggatggaacatagtgaaacttatgtcaggaaaggatgtattttacctgcccccagaaaaatgcgatactctactctgcgatataggagaaagctcaccaagccctacagtcgaagagtcaagaacaatacgcgtgctaaagatggtggagccgtggttaaagaacaaccaattttgcataaaagtgctaaatccatacatgccaacagtaatagaacatctagagagacttcagagaaaatacggaggaatgttagtgagaaaccctctatctaggaacagcactcacgaaatgtattggataagcaacggcactggtaatattgtgagcagcgtaaatatggtcagccgtttgctactaaacaggttcactatgactcatcgaagacctacaatagaaaaagacgtagatcttggggctggtactagacacgttaatgccgaaccagaaacaccaaatatggacgttataggtgaacgaataaaaagaattaaggaggaacattcaagtacttggcattatgatgatgaaaatccatataagacttgggcataccacggatcgtacgaagtaaaagcaacgggatctgcgagtagcatgataaatggagtagttaaattactaacgaaaccatgggacgtggtccctatggttacacaaatggcaatgacagatactactccatttgggcaacaaagggtattcaaagagaaagtagatacccgtacgccgaggcctatgcccggtacaagaaaagtgatggaaatcactgccgagtggttatggcggacgttgggaagaaataagaaacctcggctttgtacacgagaggagttcaccaagaaagttcgtaccaacgcagcaatgggagcggtctttaccgaagaaaatcaatgggatagtgcgcgagcggcagtcgaagatgaagagttctggaaattagttgatcgtgaaagagaactacacaaacttggaaaatgtggaagttgtgtctacaatatgatgggtaaaagagagaagaaacttggggagttcggcaaagcaaaaggaagtcgtgcaatctggtatatgtggttaggagcgaggtatctagaatttgaagctcttggatttcttaacgaagaccattggttttctcgtgagaactcatatagcggggtcgaaggtgaaggtttacacaaattaggctacatattaagggatatatctaagattccaggtggagctatgtatgctgacgatacagctggatgggacacgcgtataacggaagacgatttgcataatgaggagaaaataacacaacaaatggatccagagcataggcaactagcaaatgcaatttttaaattaacgtatcaaaacaaagtggtaaaagtccaacgtccaacgcctaaaggaactgtaatggatataataagtagaaaagatcaaagagggagcggccaggtcggtacttatggtttaaatacgtttacaaatatggaagctcagttagttagacaaatggaaggcgaaggggtgctttcaaaggcagatttagaaaaccctcatctattagagaagaaaatcactcaatggttagaaaccaaaggagttgaaagattgaagcgaatggcgatatccggagacgactgtgtagtcaagccaatagatgacaggttcgcaaacgcgctcttagctctaaatgatatgggcaaagtccgaaaggacattcctcaatggcagccgagtaaaggctggcatgattggcaacaagtgccattctgtagccatcactttcacgaattaataatgaaagatggtcgaaaacttgtggtgccttgtaggccgcaagatgagcttatagggcgtgcaaggatttcccagggagcgggatggtctttaaaggaaaccgcttgtttaggcaaagcatatgcacaaatgtggagcctcatgtactttcacagacgagatcttcggcttgcttcaaatgcgatatgctcagcggtacccgtgcattgggtcccaactagcaggacgacctggtcaattcacgcgcaccaccaatggatgactacagaagatatgttaactgtgtggaacagagtatggatagaagataacccctggatggaggacaaaacccccgtaacgacatgggaagacgttccatacctaggtaaaagagaagaccaatggtgcggctctcttatcggactgacgtcgcgtgcaacatgggcgcaaaacattctgaccgcaatacagcaagttaggtcactgataggagatgaagagtttttagattacatgccatctatgaaacgttttagaaaagaagaagaatcagaaggcgccatatggtaa

SEQ ID NO: 23587 - RNA, 9867 nt, synthetic construct
  misc_feature 1..9867: note = derived and/or modified CDS sequence (opt6) from DENV-4__KR922405__SS-prME
  source 1..9867: mol_type = other RNA
tcaacgataactcttttatgcttgataccaacggttatggctttccacttaagcacaagggacggggaacccctaatgatagtagcaaaacacgaacgcggacgaccccttttattcaaaactactgaaggaataaataaatgcacattaattgcaatggatctaggtgaaatgtgcgaagacactgtaacatataaatgccctcttcttgttaacactgaacccgaagacatagattgctggtgcaatttgaccagtgcctgggtcatgtatggtacgtgcacacaatcgggggaacgtcgaagggaaaaacgatctgtggcattgacaccccacagtggaatgggattagaaacacgagccgaaacttggatgtcatctgaaggagcgtggaaacatgcacaacgcgttgaaagttggatactaaggaatccaggttttgcactattagcaggatttatggcttatatgataggacaaactggaatccaaaggacagtattctttatactcatgatgcttgtagcgccatcctacggtatgcgatgtgttggagttggaaacagggactttgtagaaggtgtaagtggaggagcttgggtggacctcgtactggaacatggagggtgtgttacgactatggcacagggaaaaccaactctcgactttgaattaatcaaaaccacagcgaaagaagttgccttgctaaggacatattgcatagaagcctcaatatcaaatataacaacagcaacccgatgtccgacacaaggggaaccatatctaaaagaagaacaggatcagcaatatatttgtaggcgcgatatggtagataggggatggggaaatggctgtggtctattcggcaaaggaggagttgttacatgcgcgaagttcagttgtcttggaaaaataacgggaaatctcgttcaaattgaaaacctggaatatacagttgtagtcacagtgcataatggagatacccacgcagtaggaaatgatacaagtaatcatggtgtcacagcgacaataactccacgttcaccatcagtagaagtaaagttaccagactatggagaattaactttggactgtgaaccgagaagtgggatcgattttaacgaaatgatactgatgaaaatgaagacaaaaacttggctcgtacataaacaatggtttttagatctaccacttccctggacaacaggtgccgataccttagaagtacattggaatcacaaagagcggatggtcactttcaaagtaccacatgctaagaggcaagatgttacagttttagggtctcaggagggggcaatgcattctgctctggcaggcgctacggaagtagactccggtgacggaaaccacatgtttgctggacatcttaaatgtaaggtgagaatggagaagttaagaatcaaaggaatgagttacaccatgtgcagcggaaagttcagcattgataaagaaatggctgaaacccaacacggaacaacagtagtaaaagtaaaatatgaaggaacaggtgcaccttgtaaagtaccgattgaaattcgagacgtaaacaaggaaaaagtagttggtagaataatctcttcgacacctttcgccgaaaataccaattcagtgaccaatattgaactcgaaccgccatttggcgatagctacatagtgatcggagtaggagactctgcactgacgttacactggtttaggaaagggtctagtataggaaaaatgtttgaaagcacatacagaggggcaaaacgaatggcaatactaggtgaaactgcctgggatttcgggagtgtaggaggtttattaacatcactaggtaaagctgtacaccaagtgttcggctctgtatatacgacgatgtttggtggtgtctcttggatggtacgaattttaattggactactcgttctatggataggaaccaactcgagaaacacatcaatggctatgtcatgtatagctgttggcggcataacattatttttaggttttactgtccacgcggacatgggctgcgttgtttcttggtctgggaaggaacttaaatgcggttcgggtatatttgttatagacaatgtccacacttggactgaacagtataaatttcagcctgaaagcccagcaagacttgcttcagcgatacttaatgcacacaaggaaggcgtttgtggcattcgttccacaactcgattagagaatgtcatgtggaaacagattacgaatgagttaaattacgtcctatgggaaggaggtcatgatctaacagtagtagcaggagatgtaaaaggagtactttccaaaggaaagcgtgcgttagcaccacccgtgaatgatttaaagtattcatggaagacatggggcaaagcgaaaatatttactcccgaaactcgaaattcaactttcctggttgatggaccagatacaagcgaatgccccaatgaaagacgcgcatggaactttttggaagtagaagattatggattcggtatgtttacaaccaatatatggatgaaatttagggagggttcatctgaagtttgtgatcaccgcctaatgtcggcggctataaaggatcaaaaagcagtgcatgccgatatgggttactggatagaaagttctaagaaccaaacttggcagattgagaaagcctcgctcatagaagtcaaaacttgcctctggcctaaaacccacactctatggtcaaacggtgtacttgaatcacaaatgttaatccctaaagcatatgcagggccaatttcacagcataactacagacaaggatatgcaacgcaaacggcaggtccctggcatctcggaaagctggaaattgattttggggaatgtcccggtacgaccgttaccatacaagaagattgcgatcatagaggcccgtctctcagaacgactactgcttcaggtaagttagtaacacaatggtgttgcagaagctgtaccatgccgcctcttcggtttcttggagaagacggatgctggtatgggatggaaataagacctttaaatgagaaggaagaaaatatggtaaaatcacaagtaagtgccggtcaaggtacttcagaaaccttctccatgggattgctttgccttactttgtttgttgaggaatgccttcggcgacgagtaactagaaaacacatgatacttgtcgtagtaaccactctttgtgccatcatactaggtgggttaacttggatggacctactcagagcactgataatgctaggcgatacaatgtcaggtcgtatgggcggtcaaatacacttagcaataatggcagtttttaaaatgtcaccgggatatgtccttggtatctttctgagaaagttaacaagtagagaaaccgcactaatggtgatagggatggccatgaccacggtccttagtatcccacatgacttgatggagtttatagacgggataagtttaggtctgatattattaaaaatggtaacacattttgataatactcaagtcggaacattagcattagcgctaacattcattaaaagtactatgcctttggtgatggcttggcgaacgataatggcagtattgttcgtggtcacgctgattccactttgccgtacatcctgcttacaaaaacaaagtcattgggtggaaattacagcattaattctaggcgcccaggcacttcctgtgtaccttatgacgctgatgaaaggagcgtcaaagcgatcatggccactaaatgaaggcattatggcagtaggcctggtctcgctactaggtagtgcattgcttaaaaatgatgttccactagccggaccgatggtcgctggtgggctattattagcagcatatgttatgtcaggtagttctgcagacttatcgttagagaaagctgctaatgtccaatgggatgaaatggctgacataaccggatcttcacccatcatagaggtgaaacaagatgaggatggcagcttttctatacgtgacgtagaggaaacaaacatgatcacactgttggttaaattagcacttattacagtaagtggcctatatccgttagcaatacctgttacaatgacattgtggtacatgtggcaagttaaaacacaacgttctggagccttatgggatgtaccgtcacccgctgcagcacaaaaggcaactctaaccgaaggagtatatagaataatgcaacgaggactcttcggaaagacacaagtgggagtcggcattcatactgaaggcgttttccacactatgtggcatgtgaccaggggaagcgtgatatgccacgaatcaggtcgcctagagccttcctgggcagatgttaggaatgacatgatttcttacgggggaggatggagactaggtgacaaatgggataaagaagaagacgttcaagttttagcgatagaaccaggaaagaatccaaagcatgtacagactaaaccaggcttattcaagacattaactggagaaataggagcagtcaccttagatttcaaaccagggacgagtggttcaccaatcataaatcgaaaaggaaaagtgattggattatatggcaacggagttgtaacaaaatcgggggactatgttagtgcaataacccaagcagaacgaatcggcgaaccagattacgaggtcgatgaggacatttttcgtaaaaagaggctgacgataatggatttacaccctggagcaggaaaaacaaaacgaatattaccgagtatagtgagagaagcattgaaacggagactgaggacgctaatattagcaccgacgagagtagtagctgctgaaatggaagaagctctccgtggattaccaataagatatcagacccctgcagttaagtcagaacacacaggtagagaaatagtagatcttatgtgccatgcaacatttactacaagattattaagtagtactcgagtaccaaactacaacctaatagtcatggacgaagctcatttcaccgaccctagtagtgtagctgcacggggctatatctctacgagagtagaaatgggcgaagccgctgcaatttttatgacggccacaccgccgggaacaacagacccgtttccacaatcaaattccccaatagaagacattgaaagggaaatacctgaacggtcatggaacaccggatttgattggattacagactaccaaggaaaaacggtctggtttgtaccgagtataaaggcaggtaatgacatagcaaattgcctaagaaaatccggcaaaaaggtaatccaattaagccgaaaaacatttgacacggaatatcctaagacaaaactaactgattgggattttgtagtaacaactgacataagtgaaatgggggcaaatttcagagcagggcgagtaatagacccgcgaagatgcttgaagccagtaattctgactgatggcccagaaagagtaatcttggctggtcccataccagtcacccctgcatcagcagcacagagaagaggacggatcgggagaaatccagctcaagaagatgaccagtacgttttctccggtgatcctctgaggaacgatgaagaccatgctcattggacagaagcaaagatgctgctagataatatttatacccctgaaggcataatcccaacattattcggaccagaacgagaaaagactcaggcaatagatggagagttccgcctaagaggagaacagaggaaaacttttgtcgaattaatgaggcgaggagacttacctgtatggcttagttataaagtggcatcagcaggtatatcctataaagacagagagtggtgctttacgggagaaaggaataatcaaattctagaagaaaacatggaagttgaaatatggacgagagaaggagagaagaagaaactcagaccaaagtggttagacgcacgcgtgtatgcagatcccatggctcttaaagattttaaagaatttgcatcagggagaaaatcaattacattggatattttgacagaaattgcttctctaccaatgtatcttagcagtcgagcgaaattagcactagacaacatcgttatgttgcatacgaccgaacgaggtggaaaagcctatcaacatgcgcttaatgagctcccggaaagtttagaaactctgatgctagttgcgttactgggagccatgacagctggtatatttttattctttatgcaaggaaaaggaataggcaagctaagtatgggacttatcgcaatcgctgtagcaagtggactattatgggtcgcagagatacaaccacagtggattgcggccagcattatacttgagtttttcttgatggtcctcttagttcctgaacctgaaaaacaacggaccccgcaagacaaccagttaatatacgtgatcctcacgattttaacaataatagctctcgtcgcagcaaatgagatggggttaatcgagaaaactaaaactgatttcggattctaccaagtaaaagcagagacgacgatactagacgtagatctaagaccagcaagtgcctggacgttatacgcagtagcaaccacaatattaactccgatgcttaggcacacaatagaaaatacaagtgcaaatctatctctagctgcaatagccaatcaggcagcagttcttatgggtttaggaaaaggatggccattacacagaatggacttaggcgttcccctcctagccatgggatgttacagtcaagtgaacccaaccacgctgacagctagtttggtgatgttgctagtccactatgcaattatcgggccaggcctacaggcaaaagcaacacgtgaagctcagaaacggacagcagcaggaataatgaagaatcccactgttgatgggataacggtcattgacctagagcccatcagttacgaccctaagtttgaaaaacagttaggacaagtgatgctgctagttctatgcgcaggtcagctactgcttatgcgtactacgtgggccttttgtgaggtattgaccctagccacaggaccaatattaacgttatgggaaggaaatcctggaagattttggaataccacaatcgcggtgagtacagccaatatattccgcgggtcatacctagccggtgcagggctggccttttcgctaatcaaaaatgctcagaccccaagacgcggtactgggacgactggagaaacacttggagaaaagtggaagagacaactaaatagtcttgataggaaagagttcgaggaatataagagatcggggattctagaagtagacagaacagaagcgaaaagcgcactaaaagatggatcaaaaataaaattcgccgtatcaagaggcacttcaaaaataagatggatcgttgagcgggggatggttaagccgaaaggcaaggtggtggatttaggttgtggacgagggggttggagctattatatggcaacattaaagaatgtcacagaagttaaaggttacacaaaagggggaccgggacatgaggaaccggttcccatggcaacttatggatggaacttagtgaaattacatagtggcgtagatgtattttacaagcccacagaacaagtagacactctcttatgcgatataggcgaatccagttctaacccaacaattgaggaagggcgtactcttagagtattaaaaatggtggaaccatggctatcatcaaaaccagaattttgcattaaagtactcaatccttatatgccaacagtaatagaagaactggagaaattgcaaaggagacacggcggatcacttgttcgttgtccgttatcgagaaattcgacccacgaaatgtattgggtatcgggagtttcaggcaatattgtaagctcggtaaatacgacatcaaaaatgttattaaataggtttacaactagacataggaaaccgacatatgagaaagatgctgacttgggagctggaacacgttcggttagtacagaaacagagaaaccagatatgacaataattggaaggcggctgcaaagattacaagaggaacataaagagacttggcattacgaccacgaaaacccgtatagaacgtgggcctatcacggttcatatgaggcgcctagtacaggaagcgctagtagtatggtcaatggagtagttaagctgttaacaaaaccatgggatgtagtgcccatggttacacaactagcaatgacagatacaacaccctttggtcaacaaagagtatttaaagaaaaagttgatacacggacacctcaacctaaaccaggcacaagagtcataatgacaacgacagctaactggttatggacattgttgggacgtaagaaaaacccccgtctttgtacacgtgaggagtttatatcgaaggttagaagtaacgccgccataggagcggtattccaagaggaacaaggctggaccagcgctagcgaagcagttaacgatagtcgcttctgggagctggtagataaagaaagagcactacatcaagaaggaaaatgtgaatcatgtgtttacaacatgatgggaaagcgggagaaaaagctaggtgagttcggtagagcaaaaggctcaagggcaatttggtacatgtggctgggagcacggtttctagaatttgaggcgctaggttttctgaacgaagatcattggtttggaagagagaatagttggagcggagtggaaggagagggccttcacaggctaggttacattttggaagatatcgataagaaagacggtgatttaatctacgctgatgatacagccggttgggatacccggatcaccgaagatgatcttctgaatgaagaattaatcacagagcaaatggcacctcatcacaaaattttggcaaaggcaatattcaagttgacctatcagaataaagtagtaaaggtcctcagaccgaccccgaaaggagctgtaatggatataattagtaggaaagatcagcgcggcagtggccaagttggtacgtatgggttgaataccttcacaaacatggaagtacaattaattcgacaaatggaggcagaaggagttataacacaagacgatatgcacaatccgaaagggttaaaggaaagggtagaaaaatggctaaaagaatgcggtgtagacagactaaaacgcatggcgatatcgggagacgactgtgtagttaaaccgctggacgagcgtttttccacatcgcttttatttctaaacgatatgggcaaagtcagaaaagatataccacaatgggaaccttcaaaaggatggaaaaattggcaagaggtgccattctgttctcatcactttcacaaaatattcatgaaagacggtagatctctggttgtaccctgccggaatcaagacgaacttattggtagagcgcgtataagtcaaggggctggctggtcactaagggagacagcatgtttgggtaaagcgtatgcgcaaatgtggtcattaatgtatttccataggcgagacttgcgtcttgcaagcatggccatctgtagtgccgtgccgacagaatggtttccgacgtctcgtaccacatggtcgatacatgcgcatcatcaatggatgactacagaagatatgttaaaagtttggaaccgcgtatggatcgaagataatcctaatatgatagataaaacgcccgtgcattcatgggaggatataccttatctaggtaaacgagaggatctgtggtgtggaagcctaatcggattaagctcccgtgccacatgggccaaaaatatacacacagcaataacccaagtacgaaatctgattggaaaggaagaatacgttgattatatgcctgcaatgagacgttatagtgcacacttcgagtctgaaggcgtgttgtaa

SEQ ID NO: 23588 - RNA, 9867 nt, synthetic construct
  misc_feature 1..9867: note = derived and/or modified CDS sequence (opt6) from DENV-4__KP188557__SS-prME
  source 1..9867: mol_type = other RNA
agtactataacattactctgcttaataccaactgtcatggcatttcacctctcgacccgtgacggggaaccactcatgattgtcgcaaaacacgaaagaggacgaccattattatttaaaacaacagaaggtataaataaatgtaccctgattgcaatggatttaggagaaatgtgcgaagatacagtgacgtataaatgtcccttgctcgtaaacacagaaccagaagatatcgattgctggtgtaaccttacatctacatgggtaatgtatggaacatgtacccaatctggtgaacgaaggagagaaaaacgtagtgtggctttaacacctcactctggaatgggccttgaaactcgggcagagacgtggatgagttctgaaggtgcatggaaacatgcacagagagtcgaatcatggatcctaaggaatccgggcttcgcgcttttggccgggtttatggcttacatgattggtcaaacaggaatccagaggacagtgttctttgtcttaatgatgctagtcgcgccctcctacggtatgcgatgcgtgggtgtgggaaacagagatttcgtagagggagtatcgggtggagcctgggttgatcttgttttagaacatggtggatgcgtgacgacaatggcccaaggaaaaccgactcttgatttcgaactgacaaaaaccacggcaaaagaagttgctttactaagaacatactgtatagaagcacttatcagtaacatcacaactgctacgcggtgtccaactcaaggtgaaccctatttaaaagaagaacaggatcagcagtatatctgtagacgagatgttgtagatcgtggttgggggaacggttgtggtctattcggaaaaggtggagtcgtaacatgcgccaaattctcttgctcaggaaaaataacagggaatttggttcagatagaaaatttagagtacaccgtagtagtcacagtacacaacggcgatacgcatgcagtcggaaatgatacaagtaatcacggcgtaacagctaccattacaccaagatccccgtcagtagaagtgaaactgcccgattatggagaactaaccctagattgtgagcctcgatccggaatagactttaatgaaatgatcctaatgaaaatgaagaagaaaacctggttagtgcacaagcaatggtttctagacctaccactcccttggacaacaggcgcagatacaagtgaagttcattggaattacaaagaaagaatggtaacatttaaggttcctcatgctaagcgacaagacgtaacagtattaggaagccaagagggagcaatgcactccgcgttagcaggggctaccgaagtagattctggggatgggaaccatatgtttgcaggtcacctaaaatgtaaagttcgaatggaaaaattgagaatcaaaggaatgagctacacaatgtgttccggaaaatttagcatcgataaagaaatggctgaaacacagcacggcacaacagttgtcaaggtaaaatacgaaggcgccggagcaccctgtaaagtaccgatagaaattcgggatgtcaacaaagagaaggttgtaggaagagtcatctcagctacccctctagcagaaaatactaattcagtgacaaatatcgaattagagccaccatttggagattcatatattgtaataggcgtcggaaattcggccttaacactccactggtttcgaaaaggttcgtcaattggtaagatgtttgaaagcacttatagaggtgcgaaaaggatggcgatactcggagagactgcttgggactttggctccgtaggtggtctattcacttctctaggaaaagctgtacatcaagttttcggatcagtttatacaactatgtttggcggggttagttggatgataagaatcctgataggatttcttgtcttatggataggaaccaatagtaggaacacaagtatggctatgacatgtatagcggtaggtgggataacattattcttagggtttacagtgcaggccgacatgggatgtgtcgtgtcatggagcggacgcgaattaaagtgtggaagcggaatttttgtagtagataatgttcatacatggacagaacaatataagttccaacctgaatctccggcccggttagcaagcgcgatcttaaacgcgcacaaagacggtgtctgtggaataagatcgacaacacgcttagaaaacgttatgtggaaacaaataactaacgagctcaactatgtgttatgggaagggggtcacgacttgacagttgtagcgggtgatgtaaaaggggttcttacaaaggggaagagagctctaactcccccggcaagcgatcttaaatacagttggaaaacgtggggtaaggcacggatatttactccagaagcccgaaataatacttttctgatcgatggacccgacacgtctgagtgtccaaatgagagacgagcttggaactcatttgaagttgaagattatggattcggtatgtttacaaccaacatatggatgaaatttcgtgaaggcagcagcgaagtttgtgatcatagattaatgtccgctgccatcaaagatcagaaagctgtgcacgctgatatgggctattggatagaaagcagcaaaaatcagacatggcaaatagaaagagcaagcctcatcgaggtcaaaacctgtttatggcctaagactcatacgttatggtccaacggtgtgctggaatcgcaaatgttaataccgaaatcatacgctggaccatttagccaacataactatcgtcagggttacgcgacccaaactgttggaccctggcatttgggtaaacttgaaatagatttcggtgaatgtccaggcacaactgtaactatacaagagaactgcgatcatagaggacccagtctcagaacgacaacggcaagcggcaaattggtaacccaatggtgctgtaggagttgtacaatgccaccattacgttttctaggggaggatgggtgttggtatggtatggaaattagaccgctaagcgaaaaggaagaaaatatggtaaagtcacaggtgactgcaggacagggtacctcagagactttttcaatgggtctactatgtctaacgttgttcgtggaagaatgtttacgaagacgtgtaaccaggaagcatatgattttagcagtagtaataacattatgcgccattatattaggaggactaacttggatggatctactcagagctttgatcatgctaggagacactatgagtgggaggataggcgggcaaacacacctagctataatggctgtctttaaaatgagtccaggctacgtcttgggggtcttcctaagaaaacttacatcgcgtgaaacagcgttaatggtcataggtatggcaatgacgaccactcttagtatacctcatgatttaatggaacttattgacggaataagcctaggtctaattctattaaagatagtcacgcagtttgacaacacgcaagtcggaacattggcgttatcattgacatttattcggagtacaatgtcgctagtgatggcgtggagaacaataatggccgtactcttcgttgtcacgctaatcccactttgtagaacaagctgtttacaaaagcaatcgcattgggtcgaaatcactgctttaattcttggagcgcaagccttacccgtctacctcatgactttaatgaaaggcgcgagtagaaggagttggccattgaacgaaggaattatggccgtaggattagtgagtctactaggtagtgctctattgaaaaatgacgtaccgttggcaggacctatggttgcaggaggtctcctattggcagcatacgtaatgtctggtagctcagcggacctaagtctggagaaagcggcaaacgtccggtgggatgagatggctgatatcaccggttccagcccaataatagaagttaaacaagacgaagatggtagcttcagcattcgcgacgtagaagaaacaaacatgatcactttactggtcaaattagcattaatcacagtctcgggcctataccccttagcaataccaattacaatgacgttatggtatatgtggcaagtaaaaacgcaacgatccggtgcattatgggatgtaccaagtccggcagcaactcaaaaggcagctctatcagaaggggtttaccgaataatgcagagaggattgtttggtaaaacacaagtaggagtgggaatacatatggaaggcgtattccataccatgtggcatgtcacacgcggttcggtcatctgccacgaaactgggcgacttgagcctagctgggcagatgttagaaatgatatgatcagctacggtggaggatggagattgggcgataagtgggataaggaagaagatgtgcaagtgctagcaatagagcctggaaagaacccaaaacacgtacagacaaaacccggattatttaaaacacttacaggagaaataggagcagtgacactagattttaaaccaggcacctcaggcagtcctatcattaatagaaaaggaaaagttataggtctatacggcaacggtgtggtaactaaatctggagattatgtgtcggcaataactcaggctgaaagaataggagaaccggactatgaagttgacgaggatatatttagaaagaaacgacttacaataatggatctccatcctggagcaggaaagacgaaacggatattacctagtattgtacgcgaggcattgaagcgcagacttagaaccctaatattggcgcctacgagagtagtcgctgctgaaatggaggaagctctaagaggcttacccataaggtaccagacacccgccgtgaaatcagaacacacgggacgggaaattgtggacttaatgtgccatgccacttttacaacacggcttttgagtagtacaagagtacctaattacaaccttatagttatggatgaagcccattttacagatccaagcagcgtggcagcaagaggctatatctctacaagagtggaaatgggcgaagctgcagccatcttcatgactgcaacaccacccggagcaacagatccgtttccgcaatccaatagccctattgaagatatagaacgagaaatcccggaaaggagttggaacactgggttcgactggataacggactatcaaggaaaaactgtctggttcgtaccttcaataaaggccgggaacgatatagcaaactgtttgagaaaaagcgggaagaaagtaattcaactcagtcgaaagacctttgacacggaatacccgaaaactaaattaacagattgggactttgtagttaccacggatatatcagaaatgggagcaaacttccgagccggacgagttatcgacccaagaagatgccttaagccagtaatactaactgatgcgccagaaagagtaatattggcaggacccatcccagtaacaccagcttctgcagcgcaacgtagaggcagaataggcagaaacccagcacaagaggacgaccaatacgtctttagtggggacccactgaagaacgacgaagaccacgcacattggactgaagccaaaatgctcctcgacaatatttatactcctgaaggaataataccaaccctatttggtccggaaagagaaaagacacaagcaattgatggggagttcagactaagaggagaacaacggaagacctttgtcgaattaatgaggcgtggagacttaccagtgtggcttagttacaaggtagcaagtgcgggcatctcatataaagatcgagagtggtgttttactggagagcgtaacaatcaaatcttagaggaaaacatggaagttgaaatttggactagagaaggtgagaaaaagaaactacgaccaaaatggctagatgcacgtgtatacgcagatccaatggcgttaaaggacttcaaagagttcgcgtcaggcagaaaatccataactctagatatattaacagaaatagccagcttaccaacttacttgagctcaagagcaaaattagccctagacaacatcgtaatgttacatactacagaaagaggagggcgagcttatcaacacgcattgaatgaattacctgaatctttagagacactaatgttagtcgctctactcggcgccatgaccgcaggcatctttctattctttatgcaagggaaagggataggtaaattaagcatgggactcataacgattgcagttgcttccggtcttttgtgggtagcagaaatccaaccgcaatggattgcggcatcgataatattagagtttttcctaatggttttgctaattccagaaccagaaaaacaaaggaccccacaagataaccaattaatatacgtaatactaacaatactaacaatcattggtttaattgcagcaaacgagatgggactcattgaaaagacaaaaacggatttcggcttttatcaagtaaaaacggaaactactatacttgacgtagatttaaggccagctagcgcatggacactttatgccgtagcaaccacgatcctaactccaatgcttcgtcacacaatcgaaaacacatcagctaacctcagcctcgccgctattgctaaccaagcagctgtattaatgggactaggtaaaggatggccactccatcgaatggacttaggcgtccccctactggcaatgggatgctacagtcaagttaacccaactactttgactgcaagtttagtgatgttactggttcattacgcaataattggacccgggcttcaagccaaagcaacaagggaagcacagaagcgaaccgccgctgggattatgaaaaatccaactgttgatggtattaccgtcatcgatttagaacctatctcgtacgatccgaaatttgaaaaacaactaggccaggtaatgcttctagttctatgtgctggtcaattgctgctgatgcgaacaacatgggctttttgcgaagttttaactctggcaactggacctatactgactctatgggaaggaaacccgggaaggttttggaatacaacaattgctgtgagcacagcaaatatctttcgcggatcatatctcgccggtgcaggcctggctttcagtttaataaagaacgcacaaacaccacgaagaggaaccggcaccgcaggagagacgctaggggagaaatggaagcgtcaactcaactctttagatcgaaaagagttcgaagaatataaaaggagcggaattttagaagtagatcgtactgaggcaaaaagcgctttgaaagatggaagcaaaataaaacatgccgtttcgagggggtcgtccaagatacgctggattgttgaaagaggcatggttaaacctaagggtaaagtagtagatctagggtgcggccgaggaggatggtcttactatatggccacactgaaaaatgtaacagaggtaaaaggatacaccaaaggcggtcctggtcacgaagaaccaatacccatggcaacttatggatggaacctagtaaagctccatagcggagttgatgtattctacaagccaacggagcaagtagataccctcctgtgtgatatcggtgaaagctcgtcaaatccaactattgaggaagggcggactctcagagtactaaaaatggtcgagccatggctttcaagtaaaccagaattttgcattaaagtactcaatccctatatgcctacagttattgaagaattagagaaactacaaagaaaacatgggggaaatcttgtgcgttgtccattaagtagaaattcaacacatgagatgtattgggtgtccggagcatcaggaaatatagtttcgtcagtcaatactacttcaaaaatgctattaaatagattcactacacggcatcgaaaacctacatatgaaaaagatgttgatcttggtgcagggacccgaagtgtatctacagaaactgaaaaacccgatatgaccattataggccgccgactacagaggctgcaagaggaacataaggaaacctggcactacgatcaagagaatccttacagaacatgggcatatcacggtagttatgaagcaccaagcacgggttcagcatccagcatggttaatggagtcgtaaaacttttaacaaagccatgggacgttataccaatggtcacccaactcgccatgacagacacaactccgtttggacaacaacgtgtattcaaggagaaggtggacacaagaacccctcaacctaagccgggtacaagaatggtaatgaccaccacagcaaattggctttgggcattattaggtaagaagaaaaacccacggctatgtactcgagaagagttcatctcaaaagtaaggagtaacgctgctatcggcgcagttttccaagaagaacaaggctggacttccgctagtgaggccgtcaatgactcgagattttgggaactcgtcgacaaagaaagagcgttacaccaagaagggaaatgtgagtcgtgtgtttacaatatgatggggaagagggagaagaaactaggtgagttcggcagagcaaaagggtctcgcgcaatatggtacatgtggctaggagcgcgttttctggaatttgaggctttaggatttttgaacgaagaccattggttcggtagagaaaacagctggagcggcgtggaaggcgaaggattgcacaggttaggttatatactcgaagaaatagataagaaagacggcgatttgatgtatgcagacgataccgcaggatgggataccaggataactgaggatgatctccaaaatgaagaactgataacagaacaaatggcaccacatcacaagattcttgccaaagcgatcttcaagctaacttaccagaacaaagttgtcaaagtactgagacccacaccgcgaggagctgttatggacattatctcaaggaaagatcaacgtggctcaggacaagtagggacgtatggattgaacacctttacaaatatggaagttcaactgataagacaaatggaagccgaaggagtaataacccaagatgacatgcaaaacccgaaaggactaaaggagagagttgagaaatggttgagagaatgtggcgtagatcggctaaagagaatggctatttcaggggatgattgtgtagtcaaaccacttgacgaaagatttggtacatcattgctatttcttaatgatatggggaaggtaagaaaagatatcccacaatgggaaccaagtaaaggttggaaaaactggcaagaggtcccgttttgtagccaccattttcataaaatattcatgaaagacggtcgtagcctggtagtaccctgtcgaaaccaagatgagttaataggcagagcaagaatatcgcaaggagctggctggtcattaagagaaacagcctgcctggggaaggcttatgctcaaatgtggagcctaatgtatttccatagaagagatttaaggctggccagcatggcaatttgctcagctgtacccactgagtggttcccaacaagtagaaccacctggtcaattcatgctcatcaccaatggatgaccacggaagatatgcttaaagtttggaatagagtatggatagaagataaccctaatatgatagacaagactccagttcattcatgggaggacatcccatacttaggtaaacgtgaggatctatggtgcggatctctaatcggtctcagttcaagagcaacctgggccaaaaatattcatacagcgattacacaagttagaaatctaattggtaaggaagaatacgtagactatatgcctgttatgaaacgatatagtgcaccgtcagaaagtgagggcgttttgtga

SEQ ID NO: 23589 - RNA, 9867 nt, synthetic construct
  misc_feature 1..9867: note = derived and/or modified CDS sequence (opt6) from DENV-4__KP188558__SS-prME
  source 1..9867: mol_type = other RNA
tctacaattactcttctatgcctgattcccacagttatggcttttcatttatccacaagggacggtgaacccttaatgatcgttgctaaacatgaacgcggtagaccactattgtttaaaactacagaaggtataaacaaatgcacattaattgcaatggatctgggggaaatgtgtgaggacaccgtgacttataaatgtcctttattggttaataccgaaccagaagatattgattgttggtgtaatcttacaagtacatgggttatgtacggaacgtgcacccaatcaggagagaggaggcgagagaaaagatcagtcgcacttacaccacacagtggcatgggattagaaacgagagccgagacatggatgtcgagcgagggagcctggaaacacgcccaacgagtagagagttggattttaaggaacccaggattcgctttgttagctggatttatggcttatatgataggacaaactggcattcaaaggacggtattctttgtgctaatgatgcttgtggctccaagctatggcatgcgctgtgtaggggtagggaaccgggatttcgtagagggtgttagcggaggagcgtgggtggatttagtgttagaacatggtggctgtgttacaaccatggcacaaggcaaacctacactagattttgagttaacgaagacaactgcaaaagaggtagccctgctaaggacctactgcattgaggcattaataagtaacataaccacagctaccagatgtccaacccaaggtgaaccatacttgaaagaagaacaagatcaacaatacatttgtcgaagagatgtcgtcgacagaggatggggcaatggttgtggactgttcggtaaaggaggagttgtaacatgcgcaaagttttcttgttcgggaaaaattacaggaaatctagtacagatagagaatctagaatataccgttgtagttaccgtccatgatggtgatacgcacgccgtaggaaatgacacatcaaatcacggagtcactgccacaattactcctaggagtcccagcgtagaagtcaaacttcccgactatggagaattaactctggactgtgaacctagaagtggaatagactttaatgaaatgatccttatgaaaatgaagaagaaaacttggcttgtgcataaacaatggtttttagatcttccactaccctggacaaccggtgcagacaccagtgaagtacattggaattataaggaaagaatggtaacatttaaggtgcctcatgctaaacgacaagacgtgactgtattaggaagtcaagagggtgcaatgcacagtgcactagctggcgctactgaagttgatagtggagacggaaaccatatgtttgcaggccatttaaagtgcaaagtacgcatggaaaaactcagaataaagggaatgagctataccatgtgttccggaaagttcagcattgataaagaaatggccgaaacacaacatggcaccacagttgtaaaagtaaaatacgaaggcgcgggagccccctgtaaagtaccaatcgagataagggatgttaacaaggaaaaagtcgtaggacgtgttatctctgctaccccattggcagaaaatacaaatagcgtgacaaacatagaattagaacccccatttggcgatagctatatcgtcataggtgtaggaaattccgcgctaaccctacattggtttcggaaaggatcgtcaataggtaagatgttcgaatcgacatacagaggcgcaaaacgaatggccatccttggggagactgcatgggattttggatccgtcggtggcctttttacatcattaggtaaagctgttcaccaagtattcggctccgtgtacaccactatgttcggcggtgtttcttggatgattagaatacttattggatttctcgttctctggataggcacgaacagcagaaatacttcgatggcaatgacttgcatagcggtcggtggcataacattatttcttggtttcacggtccaagcagacatgggatgcgtagtgagttggagcggcagagaacttaagtgcggatctggaattttcgtcgtagacaatgtccatacgtggaccgaacaatataaatttcaacctgaatctcctgctaggcttgcttcggcgattttaaatgcgcataaagacggtgtatgcggaatacgttcaacgacaagacttgaaaatgtaatgtggaaacagataactaacgaactcaattatgtattgtgggagggaggccatgaccttaccgttgtagctggtgatgtgaaaggggtattaacaaaaggaaagagagctctcacaccccctgcatcagacttgaaatattcatggaagacgtgggggaaagccaaaattttcacacccgaagcgcgaaattcgactttcttaattgatggcccagatacctccgaatgtcctaatgaaaggcgagcctggaacagctttgaagtagaggattacggtttcggcatgttcacaacgaatatttggatgaaatttcgtgaaggtagtagtgaagtatgcgatcataggctaatgtcagccgcaatcaaagaccagaaagcggtacacgcggacatgggatactggatagaaagtagcaaaaaccaaacttggcaaatagaaagggctagtctgatcgaagttaagacatgcttatggccgaagactcacactctctggtcaaacggggttttagaatcacaaatgcttattcctaaatcgtatgctggcccgttttcgcaacataattaccggcaaggatatgcgacgcagacagtcggaccttggcacttaggaaaacttgaaatagactttggagaatgccccgggacaactgttactatacaagaaaattgtgaccaccggggacctagtttaagaaccaccaccgcatcgggaaagctagtcacacaatggtgttgccgtagctgcacaatgcctccattgcgattcttgggtgaggatggatgttggtacggaatggaaataagaccattaagcgaaaaagaggaaaatatggtcaaatcacaggttaccgcagggcaaggaacatctgagactttctcaatgggactcttatgtttaacactattcgttgaggaatgcttgcgccgtcgcgtcacacgtaaacacatgattctcgcagtagtaataactttgtgtgccatcatactaggaggactaacttggatggacctactcagagcattaattatgttaggtgatacaatgagtgggagaataggtggtcaaacgcatctagccatcatggcagtattcaaaatgagtcctggatatgtgttaggcgtcttcctaaggaagctaacttcccgagaaaccgccttaatggttatcggcatggcaatgactacgactctctccatcccgcatgacctaatggaacttatagacggcattagcttgggtttaatattactaaaaatagtcactcaattcgacaatactcaggtaggtacacttgccttaagtctaacgtttatccgatcaacaattagcttggtaatggcatggagaactataatggcagtcttatttgtagtcaccttgattccactttgccgcacttcatgccttcaaaaacaatcgcactgggttgaaattacagcattaatactaggggctcaagcactcccagtttacctaatgactctaatgaaaggtgcaagtcgacgcagctggccactgaatgaaggtatcatggccgtaggtctcgttagcctgctgggttctgcattactcaaaaatgatgtaccgctagctggaccaatggtggccggtggactactgctggccgcgtacgttatgtcaggttcctcggcagatcttagcctagaaaaagctgcaaatgtacagtgggatgaaatggccgatattacaggatcaagccctattatagaagttaaacaagacgaagatggatctttttccatacgtgacgtagaagagacgaacatgatcaccttactcgtaaaactagcattgataactgtttccggtctttatccattagcaataccaataaccatgacgctttggtatatgtggcaagtgaaaacgcaaagatctggagctctttgggacgtaccgtctcctgcagcaacacaaaaagctgcattgtcggaaggggtgtacaggataatgcagagaggcctgttcggaaaaacgcaagttggcgtaggcatacatatggaaggagtttttcacactatgtggcatgtaacacgcgggtctgtgatttgtcatgaaacaggacggcttgagccatcttgggcagacgtaagaaatgatatgatctcctacggaggaggctggcggctcggagataagtgggataaagaggaggacgttcaagttttggcaatagaaccaggtaaaaatccaaaacacgtccaaacaaagcccggcctctttaagaccctaacaggggaaataggcgcggtaacgctagactttaaacccggcacgagtgggtcgccaataataaatagaaagggaaaggtgataggtttgtacggcaatggtgtagtaacaaaaagtggagattatgtgagcgctataactcaagcagaaagaatcggagaacccgattacgaagtcgacgaagatatctttcgaaagaaaagattaactatcatggatttacatcctggagccggaaaaacaaagagaatattaccttctattgtccgcgaggcattaaaaaggcgtctaagaacactcattttagctcccacgcgagtcgtggcagctgaaatggaagaagccttacgaggactgccaatcagatatcagacaccggctgtaaaatccgaacataccggaagagaaatagtcgacctaatgtgccacgcaacatttaccactagacttttaagttcaacccgggtgccaaactataacctcatagtaatggacgaagctcatttcacagatccgagcagtgtggcggcgagaggctatatcagcactcgagtcgagatgggagaagcagcagccattttcatgacagcgacaccaccaggtgctaccgatccgtttcctcagagcaattcgccaatagaggacatagaaagagagattccagaaagatcatggaatactggatttgactggattacagattatcaaggcaagacagtatggtttgttccgtccatcaaggctggtaacgatatagcgaattgtctaagaaaatcaggtaaaaaggttattcagttatctcgaaaaacattcgacactgaatatcctaagacgaaactcacggattgggacttcgtcgtaacaaccgatatctcagaaatgggagcaaactttagagcgggcagagtaatcgatccaagacggtgtttaaaaccagtaattttaacagatggtccagaacgcgtcatattagcaggtccaattccagtaacccctgcatcggccgctcagcggagaggaagaattggcaggaatcctgcacaagaagacgaccaatatgtcttttctggagatcccctcaaaaatgatgaagatcatgctcattggacagaagcaaaaatgttactagataatatatatacaccagaaggtatcatacctacactctttggaccggaacgtgagaaaacccaagcgatcgatggtgaatttcgattacgaggagaacagagaaaaacttttgttgaattaatgcgtcgaggagatctgcccgtatggttgagctataaagtagcttcggccggtatttcctataaagatcgcgaatggtgctttacgggagaaagaaataaccaaatactcgaggaaaacatggaggttgaaatatggactcgtgaaggcgagaagaagaaattaaggcccaaatggttagacgctcgagtttacgccgatcctatggccttaaaggatttcaaagaatttgcatcagggcggaagagtataactctagatatactaactgaaatagcaagcctaccaacctatctatctagtcgcgctaaattagctctcgacaacatagtaatgctgcacacaacagaacgcggaggtagagcataccaacacgctttgaacgaactgcccgagtcgttagaaactcttatgctagtcgctttattaggagctatgactgctggaatatttttatttttcatgcagggaaagggaatcggaaagttaagtatgggtctaataacaatagctgtagcctcaggacttctatgggtggctgaaatacaaccgcagtggatcgcggcttcgataatcctagagttctttttaatggttttattaataccggaacctgaaaaacaaagaacgcctcaggataatcagttaatttacgtaattcttacaatattgactataattggattgattgcggccaatgaaatgggtctaattgaaaagacaaaaactgattttgggttttatcaagtaaaaactgaaacaactatattagatgtagaccttaggccagcgtctgcatggacattgtacgcagttgcgacaacgattttaacaccaatgttgcgacacacaatcgaaaatactagcgctaacctcagtctagcagcaattgctaatcaggcagctgttttaatgggactcggaaaaggatggcctctacataggatggatttgggagtgcctcttctagccatggggtgttactcgcaagtgaacccaaccaccttaacagcatcactggtaatgctgctggtacattatgcgataatagggccaggattacaagctaaagccacacgagaagctcaaaaacgtactgccgccggaataatgaagaatccaacggttgatgggattaccgtaattgatctagaaccaatatcttacgatcccaagttcgaaaaacaacttgggcaagtgatgcttctagttctatgtgcaggtcaactattacttatgagaacgacttgggccttttgtgaagttcttactctggcaaccggaccaatcttaacattatgggaaggcaatccaggtcgattctggaatacaacaatagcggtgtcgacagcaaatattttcagaggttcgtacttggccggagcaggattggcattctccttaattaaaaacgcacaaactccacgccgagggaccggaaccgccggtgaaaccctcggagaaaaatggaaaagacaattaaatagcttagataggaaggaatttgaggagtataagcgaagcggcatccttgaggtcgatagaacagaagcgaaatcagcgctgaaagatggttcaaaaataaaacacgctgtaagtagaggatcatccaaaatacggtggattgttgaacgtggtatggtgaagccaaaggggaaagtagtggatttaggctgcggacggggcggttggagttactacatggcgaccctcaaaaacgtaaccgaagtgaagggatatacaaaagggggtcccgggcatgaagaaccaataccaatggcaacatacgggtggaacttagtaaaattacattcgggagtagacgtattttacaaacccacggaacaagtagataccctgctatgtgatataggagaaagttcaagcaatccaactattgaagaaggcagaaccctgagggtgcttaaaatggtcgagccctggttaagttcaaaaccagagttctgtatcaaggtactcaatccatatatgcccaccgtgatagaagaactcgaaaaattgcaacgtaagcacggtggaaatctagtaagatgcccattgagccgaaactcaacacacgaaatgtactgggtatctggcgcttcaggtaacatagtgagttcagtaaacacgacctcaaaaatgctactcaatcgatttaccacaagacatagaaaaccgacgtatgaaaaagatgtagatttaggggcaggtactagatcagtgtcgacagagactgaaaaacctgatatgacgataataggcaggcgtctgcaacgattgcaagaggaacataaagagacttggcattatgatcaggaaaatccctatcggacttgggcatatcacggatcgtatgaagctccgtcgactggaagtgcgtcatctatggtaaatggcgtcgtgaaactactgactaaaccatgggacgtaataccgatggtaactcagttagccatgacagatacgacccccttcggtcaacaaagagtcttcaaagagaaagtagatactagaacacctcaacctaaaccaggaacccgaatggtaatgactaccacagcaaattggctctgggctttactcggtaaaaagaagaacccacgcttatgtacaagggaagagttcattagtaaagttagaagtaacgccgcaataggagcggtcttccaagaagaacagggctggacgagtgcgtcggaagctgtaaatgactcgcgcttttgggaactcgtcgacaaggaacgtgcacttcaccaagaagggaaatgcgagagttgtgtctacaacatgatgggaaaacgggagaagaaattaggcgagtttgggagagcaaaaggttcaagagcaatctggtatatgtggttgggtgcaagatttttggaatttgaggcgctggggtttctcaatgaggatcattggtttgggagagaaaattcatggagtggagtagagggtgaaggtctccatagactaggatatattttagaagaaatcgataagaaagacggggacttaatgtatgcagatgacaccgcgggttgggacaccagaataaccgaagatgacctacagaacgaagagttaatcactgaacaaatggctccgcaccacaagatacttgcaaaggccatttttaagctaacttaccaaaataaagtagtaaaagtgctaagacctaccccacgaggagctgtcatggatatcatttccaggaaagatcaacgcggaagcggacaagttggtacgtacggtttgaatacattcacgaacatggaagtacaactcataagacagatggaagcggaaggcgtaataactcaagatgacatgcaaaatcccaagggcttaaaagaaagggtggagaaatggttaagagagtgtggagtagataggctgaaaagaatggccatctcgggagacgactgtgtcgtgaaaccccttgatgaaaggtttggaacaagtcttctcttccttaatgatatggggaaagtaaggaaggatataccacaatgggagcctagtaaaggatggaagaactggcaagaggtaccgttttgctctcatcattttcacaaaatattcatgaaagacggaagatcattggttgtaccatgtagaaatcaagatgaactaattggacgagccaggattagccaaggagcaggttggtcactcagagagaccgcatgccttggaaaagcatatgcacaaatgtggtccctgatgtattttcatagaagggatctgagactagcttctatggccatttgttctgccgttccaacagaatggtttcctacgtcgcgtactacatggagtatacacgcgcaccatcagtggatgacaactgaggacatgttaaaggtctggaatcgtgtttggatagaagataatcctaatatgatagacaaaaccccagttcacagttgggaggatataccatacctcggaaaacgcgaagacctttggtgtggtagcctcataggtctctcttctagagccacgtgggccaaaaacatccacacggctataacgcaagtaagaaatttaataggcaaagaggagtatgtagattatatgccggtaatgaaaagatacagtgcgccgtcagagtcggagggggtattatag

SEQ ID NO: 23590 - RNA, 9867 nt, synthetic construct
  misc_feature 1..9867: note = derived and/or modified CDS sequence (opt6) from DENV-4__KP188563__SS-prME
  source 1..9867: mol_type = other RNA
tcaactataacccttttatgtctcatacccaccgtaatggcctttcatttatcaacaagagacggagaacccctgatgattgtagctaaacatgaacgcggaagacctctactgttcaaaaccaccgagggaataaataaatgcacgcttatagcaatggaccttggggagatgtgcgaagatacggtaacatataaatgtcccttacttgtaaacaccgaaccagaagatattgattgttggtgtaacctcacgagtacctgggtaatgtatggaacatgtacacaatccggagaaaggcgaagagaaaaacgcagtgttgcacttaccccacactcaggaatgggactggaaacgagagcagagacatggatgtcatcagagggagcatggaaacatgctcaacgggttgaaagctggattttacgaaatcccgggttcgcacttctagcgggttttatggcttacatgataggacaaacaggtatacaacggacagtatttttcgtactaatgatgttagttgcaccaagctacggaatgcgttgtgtaggtgttggaaaccgcgactttgtggagggtgtttcaggaggagcatgggtagatttagtgcttgaacacgggggctgcgtgactacgatggcccagggaaaaccaacgcttgattttgaacttacaaaaactacagcaaaagaagttgctctattgaggacgtactgcattgaggcattaatctcaaacataaccacagctacacgatgcccaactcagggagaaccataccttaaagaggaacaggatcaacaatatatatgcagaagagacgtagtagacagagggtggggtaatggttgtgggcttttcggaaaaggaggtgtcgtcacctgtgcaaaattcagttgttctggaaaaattactggaaacctcgtacagattgaaaacctagagtacacagtagttgtcactgttcataacggagatactcatgcggtcggaaatgatacttcaaatcacggggttacggcaacaattaccccgaggagtccatcggtagaagtcaaacttccagattatggagaactaacgctggactgtgagccaaggagtggcattgatttcaacgaaatgattcttatgaaaatgaagaagaaaacttggctagtacataaacaatggtttctggatctccctttgccatggactacaggagctgacacatcagaagttcattggaactataaagaacgcatggtaacattcaaagttcctcatgcaaaacgacaagatgttaccgtactaggttctcaagaaggtgcaatgcatagtgcacttgctggagcaaccgaagtcgattcaggcgatggcaatcatatgttcgcgggacacttaaaatgtaaagtcagaatggaaaaactaagaataaaaggtatgtcatatacaatgtgttccgggaaattttcaattgacaaagaaatggcggaaactcaacatggaacaactgtagtcaaagttaaatatgaaggtgcaggggcaccttgcaaagttccaatagaaatccgtgacgtcaacaaagaaaaagtcgtaggacgggtcattagtgcaacaccgctggcggaaaacacaaattctgtgacaaatattgaattggaaccacctttcggtgattcatacattgtgataggagtgggaaattcagcactcacattacattggtttagaaaaggatcctccatcggaaaaatgttcgaatcaacgtaccgtggagcaaaaagaatggctatcttgggcgaaactgcatgggattttggcagtgtcggagggctgtttacatccctaggaaaggcggttcatcaagtttttgggagcgtgtataccacgatgttcggaggcgtttcgtggatgattcggatattaattgggtttctagtgttgtggatcggtacaaatagtcggaatacatcaatggcaatgacctgcatcgctgtaggaggcattacactattcctaggatttacagtccaagcagatatgggttgtgtggtaagttggtcgggacgggaattgaaatgtgggagtgggatttttgttgttgataatgtacatacatggacagaacagtataaatttcaacccgaaagccctgctagattagcgagcgcaattctaaacgcgcataaggacggtgtatgtggaattagatctactacccgtctggagaatgtcatgtggaaacaaatcacaaatgaactgaattatgtattatgggaaggcgggcatgatcttactgtagtagcaggggatgtcaagggtgtattaacgaagggtaagcgtgcacttacaccacccgcatccgacctgaaatattcatggaaaacatggggaaaagcaaagatattcactcctgaagcgcggaactcaacatttctaatagacggcccagatacgtccgaatgtcctaatgagagacgtgcatggaatagctttgaagtagaggattatggatttgggatgtttacaacaaacatttggatgaaattccgagaaggctctagcgaagtatgtgatcaccggttaatgtcggctgccataaaagatcaaaaagcagttcatgcagatatgggttactggatagaaagttcaaagaatcaaacgtggcagatcgaacgtgcatcactgatagaggtgaaaacatgtttatggcctaaaactcacacgttatggagtaacggtgtattagaatcacagatgttaataccaaaatcatatgctggcccattttcgcaacataattatcgtcaggggtacgctacgcaaaccgtaggaccttggcatttgggcaagttagaaattgactttggcgaatgtcctggcacaactgtcacaatccaggaaaactgcgatcacagaggtccgtcccttcgtaccacaacggcatctgggaagctagttacacaatggtgctgtcgatcatgcaccatgccaccactaagatttttgggtgaagacggttgctggtacggtatggaaataaggcctttaagtgagaaggaggaaaacatggtaaaaagccaagtaactgccggccaaggaacgtccgagacgttcagtatggggttactttgccttacactctttgtagaagagtgtctacggcgacgtgttacccggaaacacatgatcttagcagtggttataaccctatgcgcgatcatattaggtgggcttacgtggatggacctactacgagcgttaataatgttaggagataccatgagtgggcgaatagggggccaaacacatctagcaatcatcgccgtctttaagatgtcgccaggctacgttctgggtgtatttctacgtaaactcaccagccgcgaaacagcactgatggtaataggcatggcaatgaccactactctatcaattccacacgacctgatggaactaatagacggtataagtcttggtctcattttattgaaaatagtaacacaattcgataacacgcaagtgggaacattggccttaagtctcacgttcattagaagcactatgtcattggtcatggcttggcgaactataatggcagttttatttgtagttaccttaataccattgtgtcgtacttcatgtttacaaaaacagagtcattgggtggaaataacagcgttgattctaggagctcaagcattgcccgtctacttaatgacattaatgaaaggtgcatctagacgctcatggcctttaaatgaaggaattatggctgtcgggctagttagtcttctgggaagtgcattattaaagaacgacgttcctctcgcgggtccaatggtggctggcggattacttttagccgcatatgtcatgagcggaagctctgcggacttgtctttggaaaaagccgccaatgtccaatgggacgaaatggcagatataacgggtagcagtccaataatcgaagttaaacaggatgaagatgggtctttttcaatacgagatgtggaggagacaaacatgatcaccttgttagtgaaattggcattaattacggtctcggggctatatccacttgccattccaataactatgacactctggtatatgtggcaggtaaagacacagagatcaggagcgttgtgggatgtgccttcccctgcagcaacacagaaggcggcactatccgaaggagtttatagaataatgcagagagggctattcggcaagacacaagtcggagtaggcattcacatggagggtgtgtttcacacaatgtggcatgtaacaagaggctcggtaatttgtcacgagacagggcgattagagccatcttgggctgacgttagaaatgacatgatctcttatggaggcggatggcgattaggagacaagtgggatcgagaggaggatgttcaagtactggcgattgaaccaggcaaaaatccaaaacatgtacaaactaagcccggtttatttaagactttaaccggtgaaataggagcagtaacgcttgatttcaaaccagggacttctggtagcccaataataaaccgaaagggaaaagtaataggactatatggaaatggtgtagtgacaaaatcaggtgactatgtcagcgcgataacccaggcggaaaggatcggtgagcccgattatgaagtcgatgaagatatattcagaaagaaacgattaacgataatggatttacatcctggtgcgggtaaaacaaaacgtatattaccatcaatagttagagaagccttaaaacgacgactcagaacactaatattagcaccaacgagggtagtcgccgctgagatggaagaggctctgaggggcttaccaatacgttatcaaacaccagctgttaaaagtgaacacactggacgagaaattgtcgacctaatgtgtcatgccacattcacaaccagattactgtcatccactcgcgtccctaactacaatttaattgtgatggacgaggctcatttcactgatccttccagcgtagcagctcgaggttatatttccacacgtgttgagatgggggaagctgcggctatattcatgacagcaacacccccaggggcgacagatccatttccgcaaagcaattcaccaattgaagatattgaacgggagataccagaacgtagttggaacacaggatttgactggataacggattaccaaggaaagacggtatggttcgttccttcaataaaagcaggaaatgatattgcaaattgcttgcggaaaagcggaaagaaagtaatacaattaagtagaaaaacgtttgacacagaatacccaaaaacaaaattaaccgattgggattttgtagtcaccacagacattagtgaaatgggtgcaaattttcgagctggccgagtgatagacccacggcgttgcttaaaaccagtaatattgaccgatgggccagagagagttatcttagctggaccaatacctgtaacaccagcttctgcggctcagaggcgaggacggatagggcgaaacccggcacaagaagacgaccaatatgtatttagcggtgacccactcaagaacgatgaagatcacgctcattggacagaggctaagatgctacttgataatatctatacaccagaaggtattattccgacactatttggacccgaaagagagaaaacgcaagctatagatggcgagttcagactcagaggagaacaaagaaagacgttcgttgaacttatgaggagaggagatttaccggtatggttgtcatataaggttgcgagcgcggggatttcttataaagacagagaatggtgtttcacaggggaaagaaataaccaaatactagaagaaaatatggaagtcgaaatatggactagagagggcgagaagaagaaattgaggccaaaatggttggacgccagagtgtatgctgacccgatggcccttaaagacttcaaggaatttgctagtggtcgtaaatctataacactcgatatactaacagaaatcgcatctctaccaacctacttatcatctagagcgaaactggcgttggataatattgtaatgcttcacaccacagagagaggtggacgcgcataccagcatgcattaaacgaactaccagagtcgctggagacgttaatgttggtggccctcttaggtgcgatgaccgctggaatcttcttattctttatgcaaggaaaaggaatcgggaaattatctatgggactgataacgattgcggtcgcatctgggcttctatgggtagcggaaattcaaccacaatggatagcagccagcataatcttagagttctttttgatggtactacttatacctgaacctgaaaagcaacgtacaccacaagataatcaacttatttacgttatactgacaatcctaacaattattggactaatagctgcaaatgaaatgggactaattgagaaaacaaaaacagattttggtttctatcaggttaaaactgaaacaacgatactggatgtagatttaaggccagcttcggcatggaccttgtatgcggtagcaactacaatattaacgccgatgctccgtcacaccattgaaaatactagcgcaaacttatctttagcagcgattgctaatcaagctgcagtactcatggggcttggaaagggttggccactacatcgaatggatctaggagtaccgttgctagcaatgggttgttacagccaggtaaatccaacgaccttaacagctagtctagttatgttattagtgcactacgcaattataggcccaggtcttcaagcgaaagccacacgagaagcacagaagcgcaccgcagccggaataatgaagaatcctacagttgacggaatcactgtaatagacttggaaccaatctcgtatgatcccaaattcgaaaagcaattggggcaagtaatgctattagtgttgtgtgcaggacaattacttttaatgagaactacgtgggctttttgcgaagtcctaacgttggcaacaggtccaatcctgacgttatgggaaggcaaccccgggaggttttggaatacaacgattgcggtttccacagccaatatatttagaggatcctaccttgcaggagcgggactagctttctcgttaatcaaaaatgcacaaacacccagaaggggaaccggaacagctggtgaaacattgggcgagaagtggaaaagacaacttaacagtcttgacagaaaagaatttgaggaatacaaaagatcaggtatattagaagtagatcgtaccgaagcaaagtcagcattaaaggatggttcgaagataaaacatgccgtaagccgcggatcttcgaaaatacgttggatcgtggaaaggggtatggtaaaaccgaaaggaaaggtagttgacttggggtgcggtagaggtgggtggagctactatatggcaacccttaagaatgtgactgaagttaaagggtatacaaaaggagggcccggccacgaagaaccgattccaatggcaacatacggatggaaccttgtaaaacttcattcaggtgtcgacgtgttctataaacctactgagcaagtcgatacacttctgtgcgacataggagagtcctcatcgaatccgaccatagaagagggacgtactttaagggtactaaaaatggtcgaaccgtggctgagtagtaaaccagaattttgtataaaagtcctaaatccgtatatgccaacagtaattgaagaactagaaaaactacaaaggaaacatggaggtaacctagtccggtgtcctctatcgagaaacagcactcatgaaatgtactgggtaagtggggctagtggaaatatcgtgagctctgtaaacacaacatcaaaaatgttattaaatcgatttactacaaggcatcgaaaaccgacatatgaaaaggacgtggatctcggtgcagggaccagatcagttagtacagaaatagaaaaaccagacatgaccattataggtagacgacttcaacgacttcaggaagaacacaaagaaacatggcattatgatcaagaaaatccataccgtacatgggcttatcatggaagttatgaggctcccagcactggtagtgcatcaagtatggtcaatggggtagtgaaacttctaacaaagccatgggatgtcataccgatggtaacgcagttagctatgaccgatactacaccttttgggcaacagcgggtgtttaaagaaaaagtcgatacaagaacacctcagccgaaaccggggacaagaatggtcatgaccacgacggcgaactggttgtgggccttattaggcaagaagaaaaatccaagattatgcacaagagaagagtttatcagcaaagtacgatcaaatgctgctattggggctgtttttcaggaggaacaaggatggacaagtgcctcagaagcggtaaacgattctaggttctgggaattggtagacaaggaaagagcgttacaccaagaaggtaaatgtgaaagttgtgtctacaatatgatggggaaaagagaaaagaaattgggtgaatttggccgtgctaaagggtctagagcaatatggtacatgtggttgggcgcgaggttccttgagttcgaagcattagggtttctaaatgaggatcattggttcggacgtgaaaattcgtggtcaggagtggaaggagaagggctgcatagattggggtacatactagaggagattgacaagaaagacggcgatctcatgtatgcagatgacaccgcggggtgggatacgcggataaccgaagatgacttgcaaaatgaggagctaatcacggagcaaatggcaccccatcataaaatcttagcaaaagcgatctttaaattaacttatcaaaataaggtcgtaaaagttttaaggccaactcccaggggagcagtcatggatataattagtcgaaaagaccaaaggggtagcggacaagtgggtacctatggattaaacacctttaccaatatggaagttcagctaattcgtcagatggaagcggaaggggtaataacgcaagatgatatgcaaaacccgaaaggtctaaaggaacgagtcgaaaaatggcttcgagaatgtggtgtggacagacttaagagaatggcgataagtggagatgattgcgtagtgaagccgttagacgagaggttcggcacgagcctattattcttgaatgatatgggaaaagtgagaaaagatatcccacagtgggaaccctcaaaaggatggaagaattggcaagaagtccccttttgcagccatcatttccataagatatttatgaaagacggtcgtagtttggtagtaccatgtaggaatcaagatgagttaatagggcgcgcaagaataagccagggagccgggtggtcattaagagaaactgcatgcttgggaaaggcttatgcacaaatgtggagcctaatgtacttccataggagagatctaaggttagcctcgatggcaatttgttccgctgttccgaccgagtggtttccaacaagtcggacgacatggtcaatacacgcccatcatcagtggatgacaaccgaagatatgctcaaagtatggaacagagtctggatcgaagataatccgaatatgatagataaaacacccgtccattcttgggaagatataccatatttaggaaagcgagaggacctatggtgcggtagcctgatcgggttgagttccagagctacttgggccaaaaatatacataccgcgattactcaagtacgaaatctaatcggaaaagaagaatatgtagattacatgtcagtgatgaaaaggtactctgccccctcagagagcgaaggagttttataa

SEQ ID NO: 23591 - RNA, 9867 nt, synthetic construct
  misc_feature 1..9867: note = derived and/or modified CDS sequence (opt6) from DENV-4__KP188564__SS-prME
  source 1..9867: mol_type = other RNA
tcaactataacactgctatgtctaattccaacagttatggcatttcatctaagcaccagagatggagaacccttaatgatcgttgcaaagcatgaacgaggtcgtcccttattatttaaaacaaccgagggaattaataaatgcacattaatcgcaatggatctaggcgaaatgtgtgaagacacagttacatacaagtgtccattacttgttaacactgagccagaagacatcgattgctggtgtaacttgactagcacatgggttatgtacggaacgtgtactcaatcaggcgaaagacgtcgagagaaacgaagtgttgcactaacaccacattcaggaatgggattagagactagagcagaaacatggatgagcagtgaaggagcttggaagcacgcgcaaagagtcgaaagttggatactaagaaatcccggttttgccttgctagctggctttatggcatacatgattggacaaacaggtatccaaaggacagtattctttgtgctgatgatgctagtggccccatcgtatggaatgcgctgtgtgggggtaggcaaccgtgactttgttgaaggtgtaagtggaggtgcttgggttgatttagttcttgagcatgggggttgtgttacaacgatagcccaaggaaaaccaactttagattttgagctcaccaaaacaactgcaaaggaagtagcattactcagaacatattgtattgaagccctcataagtaacatcaccaccgctactcgatgtccaacacaaggcgaaccctatttaaaagaagaacaagaccaacaatatatatgtagaagagacgtagttgatagagggtggggaaatggatgtggtctattcggtaaaggaggggtggttacgtgtgccaagttttcatgctctgggaaaataacaggaaatttagtgcagatagaaaaccttgaatatactgtagtagtaacagtccataacggggacactcacgcggttggaaatgacacaagtaaccacggtgtcactgcaacgataacgccaaggagtcctagtgtagaagtgaaactacccgattatggtgagttaacgttagattgtgagccacgaagcggtatcgattttaatgagatgattttgatgaaaatgaagaagaaaacttggctagtccacaagcaatggttccttgacttacctttaccatggacgacaggtgccgatacctctgaagtccattggaactataaagaacgaatggtcacattcaaagtaccacacgcgaaaagacaagacgtcacagtattgggtagtcaagaaggggcaatgcattccgcactagctggagctactgaagtagattctggcgacggaaatcacatgtttgctggacatcttaagtgtaaagtacgaatggaaaaacttagaataaagggaatgagctacaccatgtgctcaggtaaattctctatcgataaggaaatggcagaaactcaacacggaacaacggttgtaaaaatcaaatacgaaggagcaggagcaccatgtaaagttccaatcgaaataagggatgtgaataaagaaaaagtagtaggtcgagtaatcagcgcaactcctttagctgagaacacaaacagtgtaactaacattgaattagaacccccatttggagattcgtacattgtaataggggtcggaaatagtgctctaacattacattggtttagaaagggaagctcgataggaaaaatgttcgagtcaacataccgaggagctaaaagaatggccatactcggagagacagcatgggactttggcagtgtaggcggacttttcacgtctcttggcaaagcagtacatcaagtgtttggttcagtatatacgacaatgtttggaggcgtaagttggatgattagaatccttatcggatttctggttttgtggatcggtactaactcaagaaatacaagtatggctatgacatgtatagcggtaggaggtataacattgtttctaggctttaccgtccaagcagacatgggctgcgtagtgtcatggtccggacgagaactcaaatgtgggagtggaatattcgtcgttgataatgtacacacgtggactgagcaatacaaatttcaacctgaaagcccagcgcgattagcgagcgcaattttaaatgcgcataaagacggcgtatgtggcataaggtccacgacgagactagaaaatgttatgtggaagcagatcactaatgaattgaactacgtactatgggaaggaggacatgatttaacagtagtcgcaggggatgtgaaaggagtattaacaaaggggaaaagagcattaaccccaccagcttctgatttaaaatatagttggaaaacttggggtaaagcaaagatcttcactccggaggcacgtaacagtacattcttaatagatggaccagatacaagcgaatgtccaaatgaaagaagggcctggaacagctttgaggttgaagattatggtttcggaatgtttaccacgaacatttggatgaaatttagagagggatcttcagaggtgtgtgaccatagactcatgagcgcagctataaaagatcaaaaagcagtacacgcggatatgggatactggatagaaagtagcaaaaatcaaacgtggcaaatcgaaagagcatcactgatagaagttaagacatgtttgtggcctaaaacacatacattatggtctaatggagtcttggagagtcaaatgttaattcctaaatcttatgcgggccctttctcacagcataattaccgccaaggctatgcaacgcaaaccgtgggaccatggcacttaggaaagttagaaatagatttcggggaatgccctggaacaaccgtcacgatacaagaaaactgtgaccataggggcccgagtttaagaacgacaacagcttcaggcaagttagtaacacaatggtgttgtcggtcatgtacaatgccaccgttaagatttctaggcgaggatggatgctggtacggcatggaaattcgtccattatcagaaaaagaggaaaacatggttaaatcacaagtcaccgcaggtcaaggtacttcagaaacattttcaatgggacttttatgtcttacacttttcgttgaggagtgtctaaggcgaagagtaacacgtaagcatatgattttagctgtagttataacattatgtgctataatacttggcggtctaacatggatggacctcctgcgagcactaatcatgttaggtgatacgatgtcaggaaggatcggtggacaaacccatcttgccatcatggcggtgtttaagatgtcacctggttatgtcctcggcgtattcttaagaaaactcacgtcaagagagaccgctctgatggtaataggaatggccatgacaaccactctgagtattccacacgatctcatggaattaattgatggtatcagtctgggattaatattattaaagatagtgacacagtttgacaatacacaggtaggcaccttagcattatcactaacctttatcagatcgaccatgtcgcttgtgatggcgtggagaacaataatggcagtattgtttgtggtaacgctaattccattgtgccgaacctcttgtctccagaaacaaagccattgggtagaaataacggcactaatattaggagcacaagccctgccagtatatttaatgacactcatgaaaggtgcctcacgaagatcatggccgcttaatgaaggtattatggctgtgggcctagtctcgctgctgggatctgcactattgaaaaatgacgtgcctctagccggacccatggttgcaggcggactgctgttggcggcctacgtaatgagtggaagcagtgccgacctttcactagaaaaagctgcaaatgtccaatgggacgagatggcggacatcacgggcagtagtccaataattgaggtgaaacaagacgaggacggaagtttcagtatacgagatgtggaagaaacaaatatgataacattactcgtaaaacttgctttaatcactgtctccggactgtatccattggcaattccaataacaatgactttatggtatatgtggcaagtaaaaacacaaaggagcggagctctctgggatgtaccctcgcctgcagcaacacaaaaagcggctttatcggaaggagtatatcgaatcatgcagagaggcttatttggaaaaacgcaggtcggcgtaggaatacatatggaaggagttttccatactatgtggcacgtcacccgcggttcagtgatatgtcatgaaaccggacgactagaacctagctgggctgacgttagaaacgacatgatttcatatggcggaggatggagactgggcgacaaatgggataaagaggaagacgtacaggtattggcaattgagccaggtaagaatccaaaacatgtccaaacaaaacccggtctatttaaaactttaactggtgagattggggcagtgactttagacttcaaaccaggcactagcggaagccctatcattaatagaaaaggaaaagtgatcggactttacggaaacggggttgtaacaaaatctggagattacgtcagcgccattactcaagctgaaagaataggggaaccagattacgaagtagatgaagacatttttcgcaagaaacggctaacaataatggatctacatccaggcgcgggaaaaacaaaaagaatactaccctcaattgtcagagaagcattaaagagaagattacggactttaatcttagcgcccacaagggtggtagcagccgaaatggaggaagcgttaagaggtttacctataagatatcagactcccgccgttaagtcggaacacaccggtcgagaaatcgtagatttgatgtgccacgcaacatttacaacacgactattgtcatccactcgcgttccgaattataacttaattgtaatggatgaagcccattttactgacccatccagtgtagcggctaggggctatatctctacgagagtcgaaatgggcgaagctgcggccatttttatgaccgccacgcccccgggtgcgacagacccattcccacaatctaatagtcccattgaagatatcgaacgcgaaatacctgaacgatcatggaatactggtttcgactggataacagattatcagggaaagacagtgtggttcgttccttcgataaaagccggaaacgatatagccaattgcctaagaaagagcggtaaaaaggtcatacaactatctagaaagacatttgacacagaatatcctaaaacaaagttaaccgactgggattttgttgttacaacagacatttccgaaatgggagcaaatttcagggctggaagggtgatagatccacgacgctgcttaaagcctgtcatcttaacagatggcccggagcgtgttatactcgcaggaccaatcccagttacgcccgctagcgcagcacagcgcagaggacggatcggcaggaatccagcccaagaagacgatcagtatgtatttagcggggatccattgaaaaatgacgaagatcacgcccattggaccgaagccaaaatgctcttagataacatatacactccagaaggaattattccgacattattcggtccggaacgcgaaaagacacaagctattgatggtgaatttcgactcagaggtgaacaaagaaagacgttcgtagagttaatgcgacgcggcgaccttccagtctggctatcttacaaagtagcgtctgctggcatttcttacaaagatagagagtggtgcttcacaggtgaaagaaacaatcaaatactagaagaaaatatggaagtggaaatttggacacgtgaaggggagaaaaagaaactgaggcctaaatggctagatgctcgcgtgtatgcagatcccatggcattgaaagattttaaagaatttgcatctgggagaaaaagtataactctggatatcttaaccgagatcgctagtctacctacttatttaagcagtcgcgcaaagttagcactagacaacatagttatgttacataccacggagcgaggcggtagggcataccaacatgcattaaatgagctaccagaaagcctggaaaccttgatgttagttgccctattaggcgcaatgacggctggaattttcctattctttatgcagggaaaaggtattggtaaactttctatgggcttaataacaatcgcagtcgcctcggggctgctttgggtggccgaaatacaaccccaatggatagctgcgagtatcatattggaatttttcctaatggtcttacttatccctgaacccgaaaagcaacgtactccacaagacaatcaacttatttatgttatcttgaccattttaacaatcatcggattaatagccgccaatgaaatgggtttgatagagaaaactaaaacagatttcgggttttatcaagtaaaaaccgaaacaacaattctagacgtagaccttcgtccagcctcagcttggaccctctatgcagtagcaactaccatcttaaccccgatgttgcgtcatacgatagagaacactagcgcgaacttaagtttagctgctatcgcaaaccaagccgctgtattaatgggtctggggaaggggtggcctttacaccggatggatctcggtgttccactacttgccatgggctgctactcgcaggttaaccctacaacgcttaccgcctcgctcgttatgctgctggttcattatgccataataggaccagggctacaagcaaaggcgaccagagaagcgcagaaaagaactgccgcagggattatgaaaaatccgactgtagacggaataactgtaatagatctagaaccgataagttacgacccgaaatttgagaaacagctaggtcaagttatgctcctagttttatgtgcaggacaacttctattaatgagaactacttgggcattttgtgaagtcctaactttagctactggtcctacattaacactatgggaaggcaaccccgggcgattttggaatactacaattgccgtaagtacagctaacatatttagaggatcttatctggcgggtgcaggccttgcattcagtttaatcaaaaacgcacaaacacctagacgtggtactgggactgcaggcgaaacattaggtgagaaatggaagcgtcaattaaattcgctggacagaaaagaatttgaagaatacaaacgaagtggcatattggaggtagaccgaactgaagcgaagtcagcgcttaaagacgggagtaaaataaaacatgccgtttcacgaggatcaagcaagatccgatggattgtggaacgaggaatggtaaaacctaagggcaaagttgttgatctagggtgtggtcgcggaggctggagttattatatggccacactcaaaaacgtaacagaggttaaaggctacacaaagggcggaccaggtcatgaagaacctatcccaatggcaacatacggatggaacctagtcaagctacactcaggagtcgatgtattttataaaccaactgagcaagtcgacactctactatgtgatataggcgaatcatcctctaatccaacgattgaggagggtcggacactccgtgtgttaaagatggtagaaccctggctaagttcaaaacccgaattttgtatcaaagtacttaatccatacatgccaaccgtaattgaggaactagaaaaacttcaaaggaaacatggcgggaacctagttcggtgcccattatctcgcaattcaacacacgaaatgtattgggtatctggcgcatcagggaacatagtatcaagtgtaaatacaacttccaaaatgttattaaacagatttacaacacgacatcgaaagccaacttatgagaaagatgttgatctcggagcgggaacaagatcagtgtccaccgagactgaaaaacccgatatgacgataattggtagacgcctacaaagactccaagaagaacataaagaaacatggcattatgaccaagaaaatccatatcgaacttgggcctatcacggttcatatgaagcgcccagcacagggagtgcaagttctatggtgaacggtgttgtaaagctactcacgaaaccatgggacgttataccaatggtaacacaattagccatgactgatactacaccatttggtcaacaaagagtgtttaaagagaaagttgatacccgaacgccacagccaaagcccggaacaagaatggttatgacgacgactgcgaattggctttgggctctattaggaaagaagaaaaatccacgtctgtgtacgagagaagaatttatatcgaaagtaagatccaatgcagctattggcgctgtatttcaggaagaacaaggatggacatctgcaaacgaagcggtcaatgattctagattttgggaattagtcgataaagaaagagcactacaccaggaaggcaaatgcgaaagttgtgtttataatatgatgggcaaacgtgagaagaaacttggagaatttggcagagctaaaggcagccgggcgatttggtacatgtggttaggcgctaggtttctagaatttgaggcacttggatttttaaatgaagatcactggtttggaagggagaactcatggagcggtgtagaaggagaaggattacatcgcttgggctacattttggaagaaatcgacaagaaagacggcgatctcatgtacgccgacgatacagcaggttgggatacacgtattactgaagatgatttacaaaacgaggagttgataacagaacaaatggcaccccatcataagattctcgcgaaagcaatctttaaattaacctaccaaaacaaggtagttaaggtgttaagaccaacccccagaggagccgtcatggatataatttcaagaaaagaccaaagaggttccggccaggtcggtacgtacgggttgaatacttttacaaatatggaagttcaactgatacgacaaatggaggcagaaggagtcattacgcaagacgatatgcagaatcccaaaggactgaaagaaagagtggaaaaatggttgagagaatgcggagttgatcgactaaaacgaatggcgatttcaggggatgactgcgtcgtaaaaccattagatgaaaggttcggtacatcgcttctctttctcaacgatatgggcaaggtcagaaaagatataccgcaatgggaaccgagcaaagggtggaaaaactggcaagaagtaccgttctgtagtcaccacttccataaaattttcatgaaagatggtagaagtctagtagtgccatgtcgtaaccaagatgagctaatcggacgcgcaagaatatcgcagggggcagggtggtcgttgcgtgaaactgcctgtttagggaaggcctacgcacagatgtggtccctgatgtattttcacaggagagatttaagattagcgtcgatggcaatttgtagcgcagtcccaactgaatggtttcccacgtcgaggacaacctggtcgatccatgcacatcaccagtggatgacgacagaggacatgttaaaagtatggaatagagtatggattgaagacaatcctaacatgattgataaaactcctgtacactcatgggaagatataccgtatctgggcaaaagagaagatttgtggtgtggatccttaattggcctcagtagtcgtgcgacctgggccaaaaatattcatacagctataacacaagtacgcaatctaataggtaaagaggagtacgtcgattatatgccagtgatgaaaaggtattcggcgccgagcgaaagtgaaggtgttctttaa

SEQ ID NO: 23592 - RNA, 9867 nt, synthetic construct
  misc_feature 1..9867: note = derived and/or modified CDS sequence (opt6) from DENV-4__JN983813__SS-prME
  source 1..9867: mol_type = other RNA
agcacaattaccttgttatgcttaatacctacagtgatggctttccatctatcaacacgtgatggagaaccattaatgatcgttgctaagcatgaaagaggacgaccgcttctattcaaaactactgaaggcattaacaaatgcacactgatagcaatggacttaggagaaatgtgtgaagacacagtaacgtataagtgtccgttgttagtaaatacggaacctgaagatattgactgctggtgtaacttaaccagtacgtgggttatgtatggtacatgcactcagagcggtgaacgaagaagagaaaagaggtcagttgccttgacgccacactcaggcatggggctcgaaacacgtgcagaaacatggatgtcttctgaaggggcatggaaacatgcccaacgagttgaatcttggatactgagaaaccctgggtttgccttactagcaggattcatggcttacatgataggacaaacgggcattcaaaggactgtgttctttgttttgatgatgttagtcgcaccaagttatggaatgaggtgtgtcggcgtaggtaaccgtgacttcgtggaaggcgtgtcaggaggagcatgggtggatttagttcttgaacatggagggtgtgtgaccacaatggcacaaggaaaaccgacattggattttgaattaacaaagacaactgccaaagaagttgcattgttaagaacgtattgcattgaagcgctaatcagcaacataaccactgccactaggtgtccaacgcaaggagaaccttatctgaaggaagaacaagatcaacagtatatctgcagaagggatgttgtcgatagagggtggggaaatggttgtggtctatttgggaaaggaggcgtggttacttgcgcgaaattttcttgctcaggtaaaataacaggaaacctcgtacaaatagaaaacttggagtatacagtggtagtaaccgtgcacaatggagatacgcatgcagtcggtaatgacacatccaatcacggagttactgcaacaattaccccgcggtctccaagcgtcgaagtaaaattaccagattatggagagttaaccttagattgcgagccaagaagtgggattgatttcaacgaaatgattttgatgaaaatgaaaaagaagacgtggctggtccacaaacagtggttcttagatctcccgttaccttggactacaggagcagatacttcagaggtgcactggaattataaagaacgaatggttacattcaaagtaccgcatgcaaaacgtcaggacgtcacagtactaggctcacaagaaggggccatgcatagcgctttagcaggggcaacagaagttgacagcggcgacggaaatcatatgtttgctggacacttaaaatgcaaagtgaggatggaaaaattaagaattaaggggatgagttacacaatgtgttcaggaaaattttcgatagacaaagaaatggcagagacacaacatggaacaaccgttgtaaaggtaaagtatgaaggggccggcgcaccttgtaaggtaccgatagagataagggacgttaataaagaaaaggtagttggaagagtaattagcgcaactcctcttgcggagaataccaattcagtaactaacatcgaattagaaccaccatttggagattcttatatcgtaatcggtgtcggcaactcagcattaacattacactggtttcggaaaggttcaagtatcggtaaaatgtttgagagtacatacaggggagccaaacgaatggcaatcttaggcgaaacagcatgggacttcgggtccgtcggcgggctattcacaagtctagggaaagctgtacaccaagtatttggatctgtatacactactatgttcggtggagtttcgtggatgattcgaattttaatagggttcttggtgctatggataggaaccaacagtaggaacacttcaatggccatgacctgcatagcagtcggaggaataaccttgttcctggggttcactgtacaggcagacatgggatgcgtcgtatcgtggagtggacgcgaattaaaatgtggatctgggatatttgttgtagataacgttcatacatggaccgaacaatacaaattccaaccagaatcaccagccagattagcgagtgctatactgaatgctcataaagatggcgtgtgtgggatacgctcaacgacacgtctagagaatgtaatgtggaaacagataacaaatgagcttaattacgtactatgggaaggtggtcatgacttaactgtagtagctggagacgttaagggtgtgcttactaaaggtaaacgtgccttaacaccccctgcatcagatttgaagtatagttggaaaacctggggtaaggccaaaatttttacacccgaagcaaggaatagtacattcttaattgatggaccagacaccagcgaatgtcctaatgaacgacgagcatggaactcattcgaggtcgaagactatggattcggaatgttcacgacaaatatatggatgaaatttagagaaggttctagtgaggtgtgtgaccatagacttatgagtgctgcaataaaagaccagaaggcagttcacgccgatatgggatattggatagaatcatccaaaaatcagacatggcaaatcgaaagggcctcactaatagaagttaaaacttgcttatggcctaagacacacacgctttggtctaatggagttttggagtcacaaatgttgataccgaaatcatacgctggtcctttcagtcaacacaactacaggcaaggttatgcaacacaaacagtaggaccatggcatctaggtaaattggagatagattttggcgagtgcccggggacgactgtaacaatccaggaaaattgtgatcaccgaggaccgagcttacgtactaccactgcttcaggaaagttagtaacacaatggtgttgtagatcgtgtacgatgccaccactccgattcctcggagaggacggatgttggtatgggatggaaatacgacccttaagtgaaaaagaagaaaatatggtaaagtcacaagtcaccgcagggcaaggaacctcagaaacctttagtatgggactgctctgtctaacgctctttgtggaagaatgcttgaggcgaagagtaacacgaaaacatatgatactcgcagtagtgatcactctttgcgctatcattttaggaggattaacgtggatggatttgttacgggcattaattatgttaggagacacaatgtcaggaaggattggagggcaaactcatctagctataatggcagtgtttaagatgtccccaggctacgtattaggtgtgttcttaaggaaattaacttccagagagacagctctaatggttatcggaatggctatgacaactacgcttagcatacctcatgatctgatggagcttatagatgggattagtttaggacttatattactaaaaattgtgacacaattcgacaatactcaagtaggaacacttgccctatcattaacttttatcagaagtactatgagcttagtcatggcgtggagaacaataatggcagtactatttgttgtaaccctcattcccctatgccggacgtcctgtttgcaaaaacaaagtcactgggttgagataacagcgttaatactgggcgctcaggctttgccggtatacttgatgacccttatgaaaggagcctcaagacgatcatggcccttaaacgaggggataatggcagtaggtcttgtcagcctattgggatctgcacttctaaagaatgatgtgccgttagctggaccaatggtagcagggggcttacttcttgccgcttatgttatgtcgggtagcagcgcagatttgtctctagagaaagccgccaacgttcaatgggatgaaatggcagacataacgggtagcagtccaattattgaagtaaaacaagatgaagacgggagctttagcatacgtgatgttgaagagacaaatatgattactttactcgtaaaactcgcacttattaccgtatcaggtttatatccattagccattccaataacaatgacattgtggtatatgtggcaagttaagacacaacggagcggcgctttgtgggatgtcccatcaccggccgcgacacaaaaagcagctttatcagaaggggtatatagaataatgcaacgaggattattcgggaaaactcaggtaggtgtgggaatccatatggagggagttttccatactatgtggcatgttacaagaggctcggtaatatgtcacgaaacggggagattagaaccatcctgggctgatgtaagaaatgacatgatatcatacggaggaggatggagactaggagataaatgggataaggaagaggatgtacaagtcctggccatcgaaccgggtaaaaaccccaaacatgtacaaaccaaaccaggattatttaaaacactaactggcgagatcggggcagttacattagattttaaaccagggacctctggcagccccatcattaacagaaaaggaaaagtaattgggttatacggaaatggagttgtaaccaagtccggtgattatatatctgccattactcaagcagaaagaataggggaacctgattatgaagttgacgaggatatattcagaaagaaacgattgaccatcatggatttacacccgggagccggtaaaactaaaagaatacttccgagtattgtgcgcgaggctctaaaacgaaggctgcgaactctaattttagcacccactagggttgtagcagcagaaatggaagaagcactacgagggttaccgattagatatcagacgcccgctgtgaaatcagagcacacaggacgagagattgtcgacttaatgtgtcatgccacgtttacaactcgactattatcaagtactagggtaccgaactacaatttgatcgtgatggatgaagcgcatttcaccgacccatcgtcagtagctgccagaggttacatttccacaagagtagaaatgggggaagcggccgctatttttatgactgcaacacctcctggggctacggatccttttcctcaaagtaattcacctatagaagacattgaaagagagattcccgaacgtagctggaatacaggatttgactggataacagattatcaaggtaaaaccgtctggtttgtaccttcaattaaagcggggaatgacattgcgaactgtttaaggaaatcaggtaagaaagttattcagttaagccgcaaaacgtttgatacagagtacccaaaaaccaaactcaccgactgggattttgtagttacaactgacatttctgaaatgggggcaaattttagagccggaagggtaatagacccacgaagatgtctgaaaccagtaatcctgacagacggacctgagagagtgatactagccggaccaattccagtaactccagcttctgcagcgcagagacgaggccgcattggtagaaaccccgcccaggaagacgatcaatacgtatttagcggtgatcctttgaagaatgacgaagaccatgcacattggacagaagcaaaaatgttactagacaacatttacacccccgaggggatcatcccgactttattcggcccagagcgagagaaaactcaagcaatcgacggagaatttaggctccgtggcgaacaacgaaaaacttttgtcgaactcatgcggcggggagatcttcctgtttggctaagttataaggtcgcgtctgctggaataagttacaaggatagagaatggtgtttcaccggagaaagaaataatcaaatacttgaggaaaatatggaagtagaaatatggacaagggaaggagagaagaagaaattaagaccaaaatggttagatgcacgcgtgtatgccgatccaatggcattgaaggactttaaagaatttgcttccggacggaagtcgatcacgctagacattctaactgagattgcttcactaccaacatacctgtcatcaagagccaaacttgcactcgataacatagtaatgctccacaccacggaacgcggagggcgagcctaccaacatgctttaaacgaattgccggaatctctagaaactctaatgctcgtagctctactaggagctatgacagcaggtatctttctgtttttcatgcaaggaaaaggaatcggtaaactttccatggggttaataaccatagctgtagcctcgggacttctatgggttgctgagatacaaccacagtggatagcggcgagcataatactagaatttttcctcatggtcttactaatcccagaaccagagaaacaacgaacaccacaagacaatcaattgatatacgtaattcttactatcctcactattatcgggttaatagctgctaacgaaatgggtctcatagaaaagacaaaaacggatttcggtttctatcaagtgaagacagaaacaacgatactagatgtcgatctaagacctgcttcagcctggacattgtatgcagttgcaacgacaattctaacgccgatgctacgacatactatagaaaacacaagtgcaaatctttcattagcagccattgcaaatcaggcagccgtgctaatgggactgggaaaagggtggccgttacatagaatggacctcggcgttccattattggcaatgggttgttacagccaagtaaatcctactactttaaccgcaagtttagtaatgctattagttcattacgctatcataggaccagggcttcaagctaaggcgacccgcgaagcacaaaagagaactgctgctggcataatgaaaaatcctacagtagatggaataacggtgattgaccttgaaccaatttcctacgatcctaaatttgagaaacagcttggtcaagtcatgctattagttctatgtgccggtcaattgctgttgatgcgcaccacttgggcattttgcgaggttcttacattggcgactggacctatacttacgttatgggaaggtaatcccggtagattttggaatacaacgattgctgtaagcactgctaatatattcaggggtagctatctagctggagcaggattagcttttagtctaattaaaaatgcccaaacacctaggagaggaactgggacagctggcgaaacattaggagaaaaatggaaaaggcaattgaactctttggataggaaagaatttgaagagtataagagatcaggcatacttgaagtagatcgtactgaagcaaaaagcgctcttaaggatggatctaagattaaacatgctgtatcaagaggtagcagtaaaataaggtggatagtcgagagaggaatggtcaaacctaaaggcaaagttgttgatttaggttgcgggcggggagggtggtcctattatatggctaccctaaagaatgttacagaagtcaaagggtatacaaaaggaggaccgggacacgaggaacctattccaatggccacgtatggctggaacttagtaaaacttcatagcggtgtagacgtattttataaaccaacagagcaagtggatacattattatgtgatatcggcgaaagctcctcaaacccgaccatagaagaagggaggacgcttcgcgtgttaaaaatggtagaaccatggcttagttcgaaacccgagttctgtatcaaagtattgaatccgtacatgcctacagtaatagaggaactagagaaattacaaaggaaacatgggggaaatctcgtcagatgcccattatctagaaattcgactcatgaaatgtattgggtatcaggagcatcaggcaatatagtctcatctgtgaatacaaccagtaaaatgcttctaaaccgatttacaacaagacacaggaaaccaacttatgaaaaagacgtcgatttgggagcaggtacgagatcagtcagcactgaaacagaaaaaccggatatgactataataggaagaagactgcaaagattgcaagaagaacataaagagacatggcactatgatcaagagaacccatacagaacctgggcctaccatggtagttacgaggccccttcgacgggttccgcatcatcaatggttaatggagtagtaaaactgttaacgaagccatgggacgtaatacctatggttacacaactagcgatgacagatactactccatttggacagcaaagagtctttaaggaaaaagtagacacgcgaaccccacaaccaaaacctggtacacgaatggttatgacaaccaccgcaaattggctctgggcacttcttggcaaaaagaagaatccacgattatgcacacgcgaagagttcatttcaaaagtccgatcaaacgctgcaatcggagccgtattccaagaggagcaaggatggacatccgcctccgaagcggtaaatgatagcagattctgggagttagttgacaaagaaagggcattgcaccaagaaggaaagtgcgaatcttgtgtatacaatatgatgggcaaaagagagaagaaacttggagagttcggacgagcaaaaggctctcgcgctatctggtacatgtggctaggggcgcggtttttagagttcgaagccctgggcttcttgaatgaagatcactggtttggacgggagaatagttggagtggggtagaaggggagggtttacaccgactaggttatattttagaagaaatagataagaaagacggagacctcatgtatgcagacgacacagcagggtgggacacaagaataaccgaagatgacttgcaaaatgaggaactcatcaccgaacaaatggccccacatcacaagatattagccaaggcaattttcaaactaacttatcaaaataaagttgtcaaagtacttcgaccaacaccgagaggtgcagtaatggacattataagtagaaaagatcaaaggggatctggacaagtaggaacttatgggctgaatacatttactaacatggaagtacagttaattcggcaaatggaagcagaaggtgtaattacccaggatgacatgcagaaccctaaaggactgaaagagagggtagaaaagtggctaagagaatgtggtgtcgacaggctgaagagaatggcaattagcggagatgactgtgtagtcaagccattagatgaacggtttgggacatcactccttttcctaaatgatatggggaaagtgagaaaagatataccacagtgggagccgagcaagggttggaagaactggcaggaagttccattttgctcacaccattttcataaaatatttatgaaagatggaaggagcttggttgtaccgtgtcgcaaccaagacgaattaattggtcgagcaagaatttctcaaggtgcagggtggtcattgagagaaactgcttgtctgggaaaggcatacgcacagatgtggtctcttatgtactttcacagaagagacctaagattggcaagcatggccatttgtagcgcagtaccgacagaatggtttcctacaagccgaaccacttggtcgattcacgcccaccatcaatggatgactacggaagacatgttaaaagtatggaatagagtctggattgaagataaccctaacatgattgataaaacaccagtgcattcctgggaagacattccatatttaggaaagagagaggatctatggtgtggcagtctcatcggattgtcgtctcgggctacatgggctaaaaatattcatactgcaattacacaagttcgcaatttgattggcaaggaagagtatgttgattatatgccagtcatgaagagatacagtgcccccagtgaatcagaaggtgtattgtaa

SEQ ID NO: 23593 - RNA, 9867 nt, synthetic construct
  misc_feature 1..9867: note = derived and/or modified CDS sequence (opt6) from DENV-4__KF041260__SS-prME
  source 1..9867: mol_type = other RNA
tcaactataacacttttgtgccttataccaaccgttatggcttttcatctgagtactcgagatggtgaaccattgatgattgtagcgaaacatgaacgaggaagaccactactatttaaaacgactgaaggtatcaacaaatgtacactaatagccatggaccttggagaaatgtgtgaagacacagtaacatacaaatgtccattgttagtgaatactgaaccggaagatattgattgctggtgcaatttgacttccgcttgggtaatgtatggtacctgtacacaatcaggggaaagacgtagggaaaaacgatcggtagctttgacgcctcattctggaatgggccttgaaacaagagccgaaacgtggatgtcctcagaaggcgcctggaaacacgcccaacgcgtagaatcatggatactaaggaatccaggatttgcccttttagcgggcttcatggcatatatgatcgggcagactggaatccaaaggacagtattcttcattttaatgatgttggtagccccttcatacggtatgcgatgcgtaggggttggtaacagggactttgttgagggagtaagtggaggagcatgggtagacttagttttagagcacggcggttgtgttactactatggcccaagggaaaccgacactcgactttgagttgataaaaaccacagctaaagaagttgctctgctacgaacatattgtatagaagctagtatttctaatataacaaccgcaacgcgatgcccaacacagggagaaccatacctgaaagaagaacaagatcaacaatacatatgtcgaagagatgtagtagatagaggatggggtaatgggtgtggtttattcggaaaaggtggcgtagttacatgtgcaaaattttcatgttcaggaaaaataactggaaatcttatacagatagaaaacttagaatatactgtagtagttaccgtccacaatggcgatacgcacgccgtgggcaacgatacgagtaaccacggcgttacagctacagttacaccaaggtcaccatcagtggaagtcgaattaccagattacggagaactgacactagactgcgaaccaagaagcggaatagatttcaatgaaatgatacttatgaaaatgaataagaagacatggctagtccacaaacagtggtttcttgatctaccactcccatggactgccggagccgatacaagtgaagtacattggaaccataaagagcgaatggtgacattcaaagtgccacatgcaaaaagacaggatgtaactgttctaggaagtcaagaaggtgctatgcatagcgcgctgacaggagcaaccgaagtggactcgggggatggcaaccatatgttcgctggacatttaaagtgcaaagtaagaatggaaaaattacgtataaaggggatgagttatactatgtgcagcggtaagttctccatagataaagaaatggctgaaactcaacacgggacgacggtagtaaaggtaaaatatgaaggagcaggcgctccgtgtaaagttcccatagagattagggacgttaacaaagaaaaagtagtaggtcgtataatcagctcgactccattcgccgaaaacactaatagcgtaacgaatatagaattagaacctccattcggagactcatatatagtcatcggagtaggggacagtgcattaactcttcactggttccgcaaagggtcgtctataggaaaaatgtttgagagtacttatagaggcgccaaaagaatggctatactaggagagacggcatgggacttcggatcggtgggcggattattaacttctttgggcaaggctgttcaccaggtgtttggttcggtgtatacgacgatgttcggaggagtatcctggatggtccgtatactaattggatttctcgtactatggatcgggacaaatagccgtaatacgtcaatggccatgtcctgcatagcggtaggtggaataacgctatttttaggattcactgtacacgcggatatgggttgtgctgtatcatggagcggtaaagaactgaagtgcggcagcggcatcttcataatcgataacgttcatacatggacagagcagtacaagttccaaccagaatctccggccaggttggcgtcagccatcctcaatgcgcataaagatggggtatgcggtattcgttctacgactagacttgaaaacgtaatgtggaagcagattaccaacgaactcaactatgtgttatgggaaggaggacatgatctaactgtagtcgcaggagacgtcaaaggcgttttgtcaaaaggcaaaagagcgcttgcgccacctgtaaacgatcttaaatacagttggaaaacctggggaaaggcaaaaatattcacccccgaaacgagaaactcaacgttcctgatcgacggaccagacacgagtgaatgtcctaacgaaagacgagcgtggaactttctagaagtagaggattatggtttcggtatgtttacaaccaacatttggatgaagtttagggaaggaagtagtgaagtatgtgaccataggttaatgtctgctgcaataaaagaccaaaaggcagtccatgctgacatgggttattggattgaatcaagtaagaaccagacgtggcagatagaaaaagcaagtttaatcgaggtcaagacttgtctgtggcctaagacacatacgctatggtcgaatggagtattagaaagccaaatgctaatccccaaagcctacgccgggccattttcacagcacaactatcgtcagggatacgccacacagaccatgggcccatggcatcttggcaagttagaaatagacttcggagaatgccccggaacaactgtaaccatccaggaggactgcgaccataggggacccagcttaaggacaactaccgcttcaggcaagttagtcactcaatggtgctgtagaagctgcacaatgccaccgctaagatttttaggagaagatgggtgctggtacggaatggaaatacgtccattaagcgaaaaagaagaaaatatggtaaaatctcaagtaagcgcgggtcagggtacctcagagacattctccatgggcttattatgcctcacactcttcgttgaggagtgcctaagacgcagagtaacacgaaaacatatgatcctagtggtagtcacaaccctatgtgccataatattaggaggtttaacctggatggatctgcttagggctctaataatgttagggaatacgatgtcaagtcgtatgggcggacaaacgcatttagctatcatggcagtatttaaaatgtcgccaggatacgtactgggcatattcctgagaaaattaacttcaagagaaacagctttaatggtcataggaatggctatgacaacagtgttgtccattccgcatgatctcatggaatttattgatggaatttcattaggactaattctgctaaaaatggtcacgcacttcgataacacacaagtagggactttagccttatcactcacatttatcaaatcaacaatgccgctagtaatggcatggcggacaataatggctgtactatttgttgtcacattgataccattatgtaggacatcatgcttacaaaaacagagtcattgggtagaaatcacagcgttaatacttggtgctcaagcactacctgtttatcttatgacactaatgaagggagcttcaaagcgctcatggcctctgaatgagggaataatggcagtaggactcgtatcattattgggttccgcacttctcaaaaatgacgtgcccttggctggacctatggtagctggaggtttgttgctcgctgcatatgtaatgtcgggctcgtcagctgacttaagcctagaaaaagcggctacagttcaatgggacgaaatggcagatatcacgggaagctctccaatcatagaagttaaacaagatgaagatggatcattttcgataagagacgtagaagaaactaatatgataacattattggtaaaattggcattaataacagtaagtgggctgtatccccttgcaataccagtcactatgacgctgtggtatatgtggcaagtaaagactcaacggtctggtgccctatgggatgtaccaagtccggcggcaacacaaaaagccacactcacggaaggagtatacagaataatgcagaggggcttattcgggaaaacgcaagttggagttggaatacatatggaaggagtatttcatactatgtggcatgttacacggggatcggtcatttgtcacgaaagtggacgacttgagccctcatgggcagatgtgaaaaatgatatgataagttatggtgggggatggcgacttggggataaatgggacaaagaagaagacgtccaagtattagcagttgagccaggtaaaaacccgaaacacgttcaaacgaaacctggcttatttaaaacgttgactggcgaaataggggcggttacactagatttcaagccagggacttccggttctccaattattaaccgtaaaggaaaggtcattgggctctatggtaatggggtagtgacaaaatcgggtgactacgtgtcagcaatcactcaagcagaaaggatcggggaaccggattatgaggtagatgaagacatttttaggaagaaacgattgactattatggatcttcatccgggagcaggtaaaacaaaacgaatattgccttcaattgtacgtgaggctttaaaaaggcgtctacgtactctgattctagcccctactagagttgtagcggcagagatggaagaggctttgcgcggcttacccataagatatcaaacacccgcagttaaaacagagcatacaggacgagaaatagtcgatttaatgtgtcatgcaacattcacgacacgcttactatcgtctacaagggtcccgaactataacctaatagttatggatgaagcgcactttacggatccatctagcgttgccgcaagaggttacatatcaacgagggtcgaaatgggtgaggcggcagctatatttatgacagcgactcctccaggaacaacggatccattcccccagtcgaatagccccatcgaagatatagaacgggagattccggaaaggtcatggaacacgggattcgactggataacagattatcagggcaagacagtgtggtttgtgccaagtataaaagctggaaacgacatcgcaaactgtttacgtaagtctggcaagaaagttgtccaactctcgagaaaaacctttgacactgaatatccaaaaactaaactaactgactgggactttgtagtgactacggatattagcgaaatgggagctaatttcagagctgggagggtcattgacccacgtaggtgtctaaaacccgtaattatcacagatggtcccgaacgggtaatacttgcaggtcctattccggttacaccagctagcgcagcacaacgacgaggtagaatcgggaggaatcccgcccaggaagatgatcagtatgtattctctggagaccctttgagaaatgacgaagatcacgcacattggacagaagctaaaatgcttctggataacatacataccccagaaggaatcattcctacactttttggaccagaaagagaaaagacacaggcgatagacggagaatttagacttagaggtgaacagaggaaaacgttcgtagagctaatgagacgaggagacttaccagtctggttatcttacaaagtagcgtcagcgggcatatcctacaaagatcgtgaatggtgttttactggcgaaaggaacaaccagattttagaagagaatatggaagttgaaatatggacaagagaaggagagaagaagaaacttagacctaaatggcttgatgccagagtatatgctgacccagttgcgctaaaagattttaaagaatttgcatccggaaggaagagtattaccctcgacatactaaccgaaatagcctcattaccaacatacttatcttcacgtgcaaagttagctctggataacatagtcatgttacacaccaccgaaagagggggaaaagcgtaccaacacgcgttgaacgaattacctgaaagtttagaaacattaatgctcgtcgcccttctaggtgctatgacagcaggtatctttttattcttcatgcaaggcaagggtatgggaaaattgtccatgggtctgatagctatagcggtggcctctggtctgctgtgggtcgcggaaattcaaccacaatggatagcagcatcaataatattagagtttttcctaatggcactgctaataccagaaccagagaaacagcggacaccacaggataatcaattaatttacgtaatcttgacaatactgactatcatcggacttgtcgctgcaaatgagatgggcttaatagagaaaactaagacggactttgggttttaccaggtaaaaacagaaacaaccattttagatgtagacctccggcctgcatctgcatggacattatatgcagtcgcaactacgattcttacaccaatgctgagacacacaatcgaaaacacctcagctaatttatcattagcagccatagcaaatcaagctgcagttctaatgggtctagggaaaggttggccattacaccgtatggacctaggtgtcccgctacttgcaatggggtgctactctcaagtaaatccaaccaccttaacggcgtctctcgtaatgttattggtacattatgcgataattggaccaggtctacaggccaaggcaacaagggaagcgcagaaaaggacagcagcagggataatgaaaaacccaactgttgacggtatcactgtaatagatttagaacctataagttacgatccgaagtttgaaaagcaattaggtcaggtaatgctattagtactttgcgccgggcaacttcttctaatgagaacaacatgggctttctgcgaagtcctcactttagcaacaggaccaattttgactttatgggaaggtaaccctggaagattttggaataccacgatagctgtctcaactgcgaatatattccgaggaagttatctggccggagcagggttagcgtttagtttgatcaaaaatacacaaacgcctagaaggggtaccggtacaacaggagaaacattgggagaaaaatggaaaagacaattaaatagtttagataggaaggagttcgaagaatataaaagaagtggtattcttgaagtagaccgaacagaagctaaatctgctctcaaagacggaagtaaaataaaatatgctgttagcagaggaacaagcaaaataaggtggatagtcgaaagaggaatggttaagccaaaaggaaaggtcgttgacctagggtgcggacgaggaggatggtcatattacatggccacactaaagaatgtcacggaggtcaaaggatatacaaagggaggaccagggcatgaagaaccgatcccaatggccacatatggatggaatttagtcaaattgcacagcggagtggatgtattctataaaccaacagaacaagtagatacattactgtgcgacattggtgagagttctagtaaccccactatagaagaagggagaaccttacgcgtactaaaaatggtggagccctggttatcttctaaaccagaattttgcataaaggtactaaatccttatatgcctacggtaatagaagaacttgaaaaattacaaagaaaacatggagggagtttggtacgatgcccattaagcaggaatagtacccatgaaatgtattgggtgagtggagtatcgggaaatattgtttcgtctgtgaatacaacgtccaagatgctactaaacaggtttacaacaagatacagaaaaccaacttacgaaaaagatgcagaccttggtgcgggtactagatcagttagtaccgaaacagaaaaaccagatatggcaatcatcggtagaagattacaacgtctccaagaagaacataaagaaacatggcactatgaccaagaaaatccataccgcacatgggcctatcatggtagctatgaagctccatcaactggaagtgcctcgtcaatggtaaatggggtagtgaaactcttaactaaaccgtgggacgtcataccgatggtaacccagctagcaatgaccgatactacccctttcggccaacaaagagtatttaaagagaaagttgatacaagaacacctcaacccaaacctggtactcgaatgataatgacaacaacagcaaattggttgtgggctttacttggaaagaagaagaatcctcgcctatgtacaagggaagaatttatatctaaagttagatcaaatgcagcaatcggagcagtatttcaggaggaacagggttggacaagtgcgtccgaggcggtaaatgactcaagattctgggagttagttgataaagaaagggcgttacatcaagaaggtaagtgcgaatcatgtgtatataacatgatggggaaacgtgagaagaaattgggggagtttggaagggcaaaaggttctcgtgcgatttggtatatgtggttaggagcaaggttcctcgagtttgaagcactaggtttcttaaacgaagaccattggttcggaagagaaaatagttggagcggcgttgaaggtgagggcttacatcgattgggatatatacttgaagatatagacaagaaagacggtgatttaatatatgccgacgacacggctgggtgggacacaagaatcacggaagatgacctgttaaacgaagaactaataacagagcagatggcaccacatcacaaaattctggcgaaagcaatttttaaacttacgtatcaaaacaaagtagttaaagttctcaggccaacaccgaaaggagcggtaatggacataatttcaagaaaagaccagcgtggaagcgggcaggtaggaacgtatggcctcaatacattcacgaatatggaggttcaattgatacgtcaaatggaagctgaaggcgtcattactcgagatgacatgcataaccccaaggggctaaaagagcgcgtagaaaaatggttaaaggaatgcggagtcgaccgtctgaagcgtatggcaatatctggagatgactgtgtagtaaaacctttagatgaacgatttagcacctcactactctttttaaatgatatgggaaaggttagaaaagacatcccccaatgggagccatcaaaaggatggaagaattggcaagaagttccattctgttcacaccacttccataaaatattcatgaaagatggccgaagtcttgtagttccttgcaggaatcaagatgaattgattggcagagcgagaatatcgcaaggagctggatggtcgttacgagaaacagcgtgcctaggaaaagcgtacgcccagatgtggagtctgatgtatttccatcgacgcgatttacgcctagctagcatggcaatttgttccgcagtccctaccgaatggtttccaacaagtagaactacctggtcaatacacgctcatcatcagtggatgacaaccgaggatatgctcaaggtgtggaatcgagtatggattgaggataatcctaacatgacagacaaaactcccgttcattcgtgggaagacattccataccttgggaaacgcgaagatttatggtgtggctccctgataggattaagcagtagagccacatgggccaaaaatatccacacggcaattacgcaggtacgaaatttaattggcaaagaagagtatgtggactacatgccggtaatgaagcgctattctgcaccattcgaaagtgaaggtgttctgtag

SEQ ID NO: 23594 - RNA, 9867 nt, synthetic construct
  misc_feature 1..9867: note = derived and/or modified CDS sequence (opt6) from DENV-4__FJ024476__SS-prME
  source 1..9867: mol_type = other RNA
agtacgataacattactgtgtctgataccaaccgttatggctttccatctaagcactcgagacggagaacctttaatgatagtcgctaaacatgaaagaggtcgtcccttactattcaaaaccacagaagggatcaataaatgtacgcttatagcaatggatctgggagaaatgtgtgaagacacagtaacgtacaaatgtcccctattagttaatacagaacccgaagatatagactgctggtgtaatcttaccgcaacatgggtgatgtacggaacttgcacacaatctggagaacgtcgacgagagaaacggtctgtggccttaacaccgcattctggcatgggactagaaacacgcgcggaaacttggatgtcatcagaaggtgcatggaaacatgctcaaagagttgaatcttggatattaaggaatccgggatttgctttgctggccggttttatggcatatatgatcgggcaaactgggatacaaagaaccgtgttctttgttctgatgatgttagtcgccccatcatatggtatgcgatgcgttggagttggaaacagagattttgttgaaggagtgtccgggggcgcatgggtcgatttagtattagaacatgggggatgtgtcacaactatggcacaaggaaaacctacattagatttcgaattgacaaaaacaacagcgaaagaagttgctttactacggacatattgtatcgaagcgtctatcagcaatattactactgctaccaggtgccctacacaaggagaaccttatcttaaagaagaacaagatcaacaatacatctgtaggagagatgttgtcgatcgcggctgggggaacgggtgcggacttttcggaaaaggcggagtggttacttgcgcaaaatttagctgtagcggcaaaataactggtaatttggtccaaattgaaaatctagaatatacagtggtagtaactgtccataatggagacacacatgcagtgggaaatgacacctcaaaccatggcgtaactgccatgataacgccccgctctccctctgtggaagtaaaactgccagattatggagaattgacattggattgtgaacccagatcggggatagactttaatgaaatgatattaatgaaaatgaagaagaaaacatggcttgtacacaaacagtggtttctagacctaccacttccatggactgcaggggccgatacatccgaagttcattggaattacaaagaacggatggtcacatttaaagtaccccacgctaaacgccaagatgttacagtactcggatcgcaagaaggagctatgcattcggccctggctggagctaccgaagtcgattctggagacggcaaccacatgttcgcgggacacttaaaatgtaaagtacgtatggaaaaacttaggatcaaaggaatgagctacacgatgtgcagcggaaaatttagcatagataaagaaatggctgaaacccaacacgggactactgttgtcaaagttaaatacgaaggtgcgggagccccgtgtaaagtaccgatagaaataagagacgtaaacaaagaaaaagtcgttggtagaataataagctctacaccactagcagaaaatacaaattcagtgactaatattgaactggaaccgccatttggagattcctatatagtgataggagttgggaactctgctctaactctacactggttccgtaaaggtagtagcatcggaaaaatgtttgaaagcacttatagaggggcaaaacgaatggctatcctaggtgaaaccgcctgggatttcgggtcagtaggagggttatttacaagtttaggcaaagcggtacaccaagtgtttggctcagtgtatacaacaatgtttggtggagtatcatggatgatcagaatactaattggtctattagtgctatggatagggactaatagtcgtaatacgtcaatggctatgacatgtatagcagtcggaggtattaccctgttccttggattcaccgttcaggcagacatgggctgtgtagtatcttggagtggtaaagaattgaaatgtgggtcaggaatatttgtagtagacaatgtgcacacatggacagagcaatacaaattccagcccgagagccccgcaaggttggcgagcgcaatattaaatgctcataaagacggcgtatgtggaatccgatctacaacgaggttagagaacgtgatgtggaaacagataacaaacgaactaaattacgtcctatgggaaggagggcacgacctcactgtagttgcaggcgacgtaaaaggagttctaactaaaggaaaacgggcacttactccacccgtctctgacctaaagtatagttggaaaacatggggtaaagccagaatctttacgccagaggcacgcaacagcacatttctcattgatggtccagatacctcagaatgtcctaatgaaaggagagcgtggaactcgctagaagtggaagattatgggttcggaatgtttacaacgaacatatggatgaaattccgagaaggaagctcggaggtatgtgatcataggctaatgagtgcggcgataaaagaccaaaaagctgtccacgcagatatgggctattggatagaatctagcaaaaatcaaacgtggcaaatagaaagggcatccttaatagaggtcaaaacatgtctctggccaaaaacacacactttatggtcgaatggggttcttgaaagccaaatgcttattccaaaatcttatgcagggcccttttcacagcataattaccgacaaggttacgcaacacagactatgggaccatggcatctaggtaaattagaaataggattcggggaatgccccggaacaacggttacaatacaagaagattgtgaccatagaggcccatcattgcgcaccaccacagcatctggcaagctagtcacccaatggtgttgtcgaagctgtactatgccaccgctacgcttcctaggggaagacggttgttggtatggaatggaaatcagaccactatctgagcgcgaggaaaacatggtgaaaagtcaagtaacagctggtcaaggaacatcagaaacatttagtatggggctactttgtttgacgctatttgtggaggaatgcttgagaagacgagttacaagaaaacatatgatattagttgtagttataactctatgtgcaataatattaggcggccttacttggatggacctattaagagcactgataatgttaggagatacaatgagcggaaggatcggaggtcaaatacacttggcgattatggcagttttcaaaatgtcgccaggttacgtgctcggtgtttttctaagaaagttaacctcacgtgaaacggccctaatggttataggaatggcgatgacaaccgttctttcaattccgcacgaccttatggaattaattgacggtatcagcttaggtttgatacttctaaaaattgtaacacaatttgacaatacacaagtagggactctggccctatctttaacctttatccggtcaactatgccactggtcatggcgtggaggaccataatggccgtactatttgtagtaacattaataccgttgtgtagaacctcatgtctccaaaagcaaagtcattgggtcgagataaccgcattaattctaggagcacaagccttaccagtctatcttatgacactgatgaaaggcgctagtcgtagatcttggccactaaatgagggaattatggctgtaggtctcgtcagcctgctaggatccgccttactgaaaaacgatgtaccactagctggacccatggtagctggtggattattacttgcagcatatgtcatgagtggttccagcgcagatctatctcttgagaaagcagccaatgtacaatgggacgaaatggccgacattactggatcctcacctatcatcgaagtgaaacaagacgaggatgggagcttttcgatacgggacgttgaagagacaaacatgattacgttactcgtaaaactagccttaataacagttagcggcctataccccttggctattcccgttacgatgactttgtggtatatgtggcaagtaaaaacgcaaagatctggggcattgtgggatgtaccgagtcctgcagctacacaaaaggctgcactaagtgagggagtctaccgaatcatgcagagaggactattcgggaaaacacaggtgggtgtaggtatacacatggagggtgtttttcacactatgtggcatgtcacaagaggatcagttatctgccacgagacgggccgcctggaaccctcctgggcagacgtaaggaacgatatgataagctacggtggcggttggcgattaggtgataaatgggacaaagaagaagatgtacaagttcttgcaattgagcctggcaaaaatccgaagcacgtgcagacaaaacctggcttatttaaaacattaactggcgaaattggggctgtaacattagactttaaacccggtactagcggaagtccgataattaatagaaaaggtaaggtaataggtctgtacggcaatggagttgttaccaaatccggtgattatgtaagtgcaatcactcaagctgaaagaattggagaaccagactacgaagtagacgaagatatttttaggaagaaaagattgaccattatggacctacatccgggtgccggaaaaacaaaacgtatactaccgtctatagtaagggaggctttaaaaagaaggttacgaacacttattctagcgcccactagagttgtcgcagcagaaatggaagaagcactgagaggtctgcccattcgctatcaaacaccagcagtaaaatcagaacatacgggacgagaaattgtggacttaatgtgtcacgcaactttcactacacgcctactatcttcaacaagggtcccaaattacaacctaatagtaatggacgaggcccatttcaccgacccatccagtgttgcggcaaggggatatatctcgaccagagttgaaatgggcgaggctgctgcgatatttatgacagcaacacccccaggagcgactgacccctttccacaatcaaacagcccaatagaagatatagaacgagaaatccccgagaggagttggaacactggttttgactggataacagattatcaagggaaaacggtatggtttgtaccatcaataaaagccggaaacgatatcgcaaactgtcttagaaaatctggaaagaaagtcgttcaattatcaaggaaaacgtttgatacagaataccctaaaacaaaactgacagattgggattttgtcgtgaccacagatatttctgaaatgggggccaactttagggcagggcgcgtaatagatcctagacgctgcctaaaaccggtaattctgactgacggcccggaacgagtaatactcgctggtccaatcccagtaactcctgcaagcgctgcgcaacgtcgaggcagaataggtcgtaatccagctcaagaagatgaccaatacgtgttcagtggagacccacttaagaatgatgaagaccacgctcattggacagaagctaaaatgttattagataacatttacacccctgaagggataatacccacgttattcggaccagagcgagagaaaacccaagcaattgatggggaatttcggcttcggggagaacaaagaaaaacatttgtcgaattgatgagaagaggagatttgccggtttggttatcatataaggtagcatcggcgggaattagttataaagaccgtgaatggtgtttcaccggagaaagaaacaatcaaatattggaagaaaacatggaagtggagatttggacgcgagaaggtgagaagaagaaattaagaccaagatggcttgatgcccgggtctatgcagatccgatggctttaaaagattttaaagaatttgccagcggacgaaaatctattacattagacattttaaccgaaatagcttcacttcccacgtatctaagttcacgagcaaagttagcgcttgacaacatagtcatgctacacacaaccgaaagaggtggacgggcataccaacacgcactaaatgagttaccggaatcgctggagaccctaatgttggtggccctcctgggagctatgacagcgggaatctttttgttcttcatgcaaggaaaaggtataggtaaattatccatgggcttgattactatagcagtagcatctggactgctctgggtagcggaaatacaaccacaatggatagccgcgtcaattattttagagttctttttgatggtactgttgataccagaacccgaaaaacaaaggacaccacaagataatcaactaatatatgtcatacttacaattctaacgatcatcggattaatagccgccaacgaaatgggactcatagagaaaactaaaactgacttcggattctatcaggtgaaaactgaaaccacaatattagatgtggatttacgacctgctagtgcctggacactttacgcagttgcgaccaccatactcacacctatgttaagacacaccattgagaatacaagtgcaaatctgtcattggctgcgatagcaaaccaagcggccgtactaatgggtctcggtaaaggctggccgctgcacaggatggacctcggggtgcctcttcttgcgatggggtgctactcacaggtaaatccaacaacccttacagcctctctggttatgcttctagtgcactacgcgatcataggcccaggactacaagccaaggcaactcgagaagcacaaaaacgtacagcagcaggaataatgaaaaatccaacagtagacggaataactgtcattgatctggaacccatctcttacgatccaaaattcgaaaagcaactcggtcaggttatgctattagtcctttgcgcaggtcaattacttctaatgcgaacaacttgggcattctgcgaagttctaacattggcaaccggtccaatactaacgctatgggaaggcaatcccgggcgtttttggaatacaactatagctgtgagtactgcaaacatattcagaggatcatacctagcaggggcgggattagcttttagtctaatcaaaaacgcgcaaacacctaggagaggtacaggtacaacaggcgagaccttaggagagaagtggaaaaggcaattaaacagtctagatagaaaagaatttgaagaatataaaagaagtggaatattggaggtagacagaacagaagcaaagtctgccttaaaagatggcagtaagataaaacacgccgtctcaagaggtagttctaaaattcgctggattgtagaaaggggtatggtaaaaccgaaagggaaagtagtggacctcggttgtggccgaggaggatggagttactatatggctacgctaaagaacgtaacagaggttaaaggttatacaaaaggtggtccggggcacgaggaaccgattccaatggcaacatatggttggaatttagtcaaactccatagtggagtagacgtattctataaaccgaccgagcaagtagatacactgctttgtgacataggagaatcctccagtaaccccaccatagaagagggaagaacgttaagagtgctcaaaatggtagagccttggttaagctcaaaaccggaattttgcattaaagtcctaaatccttatatgccaacggtgattgaggaactggaaaaacttcaaagaaaacacggtgggaatctagtacgttgtcctttgtcaagaaattcgactcacgaaatgtattgggtatccggtgcgtcgggcaacatagtgtcatcggtaaatactacctccaagatgctacttaacagatttactacccgccatcgcaaaccaacttatgagaaagatgtcgacctgggcgccggaacaaggtcagtttcaactgaaacggagaaaccagacatgactatcataggaagacgactccagcgtttacaggaagaacataaagaaacgtggcattacgatcaggaaaatccatatagaacatgggcataccatggaagctatgaagcaccctcaactggatcagcgagtagtatggtcaacggggtagtaaaactattaacgaaaccttgggatgtaattccgatggtgacacaactagcaatgaccgatactacaccgtttggacagcaacgggtcttcaaagagaaagtcgatactagaacaccccaaccgaaacctgggacaaggatggttatgactactactgctaattggctttgggcactattaggcaagaagaaaaatcctcgactatgtacgagagaggagttcataagtaaagtgcgatccaatgcagctataggagcagttttccaagaagaacagggatggacaagcgcttccgaagcagtcaacgactcacggttctgggaattagtagacaaagaaagagccttgcatcaagaaggaaaatgtgaatcctgcgtatataatatgatgggaaaacgagagaagaaactcggtgaatttggtcgtgcaaagggatcgcgcgcaatttggtacatgtggctaggagcaaggtttttagagttcgaggctttaggatttttaaacgaagatcattggttcggccgagaaaatagttggagcggcgttgaaggagaaggattacatagattaggttatatcttagaggagattgataagaaagatggagacctaatgtatgccgatgacacggctggatgggatacgagaatcactgaggatgatctacaaaacgaagaacttattactgagcaaatggcaccgcatcataagatactggcaaaggcaatcttcaaattaacatatcagaacaaagtcgtaaaggtactaagaccaacacccagaggtgcggtcatggatataatttcacgtaaagatcaacgaggatcaggtcaagttgggacttacggattgaacaccttcacaaacatggaagtgcaattgattagacaaatggaagcggaaggtgtaattacgcaggacgatatgcagaatcccaagggcctgagagaacgcgtagaaaaatggttgaaagaatgtggagttgacagattaaaacgtatggcaatttcaggtgatgattgtgtggtcaagccactagacgaaagattcggaacatcattattgttcttaaacgatatgggaaaagtgcgtaaggatataccacaatgggagccatcaaaaggatggaagaactggcaagaagtgccattctgctcacatcattttcataaaatatttatgaaggatgggcgatcattagtagtgccatgtaggaaccaagatgaattgatagggcgtgcacgtatatcacaaggagcaggttggtctctgagagaaacagcttgcctgggcaaagcctacgcgcaaatgtggtctctaatgtactttcacagaagagacctacgacttgcgtcaatggcaatttgttccgccgtgccaacggagtggtttccaacgagccgaacgacatggagtatacatgcccaccatcaatggatgacaaccgaagatatgttaaaagtttggaacagagtttggattgaggataatccaaacatgacagacaaaactccagtccattcctgggaggatattccatatttagggaaaagagaagacctctggtgcggcagtttaataggactatcaagccgtgcaacatgggccaaaaacattcatacagcaattacacaagtaaggaacctaataggcaaagaagaatatgtggactacatgccagtgatgaagcgctattccgctccatcagagtctgaaggagttctatag

SEQ ID NO: 23595 - RNA, 9867 nt, synthetic construct
  misc_feature 1..9867: note = derived and/or modified CDS sequence (opt6) from DENV-4__GQ868579__SS-prME
  source 1..9867: mol_type = other RNA
agcacgataactctgttatgtctgattcccacgatcatggcatttcatttatccacgcgagatggggaaccactcatgattgtggcaaaacatgaaagaggacgccctcttctctttaaaaccaccgaaggtatcaataaatgcactctaattgccatggatttaggagaaatgtgtgaagacacagtaacatacaaatgtcctctactaattaatacagaaccggaagatattgattgttggtgtaatctgactagcacatgggtcatgtatggaacttgtacgcagtcaggagaaagaagaagagagaaaagaagcgtagcgttaacaccacatagtggtatgggactggaaactagggctgaaacgtggatgtcctcggaaggagcctggaagcatgcccaaagagtcgaatcctggattttacgcaatcccggattcgccttattagcgggattcatggcctacatgatcggtcagacaggcattcaaagaaccgtattctttatactaatgatgcttgtagcacccagttacggaatgagatgtgtaggagtgggaaaccgggactttgtcgaaggagtctctggaggagcatgggtagatttagtactggaacatggcggatgtgtgaccacgatggctcaaggtaagccgacactggactttgaattgacaaaaaccaccgcaaaagaagttgcgcttttacggacgtattgcattgaagcacttataagtaacataaccacagcaactagatgtcctacccaaggtgaaccatatttgaaagaagaacaagatcagcaatatatatgtagaagagacgtcgtagataggggctggggaaatggatgcggcttattcggaaaaggaggggttgtcacatgcgcgaaattctcttgttctggcaaaatcactggtaatctggttcaaatagaaaatctggagtatacagttgtagttactgtacataacggagatacacatgcagtgggcaatgacaccagcaatcacggggtaactgcaaccattacacccagatcaccatcagtagaagtcaaattgccagattacggagagttaacattagactgtgagcctcggtcaggcatcgacttcaatgaaatgatattgatgaaaatgaagaagaaaacttggcttgtccataaacaatggtttctggacctaccgttaccctggacagcaggagctgatacctcggaagtacattggaattacaaggaacggatggtaacatttaaagtcccccatgcaaaacgacaagacgtcacggtccttggaagccaggaaggagcgatgcactccgcactggctggcgcgacagaagtagatagcggtgacggtaatcacatgtttgcaggacatctaaaatgcaaagtgagaatggaaaaactgagaatcaaaggtatgagttatactatgtgttcaggaaagtttagcatcgataaggagatggctgagacacaacacgggacaaccgttgtaaaagttaaatatgaaggtgccggcgcaccatgtaaggtaccaatagaaattcgagacgttaataaggaaaaagttgtaggacgagttatatcatctacgccgttagctgagaacaccaattctgtaacaaatatcgaattagagcctcctttcggtgattcatatatagttattggagtaggcaactctgccttaacacttcattggtttagaaaaggctccagcatagggaaaatgtttgaatccacgtaccgaggggctaaaagaatggcaatcttgggagaaacagcgtgggatttcgggagcgttggaggactttttaccagtcttggaaaagcagttcatcaagtttttgggagtgtgtacacaactatgttcggtggtgtcagctggatgatcaggatactgatcggattcttagttctatggattggaaccaactcaaggaatacatctatggccatgacatgcattgccgtaggaggtataacattatttttgggattcacggtaagagcagatatgggctgcgtggtcagttggagtggcagagagttaaaatgtgggagtggaatttttgtcgtagataatgtccatacctggaccgaacaatataaatttcagccggaaagccctgctcgattagcatctgcgattttaaacgcgcataaagatggtgtctgtggcatcagatctactacacgactcgaaaatgtaatgtggaagcaaatcacaaatgagttgaattacgtgctatgggaaggaggtcacgacctaaccgtagttgctggggatgtaaaaggagtacttactaaaggcaaaagagcgttaactccaccggtttctgaccttaagtattcatggaaaacttggggtaaagccaaaatattcacaccagaagctagaaactctaccttccttattgatggcccggatacatctgaatgtccaaacgaacgcagggcctggaacagcctagaggtagaagactatggtttcggaatgttcacgacgaacatctggatgaaattccgtgaagggagttcagaagtatgcgaccatcgacttatgtcagccgcgatcaaagatcagaaagctgtacacgcagatatgggctactggattgaatctagtaaaaatcaaacctggcaaattgagagagcaagtttaatagaagtcaaaacatgcttatggccaaaaacgcacacactgtggagtaatggagtactagaatcacaaatgctgataccaaaatcttatgcgggaccgttcagtcagcacaattatagacaaggatacgcgactcagacggtagggccttggcatttaggtaaactggagatagacttcggagagtgccctggcacgactgttacgatccaagaggattgcgatcatcgtggtccaagtctaagaactactacagccagtggaaaactcgtaacacaatggtgttgtagaagttgcacaatgccacctcttcggttcttaggtgaagacggttgttggtatggtatggaaattagaccattatctgaaaaagaagagaatatggtaaaatcgcaagtaactgcaggtcaaagcacatcggagaccttctctatgggacttttatgcctaactctcttcgtggaagaatgtttaagacggcgtgtaacccgtaaacacatgattttagcagtcgtaatcacactttgcgctattattttaggtggcttaacatggatggatttacttcgagcattgataatgctcggcgacacaatgtcgggacgaatcggagggcaaacacacctagcgattatggcagtcttcaagatgagtccaggatatgtcttaggtgtgtttcttcgaaaacttacgagcagggaaaccgctttaatggtaataggaatggccatgactactacattgagtattccccacgatctaatggaattaatagatgggataagtctaggactcatactgttaaagatcgtcacacaatttgacaatacacaagttggtacactcgcgttgtctcttacatttattagatccactatgagcctagtaatggcatggcgaactatcatggcggtactatttgtagtaacattaatccctttgtgccggactagctgcttacaaaaacaatcacactgggtagagataacagcactcattttgggtgcacaggcgctcccagtgtatctgatgacccttatgaaaggagctagtaggcgaagttggcccctgaatgaaggaataatggcagtaggattagtgtcattattaggcagtgcgttattaaagaacgacgtgccactagcaggtcctatggtagctggtggacttttgctggcagcatatgttatgtcgggcagttccgcagatctatcactagaaaaagcagcgaacgtgcaatgggatgaaatggcagatattactggttcatctccaataatcgaagtaaaacaagacgaagatggctcgttttcaataagagacgtcgaggagacaaatatgattactctattagttaaactcgctttaataacagtatcagggctctaccccttagcaataccagttacaatgacactatggtatatgtggcaagtcaaaacacaaagaagcggtgctttgtgggatgtcccctctcccgcagcgacccagaaagcggcactaagtgagggtgtctaccgaatcatgcaaagggggttatttggcaaaactcaggtaggagtgggaatacatatggaaggggtttttcataccatgtggcatgtaactagaggaagtgtaatatgtcatgaaactggaagattagaacctagctgggccgatgtaagaaatgatatgatatcatatggaggaggatggcgactaggggataaatgggacagagaagaagatgtccaagtgttagctattgaaccgggcaaaaacccaaaacatgttcagacaaaaccaggtctctttaaaacattaactggggaaataggggccgtcactttagacttcaagccgggaacatcaggttcccctattataaataagaaaggcaaagttatagggctatatggcaacggcgtagtaaccaaaagtggagattatgtatcagcaattactcaagcagagcggattggagaaccagattatgaagtggacgaagacatattccgtaaaaagcgactaacgatcatggatcttcaccccggtgcaggtaaaacaaaaaggatacttccttcaatcgtgcgagaagcactaaaaagacgactgagaacacttatcttagcacccaccagagttgtagcagcggagatggaagaagcactgcgaggtcttccaatacgttatcaaacaccggctgtaaagtcagagcacacaggccgcgagattgtggacttaatgtgtcatgcgactttcacaaccagactcttgtcttcaacgagagtcccgaactataatctaattgtaatggatgaagcacactttacagatccatcctccgttgcagcacgcgggtacatatcaacccgtgtagaaatgggggaagctgcagcgatattcatgaccgcgacgcctcccggagcgactgatcccttcccacaaagtaacagcccaattgaggacatcgagcgtgaaattccagaaagatcctggaatacaggatttgactggattactgattatcagggaaaaacagtatggttcgtcccatcaataaaggcaggaaatgacatcgcgaattgtcttcgtaaatccggtaagaaagtaatacaattgtcaagaaaaacatttgataccgaatatcctaaaacaaaactaactgattgggattttgttgttacgaccgacatttctgaaatgggcgctaactttcgagcagggcgtgtcattgatcctcgacgatgcttgaagcccgtaatcttgacagacggaccggagcgagtgatactagcaggcccgataccagttacaccagctagtgcagctcaaagaaggggaagaataggcagaaaccctgcccaagaagacgaccagtacgtattttctggtgatcccctcaaaaatgatgaagatcatgcacactggacggaagcaaaaatgctcctggacaacatatacacacctgaagggattatccccacattgtttggacctgaaagggagaaaacgcaagcaatagatggcgagtttcgcctgcgaggagagcaacgaaagacttttgtcgaactcatgaggaggggagatcttccagtttggctatcatacaaagtcgcttcagcggggataagttataaagaccgcgaatggtgcttcacgggcgagagaaataatcagatactagaagaaaacatggaagtagaaatttggacccgggaaggagagaagaagaaattgagaccacgatggcttgatgcacgagtctacgcagaccccatggccttgaaagactttaaagaatttgcatctggaagaaaaagtataacattagatattttgactgaaatagcatcacttccgacatacctaagcagcagagccaaattagcgcttgataacatcgtcatgttacatactacagaaagagggggtcgagcataccaacatgcattaaacgagctcccagagagccttgaaacgttgatgttagtcgcattactaggtgccatgactgcaggaacgtttctgttctttatgcaagggaaagggataggaaagctatctatgggactaattacaatagccatggccagcgggttactatggattgcggaaatacaaccacaatggatagcagcttctatcatactcgagttctttcttatggtccttctaattccagaacccgagaaacaacgcacgccgcaagacaatcaactaatttacgttattctcacaattctagcaattatcggtttaatcgcagcgaatgaaatggggctaatagagaaaaccaaaactgatttcggattctaccaagttaagacagaaacaaccattctggatgtcgatctgcgccccgctagtgcctggacactctatgccgtagccaccacaatattaacgccgatgttaaggcacactattgaaaatacaagtgccaacttaagtttggccgcaattgcaaatcaggcagcggtcttaatgggtctgggtaaagggtggcctcttcataggatggatttgggagtcccattattagccatgggctgttatagccaggtaaatccaacgacattaactgcatccctagtgatgctattagtacactatgcaataataggtccaggactacaagctaaggcaacacgcgaagcgcagaaacgaacagctgccggaatcatgaaaaatcctaccgttgatggtatcacagtcattgacttagaaccaatatcatatgatccaaagttcgagaagcagcttgggcaagtaatgttattagttttgtgtgctggccaattactcctaatgcgaacaacatgggcgttctgtgaagtgttaactctagccacaggacctatccttacattatgggaaggtaatccgggaagattctggaacaccaccattgctgtaagcaccgccaacatatttagaggttcctatctagccggtgcaggtctcgcatttagcctaatcaaaaatgctcaagccccaagaagaggcacaggtacaaccggcgaaacactcggcgaaaaatggaaaagacaactgaatagtttagatcgaaaagagttcgaagaatataaacgatcagggatattagaagtcgatcgcactgaagcaaaaagtgctttgaaagacggaagtaaaataaagcatgcggtatcaagaggatccagcaaaattagatggatagttgagaggggtatggtgaaaccaaaaggaaaagtagtagatttgggatgtggacgcgggggctggtcgtactacatggctacattgaaaaatgtcacagaggttaaaggttatacaaaaggtggaccgggacacgaagaaccgattcctatggcgacatatggctggaatctggttaaattacattcgggtgtagatgtattttataaacctactgaacaagttgatactttgttgtgcgacattggtgaatcgtcaagcaacccaacgatcgaggaaggaaggacgttaagagtgctcaaaatggtagaaccatggttaagttcaaaacctgaattttgtatcaaggttctaaacccatatatgccaactgtaattgaagaactagagaaactgcaaagaaagcatggtggaaacctagtcagatgcccgctcagtagaaattcaactcacgagatgtattgggtatccggtgcttccggaaacattgtctcgtctgtaaacacaacttcgaaaatgctcttgaatagatttacaactcgtcaccgaaaacccacctacgagaaagacgtagatctaggtgccggaaccagaagtgtcagcacagaaactgaaaaacctgatatgaccatcattggtagacggctccaaaggctgcaagaggagcacaaagaaacttggcactatgatcaagagaatccctaccgtacttgggcgtatcatggcagttatgaagccccgtcaacgggatcagcaagcagcatggtaaatggagtcgtaaaacttttaacaaaaccatgggacgtcatccctatggtcacgcaacttgcgatgacagacacaactccatttgggcaacaaagagtttttaaagaaaaagtagacacccgtactccccagcctaaacctggtactcgaatggttatgacgacgactgcaaattggctatgggctttattggggaaaaagaaatctcccagattgtgtacaagagaagagttcatttctaaagtgagatccaacgcagcgatcggggcagtatttcaggaagaacaaggatggacaagtgcttctgaagcggtcaacgactcgcggttttgggaactcgtcgataaagaacgagcactacatcaagaggggaaatgtgagagttgtgtctataatatgatgggaaaaagagagaagaaacttggagagtttggtagagcgaaaggaagccgagcaatctggtatatgtggctaggagcacggtttttagaatttgaggcattaggctttctaaatgaagaccactggttcggccgtgaaaactcttggtcaggagtagaaggagagggattacatcgactcggatacatcttagaagaaattgataagaaagatggagatctaatgtatgctgatgatactgctgggtgggatacgagaatcactgaagacgatttgcaaaatgaggaattaataacggaacagatggcaccacaccataaaatactagcaaaagcaatattcaaattaacatatcagaataaggtagtaaaagttttaagaccaacaccccgaggagcagttatggatataatctcacgaaaagatcagagaggctcaggtcaagtaggtacatacgggctaaacacattcactaacatggaagtacaattaattcgacagatggaagcagagggggtcatcacccaagatgacatgcaaaacccaaagggcttaaaagaacgtgtcgaaaattggttacgagagtgtggagtagacagacttaaacgaatggcaattagcggagacgattgtgttgttaagcctttggacgaaagatttggaaccagtttacttttcttaaacgacatgggtaaagtaagaaaagatatacctcagtgggagccctcaaagggttggaaaaattggcaagaggtaccgttttgctcccatcactttcataaaatttttatgaaagatggcagatcattagtagtaccctgtagaaatcaagatgaactaattggcagagcacgaatttcacagggtgccggttggtcactaagagaaactgcctgtctcggtaaggcatatgctcagatgtggtccttaatgtactttcatcgtcgcgatctccgtttggcgtcaatggcaatctgttctgcagttccaaccgaatggttccctacaagccgaactacttggagcatccatgcgcatcatcagtggatgactacagaagatatgcttaaagtgtggaatagggtatggatcgaagacaaccccaatatgatagacaaaaccccagtgcatagctgggaagacataccttatttaggtaaacgggaagacttatggtgcggaagcctgatagggctatcaagtagagccacgtgggctaagaatatacatacagctatcacacaagtaagaaatctaattggtaaagaagaatatgttgactatatgcctgttatgaagaggtactcagcaccgtctgaaagcgagggtgtgctgtga

SEQ ID NO: 23596 - RNA, 9867 nt, synthetic construct
  misc_feature 1..9867: note = derived and/or modified CDS sequence (opt6) from DENV-4__GQ868580__SS-prME
  source 1..9867: mol_type = other RNA
tcgactattaccctcctttgtttaatacctactataatggctttccatctttcaactagagacggagaaccactcatgatcgtcgctaaacacgaaagagggaggccattattgtttaaaactacagaaggaattaataaatgcactttaattgctatggatctcggtgaaatgtgtgaagatacggttacatataaatgcccgctactaatcaatacagagccagaagatattgactgctggtgtaatctaacctcaacttgggtaatgtatggcacgtgcacccaatcaggtgaacgaagaagagagaaacgctccgtagcattaaccccgcactcgggaatgggcttagagactcgtgcagaaacctggatgagttcagaaggtgcttggaaacatgcccaacgggtagaatcgtggatactgaggaacccaggtttcgcactgctagcaggatttatggcttacatgattggacaaactggaatacagagaacggtgttctttgtgttaatgatgctagttgcgccatcatatggaatgagatgtgtaggagtgggcaacagagatttcgtagaaggcgtgagcgggggtgcttgggtcgacttggtattagaacatggcggctgcgttacaactatggctcaaggcaaaccgacattagactttgagcttacaaaaacgacggctaaagaggtagcattactcagaacatactgcattgaagcgcttatatcgaacatcacgaccgccacaagatgtccaacacaaggcgaaccatatctcaaagaagaacaagaccaacaatatatttgtcgacgggacgttgtggataggggttggggaaacggttgtggtttatttggaaaaggaggagtcgtgacctgtgctaaattttcatgttcaggcaaaataactggaaatttagttcaaatagagaatttggaatacacagtagtagtcacagtacataacggtgacacacatgcagtcggtaatgatacatccaatcatggcgtaacagcgacgataacgccaagatctcctagtgtagaagttaaattgccggactatggtgaattaacattagactgcgaacctcgctcagggatagactttaatgagatgatattaatgaaaatgaagaagaaaacgtggttggtacataaacaatggtttctagacttaccacttccgtggactgcgggggcggatacctcggaagtgcactggaactacaaagaacgaatggtaacatttaaagtaccgcacgctaaaagacaagacgtcacagttttaggaagccaagagggtgccatgcacagtgcgctagccggcgctactgaagttgattctggagacggaaaccacatgttcgcgggacatttgaaatgtaaagttagaatggaaaaacttagaataaaaggaatgagttataccatgtgttcaggtaaattctctatcgataaagagatggctgaaacccagcacggtactactgtcgtgaaagtaaaatacgaaggagcaggcgctccttgcaaagtgcctatcgagataagagatgtgaacaaagaaaaggtggtaggcagaattatctctagtactccattggctgaaaacacgaacagcgtgaccaatatcgaactagaaccgccctttggcgattcatacattgtaattggagtagggaatagcgccctaacactacattggtttcggaaaggatcttccattggcaagatgttcgaatctacttataggggtgcaaaaagaatggcaatcttaggagaaaccgcctgggatttcggcagcgtaggtgggttatttacaagtctaggaaaagccgttcaccaagtttttggatcagtctacacaactatgtttggcggcgtaagctggatgatacgaattttaattggctttttagtattatggataggaaccaatagcaggaacaccagcatggcaatgacctgcatagccgtcggaggaataacattattcctaggtttcacggtgcaagcagatatgggctgtgtagtaagctggagcggaagggagttaaaatgtggaagcggcatattcgtagtcgacaacgtgcatacctggacagaacagtataaatttcaacccgaaagccctgcacgactagcgagtgcaatattgaatgcccacaaagatggagtatgtgggatcagatcaacgactagactcgaaaacgttatgtggaagcaaataactaacgagctaaactacgttctatgggaaggcggccacgacttaacagtagtcgcgggagacgtaaagggcgtgttgacaaagggtaaacgagcactaacacctccagtcagcgatttgaaatattcatggaaaacatgggggaaagcgaaaatatttacacctgaagcaagaaattcaacattcctgatagatggccctgacacgtctgagtgccctaatgaacgacgagcctggaacagtcttgaggttgaagactacggatttggaatgtttactactaatatatggatgaaatttcgagaaggatcgtcagaagtatgtgatcacagactgatgtcggccgcaataaaagaccagaaggctgttcatgctgatatgggctactggatagagtctagcaaaaatcaaacgtggcaaattgaaagagcaagtcttatagaagtaaaaacctgcttatggccaaagactcatacactgtggtctaatggcgtgctggagagtcaaatgcttataccaaaaagctacgcgggaccttttagtcaacataattacaggcaagggtatgcaacccaaaccgttggtccgtggcacctaggtaaactagagatagattttggagaatgcccaggaactacggtgactatacaagaagactgtgaccatcgcggacctagccttagaactacaactgcttccgggaagttggtaacccaatggtgctgtaggtcgtgtacaatgccacctttaagattcttgggcgaagacggatgctggtacgggatggaaataaggccactgaacgaaaaagaagaaaacatggttaaaagccaggtgacagctgggcagtccaccagtgaaacctttagcatgggtttgttgtgtttgacactattcgtagaagaatgtctaaggagacgggtaactcggaaacacatgatactagcagtagtgataacattatgcgctatcattctaggaggcctgacatggatggatcttcttcgtgcacttattatgctaggggatacaatgagcggtcgtatcggaggtcaaactcaccttgcaataatggcagtgttcaaaatgagcccaggatatgtacttggcgttttcttaaggaagttaacttcacgagaaacggctttaatggtgattggaatggcaatgactaccacattttcgatacctcatgacttaatggaattaatagacggaattagtcttggcctaatacttctcaaaatagtaacacagttcgacaatacgcaggtaggaacgttagcgttgagcttaacttttattagatccacaatgagcttagtaatggcttggcgtactataatggcagtattatttgtagtaacattaatacccctatgtagaacaagttgtttacaaaaacaaagtcactgggtcgaaataaccgctctaatactaggcgcccaagcccttccagtttacctaatgacgctaatgaaaggggcaagccgacgaagctggcctcttaacgaaggcatcatggcagtagggctagtatcattgcttggcagtgctttgttaaagaacgacgtcccgctcgcaggacctatggttgcagggggattattactggccgcgtatgttatgtcaggatcatcagcggacctatccttggaaaaagctgcgaacgtgcaatgggatgagatggctgacatcacaggatcttcacccattattgaagttaaacaagacgaggatggctccttttcgatacgagacgtggaagaaaccaatatgattacacttctagttaaactcgcactaatcacagtatcaggattatatccccttgcaatacccgtcactatgaccttgtggtacatgtggcaagttaaaactcaaagatcaggagctttatgggatgtaccctctcccgctgcaacgcaaaaagctgccttgagtgagggagtataccgaataatgcagagaggattacttggaaagacccaagttggcgtaggaatacatatggaaggagtgtttcatacaatgtggcatgttaccaggggatcagttatttgtcatgaaaccggaagactagaaccatcttgggcagacgtacgaaatgatatgatatcctatggcggtggttggaggctaggggataaatgggaccgagaagaagatgttcaagtgttagctatagaacccggcaagaaccccaagcacgtacagacgaaaccaggtttattcaaaacgcttacaggagaaattggtgccgtaactctcgactttaaaccggggacaagtgggagtcccataattaatcgaaagggtaaagttatcggattatatggcaatggagttgtcacgaagtcaggggattatgtgtcagcgataacccaagcagaaagaataggggagccagattatgaagtcgatgaagatatatttcggaaaaagagattaacgataatggatttacatcccggtgctggcaagacgaaacgcattttaccatcgatagtaagagaagctctaaaacgacgtctaagaacacttattttggcacctacacgagtagttgctgcagaaatggaagaagcactacgaggactgcccattagatatcaaactcctgcagtaaagtcggagcatacaggacgtgaaatagtcgaccttatgtgccacgcaacatttaccacaaggctattatcatcaacacgggtaccgaattataatttaatcgtaatggacgaagcacacttcacagacccatcctcagtagcggcacgaggttacataagtacgcgtgtagagatgggagaagcagcggcgatttttatgacagccacgccaccaggcgctactgaccctttcccacaaagcaattctcccatagaagatatcgaacgcgaaatcccagaacgatcgtggaatacgggttttgactggattactgactaccaggggaaaacagtctggtttgtccctagcattaaggcaggcaacgatatcgccaactgtcttagaaaatctggcaagaaagtgattcaattaagcagaaaaactttcgacacagaatatccgaagacaaagctgacagattgggatttcgtcgtaactacagacatctcagaaatgggagctaacttcagggcaggtcgcgtcattgatccgagacgctgcctaaaaccagtaattctaacagacggaccggaaagagtaatactcgctggacctatacctgtcaccccagcttcagcagcacagagacgaggaagaatcggtaggaatcccgcacaagaggatgaccaatatgtattcagcggagatccactcaagaatgacgaggaccatgcacattggaccgaggcaaaaatgttattagacaacatttatactcctgagggaataattcccaccctatttggtcctgaaagagaaaagacacaagccattgacggtgaatttagactccgtggggagcagagaaaaacatttgttgagttgatgagaaggggagatttgccagtatggctaagttacaaagtagcttccgccggcataagttataaagacagagagtggtgctttactggggagcgtaataaccagatccttgaagaaaatatggaagtagaaatctggacgagggagggtgagaaaaagaaattgaggcccaggtggcttgacgcgcgtgtgtacgctgacccaatggcattgaaagactttaaagaatttgcaagtggcaggaaaagtataacattagacatactcacagaaatcgcttcacttccaacatatctgagttcccgtgctaaattagcactcgacaacatagtaatgttacacacaactgaacgaggaggacgagcgtatcaacatgccctaaatgagctacccgaatctctagagacactcatgctggtagcactgctaggcgctatgacagctggtatttttctattctttatgcaaggcaaaggtattggtaaattgtccatggggctaattacaatagcaatggcatcaggattattatggatcgctgagatacagcctcaatggatcgcagcgtctattatactagagttcttcttaatggttctactgataccagagccggagaaacaacggacaccccaagataatcaactgatatacgtaatcttaactatactaactattattggtttaattgcggcaaatgaaatggggctaatagagaaaacaaaaacagattttggcttttatcaggtcaaaacagaaactacgatactggatgtagacttgcgacctgcgtcagcgtggactttatatgcggtagcaaccacgatcctcacacccatgctacgtcacactattgaaaacacgtctgcaaatttatcgctcgcagcaatagctaatcaagctgctgtacttatgggcctaggaaaaggttggcccttacacagaatggatttaggtgtaccattacttgctatgggatgctactctcaagtaaatcccaccacgcttacagccagcctagttatgcttctagtccattatgcaataataggtcctggacttcaagcgaaagcgaccagggaagcacagaaaaggactgcagccggtattatgaaaaacccaactgtagacggtataaccgttatagacttagaaccaatatcgtatgatcctaaatttgaaaagcaactaggacaagtaatgctattagtcctttgcgcgggacagttattattaatgaggacaacatgggcgttctgcgaagtcctaacgttagcaacaggaccaatactaaccttgtgggaaggtaatcccggacgattctggaatactactattgccgtttcgacagccaatatctttcgtggtagctatcttgcgggtgcaggtctagcttttagcttaattaaaaacgcacaaacgcctcgaagaggaacaggaacgacaggggaaacgttaggtgaaaagtggaaacgacaattaaatagcttggacagaaaggaatttgaagaatataaaagatctggcatactagaagtagaccggaccgaagccaaaagtgcactcaaggacggcagcaaaattaaacatgcagtaagtagagggagttccaaaattcgttggatagtcgaaagaggaatggtcaagccgaaagggaaagtcgtagacctgggatgtggcagaggtggttggtcgtactatatggcaacacttaaaaacgtaacagaagtaaaaggatataccaaaggaggtccaggacatgaagaaccaattccgatggctacctatggatggaacttagtaaagttacacagcggcgttgacgttttctataagccaacagagcaggtagatactctactatgtgatattggggaatcttcaagtaacccaacgatagaggagggtcgaactttaagagtattaaaaatggtagaaccctggctttcatctaaaccagaattttgtatcaaagtactaaatccctatatgccaactgtaatagaggaattagaaaaactacagaggaaacatggagggaatctagttagatgtccattatcaagaaatagcactcacgaaatgtactgggtgagtggagctagtgggaatatagtaagtagtgtcaataccacttctaaaatgttactaaataggtttaccacaagacacagaaaacccacctacgaaaaagacgttgatttaggagccggcacaagatctgtaagtacagaaactgagaagcccgatatgaccatcattggacgaagattacaaaggttacaagaagaacataaagaaacttggcattatgatcaggaaaatccctaccgaacctgggcctatcatggaagttacgaagctccaagtactggttcggctagctctatggttaatggagtagtaaaattattgaccaaaccatgggacgtaattccaatggtaacacagcttgcgatgaccgatacaactccttttggccagcaacgggtgtttaaagaaaaagtagacactagaacaccacaacctaaaccaggcacaagaatggttatgactacgacagcaaactggctgtgggcactacttggaaagaagaaaagtccgcggctctgtacaagagaagaatttataagtaaagtaaggagtaatgcagcaataggggccgttttccaggaagaacaaggatggacaagcgcgtcagaagcggtttcggatagtaggttctgggaattagtcgataaagaaagagcacttcaccaagagggtaaatgtgaatcttgtgtatacaatatgatggggaaacgggagaagaaattgggagaatttgggagagcaaaaggatcaagagcaatctggtatatgtggctaggagccagattcctagaatttgaagcacttggatttttaaacgaagatcattggttcggcagagaaaattcctggtcaggcgtcgaaggcgaaggcctccacagactcgggtatattttagaagagattgacaaaaaggatggggacctaatgtacgccgacgatacagcgggatgggacacaagaataactgaggacgacctacagaacgaagaactgataacagaacagatggcaccccatcacaaaattttagccaaagctatcttcaaactgacatatcaaaacaaagtagttaaagtattacgaccgaccccaaggggcgctgtaatggatattattagtcgtaaggatcaaagaggatcgggccaagtggggacttactcactaaacacatttaccaatatggaagtacagctgatcagacagatggaagcagaaggtgtaatcacacaagatgatatgcagaatcctaaaggactcaaagaaagggtagagaattggttaagggaatgcggcgttgacagacttaagcgcatggcaatctctggagacgattgtgttgtcaaaccgcttgatgaacgtttcggcacctcactattatttctcaacgacatgggtaaagtcagaaaagatattccacaatgggaaccgagcaaaggttggaaaaattggcaagaggttccattctgctcacatcattttcataaaatcttcatgaaagatggccgatcacttgtagttccgtgtcgtaatcaagatgaacttataggacgggcgcgtatatcacaaggtgccgggtggtccttgagagaaaccgcatgtctcggtaaggcttacgctcagatgtggagtctcatgtatttccaccgaagggacttgagattagcaagcatggcaatttgtagcgccgtcccgaccgagtggtttccaactagcagaacgacgtggagtattcacgcccatcaccaatggatgacaacagaagacatgctgaaagtatggaatagagtctggattgaggacaatccaaatatgatcgacaaaacgccagtacactcgtgggaagacataccatatctgggaaaacgtgaggatttgtggtgcggttctttgataggattatcgagtagagcaacatgggcgaaaaacatacacaccgctataacacaagtcagaaatttaattggtaaagaggaatatgttgattatatgccagtaatgaaaagatattccgcacctagcgaatcagaaggggtgctctaa

SEQ ID NO: 23597 - RNA, 9867 nt, synthetic construct
  misc_feature 1..9867: note = derived and/or modified CDS sequence (opt6) from DENV-4__GQ868583__SS-prME
  source 1..9867: mol_type = other RNA
tcgactattaccctcctttgcttaattcccaccgtgatggcgtttcatctctcaacccgcgatggtgaaccccttatgatagtcgctaaacacgaaagaggcaggcccctcttatttaaaaccaccgaaggtataaataaatgtactctcatagctatggatcttggtgaaatgtgtgaagacaccgtaacttacaaatgtcctctattagttaatactgaacccgaagacatagattgttggtgcaacctcacatcaacgtgggtcatgtatggcacgtgcacacaatccggcgaaagaagacgtgaaaaacgtagcgtagccttaaccccgcattcaggaatgggcctggaaacaagagctgaaacctggatgtcatccgaaggagcttggaaacatgcacaacgagtagaatcttggatactaaggaatccagggtttgccctgctggccggatttatggcgtacatgataggtcaaactgggatccagcgtacggtattcttcgttttgatgatgttagtagcccctagctatggaatgcgctgtgttggagtaggaaatcgagattttgtagaaggtgtctcgggcggcgcttgggtcgatcttgtattagaacacggtggatgtgtcacgacgatggcccaaggtaaacctacattggacttcgaactaactaaaacaaccgcgaaagaagtagccttattaagaacttattgtatagaagctctaatctccaacataacaactgcgaccagatgccccacacagggtgaaccatatctaaaagaagaacaagatcaacagtatatttgtagaagggatgtagttgaccggggatgggggaacggatgcggactatttggaaaaggcggggtagtcacgtgcgcgaaatttagctgcagcggtaaaataacaggaaacttagttcaaatagagaatcttgagtacacagtcgttgtaactgttcacaatggagacacgcatgccgtcggcaacgatacgtctaatcacggcgtcacagcaacaattactccgagatctccttcagtggaggtaaaactcccagattatggagaactgactctagactgcgaaccaaggagtggtatagattttaacgagatgatcttaatgaaaatgaagaagaaaacctggcttgtccacaaacagtggtttttggacctaccattgccatggacaacaggggctgacacaagtgaggtccattggaattacaaagaaagaatggtaacttttaaagttcctcatgccaaacgtcaggacgttacagtgttgggatcacaagagggagcaatgcattcagctttagctggtgcaacagaagttgactctggcgatggtaatcatatgttcgctggacatctcaaatgtaaagtcagaatggaaaagctgcggataaaaggaatgtcttacacaatgtgttcgggaaaatttagtatagataaagaaatggctgaaacacaacacggaacaactgtagtaaaggtgaagtatgaaggggcaggagcaccatgtaaggttcccatagaaattagggacgttaacaaggaaaaggtagtcggaagggtgatatcggcaacaccgctggctgaaaatactaatagcgtaacaaatatcgaattagaaccccctttcggcgatagctacataatgataggtgtcggcaattctgccctaacactccattggttcagaaaaggatcatcgataggaaaaatgttcgaaagcacttatagaggcgcaaaaaggatggccatacttggcgagacagcttgggactttgggtcagttggaggtttattcacttccctagggaaagcagttcatcaagtgtttggatcagtgtatactacaatgtttggaggagtctcctggatgatacgtatattaataggattcctggtcttatggattggaacgaatagcagaaatacaagtatggcaatgacttgtatagctgtaggtgggataaccttattcttgggttttacagtacaagcagatatgggatgtgtcgttagttggtcgggacgagaattgaagtgcggatcaggtatattcgtggttgataatgtgcacacctggactgaacaatacaaattccaaccggaatcaccggcacgattagccagtgcaatactaaacgcgcataaagatggagtatgcggaatacgaagtacaacgagattagagaatgttatgtggaagcaaataactaatgaattaaactatgtattgtgggaagggggacacgacctaaccgtggtagcaggagacgttaagggcgtgctcacaaaaggaaagcgggcacttgcacccccagcaagcgatttgaaatactcatggaaaacgtgggggaaagctaaaatatttactccagaagcgcgaaactctactttcctcatagatggtcccgatacatctgagtgccccaatgaacgtagagcctggaactcatttgaagtagaagactatggctttggaatgttcacaacaaacatatggatgaagttccgtgaaggtagcagcgaagtctgtgatcacagacttatgtcagcagctatcaaagaccagaaagcggtgcacgctgatatgggatattggatagaatctagtaaaaaccaaacctggcaaattgaacgagcgtcattaatagaagtcaaaacgtgcttatggccaaaaacccatactctttggtcaaacggagtattagagagtcaaatgttaattcctaaatcgtatgcaggacccttctctcaacacaactatcgacagggttatgcgacgcaaacagtaggtccatggcacttaggaaaattggaaatagattttggtgaatgccctggaacaaccgtaactatacaagaagactgtgaccaccgaggacctagtttaagaacaactaccgcttccggtaaactcgtgacgcaatggtgttgcaggtcgtgtacaatgccaccgttgagatttttaggtgaggatggatgttggtatggtatggaaatccgaccactcagcgaaaaagaagaaaatatggtaaaatcgcaagtgacggcaggtcaaggaacctctgaaacatttagtatgggccttctatgcctaacgcttttcgtcgaagaatgtttaagaagacgtgtaaccagaaaacacatgattctagctgttgtaataacattatgtgccatcatattaggtggactaacatggatggatctactaagagctttaattatgttaggagacacgatgagcggtagaataggtggacaaacgcatttagcaataatggcagtattcaaaatgtcaccaggatatgtactcggagtgttcttaagaaaactaaccagccgagaaacagctttaatggttataggaatggctatgacaacaactctaagtattccacacgatttaatggaacttatagatggcatctcgttaggtttaattcttttaaagatagtaacccaattcgataatacacaggtaggaacactagcactatctttaacattcataagaagtactatgagcttagtcatggcctggagaacaatcatggctgtcctctttgtggtgacattaattccactgtgtcgtacatcatgtctccaaaaacaaagtcattgggtagaaataacagctcttattttgggagcacaagccttacccgtgtacttaatgaccttgatgaaaggggcttcccgaagatcttggcctttaaacgaagggataatggcggtcgggttagtatcgctcttgggaagtgctctgttgaaaaatgatgtacccttagctggtcccatggtggctggaggtcttctattggcagcatatgttatgagtggatcgagcgctgatttgtctctcgaaaaggcggcaaacgtacaatgggacgagatggccgatataacagggtcgtcaccgattatagaagttaagcaagacgaagatggtagtttctcaatacgagacgtagaggagacgaatatgataacactgttagtgaagttggcgctcattaccgtctctgggttgtatccattagcgatccctgtgactatgacattatggtatatgtggcaggttaaaacgcaaagaagcggtgcattgtgggatgtaccctctccagccgcgacacaaaaagccgctctttcagaaggtgtttacaggattatgcaacggggcttgttcggtaagacgcaagtgggtgtgggaatacatatggaaggggtcttccacacaatgtggcatgttactagagggtcagttatttgtcatgaaactggaagactagaacctagctgggctgatgtcagaaacgatatgatatcatatggtggcggatggcgactaggggataagtgggataaagaagaagacgtccaggtactagctatagaacctggaaagaatcccaagcatgtacaaactaaaccaggccttttcaaaacattgaccggagaaatcggagccgtcacccttgactttaaaccgggtacatcagggtcaccaataataaatcgcaaggggaaggtcatcggattgtatggtaacggcgtcgtgacaaaatctggtgattacgtatcagccatcacccaagctgaaagaattggagaaccagactacgaagtagacgaagatatcttcaggaaaaagcgccttaccataatggatttacacccaggtgcaggcaagacaaagagaatcttaccatcaatagtgagagaagcattaaagagacggttaagaacactaatcctagcccctaccagagtagttgccgccgaaatggaagaagcgttgagaggtttacctattaggtaccaaactccagcagtaaaatctgagcacactggaagggagattgtcgatcttatgtgccatgccacttttacaacacgtttattaagcagcacacgagtcccaaattataatctcatagtaatggatgaggcacattttacagaccctagctcagttgctgcgcgaggatatataagtacgcgtgtagaaatgggagaggcagctgccattttcatgacagccacgcctccgggcgcgaccgatcctttccctcaaagtaacagccccatagaagatatagaaagggaaataccagaaagatcatggaatactgggttcgattggatcacagattaccaagggaaaacagtatggttcgtgccgtcaattaaagcagggaatgacatagcaaattgcctcaggaaaagtgggaaaaaggttattcagttatcgaggaagaccttcgatacggaatacccaaaaaccaaattaacagattgggactttgttgtaactacagatatatcagaaatgggagcgaacttccgagcaggacgagttatcgatccacgccgttgtctaaagccagtaatacttactgatggaccggaacgcgtcattttagccggtccaatacctgtgacgccagcatcagctgcgcagagaagaggcaggattggcagaaaccctgctcaagaagacgatcagtatgtgttcagcggagacccattaaagaatgatgaagatcatgcacattggaccgaagcgaaaatgctgcttgacaacatttatacccctgaaggcattatccctaccttgttcggtccagagcgagagaaaactcaggcaatcgatggcgaatttagattacgaggtgaacaacgaaaaactttcgtcgaacttatgcgtcgaggtgatctaccggtttggttgagctataaagtcgcttcagcaggaataagttacaaagaccgagaatggtgctttactggggaaaggaataatcaaatattagaagaaaatatggaagtagaaatctggaccagagaaggagagaagaagaaactaagaccgaaatggctagatgcgagggtctatgcagatcctatggcactacaagactttaaagaatttgcttccggtagaaaaagtattacattagacatcctaacagaaatagctagcttaccgacctatctgtctagtagagccaaactagcgctagataatattgtgatgttacatacaacagaaaggggtgggcgcgcctatcaacatgcccttaacgaattaccagagagcttagaaacgttaatgttagtggcgctccttggtgcgatgaccgcaggaatattcttatttttcatgcagggtaagggaataggaaaattatctatgggtttgatcaccattgccgtggcgagcgggttactctgggtagcagagattcagccgcaatggatagcggcgtctataatcttagagttctttttaatggttcttcttatacctgaaccagaaaaacaacgaactccacaagataaccaactcatttatgtcattttaacaatactgacaatcatcggtttaattgccgcaaacgagatgggattgatagagaaaactaaaactgactttggattttatcaagtcaaaacagaaacaactatactagatgttgatcttcgccctgcttcagcatggacgctatatgcagtagcgacgaccattcttacacctatgttaagacatacgattgaaaatacatcagcaaacttatcactcgccgcaatagctaatcaagccgcagtgttaatgggcctgggcaaaggctggcccttacatagaatggatcttggagtaccactactcgctatggggtgctattcccaagtaaatccgacaactttgaccgcatcgctggttatgttactggttcattatgcgattattggacctgggctacaggcaaaagcgactcgggaagcacagaaaaggacagccgcgggaatcatgaagaatccaaccgtcgacggcattacggtcatagatttagaaccaatctcatatgatcctaagttcgagaagcaacttggacaagtcatgttgctagtactatgtgcaggccaacttttactgatgagaacaacatgggctttctgcgaggttttaactctagccaccggtccgatattaacactatgggaagggaatcctgggcgcttttggaataccactattgcagtttctacagctaatatcttcagaggaagctatctagctggtgcaggactcgcgttcagcttgatcaaaaatgctcaaacccctagacgagggactggtacaacaggagaaacgttaggcgaaaagtggaaacgtcagcttaactcgctcgacagaaaggaatttgaagaatacaaaagatctggtattcttgaggtagatcgtaccgaagctaaaagtgcgttaaaggacgggtctaaaattaaacatgctgtctcgcgcggtagcagcaaaattcgctggattgtagaacgaggaatggtcaaaccaaaagggaaagtagtggatttaggatgtggtcgcggtgggtggagctattatatggcaacacttaaaaatgtaacagaagtaaaaggatacacgaaaggtggaccagggcatgaagaaccaataccaatggcaacgtacggatggaatctagttaaactacattctggagtcgatgtgttttacaagccgacagaacaagtagatacgcttttgtgtgacataggtgaaagttcatcaaatccgacaatagaggaaggaagaactcttagagtactaaagatggtcgaaccatggctatcttcaaagccagagttctgcattaaagttttgaatccatatatgccaacggtaatcgaagaattggaaaagttacagcgaaaacatggtggcaatcttgtaaggtgcccgctatctagaaattccactcatgaaatgtattgggtttctggagcatcaggaaacatagtatcatctgtgaatacaacaagcaagatgctactgaataggtttacaacaaggcatagaaaaccaacgtatgaaaaggatgtcgatttaggtgctggaaccaggtcggtctcgacggagacggagaagcctgacatgacaataataggacggagactacaaagactccaagaggaacacaaagagacgtggcattatgatcaagaaaatccataccgtacttgggcctatcacggtagttatgaggcaccgtcaacgggtagtgcatcatctatggtaaatggagtcgtaaaactactaacgaagccatgggacgttattccaatggtaacgcaactcgctatgaccgatacaaccccatttggacaacagagagtattcaaagagaaggtcgatacccgtacgcctcaacctaaaccggggacacggatggttatgactactacggcaaattggctttgggcactactaggtaagaagaaaaacccgagactctgtacgcgtgaggagtttatatcgaaggtacgatcaaatgcagcgataggtgcggttttccaggaagaacaaggatggacaagtgctagtgaagccgtttcagattccagattttgggagctcgttgataaggaaagggccttgcaccaagaggggaagtgtgaatcatgcgtatacaatatgatgggaaagagggagaagaaattgggtgaatttggccgagcgaaaggatcgcgagccatttggtatatgtggctaggggcacggtttttagagtttgaagcacttggatttttaaatgaagaccactggtttggacgggaaaattcctggtctggagtagaaggagaggggttacaccgtcttggctatatacttgaggagatagacaagaaagatggagacctaatgtatgctgatgacacggccggctgggacactaggataactgaagatgatttgcaaaacgaagagttaataaccgaacaaatggctccccaccataaaatccttgccaaagcaatctttaaacttacatatcaaaacaaggttgttaaagtattgagacccacaccacggggcgcggtaatggatattatatctagaaaggaccaaaggggatcgggacaagtgggtacatatggactcaataccttcacaaacatggaagtacaactaatcaggcaaatggaagctgagggagttatcacacaagacgatatgcaaaacccaaagggtctaaaagaaagagtcgagaaatggctaagagagtgcggagttgaccgcttaaaaagaatggctatcagcggtgatgactgcgttgtgaagcctctcgacgaacgcttcggtacgtcccttttgtttcttaatgacatgggaaaagtcagaaaagatataccacaatgggaaccatcaaagggttggaaaaactggcaagaagtcccattttgttcacatcatttccataaaatatttatgaaggatggacgaagtttagtcgtaccatgccgaaatcaggatgaattgatcgggcgagcaagaatttctcaaggagcaggctggagtctacgtgaaacggcatgtctaggaaaagcgtatgcccaaatgtggagcttgatgtatttccacagaagagatctacgattagccagtatggccatatgttcagcagtaccaacagaatggttcccgacctctagaacaacatggtcaatccatgcgcatcatcaatggatgacaacggaagacatgttgaaggtatggaatagagtatggatagaagacaatccaaatatgatagataaaacacctgtgcactcctgggaggacataccctaccttggaaagagagaggacctctggtgcggctctttgatcgggctttcttctagagctacatgggcgaagaacatacacactgccatcactcaagtacggaacttaataggaaaggaagaatatgtcgactatatgccggtaatgaaacgttatagcgccccaagtgagagtgaaggtgtgctataa

SEQ ID NO: 23598 - RNA, 9867 nt, synthetic construct
  misc_feature 1..9867: note = derived and/or modified CDS sequence (opt6) from DENV-4__GQ868584__SS-prME
  source 1..9867: mol_type = other RNA
agcactattacactgttatgcttaataccaactgtcatggcttttcatttaagcaccagggacggagaaccattgatgatagttgcgaaacacgaaaggggaagacctctactatttaaaaccactgaaggtataaataaatgtacattaattgcaatggacctgggggaaatgtgtgaagacactgtaacgtataaatgcccactattagttaacacggagccagaagacatcgattgttggtgtaatttaacatctacatgggtaatgtacggaacttgcacacaatcaggggaaagaagaagagagaaaaggtcggtggcactgactccgcattcaggtatgggccttgagacgcgagcggaaacatggatgtccagtgaaggggcttggaaacatgctcaaagagttgagagttggatactaaggaaccctggtttcgcacttttggctggtttcatggcttatatgattggtcagacaggcattcagagaacagtattctttgtcttgatgatgttagtggctccatcgtatgggatgaggtgcgtaggggtaggaaaccgagactttgttgaaggagtttcaggtggagcttgggttgatctcgtattagaacatggaggttgtgtaacaaccatggcacaaggaaaaccaacacttgatttcgaactaactaaaacaaccgctaaagaagtagcattattgcgcacatactgtatagaagcattgatatctaatataacaactgccacacgttgtcccactcaaggcgaaccatacctaaaagaagaacaagacagacaatatatctgtcgtagggatgtagtagaccgtggttggggtaacggctgtggactattcggaaaaggaggtgtagtaacgtgtgctaaattctcgtgcagcggaaagataacaggaaacttagtgcaaatcgagaatctggaatatacggttgtagtaaccgttcataacggtgatactcacgcagtcggaaacgacacgtctaaccacggagttacggccactataacgcctagaagtccctcagttgaggtcaaactaccagactacggcgagctaacactcgattgtgaaccgcgtagcggtattgactttaatgaaatgatactaatgaaaatgaagaagaaaacttggctggttcataaacaatggttcctagatttaccgttgccttggacaactggcgcagatacgtcggaagtgcattggaactacaaagaaagaatggttacgttcaaggtgccccatgctaaaagacaagatgttactgttttaggatcccaagaaggtgcgatgcattcagctcttgcaggggcaaccgaagtagatagtggagatggaaaccatatgttcgctggccatttaaaatgtaaagtgagaatggagaaacttagaatcaaaggaatgtcttacaccatgtgtagcggtaaattctcaatcgacaaagaaatggccgaaacacagcacggtactactgtagtaaaagtaaaatacgaaggagcaggcgccccatgcaaagttccaatagaaatacgcgacgtaaataaagaaaaagttgttgggcgagtgatatcagcgacaccgttagcagaaaacactaattcagtaaccaatattgagttagaaccaccatttggtgatagctatataatgattggagttgggaatagtgccttgacacttcattggtttagaaaaggctcaagtatagggaagatgttcgagagtacatatagaggagcaaaacgtatggctattttgggagaaactgcgtgggattttggttctgtgggtggtctatttacgagtttaggaaaagccgtccatcaagtatttgggagtgtttatactaccatgtttggtggcgtttcgtggatgatccgtatactgatcggctttttggtattatggatcggaaccaactcaagaaacacttccatggcaatgacatgtattgcagtcggagggataaccctcttcttaggattcacagtgcaagcagatatgggttgcgtagttagctggtcgggtagggaactaaaatgtggatcaggaattttcgtagtcgataatgtacatacttggacagaacaatataaattccaaccagaaagcccggccagactagctagcgccatattaaacgcgcataaagacggtgtgtgtggtataaggagcacaaccagactagaaaatgtaatgtggaaacaaataactaacgaactaaattatgtgctatgggaaggaggtcatgatctaacagttgttgcaggagatgtaaaaggtgtattaacgaaaggcaaaagggctctcgcgcccccagcctcagatcttaaatattcgtggaagacgtggggaaaagccaaaatcttcacacctgaggcacgaaactcaacgttcctaatagatggtccggatacctccgagtgccctaatgagcgcagggcatggaatagttttgaagtggaagactatggatttggtatgttcactaccaacatctggatgaaatttcgcgaaggctcaagtgaagtatgtgaccatcgactgatgtccgcagccattaaagatcaaaaagccgtgcatgcagatatgggatattggatagaatcctctaaaaatcaaacatggcaaatagaaagagcgagtttaattgaagttaagacctgcttgtggccgaaaacacatacactgtggtctaacggtgtattagaatcgcaaatgctaatcccaaaaagttacgcaggacctttttcacagcataattaccggcaaggttatgctacccaaaccgttggaccttggcatttgggaaagttagagattgattttggcgagtgccccggtactaccgtcactatacaagaagattgcgaccaccgcggaccatccttgagaaccacaacagcatcggggaaacttgttacgcaatggtgttgtagatcctgcacaatgcccccattacgatttctgggcgaagacgggtgttggtacggaatggaaattagaccgctaagtgaaaaagaggaaaatatggtaaaatcccaagtaaccgcaggacaggggacgtcggaaacattttcaatgggcttactctgcttaactttgttcgtcgaggaatgcttacgaagacgagtgactagaaaacacatgattttggcagtcgttattaccctgtgtgcaataatactagggggacttacgtggatggatctactaagagctttgatcatgctaggcgacaccatgagtggacgaattgggggccaaacacatcttgctattatggcagtattcaaaatgtcacctggttatgtattgggtgtatttctcagaaaattaacaagccgggaaactgccttaatggttattggcatggcaatgacgaccacgctaagtatcccacatgaccttatggaattaatagacggtatatcgctaggtcttattctattaaagatagtaacacagttcgacaatactcaagtgggtactttagcattgtctctaaccttcattcgtagtacaatgtccctagtaatggcatggagaacaataatggctgtcctttttgtagttacacttattccactatgccgcacaagttgtttacaaaaacaatcacattgggtagaaatcacagctctcattctcggagcccaagcactaccggtttacctaatgacgctgatgaaaggtgcttcaagaagatcctggcctttaaacgaaggcattatggcagtaggtttagtatctctactcggatccgcacttttgaaaaatgatgtgcccttggccggaccgatggttgccggcggtttattactcgcagcgtacgtaatgtcaggctcaagtgcagacctttcactagagaaagcagcaaacgtccaatgggatgaaatggcggacatcaccggtagtagtcctattatagaagttaaacaagatgaagatggctcgttttcaataagggatgtagaggagacaaacatgattacactattagttaagttagcattaataacagtaagtggactttatcctttagcaattcccgtaactatgacgctttggtatatgtggcaagtgaaaacgcaacgaagtggcgctttatgggacgtcccttcaccagcggcaacgcagaaagccgctttaagcgaaggcgtttacagaatcatgcaaagaggcctatttggaaaaacccaggtcggtgtaggaatacatatggagggagtattccacacaatgtggcacgtaacccgtggcagtgttatatgtcatgagactggtagattggaaccatcctgggctgatgtccgaaatgacatgatctcatatggaggcggatggcgtctgggagacaagtgggataaagaagaggatgtacaagttcttgcaattgagcctggcaaaaatcctaagcacgttcaaactaaacccggactattcaaaaccttaacaggggaaataggtgcagtgacacttgactttaagcccggaacgtctggatctccaataataaatcgtaaaggcaaagtgataggcttatatggaaacggagtcgtgacgaaaagtggagactacgtaagtgccataacccaagctgaaagaatcggggaaccggactatgaagtcgatgaggatattttccgaaagaaaaggttaaccataatggacttacatccaggtgccggtaaaacgaaacgcattttaccaagcatagtgagggaggctttgaagagaaggttacgtacactgatattagcacccactagagtcgtggcagctgagatggaggaagctctacgaggactaccgatccgttatcaaacaccagccgtgaaatcagaacacactgggagggagatagtagatctaatgtgtcatgccacatttacaacgcgtttgttatctagtacaagagtaccaaactacaaccttatcgtcatggacgaggcacattttactgacccctcatcagtagcagcgcgtggttacatctctacacgcgtagaaatgggagaagccgccgcaatatttatgacagctacgcctcccggtgccacagatccattcccacaatcgaacagcccaatcgaagatatcgaaagggaaataccagagagatcatggaatacgggttttgattggatcactgactatcaagggaagaccgtttggttcgtaccatcaatcaaagcggggaacgatattgcaaattgccttagaaagtcgggcaagaaagtcatccaattaagtaggaaaacattcgacaccgaatatccaaagactaagctcacagattgggatttcgtagttaccacagacatttcagaaatgggtgcgaactttcgcgctggacgagtgatagatccaagaaggtgcctgaaacccgttattctcacggacggcccagaaagagtaatcctggctggccctataccagtaactccggctagcgcggcgcagagaagaggacgaattggcaggaacccagcccaagaagacgatcagtatgtttttagtggcgatcctctcaaaaatgacgaagaccacgcacactggacggaagcaaaaatgctcctggataacatctatacgccggaaggtattatccctacgttattcggtccagaacgtgagaaaacacaggcaatagacggtgagttcaggctacgaggagaacaaagaaaaacttttgttgaattgatgcgaagaggggacttgcctgtatggctaagttataaggtagcgtcggcaggaattagctacaaagatcgagaatggtgtttcaccggggaacgcaacaatcagattctagaagagaatatggaagtagaaatttggacaagagaaggtgagaagaagaaacttcgaccaaaatggttagacgctcgagtgtatgccgacccaatggcgttgaaagactttaaagaatttgctagcggtagaaaaagtataacgttagatattcttacagaaatagcgagtctccctacatacctctcctcacgagccaaactagcactcgataatatagtaatgctacatactaccgagaggggaggacgtgcataccaacacgcactaaacgaattgcctgagagcctagaaacattaatgctagtcgcgctcttaggagccatgactgccggtattttcctgttctttatgcaaggaaaaggtataggaaagctaagcatgggattaattacaatagcggtagcttctggattgctttgggtcgcggaaatacagccacaatggatagctgcctcaatcatattagagttctttctgatggtattattaattcctgaacccgaaaagcaacgaacaccccaagacaatcagttaatctatgtgatattgaccatcttaaccataatcggtttaattgctgcgaatgaaatgggtttaatcgaaaagactaaaactgattttggattctatcaggtaaaaaccgagacgactatactcgatgttgatctacgccccgcatcggcttggaccttatacgcagtagcgacgacaatacttacaccaatgttgagacataccatcgagaacacaagtgccaatttatccttagcagctatagcaaatcaagctgctgtattgatgggattaggaaaaggatggccactacatagaatggatttaggagtcccacttcttgcgatgggatgctattcgcaagttaatcccactactctaaccgcctcacttgttatgcttttagttcactacgcaataattggacccggcttacaagcaaaagccacgcgagaggcacagaagaggacagcggcgggaataatgaaaaatccgaccgttgatggaataaccgtgatagacttggaaccaatttcatacgacccgaaattcgagaaacagttaggacaggttatgcttcttgtattgtgtgcaggccaactcctactaatgcggacgacgtgggctttttgtgaggtccttacgcttgcgactggtccaatacttaccctgtgggaaggcaatcctggtaggttctggaacactacaatagctgtctccaccgcaaatatttttagaggtagttatcttgcgggtgctggcctagcctttagcctaatcaaaaacgcacaaacaccacgcagaggaaccgggacaactggtgaaactttaggggaaaagtggaaaaggcagcttaactcactcgatagaaaagaatttgaagaatacaaaagatctggtatactggaagtagaccgaacggaagctaaaagtgcattaaaagacggttcgaaaattaagcatgcagtctcacgtggaagctctaaaatcaggtggatagtagaaagaggcatggtaaaacctaaaggaaaagtggtagatttgggttgcgggagaggcggctggtcttactatatggcgacgcttaaaaacgtcacagaagttaaaggctacaccaagggcggtcccggacatgaagaaccaataccgatggcaacgtatggatggaatttagtcaaactacatagcggcgtcgacgtattttataaacctacagaacaagtggacactctattatgtgatataggggagtcttctagcaatccaacaatagaggaaggacgtaccttacgagtattgaaaatggttgagccctggttgtcttcaaaaccagaattttgcattaaagttctcaacccttatatgccaactgtaatagaagaattagaaaaactacaaagaaaacatggaggcaatctcgtgcgctgtcctttgagccgaaattccacgcatgaaatgtattgggtatctggagctagcggaaatatcgtaagctcagtaaacactacgtcgaagatgctcctgaataggtttacaactcgacatagaaagcccacttatgaaaaagatgttgacttaggagctggcaccagatcggtaagtaccgaaacagaaaaaccagatatgactatcattggtcgtcgattacaacgcctacaggaagaacataaagaaacctggcattatgatcaggaaaatccatacagaacatgggcgtatcatggcagttatgaagccccctcaactggatcagcatcatctatggtaaatggggtagtaaaacttttaaccaaaccatgggatgtaatacccatggtgactcaattagccatgactgatacgactcccttcggacaacaaagagtattcaaagaaaaagtagacactagaacaccacagccgaaacctggaacgcgcatggtgatgaccacgactgctaactggctatgggccttattaggtaagaagaaaaatccgaggctttgtacaagagaagaatttatctcaaaagtccgatcaaacgctgcgattggcgcggtctttcaagaagaacaagggtggacatcggcctctgaggcagtaagcgactcaagattttgggaattagtagataaagagagagcattacaccaagaagggaaatgcgaatcatgtgtgtataacatgatgggtaaaagagagaagaaattaggagaatttggacgagccaaaggatcacgtgccatttggtacatgtggctaggcgcacgatttcttgaatttgaagcacttggatttcttaacgaagatcactggttcggacgggagaatagttggagcggagtggaaggggaaggccttcataggcttggatacattttggaggaaatagataagaaagacggtgatctaatgtatgcagacgacaccgctggctgggacacgcgtatcaccgaggatgatctacaaaacgaagaactcattacagaacaaatggcaccccatcataaaatattggcaaaggctatatttaaacttacatatcaaaataaggtcgtcaaagtccttcgaccgactcctagaggagcagtaatggatataatatcgcgtaaagatcaaagaggttctggccaagtggggacatatggattgaacacattcacaaatatggaagtacaactgatacgacaaatggaagccgaaggggttataactcaagacgacatgcagaatcccaaagggttgaaggaaagagtggaaaaatggttacgcgaatgcggtgttgacagattaaaacgaatggctatctctggtgatgactgcgtcgtcaagcccttagatgaaaggttcgggacatccttattatttttgaacgatatgggaaaagtccgcaaagatatacctcaatgggaacccagtaaaggttggaaaaactggcaagaagtacccttttgttcccatcattttcataaaatttttatgaaagacggaagaagtctagtagtaccatgtcgtaaccaagatgaattaataggccgcgcccgaatcagccagggagcgggttggtcactacgtgaaacagcatgccttggtaaggcctacgcacaaatgtggtcattaatgtattttcacagaagggatcttcggctagcaagcatggctatctgttccgcagttccaaccgaatggttccctacttcaagaactacttggagtatccacgcacatcaccagtggatgacaacggaagacatgttaaaagtttggaatcgggtttggattgaggacaatccaaacatgatagataaaactccagttcattcttgggaagacattccctacttaggaaaaagagaagatctttggtgtggttctctgattggacttagctctagagccacttgggccaaaaacattcacacagcgatcacacaagttagaaatctcataggcaaagaagaatatgttgattacatgcccgtgatgaaaagatacagcgcaccatcggaatccgagggagtcctatga

SEQ ID NO: 23599 - RNA, 9867 nt, synthetic construct
  misc_feature 1..9867: note = derived and/or modified CDS sequence (opt6) from DENV-4__GQ868585__SS-prME
  source 1..9867: mol_type = other RNA
agcactataacgttgttatgcttaataccaactgtcatggcatttcatctttcaacacgtgatggagaacccttaatgatagtggcaaaacatgaacgcggaagacctttgctatttaaaacgaccgaagggataaacaaatgtactttaatagcaatggacctaggggaaatgtgcgaagataccgtaacatacaaatgtccgttgcttgttaataccgaaccggaagacatagattgctggtgtaatttaacaagcacatgggtcatgtacggaacatgtacccaatcaggagaacgaagaagggagaaacggtcagttgcactaacgccacattctggcatgggtctcgaaaccagagcagaaacatggatgagcagcgaaggtgcttggaaacatgcacaaagagttgaatcatggatcttacgaaatccgggattcgcacttctggctgggtttatggcatacatgattggacaaacaggaatccaacgtacagttttctttgtactaatgatgctagtggctccttcctacgggatgaggtgcgtaggagtgggaaatagggattttgtagaaggagtttcaggaggcgcgtgggtagacctagttcttgagcacggtgggtgcgttactaccatggcccagggaaaacccactctagactttgaattaactaaaacaacagcgaaagaggtagcacttttgagaacttactgcatagaggcgctcatatcaaatataacaacagcaacacgttgcccgactcaaggagaaccgtatttgaaagaagaacaagaccagcagtacatttgtaggagagacgtcgtagatcggggatggggcaatggatgtggcttattcgggaaaggaggagtggttacgtgcgccaaattttcatgttcgggaaagataacaggaaatttagtccagatcgagaacctagagtatacggtagttgttactgtacacaacggggacacgcacgctgtcggtaatgataccagtaatcatggagtgaccgctacaataacaccaagatctccttctgtagaagtaaagctgccagattatggggaacttactcttgactgtgagcctcgtagtgggatagactttaatgaaatgatattgatgaaaatgaagaagaaaacgtggttagtacataaacaatggtttctagatctaccactcccatggactacaggtgccgatactagcgaggtacattggaattataaagaacggatggtaacgtttaaagtaccacatgccaagagacaagatgttacagttttgggatctcaagagggagcaatgcactcggccctagcaggagcaactgaagtagattccggagatgaaaatcacatgttcgcgggtcatttaaaatgtaaggttcggatggaaaaattacgaattaaaggaatgtcgtatactatgtgctcaggaaaatttagtatagacaaagaaatggctgaaacacagcacggcactacagtcgtcaaggtcaaatatgagggcgcaggggcaccctgtaaagtcccaatagagatacgcgatgtgaacaaagaaaaagtagtaggaagagtaatcagcgctacacccttggcagaaaataccaattccgtcacaaatattgaactcgagccgcctttcggtgactcttacattgtaatcggggttggcaacagcgcactcaccctgcactggtttagaaaaggctcctcgattggtaaaatgttcgaatctacatacagaggtgcgaaacgcatggcgattctaggagaaaccgcttgggactttggaagtgtgggagggctgtttacgagcctgggaaaagctgtgcatcaagttttcgggtccgtatatacaacgatgtttggaggcgtatcttggatgatccgaatcttaattggttttctcgttttatggataggaacaaattcaagaaatacctcaatggcaatgacatgcatcgcagtaggcggtataactttatttctgggattcactgttcaggccgatatggggtgtgtagtttcctggagtggccgagaattaaagtgtggtagcgggatctttgtagtcgataatgtgcacacgtggacagaacaatataaattccagccagagtccccggctagactggcctctgctatactaaacgcacataaagatggcgtatgcgggataagatcaactacacgactagaaaatgtaatgtggaaacagataaccaatgaattaaactatgtcctctgggagggaggtcacgatttaacggtagtagccggcgatgtaaaaggagtactaactaaaggtaaaagggccctgacacccccggctagcgatttgaaatattcatggaaaacctggggaaaggccaaaatctttacaccagaagctcggaatagtactttcttaatcgatgggcctgatacgtcagagtgcccaaatgaaaggagagcctggaacagctttgaggtagaagactatggcttcggaatgtttactacgaatatctggatgaagttccgagaaggtagcagtgaagtatgtgaccatcggctaatgtcagcagcaattaaagatcaaaaggcggtccatgctgatatgggttattggatagaaagtagtaaaaaccaaacgtggcaaatagaacgtgcgagtttaatagaggtgaaaacatgtctatggcctaaaacccatacactctggagcaacggagttctcgaatcacaaatgcttataccaaagtcttatgccggaccgttctcccagcacaattatcgccaaggatacgcaacgcaaaccgtaggcccctggcatttgggcaaattagaaatcgacttcggcgaatgtccagggacaacagtaaccattcaagaaaattgcgatcatcgcggcccatcccttaggacaacgactgcttcaggcaaactcgttactcaatggtgttgcagatcatgtaccatgccaccattacgttttcttggtgaagatggatgttggtatggaatggaaatcaggcctttgagcgaaaaagaagaaaatatggtgaaaagtcaagtaacagcaggacagggtacatccgagacgttttctatgggactcttatgtttaacattgttcgtagaagaatgtctaaggcgcagagtaacaagaaagcatatgatactcgcagtggtaattaccttgtgcgccattatattagggggtctgacatggatggaccttttaagagcgctaatcatgcttggcgatacaatgtccggaagaataggcggtcaaacgcatctggcaatcatggcagtgtttaaaatgtctcctggctatgtgttaggggtatttttaagaaagctaacatccagagagaccgcattaatggtgataggtatggcgatgacaacaactttgtctattccccatgatctcatggaactcatagacgggatatctctgggcttaatcttactcaaaattgttactcagtttgataacacccaggtaggaactctggccttaagtctcactttcattcgaagcactatgagtcttgttatggcatggcgtacaataatggccgtactattcgtcgtaaccctaattccgctttgccggacaagttgcctacaaaaacaatcacattgggtagaaatcacagcactaattctgggcgcccaggcgttgccagtttatttgatgacattaatgaaaggtgcttcacgtcgaagttggcctctaaacgaaggaataatggcagtgggacttgtatcattgttaggcagcgcactcttgaaaaacgatgttcctctagctggaccaatggtggcaggcggtctgcttttagcggcgtatgtgatgtccggttccagtgcagacttgtcattggaaaaagctgcgaatgtccaatgggatgaaatggctgatataacaggatcatctccgattatagaagttaagcaagatgaagatgggagcttttcgataagagacgtagaagaaacgaatatgataactctgttggtgaaattggcattgataacagtaagtggactatacccgttagcgataccaataaccatgacgctttggtatatgtggcaagtcaaaacccaaaggtcgggcgcgctatgggacgtccctagtcctgcagctacccaaaaagcagcacttagcgagggtgtctatagaataatgcaaagaggattattcggaaagacgcaggttggtgtaggaatccatatggaaggtgttttccacacaatgtggcacgtaacaagagggtcagttatatgccatgaaacaggtagattagaaccatcatgggctgacgtgagaaatgatatgatctcatacggaggtggttggcgtttaggagacaaatgggataaagaagaagatgtccaagttttagcaatagagcctggcaaaaatcctaaacacgtacaaactaaacccggtctgtttaagacactcacgggtgaaattggagccgtaactttagacttcaaaccaggcacttctggttctccaatcataaacaggaagggaaaggttataggtctatatggaaacggtgttgtgacaaaatcaggcgattatgtatccgcgataacccaggctgagagaataggcgagccagattatgaagtagacgaagacatatttcgcaagaaaagacttacaattatggacctacacccaggcgcaggtaagacgaagagaatactaccgagcatagtacgagaagctcttaagcgacgattaagaacactaattctcgctccgacgcgagttgtagcagcagaaatggaggaagctctgcgcggtttgccaattagatatcaaactccggccgttaagagtgagcatacaggtcgagaaatcgtagacctaatgtgccatgctacattcacgacaagattgttaagcagtacacgtgtaccaaattacaatctcatcgtaatggatgaagcacactttactgatccgtcaagcgtagcagctcggggatatataagtaccagagtggaaatgggggaagcagcggcgatattcatgacggcaacccctcctggtgcaacagatcctttcccacaatctaactctcctatcgaggatatcgaacgtgaaatacccgaacgatcctggaacacgggtttcgattggattacagactatcagggcaaaaccgtatggtttgtacccagcataaaagcaggtaatgacatcgcaaattgcttaagaaaatctggcaagaaagtaatacaactctcaaggaaaacttttgacaccgaataccccaagacaaaacttaccgactgggattttgtagttacaacagatatcagcgagatgggtgcaaatttccgtgcgggaagggtcatagatccacgtaggtgtctcaaaccagttatattaacagatggcccggaacgagtaattctagctggaccaatacctgtgaccccggcttctgctgcacagcggcgcggacgaataggtagaaatccagcacaagaagacgaccagtacgtctttagtggggatccattaaagaacgatgaagaccatgcacattggactgaggctaaaatgttattagataatatatacactccagaaggcattattccaactctattcggaccagagcgagagaaaactcaggcgatcgatggtgaatttcgcttgagaggggaacagaggaaaacctttgttgaactaatgagacgaggcgatctaccagtttggcttagctacaaagttgcaagcgccggcatttcctataaggaccgagaatggtgttttaccggggagagaaataaccagatactcgaggaaaatatggaagttgaaatatggacacgtgaaggtgagaagaagaaacttcgaccaaaatggctcgatgctagagtatatgcagatcctatggcgctaaaagactttaaagagttcgcgagcggccgtaaatcaattaccttggatatcttaacagaaatcgcatcattgccgacctatttaagtagccgtgcaaaactagccctagataatatcgtaatgttacacacaacggaacggggtggacgcgcatatcagcatgcactaaacgaattaccagaatccttagaaaccttaatgttagtagcacttctgggagcaatgactgccggaatatttctctttttcatgcaagggaaaggtattggcaaattatccatggggttgattacgatagccgttgcaagcggactattatgggtagctgaaatacagccgcaatggattgcggcatcaataatattagaatttttcttaatggtactcctaataccagaaccagaaaaacaacgtacaccgcaagacaatcaattgatatatgttatcctgactatactcacgattatcggtcttatagcagctaacgaaatgggattaatagagaaaacaaaaacagattttggattttaccaagttaagacagagactaccatactagatgtagatctccgaccggctagtgcatggactctatatgcagtagcaacgactatcctcacaccaatgctgaggcatacgattgaaaatacatcagcaaatctcagtcttgcagccatagccaatcaagcagcagttctaatgggtctaggtaaaggatggcctttacatcgaatggatctaggagttccattactagcgatgggttgctatagtcaagtaaatccgactacactgacagcctcattagttatgttattggtccactatgctattataggacctggattacaagctaaagctactagagaagcgcagaaacggacagccgcaggtattatgaaaaatccaaccgttgatggtataacggtaatagatctagaaccaattagttacgaccctaaatttgaaaaacaattgggacaagtgatgttactggtcttatgtgcgggtcagcttcttctaatgcgaacgacttgggcattttgcgaagtactcactttggcaacaggaccaatactcaccctttgggaaggcaatccaggaagattttggaacaccaccattgctgtttcgacagctaacatttttcgaggaagttacctggcaggggcaggtctagcattctcactaatcaaaaatgctcaaactccaaggcgaggaactggaacaactggggaaacactgggagaaaagtggaaaagacaattgaacagcttggaccgtaaggagttcgaagaatacaaacgaagcggaatacttgaagttgaccgtacagaagcaaaatcagcccttaaagacggatcaaagataaagcatgcagtgtcccgaggaagtagcaagattagatggatcgttgaacgtggcatggtcaagccgaaaggtaaagtaattgatttgggttgtggacgaggagggtggagttactatatggcgacgctcaaaaatgttaccgaagtcaaaggctatacaaaaggagggccggggcacgaagaaccaataccgatggcaacatatggatggaatctagtaaaacttcacagcggagttgatgtattctataaaccaactgaacaggtagatactttactttgtgatataggagaaagcagttcaaatccgaccatcgaggaaggaaggacactgagggttctcaaaatggtcgaaccttggttaagcagtaaacctgagttttgtataaaagtgttgaatccatatatgcctacggttattgaggaattagagaaattacagagaaaacacggaggtaatctagtgaggtgtccgttgtcacggaactccacgcacgaaatgtattgggtatcaggcgccagtggaaacattgtttcatcagtgaatacaacaagtaaaatgctcttgaacagatttacaacaaggcatagaaaaccgacctatgaaaaagatgtcgatttaggagccggaacgagatccgttagtacagaaacggaaaaacctgatatgaccataataggccgacgcctccaacgtcttcaagaggaacacaaggaaacatggcactatgatcaagaaaatccatatagaacttgggcatatcatggttcatacgaagcacctagtacgggctcagcgagcagtatggtcaatggggtagtcaagttactgacaaagccatgggacgtgattccaatggttacacagttagccatgactgacaccacgccgtttggtcagcagagagtctttaaagagaaagtggacacacgaacaccacaacccaaacctgggacaagaatggtgatgaccaccacagctaactggttgtgggcattactaggtaagaagaaaaatcccagactatgtacacgagaagaatttatttcaaaagttaggtcaaatgcggccataggagctgtttttcaagaagaacagggttggacgtccgcaagtgaggctgtcaatgacagccgattttgggaattagttgataaagaacgtgctctccaccaagaaggaaaatgcgaatcgtgcgtttacaatatgatgggaaaaagggaaaagaaacttggtgagttcggtagagcaaaaggatcgagggcaatatggtacatgtggttaggagctaggtttttagagttcgaagcactcggatttttaaatgaagaccattggtttggacgagaaaacagctggtcaggagtggaaggcgaagggttacacaggctagggtatatattagaagaaatcgacaagaaagacggcgatctaatgtacgctgatgatacagctggctgggatacccgaataactgaggatgatctgcaaaacgaagaactaataactgaacaaatggcaccacatcataaaatattagcaaaagccattttcaagctaacttatcaaaacaaagtagtaaaagttttaagaccaacgcctaggggagcggtaatggacattataagtagaaaggaccaaagaggatctggacaagtgggtacatacggattaaatacatttacaaacatggaggtacagttaataagacaaatggaagctgaaggtgttattactcaggatgatatgcaaaatcctaagggcttaaaggaaagagttgaaaaatggctccgggaatgcggtgtagaccgcctaaaaagaatggccatatcaggagacgattgtgttgtcaaaccattggacgaaagatttgggacaagtctactcttcctcaatgatatgggcaaagtacgcaaggacatccctcagtgggaaccatcaaaaggatggaaaaattggcaagaggtacctttctgctctcatcatttccacaagatatttatgaaggatggtcgtagccttgtggttccgtgtagaaaccaagatgaattaataggaagggcaagaattagtcagggggcaggctggagtcttcgagaaacagcttgtcttggcaaggcttacgcccaaatgtggtcattaatgtatttccatcgacgcgatttaagattagcatccatggctatttgtagtgccgttccgaccgaatggttccccacctcacgaacgacttggagcatccatgctcaccatcaatggatgacaactgaagacatgcttaaagtatggaatagagtatggatagaggacaatcccaacatgatagataaaaccccagtacactcgtgggaagatataccgtacctaggcaaacgggaggatctatggtgcggtagcttaattggcctgtcaagtcgagcgacttgggctaaaaacattcatacggcaataacgcaagtaagaaaccttataggcaaagaagaatatgtagattatatgcccgtaatgaaacgatactcagcacctagcgagtcagaaggcgtgttataa

SEQ ID NO: 23600 - RNA, 9867 nt, synthetic construct
  misc_feature 1..9867: note = derived and/or modified CDS sequence (opt6) from DENV-4__JQ922560__SS-prME
  source 1..9867: mol_type = other RNA
tcaaccattaccctattgtgtttaattcctacggtaatggcgtttcacctaagtacacgtgacggggaaccactaatgatagtggcaaaacatgaaagaggtagacgattgctctttaaaaccaccgaaggtataaataaatgcactttaatagcaatggacctaggagaaatgtgtgaagatacagtaacatacaaatgtccccttcttgtgaacactgaacctgaagatattgactgctggtgtaacttaacgagcgcatgggtaatgtatggaacatgtacacaaagcggagaaagacgtcgagagaaaaggagtgttgcgcttacaccacactccggaatgggattagaaaccagggccgaaacatggatgagctccgagggggcatggaaacacgcacaacgggttgaatcatggatcctcagaaatccgggctttgctctcctagctggatttatggcctatatgataggacaaacggggattcagagaacagtgttctttattttaatgatgctcgttgcaccttcatacgggatgagatgtgtaggagtcggaaatcgagacttcgtagaaggagtttctggaggagcttgggttgatctcgtacttgaacacggaggttgtgtcactaccatggcccagggcaaaccaaccctggattttgaattaatcaaaacaacggccaaagaggtagctctattaagaacttattgtatcgaagctagtattagcaatataacgaccgcaacaagatgtccgacacaaggtgaaccatacctaaaagaagaacaggaccaacagtatatttgtcgtagagacgtcgttgatagaggatggggaaacgggtgtggactattcggtaaaggaggtgtagttacatgtgcaaaattttcctgcacgggaaaaataaccggaaatctaattcagatcgaaaaccttgaatataccgtagtggtcaccgttcacaatggagacacgcatgctgttggtaacgacacgtcgaaccatggagtaacagctaccatcactcctagatcgcctagtgtagaagtcgaactgccggattatggagaactaacactagattgtgagccgcgcagcggcattgattttaatgaaatgattctcatgaaaatgaataagaaaacttggctagtacacaaacaatggtttctagacctacctttgccttgggctgcaggagccgacacatccgaggtacattggaaccacaaagagcgaatggttacatttaaagtaccacatgcgaaacgacaagatgtaactgtattaggaagtcaggaaggtgcaatgcactcagcattaactggagccacagaagtatatagtggagatggaaatcttatgtttgctggccacctcaaatgtaaagttcgcatggagaaattgagaattaaaggcatgtcctacaccatgtgtagtggtaaattctcaatagacaaagaaatggcagaaacacagcatgggacaacagtcgtaaaagtgaaatacgaaggcgcaggcgcaccctgtaaggtaccgatagaaattagagacgtgaacaaggaaaaagttgtagggagggtgatatcttcaacaccctttgcagagaacaccaactcagttactaacattgaacttgagccccctttcggtgattcatacatcgtcataggcgtaggcgacagtgcactgacacttcattggtttacaaaaggaagctcaattgggaagatgttcgagtcaacatacagaggagctaagagaatggctatcctaggggaaacagcatgggactttggcagcgtaggaggcctattgactagcttgggtaaagccgttcatcaagtgttcggttcagtctatacaaccatgtttggaggagtatcatggatggtacgaatactgataggattcttggttttgtggattggtacgaatagtcgtaatacttcaatggcaatgtcgtgtattgctgtcggagggattacactattcctaggattcactgttcatgcagacatggggtgtgccgtctcatggtctgggaaagagctaaagtgtggatcaggaatttttattattgataatgtacatacatggacagaacaatacaaatttcaaccagaaagccctgcacgattggcatcagcgatattgaacgctcacaaggatggagtctgcggaatccgctctacaacacgacttgaaaatgtcatgtggaaacaaattacaaatgagcttaattatgtcctatgggaaggcgggcatgatttaactgtggtagccggtgatgtgaagggagttcttagtaaaggtaaaagggctctagcaccaccagtaaacgatttaaaatatagctggaaaacatgggggaaggctaagatatttacccctgagactagaaactcaactttcttaatcgacggacctgataccagcgaatgccctaacgagcgccgtgcgtggaatttcttagaagtagaagattatggatttggtatgttcaccactaacatttggatgaagtttcgagaaggtagttccgagatgtgtgatcacaggcttatgagtgctgccataaaagatcaaaaagccgtacatgcggatatgggatattggatagagagtagcaaaaaccaaacatggcagatagaaaaggcaagtttaattgaagtaaaaacttgtttatggcccaaaacacatacactatggagtaatggagttctcgaaagccaaatgttgataccgaaagcatatgctggccccttcagccagcacaactatcgacaaggatatgctacacaaacagtaggtccttggcatttgggtaagctcgaaattgactttggagaatgccccggaaccacggttactatacaggaggattgcgatcaccgaggtccttccttgcgaacgacaacagctagtggtaagttagtcacacaatggtgctgcagatcctgtacgatgcctccactcagattcctaggtgaagatggttgctggtatgggatggaaataaggcctttaagcgagaaagaagaaaacatggtgaagtctcaggtatctgcgggtcaggggactagcgaaacttttagcatgggtctactatgtttaactttatttgtcgaggaatgtctacgtagaagagtcactcggaaacacatgattttggtcgtagtaacaacactatgtgcgattatactaggcggtctaacatggatggatttactaagagcccttattatgctaggtaacactatgtcaagccgcatgggaggtcaaatacacttggcaataatggcggtctttaaaatgagtccaggatacgttttggggatatttctacgcaaattaacgagtagggaaacagcactcatggttatcggaatggccatgacgaccgtactctcaataccacacgatctaatggagttcgtagatggaatttcccttgggctaatattactaaaaatggtaacgcattttgacaatactcaggtagggacgctcgctttgtctttaacttttataaaatcgacgatgccgttggtcatggcatggcgtaccattatggcagtactatttgttgtaacactaatacccttgtgccgaacatcgtgtctacaaaaacaatcccattgggtcgaaattacagccttaatcttaggggcacaagctctacctgtatatcttatgacgcttatgaaaggagcaagtaaaaggagctggcctttgaatgaaggaatcatggctgtcggcttagtttccttgcttggatcagcgctacttaagaacgacgtccctctagctgggcctatggtagcaggcgggttactgcttgccgcatatgtcatgtctggatcatcagccgacttaagccttgaaaaggcagctaccgtccaatgggacgaaatggcagatatcaccggttcgtcacccattattgaagtgaaacaagacgaagacggctcatttagtataagggatgtggaagaaactaatatgatcacgttgctcgtaaaattagcccttatcacagtttcgggtttatacccgttagcaatacccgttactatgactttatggtatatgtggcaagtaaaaacacagcgaagcggcgccttgtgggacgtaccatcgccagcagcggctcaaaaagccacattaacagaaggtgtctatcggataatgcagcgagggttatttggcaaaactcaagttggtgtaggaatacatatggaaggggtgtttcacactatgtggcacgtgacaagagggtcagtaatatgtcatgaaagtggaagactcgaacccagctgggcagatgtaaggaatgatatgataagttacggaggtggatggagactaggtgacaaatgggataaagaagaagatgtacaggttctagcggtggagccgggtaaaaatcctaaacacgtacaaacgaaaccaggactgtttaagaccttaactggggaaatcggggctgtaacattggacttcaagccagggacatccgggtcaccgataatcaataggaaaggaaaagtaataggactgtatgggaacggagttgttacaaaatcgggagactatgtgtctgccataacacaagctgaaaggattggtgaaccggactatgaggtagacgaagacatatttaggaagaaaagattaacaattatggatctacatccaggggccggcaaaacaaagaggatcttgcctagcatagtaagggaggctttgaagaggaggcttcgcacattaatattagccccgactagagttgttgccgcggaaatggaggaggctttaagggggttaccaatccgttaccagactccggctgttaaatcagaacacacaggtagagaaatcgtcgacttaatgtgtcatgcaacttttaccacacgtttgttatcatcgacaagggtacctaattataacttgatagtaatggatgaagcacattttacagatccatcgagtgtcgccgcacgggggtacatttcaacccgggtagaaatgggtgaagcagcagcaatatttatgactgctacaccaccaggaacgacggatccattcccacaatcgaatagcccaatagaagacatagagagagaaataccggaacgttcgtggaatacagggtttgactggatcacagattaccaaggtaagaccgtgtggttcgtgccttcaataaaagcaggaaatgatatcgcgaactgcctaagaaagtcaggcaaaaaggttgtacaattgagccgaaaaacatttgatacggaatatccgaagacaaagttaacagattgggattttgtagtaacaacggatatcagtgaaatgggggctaactttagggcaggtcgagtgattgatccaaggcgatgtctaaaaccggttatcattacggatggcccagaacgtgtaattctagcaggaccaataccagtaaccccagcgagcgccgcgcaaagaaggggacgcatcggcaggaatccagctcaagaagatgaccaatacgtatttagcggagacccattaaggaatgacgaagatcatgctcactggaccgaagcaaaaatgttgctagataatatatatacgccagaaggtataataccaactctgtttggacctgaacgtgagaaaacccaagcaatagatggggaatttagattaagaggagaacaaagaaaaactttcgttgaattgatgaggagaggcgatctaccagtgtggttgagttataaggtggcctcagcaggaatctcttataaagatagagagtggtgttttactggagaaaggaataatcaaattttagaggaaaatatggaagtagaaatatggactagggagggagagaagaagaagttgagaccaaaatggctagacgccagagtatatgcggatcctgtagcattgaaagattttaaagagtttgcatcagggcgtaaaagcataacgctcgacatactcaccgagattgcgtcgttaccaacttatctttcatccagagcaaaattagcgttagataacattgtaatgttacatactacggaaagagggggaaaagcataccaacatgccctaaatgaattgccggaatcattagagacattaatgctaatagctctcttaggtgcgatgacagcaggtatatttttatttttcatgcaaggcaaagggatgggcaagttatcaatgggattaattgcaattgctgttgcaagcgggctgttgtgggtggcagagatacaacctcaatggatagctgccagtattatcttggagttctttctaatggctctactgattccagaacctgagaaacagaggactccacaagacaaccaactgatatacgttatcttaacaatattaaccataataggacttgtagcagctaacgagatgggtctgatagaaaagactaagacagactttggtttttatcaagagaaaaccgaaactaccatacttgatgtggatttaagaccagcaagtgcatggactttgtatgcggttgcgacaacaatacttactccaatgttacgtcatacaattgaaaataccagtgcaaacctgtctctagcggcaattgcaaatcaagctgcagtgctcatgggactaggtaaaggttggcctctccaccgaatggatttaggcgtaccattattagccatgggatgctattctcaagtgaatccaaccacactaacagcctcattagtgatgctgttagtccactatgcgataataggacctgggttacaagcaaaggcgactcgagaagcacagaagagaacagctgccggaatcatgaagaatccgactgttgatggtattacagtaatagatctagaacccataagttatgaccccaagtttgaaaagcaactaggacaagttatgctattagttctttgcgcaggacaattgttattaatgaggactacgtgggctttttgtgaagtccttacactagccactgggcctatcttgactctatgggaagggaatccagggcgattttggaataccactatagctgtgtctaccgcaaatatattccgaggtagttatctagctggagccggtctagcgttctctctaattaaaaacacacaaaccccgcggcgcggcactgggaccactggagaaacattaggagaaaaatggaaacgacagcttaatagtcttgatcgtaaagagttcgaagaatataagcggagcgggattttagaagtggatagaacagaagcaaaaagtgcattaaaagacggatctaaaataaaatacgcagtgtcaagaggaacttcaaaaatacgttggattgtggagaggggaatggttaaaccaaaaggtaaagtggtagatcttggatgtggccgtggaggatggagttactatatggcaacccttaaaaatgtaacagaagtgaaaggatatacaaagggtgggcccggacacgaagaaccaattcccatggccacgtatggatggaacctagttaaactacactcaggagttgacgtattttataaacccacagaacaagtggatacgctcctatgtgatataggggagagttcatcaaacccaacaattgaagaaggacggacactacgcgttctaaaaatggttgagccttggctttccagtaaaccagaattttgcattaaagtacttaatccatacatgcctacagttatagaagagttagaaaaattgcaaagaaaacatggcgggtcgttagtgagatgcccattatctaggaatagcactcatgaaatgtactgggtctcaggtgtatcaagaaacatcgtaagtagtgtaaacacaacatcaaaaatgctattaaataggtttacgactcgttatcgcaaaccgacttatgaaaaagatgcagacttgggcgcaggtacaagatcagtcagtacagaaacagaaaaacctgacatggcgataatcggtcgaagacttcaacgtttgcaagaagaacataaggaaacgtggcactatgaccaggagaacccctatagaacgtgggcttaccatggtagctatgaagccccatctaccggctcagcaagcagtatggtaaatggcgttgtaaagctattaaccaagccctgggacgtagttccaatggtaactcagcttgctatgactgatactactcctttcggtcaacaaagagtattcaaagaaaaagttgacacgcgaacgccacaaccgaaaccaggtactcgcatgataatgactactactgcaaactggctttgggccctgttaggtaagaagaaaaatccacgcctttgtacaagagaagagtttatctctaaagtaagaagtaatgcagctataggagctgtgtcccaagaggaacaaggttggaccagtgcaagcgaggctgttaacgattcaagattctgggaacttgttgacaaagaaagagcactgcatcaagaaggcaagtgcgaaagttgtgtgtacaacatgatgggtaaacgtgagaagaaactaggcgaatttggcagggctaaaggtagtagggccatctggtatatgtggctaggcgccaggttcctagaatttgaggcattgggatttctaaacgaagatcactggtttggacgggaaaacagctggtcgggagttgaaggagagggacttcatagacttggatatattctggaagacatcgacaagaaagatggggacctaatctatgccgatgacacagcaggttgggacactagaattacagaagatgacttacttaacgaggagcttataacagaacaaatggcaccacatcataaaatcctagctaaggcaatatttaaattaacataccagaacaaagtcgtaaaagtattaagaccaactcctaagggcgctgtaatggacataatcagcagaaaggatcagagagggtcgggccaagtgggcacttatggacttaacacattcacgaatatggaagtccagctaattagacaaatggaagcggagggagtaatcaccagagatgatatgcataacccaaaagggctaaaagaaagagtagaaaaatggctaaaagaatgtggagttgaccgacttaaaagaatggctattagtggggatgattgtgtggtaaaaccactcgacgaaagattctctacttctttactatttcttaatgatatgggtaaagtaagaaaagatataccgcaatgggaacctagcaaaggttggaagaactggcaagaggtacctttttgctctcatcacttccataaaatctttatgaaggacggtaggtctcttgtagtaccatgtcgaaaccaggacgaactcattggacgtgcacgaataagtcaaggggcaggttggagtttaagagaaactgcctgcctgggaaaggcttacgcacaaatgtggtccttaatgtattttcaccgcagagacttacgactcgcttcgatggcaatatgcagtgcagtccctaccgaatggtttcctacatcacgaactacatggagcatacacgcacaccaccaatggatgaccacagaagatatgttaaaagtgtggaatcgcgtttggatagaagacaacccaaacatgactgacaagacgcctgttcactcgtgggaagacatcccctacttaggaaaacgtgaagatttatggtgtggatccttaataggtttgtcatcacgagctacctgggcaaagaacatacatacagcaattactcaagtgaggaatctgatagggattgaggaatacgtcgattacatgcctgtcatgaaaagatattctgctcccttcgaatccgagggagtgctataa

SEQ ID NO: 23601 - RNA, 9867 nt, synthetic construct
  misc_feature 1..9867: note = derived and/or modified CDS sequence (opt6) from DENV-4__JQ922558__SS-prME
  source 1..9867: mol_type = other RNA
tcgacgcttactctactttgtttaatacccaccgtgatggcgtttcatttaagcacccgcgatggagaaccgctcatgatagttgcaaaacacgaaagaggtagacccttattatttaaaaccactgaagggatcaacaaatgcaccttgatcgcaatggacttaggagaaatgtgtgaagatacagttacttataaatgtccactattagtcaatacagaaccagaagacatcgattgttggtgtaatttaacttcaacttgggttatgtacggtacatgcacacaatccggagaaagacgaagggaaaagaggtcagttgcactgacaccccactcaggtatgggactagaaactagagcggaaacgtggatgagttccgaaggggcatggaaacatgctcaaagagttgaatcttggatcttacgaaaccctggatttgcactgttggctggatttatggcatatatgataggacaaaccggtatacaaaggaccgtattctttgtcctaatgatgctagttgcaccaagttatggaatgagatgtgtgggagtcggcaatcgagactttgtggaaggagtaagcggaggtgcatgggtagatctagttctagaacacggaggatgtgtaacaacgatggcacaaggaaaaccaacacttgatttcgaactcataaaaacaactgcgaaagaagtggccttgctaagaacatactgcatagaggcttccatatccaatataacaaccgccactagatgcccgacgcaaggagaaccatacctaaaagaagaacaagaccaacagtatatctgtagacgagatgttgtagatcgaggctggggaaatggctgtggattattcggaaaaggaggagtggtaacctgcgcaaaattcttatgtctaggaaaaattactggaaacctcgtccaaattgagaacttagaatatacagtagtagttacagtccataacggagacacccatgcagtaggaaacgatatatctaatcatggggtaactgcaacgataaccccacgatcaccaagcgtagaggtgaaattgccagattacggagaattgacgctcgattgcgaacctagatctgggatagactttaatgagatgatacttatgaaaatgaaaaagaaaacatggctagtacataaacagtgggtattagatttacccttaccctgggcagcaggggccgacacaagtaaagtacaatggaattacaaagaaaggatggtaacattcaaggttccacacgcaaaacgtcaagatgtgacagttcttggcagccaagagggagctatgcatagcgccttgaccggtgctacagaagtcgattccggcgatggtaaccatatgttcgcggggcacttaaagtgtaaagttagaatggaaaaactgaggattaagggaatgagctatacaatgtgttcaggcaaattctcgatagataaagagatggcagaaacacaacatggtacaacagtcgtcaaagtaaaatacgaaggagcaggagcaccctgtaaagtaccaattgaaatcagagatgttaataaggaaaaggtggttggaaggataatatcttcaacgccgtttgcagaacacacaaacagcgtgactaacatagaattggaaccaccattcggagattcctatatagtcataggtgttggtgattccgctctaacgttacattggtttcgtaaaggctcctccatcggaaagatgtttgaatccacttacaggggcgctaagcgcatggcaatcttgggggaaacagcatgggatttcggatcggtcggaggactatttacttcattaggaaaagccgtgcatcaggtattcgggagcgtatacacaacaatgttcggtggagtcagttggatggtacgcatactaattggattgctagttctctggattgggactaactcgcgaaatacttccatggcaatgacatgtatagcaataggagggatcactttgtttctaggatttactgttcatgccgatatgggttgcgcagttagttggagtgggaaagaactcaaatgtggctcaggtatatttgtggtagataatgttcatacttggacagagcaatacaaatttcaaccggaatcgcccgcacgactagcctcggcaatattaaatgcacataaagacggagtttgcggaattagaagtacgacaagattagagaatgtaatgtggaaacaaatcacaaacgaattaaattacgtattatgggaaggcggacatgatttaacagtcgtagcaggcgacgttaaaggcgtgttgacaaaaggaaagcgagctttaacaccacccgtgaatgatctaaagtatagttggaaaacttgggggaaggcaaaaatattcacccctgaggcgagaaatagtacatttttaatcgatggtccagacacgtcagaatgtccaaacgaaaggagagcatggaatttcctagaagttgaagactatggattcggaatgtttactacgaatatctggatgaagtttagagaaggatcatcagaggtctgcgaccataggctaatgagtgccgcgatcaaagatcagaaagcagtccatgctgatatgggatattggattgagagcagtaaaaatcaaccctggcaaattgggaatgcatcattgatagaagtaaagacttgtttatggcccaaaacacataccttatggtcaaacggcgttctcgaaagtcaaatgctgataccaaaggcttacgctggacccttcagtcaacataattataggcagggctatgcaacacaaactataggtccttggcatctgggtaaactagaaatagactttggcgagtgcccagggacaaccgtgacaattcaagaggactgtaatcatagaggtccctcgttgcgaacaacaacagctagtggtaaactggtgacgcaatggtgttgcaggtcatgtaccatgccacccctgcggtttcttggggaagatgggtgctggtacggaatggaaattaggccactcagtgaaaaggaggaaaacatggtgaaatctcaagtcagtgcaggacaaggcacttctgagaccttttctatgggcctactctgcctaaccctatttgtagaagagtgcttacgacgaagagtaacacgcaaacatatgattttggtagttgttactacattatgtgctatcatccttggaggattaacttggatggatttgcttcgagctttaataatgctgggagatactatgtccggtagaatgggtggccaaattcatttgacgataatggctgtttttaaaatgtctccaggttatgttttaggtgtttttctaaggaaactaactagcagagaaactgcattaattgttataggaatggccatgactacagtcttgagcataccgcacgatctgatggagttcatcgacggtatctccctaggtttaattcttctcaaaatggtagcacacttcgacaatactcaagtaggaacattagccctatcgctaacattcatacggtcaactatgcctctcgtgatggcatggcgaacaataatggcagtgttatttgttgttactttgatacctctgtgtcgcaccagttgtctacaaaagcaaagtcattgggttgagataacggctctaatattaggagcacaagcattaccggtttatcttatgacattaatgaagggggcgagcaaaaggagctggccccttaatgagggaattatggctgtcggcttagtgtcccttttagggtcagctctacttaaaaacgacgtaccactagcaggacccatggtcgcaggaggactactattagcggcttatgtaatgagcggatccagtgcggacctatctttagaaaaagcagctaatgtacattgggatgaaatggctgacataacaggaagttcaccaattatcgaagtcaaacaagacgaggacggttctttcagcatcagagatgttgaggagacgaatatgattacgcttttagtaaaactcgctctgataacagtgtcgggactttaccctcttgcgattcctgtcacaatgacactctggtatatgtggcaggttaaaacgcaaaggagcggtgccctatgggatgtaccttctccagccgccgcccagaaggcaacactcacagaaggagtatatagaataatgcagcgaggattattcggtaagacccaagtaggagtggggattcatatggaaggtgtttttcacactatgtggcatgtgacgagaggctccgtaatctgccatgaaactggtagactcgaaccaagctgggccgatgtaagaaatgatatgatctcctacggaggagggtggcgtctgggagacaaatgggacaaagaagaggacgtgcaggttttggcaatcgaacctggcaaaaatcctaaacacgtacaaactaagccgggactcttcaaaacattaacgggggaaataggagccgttacattagacttcaaaccgggaacttctggaagcccaattattaataagaaaggtaaagttattggactgtatggcaatggagtcgttacaaaaagtggggattatgtatctgctattacacaggccgaaagaatcggggatcctgattacgaagtcgacgaagatatttttcgtaagaaaagacttaccataatggacctacaccctggtgcgggaaagaccaagagaatcctcccctctatagtaagagaagcactaaaaaggaggttaagaacgctgatcctagcgcctacgagagtagttgctgccgaaatggaagaggctttacgtgggttgccgattagatatcaaacacccgcagttaagagtgagcacactggaagagaaatagtagatttgatgtgtcacgccacgtttacggctaaccctttgagtagcacacgagtaccaaactataaccttatagtaatggatgaagcacatcttcaagatctttctatcgttgctgccagaggatacatatccactcgtgtagaaatgggagaagcggcagctattttcatgacagcaaccccaccaggagctacggatccttttccacaatcaaatagtcccatagaggacatagaacgagaaattcccgaacgatcatggaatacagggttcgattggattactgactatcaaggtaaaacagtttggtttgtcccttcaattaaagcaggaaacgatattgcaaactgtttgaggaaatcgggcaagaaagtgattcaactaagcagaaagacattcgacacagaatatcctaaaactaagctcacagactgggattttgtagtgactacagacatatctgaaatgggagctaactttcgtgcacggcgcgtaatagacccccgacgatgtttgaaaccagtaatcctaacagatggacctgagagagtcatactagcaggcccaatacccgttacaccagcctctgcagctcagcgtagaggtagaatcggtagaaatcccgcccaggaggatgaccagtacgtattctctggcgatccactcaaaaatgatgaagatcacgctcattggacggaagcaaaaatgctccttgataacatttacactccagaaggaataatacctaccctattcggcccagaacgagagaaaattcaggcgattgatggcgaatttcgattgcgcggagaacaacgtaaaacattcgtagaactgatgaggagaggagatctgccagtatggttaagttataaggtcgcatctgccggtatatcgtataaagaccgagagtggtgctttactggagaacgtaataatcaaattctagaagaaaatatggaggtagaaatttggacaagagaaggtgagaagaagaaattgagaccaaagtggttggacgcccgcgtttacgctgaccccatggcgctaaaagactttaaagaatttgcttctggtcgtaaatcaattacactagacatacttacagaaattgcgagcctccccacttacttaagttctagggcgaaattagcgctcgataacatagttatgttacacaccacagaacgaggtggaagggcataccaacatgcattaaacgagctaccggaatcgttagaaacactcatgcttgtggcgttgttaggagcaatgacggcgggaatatttctattctttatgcaaggcaaaggaataggaaaactatctatggggttaatggctatagccgtggcaagtggtcttctatgggtagctgaaattcaaccgcagtggatagcagccagcataatccttgaatttttctcaatggctttactgatacctgaaccagagaagcaaagaacaccacaggacaatcaattaatatatgttattctaacaatactaacaataattggactaatagcagcgaacgaaatgggcttaatagagaaaactaaaacagattttggtttttatcaagttaagaccgaaactactattcttgatgtagatttgaggccggcaagtgcttggacactttatgcggtggcgactacaatactgacacccatgttaaggcatactatagaaaatacatctgccaatctttcgttagcggccatcgccaatcaggctgccgtgttgatgggccttgggaaagggtggccactacacaggatggacttaggagttccattacttgcaatgggatgctatagccaagttaacccaacaactctaactgcttcgttagtaatgctgtctgttcattacgccataatcgggcccggattacaggccaaagcaacaagggaggcccagaaaagaagtgcagctggaataatgaagaatcctaccgtagatggaataaccgtaatagatctagagccaatatcatacgacccaaaattcgaaaaacaactcggccaagtaatgttacttgcattatgtgccggccaattgttactcatgagaacgacatgggctttctgcgaagtattaactctagcaactgggccaattttaaccttatgggaaggaaatccaggaagattttggaacacaaccatacccgttagtactgccaatatttttagaggatcgtatcttgccggtgctggactagctttctcacttattaaaaacgcacagactccccgacgaggaaccggaacgaccggtgaaactttgggcgaaaaatggaaacgacaactaaattcattagatagaaaggaatttgaggaatataaaaggagcggtatattcgaagttgatagacatgaaatcaaatatacacttaaagatgggtcaaaaataaatcacgcaatgtcaacgggctcaattaaaataagaggaattgatgaacgaggaatggtcaaacctaaggggaaagtggtagaccaaggctgtggacgtggcggctggtcacactatactgcgaccgctaagaaagtaacagaggttaaaggttatacaaagggcggccccggccatgaagaaccgattccaatggctacatacggatggaatctggtcaaactccactcaggagttgatgttttctataaaccaactgaacaagttgacaccttgctatgcgacattggggagagttcgtcaaacccaacaatcgaagagggtcgaacactcagagttttgaagatggttgaaccatggctatcatcaaaacctgaattttgtatcaaagtgttaaatccatacatgcctacggtcatcgaagaattagaaaaattacaaaggaaacacggcgggtctttagtacgctgtccattatcaagaaactctacacatgaaatgtactgggttagtggtgttagcggcaatatcgtttcttcagtcaatacgacaagtaaaatgctactcaatcggtttaccacccgccatcgcaagccaacatatgaaaaagacgtagaccttggagcaggtaccagatcagtgtcaattgaaactgagaagccagatatgactatcataggcaggagactacaaagactaagagaggaacataaggaaacgtggcactatgaccaagaaaacccttaccgaacatgggcatatcacggttcatatgaagctcctagtactggatccgcgagctctatggttaatggagtcgtaaagctattgacaaagccatgggacgtaatacccatggttacacagctcgctatgacagacacgaccccatttggtcagcaaagagaatttaaagaaaaagtatatacaagtactccccacccgaaaccatggaccagaatggttatgaccacgacagcgaactggctgtgggctttaggagggaaaaagaagtcgccacgtctgtgcacatgggaagagttcatcagcaaagtccgatcgaatgcggctataggagcagtattccaagaagaacaaggttggacatccgcttcagaagcggtaaatgattcccgattttgggagttggttgataaggaacgtgccctccaccaagaaggtaagtgcgaaagttgcgtatataacatgatggggaaacgagagaagaaacttggagaatttggaagggcaaaaggaagccgagcaatttggtatatgtggctaggggcaagatttttagagtttgaagcactcggatttttaaatgaggatcattggtttggacgcgaaaactcttggagcggtgttgaaggagagggattacacagattaggatatatactagaagatatagataagaaagacggggatttaatctatgcagatgatacagcgggatgggatacaagaataactgaagatgatctactgaatgaagaacttatcacagaacagatggctccacatcatagaatactagcaaaagctatatttaaactgacgtatcattccaaagtgatgaaagtcctacgacctacaccgaaaggagcagttatggatataatctcaagaaaggatcaaagaggatcaggtcaggtcggaacttatggactaaatacatttactaacatggaagtacaattaatacgacaaatggaggccgaaggagttatcactcaagacgatatgcaaaatcccaaagggctaaaggaaagggtggagaaatggcttaaagaatgcggcgtggaccgattaaaaaggatggcgatttcgggcgatgactgcgtagttaagcctctagatgagcgatttagcacatcattactctttctaaatgatatgggcaaggttaggaaagacataccacaatgggaaccttccaaagggtggaagaattggcaagaggtaccattttgcagccaccattttcacaaaatctttatgaaagatggtagatcactcgtcgtgccatgtcgtaaccaagacgaattaataggccgtgccaggatcagtcaaggagcaggatggtccctaagagaaacagcatgtctagggaaagcctacgctcaaatgtggagtctaatgtactttcaccgacgggacctgcgtcttgcgagtatggcgatatgttcagctgtcccgaccgaatggtttccaaccagtagaaccacatggtcaatccacgctcatcatcaatggatgacaaccgaggatatgttaaaagtttggaaccgcgtctggatagaagacaatcctaatatgaccgacaaaacacctgtacattcctgggaagatgtaccctacctaggaaaaagagaagatctgtggtgcggttctcttatcggactatcttcacgggctacgtgggcgaagaacatacatacagcaatcactcaggtacggaatctaattggaaaagaagaatatgtcgactacatgccagtaatgaaaaggtatagcgctccaatagagtcagagggagtcttatag

SEQ ID NO: 23602 - RNA, 9867 nt, synthetic construct
  misc_feature 1..9867: note = derived and/or modified CDS sequence (opt6) from DENV-4__JQ922559__SS-prME
  source 1..9867: mol_type = other RNA
tcaacgataactctcctctgcctcatacctacggtgatggcttttcacttgtcaaccagagatggtgaacctctaatgatcgttgcaaaacatgaaagaggtcgtccgcttctattcaaaactacagaaggaatcaacaaatgtaccttaattgcaatggatttaggtgagatgtgtgaagacactgtaacttataaatgtccattattagttaatacagaaccggaagatattgactgttggtgtaaccttacatccgcctgggtaatgtatggaacatgtactcaaagtggagagcgtagacgcgagaaacgtagtgtcgctctaaccccacattcagggatgggtctagagacgagagctgaaacatggatgtcgtcagaaggagcctggaaacacgcacaaagagtcgaatcgtggattttacgaaatccaggttttgctttattggcaggcttcatggcttatatgataggacaaaccggtatccaacgaactgtatttttcatactaatgatgcttgttgcaccgtcgtacggcatgcgatgtgttggagtaggtaacagggacttcgtagaaggtgtcagtggcggagcttgggtagatctagtattagaacatggagggtgcgtaacaacaatggctcaaggtaagcccactttggactttgaactgataaagacgactgcaaaagaagtagcactactaagaacgtattgcattgaagcgagtatcagcaacataacaacagcaaccaggtgtcctactcagggagaaccatatcttaaagaagaacaagaccaacaatacatctgcagaagagatgtagttgataggggatggggtaatggatgtggtttatttggtaagggaggagtcgtcacttgcgccaaatttttatgctccggaaagataaccggtaacctggtacagatagagaatctggaatacacagtggtagtaactgtacacaacggtgatacacatgctgtaggcaacgatatctctattcatggagttacagctactatcacccctagaagtccgtcagtggaagttaaattacccgattacggggagcttacgctggattgcgaaccacggtctggtatagactttaacgaaatgatcctaatgaaaatgaagaagaaaacttggctagttcacaaacaatggtttttagacctcccccttccttggactgccggcgcggatacttctgaggtacaatggaattacaaagaaagaatggtcacttttaaagtacctcacgcaaaaagacaagacgtaaccgttttaggtagtcaagaaggagcaatgcatagtgcattgaccggtgcaactgaagtagattccggagatggaaaccatatgttcgccggacatttaaaatgtaaagtacgcatggaaaaactaagaataaaaggaatgagttataccatgtgcagtggaaaattctcgatcgataaggagatggcagaaacccaacacgggacaacggtggtcaaggtcaaatatgaaggagcaggggcaccatgcaaggtacctatagaaattcgcgacgttaataaagaaaaagttgttggccgaataatatcaagtacaccttttgctgaaaatacttattccgtaacaaacatcgagctggaaccgccttttggtgattcatatataataattggagttggtgatagtgcattaacgttacactggttcagaaaaggcagtagcattggaaagatgtttgaaagcacgtatagaggggcaaaacgaatggcaatattaggcgaaactgcctgggattttggcagtgttggagggctcctgacatcattaggaaaagcagtacaccaagtctttggaagcgtctataccaccatgtttggcggggtgagttggatggtacggattctcataggtttattagtactctggataggaacaaattcaaggaatacaagtatggctatgagttgcatcgcagttggaggaataactttgttcttaggtttcacagttcatgctgacatgggttgcgccgtaagttggtcaggcaaagaactcaagtgtgggagcggtatttttgttatagataatgtacacacttggaccgaacaatataaatttcagccagaaagcccagcaagattagcaagtgccattctaaacgctcacaaagacggcgtttgtggaataagatccacgacgagactggaaaatgtgatgtggaaacagataacaaatgaacttaattacgttctttgggaaggaggacatgacttgacgatcgtagccggggacgtaaaaggggtactctctaaggggaaaagagctttagcaccaccagtaaatgatctaaaatacagttggaaaacatggggcaaggcaaaaatatttacaccagaaacacgtaacagcaccttccttatagatggtccagatactagcgaatgtcccaacgaacgacgggcttggaactttttggaggtggaagactacggctttggtatgttcaccacaaacatctggatgaagtttagagagggttcttcagaggtttgtgatcatcgactaatgagcgctgcgattaaagaccaaaaggcagtacatgctgacatgggttattggatagaaagttctaaaaatcagacttggcaaatagaaaaagctagcctcatagaagtaaaaacctgcctgtggcctaaaacacacacactatggagtaacggcgtcctcgaatcacaaatgctaatacccaaggcatatgcaggtccatttagtcaacacaattacagacaaggatatgcaactcaaacggtggggccttggcatttgggtaaactcgagattgactttggtgaatgccccggcacgactgtaacaattcaggaagattgcgatcatcgaggtccatccttacgcacaacaaccgcatcaggcaaattagtaactcaatggtgctgtcggtcatgcactatgcctcctttgagatttttaggtgaggatgggtgctggtatggtatggaaattcgaccactttcagaacgtgaagagaatatggtaaaatcccaagtatcagcagggcaaggtacatcagaaacatttagtatgggattattatgtttaacgttattcgtagaagagtgcttaagaagaagagttacgcggaagcatatgatcctcgtggtagtaactaccctttgcgctataatcttgggtggattaacttggatggatcttcttcgtgctttaataatgctgggggataccatgagttcaagaatgggtgggcagatacacttagcgatcatggccgtatttaaaatgagtccagggtatgtgctgggaatcttcttacgaaagctcacatcacgagaaacggctctaatggtgataggtatggcaatgaccaccgtgttaagtataccacacgacttaatggagttcatagatggtattagtttaggactgatacttttaaagatggtaactcacttcgacaatacacaaatgggcactctcgcactgtcactcacttttataaagtctacaatgccgttagttatggcatggaggactataatggccgtacttttcgttgtaactctaataccgctatgcagaaccagttgccttcaaaaacaatcgcactgggtcgaaatcacggcgctaattctaggtgctcaggccttaccagtatacctcatgactctaatgaaaggagcatcaaaaagaagctggccattgaatgaaggcataatggccgtaggtctcgtaagcctattaggtagtgctttactcaaaaatgacgttccactcgcaggcccgatggtggcgggaggtctcttgttggcggcatacgtaatgagtgggagctcagctgatctatcccttgagaaagctgcaaacgtgcagtgggatgaaatggctgacataacgggaagcagtccaattatagaagttaaacaagacgaagatggaagtttctctatacgagatgtagaagagacaaacatgataactcttttggtaaaattggctttaataacagtctcaggattataccccctagctataccagttactatgacgttatggtatatgtggcaagtaaaaacgcaaagatcgggcgctttatgggacgttccgtcgccggcagcagcacagaaggcgacacttacagaaggagtttatagaataatgcagcgtggactattcggcaaaacacaggtaggcgtgggcatacatatggaaggcgtattccacaccatgtggcatgtcacacgcggatctgtaatatgtcatgaaagtggtcgtctggaaccatcatgggcagatgtacgtaacgatatgatatcgtatgggggtggatggagactaggtgataaatgggataaagaagaagacgtacaggtcctcgcaatagaaccaggcaaaaatccaaagcacgtacaaaccaaacctggtctctttaaaacactaacaggagaaattggagcagtaacgttagactttaagcctgggactagcggtagtcctataataaacagaaaaggtaaagtaataggactctatggtaatggagttgtcacaaaaagtggcgattacgtaagcgctatcacacaagcagaaaggatcggtgaacctgactacgaagtcgacgaagacatattccgcaagaagagacttacaattatggatctacatccgggagccggcaaaacaaaacgtatcttgccaagtatagtacgagaagcgctaaaacgacgtcttagaaccttgatactagcaccgacaagggttgtagcagccgaaatggaggaggcactgagaggattacccattcgatatcagactcctgccgtactttcagagcatacgggaagggagattgtcgacttgatgtgtcatgctacgttcacaaccagattattatcatcaacgagagtaccaaactataacctaatagtgatggacgaggcacatttcacggatccatcgtcggtagcggctcgtggatatatatctacaagagttgaaatgggcgaggcagcggcgattttcatgacagcaacgccaccggggacaactgacccttttccgcaatcgaactcaccaatcgaggatatcgaaagagaaattcctgaacggagttggaacacaggtttcgattggatcacagactatcaggggaagacagtgtggttcgtacctagcattaaagcaggcaacgacattgcgaattgcctaaggaaatcgggtaagaaagtaatccaattatcacgaaagaccttcgacacagaatatcctaaaactaaacttactgattgggattttgttgtaacaacggatatttcagtgatgggtgcaaattttagagcggggagagtcatagatccgcgacggtgtttgaaaccagtaattatcacagatggtccagaaagagtaatcctagcgggaccgataccagtcacgcctgcaagtgcagctcaacgcagaggacgaatagggaggaaccctgcacaggaagacgaccagtacgtattctcaggggaccccttacgaaatgatgaagatcatgcacattggaccgaagcaaaaatgctgttagataacatatacacaccagaaggtataattccaactcttttcggtccagaaagagagaaaacacaagcaatagacggtgaatttcgtttacgcggagaacaaaggaaaacctttgttgaattaatgcgaagaggtgatctgcctgtgtggttatcttataaagtagcgtcggccggaatatcttacaaggatagagagtggtgtttcactggagagcgaaacaaccagatacttgaagaaaatatggaagtcgagatttggacacgagaaggtgagaaaaagaaattaagaccaaagtggctagatgccagagtttatgctgacccaatggccctaaaggactttaaagaatttgcgtcaggtaggaaatctataacattagacattttaactgaaattgcatcactcccaacttatcttagctctcgtgccaagttggcactagacaatatagtcatgctacatacaacagaacggggtggcaaagcgtatcagcatgcactcaacgaactgccagaatcattagaaacgcttatgcttgtcgcgctgctaggcgcaatgactgctgggatatttctcttcttcatgcaaggaaaaggcattggtgaactgtcaatgggattaatagcgatcgcgggggcatcaggattattatggggaacaaaaacgccgccaccatggggtgccgcctcaaatatcttagaatttttcttaatggtactcttaatacccgaacctgaaaaacagcgcaccccacaagataaccagctaatatacgttatcctgacaatactcacgattatcggcctagtggccgcaaacgaaatgggtttaatagagaaaacgaagacggattttggtttctaccaagtaaagacagaaactacaattttggacgtagacctgagacctgcaagtgcatggacactctacgcagtggcgacaacaatattaaccccgatgctgcgtcatacaattgaaaataccagtgccaatttatcattagctgcaatagcgaatcaggcggctgttttaatgggattagggaaaggctggcctcttcatcgcatggatctgggtgtacccctactagcaatgggctgttattcacaagttaatccaacgacactaattgcgagtttagttatgctattagtacactacgctattataggaccaggactacaagctaaagcgacccgagaggcacagaaaagaacggcagcgggtataatgaaaaaccctacagtcgatggcattacggttattgatctagaacctatatcatacgacccaaaattcgaaaagcaattaggtcaagtgatgttgctggtgctatgtgcaggacaattactacttatgcggacaacttgggcattctgtgaagtcctgacattggcaacaggtccaatattgacactgtgggaaggaaacccggggcgtttttggaacactactatcgcggtttcaacggctaatatattcaggggaagctatctcgctggagcaggcctagccttcagtttaatcaaaaatgcacaaacgcccaggcgcggcacaggggttactggagagacactaggagaaaagtggaagaggcaactaaattcgctggaccgtaaagagttcgaagagtacaaacgaagcggaatattagaggttgaccgaacagaagcaaaaagtgcattaaaagatggctctaagataaagcaagcagtgtcgagaggaacgagcaagattaggtggattgtggaaagaggtatggttaaaccgaaagggaaagtagtagacttaggttgtggtagaggtggttggtcatattatatggccacacttaagaatgtcacagaagtcaaaggatacaccaagggtgggcccgggcatgaagaaccgattccaatggcaacctatggttggaatctggtaaaattacattcaagggtggatgtcttttataagcctactgagcaagtcgacacattgctatgcgacataggcgaatcgtcgagtaaccctacaatcgaagaaggaagaacactcagagttctcaaaatggttgaaccatggctttcatcaaagccagaattttgtatcaaagttctgaacccatacatgccgactgtcattgaagaactagaaaaacttcaaaggaaacatggtggcagcctagtcaggtgcccattatcaagaaattccacacacgaaatgtactgggttagtggagtgtctggaaacatcgtatctagtgtaaacacaacgtcgaagatgctattaaaccgatttaccacgaaacatcgtaaacctacctacgaaaaagatgctgacttaggtgcaggaacaagatctgtatccaccgagacggaaaaaccagacatgacaataatcggacgcagactacaaaggcttcaggaggaacaccaagaaacttggcattatgatcaagagaatccatataggacttgggcgtaccatgggggttacgaagctccaagcacaggatcagcaagttccatggtaaatggagtagtaaaactattaacaaaaccatgggacgtcattccaatggttacacaattggcaatgacagatactacaccatttggtcaacaacgagtatttaaagaaaaagtagatacccggacaccccaacccaaacctgggaccagaatggtaatgaccacaactgcaaattggctatgggctctacttggtaagaagaaaaaccctaggctctgtactcgcgaagagttcattagtaaagttcgcagtaatgcagcaattggagcggtatcacaagaagaacaaggatggacctcatctttcgaagcagtaaacgacagcaggttttgggaattagtagacaaagaaagagcactccaccaagaaggaaaatgtgagagctgtgtgtataatatgatgggtaaaagggagaagaaacttggagaatttggcagagcaaagggctcaagagccatttggtatatgtggctaggtgccagatttctagagttcgaggcattaggcttcttaaatgaggaccattggttcggcagggaaaattcatggtcaggggttgaaggtgagggacttcatagactaggatatatccttgaagacttagacaaaagggatcgatcattagtttttgcagacgacacagctgggtgggatactaaaattccggaggatgatctattgaaagagaaaccaattcccggtccaatggcaccccatcaacgcatacctgccagagcaattttcaaactgacataccagaataaggtagttaaagtgctacgattgaaattgaaaggagctgtaatggacataattagcagaaaagaacaaagaggatcaggacaggtcggaacatatggacttaacacattcacaaacatggaagtgcaattaataagacaaatggaggcggaaggcgtgattacccgtgacgacatgcacaatccgaagggattaaaagaaagagtcgaaaaatggttaaaagaatgcggggttgaccgattagaaaggatggctataagtggtgatgattgtgtggttaaacccttagacgaaagatttagcacgagtctacttttcctcaacgatatggggaaagtaagaaaagacatcccccaatgggaaccttctaaaggttggaaaaactggcaggaagtaccattctgcagccatcactttcacaagattttcatgaaggatggaaggtcattggttgtaccatgtcgaaaccaagatgagttgatagggagggccagaattagtcaaggcgctggatggagcttacgagaaactgcttgcttagggaaggcatatgcccaaatgtggtccctaatgtactttcacagaagagatctcagacttgcgtctatggctatatgtagtgcagttccaacagaatggtttcccacttccaggacaacttggtccattcatgctcaccaccaatggatgacaacagaagatatgcttaaggtatggaaccgtgtatggatagaggataacccgaatatgacagacaagacacccgtacacagttgggaagacataccataccttggcaaacgagaagatctatggtgcggctccttaatcggactttcctctagagcaacttgggcaaagaacatacacacagcgataacgcaagtcagaaacttaattggtatcgaaggatatgttgattactttttgttaataaagtggtactcagctcccttcgaatcggaaggagtattgtag

SEQ ID NO: 23603 - RNA, 9867 nt, synthetic construct
  misc_feature 1..9867: note = derived and/or modified CDS sequence (opt6) from DENV-4__KF955510__SS-prME
  source 1..9867: mol_type = other RNA
tcaacaataactcttctttgcctgattccaactgtaatggctttccatttatcaacacgtgacggagaacccttaatgatagtcgcaaaacatgaaagaggacgaccccttttatttaaaacaacagaaggtattaacaaatgtacattaatagcaatggatctaggtgaaatgtgtgaagatactgtcacctacaaatgtcctcttttagttaacactgaaccggaagatattgactgttggtgtaacctaacctcggcttgggtcatgtacggaacttgtacacaatcgggagaacgcagacgagagaaaagatcagtcgcgcttacgccacactcaggaatgggacttgaaactcgcaccgaaacatggatgtcgtccgaaggcgcatggaagcacgcacaaagagtcgaatcatggatattaagaaaacccggcttcgcactgagtgccggattcatggcgtacatgataggacaaactgggattcaacgaaccgtgttcttcatattaatgatgctagtagcgccaagttacggcatgagatgtgttggagtaggaaatagagacttcgttgaaggagtgagtggaggtgcctgggtagacttggtactagaacatggaggttgcgtgacaactatggcacaaggtaaaccgacgttagactttgaattaataaagacaaccgctaaagaagtagccttgctacgaacttattgtatagaagcctcaatatccaatataactaccgcaactcgctgtcctacacaaggcgaaccttatctaaaggaagaacaggatcagcaatatatatgcaggagagacatggtcgatagaggctggggaaacggctgtggtctttttggtaaaggaggtgttgtaacatgtgctaagttctcatgttcgggaaagataacagggaatctagttcaaatagaaaacctagaatataccgttgtcgtgacggttcacaacggagatacgcacgccgtaggtaatgacacttcaaaccacggtgaaacagcaacaatcacgccacgatcaccaagcgttgaagttcgattacctgattatggcgaactaactctggactgtgaaccccgatcgggtattgactttaatgagatgatattaatgaaaatgaaaaccaaaacatggttagtacataaacaatggtttctagatctcccactaccatggacagcaggagcagacacaagcgaagtgcattggaaccataaagagagaatggttacttttaaggtacctcacgcaaaaagacaagatgttactgttctgggttcccaagaaggagcaatgcattcggcactagccggtgcaacagaagtggatagtggggatggtaatcacatgtttgcaggccatcttaaatgcaaggtccgaatggagaaactgcgaatcaaaggtatgagttacaccatgtgcagcggaaagttttcaattgacaaggaaatggccgaaacccaacacggaacgacagttgtaaaagtaaaatacgaaggaactggagcaccatgcaaggtgcccatagaaatacgtgatgtaaacaaagaaaaggtcgtaggccggattatcagtagtactccgtttgcagaaaacacaaacagtgtcacaaatatagaacttgagcccccattcggtgacagctatattgtaataggagccggagactcggccctaacactccattggttcagaaaaggatctagcattgggaaaatgtttgaatcaacttacagaggagctaagcgaatggcaatactgggcgaaacagcctgggactttggatcggtagggggactcttaacaagtctaggaaaagcagtacatcaagtattcgggtcagtttataccactatgttcggaggagtatcctggatggtgaggattctaattggactattagtgttatggatcggaactaattcccgaaataccagcatggctatgagttgtattgtggttggtggaataacactatttctggggtttacagtacacgcagatatgggatgtgtagtgtcctggtctggtaaagagctcaaatgtgggtctggtatattcgtaattgataatgtacatacgtggacggagcaatataaattccagccagaatccccagccagattagctagcgcaatactaaacgcccataaagacggtgtttgtggcattcgttcaacgacgcgcttggaaaatgtaatgtggaaacagataactaacgaactaaactatgtcctatgggagggcggacacgatctaacagtagtagcgggggatgttaaaggtgtcctctcaaaggggaaaagggcgttagcaccacctgtcaatgatttgaaatactcctggaaaacatggggaaaagcgaaaatattcacgccagagacgcgtaattctacattcctggtagatggccccgacacgtcagagtgtcccaatgaaagacgcgcctggaactttctcgaagttgaggattatgggtttggtatgttcacgactaatatatggatgaaatttagagaagggtctagtgaagtctgtgatcacagattgatgagcgcagcaataaaagaccagaaagcagtccatgcagacatgggttattggatagaatcaagcaaaaatcaaacttggcagatagaaaaggcttctctaattgaagttaaaacatgtctctggccgaaaactcatacgctatggtcaaatggagttcttgagagtcaaatgctcataccaaaagcatatgcaggaccaatctcccagcataattaccgacagggatacgctacacaaacagtgggaccttggcacctaggaaaattagaaatagactttggtgagtgtccgggaacaaccgtcacaatccaggaagactgtgatcatagaggaccatcactcaggacaacaaccgctagcggtaaattagtaacgcagtggtgttgtagatcatgtaccatgccgcctctaaggttcctgggagaggatggatgctggtacggtatggagattcgacccctaaacgaaaaagaagaaaatatggtaaagagccaagtatcggcagggcaaggtacttccgaaacatttagcatgggattgctctgtcttactctattcgtcgaagaatgcctcagacgtagagtaacacgaaaacacatgatcctagttgtggtcacgacactctgtgcaataattttaggaggactaacgtggatggacttgcttagggcgttaattatgctgggtgacaccatgagtggtaggatgggtggtcaaatacatttagctataatggctatgttcaaaatgtcacctggatacgttttaggaatatttttgagaaaactaacatcacgagaaacagcattaatggtaattggaatggctatgacaactgtactttctataccccatgatcttatggagttcattgatggcatatcacttggtttaattctgttaaaaatggtaactcatttcgataatacacaggtaggcacactagccctcagtttgacatttatcaagagcacaatgccgctggtaatggcatggaggacaattatggctgtgctattcgtagtaacgttaataccactatgtaggacctcttgtttgcagaaacaaagtcactgggtcgaaattacagccttaatactgggcgcgcaagccttgccagtatatttaatgacactaatgaagggagcaagcaagcgctcatggcccttaaatgagggcataatggcagttgggcttgtcagtttacttggcagcgcattactgaaaaacgatgtaccattagccgggccaatggtggctggagggctattactagccgcttacgtaatgtctggctctagtgcagacctatcattggaaaaagcagcaaatgtccaatgggatgaaatggccgatatcacaggttcctcaccaataatcgaagttaaacaagatgaagatggcagtttcagtataagagacgtagaggagaccaatatgataactctcctagtaaagttagcactaataactgttagtggactgtatccgctcgcgatacccgtaacaatgacattatggtatatgtggcaagtgaaaactcagagatcaggtgcattatgggacgtccctagccctgcagcggctcaaaaagcgacactaacagaaggtgcataccggattatgcagagaggtttatttggaaaaacacaagtaggagtgggtattcatatggaaggagttttccatacaatgtggcacgtcacgagaggaagtgttatttgtcatgaatcaggacgactagaaccctcgtgggctgatgtacggaatgacatgatttcttacggaggaggttggaggcttggagataagtgggacaaagaagaagacgttcaggtacttgctatagaaccaggaaagaatcctaaacatgtgcaaacgaaaccaggtctgtttaagaccctgacgggagaaattggtgcggtaactctggactttaagcccgggacgagcgggtcaccaattatcaataggaaggggaaggttataggattgtacggaaacggagtagtaacaaaatcaggggattatgtatcagccataacacaagcagagcgaattggagaacccgactatgaagtcgacgaagatattttcagaaagaaacgattaaccataatggatctgcatcccggtgcagggaaaacgaaaagaatattaccgtctatagtgagagaagcattaaaacgaaggctgagaacattaattttggctccgaccagggtcgttgcagcagaaatggaggaagctctaagaggacttccaatacgttatcaaacccctgcagtaaaatcagagcacaccgggagagaaatagtggatctaatgtgccacgcaacattcactactagactgttgtcatcaaccagggttccaaattacaatctaattgttatggatgaagcccattttacggacccttcttccgtggcagcaaggggatatattagcactcgggtagaaatgggagaggctgcagcgatttttatgaccgcaacaccaccaggtaccacagatccattcccgcaatcaaactctccgatcgaagacatagaacgagaaatacccgaacggtcatggaataccggattcgattggattacggactaccaagggaagaccgtctggttcgtaccatccattaaagctggaaatgacatcgcaaattgtttacggaagagtggcaagaaagtgattcaactcagtagaaaaacattcgatacagaatatccaaaaacaaaacttacggactgggacttcgttgtcaccacagacatttctgaaatgggagctaattttagggcaggacgtgttatagatccacgaagatgtttaaaacccgttatcttaaccgatggaccagagcgtgtgatattagcggggccgataccggtaactcctgcttctgcagcacaaagacgtggacgaattggtcgtaatccagcacaggaagacgatcaatatgttttctctggcgatccactaaggaatgatgaggatcacgcacattggacagaggcaaaaatgctattggacaacatctacacacctgagggaattatacctaccctttttggacccgaaagggagaaaactcaagcaatagatggggagttccgattaaggggtgagcaaagaaaaacctttgtagaattgatgcgacgaggtgatctaccagtatggctatcatacaaagtagcatcggctggaatatcctacaaggacagagagtggtgctttaccggtgaacgaaataatcagatacttgaagaaaatatggaggtagaaatttggacaagagaaggcgagaaaaagaaactgagaccgaaatggctagatgcgagagtttacgcggaccctatggcactgaaagattttaaagagtttgcgtcaggtaggaaaagcattacactcgatatactaactgaaatcgcttcgcttcctacatacctaagctcgcgagcaaaactagccctggacaacatagttatgttacacaccactgagagaggtgggaaggcttaccaacacgcgctaaacgagctgccagaatccctggaaactctcatgctagtagccctacttggagcaatgacagcaggtatattcttgttcttcatgcaaggcaagggaatgggcaaactaagtatggggcttatcgcaatagcagtcgcttcaggtctactatgggtcgccgaaattcaaccacaatggattgcggcatcaattatattagagttcttcttaatggtcctattggttccggaacctgagaaacagcgaacccctcaagacaaccagttgatatacgtaattcttactatacttactataatcgccctagtcgcagcaaacgaaatgggcctaatagagaaaacaaaaactgatttcggtttctatcaagccaaaactgaaacgacaattcttgacgtcgatttacgacctgctagtgcttggacgttatatgcagtagcgacgaccattcttacaccgatgttaagacacacaatagagaacacttctgctaacctaagtctagcagctatcgcaaatcaagcagctgtattaatgggcctaggaaagggttggccactgcatcgaatggacttaggggttccactgttggcaatgggatgttatagtcaggtaaatcctaccaccctgacagcgagtctcgttatgctcctggtacactatgctataatcggccctggattacaagctaaagcaacgcgggaagcacaaaagagaacagccgccggcattatgaagaatcccaccgttgacggaataacagttattgatctcgaacccattagttatgacccgaagttcgaaaaacaactcggtcaagtaatgctactcgtactatgtgcgggacaattacttttgatgagaacaacatgggcgttttgtgaagtattaacgcttgccacaggtccaattttgacactatgggagggtaatcccggacgattttggaacacgacaatagcagtatctaccgccaatatctttagagggagttaccttgcaggagcaggtttagcgtttagtctaatcaaaaacgcacagacaccacgaaggggaacgggtactactggtgagaccctaggcgagaagtggaaaagacagctaaatagcttagatagaaaaggattcgaagaatataaacgtagtggtattttagaagttgatcgaaccgaagccaagagcgcattaaaagatggtagcaaaattaaatatgctgtctcacgaggaacatcaaagataagatggatagtagaaagaggtatggttaaacccaagggtaaagtggtcgacctaggatgtggaagaggcggatggagctattatatggcaacacttaaaaatgtcactgaagtcaaaggttacacaaagggcgggcccggacacgaggaaccaataccgatggccacatacggatggaatttagtaaagctgcactcaggagtcgacgtattctataaaccaacagaacaagtggatactctgttatgtgatatcggtgagtcaagttccaatcccaccattgaagaaggcaggactcttcgggttctgaagatggtagaaccatggttgtctagtaaaccagagttctgtattaaggtacttaacccatatatgccgactgtcatagaggaactagaaaaactgcaaagaaaacacggaggaagcctagtacgatgtccattatctcgaaattcaacccacgaaatgtactgggtgagtggagtaagtggaaacatcgtaagttcggtaaacacaacaagtaaaatgttattaaacagattcacaacaaggcacagaaagccaacgtacgaaaaagatgcggatttaggcgcagggaccagatcagtatcaacagaaacagaaaaacctgatatgacaataataggacggagacttcaacggttgcaggaagaacacaaggagacatggcactacgatcatgaaaatccatatcggacatgggcgtatcatggtagttatgaagcgccctcaactgggtccgcttcttcaatggtaaatggagttgttaagctcttgacaaaaccgtgggatgttgtacctatggtcacgcaactcgcaatgacggacacaacaccctttggacagcagagagtattcaaagaaaaggtggacacacgaactccacaaccaaagcctggaacgcgagttgtaatgacgacaacggctaactggttgtgggccctacttggtaggaagaaaaatcctcgtttgtgtaccagagaagagtttattagtaaagtaagatctaacgccgcgataggagcggtatttcaagaagaacaaggatggaccagcgcaagtgaagctgtaaacgattcccggttttgggaactggttgacaaagaaagagcgttacatcaagaaggtaagtgcgaatcatgtgtatataatatgatggggaaacgcgagaagaaactaggtgaatttggtagagccaaaggatcaagagccatatggtatatgtggttgggtgcaagatttcttgagtttgaagcacttggattcctgaacgaagaccattggtttggtcgtgaaaactcttggtcaggggtagaaggagaaggattgcaccgcctgggatacatactggaagacatcgataagaaagacggcgacttgatttatgctgacgacacagcgggatgggacactagaataactgaagacgatctactaaacgaagaattaataactgaacaaatggcgcctcaccacaaaatattagccaaagcaatattcaaactaacatatcaaaataaagtagtaaaagtgcttagaccaacaccaaaaggagcagtaatggatataattagtcggaaggatcaaagagggtcgggacaagtcggaacatatggacttaacacatttactaatatggaagtacaattgattaggcaaatggaggcagaaggagtcattacaagggatgatatgcataatcctaaaggtcttaaggagcgagtagaaaaatggctcaaagagtgtggtgtagatcgtctaaaacgcatggcaatctccggagatgattgtgttgtgaaacctctggatgagagatttagcacaagtctactgttcctaaacgatatgggtaaagtacgcaaggatattccccaatgggaaccctctaagggatggaaaaattggcaagaagttccattttgttctcaccattttcacaaaatttttatgaaagatggacggagcctagtagtaccctgtcgaaatcaggacgaattaataggccgagcgagaatatcgcaaggagcgggctggtccctccgagaaaccgcctgcctaggaaaggcctacgcccaaatgtggtccctcatgtattttcatcgtagagatttgcgtttagcttcgatggcaatatgctcggcggtcccaactgagtggtttcctacatcccgaacaacctggtccatccacgcacaccatcaatggatgacgactgaagacatgctaaaagtctggaacagggtgtggattgaagataatcccaatatgattgataaaacaccagttcactcttgggaggatattccctatctaggcaagcgagaagatctgtggtgtggaagtttaataggattatcctcaagagctacttgggccaaaaacatacatacggcaattactcaagtccgcaacctcatcgggaaagaagagtacgtagattatatgcccgtgatgaaacgttatagcgcacactttgaatcagaaggtgtactatga

SEQ ID NO: 23604 - RNA, 9867 nt, synthetic construct
  misc_feature 1..9867: note = derived and/or modified CDS sequence (opt6) from DENV-4__GQ868594__SS-prME
  source 1..9867: mol_type = other RNA
agcaccatgactctattatgtttgattccgactgtcatggcgtttcatcttagtactcgagatggtgaaccattgatgatagttgcgaaacatgaacgagggcgacctttactattcaaaacaaccgaaggaattaataaatgtactttaattgcaatggatttgggagaaatgtgtgaagataccgtcacttacgaatgtccacttctagtgaatactgaaccggaagatattgattgttggtgtaatttgacaagtgcttgggtaatgtatggaacttgcacacagtcaggagaacggaggagagagaaaagaagtgttgcactcactccccacagtggaatggggttagaaaccagagctgaaacttggatgagttctgaaggtgcgtggaaacacgcacagagggtagagtcatggatactgcggaatccgggcttcgcactacttgctggattcatggcgtacatgattggccaaacgggtatacaacgaactgtattctttgtattaatgatgttggtagctccaagctatgggatgcgatgcgtaggtgtcgggaacagggattttgttgaaggggtctcaggtggagcttgggttgacctagtgcttgaacacggaggttgtgtcacgacgatggcacaaggtaaacctactttagatttcgaattgattaaaaccactgcaaaagaagttgcactgctaagaacctactgtatagaagcaagtataagtaatattaccacagcaacacgatgcccaactcagggtgaaccatatctgaaagaagaacaagatcaacaatacatatgccgcagggatgtagttgataggggttggggcaatggctgtggattatttggtaaaggaggagtagtaacttgcgcgaaatttagttgttcaggaaaaataacaggtaatctagtacaaatcgaaaacctagagtataccgtggttgttacagtacataatggagatacgcatgcagttggtaatgatatacccaatcacggagttacagcgaccatcacacctcgttcaccgtcagtagaagtaaaactgccggattatggagaactcacactcgattgtgaacctagatcaggaatagacttcaatgaaatgattcttatgaaaatgaagaagaaaacttggctcgttcacaaacaatggtttctcgacctacctctgccttgggcggctggcgcagatacatcagaagtacattggaattataaagaacgaatggtgacctttaaagtgccacacgcgaaacgacaagacgtgatagtactaggttcgcaagaaggagctatgcatagcgccttaaccggagcaacagaagttgatagcggagacggaaatcacatgttcgccggccacttaaaatgtaaagtacgaatggagaaattacgtataaaaggaatgtcctataccatgtgctctggcaaattcagcattgataaagaaatggcggaaacacaacatggaacgaccgttgtgaaggtaaaatatgaaggcgctggcgcaccgtgtaaagtaccgatcgaaatcagagatgtgaacaaagaaaaagtagtagggagaataatatcatcgactccatttgctgagtacaccaatagtgttactaatattgaactagaaccaccatttggagatagttacatagtaataggcgtcggtgattccgcactcaccttacattggtttagaaaaggctcgagtattggcaaaatgctggaaagcacgtaccgaggtgctaaaaggatggcaatcctaggagaaacggcatgggactttggatcagttggtggcctgctaaccagtctcggaaaagctgtacatcaagtctttggatccgtgtacactacgatgtttggaggtgtcagttggatggtcagaatactcataggatttttagtactgtggattgggacgaatagccgcaatacatctatggcaatgacatgcatagctgtaggaggtataactctatttttaggattcacggtgcatgcagacactggctgcgcagttagttggagtggaaaagaattaaaatgcgggagcgggatatttgtaatagacaatgtacacacatggacggagcaatataaatttcagcctgaaagcccagccagacttgctagtgcaatattgaacgcacataaagatggtgtatgcggcatcagatcgacaaccagattagaaaacataatgtggaaacaaataacgaacgaattgaattacgtactatgggaaggcggacacgatcttacagttgtggccggtgacgtaaaaggtgtcctatcaaagggtaaacgcgctttagcacccccagttaacgacttaaagtacagttggaagacttggggaaaagctaaaatctttactcccgaagccaaaaattctacattcctgattgatgggcctgatacaagtgagtgtccaaacgagaggcgtgcttggaatttccttgaagtagaagactacggcttcggcatgtttacaactaacatatggatgaaattcagagaagggagttccgaagtatgtgaccaccggttgatgagcgcggcaataaaagatcaaaaggccgtccacgccgatatgggttattggatcgagagcagcaaaaaccaaacatggcagatagagaaggcatcgctaatagaagtgaaaacatgtttatggccgaaaactcacacgttatggagtaatggggtactagagtcacaaatgctcattccaaaggcttacgcgggaccattttcacaacacaattacagacaaggttatgccacacaaacggtagggccgtggcacttaggcaaactcgaaattgactttggggaatgcccaggaacgacggtgacgatccaagaagactgcgaccacagagggccctctttgagaacaacaacggcatcaggtaagctggtcacacagtggtgttgtagaagctgtaccatgccaccattaagattcctaggagaagacggatgctggtacggcatggaaattaggcctctaagtgaaaaagaagaaaatatggtaaagagccaggtatctgccgggcaaggaaccagcgaaacattttcaatggggttgctttgcttaactttattcgttgaagaatgtctacgcaggagagtgactaggaagcatatgatacttgtggtagtaactaccttgtgcgcaatcatactaggtggtttaacatggatggatctactacgagcattgatcatgttgggggacacaatgagtggaagaatgggaggacaaattcatttagccataatggcagtatttaaaatgagtccgggttatgtattgggaatattcctacgaaaacttacgtcaagggaaacggcattgatggtcataggtatggctatgaccaccgtattatcaattcctcatgatctgatggaatttatagacggtatcagcttaggattaatattgttaaaaatggtcacgcacttcgacaatactcaagttggtacccttgccctcagcttaacttttatcagaagtactatgccattggtgatggcgtggcggactataatggcagtgctgttcgtcgtgacacttattccattatgtaggacaagttgtttacaaaagcaatcacattgggtggaaataactgcccttatattgggagcacaggctctacccgtatatttaatgacattaatgaagggagcgtctaagagatcgtggccattaaatgagggaataatggcagtaggattagtaagcctgctaggatcggccttgcttaagaatgatgtgcctctagctggcccaatggtagcaggaggcttattactcgctgcatatgtcatgtcagggtcctcggcagatctctcgctagaaaaagctgcgaatgtacaatgggatgaaatggctgacataactgggtcatcgcctattatcgaggtgaagcaagatgaagacggttccttctcgatccgcgatatagaagaaacaaatatgattacattattagtaaaattggcactaataacagtttcgggactatatccacttgctattcctgtaactatgacattatggtatatgtggcaagttaaaacacagagatcaggagcactgtgggatgttcctagtccagcggcagcacaaaaagcaacactgacagagggtgtttatagaataatgcaaagagggctattcggtaagacacaggttggggtaggtatacatatggagggagtattccatacaatgtggcatgtgacacgtggatcggtaatatgccacgaaacaggaagattggagccatcatgggctgatgtacgaaatgacatgatctcctatgggggtggttggagattgggcgataaatgggacaaagaggaagatgttcaggtgttggccattgaacctggcaaaaatccaaagcatgtgcaaacaaagcctggtctctttaagaccctaactggcgaaataggtgctgtcacattagatttcaagcctggaaccagtggatcacccattattaatcgcaaaggtaaagttatagggttatatggaaatggtgtggtaactaaatctggggactatgttagtgcaataacacaagcagagcgcactggggaacctgattatgaagtagacgaagatattttccgcaagaaaagactcactattatggatttacatccgggagcggggaaaacaaagcgaatcctgccatccatagtaagagaagcactaaaaaggagactaaggacacttatattagcaccgacgagagtagtcgccgcagaaatggaagaggcgctaagaggtttgccaatcagatatcagactccggcagttaaatcggaacataccggtagagaaatcgttgatttaatgtgccatgccacgtttaccaccagactattgagcagtactagagtaccaaattataaccttatcgttatggacgaagctcatttcacagatccatcatctgtggccgcacgtgggtacatttcaacccgcgtagaaatgggagaagctgcagccatttttatgacggcgactccgcccggagctacagatccatttccccaaagtaactcaccgatagaagatatagaaagagaaatcccagaaagatcttggaatacgggatttgattggattacagattaccagggcaaaacagtatggttcgtaccgagtataaaagccggtaatgacattgcaaattgtcttaggaaaagtgggaagaaagtaattcagctatctcgtaagacatttgatacagagtatccgaaaacaaaattaacagactgggatttcgttgtcacaacggatatcagtgaaatgggcgctaactttagagcaggaagagtaattgatcctaggagatgcctcaagccagttatttccacagatggcccagagcgcgtcatcctagctggtccaatacccgtaactccagcaagcgccgcccaacgtaggggtaggattggacgaaacccagctcaagaagacgatcagtatgtattcagcggtgatccactaaagaacgacgaagaccatgcacactggacagaagcaaaaatgctcctggataacatctacacaccggaaggtatcatccctacacttttcggtcctgaacgcgagaaaaaccaggctatagatggagagtttaggctacgaggtgaacagagaaagacatttgttgaactaatgagacgaggtgatctccctgtgtggttgtcatacaaagttgcttcagctggaatttcctacaaagatagagagtggtgcttcactggagaacgtaataatcaaattttagaggaaaatatggaagtcgagatatggacaagagaaggagagaaaaagaaactaaggcctaaatggctagatgcaagagtatacgcagatcctatggctctaaaagatttcaaagaatttgcatctggaagaaagagcatcacattggacatcctcacagagatcgcatccttgccaacgtacctatcgtcaagagcgaaattagcactagacaacatcgttatgcttcacaccaccgagcgaggcggaaaagcctatcaacacgcgttaaacgagcttcctgaaagcctagaaacgctaatgctggttgcgctccttggcgcgatgacagcaggaatatttctatttttcatgcaaggaaaaggtattggcaaactatctatgggcctaatagccatagccgttgcaagtggattactttgggtcgcagaaattcaaccacagtggatagctgcgtcaataattttagagttctttttgatggttttactaataccagagccagagaaacaaagaacacctcaagacaatcaactaatatacgtcatacttactatactaacgatcattgggttaatcgctgctaacgagatggggttgattgagaagacaaaaacagacttcggcttctatcaagtcaaaactgaaacaacaatattagacgtcgatttacgacccgctagtgcgtggacgctatacgcagtagcgactaccattctgacaccgatgttgagacatactatcgaaaatacatcagccaatttaagtttggcggctatagcgaatcaagcagccgtccttatgggtctgggaaaaggatggccccttcaccgaatggacctcggtgtgccattgctcgcaatggggtgttactctcaagtgaaccctaccaccctaattgcgtctttggtcatgctcctagtccactatgccatcattggaccgggactacaggccaaagctacacgagaagctcagaagagaacggctgctggtattatgaaaaatccaacggtagatggaattaccgtcattgacttggaacctatatcatatgacccaaaatttgaaaaacagttgggtcaagtgatgctactggtactatgtgcaggtcaactgttgctgatgcgcacaacgtgggctttttgtgaagtactaacgttagctaccggcccagtactgacgctatgggagggtaatccaggacgtttctggaatactacgatagcagtaagtaccgcaaatatatttaggggaagctatttggcaggcgcaggcctagccttttcattgatcaaaaacgctcaaacaccacggagagggaccggaactacgggggaaacccttggtgagaagtggaaaaggcaattaaactccttagatagaaaagaatttgaagagtataaacggtccgggatactcgaagttgataggactgaagcaaagtcagcgctaaaggatggatccaaaatcaaacacgctgtatcccgaggtagtagcaaaattaggtggattgtagagagaggtatggtaaaacccaaaggaaaggtagtggatttaggctgtgggagaggagggtggtcatattatatggcaacattgaagaatgtgacagaagttaaaggatatactaaaggcggaccaggacatgaagaaccaatcccaatggcaacatacggctggaatctagtcaaattacattcgggcgtggatgtattctacaaaccgacagagcaagtcgataccctactttgcgacattggtgaaagcagttcgaatcccacaatagaagagggacggacactacgtgtcctaaaaatggtagaaccatggctatcgtccaagcctgaattttgcattaaagtcctaaacccctatatgccgactgtgattgaagaattggagaaactacaacggaaacacggcggtagcttagttcgatgtccgttatcgagaaattccactcatgaaatgtactgggtatctggtgtgagcggtaatatagtaagttcggtgaacactacgtcaaaaatgctactgaatagattcacgacaagacatcgaaaaccaacatacgaaaaagatgttgatttaggtgctggaacccgctcggtgtcaactgaaacagaaaaaccagatatgacaataattggacggagacttcaaagactacaagaagaacataaagagacttggcattatgaccaagagaacccttatagaacctgggcataccacggctcttatgaagcacctagtactggatctgcttcttcaatggtcaacggagtagtaaaacttctcaccaaaccgtgggatgtaatccctatggtaacacaactggcaatgacagacactacaccttttggtcaacaacgggtatttaaagaaaaggtagatacaagaaccccacaaccaaaacctggaacgcgaatggtgatgacgacaaccgcaaattggctatgggcactgttaggtaagaagaaaaaccctagactatgtaccagggaagaatttattagtaaagttaggtccaacgcggccatcggagcagtatttcaagaagaacaagggtggaccagcgcctccgaagcggtaaatgattccaggttttgggagttagtcgacaaagaaagggcccttcatcaagaaggcaagtgcgagtcatgtgtatataacatgatgggaaaaagggagaagaaattaggagaatttggtagagccaaaggatcaagagccatatggtatatgtggttaggagcgagatttttagagtttgaagcattaggttttctaaacgaagaccactggttcggccgtgaaaattcttggagcggcgttgaaggagaaggtctgcatagattaggatatattttagaggacatagacaagaaagacggcgatctgatttatgctgatgacacagcgggctgggacacaagaattactgaagatgacctgctaaacgaagaattgataaccgaacaaatggcgccacaccacaaaatcctcgcgaaagcgatatttaaattaacatatcaaaataaagtagtcaaggtattaagaccaacaccgaaaggtgccgtcatggacatcatatccagaaaagaccagagaggatcgggacaagtggggacatatggcctcaatacttttacaaatatggaggtacagctgatacgacaaatggaagcagaaggagttatcacgcaagatgatatgcataatccaaaaggtcttaaagagagggtagaaaaatggctcaaagaatgtggcgtggataggcttaaaagaatggcgataagtggcgacgattgcgttgtcaaaccgctggatgaacgatttagtacgtcattactcttcctcaatgatatggggaaagttagaaaagatattccccaatgggaaccctcaaaaggatggaaaaattggcaagaagtaccattctgctcacaccatttccataaaatctttatgaaagacggccgttctcttgtggttccctgtagaaatcaagatgaattgataggtagagcgaggatatcgcaaggtgctggatggagccttagggagactgcgtgtttgggcaaagcatatgcacaaatgtggtcattgatgtactttcatcgccgagatttaagattggcctctatggcgatatgttcagcagtccctacagagtggtttccaacctcacgcacaacatggtctattcatgcgcaccatcaatggatgacaacagaggatatgttaaaagtctggaacagagtatggatagaagataatccaaacatgaccgacaaaacacctgtacactcatgggaagacataccatacttaggaaaaagggaagatctttggtgcggttcgcttattggtttgagttcgagagcaacttgggctaaaaatattcatacagcaataacacaagtgaggaatctgataggtaaagaagagtatgtagactatatgccagtaatgaaacgatattcagcaccatttgagtcagaaggtgttctttaa

SEQ ID NO: 23605 - RNA, 9867 nt, synthetic construct
  misc_feature 1..9867: note = derived and/or modified CDS sequence (opt6) from DENV-4__FJ024424__SS-prME
  source 1..9867: mol_type = other RNA
tctactattactctcctctgccttataccaactgtaatggcttttcatctttcgaccagagacggagaacctctgatgattgtcgctaaacatgaacgtggacgaccactgttgttcaaaaccacagaagggattaacaaatgcacattaattgcaatggaccttggggaaatgtgtgaagacaccgtaacatacaaatgcccactcttagttaatacagaacctgaagatatcgactgttggtgtaacctgacaagtacatgggttatgtatggaacttgcacccaaagcggggagcgaagacgtgaaaaacgtagtgtcgctttgacaccacatagtggaatgggattggaaacgagagcagagacttggatgtcctcggaaggagcctggaaacatgcacagcgggttgaatcatggattcttagaaaccccggtttcgctctactggccgggttcatggcatatatgataggacaaactggaatacaaagaacagtcttcttcgtcttgatgatgttagtcgctccaagctacggtatgcgatgcgttggagtaggaaaccgagattttgtggaaggggtgagcggcggggcatgggtagatttagttttagagcatggcggatgcgtaacaactatggcgcaaggtaaaccaacattagatttcgaactaacaaaaactactgccaaagaagtggcattattacgcacttattgcattgaagccagtatctcgaatattactacggcgacccgctgccctacacaaggtgaaccttaccttaaagaagaacaagaccaacagtatatttgtaggcgagatgtggtagatagaggttggggaaacggatgtggattattcggaaaaggaggggtagtgacatgtgcaaaatttagttgctcaggcaaaatcacagggaacctcgtccaaatagagaatttagagtacactgtcgttgtcacagtacacaacggtgatactcatgccgtaggaaatgacacgtcgaatcatggtgttactactaccataactcctcgatcaccaagtgtagaagttaaactacctgactatggagaactcaccttagactgtgagcctagaagtggcatagattttaacgaaatgatcctaatgaaaatgaagaagaaaacctggctagttcataaacaatggtttctagatttaccgttaccatggaccgctggagctgacacaagtgaggtacattggaactacaaagagcgtatggttactttcaaggttccgcatgccaaaaggcaagacgtaactgttctcggttcccaagaaggtgcaatgcattcggcactagctggagcgacagaggtagattcaggtgacggaaatcacatgtttgcaggccatctgaaatgtaaagtaagaatggaaaagttaagaatcaaaggtatgtcatataccatgtgtagcgggaaatttagtattgacaaggaaatggctgaaacccagcacggaactactgttgtgaaagttaaatacgaaggagcaggagctccatgtaaggttcctatagagattcgcgacgttaataaagaaaaagtcgtcgggagagtgattagctctacaccactagcagagaacactaattcggttacaaatatagaactagagccaccctttggcgattcatatatcgtaataggagtaggaaatagtgcgcttaccttacactggtttcgcaagggttccagcattgggaaaatgttcgagagcacctacaggggtgctaaaaggatggctatcctaggagaaacggcctgggattttggttctgttggaggattatttacatctttaggtaaagctgttcatcaagtctttggatcagtatatacgactatgtttggaggagtaagttggatgattagaatattaattggatttctcgtactatggataggtacaaactctcgaaatacatcaatggcaatgacatgcatagccgtagggggaattacactcttcctggggtttaccgttcaagccgatatgggatgcgttgtttcgtggtcaggtaaagagttaaagtgtgggtctggcatattcgtagttgacaatgttcatacctggaccgaacaatataaatttcaaccagaaagtccagcaagactcgcatcagcgatattaaatgcacacaaggatggtgtttgtggtatacgtagtaccaccagattagagaacgtgatgtggaagcaaataacaaacgaactgaattatgtactctgggagggaggccatgatttaactgtggttgcgggcgatgtaaaaggtgtattgactaaaggtaaaagagccttaactccaccagtctcagacctaaaatactcctggaagacatggggtaaggccaaaatctttacaccagaggctaggaactcgacctttttaattgacggtccggacacatctgaatgccccaatgagcggcgggcttggaactcactagaggtagaggactacggctttggaatgttcacaaccaatatatggatgaagttcagagagggttcttctgaagtgtgcgatcacagattaatgtctgcagcaatcaaagaccaaaaagctgttcacgctgacatgggctattggatagaatcaagcaagaatcaaacctggcaaatagaaaaagcatcacttatagaagtgaaaacttgcttgtggccgaaaacacacactctttggtcaaacggcgtattagaatctcaaatgcttattccaaaaagctacgcaggacccttttcgcaacacaattacagacaaggctatgcaacacaaacagtaggaccatggcacctcggcaaactagagatagacttcggagaatgcccagggaccacagtcacaattcaggaagactgcgatcatagaggtccatccctacgtacaactaccgcatcaggcaaattggtgacacaatggtgctgtagatcgtgtacaatgccgccattaagattcctaggagaagacgggtgctggtacggaatggaaatccggccattaagtgaaaaggaagaaaatatggttaaatcgcaagtagcagctggacaaggtacaagtgaaaccttttctatgggcttgttatgcctgactcttttcgtcgaagaatgtcttcgcagacgcgtaactaggaaacacatgattcttgccgtagtaataacactctgtgctataattcttggaggtctcacatggatggacctacttagagctctgattatgttgggcgacacaatgagcggacgaatcggcggtcaaactcatctcgccataatggcagtctttaaaatgtctcccggatatgttctaggagtgtttttacgcaaattaacttccagagagactgcgctaatggtcattggtatggctatgacgacaaccctcagtatcccgcatgatcttatggagctgatagatgggatatcccttggcctcatactgttaaaaatagtaacccaattcgataacacacaagttggaacattagcactgagtctaacattcattaggtcaaccatgagtctagttatggcctggagaactatcatggcagttctctttgtcgtgacgctaataccattatgtaggactagctgtcttcaaaaacagagccattgggtagaaataaccgcccttatcctgggtgcgcaagcacttcccgtttacctcatgaccctcatgaaaggcgcatcgagaagatcctggccactaaatgagggtatcatggctgtaggtctagtcagtttactgggatcagctctattgaaaaatgatgtgccgctagctggacctatggttgcagggggactactactcgcggcctatgtaatgtccggaagctcagcagatctgtctttagaaaaagctgccaatgtacagtgggatgaaatggcagatatcaccggaagcagccccatcatagaggtcaaacaagacgaagacggatcatttagcatacgtgatgttgaagaaactaatatgattacattactcgttaagttggctctaataaccgttagtggtctctatcctctcgccattccagtgacgatgacattatggtacatgtggcaagtcaaaactcaacgatcaggagccctttgggacgttccaagtcccgctgctacacagaaagcagcactatccgagggtgtttatagaataatgcaaaggggactctttgggaaaacgcaagtaggagtaggtatccatatggaaggtgtcttccataccatgtggcatgttacccgtggcagtgtaatatgtcatgagaccggacgactagaaccgagctgggctgatgtaagaaatgatatgatatcttatggagggggttggagattgggtgataagtgggataaagaagaagacgtacaagtcttagcaatagaacccgggaaaaatccaaaacatgtacaaacaaagcctggattattcaagactttaaccggagaaattggagcagtaacgttagattttaaacccggtacttcaggctcgcctattatcaatagaaaaggtaaggttataggactctacggaaatggggttgttacaaagtcaggtgactacgtctctgcaataactcaagccgagagaataggtgaaccagactatgaagtagatgaggacattttcagaaagaaacgtctaactattatggacctacatcctggtgctggcaagacaaaaaggatcttaccgagcatagtgagagaggcattgaaaagacgtctaagaaccctgatacttgcaccaacaagagtggtcgccgcagagatggaagaagcgctcaggggattgcccataaggtatcaaactccagccgttaaaagcgaacataccggacgcgagatagtagatttaatgtgccatgctacattcacaactcgactgctctcaagcaccagggttccaaactacaatttaattgttatggacgaagcacattttacggatccgtcgagtgttgccgcgcgaggatatattagtaccagagtagaaatgggcgaagcagcggcgatttttatgaccgcaaccccaccgggagctacagatccatttcctcaatcgaactcacccattgaagacatagagcgagaaattcccgaaagatcatggaatacaggattcgattggataaccgactaccaaggcaaaacagtatggttcgtcccttcaattaaggcaggtaacgatatagccaactgtttaagaaaatcaggtaagaaagtcattcaattaagtcgtaagacattcgacactgaatatcctaaaaccaaacttactgactgggatttcgtggttacgacagatatatctgaaatgggtgcaaatttcagagcaggtagagtaatagaccctcgacgatgtttaaagccagtaatactcacggatggtccagaacgggtgattctagcaggaccaattccagtaaccccagcatctgcagcccaaagaagagggaggataggccgtaaccctacacaggaagatgatcaatatgttttcagcggggatccattaaagaatgacgaagatcacgcccactggactgaagctaaaatgctattggataacatttatacacccgaaggaatcatacccaccttgttcggaccagaacgagagaaaacacaagcaattgatggtgaatttaggctgcgaggtgagcagagaaaaacatttgttgaactaatgagaagaggtgaccttccagtatggttgagttacaaggttgcctcggcggggatatcatataaagaccgagaatggtgttttacaggcgaacgcaacaatcagattctagaagaaaatatggaagttgaaatctggacacgagaaggtgagaaaaagaaactaagaccaagatggctagacgctcgcgtttatgcagatcccatggcacttaaagacttcaaagagttcgcaagcgggagaaaatcaataacactagatattttgacagaaatagcatcactacctacttatttaagtagtcgagcgaaactagcgctagacaatatagtcatgttacacacgacagaaagaggaggtagagcatatcaacatgctctaaatgaattacccgagagtttggaaacactaatgcttgttgcattacttggagcgatgacagccggcatatttttattcttcatgcaaggaaaaggcataggcaaactatctatgggtttaattacaattgccgttgcatccggactgctttgggtcgcagagatacaaccgcagtggatcgctgcatcaatcattctagagttctttctaatggtactactcattcctgaacctgaaaaacaaaggaccccacaagacaaccaactaatatacgtaattcttactattctgactataattggccttattgcagccaatgaaatggggttaattgagaaaacgaaaacagacttcggtttttatcaagtaaagacagaaacaaccatattggacgtggatctaagaccagcaagtgcctggacattatacgccgtagctacaacgattctaaccccgatgttaaggcacactatcgaaaataccagcgcaaacctctctctagctgctattgcaaatcaagcggctgtcttaatgggactaggcaaaggctggcctttacacagaatggatctaggagtacccctacttgcgatgggttgttattcacaagtaaatccaaccacactaacagcttctcttgtaatgctgctagtgcattacgctataataggaccgggactacaggcaaaagcgactagggaggcacagaaaagaactgccgcaggaataatgaaaaacccaacagtagatgggataactgttatagatctagaaccgatctcatatgatccaaaatttgagaagcaactaggacaggtgatgcttctcgttttatgtgccgggcagttgctcttgatgaggacgacttgggctttttgtgaagtgttaacactcgcaacaggaccgatactcacgttgtgggaaggaaaccctgggcgtttctggaatacgacaatagctgtatcgactgcaaatatatttagagggagctatttagcgggtgctgggttagctttcagtttaataaagaacgctcaaacccccagaaggggaactgggactactggcgaaacattaggagaaaagtggaaacgacagttaaactcattggacagaaaagaatttgaggaatacaaaagatccggtatcttggaagtagatcgaacagaagcaaaaagcgcgttaaaagacggcagcaaaatcaaacatgctgtaagcagaggatcaagtaaaatacgctggattgtagagagaggtatggtaaagccgaaggggaaagttgtagatctaggatgcggacggggcggttggtcgtactatatggctaccttaaagaatgtcacggaagttaaaggatacacaaaagggggtccggggcatgaagaaccaataccgatggcaacttacggctggaatctagttaagttacattctggagtcgatgtgttctataaaccaactgagcaagtagatactttactatgtgacattggagagtcatcttcaaatccaacaatagaagaaggcagaacgcttcgagtattaaaaatggtggaaccatggttatccagcaagccggaattttgtataaaagttctcaacccctacatgccaacagtaatagaagaactagaaaaattacaacgaaaacacgggggcaatttggtacggtgcccactttccagaaattcgacacatgaaatgtattgggtatccggtgctagtgggaacatagtttcaagtgttaatactacaagtaaaatgttgcttaaccggtttaccactagacaccgaaaaccaacatatgaaaaagatgtagatctaggcgcaggaaccagatccgtttctacggagacagaaaagccagatatgacaataattgggcgtagattacagcgactacaagaagaacataaggaaacttggcactatgaccaagagaatccttatagaacatgggcctatcatggttcatatgaagctcccagcacaggttcagcaagctctatggttaacggggtagtaaaactactaactaaaccgtgggatatgattcctatggtcacacagcttgcaatgacggatacaactccatttggacaacaacgagtttttaaagaaaaagtagacacacggacacctcagccgaaacccggaaccagaatggtcatgactacaacggcaaactggctatgggcactcttggggaagaagaaaaacccacgtttatgtacgcgtgaggagttcataagtaaagtaagatcgaatgccgcgattggcgctgtttttcaggaagaacaaggatggacttcagcgagcgaggctgtaaacgactcaagattctgggaactcgtagacaaagaaagagctctgcaccaggaagggaagtgtgaatcgtgtgtctataatatgatgggaaagagagagaagaaattaggtgagttcgggagagctaaaggaagtagagcaatttggtatatgtggctaggggcaagattccttgagtttgaagctctaggattcttaaatgaggatcactggtttggacgagaaaattcgtggagtggagtagaaggagagggcctacatagattggggtatatcctggaagaaatcgataagaaagatggtgatttaatgtatgcagatgatacagccggatgggatactagaataacagaggatgacctgcaaaatgaggaactaataacggagcagatggctcctcatcacaagatactagccaaagccatatttaaattaacataccaaaataaagtcgttaaagtcttgcgacctactccaagaggagctgttatggatataatttcaagaaaagatcagagaggaagcgggcaagtcggaacctatggacttaatacattcacgaacatggaagtccaattaataagacaaatggaagcagaaggagtaattacgcaggatgatatgcaaaatccaaaaggactcaaggagcgagtcgagaagtggctccgggaatgtggagtggatagactaaagcgaatggcaataagtggggatgattgcgtcgtaaagccacttgacgaaaggttcggtacaagcctactattcctcaacgacatgggaaaggttagaaaagacataccgcagtgggaaccatcgaaaggttggaaaaactggcaagaagtgccattctgtagtcaccactttcataaaatctttatgaaagatggacgctccctggtagttccgtgtagaaatcaggatgagttgattggtagagccaggattagtcagggagccggatggagcctacgagaaacggcttgtcttggaaaggcttatgcccagatgtggagtctgatgtatttccacagaagggatctaaggttagctagcatggcaatatgcagtgcagtacctaccgaatggttccccacttctagaacgacgtggtcaatacacgcgcaccatcagtggatgaccaccgaggatatgttaaaagtatggaatcgagtatggattgaggataatcctaacatgatagataaaactccagtccactcctgggaggatataccttatttagggaaacgagaagatctctggtgcggctctctaataggtctttcttcgagagcaacatgggcaaagaacatacatacagcaattacacaagtccgtaatttaatcgggaaagaggaatatgttgactacatgcctgtcatgaaaagatatagcgcaccatcagaatctgaaggtgttctataa

SEQ ID NO: 23606 - RNA, 9867 nt, synthetic construct
  misc_feature 1..9867: note = derived and/or modified CDS sequence (opt6) from DENV-4__EU854295__SS-prME
  source 1..9867: mol_type = other RNA
tctactataacccttttatgtttaatacctactgttatggcgttccacttatccacgagagacggagaacctttaatgatagttgctaaacatgaaagaggacggccgttgctatttaaaactaccgaaggtataaacaaatgcacattaatcgctatggaccttggagaaatgtgtgaagatactgtgacttataaatgtcctcttctggtaaacacagaaccagaagatatcgattgctggtgcaacttaacgagcacttgggtaatgtatggcacatgcacacaatctggtgaaagacgtcgtgagaaaaggtcggtagctcttactccgcactccgggatgggtttagaaacacgagcggaaacttggatgtcgtcagaaggtgcctggaaacatgcacaacgagttgaatcgtggattcttagaaatcccggctttgcacttctcgcaggattcatggcatacatgataggccaaactggtattcaaagaactgtattctttgttttgatgatgcttgtggcaccatcatatggaatgagatgtgtgggggtcggcaaccgggactttgtagaaggagtttctggcggagcttgggtagatttggtattggaacatggaggttgtgtaacgacgatggcccagggaaaaccaacattagattttgaacttactaaaacaacagcgaaagaagtagcattgttgcgaacatattgtattgaagccagcatttctaacataacaactgccacgcgatgtcctacacaaggagaaccctatttgaaagaagaacaggatcaacaatacatttgcagacgcgacgtcgtagatcgaggatggggaaatgggtgtgggctgtttggcaaaggaggggttgtaacctgcgctaaatttagttgttccggtaagatcactggtaatttagtacagatagaaaatttagaatatacagttgtcgtaactgttcataacggagacacacatgcagtaggcaatgacacttctaaccacggcgttactgcaacaataactccaagaagccctagtgtcgaagtaaaactaccagattacggtgaactaacactagattgtgaaccccgttctgggattgattttaatgaaatgatcttaatgaaaatgaagaagaaaacttggctagtacataaacaatggttcttggatctgcctttaccttggacagccggagccgatacttcggaagtgcattggaactataaagaaagaatggttacatttaaagtaccacatgcaaaaaggcaagacgtaactgtgttgggttcccaagaaggtgctatgcacagcgctctggctggtgcgactgaagtagattcaggtgacggcaatcatatgtttgcaggacatctcaaatgcaaagtcagaatggaaaaattaaggattaaagggatgtcatacaccatgtgcagcggaaaattctcgattgataaagagatggccgagacacagcatgggacaacagtcgttaaagtgaaatatgaaggtgcaggcgctccctgtaaagtacctatcgaaattagagatgtaaacaaagagaaagttgttggtagagtcatctcttcaactccactcgcggagaatacaaactctgtaaccaacattgagttggaaccgccattcggtgatagttacatagtaataggtgtgggtaattcggcactaacactacactggtttcgaaaaggttcttccatcggcaaaatgtttgaatccacttaccgaggagcgaagcgtatggcaatcctgggagagaccgcttgggacttcgggtctgtaggcggtctttttacatccttaggcaaagcggtccatcaagtattcggctcagtttatactacaatgtttgggggtgttagttggatgatacgtatactgatcggatttttagtcttatggataggaacaaattctcgtaatacttcaatggcaatgacttgtatcgcagtcggcggcattacactcttcctcggtttcactgtacaggcagacatgggctgtgttgtgtcatggagtggacgggaactaaaatgcgggagcggcatctttgtagtagataatgttcatacatggaccgaacaatacaaatttcaacccgaatctccagcaagattagctagtgcaattttgaatgcacataaagatggagtatgtgggatacgttcaaccacaagactagaaaatgtaatgtggaaacagattacaaatgagctgaactatgtcttatgggagggaggccacgatctaactgtcgtagcgggagacgtcaaaggtgtactaactaaaggaaaacgggcactaactccaccagtatcagacttaaaatactcatggaaaacatggggcaaagcaaagatatttactccagaagcaaggaacagtacgtttttgatagacggaccggacacttcagaatgcccaaacgaacgacgagcctggaacagcctcgaagtagaagattacggattcggaatgttcacaacaaatatctggatgaaatttcgcgaagggtcctcggaagtatgtgaccatcgactgatgtcagccgctattaaagaccaaaaggccgttcatgctgacatgggttactggatagagtcgtccaagaatcaaacctggcaaatagaaaaggcttctttaattgaagtcaaaacctgtctttggccgaaaacacatacgctatggtctaacggagttctagaaagtcagatgttaataccgaaaagctatgctgggccattttcacaacataattatcggcaaggttatgcaacccaaacagtcggtccatggcacttagggaaacttgaaatagatttcggagaatgtcccggaacgacagttaccatacaggaggattgtgaccatagaggaccttctctacgaacaacaacagcgagtgggaagctcgtaacacaatggtgctgtagatcttgtactatgccgccattgcggtttttaggcgaagacggatgttggtatggaatggaaataagacccctgtccgagaaagaagaaaatatggtgaagtcacaagtagccgccggtcctggtacaagcgaaacattctccatggggctactttgcctaacactattcgtagaagaatgtctaaggagacgagttacaagaaagcacatgatcttagcagttgtaataaccttatgtgcgataatactaggcggattgacatggatggatttacttcgcgcattaattatgttaggagatactatgagtggaaggataggaggacagacacatctcgccataatggcagtattcaaaatgtctcctgggtacgtacttggagtatttttgagaaagctaacaagtcgggagactgctctaatggtgattggtatggctatgacaaccactttgtccattccacatgaccttatggagcttattgatggtatatcactaggcctaatacttcttaaaatagtaacacagttcgacaacactcaagttggaaccctcgcattaagcctaacgttcatacgaagcactatgtcactcgtgatggcatggagaaccataatggcagtgctatttgtggtaacgttaatccctttatgcagaacgtcttgcttacagaagcagtcgcactgggtagaaataaccgctttaatactaggtgcgcaagctctcccggtttatttaatgaccctaatgaaaggagcaagtagaagatcttggcctcttaacgaaggaataatggctgtgggtctcgttagcttattaggatcagcactattgaaaaatgatgtaccactagctggccctatggtcgctggcggccttttactagcggcctacgtgatgagtgggtcatcagcagatctgagtttagaaaaagctgccaatgttcaatgggatgagatggcagatataacaggttcgtcgcctatcatagaggttaaacaagatgaagatggctccttttccattagagacgtagaagaaacgaatatgattacactcctcgttaagttagctttaattactgtttcaggcctatatccacttgccatacccgttacaatgaccctttggtatatgtggcaggtcaaaacacaacgctcaggagcgttatgggatgtaccgtcacccgcggctacacaaaaggccgcactctctgaaggagtatatcgtataatgcaaagaggattattcggaaaaacacaagttggcgtgggaatacacatggaaggggtttttcacacaatgtggcacgttactagaggatctgtcatatgtcacgaaacaggacgcttagaaccgagctgggcagacgttagaaacgacatgatatcttatggtggtggctggcgtctgggagacaaatgggacaaagaagaggacgtacaggtactggctattgaaccagggaaaaatccaaaacatgtacaaacgaagccgggtctattcaaaacacttacaggagaaattggggcagtcacactagattttaaaccaggaacaagtggttcaccaataataaatcgaaaaggaaaggtaatcgggctctatgggaatggcgtagtgactaaaagcggggattatgtgtcagcaatcactcaagccgaaagaataggagaaccggactacgaggtagacgaggacatcttcaggaagaaacgacttaccattatggatttgcaccctggtgcaggtaaaaccaaacgaattttacctagtatcgtccgagaggcattaaagaggcgcctgagaactttaatattagcaccaactagggtagtagccgcagaaatggaagaagcgttgcgaggattgccaattagatatcaaacaccagctgtcaaatccgagcatacaggaagagagatcgtggatctaatgtgtcatgccacctttactacgaggttactaagtagcacaagggtacccaattacaacttaatagtaatggatgaggctcatttcacggacccaagtagtgtagcggcaagaggctacatatcaacgcgagtagaaatgggggaagcagcagcgattttcatgactgcaacacctccgggtgcaacagacccgtttccacaatccaactcacctatagaagacatcgaaagagagataccagagcgatcatggaatacgggattcgattggataactgactaccaaggaaaaaccgtttggttcgtaccatcaataaaagcaggaaatgacatagctaactgcctaagaaaatccggcaagaaagtcatccaactatcgcgcaagacatttgacaccgagtacccaaaaacaaagttaactgattgggactttgtagtaacaactgatatctctgaaatgggcgctaacttccgggctggcagagttattgatccaagacgatgtctaaaaccggtaatattaactgacggcccagaaagggtaatattagcaggacccatacccgtaacacccgcatccgctgcacaaagaaggggacgtataggtaggaacccagcacaggaagatgaccaatatgttttcagtggcgatcctttgaagaacgatgaggaccatgcccactggacggaagcaaaaatgctactggacaacatctacacgccagaaggaataatacctacactattcggcccagaacgtgagaaaactcaagccatagatggggaatttcgactgagaggtgaacaacggaaaacatttgttgaacttatgcgacgaggggacttaccggtgtggttgagctacaaagttgccagtgctggaataagttataaggatcgtgaatggtgtttcacaggcgaacgtaacaatcaaatattggaagagaacatggaagtagagatatggacaagagagggggagaagaagaaattgaggcctaggtggcttgatgcacgagtttacgcagatcccatggcactcaaggattttaaagagttcgctagtggcaggaaatcgataaccctcgatatattgactgagatcgctagtctaccaacttatctttcatctagagcaaaattggcattggataatattgtcatgttacatacaacagaaagagggggtcgcgcatatcaacacgcgttgaacgaactaccagagagcttggagacactaatgttagtagctttgttgggcgccatgacggcaggaatatttctatttttcatgcagggaaaaggaataggaaaactcagtatgggtcttattacgatagcagttgcctcaggattactctgggttgcagaaatacaaccacagtggatcgctgcatctatcatattggaatttttcttaatggtattattaatcccagaacctgagaaacagagaacaccccaagataatcagcttatttatgttatattaacaatactaacaataattggtttaatagcagcaaatgaaatgggattgatcgagaaaaccaaaaccgacttcggattttaccaagttaaaacggagacaacgattctggatgttgatctaagaccagctagcgcatggacactgtatgcagttgcaacgactatactcacacccatgctgcgtcatacgattgaaaatacctcagccaatttaagcctagcagccattgcaaatcaagctgctgtgctaatggggttgggcaaaggatggccattacaccgcatggatctgggggtaccacttttagccatgggctgctactctcaggtaaatccaaccacgctaactgcatctcttgttatgttgttagtgcactatgctatcataggacccggcttacaagcaaaggcaacaagggaagcgcaaaagcgaactgcagccgggataatgaagaatccaacagtagatggtattacggtaatagacctcgaaccgatatcatatgaccctaaattcgagaaacaattgggacaggtcatgttattagtcctttgtgcgggacagttattattaatgagaacaacatgggcattctgtgaagttctcacactagcaacaggacctatactaacgctatgggaaggtaacccaggcagattttggaataccactattgcagtgtctacagcgaatatctttcggggttcataccttgcgggagcaggacttgcttttagtctcatcaaaaatgctcagacgccacgtaggggtaccggtacaacaggtgaaacgttaggcgagaaatggaaacgacaactcaattctttggatagaaaagaatttgaggagtacaaaaggagtggaatattagaagtagaccgaacagaagcaaaaagtgccctaaaagatggctcgaaaattaaacatgccgtgagtcgagggagtagcaaaatacgttggatagtagaacgcggaatggtaaaacccaaaggtaaagttgtggatttaggatgcggtagagggggctggtcatactacatggcgaccctaaagaacgtcacagaggttaaagggtacacaaaaggcggtccaggtcacgaagaaccaataccgatggcaacttacggatggaatttagtgaaactccattcaggtgtagacgtattttataaacctacagaacaggtagacaccctattgtgcgacatcggagaatcaagtagtaatcccaccattgaagaaggcagaacgttacgtgttttgaaaatggtcgagccatggctttcctcgaaaccagagttttgtatcaaagttttgaatccgtatatgcctactgtaatagaggaactagaaaaactgcaaagaaagcacggtggtaacctcgtacggtgtccactttccagaaattcaacacatgaaatgtattgggtctccggcgcatcgggtaatattgtgagtagtgtaaatactacgagtaaaatgcttcttaatagatttacaacacgtcaccgcaaacccacgtacgagaaagacgtggatctaggcgctggaacaagatccgtttcaaccgaaactgaaaaaccagatatgacaatcataggtcgacgattacaacgtttgcaagaggaacacaaagaaacatggcattatgatcaagaaaatccttatcggacgtgggcgtaccatggaagttatgaagctccatcaacgggctctgcatcgagtatggttaatggggtagtgaagttgcttacaaagccatgggacgtcatacccatggttacccagttagctatgacagacactaccccttttgggcaacagcgtgtttttaaagaaaaagtagacaccagaactccgcagcctaaacctggcacacgggttgtcatgactacaacagctaactggttgtgggcgcttcttggcaagaagaaaaatcccaggttatgtacgcgtgaagaatttatctcaaaggtaaggagtaatgctgcaataggagctgtgtttcaagaagaacaaggatggacatctgcttctgaggctgtaaacgactcccgattctgggagttggtggataaagaaagagcattacatcaggaaggtaaatgtgaatcatgtgtttacaatatgatgggtaaacgagagaagaaactaggtgaatttggtcgggctaaaggatcgcgagccatttggtatatgtggcttggagctagattccttgagttcgaagctctaggcttcttgaatgaagatcattggtttggcagagagaatagttggtcaggtgttgaaggcgaaggactgcaccgtctcggatatatactggaagaaatagacaagaaagatggtgatttaatgtatgcagatgatacagcaggctgggataccagaatcactgaagatgatttacaaaacgaagaacttatcactgaacaaatggctccacatcacaaaattctagccaaagcaatttttaagctgacataccagaacaaggtagtgaaggtactgcgtccaactccgagaggggctgtaatggacatcattagcagaaaggatcagcgaggttccgggcaagtgggcacctacggacttaacaccttcactaatatggaagttcaactaattagacaaatggaagcggaaggagtcattacacaagacgacatgcaaaacccaaaaggtttaaaagaacgtgtcgaaaaatggctgcgagagtgcggtgtggatagactaaaaagaatggccataagcggtgatgattgtgtagtaaagccacttgatgaacgtttcggaacttcacttctcttccttaatgatatgggtaaagtaagaaaagatataccacaatgggaacctagtaaaggatggaagaattggcaagaagtcccattttgcagccaccactttcataaaatttttatgaaagatggtagaagtctagtcgtaccatgcagaaatcaggatgaattaatagggagggcgagaatatcacagggcgcaggctggagtctcagagagacagcctgcttagggaaggcttatgcccagatgtggtcgttaatgtacttccaccgcagagatcttagactggcttcaatggccatatgttctgcggttcccacggaatggttcccgacttctaggacaacttggtccatacacgcccaccatcagtggatgacaacagaagacatgctgaaggtctggaatcgggtctggatcgaagataatccaaatatgatagacaaaactcctgtacacagttgggaggatataccttatttaggcaaacgtgaggatttatggtgtgggtctcttataggattgtcttcacgggcaacatgggctaaaaatattcatacagcaattacacaggtaagaaatcttatcggtaaagaagaatacgttgactatatgcctgtaatgaagagatattcagcccccagtgaatccgaaggagtactctaa

SEQ ID NO: 23607 - RNA, 9867 nt, synthetic construct
  misc_feature 1..9867: note = derived and/or modified CDS sequence (opt6) from DENV-4__EU854296__SS-prME
  source 1..9867: mol_type = other RNA
tcaactataacgctactttgcttaatcccaacggtaatggcatttcacctcagtacaagggacggtgaaccgctcatgattgtagctaaacatgaaagaggtaggccgctcctctttaaaaccacagaaggaatcaataaatgcacgttgattgctatggacttaggagagatgtgcgaagacacggtgacatacaaatgtccactgctagttaatacagaaccggaggatattgactgctggtgtaacctaactagtacttgggtgatgtatggcacatgtactcaatctggagaaagacgtcgggaaaaaagaagcgttgctctaacaccacacagtggaatgggacttgagacaagagcagaaacatggatgtcatcagagggtgcatggaaacacgcacagcgggtagagagttggatactaagaaatccaggcttcgctctgttagctggttttatggcctatatgattgggcaaacaggcattcaaaggacagtcttcttcgtcttaatgatgcttgtggccccgtcatacggcatgcgctgtgtaggagtaggcaatagggatttcgtagaaggcgtcagcggaggagcatgggttgatttggttttagaacatggtggctgcgttactactatggcgcaaggcaaaccgactttggattttgaattaaccaagaccactgcaaaagaagtagctctactaaggacatattgtatagaggcatcaatctcaaatattactacagcaacaagatgccctacacaaggagaaccttacttaaaagaagaacaagatcaacagtatatatgtcgtcgagacgtggtagacagaggatggggtaacgggtgtggattgttcgggaaaggaggagtagtgacatgtgcaaaattcagttgttcaggaaaaataaccggaaacttagtacaaatcgaaaacctggaatacacggtcgtagtcactgtacacaatggtgatacacatgccgtaggaaatgacacgtcaaaccacggtgtaaccgcgacaataactccccgaagtccaagcgtcgaagtaaaactccccgactatggggagctcacccttgattgtgaaccgcgaagtgggatagatttcaatgaaatgatcctcatgaaaatgaagaaaaaaacgtggttggtgcacaaacaatggtttttagacttaccactcccgtggacagctggagcagatacgtcggaagttcattggaattataaagagagaatggttacatttaaagtcccgcatgcaaaaagacaagacgtaactgtactcgggtcccaagagggtgctatgcatagtgcattagccggtgctacggaagtagactcaggagatggaaaccatatgtttgcaggacacctaaaatgtaaagttagaatggagaagctaagaataaaaggtatgtcttatacaatgtgtagtggaaaatttagcatcgataaagagatggccgaaactcaacatggcaccacagtagtaaaggtaaaatatgaaggagcgggagcgccgtgcaaagtccctatagagattagggatgtcaataaagaaaaggttgtaggtcgtgttatatctagcacgccgcttgccgaaaacaccaatagcgtaacaaacatagaattggaaccaccatttggtgacagctatatcgtaataggcgtcggtaattccgcgctcacgttacattggtttcgaaagggatcaagcattggaaaaatgttcgaatcaacatacagaggagcaaaacgaatggcgatattaggagagactgcctgggacttcggatcagtcggtggattgtttacgtcactaggaaaagctgtacatcaagtatttggatctgtttatacgaccatgtttggaggagtgagttggatgatcaggattctgataggttttctggtgttatggattggtacaaactcccgaaacacatcaatggctatgacatgtatagcagtaggaggaataacgcttttcttaggctttaccgtacaagctgatatggggtgtgttgtttcctggtccggaagagaattaaagtgcggatcaggtattttcgtagttgataacgtacatacttggactgagcaatataagtttcagccggaaagcccagctagactagcaagcgcaatattaaacgctcataaggatggcgtatgcggcataagaagtacaactcgtctagaaaacgtaatgtggaaacaaattacgaatgaattgaattatgtattgtgggaaggaggccatgatctcaccgtagtcgcaggtgacgcgaagggagtgttaacgaaaggaaagagagctctaactccacctgttagtgatcttaaatactcatggaaaacgtggggcaaagccaagatatttactccggaagcaagaaacagtacgttcttaattgatggaccagatacctctgaatgcccaaacgagcggcgggcgtggaatagtctggaagtcgaagattatggctttgggatgttcacaaccaacatttggatgaaatttagagaaggatcttcagaagtctgtgatcacagacttatgtctgcagcaataaaagatcaaaaggctgtacatgccgatatgggatactggatagaatcctctaagaatcaaacatggcaaattgaaaaagcaagtttaatagaggtcaaaacttgcttatggcccaaaactcatacgctttggagcaatggagttttagaatcgcaaatgttgattcctaaatcgtatgcagggccgttcagccaacataattatcggcagggatacgctacacaaacagttgggccttggcacttgggtaaacttgagattgatttcggcgaatgtcccggcactacagtaacaattcaggaagactgtgatcatcgcggaccttcactacgaacaactactgcatcgggcaaacttgtgacccaatggtgttgtcggtcatgtactatgcctcctcttcgattcctaggcgaagacgggtgttggtacggtatggaaataagacctctcagcgaaaaagaggaaaatatggtcaagtcacaagtcacggctgggcaaggtactagtgagaccttctcaatgggactcctttgtttaactttatttgtagaagaatgtcttcgacgtcgtgtaacaagaaagcatatgatcctcgccgttgtaataacattatgtgcgataatactcggggggctaacttggatggatttactccgtgctcttattatgctgggcgacactatgtcaggcaggattggtggacaaacacatttagcaattatggcagtatttaaaatgtcgccaggatatgtattgggcgttttcctcaggaagcttacatcaagagaaacggctctaatggttattggaatggcgatgaccacaactctaagtatccctcatgatttgatggaattaatcgacggtatatcgctgggtctaatcctattaaaaatagtaactcaatttgataatactcaggtcggaaccttagcgctatcgctaacatttatacgctcaaccatgtcactggtcatggcatggagaacgattatggcagtactctttgtagtgacgctaatacctctttgtcggacaagctgtctccaaaaacaatctcactgggtagagataaccgcattaatactgggagcgcaggctctaccagtgtaccttatgacccttatgaaaggagcaagtaggaggtcctggcccttgaacgaaggcattatggcagtgggactagttagcttgttggggtcagctctacttaaaaacgatgttcctttagcaggccccatggtcgcgggagggctattactagcagcatacgtgatgtcaggaagttcagcagatttaagtttggagaaggcagcaaatgtgcaatgggatgaaatggcagatattacgggtagtagtccaattatagaggttaagcaagatgaagatggttcgttctcgatacgggatgtagaagagacaaatatgattacccttttagtaaaattggcacttattaccgtaagcggtctataccccttagcaatacctgtgactatgacattatggtatatgtggcaagtaaaaacccaacgaagcggagcactatgggatgtccccagcccagcagcaacgcaaaaagctgcgctaagtgaaggtgtctaccgtataatgcaaagaggattattcggtaagactcaggttggggtaggtatacacatggaaggtgtatttcatactatgtggcacgtaactcggggtagcgtaatatgccatgaaactgggaggctcgaaccttcatgggccgatgtaagaaatgatatgatcagctacggaggcggttggagacttggagataaatgggataaagaagaggatgtccaagtacttgctatagagcccggaaaaaatccaaagcatgtgcagacgaagccagggctgtttaaaactctaacaggagaaataggagcggttactctagattttaaaccgggaacgagtggatcacctataataaatagaaaaggtaaagtcattggattatacggaaacggagtcgttacaaaatcaggggattacgtctctgccatcacacaagcagagagaatcggggagcctgactatgaagttgacgaagacatattcagaaaaaaaaggctaacaattatggatctgcatcccggagccgggaaaactaaacgaatactacctagcatagtcagggaagctttaaaaagacgattgcgaacattaatcttggcgccgactagggttgtagctgctgaaatggaagaagcattaaggggtctaccgataagataccaaacgccggcggtaaaaagcgaacatactggaagagaaatagtagatttaatgtgccatgctacttttacaacacgattgctatctagcacgcgagtacccaattacaaccttatcgtaatggacgaagcgcactttactgacccaagtagtgttgcagcaagaggatatattagtaccagagtagagatgggcgaagccgctgcaatttttatgacagctacaccacccggcgctactgatccctttccgcaaagtaattcaccgattgaagatatagagcgagaaataccagaaagatcctggaatacaggttttgattggataactgattaccagggaaaaactgtatggtttgtaccaagtatcaaagcaggtaacgatatagccaattgcttacgaaaaagcggtaaaaaagtgatacaattatctaggaaaacattcgatactgaatacccaaagactaagcttacggattgggattttgtagtaacgaccgacataagtgaaatgggggctaatttcagagcgggtcgggtaattgatccaagacgttgtttgaagccagtaatattgactgacgggcccgaaagggttattctagcaggtccaatacctgtcactccagcttcggccgctcagagaagaggtaggattggtagaaacccagcccaggaagatgatcaatatgtgttctcaggagatccgttgaagaacgatgaagatcacgcacattggaccgaagcgaaaatgctccttgataatatctacactccagaaggaattatacctactctctttggtcccgaacgtgaaaaaactcaagccatcgacggggagtttagacttagaggagaacaaagaaaaacttttgtggaactgatgaggagaggagacttacctgtgtggctgtcttacaaagttgcttctgcagggatttcatataaggatcgagaatggtgtttcactggagagaggaataatcaaatcctagaagaaaatatggaagtcgaaatatggactagagagggggagaagaaaaaattaagaccaaggtggttagacgctcgggtatatgcggacccaatggcgctcaaggattttaaggagttcgcctctggccgtaaatctattactttagatatattgacagaaatagcgtcacttccaacttatttgtccagtcgagctaagctagcacttgataatattgttatgttacatacgacggaacgaggtggcagagcatatcaacatgcattaaatgagctcccagaatccttggagaccttaatgctagtagcgttgctgggggcaatgaccgctgggattttcctcttcttcatgcagggaaagggtataggaaagcttagcatgggtcttataacaattgcagttgcttctggactcctatgggtcgctgaaattcagcctcaatggattgctgccagcataatattggaatttttccttatggtattgttgataccggagccagaaaaacaacgaacaccgcaggacaaccaactcatatacgttatattaacaatattaacaataataggtttaatagctgcaaatgaaatggggttgatcgaaaaaactaaaactgatttcggattttaccaggcgaaaacagagacaactattctagacgtcgatttgcgacctgcatcagcatggacgctctatgccgtcgcaacaaccattctgacccctatgttacgacacactatagaaaatacatccgccaacttgagtttggcggctatagccaatcaagcagcggtactaatgggcttagggaaaggatggcccttacataggatggacttaggcgttccacttttagcgatgggatgttactcacaagtgaacccaacaacgctgacggcctcgttagttatgctattagtgcattatgcgataattggaccaggtttacaagcaaaggcaaccagagaggcacaaaagagaactgcagcgggaataatgaaaaatccaactgttgatggaatcacagtaattgatctggaaccaatcagctacgatccaaagttcgaaaaacaactcgggcaggtaatgttgctagtgttatgcgccgggcaactgctactaatgcgaaccacatgggcattttgcgaagttttaacattagcaacaggaccaattttaaccctctgggagggaaatccaggacgattttggaacaccactatcgcagtttccacagcaaatatatttcgaggcagttacttggctggcgctggcctagcgttttcattaatcaaaaatgctcagacccccagaagaggtaccggaacaataggagaaacacttggcgaaaagtggaaacgacagttaaattccctagaccgaaaagagttcgaggaatacaaacgctcgggaatcttagaagtagatcggactgaggccaaaagtgctttgaaggacgggagtaaaatcaaacacgcagtctctagaggatcatctaaaatcagatggattgtagaaagaggaatggttaagccaaagggtaaagtggtggatctaggctgtggccgaggcggttggagttactatatggccacgctgaaaaatgtgaccgaagttaaaggatacacaaaagggggacccggccacgaagagccaatacccatggctacttacggttggaatctggtcaaattgcattccggagtggatgtattttatagaccaacggaacaggtagacacccttttatgcgatataggtgaatcaagcagtaacccaactatagaggaagggagaacattgagggtattaaagatggtagaaccttggcttagctcgaaaccagagttttgtattaaggtgctaaacccatatatgccgaccgtaatagaagaattagagaaactgcaacgaaagcatggcgggaatcttgtgcgctgtccgctctcacgcaattcgactcacgaaatgtattgggtatctggagcctcgggtaatatagtatcgtcagtcaataccacatcaaaaatgctgttaaatcgttttacgacaagacatcggaaaccgacatatgaaaaagacgtagatttaggcgccggtacacgatctgtcagcactgaaactgaaaaacctgacatgacaatcattggaagaaggctgcaaagattgcaggaggaacacaaggaaacttggcattatgaccaagaaaatccatacagaacttgggcttatcatggctcatatgaagctccttctacaggttcagctagtagtatggtaaatggggtagtgaaattattaactaaaccttgggacgtcatacccatggtgacgcaattagcgatgacagatacaacaccattcggtcaacagagggttttcaaagagaaagtagatacaagaacacctcaaccaaaacccggaacaaggatggtaatgaccacgacagcaaactggttatgggcactgttaggtaaaaaaaaaaacccccgtttgtgtacaagggaggagttcatttctaaggtacgctcaaatgcagcgataggagcagtcttccaggaagagcaagggtggacaagcgctagcgaagcggtaaatgattctcgattctgggagttggtggataaagaacgggcactccatcaagaaggaaaatgtgagtcgtgcgtttataatatgatgggtaaaagagagaaaaaactaggagaatttggacgagcaaaagggtcacgtgctatatggtatatgtggttgggtgcaagatttttggaatttgaagccctaggttttctaaatgaggatcactggtttgggagagagaacagctggtcgggagtagaaggagaagggctgcatcgattaggatatatacttgaagaaatcgacaaaaaagatggcgatctcatgtatgcagatgatactgcagggtgggatacacgcattacagaggatgatttgcaaaacgaagaacttatcacagaacaaatggctccccatcacaagatacttgcaaaggccatatttaagttgacttaccaaaacaaggttgttaaggtactacggccaactcctaggggagcagtcatggacataatatcacggaaggatcagcgaggatcaggacaagttggaacatatgggttgaacacttttactaacatggaagtacagcttataaggcaaatggaagctgaaggagtaataacacaagacgatatgcaaaatccgaaaggacttaaagaaagagtagaaaagtggttacgggaatgtggagtagaccgactaaagaggatggcgatctccggcgatgattgcgttgtgaagccattagacgaacgatttgggacgtccttgctatttctaaatgacatgggtaaagttaggaaagatataccacaatgggaaccaagcaaaggttggaaaaattggcaggaagtaccattttgctctcaccattttcataaaatctttatgaaggatggaagaagcttggttgtaccttgtagaaatcaagatgaactaatcgggagggcgagaattagtcaaggcgccggctggagtttgagagagacggcatgtttgggcaaagcatatgcacaaatgtggtctcttatgtactttcacaggagagaccttcgtctggccagcatggctatctgttcagctgtccccactgaatggttccccacctctaggactacttggtcaattcatgctcaccatcaatggatgacaactgaggatatgttaaaagtatggaatcgcgtatggattgaagacaaccctaatatgatagataagactcctgtacattcttgggaggatattccatacttgggaaaacgagaggatttgtggtgtggttcacttatcggtttaagttcccgtgcaacttgggctaaaaatatacacaccgcaatcacacaggtacgcaacctcattggaaaggaagagtacgtcgattacatgcccgttatgaaaaggtatagcgcaccaagtgaaagcgagggcgtattataa

SEQ ID NO: 23608 - RNA, 9867 nt, synthetic construct
  misc_feature 1..9867: note = derived and/or modified CDS sequence (opt6) from DENV-4__GQ199878__SS-prME
  source 1..9867: mol_type = other RNA
tcaaccataactttattatgcttaattcctacagtcatggcttttcatctttccaccagagatggtgaaccattaatgatagtggccaaacacgaaaggggtcgtcccctattattcaaaacgacggaaggaattaataaatgtacgttaatagcaatggacttaggtgaaatgtgtgaagatacagtgacgtataaatgtcctttacttgttaatacagaaccagaagatatcgattgctggtgtaacttgacatccacatgggttatgtacggaacctgtactcaatccggagaaagaagaagggaaaaacgctcagttgcacttacgcctcactctgggatgggtcttgaaaccagagccgaaacatggatgagctcggaaggtgcatggaaacatgcgcaaagggtggaaagttggatattacgtaaccctggatttgcactgctggcaggatttatggcctatatgataggacaaacgggaatacagcgtacggtgttctttgttttgatgatgttagtagcaccttcatacggaatgagatgtgttggagtaggaaatagagacttcgtagaaggagtatccggaggtgcctgggtcgatttagtgctagaacacgggggatgcgttacaactatggcacaaggaaaacctaccttagacttcgaacttactaaaacaacagcgaaagaagtagcgttgctgagaacttattgtatagaagcgagtattagtaacataaccacggctacgagatgtccaactcagggagaaccatacctaaaagaagaacaggaccaacaatacatatgtcgacgagatgtagtagaccgaggatggggcaatggctgtggactttttggtaaaggcggcgtagtaacttgcgctaaatttagttgcagtggcaaaattaccggaaatctcgtacaaattgagaatctcgagtataccgtagttgtcacggttcataacggtgatacccatgctgtaggtaacgatacttcaaatcacggagtaacggcaacaatcactccaaggagtccaagtgttgaagtgaaacttccagattacggtgagctgacattagattgtgaaccacgttcgggtatagattttaacgaaatgatactcatgaagatgaagaagaaaacttggttagtgcataaacaatggtttttggatttaccgctaccctggacagcgggagcggacaccagtgaagtccattggaattacaaagaacgaatggtgacattcaaagtaccacatgcgaaacgacaagacgttacagtgttaggttcgcaagaaggcgcaatgcatagtgctctcgcaggagccaccgaagtagatagtggagatggaaatcatatgtttgcgggacatctaaaatgtaaagtaagaatggaaaaacttagaataaaaggaatgagttatactatgtgttccggtaagttttcaatcgataaagaaatggctgaaactcaacatgggactacagttgtcaaagttaagtatgaaggagcaggagcaccttgcaaagtacctattgaaatccgagacgtgaataaagaaaaggttgttgggagagtcattagttcaacgccattagcagaaaatacaaattccgtcacaaacatagagttagaaccaccttttggagacagttacattgtaataggcgtagggaacagtgcgttaactttacactggtttagaaaaggttctagtataggaaagatgtttgaatcgacctatcgaggtgcaaagagaatggccatccttggagagactgcctgggatttcggaagtgttggaggattattcacgtccctaggaaaggcggtacatcaagtttttggaagtgtgtataccacgatgttcggcggcgtgtcttggatgattagaatcctcatcggattcttagtgctatggatcggtacaaattccagaaatacaagtatggctatgacctgtattgccgtaggaggtataactcttttcttagggttcacagtacaggcggatatgggttgcgtagtatcttggtcgggtagagaactaaagtgcggtagtggcatcttcgtagttgacaatgtacatacgtggacagagcaatacaagtttcaacctgagtccccagctcgactagcaagcgcaatattgaatgcacacaaagacggtgtttgtggcataagatctacaactagacttgaaaatgtaatgtggaaacagattactaatgaattaaattacgtattgtgggaagggggacatgacctaactgtagtagctggagatgttaaaggcgtgctcactaaagggaaaagagcccttacaccaccagtttcagatttaaagtacagttggaagacatggggaaaggcgaaaatcttcacccctgaagcaagaaattcaacatttttgatcgacgggccggatacaagcgaatgtccaaatgaaagacgagcctggaatagcctagaggtagaagattacggatttggaatgtttacgaccaatatatggatgaaatttagggaggggagtagtgaagtttgtgatcatagactaatgagtgctgctattaaagatcagaaagctgtacacgctgatatggggtattggatagaatcaagtaagaatcagacttggcaaatagaaaaagcgtctctaatcgaagtgaagacttgcctatggcccaaaacccacactctctggagtaatggcgttctagaaagccaaatgctaatccctaaatcgtatgctggacccttctctcaacataactatcgccaaggatatgcaacacaaacagtaggtccatggcatttaggtaaactcgagatagatttcggtgagtgcccagggactacagtcactattcaagaagactgcgaccaccggggaccgtcattaagaaccacaacagcaagcggaaaattagtgacacagtggtgttgtcgttcctgcactatgccacccttgcgattcttaggcgaagacggttgttggtatggcatggaaatcaggccattatcggagaaagaagaaaatatggtaaaaagtcaagtagcagccggtcaaggaacttcggaaactttctccatggggcttctttgtttaaccttattcgttgaagagtgtctgagacgtagagtaactcggaagcatatgattctggcagtggttataacattatgtgccataatcctcgggggcttaacttggatggatttactgagggcactaataatgttaggtgataccatgagcggtagaatagggggacaaactcacttggccataatggcagtatttaagatgtcccccggttatgtactgggtgttttcttaagaaaactaacatcaagagagacagcattaatggtaataggtatggccatgactacaaccttatcaattccacacgatttaatggaacttattgacggtatatcccttgggcttattctattgaaaatcgtgacccaattcgataatacacaagtggggacgcttgctctgtcactaactttcatacgttcaactatgtcacttgttatggcctggagaacaataatggcagtactttttgttgttactcttatacccctttgtcgtacaagttgtcttcaaaaacagtctcactgggtagaaataaccgcattaatactaggtgcccaggcattaccagtttatctaatgactctaatgaaaggtgcatcacgacgcagctggccattaaacgaaggaataatggctgtcggcctagtttctctgctgggttctgctctactcaaaaatgacgtgccgcttgccggtccaatggtagcagggggtttgttgctagcagcatacgtaatgtctggaagttctgcggatttgtcgttagagaaagccgcaaatgtacagtgggatgaaatggccgatattactggttcttctcctatcatagaggttaaacaagatgaagacggctctttctctataagggatgttgaagaaacaaacatgataacactacttgtaaaattagccttgatcactgtgagcggtctgtacccccttgcaatccctgtaactatgacgctatggtatatgtggcaagtaaagacgcagcgctccggagccttatgggacgtccctagcccagctgctacacaaaaggctgctctaagtgaaggagtgtatagaattatgcaacgtggactattcgggaagacacaagtaggtgtaggaatacatatggagggcgtgtttcacaccatgtggcatgttaccagaggttctgttatttgtcacgaaactggacgtttagaacctagttgggcagacgtaaggaacgatatgatttcttatggcggaggctggcggttaggagataaatgggataaagaagaagacgtacaggtacttgctatagagccagggaaaaatcccaaacatgtacaaactaaacctggactattcaagactttgacaggcgaaattggagcggtgacgttagactttaaacctggaacaagtggcagtccaataatcaacaggaaaggtaaagtcataggtctctacggaaatggtgttgtaacaaagtcaggcgactacgtttcagctataacacaagcagagcgaataggagaaccagattatgaagtcgacgaggatatttttaggaagaaacgcttaacaattatggatttgcacccaggcgctggtaaaacaaaacgtatactgccatctattgttagggaggctttgaagagaaggctgcgtaccctgattctggcccctaccagagtagtcgctgcagagatggaagaggccttgagaggccttccaataagataccaaactccagctgtaaaatcagaacacaccggtagagaaatagtggacttaatgtgtcatgcaacttttaccactaggttgttgtcaagtactagggttccaaattacaatctaatagttatggatgaggcgcatttcacagatccgtcctcagtcgcagccagaggctatataagtacaagagtggaaatgggcgaagcagccgccattttcatgacagcaacgccgccaggcgctaccgacccttttccgcaatctaacagtccaattgaagatatcgagagagaaattcccgaaaggtcatggaacactgggtttgattggattacggactatcagggcaagacggtgtggtttgttccttcaattaaagctggaaatgacatagctaattgtctgagaaagtcaggaaagaaagtcattcagttaagccgtaaaacattcgacactgagtatccgaaaaccaaacttacagattgggattttgtagtgactaccgacatcagtgaaatgggggctaatttccgggcagggcgggtaattgatccacgtcgatgtctcaaacccgtaattctaactgacggacccgaacgggtaatactggcaggccccattccagtcacgcctgcatctgccgcacaacgaagagggcgaataggaagaaaccccgcacaagaagatgatcagtatgtattttcaggtgatccacttaagaatgatgaagatcatgcacattggacagaagcaaaaatgttgctagataacatctacacccctgaaggtataatacctactttattcggtcccgaaagggagaaaactcaggctatagatggcgagtttaggctaaggggagaacagagaaagacatttgttgagttaatgcgtcgtggagatctcccagtttggttaagctataaagtggcctctgccggaataagctataaggacagagaatggtgttttacgggtgaacgtaataaccaaatcctagaggaaaatatggaggtcgaaatatggaccagagaaggagagaaaaagaaacttcggccacggtggctcgacgcaagagtatacgcagacccaatggcgttaaaagatttcaaagaatttgcaagtgggcgaaaaagtatcaccttggatatattgactgaaatagcttcgttacctacctatttaagtagtagagccaagctggcactggacaacatagtcatgttacatacaactgaacgtgggggccgagcatatcagcacgcactaaatgaactgcctgaatctttggaaactttgatgttagtcgcactgctaggggctatgacagcaggtatattcctatttttcatgcaaggcaaagggatagggaaactaagtatgggacttataaccatagctgtggcaagtggtctgctttgggtggcagaaatacaacctcagtggatagctgcttctataatattagagttctttcttatggtattactaatacctgaaccggaaaaacaacgaacaccgcaagataatcaattgatttatgtaatattaacaattttgacgattattggattgattgcagctaatgaaatgggcctcattgagaaaacaaaaacagacttcggtttttatcaagtaaagactgaaacaacaatattggatgttgatttaagacccgcctcagcgtggacactgtacgcagtagctacaactattctaacacccatgctccgccatacaattgaaaatacatctgcgaatcttagtcttgcggcaattgcgaatcaagcagcagttttaatgggtttaggcaagggctggcccctacaccgcatggacttaggcgtcccgctattagcgatgggatgttattcacaagtaaacccgacaacacttacggctagtctggtaatgttattggtacattacgcaatcattggcccgggcttgcaagcaaaagcgactcgcgaggcacagaagcgtactgcagcgggaattatgaaaaacccgacggttgatggaatcacagtaatagatttagaaccgataagttatgatcctaaatttgaaaaacagctgggacaagttatgctgttagtactatgcgccggtcaacttctactgatgcggacaacttgggctttttgtgaagtattaaccttagctacagggccaatcctgacactttgggaaggtaatcccggacgattttggaatactacgattgcagtaagcactgctaatatcttccgtggcagctatttagcgggcgctggcctagcattttctcttatcaaaaacgcccaaacgcctcgacgcggtaccgggacaacaggtgaaacattaggggagaaatggaaacgacaacttaattcgctagaccggaaagagttcgaagaatataaacgttctggtatcttagaggtagaccggacagaagcgaagagtgcgcttaaagatggatcaaaaattaagcacgcagtctccagaggttcctcaaaaatccgttggatagttgaaagaggcatggtaaaaccgaaaggtaaagtagtggatttagggtgtggtagaggaggttggtcctattatatggcaacgctcaaaaatgttacagaagtgaaaggttatacaaaaggaggaccgggacacgaagaaccaatacccatggctacgtacggatggaatttagtaaaattgcattcgggagtcgatgtcttttataaaccaacagaacaggttgacactctattatgtgatataggtgagagctccagcaacccaacaatagaagaaggtcggacattaagagttcttaaaatggtcgaaccatggttgtcaagcaaacctgagttctgtataaaagttctcaacccttatatgccaacagtaatagaggaattggaaaagttgcaacgtaaacacggaggtaaccttgtgaggtgccctcttagtagaaactctacacacgaaatgtattgggtcagtggagcttcaggtaacattgtatcctctgtaaacactacgagtaaaatgttattaaacagatttactacacgacatagaaagccgacttatgaaaaagatgtagatcttggcgcagggaccaggtcagtatcaacagagactgaaaaaccagacatgacgattataggtagaagattacagagattacaggaggaacacaaggaaacttggcactatgaccaggaaaacccataccgaacgtgggcttatcatgggagctacgaagcgccgtccacaggaagcgccagctccatggtcaatggagttgttaagctgctaactaaaccctgggatgtcatcccaatggtcactcagcttgcgatgacagacacgacccctttcgggcagcaacgtgtttttaaagagaaagtagatacacggacaccacaaccaaaacctggtacaagaatggtaatgactacaactgcaaactggctttgggcgttattgggcaagaagaaaaatcctcgattgtgcaccagagaagaatttatatctaaagtacggtcaaatgctgctataggcgctgtatttcaagaagaacagggttggacctcagcatctgaagcagtaaatgattctcgcttctgggaattagttgataaagagcgagcccttcatcaagagggaaaatgcgagtcatgtgtttacaacatgatgggtaaaagagagaagaaattaggagagttcggccgcgccaaaggatcacgggctatttggtatatgtggttaggagcaagatttcttgagttcgaagcactagggtttttaaatgaggatcattggtttggaagagaaaactcatggtccggggtagaaggagagggtttacacagacttggatacatacttgaagagattgacaagaaagacggtgatcttatgtatgctgacgacaccgcaggctgggatacaaggatcacagaagatgacctccaaaatgaagaattaataacagaacaaatggcacctcaccacaaaatattagctaaagccattttcaaattaacgtaccagaataaagttgtaaaggtattacgaccaacccccagaggggcagtaatggatatcatctcaagaaaagatcaaaggggttcaggtcaagtcggaacttatgggttgaacacctttacgaacatggaggtccaattgataagacaaatggaggcagagggagtcatcacacaagatgatatgcaaaatcctaaaggtctgaaagaacgggtcgagaagtggctcagggagtgtggagtagaccggctgaaaagaatggctatctctggcgatgattgtgttgtcaagccactggatgagcgattcggtacctctctactatttctcaatgacatgggaaaagtaagaaaagacatcccacaatgggaaccttccaaaggatggaaaaactggcaagaagttccgttttgcagtcatcactttcacaaaatttttatgaaggacggcagatcgctggtcgtgccttgccgaaaccaagatgaactaataggcagagcacgaatctctcaaggagctggctggtcgcttagagaaaccgcatgtctggggaaagcatatgctcagatgtggagtttaatgtattttcatagacgagacttgaggttagcttccatggccatatgctccgctgtaccaaccgaatggttccctacttcccgaacaacatggagcattcatgctcatcaccaatggatgaccacagaagatatgctaaaagtatggaaccgagtatggatagaggataaccctaatatgattgataagacacctgtacactcttgggaagatattccttatctcggtaaacgtgaagacttgtggtgcggatccttgataggactttcttcaagagcgacgtgggctaaaaatatacatacagctataacgcaagttaggaacctaatcggcaaagaagaatacgtagactacatgcctgtaatgaagagatactccgctcctagtgaatctgaaggagtgttataa

SEQ ID NO: 23609 - RNA, 9867 nt, synthetic construct
  misc_feature 1..9867: note = derived and/or modified CDS sequence (opt6) from DENV-4__GQ199879__SS-prME
  source 1..9867: mol_type = other RNA
tcaacgataactttactgtgcctaataccaacggtcatggcgtttcatctgagcactagagacggtgaaccacttatgatagtagctaaacatgaacgcggtagaccgctgttgtttaaaaccaccgaaggaataaacaaatgcacgttaatagcaatggatttaggagaaatgtgtgaagatactgtaacttataaatgcccgctattagtgaatacggaaccagaagatattgattgctggtgcaatttaacaagtacgtgggtgatgtacggtacgtgcactcaatccggtgaaagaagaagggagaaaagaagtgtagctctaacgccccactcaggtatggggcttgaaacgcgtgccgaaacctggatgagctctgaaggggcttggaaacacgctcagagagttgaaagctggatattaagaaaccccggattcgcactcctcgccggtttcatggcctacatgattggtcaaacgggtatccagagaactgtattcttcgtactgatgatgcttgtagctccaagttacggaatgaggtgtgtaggggttggtaatagagattttgtagaaggagttagtggaggggcttgggtcgatttagtgctagaacacggaggttgcgttaccacaatggcacaaggtaaaccaactctagacttcgaattgactaaaacgaccgcaaaagaagtcgcgctccttcgcacctattgcatagaagcctcaatcagtaacattacaacggcgaccagatgtccaacacaaggagaaccttatttaaaagaagaacaagatcaacaatatatatgtaggagggacgtagtagaccgaggctggggaaatggttgcggattgtttggtaaaggcggggttgttacttgcgcgaaatttagttgttctggaaagataacaggaaacttagttcaaatcgaaaatctagaatatactgttgtcgttacagttcataatggagatacccacgctgtcggtaacgacacttctaatcatggtgttaccgctactattactcctaggtcacctagcgtagaagtgaaacttcctgactacggagagttgacccttgattgtgaaccaagatcaggcatagactttaacgagatgattctaatgaaaatgaagaagaaaacgtggttagttcataaacaatggtttctggatttaccactaccatggacagccggtgcggatacatctgaagtccattggaattataaggaaagaatggtaacttttaaagtaccgcacgcgaaaaggcaagatgtaaccgttttaggatcacaagaaggcgctatgcatagtgcattggcaggagcaacagaagtagactctggtgatggaaaccatatgtttgcagggcatttgaagtgtaaagttcgaatggaaaaacttagaataaaaggaatgtcgtacacgatgtgtagtggcaaattctcaatcgataaagagatggcagaaacacaacatggtaccacagttgtgaaagttaaatatgaaggcgctggtgcgccatgtaaggtacccattgaaattagggacgtaaataaagaaaaagtagtgggccgtgttatatcaagtacaccgctagcggaaaatacaaattcggtcacgaatattgaattagaacctccatttggcgattcctatattgttataggcgtcggcaatagtgctctgacactccattggttcagaaaagggagctctatcggtaaaatgtttgagagtacctatcgcggtgccaaaaggatggcgattttaggcgaaactgcctgggactttggatccgtgggaggactgtttacctcgttaggaaaagcggtacaccaagtctttggaagtgtatatacaacaatgttcggaggagtttcctggatggtaaggattttgataggattcctagtattatggataggcactaattcaagaaatacaagtatggccatgacctgtattgcagtgggcggtattaccttatttttagggttcaccgtgcaagctgatatgggctgtgtagtgtcttggtcagggagagaattaaaatgtggatctggcatcttcgtcgttgacaatgtccatacatggaccgaacagtataagtttcagccagaatctccagcaagattagccagtgccatactaaacgctcacaaagatggtgtatgcggaatcagatcgactacacgtttagaaaatgtaatgtggaaacaaataacgaatgagctgaattatgtgctttgggaagggggacatgatctcaccgttgtagcaggagacgtaaaaggagtcctcactaagggaaaaagggcactgaccccaccagtaagcgacttaaaatattcctggaagacttggggaaaagctaagatttttacgcccgaagcacgaaactctacatttttaatagacggtcctgatacatcagagtgtccaaatgaacgccgtgcttggaatagccttgaggttgaagactatggttttggtatgtttactactaatatatggatgaaatttcgggaaggaagtagcgaggtatgtgatcatcgattaatgtcagcggcaataaaggaccagaaggcagtgcatgcggacatgggctattggattgagtctagcaaaaaccagacctggcaaatcgaaaaggcatcactgatagaagtcaaaacctgtctatggccaaagacccatacactatggtcgaacggtgtgctagagagtcaaatgcttattccgaaatcatatgctggaccgttttcacaacataattaccgacaaggctacgccacacagacagtaggcccttggcatttgggaaaattagaaatagattttggagaatgtcctggtacaacagtaacaattcaggaagactgcgaccatagaggcccatctttaaggacaacaacagcaagtgggaaattggtaacccagtggtgttgccgatcttgtactatgcctccacttcgattcctgggagaagatggatgctggtatgggatggagataagacccttaaatgagaaagaggagaatatggtaaagagccaagtcacagccggacaaggaacaagcgagacatttagtatgggtctattatgcctaacactctttgtagaagaatgtctcaggcgaagggtcactcggaagcacatgattcttgttgtagttataactctatgcgcgatcatattgggaggcttaacctggatggacctattacgggccctaataatgttaggagatacaatgtctggtagaattggtgggcaaattcatttagcgataatggccgtatttaaaatgtcgccagggtatgtcttaggtgtattcttacgaaaattaacctcgagagagacagcccttatggtcatcgggatggcaatgacaactgttttatcgatcccacatgatctaatggaactcatagatggcataagccttggcttaattttattgaaaatagtgacacaattcgataacacccaagttggaacattagcgctgtctttgacctttattagatctacaatgccgttagtcatggcttggcgtactataatggcagttctcttcgtagtcactctcataccactttgtagaacttcttgtctacaaaaacagagccattgggtagaaataacagcgttgatacttggagcccaagctctgcctgtatatttgatgacacttatgaaaggtgctagccgtcgctcctggccccttaatgaagggataatggcagtaggacttgtcagcttactgggatcagcgttactaaagaacgatgtgccgttagcagggcctatggtagctggcggtttattactagcagcgtacgtcatgtcaggtagttcagcagatctctcattggaaaaagctgcaaatgtacagtgggacgagatggctgatattaccggcagctctccaataatagaagtaaaacaagacgaagacggatcattttcaatcagggatgttgaagaaacaaatatgattactctacttgtaaaattggcgttgataactgtgtcaggattatatcctctggctattcccgtaactatgacactctggtacatgtggcaagtgaagacacaaagaagcggtgcactatgggatgtaccatctccggcggctacacaaaaagctgccctgagcgaaggtgtctatcgaataatgcagaggggactgtttggaaaaacacaagtaggcgttggcattcatatggaaggagtatttcataccatgtggcacgtaacacgtggatcagtcatatgtcatgagacgggtcggttagaaccctcatgggcagacgttcgaaatgatatgattagctacgggggaggatggcgattgggagacaaatgggacaaagaggaggacgtacaagtactggcaatagagcctggcaagaatcccaaacacgtacagaccaaaccaggcctatttaaaaccttaactggtgaaattggagcggttacacttgattttaagccagggacaagtggtagtcctataataaaccgaaaggggaaggtgataggattatacggaaacggtgttgtcaccaaatcaggggactatgtaagtgcaataacgcaggcagaaagaatcggtgaaccagactacgaagttgacgaagatatttttcggaagaaaaggcttacaattatggatctccatccaggcgcaggcaagactaagcgaattttaccgtcaattgtacgagaggctttaaaaagacgtctaaggaccttaattttagcacctactagggtcgtagctgcagaaatggaggaagcactgaggggtttacctataaggtatcaaacgccggcagttaagagtgagcacaccggcagggaaatagtcgacttaatgtgccatgcaacttttacaactcgcctattatcgtctacaagggttcccaactataatctaatagtaatggacgaggcacatttcacagacccaagctcggttgcagcaagagggtacataagtacaagagtcgaaatgggggaagcggcggcgatattcatgactgcaacaccaccaggggctacagatccattcccacaatcaaattcccctatagaagatatagaaagagaaatacccgagcgtagctggaacactggatttgattggataactgactatcaaggaaaaacagtatggtttgtgccatctattaaagctggaaacgatattgcaaattgcttgagaaaatctggaaagaaagtgatacaactgtcaaggaagacctttgacacggaatatccaaaaacaaaactcaccgactgggatttcgtcgtgacgactgatatctcagaaatgggtgcaaatttcagggccggacgggttatagaccctaggagatgtttaaaacctgttatacttaccgatggcccagaaagagttatactcgcaggccctatacccgtaacacccgctagtgctgcccaaagacgtggccgcattggacgcaatccagcccaagaggacgatcaatatgtattttcgggtgatccactcaagaatgatgaagaccacgctcattggaccgaagctaaaatgctactggataacatatacactcccgagggaattattcccacattgttcggaccggaacgtgagaagactcaggctatagacggcgagttccgactccgaggtgaacaaagaaaaacattcgttgaattaatgagaagaggggatctacctgtatggttatcgtacaaagtagcttcagccggtatttcatacaaagacagagagtggtgttttacaggagaacgaaacaatcaaatattagaagaaaatatggaggttgaaatatggactagggaaggcgagaagaagaaactccggccaaggtggttagatgctagagtatacgctgatcccatggcgctgaaagattttaaagagttcgcaagcggtcgaaaaagtatcacattagatatccttactgaaatagccagtttacctacatatttgtcttcgagagcaaaattggctttagacaatattgtaatgctacacacaaccgaacgaggtggacgagcgtatcaacacgccttaaatgagttaccagagagcttggaaacactcatgcttgtggcgttacttggcgcgatgaccgcaggcatatttttattctttatgcaaggcaagggaattggtaaactctcaatgggacttatagcgatagcagtcgcctccgggttactatgggtcgcggaaattcaaccacaatggatcgctgccagtataattctagagttctttttaatggttctactgataccggaaccggaaaaacaacgaacaccacaggataatcaattaatttacgtaatacttactatcctcacgatcattggacttattgcagcgaatgagatgggactgattgagaaaactaaaacagattttgggttttatcaagtaaaaacagagacaacaatacttgatgtagacttaagaccggcgagcgcatggacattgtacgcagttgcaaccaccatattaacccctatgctaagacacacgattgaaaataccagtgccaatttatcactagcagcaatagcaaatcaagcagcagttttgatgggtttaggtaaaggttggccactacacagaatggacctcggcgtccccctattagcaatgggatgttattcccaagtgaatccgacgacccttacggcatctcttgtaatgttacttgtacactatgctatcattggtccaggattgcaagcaaaagccacaagagaagcacagaaacgtactgcagccggtattatgaaaaatccgacggtagatggaataacggtcatagacctagagccaatttcttatgacccgaaattcgaaaagcaattaggtcaagtgatgttactcgttttatgcgctggacaacttttactaatgaggaccacttgggcattttgtgaagtgctgacactagcgacgggaccgattttaacactctgggaaggaaaccccggaagattttggaatacaacaatagcagtgagcactgcaaatatcttccgtggatcttatctagccggtgctgggctagcattcagcttaatcaaaaatgcccaaacgccaagaagaggtaccgggaccacaggagaaacactcggggaaaaatggaagcggcaattaaattcattagacagaaaggaatttgaagaatacaaaagatcaggaatcctagaagtggataggaccgaagctaagagcgcattaaaagacggatcaaaaactaaacacgccgtcagtagaggaagttcaaagatacgttggatcgttgagcgagggatggtgaaacctaaagggaaagttgtcgatctgggctgcggtagaggtggatggagctattacatggctacactcaaaaatgtaacagaggtaaaaggttataccaaagggggtccaggtcatgaggagccaatacccatggcaacttatggatggaatttggttaaacttcattcaggggtagacgtcttttataaacctacagagcaagtagataccctattatgtgacattggtgaaagctcatcgaatcctactatagaggaagggagaacattacgagttctgaaaatggttgagccatggttaagttcgaaaccggaattttgtatcaaagttttgaacccctacatgcctacagtaatagaagaattagaaaagttgcaacgaaagcacggtgggaatctagtaagatgtccactatctcgtaacagcacgcacgaaatgtattgggtatccggtgctagcggcaacattgtgtcttccgtcaatactacttcaaagatgttactaaatagattcacaacacggcacagaaaaccgacttatgaaaaagatgtagacttaggggccggtacacgaagcgtttcaacagaaaccgaaaagccagatatgacaattatcgggagacgattgcaacggttgcaagaagaacataaagaaacctggcactatgaccaggaaaacccttatcgtacatgggcatatcacggatcatatgaagccccgtcaaccggatcagcatcgtcgatggtaaatggcgtagtaaaactactaactaaaccttgggatgttattcctatggttacccagcttgcgatgactgatacgacgccatttggacaacagagagtatttaaagagaaagtagatacacgcacaccgcaaccaaaacctggaactagaatgattatgacaacaacagccaactggttatgggctctgctaggcaagaagaaaaatcctcgattatgcacacgtgaagagttcataagtaaagtaagatctaatgcagctataggagccgtcttccaagaggaacaaggatggacttctgcttcagaagcagtaaacgacagcagattttgggaacttgtggacaaggaaagagcgctacatcaggaaggcaaatgcgaatcatgtgtatataacatgatgggaaaaagggagaagaaattaggtgagtttggacgtgccaaaggttcaagagctatttggtacatgtggttgggtgctagatttttggagttcgaagcacttggatttctgaatgaagatcactggttcggaagagaaaattcatggagtggtgtagagggagaagggctgcatagactcggatacatacttgaggaaatagacaagaaagatggtgaccttatgtacgccgatgatactgcaggctgggataccaggatcaccgaggatgacttacaaaacgaagaactaattacagaacaaatggccccgcaccataaaattttagctaaagcaatatttaaacttacctatcaaaataaagtggtaaaagttctaagaccaacccccagaggtgccgtaatggatatcatttctcgaaaggaccagagggggtcggggcaagtcggtacatacgggttaaacaccttcacaaacatggaagtgcaattaatcagacagatggaagctgaaggagtcattacacaagacgatatgcagaatcctaaaggactaaaagagagggtcgaaaaatggctccgagaatgtggagtagatagactaaaaaggatggcaataagtggagacgactgtgtagtcaaacccctagatgaacgtttcggaacgagtttactgtttcttaatgatatgggaaaagtacgaaaggacattccccaatgggagccaagcaagggatggaaaaattggcaggaggtaccgttttgctcccatcatttccataaaatatttatgaaagatggacgctcccttgtggtcccatgcaggaaccaagacgaattaattgggagagcacgaataagccaaggcgccggctggtcacttagagagacggcgtgtctagggaaggcatacgctcaaatgtggtccttgatgtactttcatcgaagggaccttcgtttagcttcaatggcgatatgttcagccgtaccaactgaatggtttcctacaagtcgaactacttggtctatacatgcacaccaccaatggatgactacggaagacatgttaaaagtctggaatagggtgtggattgaagacaatccaaatatgaccgataaaacaccaattcactcatgggaagatattccatatctaggcaaacgtgaagacttgtggtgcggtagcctcattggcttaagcagccgagcgacttgggctaaaaacatacatacagctataacacaggtgcgcaacttgatagggaaagaggaatacgtagactacatgcccgtaatgaaacgatatagtgcaccatcagaaagtgaaggggtactttaa

SEQ ID NO: 23610 - RNA, 9867 nt, synthetic construct
  misc_feature 1..9867: note = derived and/or modified CDS sequence (opt6) from DENV-4__GQ199880__SS-prME
  source 1..9867: mol_type = other RNA
tcgaccataaccctactttgtttaattccgacggttatggcatttcatctttccacccgagatggcgaacctctaatgatagtagcaaaacatgaacgaggacgacctttactattcaaaacaaccgaaggcataaataaatgcacactgattgcgatggatcttggagaaatgtgtgaagacaccgttacctacaaatgtcctctgttagtaaatacagaaccggaagacattgattgctggtgtaatttgaccagtacttgggtaatgtacggaacttgtacacaaagtggagaaagacgaagggagaaaagaagtgttgcactcacaccacacagtggaatgggcctagaaactagagcggaaacctggatgtcaagcgaaggagcatggaaacatgcccagcgggtcgaatcgtggatattacgtaacccaggattcgcgctcctcgccgggttcatggcatacatgatcgggcaaacagggattcaacgaacggttttctttgtattgatgatgctggtagcacctagttacggtatgagatgtgtaggagtgggtaacagagattttgtcgaaggcgtaagcggaggagcttgggtagatttagtcctagaacatggcgggtgcgtgacgactatggcacagggaaaacccacacttgactttgaattaactaaaacaacagcaaaagaagtagcacttttacggacctactgtatagaagccagtatatcaaacataacaactgctacgagatgtcctactcaaggcgaaccttaccttaaagaagaacaagatcaacaatatatctgcaggagagacgtagtagataggggatgggggaatggatgtggactatttgggaagggtggtgttgtgacatgtgctaaattttcgtgttcaggaaagataacgggtaacctagtacagatagaaaacctcgaatatactgttgtagtaacagtgcataacggtgacacccatgctgtgggaaacgacacgtcaaatcatggagtcacagcaactattacaccacgttctccctctgtagaagtaaaactacctgattatggagaactcacattagactgtgaaccgcgttccggaatcgatttcaacgaaatgatactcatgaagatgaagaagaaaacttggcttgttcataaacaatggttcttagatctaccattaccatggactgctggagctgatacaagtgaagtacactggaactataaggaacgtatggtaacttttaaagtaccgcatgcaaagagacaagatgttactgtactaggatcacaggaaggtgcgatgcatagcgcacttgcgggggcaactgaagtagattccggagatggaaatcatatgttcgctggacatctcaaatgtaaggtacgcatggaaaaactaagaattaaaggcatgagttatacaatgtgttctggtaaattcagcatagataaagaaatggccgaaactcaacacggaacaacggtcgtaaaggtgaaatatgaaggggcgggtgctccatgtaaggtaccaatagaaataagagacgtcaataaagaaaaagtagtggggagagtaatttctagcacgccgttggctgaaaacacaaattcagtcacaaacattgaactagaaccacccttcggagacagttatatagtaataggagtaggtaactccgcactaacattacattggttcaggaaaggaagtagtataggtaaaatgttcgagtctacgtatagaggcgcaaagcgaatggcgatacttggagagaccgcatgggattttggaagtgttggtggactgtttacttcccttggaaaagcggttcatcaggtctttggatcagtgtatactactatgtttggaggtgtatcatggatgataaggatattaatagggttccttgtactgtggatcggaacaaacagtagaaatacaagtatggcaatgacttgcatagcggtaggtggaataaccttattcttaggctttactgtgcaagctgatatgggttgcgtcgtatcttggtccggaagagaactaaagtgcggctcaggaatatttgtggtagataacgtacatacatggacagaacaatacaaatttcaaccagagagccctgctcggttagcctcggctatactaaatgcccacaaggatggcgtatgtggaataagatcgactacccgtcttgaaaacgtcatgtggaaacagataacgaatgaactaaattatgtcctttgggaagggggacatgacctaaccgtcgtggcaggggatgtgaagggtgtattaaccaaaggtaagagagctttaacaccaccggtttccgacttgaagtatagttggaaaacttggggtaaagccaaaatttttactcctgaagcaagaaactcaaccttcctaatcgatgggccagatactagcgaatgtcctaatgaaaggagagcatggaactctcttgaagttgaagattacggcttcggtatgtttactactaatatatggatgaaattcagggagggatccagtgaagtttgcgatcaccgactaatgtcggcagcaataaaagatcaaaaggcggtccatgctgatatgggatactggatagaatcgtccaagaaccaaacgtggcaaattgagaaggccagtttaattgaggttaaaacatgcctctggccgaaaactcacactttatggtccaatggtgtactagaatcacaaatgttaataccaaaaagttacgcagggccgttttctcagcacaattatcgacagggttatgcgactcagacagtaggaccgtggcatttgggtaaattagaaattgactttggtgaatgtccaggaacaacggtaacaatccaagaagactgcgatcacagaggtccatccctacggacaacaactgcatcagggaagttagtgacacaatggtgctgtcgatcatgtacaatgccgcccctccgatttctaggggaggatggatgttggtacggaatggaaataagaccattgaatgaaaaagaagaaaatatggtcaaatcgcaagtaactgcggggcaaggtacatcagaaacattctccatgggcttactgtgtttaactttatttgttgaagaatgtctccgacgaagagtaacacgtaaacacatgatattagtggtagtaattaccctgtgtgccatcattctagggggcctgacgtggatggacttattgagagctttaattatgctaggggatacaatgagcgggagaataggaggtcagatacacttagcaattatggctgtttttaaaatgtcaccaggatatgtattaggagtattcctaaggaagttgacaagtagggaaactgcgctgatggtgatcggaatggccatgactacagttttatctataccgcatgatctaatggaattaatagatggtattagtctaggcctaattctcctaaaaatagtaacccaattcgacaatacgcaagtgggaactttagccctatcgttaacatttatcagatcaacaatgccattagtaatggcatggagaacaattatggcggtactctttgttgtaacactgatacccctatgcagaacttcctgtctacagaaacagagtcactgggttgaaattactgctcttatactaggagcgcaagcattacctgtatacttaatgacgttaatgaagggtgcctcaaggaggtcctggccactgaatgaaggaattatggcagtaggacttgtatctctacttggtagcgccctacttaaaaatgatgtaccactagcaggaccgatggtagctggaggtctccttctggcagcatacgtaatgtcaggttcatcggcagatttatcactagaaaaagcggccaatgtgcaatgggacgagatggcggatataacgggcagttccccgattatagaagtaaaacaagatgaggacggcagtttttctataagggacgtggaagaaactaatatgataactcttctcgttaagctggcattgatcacagtatctggactctatcccctagctatccccgtaaccatgactttatggtacatgtggcaggtcaaaacacaacgatcaggtgctttgtgggatgtgccaagtccggccgcaacacaaaaagcagcattatcggagggcgtctatagaataatgcaaagagggctctttggcaaaacacaagttggcgttggaatacacatggaaggagtattccacacaatgtggcacgtaacaagaggcagtgtcatttgccacgaaactggaaggttggagccatcatgggcagatgtacgtaacgatatgatatcgtacggaggaggttggagactcggggataagtgggataaggaagaagacgttcaagtgctagccatagaacctggcaaaaacccgaaacacgtgcagacgaagcctggactttttaaaactttaacaggcgaaattggagcagttactctagactttaaacctgggacttctggcagtcccataataaacagaaaaggtaaggtaattgggttgtatggaaacggagtagtaacgaaaagcggcgactatgtatcagcgataacccaagccgaacgtattggtgagccggactacgaggtagatgaggacattttcaggaagaaacggttaacgatcatggatctccaccccggcgctggtaaaacgaagcgtatccttccgagtatagtacgagaagctcttaaacgtcggttaagaacgctaatactggccccaactagggtggtagctgcggaaatggaggaagcacttaggggtctacctataaggtaccaaaccccggcagttaagagtgaacataccggaagagaaatagtggacttaatgtgccacgctacatttaccacacgcctattatcttcaacaagagttccgaattacaacctaattgttatggatgaggcgcacttcacggacccaagttcagtcgccgcaagaggatatatctcaacacgagttgaaatgggagaagcagcggcaattttcatgactgcaaccccacccggagctacggatccatttccacaatctaactcaccaatagaagatatagaaagggaaattccagaacgctcgtggaatacaggatttgattggattacagactatcagggaaagactgtatggtttgtacccagcataaaagcaggaaatgatatcgccaattgtttgagaaaaagtggtaaaaaggtaatacaattaagccgtaagacctttgacacagaatatcctaaaacaaaactaacagactgggacttcgtggttacaaccgatatttcggaaatgggcgcaaatttccgagccggcagagttatcgaccctagacgatgcttaaagcctgttatcttaactgatggaccggagagagtcattctagccggcccaatcccagtgacccccgcatctgccgcccaaagacgaggccggataggtagaaacccagctcaagaagatgatcaatatgttttctctggtgatcccctcaaaaatgacgaagatcacgcccattggacggaggctaaaatgttgctagataacatttatacaccagagggaattatacccacacttttcggcccagaaagggaaaagacccaagccatagacggagaatttagacttaggggagaacaaaggaaaacgtttgtcgaactgatgagacgcggcgacttacctgtgtggctaagctacaaagtcgcaagcgccggtatttcttataaagatcgcgaatggtgttttaccggggagaggaataatcaaatactagaagagaacatggaggtagaaatatggacacgagaaggtgagaagaagaaattacgtcctcgttggcttgatgcccgagtatacgcggatccaatggcgctcaaagacttcaaagaatttgcttccggaaggaaatcaataacacttgatatattaacagagatagcttctctacctacttatttgtcgagccgcgctaaattagcactcgacaatattgtaatgttacacacaacagagaggggcggacgagcttatcagcatgctttgaacgaactacccgaatctttggaaactttaatgttggtagctctccttggagcaatgacagcaggcatttttctattcttcatgcaaggcaaaggcataggaaagttatcgatggggttaatagccattgcggtagcatccggtttattatgggtagctgagatccagcctcagtggatcgcagcctcaattattctggagttcttcctaatggttctcctaataccagaaccggaaaagcaaaggactccccaggataaccaacttatatatgtcattttaacgattctcactataataggtctcattgccgctaacgagatgggtctaatagagaaaacgaaaaccgactttggcttttaccaagttaagacagaaacgaccatccttgacgtagacctgagacccgctagtgcctggactctatacgcagtcgcaactacaattcttacacctatgcttcgacatactatagaaaacaccagtgcaaacttaagtctagcagcaatagctaatcaagcagcagtactgatgggtttgggtaaggggtggccattacatagaatggacttaggcgtacctttactagcaatgggttgctattcccaagtgaaccctactactctcacggcatcacttgtgatgctattagttcattacgcgataatagggcctggtttacaagcgaaagcgacgagggaagcccagaaacgtactgctgcaggtatcatgaaaaatccaacagtcgatggtatcactgtgattgatcttgaaccaataagctatgacccgaagttcgagaaacagttaggacaggttatgttgctagtactttgcgcaggacaactacttttaatgaggactacgtgggccttttgtgaggttctaacattagcaactgggccgatattgacactctgggagggaaacccaggaagattctggaataccactattgctgtttctacagccaatatattcagagggtcatatctagctggagctggattggccttttctctaatcaaaaatgctcaaacacctcgcagagggactggaactactggagaaaccctaggagaaaagtggaaaaggcaattaaattcacttgatcgtaaggaatttgaggaatacaaacgttcgggtatattagaagttgacagaacagaagcaaaaagtgcattgaaagatggctccaaaacaaaacacgctgtttccaggggatcgagcaagatcagatggatagtagaaagaggaatggttaaaccaaaaggcaaggtagttgatctcggctgcgggcgtggcggatggagttactatatggcgacattgaaaaatgtcactgaagttaaaggttacaccaagggaggtccaggacacgaggaaccaataccaatggctacctatggctggaacttagtcaaactacattccggagtagacgtcttttataaaccgacggaacaagttgatacattattatgcgatataggggagtcctcatccaacccaacaatagaagaaggacgcacgttacgagtactgaagatggtagagccttggctaagtagtaagcctgagttctgtataaaagtattaaacccctatatgccaacagtaatagaagaacttgaaaaactacaacgtaaacatggaggaaacttagtccggtgccctctcagtagaaactcaacacatgaaatgtactgggtatcaggtgcttcgggtaacatcgttagttctgtcaacacaaccagcaaaatgctactaaatagattcaccactagacacagaaaaccaacgtacgaaaaagatgtcgatttgggagcgggaacgcggtctgttagcacggaaactgaaaaaccagacatgactataatcggaagacggttacaaaggttgcaagaggaacataaagagacctggcattatgatcaggagaacccatatagaacatgggcataccacggttcttacgaagcgccatcaacaggatcagcaagttccatggtcaacggagtagtaaaattattaacaaaaccatgggatgtgatcccgatggttacacaattagcaatgacagacaccacacccttcggccaacaaagagtcttcaaagaaaaggttgacacacggaccccacagcccaagcctgggacaaggatgattatgactaccactgccaattggttgtgggctctgttaggcaaaaagaaaaatccgaggctatgcacaagagaggagttcatttctaaagtcagatcaaatgccgcgatcggagctgtatttcaggaagaacaaggatggacaagtgctagcgaagccgttaacgactcgaggttctgggaacttgttgacaaagaaagagctctgcatcaagaaggaaaatgcgaaagttgcgtatataatatgatgggaaaaagagagaagaaactaggagagttcggccgtgccaaaggatccagagcaatatggtatatgtggctaggggcccgattcttagaatttgaggctttgggatttctaaacgaggatcactggtttggaagagagaactcctggagtggagttgaaggtgaaggattacatcggttaggctatatccttgaagaaatagataaaaaggatggagatctaatgtatgcagatgatacagctggatgggatacacgaataactgaggacgatctacaaaatgaggagttaattacagaacaaatggcacctcaccataaaattttggcaaaagctatatttaagctaacatatcaaaataaagtagttaaggtattaaggccaacaccccgaggagccgtaatggacataataagtcgtaaagatcaaaggggttcaggtcaggttggaacatatggcttaaatactttcactaacatggaagtccaactaattcgccaaatggaggcagagggagtgataactcaagatgacatgcaaaatcctaagggtcttaaagaaagagtagagaaatggttaagagaatgtggcgtagatagattaaaaaggatggctatatcgggtgatgattgtgttgtgaaacccctggatgaacgattcgggacttcgctattatttcttaacgatatgggaaaagtacggaaggatattccccaatgggaaccctcaaagggatggaaaaattggcaagaagttccattttgtagccatcatttccataaaatcttcatgaaagacggaagatcccttgttgtaccatgtagaaaccaagatgaattaataggtagagcccgtatctcacaaggtgcaggatggagtttacgcgaaaccgcttgcttaggaaaggcatacgcgcaaatgtggtctctaatgtacttccatcgtagggatctacggttggcctctatggcaatatgttccgcagtaccaacggaatggttcccgacttcacgcacaacgtggagtatacatgcccatcaccagtggatgaccacagaagacatgttaaaagtctggaatagggtatggatagaagataatccaaatatgacggacaaaacccctatacatagttgggaagacattccgtacttgggaaaacgagaagacctatggtgtggaagtttgataggactcagcagcagagccacgtgggctaaaaacatacacactgctattacgcaggtaaggaatctgatcggcaaagaggagtacgtagattacatgccagtaatgaagcgatattccgctccaagcgagagtgagggcgtactttaa

SEQ ID NO: 23611 - RNA, 9867 nt, synthetic construct
  misc_feature 1..9867: note = derived and/or modified CDS sequence (opt6) from DENV-4__GQ252675__SS-prME
  source 1..9867: mol_type = other RNA
tcaactataactttactatgtctcatacctactgttatggctttccatctctctacacgagatggcgaaccgctaatgatcgttgcaaaacacgaacgtggtaggcctctattgtttaaaactactgaaggaataaacaaatgcacattaattgcaatggatcttggggaaatgtgcgaagatacagtgacatacaaatgtccattattggttaatacggaaccagaagacatagactgctggtgtaatctgacctcaacatgggtaatgtatggaacttgtacgcagtctggtgaacgaagaagagagaaaaggagcgtggcgctaacaccccattcaggtatgggtttagaaacccgagccgaaacatggatgtcaagtgaaggggcctggaaacacgcacaacgagttgaatcctggattctaagaaaccccggttttgcattattggctggctttatggcatatatgatcggtcagacaggaatacaaaggacagtatttttcgtacttatgatgctggtagcaccgagctacgggatgagatgtgtaggggttggcaatagagattttgtcgaaggtgtatcaggtggtgcatgggtagacctcgtactggaacacggtggttgtgttacaactatggcacagggtaaaccgacgttagactttgaattaacaaaaacaactgccaaagaagttgctctgttacgtacgtattgcatagaagccagcataagcaatattacgaccgcaacgaggtgtccgacacaaggtgaaccatatctcaaagaagaacaagaccagcagtatatatgtagaagagatgtagttgataggggatggggtaatggctgtgggctattcgggaaaggcggagttgtaacttgtgctaaattcagctgcagtggtaaaatcacaggtaatttagttcaaatcgaaaatctagaatacaccgtagtagtgacggtccacaatggcgacacacatgccgtaggaaatgatacaagtaatcacggggtcacagccacaattacgccaagatcgccaagtgtagaagttaaattgcccgattatggagaactaacactagattgcgaaccaagatcaggcattgacttcaatgaaatgatactcatgaaaatgaaaaagaaaacgtggctcgtgcacaaacaatggttcttagatttacccctaccatggactgcgggtgctgacacgtcagaagtgcattggaactataaagaaagaatggtgacttttaaagttccacatgccaagagacaggatgttacagtattagggtcccaggaaggagccatgcactcagcacttgcaggcgccacagaagtcgatagcggagatggcaatcatatgtttgctggacatttaaaatgtaaaattaggatggagaaactaagaataaaaggaatgtcgtacactatgtgtagtggtaaattttctattgacaaggagatggcggaaactcagcacggaacaacagtagtaaaggtaaaatacgaaggagcaggagctccatgcaaggttcctatagaaattagggatgtaaacaaagaaaaggtagtgggacgcgtaataagttcaacaccactcgctgaaaacacaaatagtgtaactaacatagagttagaaccaccctttggagattcgtacatagtaattggtgtgggaaattcagctttgactttacactggttcagaaaaggctcaagtataggaaaaatgtttgaatccacatatagaggagccaagcgcatggcgatactgggcgaaacggcatgggatttcggttcagtaggcggacttttcacatctttaggtaaggcggttcatcaagtgtttggatcagtatacaccacgatgtttggaggcgtatcttggatgatacgaatacttatcggcttcctagtcctttggattggaactaactctagaaacacctcaatggccatgacttgcattgcagtagggggaataacgttgtttttgggctttacggtacaagctgatatgggctgcgtggtctcttggtcgggacgggaactgaagtgcggctcaggaattttcgtcgtggataatgtacatacatggacggaacaatataaattccaaccagaatctccagctcgcctagcctctgcaattctcaacgcacacaaggatggtgtttgcggcataaggagcacaactagattagaaaacgtaatgtggaaacagattacaaacgaactaaactatgtattatgggaaggcggacacgatttgacagtagtcgctggggacgtaaaaggtgtactgaccaaggggaagcgtgcacttacacctcccgtttctgaccttaagtatagttggaaaacatggggtaaagcaaaaatatttacaccagaggctaggaacagtacattcctaatagacggtcctgatacttcagaatgcccaaatgagagacgagcatggaatagtttagaagtggaagactacggcttcggaatgtttacaacaaatatctggatgaaattccgtgaaggatcctcagaagtctgtgatcacagacttatgtcagcagctataaaagatcaaaaagctgttcatgctgatatgggttattggattgaatcgtcgaaaaatcagacgtggcaaattgaaaaggcatctttgatagaagtaaaaacatgtctctggccaaagactcacaccttatggagcaatggtgtcctcgagtcccaaatgcttatacctaaatcatatgcaggaccattctcccaacataactaccgtcaaggatatgcaactcaaacggtaggaccatggcatcttggaaaacttgaaattgatttcggagaatgccctgggacgacggtgacgatccaagaggattgtgaccaccgaggaccaagtctacgaacaacaacagcatccggaaaattagtaacgcaatggtgttgcagaagttgcacaatgcctccgctaagattcttaggagaagacgggtgctggtatggtatggaaataagaccactgaatgaaaaggaggaaaatatggtaaaaagtcaggtaacagcaggacaaggaacctccgagacattctcaatgggactactttgtctcaccctattcgttgaggagtgcctaagacgcagagtaacgagaaagcatatgatgcttgtagtcgtaattactctgtgtgctataatactaggtgggcttacatggatggatctcctcagagcgttaataatgctaggggatactatgagtgggagaataggaggtcaaatccatttagcaatcatggctgtattcaaaatgtcccctgggtacgtactaggagtgtttctgagaaaactaacatctagagaaacagcactaatggtcatcggaatggcaatgaccacagttttatcgataccccatgatttaatggaactaatagatgggataagcctgggattaattttactaaagactgtcacacaatttgataacactcaggttggaacattagccctttctttaacatttataagatcaacaatgcctttagtaatggcatggcgaacgataatggcagttcttttcgtcgtaactcttataccactttgcagaacaagttgtttacaaaaacaatcgcattgggtagaaataacagcattgattctcggtgcacaagcacttcctgtctatttaatgacactaatgaaaggcgctagtagacgtagttggcctcttaatgaaggaataatggcggtaggtcttgtgtctctattagggagtgctttattaaagaatgatgtacccctagctggtcctatggttgcaggagggttattattagccgcatacgttatgtctggttcttcagctgacttatctctcgaaaaagctgcaaacgtccaatgggatgaaatggctgatattacaggcagtagtccaataattgaagtaaaacaggacgaggatggaagtttctccatacgggacgtcgaagaaaccaatatgatcactcttttagtaaaacttgcattaattacggtgtcaggcttataccctcttgcgataccggtgaccatgacattgtggtatatgtggcaagtaaaaacacaacgaagtggagcgttatgggatgtaccctcgcctgcagcaactcagaaagcggctctaagcgaaggtgtatacagaatcatgcaaaggggtttatttggaaaaacacaagtaggcgtaggcatacatatggaaggagtgttccatacgatgtggcatgttacgcggggtagcgtaatatgccacgaaacagggagattagagccgtcctgggctgacgtccgaaacgatatgatctcatatggtggaggatggcgattaggtgataaatgggacaaagaggaggatgtacaagtactggcaatagaaccaggtaagaacccaaagcatgttcagactaaaccaggactattcaaaacgctaacaggtgaaattggagcagtcacattggattttaaaccaggtacaagtggatcgccaataatcaacaagaaaggaaaagtaattggtttatatggaaatggtgtagtcactaagagcggagactacgtctcagcgatcacacaagcggagcgcataggtgaaccagattacgaagtcgatgaagatatattccgtaagaaacgactcactatcatggatctgcatcctggtgcagggaaaaccaagcgtatactgccaagcatagtaagagaagcgttaaaaagaaggttaagaaccctcatattagctccaacaagagtggtagcagccgaaatggaagaggccctgagaggacttccgataagatatcaaactcctgctgtaaagtcagaacacacgggaagagaaatagtagatttgatgtgccatgccacctttacgactagattactatcatcaacaagagttcctaactataatctaatcgtgatggatgaagcccatttcactgacccatctagtgtcgcagcaagaggatatatatcaacgcgagtggaaatgggtgaagccgcggctatatttatgacggccacgcctcctggtgccacagatccattcccacaaagcaactctcctatagaggatatagaaagagagatacctgaaaggagttggaatacggggttcgattggatcacggactatcaggggaagaccgtttggttcgtgccatctataaaagctggaaatgatattgccaattgtctaagaaaaagcggcaagaaagtgatccagctatcaagaaaaacttttgacactgaatatccaaagaccaaattaacagattgggattttgttgtcacaacagacataagcgaaatgggcgcaaacttcagagcaggacgggtaattgatcctagacggtgtcttaagccagtgattctgactgatgggccagagagagttatactggctggccccattcccgttacgccagccagcgctgctcaacgcagaggtaggataggaagaaatccggctcaagaagacgatcaatatgtattcagtggtgatccgctgaaaaatgatgaggatcatgcgcactggactgaagctaaaatgctactagacaatatatacacaccagaagggataatacctactttattcggcccagagagggagaagacccaagcaattgatggcgagttccgtctgagaggagaacagagaaaaacgtttgtggagcttatgcgtcgaggagacctaccagtgtggctctcatacaaagtagcaagcgcgggcatatcatataaagatagggagtggtgctttacaggagaacgtaataatcagatcttggaagaaaatatggaagtagagatttggacacgtgaaggggagaagaagaaattgagaccaaggtggttggatgctcgagtgtatgccgatcctatggccttaaaagattttaaagaatttgcgagtggtagaaaatcaatcactttggatatacttacagagatagcttctctaccaacatacttatctagccgggcaaaacttgcacttgacaatatagttatgttacatacgacggaacgcggaggacgcgcctatcaacacgctctcaacgaactaccagaaagcctagaaactcttatgttagtagcgctattaggggctatgactgcgggcatatttttattctttatgcagggaaaaggtatcggtaaactgtccatgggacttatagctattgcagttgctagcggacttctatgggtagcagaaattcagccacaatggatcgctgcatcaattatacttgagttctttctgatggtattattaataccagaacctgagaagcaacgtacaccacaagataatcagttgatctatgtgatcctaactatactgactataataggtctgattgccgctaacgaaatgggcttaatagagaaaacaaagacggatttcggattttaccaagtaaaaactgagactacaatcctcgatgttgatttacgaccagctagtgcatggaccctatatgctgtcgcgaccacaatattaaccccaatgctacgacatactattgaaaatacttcagcgaatctaagtttagcggccatcgcaaaccaggccgcggtattaatgggtctcggaaagggttggccattacatcgcatggatcttggagtacctttgttagcgatggggtgctattcccaagtgaatcccacaaccttgaccgccagtctggtaatgttattagttcattacgctatcatcggtccaggtcttcaagctaaggcaaccagggaggctcagaaacgaacggccgcaggcataatgaaaaatcctactgtagatggaataaccgtgatagatcttgagccgataagttatgacccaaaatttgaaaaacaattaggacaggtaatgctcctagtactgtgtgcaggtcagttacttttgatgcgcaccacttgggctttctgtgaagtactaacacttgcaactggccctattcttacgctctgggaaggtaacccgggcaggttttggaatacaacgatcgcggtttctactgcaaatatttttagaggttcttacctagcaggcgcaggtctagcattttccttaatcaaaaatgcacaaacaccccggagaggtactggaacgacaggggaaactcttggagaaaaatggaaaaggcaactaaacagcctggataggaaagagttcgaagaatacaaaagatctggaatattagaagtagatcgtaccgaggcgaagtcagcattaaaagatggttcaaaaaccaaacatgcagtttccaggggtagttccaagataaggtggatcgtagaacgaggaatggtgaagcccaaagggaaggtggtagatctagggtgtgggaggggaggctggtcttactatatggcgacccttaaaaatgtaacagaggtaaaagggtatacaaagggtggcccaggacatgaagaaccaattccaatggcgacttacgggtggaacctagtaaaactacacagcggtgtggacgtattttacaaaccaactgaacaagtagatacgctcctatgcgacatcggtgagtcctcttccaatcccacaatcgaagagggtagaactctgagggtactaaagatggtcgaaccctggttgagctcaaaaccagaattttgcataaaagtactgaacccgtacatgccaacggtaatcgaagaactagaaaaattgcagagaaagcatgggggtaacttagttcgttgtccactatcaaggaacagtacacacgagatgtactgggtctcaggggcatccggaaatatagtatccagcgttaatactacgagcaaaatgttactaaacaggttcacaacaagacacagaaagccgacatatgaaaaagacgtggatttgggggcaggaacgcgtagtgtgagcacggaaaccgaaaaaccagatatgactataataggacgtcggctgcagagattacaggaagaacacaaagaaacatggcactatgatcaagaaaatccttataggacatgggcttatcacggaagttatgaagcacccagcaccggatcagccagtagtatggtaaacggtgttgttaaattactcactaaaccgtgggatgttatacctatggtaacacaattagctatgacggacactacaccttttggccaacaacgtgtattcaaagaaaaagttgacacgcgaacgccacaacctaaacctggaacaagaatgataatgacaacaacagcgaactggttatgggcgctgcttggcaagaagaaaaaccctcgcctctgtacgcgtgaagagttcatctctaaagttaggagcaatgcagctatcggagcagtattccaagaggaacaaggatggacatctgcctcagaagcagtaaacgatagcaggttttgggagcttgttgacaaggaaagggcattacatcaagaaggtaaatgcgaaagttgcgtctataatatgatgggaaagagagaaaagaaactaggagaatttggaagggctaaaggctcacgtgcaatctggtatatgtggttgggagcgcgctttcttgagtttgaagcacttggctttctcaatgaagaccattggtttggccgtgaaaacagctggtccggtgtggaaggagagggtcttcacaggctggggtatattctagaggaaatagataagaaagacggggatcttatgtacgctgatgatacagctgggtgggacacgaggattactgaagatgacttacaaaatgaagaactaatcactgaacaaatggcaccacatcataaaattttagcgaaagcgatattcaaactaacctatcaaaataaagtcgttaaggttctgagaccgacaccgagaggagcggttatggacataatttcccggaaggatcaaaggggcagtggacaggttggaacttacgggttaaacacgtttacaaacatggaagttcaattaatacgacagatggaggcagaaggagtaataacacaagatgatatgcaaaacccaaaaggcctcaaagagagagtagaaaaatggttaagggaatgtggcgtagatagattaaagagaatggccatatcaggtgacgactgtgtagtgaaaccattggacgaacgattcggtacaagccttctattccttaacgatatgggcaaagtaaggaaggacataccgcaatgggaacctagtaaagggtggaaaaactggcaagaagtgcccttctgcagccatcactttcataaaatatttatgaaagacggaagaagtttagtcgttccatgtagaaatcaagacgagctaatcgggagagcaaggatatctcaaggtgcagggtggagcctacgcgagacggcttgtctgggaaaagcctatgcgcaaatgtggagcttgatgtattttcacagaagagatcttaggcttgcatcaatggctatatgtagcgccgtacctaccgaatggtttccgacatcaagaactacctggtctatacacgcacatcatcaatggatgacaacagaagacatgctgaaagtttggaaccgagtatggattgaagacaacccaaatatgactgacaaaacacccatacatagttgggaagacataccatatctcgggaagcgcgaagatttatggtgcggtagtcttattgggctttcaagccgtgccacctgggcaaagaacatccataccgcaataactcaggtcaggaatttaataggaaaagaagaatacgttgattatatgccagtcatgaaaagatacagtgcaccgtccgaaagtgaaggagtattataa

SEQ ID NO: 23612 - RNA, 9867 nt, synthetic construct
  misc_feature 1..9867: note = derived and/or modified CDS sequence (opt6) from DENV-4__FJ810417__SS-prME
  source 1..9867: mol_type = other RNA
tcgacgattacgctactttgcctaataccaaccgttatggcattccacctatcaacgagggatggggagccgcttatgatagtcgcgaaacatgagcgaggacgaccgttactgttcaaaactactgaaggtattaacaaatgtactctgatcgccatggacttaggagagatgtgtgaggataccgtaacttacaaatgtccattattagtaaacactgaaccagaggatatagactgctggtgcaatttaaccagtacctgggttatgtatggaacatgcacacaaagtggagagaggaggagagaaaaacgttcagttgcactaactccgcacagcggaatgggcttagaaacgcgagcagagacgtggatgtcaagtgagggtgcctggaaacacgcacaaagagtggaatcttggattttaaggaaccctggttttgctttgctagctggatttatggcatacatgataggacaaaccggaatacaaagaaccgtcttcttcgtgttgatgatgctagtagctccatcttatggaatgcggtgcgtcggcgtagggaaccgagattttgttgagggagtgagtggaggtgcatgggtagatttagtccttgaacatggaggctgtgtcaccacaatggctcaaggaaaaccaacactcgactttgagttaacaaaaactacagcaaaagaagtagctctattacgaacctactgtattgaagcatcaatatcgaacatcacgacggctacaagatgtccgacgcaaggtgagccctacttaaaggaagaacaagaccaacaatatatatgccggagggacgtagttgacaggggatggggaaatgggtgcggtctatttggaaaagggggtgtagtcacgtgtgcgaagtttagttgttctggaaaaataaccggtaaccttgttcagatagagaatttggaatataccgtagttgttacagttcataacggtgatacgcatgctgtaggaaacgacacttcaaatcatggagtgacagcaactattacacctcgtagtccctccgtcgaagtaaaactgcctgattacggtgagctgacactcgattgtgaaccgcggagtgggatagactttaacgagatgatattgatgaaaatgaaaaagaagacgtggttagtacacaagcaatggttcctagatttaccgctcccatggacagcaggagcagatacaagcgaggtacattggaactacaaggaaagaatggtaacatttaaggtccctcacgcgaagcgacaagatgtaaccgtcttaggttcacaagaaggtgcaatgcattccgcgctagccggcgctacagaagttgactcgggtgatgggaatcacatgtttgccgggcatttaaaatgtaaagtacgaatggagaaattgcgaataaaaggtatgagctacaccatgtgctcaggtaaattttcgatagataaggaaatggcagaaacacaacatggtaccacagtggtaaaagtaaaatatgaaggagcgggcgcgccttgcaaggtcccaatagagattagagacgttaacaaagaaaaggtagtcggaagagtcatcagctctatacctcttgcagaaaataccaattcagttacaaatatagaattagaacctcctttcggggatagttatatagtgataggagttggaaatagtgctttaactcttcactggtttagaaaaggaagtagtattggaaagatgtttgaatccacatatagaggagctaagcgaatggcgatattaggggaaaccgcctgggactttgggtccgtaggtgggctatttacttctctaggaaaagctgtacatcaagtatttgggtcagtctataccactatgtttggaggggtatcttggatgattcgcatactcataggtttcttagtgttatggattggtacaaatagtagaaatacaagtatggcaatgacttgtatagcagtaggtggaatcacccttttcttgggtttcacggtgcaagctgatatgggatgtgtggtttcttggtcgggacgagaattaaagtgtggttcagggatatttgttgttgataacgtgcatacgtggacagaacagtataagtttcaaccggaatctcccgccaggctagctagcgcaatactaaatgcacataaagatggtgtatgcgggattcgtagtacaacacgtttagaaaatgtaatgtggaaacaaataaccaatgaattaaactacgtgctatgggaaggaggccacgatttaactgttgtggccggtgatgttaaaggagttcttacaaaaggcaaacgagcgttaacaccaccggtttcggatctaaaatatagttggaaaacatggggaaaagcgaaaatatttactcctgaagctagaaattctacatttttgatagacgggcccgacacaagcgaatgtcccaacgaacgtagggcgtggaatagtctcgaagtggaagactatggtttcggaatgtttacaacaaatatctggatgaagttcagagagggttcctcggaagtgtgcgatcaccgtttaatgagcgccgccataaaagaccaaaaagcggtccatgccgatatgggatattggatagaatcttcaaagaatcaaacatggcaaattgaaaaagcatccttaattgaggtgaaaacatgtttatggcctaaaactcacacgctctggtctaatggcgtgttggaatcgcagatgctaataccaaaatcctacgcgggaccattctctcagcataattaccgtcaaggctatgctacgcaaaccgttggcccttggcatcttgggaaattggaaatagattttggcgaatgtccaggcactacagttacaattcaggaggactgcgatcacagaggaccgtcacttagaacaacaacagcatccggaaaactggttactcaatggtgttgtcgctcttgtacgatgcctccattgagatttctgggagaagacggatgttggtatggcatggaaattagacctctaaatgagaaagaagaaaatatggtcaagtcgcaggttacagcaggtcaggggacgagtgaaacgttcagtatgggtttattgtgtcttacgctctttgtagaagaatgtctacgtagacgagttacacgtaagcacatgatcttagttgtggtaataacgttatgcgcaataattttgggcggactcacctggatggatcttctacgcgctctaataatgctgggagatacaatgtcgggaagaattgggggacaaatacatttagcgataatggcagtctttaaaatgagcccaggttatgttctaggagtctttctaagaaaactcacaagtcgagaaactgcacttatggtaatagggatggccatgacaaccgtactgtccatcccccatgatcttatggaactaatagacggtataagcctaggacttatcttgttaaaaatagtcacgcaatttgacaatacacaagtgggaacgttggcgttgagtttgactttcatccgttcaacaatgccactcgttatggcctggcgcacaatcatggccgtactctttgtagtaaccttgatccctttatgtcgtacaagttgcttacaaaagcaatcgcattgggttgaaatcacagccctaatactgggagctcaggcattaccggtttacttgatgacactcatgaaaggtgcaagtcgacgtagttggccattaaacgaaggtataatggcagtagggctggtctccttacttggtagtgcattgttaaagaatgatgtaccacttgctgggccaatggtggcaggaggtcttcttttagcagcttacgtaatgagtggaagttccgctgatctatcactagaaaaagctgctaatgtacaatgggatgaaatggcagatataactggctcatcccctattatagaagtaaaacaagatgaggatggttctttttctataagagatgtcgaggaaacaaatatgataactctattagtaaaattggcacttattacagtctcaggcctataccctctagctatacccgtcaccatgacactgtggtacatgtggcaagttaaaacacaaagaagcggtgctctgtgggatgtaccaagtccggctgctacgcaaaaagcggcacttagcgagggtgtttaccggatcatgcaacggggacttttcggcaagacacaagtaggtgtgggtattcatatggaaggagtttttcatacgatgtggcacgtaaccagaggatcagttatttgccacgaaacaggtcgcctggaaccatcctgggcagacgttagaaacgatatgatatcctacggcggcgggtggagactcggagacaaatgggacaaagaagaagatgtacaggtactagctattgaaccaggcaaaaatccaaaacacgtacaaacgaaaccgggattatttaaaacactaacaggagaaatcggtgcagtaacgctagactttaaacccggaacaagtggatctccaattattaatagaaaaggtaaagtcataggcctgtacggaaacggagtagtaaccaaaagcggtgattacgtatctgcaattacacaagccgaacgcatcggtgaacctgactacgaagttgacgaagatatttttagaaagaaaagactaacaataatggatttacacccaggtgcaggaaaaacaaaacgcattctaccctcaatagtaagagaagccctgaagcgtaggttacggactctcatcttggccccaacacgagttgtagcggcagaaatggaagaagcgttaaggggactaccaataaggtatcaaacaccagcagtaaaatctgaacatactggacgcgagatagttgatctaatgtgtcatgcgacctttacaacaagactcttaagttctacaagggtaccaaattataacttaattgtaatggacgaggcccattttactgatcctagttcggtagccgcaagaggctacattagcacccgggtggaaatgggagaggcagcggcaatatttatgacagctactccacccggtgcaactgatccgtttcctcaatcgaatagccccatagaagatatcgagagggagatacccgaaaggtcatggaacactggctttgactggataaccgattaccaagggaagactgtctggtttgtaccaagcataaaagccgggaacgatatagcgaattgtctcagaaagtctggcaagaaagtaatacagctctctaggaaaacgtttgacaccgaatacccaaaaacaaaattaactgattgggattttgtagttacaacagacatttccgaaatgggagccaatttcagagcaggtagagtgatcgatcctagaagatgtctaaaacctgtaatattaactgatggaccagaaagggtaattctagctgggcctatccccgtcactccggcgtctgcagcacagcgcaggggaaggataggacgtaatccagcgcaagaagatgaccaatatgtattctctggcgatccgctgaaaaacgatgaggaccacgcgcactggactgaagcaaaaatgctacttgataacatatatacaccagaaggcattatacccactttatttggacccgaaagagagaaaacacaagctatcgacggagaatttagactaagaggggaacagcggaaaacttttgtagaactcatgagaaggggagatttgcccgtctggctgtcctataaagtcgcgtctgctgggatttcctataaagacagagagtggtgcttcacgggcgaacgaaacaaccaaatactagaagaaaatatggaagtggagatttggactagagaaggtgaaaagaagaaacttagacctagatggcttgatgctcgtgtatatgcagacccaatggctttgaaagattttaaagagttcgcgtcgggaagaaaatctataaccctggacatattaacagagatcgcctctttaccaacttacctttccagtcgagctaaactagctttggataacattgtaatgttacatacaactgaaagaggcggcagagcgtatcaacacgcactgaatgaattgccggaaagcctcgaaacgctaatgctggtagccttactaggagctatgaccgcgggtatatttttgttctttatgcaaggaaaagggattgggaaactgtcaatgggactaatagcaatagcggttgcgtcagggttactttgggtagcagaaatacaaccacaatggatcgccgcaagtataattctagagttctttctaatggtactgcttattccagagccagagaaacaaaggacacctcaagataatcaattaatatatgtgattcttactatactgacaataataggattaatagcagcaaacgagatgggtttaattgagaaaaccaaaacagattttggtttctaccaagtaaaaaccgaaacaacaatattggacgttgatttaagacctgctagtgcttggacgctttatgcggtagcaacaacaatattaacccctatgcttagacacacaatcgaaaatacatcggcgaatctaagcctagcagctattgccaaccaggcagccgtgctgatggggttggggaaagggtggcctctccatagaatggacctcggagtccccctattagctatgggatgctacagccaagtcaatcctacaacattaacagcttcattagtaatgctcctagttcactacgcaatcataggcccgggactacaggcgaaggcaactagagaagctcagaaaaggactgccgcaggtataatgaaaaatccgaccgtagatggcattacagtaatcgatttagagccaatatcgtacgaccctaaatttgaaaaacaactaggtcaagtaatgctacttgtactatgtgcaggacaattactcttaatgagaactacgtgggcattttgcgaagtactcactttggcaacggggcctatattaaccctatgggagggtaatcccggtcgattttggaatacaaccatcgcggtatcaacagcaaatatttttagaggttcgtatttagcaggagctggcttggcattttctttaattaaaaacgctcaaactccccgtagaggcacaggcacaacaggagaaacactaggtgagaaatggaagcgacaattaaatagtttagaccgtaaggaatttgaagaatacaagcggtctggaattttagaggtagaccgtacagaagctaaaagtgcactgaaagacggatcgaaaacaaagcacgcagtctcgagagggtcatctaaaataaggtggatagtagagaggggcatggtcaaaccgaaaggaaaggtggtcgatttaggttgcggcaggggaggatggagctattacatggccactctgaagaatgtaactgaagtcaagggatatacgaaaggagggcccggacatgaagaacctataccgatggcaacctacggatggaatctagtaaaactacacagtggagtcgatgtattttacaaacccacggaacaagtggatacactactgtgtgacataggagaatcgagctcaaatcccacaatagaagagggacggacattacgagtcctaaaaatggtggaaccatggctgagttcaaaaccggagttttgtattaaagtacttaatccatatatgccaactgtcatagaagagttggaaaaattacaacgaaaacacggcggaaatttagttaggtgtccactttcgaggaacagcacacacgagatgtattgggtgtcgggagcgtctgggaatatagtgtcgtcagttaacaccacctcaaaaatgctactaaatagatttacaacaagacatagaaaacctacttacgagaaagatgttgatctcggagcaggtaccaggagtgtatcaactgaaaccgagaaacctgacatgaccatcattgggagaagattgcaaagacttcaggaggaacataaagaaacgtggcattatgaccaagaaaacccatatagaacatgggcttatcatggatcttacgaagcacctagcactggatctgcttcttccatggttaatggagtagtaaaactgttaactaaaccttgggatgtgattccgatggtcactcaactggcgatgactgacaccacaccatttggacaacaaagggtatttaaagaaaaagtggacacccgtaccccgcaaccgaaacctggaaccaggatgataatgactactactgctaattggttatgggctttgttagggaagaagaaaaacccaagactgtgtacacgtgaagaatttatatcaaaagtgagatctaatgccgcaataggagcggtatttcaagaggaacaaggctggacatcggcgtcagaagcggttaatgacagccgtttttgggaactcgtagataaagaaagagctttacaccaggaagggaagtgtgaatcatgcgtttacaatatgatgggtaagagggaaaagaagttgggggaatttggcagagcaaaagggtctagggcaatatggtacatgtggttaggtgcaagatttttagaatttgaggcattaggattcttaaacgaagatcattggtttgggcgtgagaacagctggtcaggagtagaaggagaaggtttacaccgattgggttatattctagaagagatcgataagaaagacggcgatctgatgtatgccgatgacaccgcaggatgggataccagaattaccgaggacgatttacaaaatgaggaattgattacagaacaaatggcgccacatcataagatattagcaaaagctatatttaaacttacttatcaaaacaaagtggtcaaagtacttagaccaactccgagaggagcagtcatggacataattagcaggaaggaccaaagaggatcgggccaggtaggaacttacggattgaacacctttaccaatatggaggtccaacttataagacaaatggaggcggaaggcgttataacacaggatgacatgcaaaatcccaaaggacttaaagaacgcgtcgaaaagtggctaagagaatgtggagttgaccgactgaagcgaatggcaatatcaggcgacgattgtgtagtcaagcccttggatgagagatttggcacgagcttattatttcttaacgatatgggaaaagttcgaaaagatattccacaatgggagccctccaaagggtggaaaaactggcaagaagtcccgttctgtagccaccatttccacaaaatatttatgaaagacggtcgatccctggtagtaccatgtagaaaccaagatgaattaattggccgtgcaagaatatcacaaggcgccggatggtcattaagagagaccgcgtgtttaggcaaagcatatgcccaaatgtggtcattaatgtacttccatagaagggatcttagactagcttcgatggcaatctgttcagcagtcccaactgaatggtttcctacctcccgtaccacatggtcgatccatgcacatcaccaatggatgacaaccgaagatatgttaaaggtatggaaccgagtatggattgaagacaaccctaacatgacagacaagacccctatacatagttgggaagatataccttatttaggaaagagggaagacctatggtgtgggagtctgataggcctttcttctagggccacctgggcgaagaatatacatactgcgattacacaagtccgaaatctcatcggaaaagaagaatacgtggattatatgcccgtgatgaaacgatacagtgcaccaagtgaatcggaaggagttctgtga

SEQ ID NO: 23613 - RNA, 9867 nt, synthetic construct
  misc_feature 1..9867: note = derived and/or modified CDS sequence (opt6) from DENV-4__FJ850057__SS-prME
  source 1..9867: mol_type = other RNA
agcactataaccctactatgtctgataccaacagccatggcatttcatttgagcacaagagatggagaaccattaatgattgtggcaaaacacgaacgtggtcgcccccttttattcaaaacaacagaaggcataaataaatgcaccttaatagcgatggatttaggggaaatgtgtgaagacacggtgacgtataaatgtccattactcgtgaataccgaaccagaagatatagattgctggtgtaacctgacatcaacttgggtcatgtatggaacgtgtacacagagcggcgaaagacgaagggagaaacgatcggtggcactgacaccacattcaggaatgggactagaaacacgcgcagaaacgtggatgtcgagcgaaggcgcatggaaacacgctcaaagggtagaatcctggattctaaggaatccaggctttgcgttacttgcaggcttcatggcatatatgattggtcaaacaggtatacaaagaacagtattcttcgtattgatgatgctggtcgcaccaagctatggaatgcgatgtgtcggagtaggtaatcgtgatttcgtagaaggggtaagtggcggagcgtgggtggatttagtccttgaacatggcggatgcgtaactactatggcacaagggaaaccaacattggactttgaattaacaaaaacgacagcaaaagaagttgcgctgctgaggacgtattgcatcgaagcaagtatttctaatattactacagccacaagatgtccaactcaaggggaaccttatttaaaagaagaacaagaccagcaatacatttgtcgaagagatgttgtcgaccgaggatggggcaatgggtgtggattatttggcaaaggaggtgtagttacatgtgccaaattctcgtgttcgggaaaaataactggaaatttagtacaaattgaaaatctagaatacactgtcgtcgttacggttcataatggagatacacacgcagttgggaacgatacgagtaatcatggagttaccgcaacgatcactccacgctcaccaagtgtagaagtgaaacttcctgactacggggaactcacactagactgcgaacctcggagtggaatagactttaacgaaatgatactcatgaaaatgaagaagaaaacgtggctcgtacataaacaatggttcttagatctgccactaccatggaccgcaggcgcagatacatcagaagtacattggaattataaagaaagaatggtaacgttcaaagtacctcatgctaaacgacaggatgtaacagtactcggatcacaagaaggtgcaatgcattccgcgctagcgggagccacggaagtagatagcggagatggaaatcacatgttcgccggtcatttgaaatgtaaagtcagaatggagaaactcagaattaaaggcatgtcatatacgatgtgcagtggtaaatttagcattgacaaagaaatggccgaaacacagcatggaactactgtagtaaaagtcaaatatgaaggtgcgggtgcaccctgcaaagtgccaatagaaatacgggatgtaaataaagagaaagtggttggaagagtaatatcgagcactcccttagccgagaacaccaattcggttacaaatatcgaactcgaacccccttttggtgactcctacattgtcattggtgtaggaaacagcgcattgactcttcattggttcaggaaaggatcgtcgattggaaaaatgttcgaaagtacataccgcggagctaaaagaatggcaattctcggtgagactgcgtgggattttggatcagtaggagggctattcacctctcttggaaaagcagtacatcaggtcttcggatcagtatataccaccatgtttggcggtgtttcgtggatgatccgaatattaatcggatttctagtgctgtggattggtacgaactcacgaaacacaagtatggcaatgacatgtattgctgtcggtggtataacactatttctaggttttacggtacaagccgacatgggctgtgtggtgtcatggtctggcagagaattaaaatgtgggagtgggattttcgttgttgacaacgtacacacttggaccgaacagtataaattccaaccagaaagccctgcaaggctagcttcagccatcttaaacgcacacaaagatggtgtatgcggaataagatcgacaacaaggcttgaaaacgtgatgtggaagcagataactaatgagctaaactatgttctatgggaagggggtcacgatctaacagtggtagccggtgacgtaaagggtgtactgacaaaaggtaaaagggcattaacgcctccggtgtcggacttaaaatattcatggaaaacttggggaaaagctaagatatttacgccagaggctaggaactcgaccttcttaatagacggtcccgatacatcagaatgcccgaatgaacgacgtgcatggaatagtctagaagtagaagactatggttttggcatgtttacaactaacatttggatgaagttccgggagggaagctcagaagtatgcgaccatcgacttatgagtgccgccataaaagaccaaaaagctgtacacgcggatatgggctattggatagaatcatctaaaaaccaaacatggcaaatcgagaaagcaagcctgatagaggtcaagacatgcttgtggccaaaaacccataccctatggtctaacggtgtgctagaaagccagatgctaattccgaaatcgtacgcgggccctttcagtcaacataattatagacagggttatgccacgcaaacggtgggaccatggcatctagggaaactagaaatcgactttggagaatgtccaggaacgacagtcacgatccaagaagactgcgaccatcgtggtccttcattacgaacaacgactgcatcaggaaagctagtaacacagtggtgttgtagaagttgcacaatgccaccactaagattccttggagaggatgggtgctggtatggtatggagattcgacccttaaatgaaaaagaagaaaacatggtaaagagtcaagtgacggcgggccaaggcacttcagaaacgtttagtatggggttactatgtttaacattatttgtagaagaatgtttaagacgccgagtaacacgaaaacatatgattcttgtcgtagttataacactttgcgcaatcatattgggtggattaacgtggatggatctattgcgcgcgttaataatgttaggagatactatgagcggacgtatcggtggccaaattcatttagctataatggccgtattcaaaatgtctcctggatacgtactaggcgtcttcttaagaaaattaaccagtagagaaacagcactaatggttataggaatggcgatgactactgttctgtcaatccctcatgacttgatggagctcatcgacggcatatctttaggtctcatactcctaaaaattgtaactcaatttgataatacacaagttggaaccttagcacttagtttgaccttcattagatcaacaatgcccctagttatggcatggaggacaataatggcagtgctattcgttgttacattgattccgttatgtcgaacaagttgccttcagaaacaatctcattgggtggagataacggccttaattctaggggcacaagccctaccggtttacctaatgacactaatgaaaggagcgagcaggagaagttggccactcaatgaggggatcatggcggtcgggctagtcagtctcctaggatcagctctccttaaaaatgatgtgccactagcagggccaatggttgcaggaggtttattactagccgcgtatgtaatgtcaggatcttctgctgatttgtctcttgaaaaagcagccaatgtgcagtgggatgagatggccgatataacaggcagcagtcctataatagaagtaaaacaagatgaggacggctcctttagtataagggatgtcgaagagacaaatatgataacattactcgtcaaattagctttaataacagtaagtggcctatatcccttagcaatcccagtaacaatgaccctgtggtatatgtggcaggttaaaacacagagatctggtgcactttgggatgttccgagtccagccgctactcaaaaagctgcgctaagcgaaggagtatatagaatcatgcaaaggggcctcttcggaaagactcaggtgggtgtagggattcacatggaaggagtgtttcataccatgtggcacgtgacaagaggaagtgtaatttgtcacgaaacaggcaggttggagcccagttgggcagatgtgcgtaacgatatgattagttatggtggagggtggaggctcggcgataaatgggacaaagaggaagacgtccaagtgttagctatagaacctggcaaaaatcccaaacatgtgcaaaccaagccggggctatttaaaacattaaccggtgagataggagccgtgactttagattttaagccaggaacaagtgggtcaccaattataaataggaagggtaaggtgataggcctatatgggaatggtgtcgtaacaaaatctggtgattacgtatccgcaatcacccaggcagagcgaataggggaacccgactacgaagtagacgaagatatattcagaaagaaaaggctaacgatcatggacctacacccaggtgcgggtaaaactaaacgaatactaccttcgatagtcagagaagcacttaaacggagactgagaactctaatacttgctcctacgagagtagtggcagctgaaatggaagaagcactacgcggattgcctattcgttaccaaaccccagcagtgaaatcagaacacacagggcgtgagatagtagatctgatgtgccatgctacatttaccactaggctacttagtagcacgagagtccctaattataatttgatagtaatggatgaagcacatttcaccgacccgtcgagcgtagctgctcgaggttacatcagtacaagagttgagatgggcgaggcggcagcaatattcatgacggctacaccgcccggcgcaaccgatccattccctcaatctaactcacccatagaagacatagaaagagaaataccagaaagatcatggaatacaggttttgactggataactgattatcaaggtaagactgtatggtttgtcccatcgattaaagcgggtaatgacatagcaaactgcctgagaaaatctggcaagaaagttatccaactatctcggaaaacgtttgatacagagtatccaaaaacgaagttaacagattgggatttcgttgttacgaccgatatttcagaaatgggtgccaatttcagggctggccgagtcattgatccacgtaggtgtttaaagccagtaatacttacagatggtccagaaagggtcatattggcaggaccaatacctgtgacccctgcaagcgcagcgcaaagacgaggtagaatagggagaaaccctgctcaagaagacgaccaatatgtcttttcgggagatcccctgaagaacgacgaggatcatgcgcactggacagaagcgaaaatgctcttagacaacatatacactccagaaggtataatccccaccttgtttggtccggaaagagagaaaactcaagccatagacggggagtttaggctacgaggagaacaaaggaagacattcgtggaattaatgcgacgtggcgatcttcccgtatggctatcctacaaagtagcgtctgcaggaatatcttataaagatcgcgagtggtgttttacaggagaacgcaataaccaaattttagaagaaaacatggaagtagagatctggacgagggaaggtgagaaaaagaaactacgtccaagatggttggatgctagagtttacgcagaccctatggcactgaaagattttaaagagttcgcttcaggacgaaaatcaatcacactggacattttaaccgaaatagcttcccttcctacctacttatcatccagagcaaagttagcactagataatatcgttatgttgcacacaacagaaagaggtggtcgagcataccaacatgctttaaacgaactcccagaaagcctagaaactttaatgctagtagctttattaggtgcaatgaccgcaggaatatttttatttttcatgcaaggaaagggaatcggtaaactatcaatgggtttgatcgcaatagccgtggcaagtggtcttctctgggtagccgaaatacagccccaatggatagccgcaagtatcatacttgagttcttcctcatggtcttattaattccagaacccgaaaaacagcgaacaccacaagataaccagttaatttatgttatactaacaattcttacaattatcggactgattgctgcgaacgaaatgggactcattgagaagacaaagactgactttgggttttatcaagtcaaaacggagacaacaatattagatgtagacctccgaccagctagcgcatggacgctttatgctgttgcgaccacgatactcactccaatgctacgacacactatagagaacacaagcgcaaatcttagtttagcagctatagcaaaccaagcagccgttctaatgggacttggtaaaggctggccattacatagaatggatctcggtgtgccacttctggccatgggctgttacagccaagtaaacccaaccacactaacagcaagtcttgtaatgctattggtacattacgcaattattggacccggattgcaggcaaaggctactagagaggcacagaaaagaaccgcggctggtattatgaagaacccgacggtagacggaataacagtaattgatttagaaccaatttcttacgatcccaaattcgaaaagcaattaggacaagtgatgctattggtgctttgcgccgggcaactacttttaatgagaaccacttgggctttttgcgaagtgttgacccttgctacgggcccaactttgactttatgggaaggcaacccgggaagattttggaatacaacaatcgctgtgtccactgcaaacatatttcgaggcagttatttggccggtgcaggattagcatttagtctaatcaaaaacgcacaaacaccgcgcagaggtaccggaacaacaggagaaaccttgggagaaaaatggaaaagacaacttaattcgctggatcgaaaagagttcgaagaatataaaaggagcggcatcctagaagtagatcgtacagaagccaagtcagcgctgaaggatggcagcaaaacgaagcatgccgtgtctcgaggttcaagcaagataaggtggattgttgagagagggatggtaaagccaaaaggcaaggtagttgatttgggatgcggtaggggcggatggagttactatatggccacactcaaaaatgtaacggaagttaaaggatacacaaaaggaggacctggacacgaggaaccaatccctatggcaacttacgggtggaatttggtaaaactgcactccggtgttgatgtgttttataaacctacggaacaagttgacactttattatgcgacataggagagtcaagctcaaatccaacaatcgaggagggtagaaccttgcgagtactcaaaatggtcgaaccatggctcagttcgaaaccagaattttgtatcaaggtcttaaatccttatatgcctacagtgatagaagaattagaaaagttacaacgtaaacatggaggaaatctagtaagatgtcctttgagtagaaattctactcatgaaatgtactgggtttctggtgcgtcaggaaatattgtttcctctgtaaacaccacatccaagatgctactaaatcgttttacaacaagacacagaaaacccacatatgaaaaagatgttgacctaggagcaggaacaagaagcgtctccactgagacagaaaaacctgatatgactattataggcagaagactacaaaggttacaggaagaacacaaagagacatggcattacgatcaagaaaatccgtatcgcacatgggcttatcatggaagctatgaggccccctcgacaggatcagcctctagtatggttaatggagtagttaagttattaacaaaaccttgggacgtcatacctatggttacacagctcgcgatgacagatactaccccgtttggacaacaaagagtatttaaagagaaagtagatactagaacaccacagcccaaaccaggcacaaggatgataatgacaacgactgcgaattggctttgggccctattaggtaagaagaaaaatccacgactgtgcaccagggaagagtttatatcgaaagtaagatctaatgctgcaataggagcagtctttcaagaagaacaaggttggaccagtgcttcagaggcggtcaatgactcacgattttgggaattagttgacaaagaacgggctttacaccaggaagggaagtgtgaaagctgcgtttataacatgatgggaaaaagagagaagaaactaggtgagttcggacgtgccaaaggcagtcgtgcaatttggtatatgtggctcggagctagatttttggagtttgaggctttaggctttctaaacgaagaccattggtttggacgagagaactcatggtcaggagtggaaggagaaggcttacaccgattaggatacatacttgaggaaatagataagaaagatggtgacctaatgtatgcggatgatacggctggatgggatacgcgtatcacagaggacgatttgcagaatgaagaattaataacagaacaaatggcgccgcatcataagatcctagcaaaggcaatattcaagctaacatatcaaaataaagtggtcaaggttcttcgacctacccctaggggtgcagttatggatataataagcagaaaagatcaaagggggtctggacaagtcggaacatacggactaaacacattcacaaacatggaagtacagttgatacgacaaatggaagccgagggagtcataactcaagatgatatgcaaaacccaaaaggacttaaggagagagtagaaaaatggctaagagaatgcggcgtggataggctcaaaagaatggcgatatccggagatgattgcgttgtcaagccccttgacgaaagatttggaacaagtcttctttttctcaatgacatggggaaagtaagaaaagacataccccaatgggaacccagcaaaggatggaaaaactggcaagaggtaccattctgtagtcaccatttccataaaatatttatgaaggatggaagaagtctggttgttccgtgccgtaatcaagacgagttgattgggcgcgcgcgaatatcacaaggagccggttggagcctacgcgaaaccgcatgtttagggaaagcatacgcccaaatgtggtcactaatgtactttcatcgaagggatttgcgtctcgcatcgatggcaatttgctctgccgttcctacagagtggtttcccacaagcagaacaacatggagcattcatgcacaccatcaatggatgacgactgaagatatgttaaaggtatggaatagggtatggatcgaagataacccaaatatgactgacaagacgcctattcactcatgggaggatattccttacctaggaaaaagagaggacttatggtgcgggtccctcataggtttaagctcacgtgctacatgggctaaaaatattcataccgcgattactcaggtacggaatttaataggaaaagaagaatacgtagattatatgccagtaatgaaaagatattcagcaccatcagaatcagagggagtactataa

SEQ ID NO: 23614 - RNA, 9867 nt, synthetic construct
  misc_feature 1..9867: note = derived and/or modified CDS sequence (opt6) from DENV-4__GQ199881__SS-prME
  source 1..9867: mol_type = other RNA
tcaacaatcacgttattatgcttaattcccacggtaatggcatttcatctgagtactcgggatggtgagcctttaatgatagtggcgaaacacgaaaggggccggccactgctatttaaaacaacagaaggcattaacaaatgtacactaatagcgatggatttgggagaaatgtgcgaggatactgttacatataaatgcccgctattagtaaacaccgaaccagaggatatagattgttggtgcaatctgacaagtacatgggtaatgtatggtacatgcactcagagtggagaacgtcgaagagagaaaagatcggtagctttgacaccacactctggcatggggttagaaacaagagctgagacttggatgagcagtgaaggagcatggaaacatgcacagagagtagaaagttggattcttaggaacccagggtttgcattacttgcgggatttatggcatatatgatcggacaaacacgaatccaaagaacagtatttttcgtgctaatgatgctcgtagcaccttcgtatgggatgcgttgcgtcggagtagggaatcgagattttgtggaaggagtatcaggaggtgcttgggtggatttagtattagaacatggagggtgtgtcacgacaatggcgcagggaaaaccaacacttgatttcgaactgacgaaaacaacggcgaaagaagttgctcttttaaggacttactgcatcgaagccagcataagtaacattactacagctacgcgatgtcctacacaaggagagccttatcttaaagaagaacaagatcaacaatatatatgtagacgagatgtggttgacagaggatgggggaatggctgcggattatttggaaaaggtggggtagtaacgtgtgcaaaattttcctgttctggaaaaattaccggaaatttagttcagattgaaaacttagaatacacagtagttgtaacagtccacaatggagacacacatgcagtaggcaatgacacatccaatcatggagtgacggcaacaataacaccgcgaagtcctagcgtagaagtgaaattacccgattacggcgaattaaccttagactgtgagcctaggagtggtattgattttaatgagatgatactaatgaaaatgaagaagaaaacttggctagtacataaacaatggtttttagatttaccgctaccatggacagccggtgcagatacctcagaggtacactggaattataaggaacgaatggtcacattcaaggttccacacgccaaacgacaagacgtcactgttctaggtagccaagaaggagcaatgcatagcgctttagccggagccacagaagttgacagcggagacggtaatcatatgttcgcaggtcatttaaaatgtaaagtacgaatggaaaaattacgaataaagggaatgagctatacaatgtgtagtggtaaattttctatagacaaggaaatggccgagacccaacacggtaccacagtagtgaaagtaaagtatgagggagccggtgcaccatgcaaagtaccaatagaaataagagatgtaaacaaggagaaagtagtaggtcgcgtgatatcttccacgcccctcgcggaaaacaccaacagtgtaactaatatcgaactagagcctccctttggcgatagttatattgtgattggtgtcggtaactctgccctaacgttacactggttcagaaaaggatccagtatagggaagatgtttgaatccacttatcgtggtgctaaaagaatggcaatactaggagagacagcatgggatttcggctctgttggaggattatttactagcctcggaaaagctgtccatcaagtatttggctctgtgtacacaacaatgtttggtggggtctcctggatgatcagaattttaattggatttttagttttatggataggcaccaattcacgaaatacttcgatggcaatgacctgtattgccgtaggagggattacattatttctggggtttacggttcaagctgatatgggatgcgtagtatcatggagcggtagagaactcaaatgcggatcaggaatctttgtggtcgacaacgtacacacttggactgaacaatataagtttcagcccgaatctccagctagattggcctccgctatactcaatgcacataaggatggagtgtgtggtatcagaagtaccacaagactagagaacgttatgtggaaacaaatcactaatgagcttaattacgtcctgtgggaagggggtcacgatttaaccgtagtagccggagatgtcaaaggggttcttaccaaaggtaaacgtgctttgacacctcccgtcagtgatttaaaatactcttggaaaacgtggggaaaagccaaaatttttacacctgaagctagaaacagtacgtttttaatagacggaccagatacatctgagtgccctaatgagcggcgtgcatggaatagtcttgaagtcgaagactatggctttggtatgtttaccacaaatatttggatgaaatttcgagagggtagttcagaagtatgcgaccatcgcttgatgagtgcagcgataaaagatcaaaaagctgtacatgccgacatgggatattggatagaatccagtaaaaaccagacttggcaaattgaaaaagcatctctgatcgaagtaaaaacatgtctatggcccaaaactcatacactgtggtcaaatggtgtattagaatcgcaaatgttaataccgaaaagttacgctggaccgttcagtcaacacaactaccgacaaggctatgccactcaaacagtaggtccgtggcatctagggaaattagagatagactttggggaatgcccaggtacgactgtaactattcaggaagattgtgaccaccgtggtccctctttaagaacgacgaccgcgagtggtaaactggtgacccaatggtgctgtcggtcttgcacaatgcctccattgcggtttctaggagaagatggatgttggtatggaatggagattcgtccgctgtcagaaaaagaggaaaacatggtaaagtctcaagtggccgccgggcagggaactagcgaaacatttttcatgggactcttgtgtttaaccttgtttgtagaagagtgcctcagaagaagggtgacgagaaaacatatgatattagcagtagttataacattatgcgctataatactaggtgggctgacatggatggatttattacgagcactaattatgctcggtgatacaatgtcgggtcgaatcggagggcaaactcatctagctataatggcagtattcaaaatgtcgccgggatatgtccttggagttttcctgcgtaaattaacaagtagggaaaccgctctcatggtaattggaatggcaatgacaacaactctctcaatacctcacgatcttatggaactcatagatggcatatctctaggtctgatactcttaaaaattgtaacacaatttgataatacccaggttggtactctggcattatcccttactttcatcagaagcacaatgtcattagtaatggcatggcggaccataatggctgtcttatttgttgtcacattaatcccattatgtagaaccagttgcttgcaaaaacagagccattgggttgaaatcacggctctgatattaggtgctcaagcattacctgtgtacttaatgaccttgatgaaaggagcttctagaagaagttggcctctaaatgagggtatgatggccgttggcttggtatctttactagggagtgctttattgaagaacgatgtccctttggcaggtccgatggtagcaggcggactgttattggcagcatatgttatgtctgggtcaagcgctgatcttagtttagaaaaagcggccaatgttcaatgggatgaaatggcggatataacgggctcctcaccaataatagaagtaaaacaggatgaagatggatcattctcaattcgagatgtggaagaaacaaatatgataactttactcgttaaattggcattgattacagtgagtggactgtaccctcttgctatacccgtaacgatgacattatggtatatgtggcaagtcaaaacacagagatcgggagcgttatgggacgtgccaagtcccgctgcgacacaaaaagcagctctttcagagggtgtttacagaatcatgcagagaggattattcggcaagacgcaagttggggtaggaatacatatggagggcgtctttcacacaatgtggcacgtcactcgcgggtcggtgatatgtcacgagacaggacgactcgagcccagttgggccgatgtgcgtaacgacatgatcagttatggtggtggctggcgacttggtgataagtgggacaaagaagaagacgtacaagtactagcaatagaacccggaaagaaccctaagcacgttcaaaccaagccaggtttattcaaaacactaaccggtgaaattggcgcagtaacactagacttcaaacccggctcatctggcagcccgataattaacaggaaaggcaaagtaatcggtctttatggcaatggtgtagtaacgaaatctggagattatgtatctgctataacacaagcagaaagaattggagaaccagattatgaagtagatgaagatatattccgtaaaaagagattaactatcatggatcttcacccgggtgccggaaaaacgaaaagaatactaccgtctatagtaagagaggctcttaaacgacgtttaagaacactgatactagcaccgactagagtagtggcagcagaaatggaagaggcgcttagaggtctgccaataaggtatcaaacccctgctgtaaagtcagagcatacgggtcgtgagatcgtagatctaatgtgtcatgcgacttttactacaaggttactgagctctacgagagtaccaaattacaatctaatagtgatggacgaggcccatttcacagatccgagtagtgtcgctgcccgaggttacatttcaactagagttgaaatgggagaagcggcagcaatcttcatgaccgcaacacctcctggcgctacagacccgttcccccaaagcaactcaccaatagaagatattgaacgcgaaatacccgaacgttcatggaatacagggtttgattggataactgattatcaaggaaaaactgtatggtttgtacccagcattaaggcgggaaatgacatagctaactgtctaagaaagtcaggtaagaaagtaatacagctatcccgcaaaacatttgatacagaatatcctaagaccaagttaaccgattgggacttcgttgttacaactgacattagtgaaatgggagcaaactttagggcaggtagggtaatagatccaagacgatgtctaaaaccggttatcctaacagatggacctgaacgagtgatattagcgggccctataccagtaactcccgcatcagctgctcaaagaagaggtcgtattgggagaaacccagctcaagaggatgaccaatacgtattttccggcgatcctctaaagaatgatgaagaccatgcccattggactgaggcaaaaatgttactcgataatatatacactccggagggcataatccctactctatttggtcctgaacgtgagaaaactcaagctatcgatggagaatttagactacgaggtgagcaaagaaaaacttttgtcgaactaatgagacgaggagacctcccagtgtggttatcatacaaagtagcaagtgcaggaataagttataaagacagagaatggtgttttacaggtgaaagaaataaccaaatactagaggaaaacatggaggtcgaaatatggacgcgtgagggtgagaagaagaaattaagaccccgatggctagacgcaagagtctatgcggatccaatggcattaaaagattttaaagaatttgcttctggtagaaagtcaataacattagatattcttacggaaatagcatctctacctacatacctaagctctcgtgcaaagttggcactagataatattgtaatgttacacactacagaacgtggtggccgagcctaccaacacgcacttaacgaacttccagaatctttggaaactctaatgcttgtggcattattgggtgctatgactgctggaatattcctgttctttatgcaaggtaaaggaataggaaagttatcaatgggtctcataaccatagccgtagcctcgggattgttatgggtagcagaaatacaacctcaatggatcgcagcttcaatcatattggagttctttctaatggtactcttaatccctgaacctgaaaaacagagaacaccccaagataaccaattgatctacgttattttagcaatattaactataataggacttattgcggcgaatgaaatgggacttattgagaaaactaaaaccgatttcgggttctaccaagtaaaaacagaaacaaccatactggacgtcgacttacgcccagcgtcagcttggaccttatatgcagtagctacaaccatcctcacccccatgttaagacatacaattgaaaatacatctgccaatttatcgttagctgcaatagcgaatcaagcagctgtcttaatgggattagggaaaggatggccactgcacagaatggatctgggcgtaccgctactagcgatgggttgttatagtcaggttaatccaacgaccctaactgctagtttggtcatgttgttggttcattatgccataataggaccagggctccaggcaaaggcaacacgtgaggctcagaaacgtacggccgctgggataatgaaaaaccccacagtcgatggtattaccgtaattgatctagaacctatatcatatgaccctaaattcgaaaaacagcttggccaagtgatgctcttagtcctatgtgccgggcagctattactcatgaggaccacttgggctttttgcgaggtgctaacacttgccacgggcccgattctcactctatgggaagggaatccaggtaggttctggaataccacaatagcagtaagtacagccaatattttcaggggttcatatcttgctggggcagggttggcattcagccttattaaaaatgcacagacaccaagaagaggaacaggcacaacaggagagacgttaggagaaaagtggaaaagacaactaaattctttagacagaaaagaatttgaagaatataagcgatcaggtattcttgaagtagatcgtactgaagcgaaatcggctttgaaggatggatcaaagataaagcatgccgtcagtcggggttcttcaaagatacgttggattgtcgagcgtggaatggtaaagcccaaaggcaaggtagtggatttaggatgtgggcgaggcggttggtcatattatatggctacccttaaaaatgtaactgaagtgaagggttacacaaaagggggacccggacatgaagaacccatacccatggcaacatacggctggaacctagtaaaacttcatagtggagttgatgtattttataaacccacggaacaggtagatacattattgtgcgacattggtgaatcaagtagcaatccgactatagaagagggccgaacccttcgagttcttaaaatggtagagccgtggttaagtagtaaacctgaattttgtattaaagtactcaatccatatatgccaacagtaattgaagaattagagaaattacaacggaaacacggaggaaatcttgttaggtgcccgctaagtcgcaatagcacacatgagatgtactgggtatcaggagcctcaggtaatattgtctcatcagtaaacactacttcaaaaatgctccttaacagatttaccacacgtcaccgaaaacctacatatgaaaaagacgtggatttgggagctggcacacgaagtgtatctacagaaacagaaaaaccagatatgacaataataggtcgcagattgcaaagattacaagaagaacataaggagacctggcactatgaccaggaaaatccatatagaacatgggcataccatggatcgtatgaagccccatcaacaggaagcgcaagctccatggtaaatggggtagttaaactactaacaaaaccatgggatgtcattccaatggttactcaattggcaatgactgacaccactccattcggccaacaacgggttttcaaagaaaaagtagatactaggacgccgcagccaaaaccgggaacgagaatggtaatgacaacaacggcaaattggttatgggcattactcgggaaaaagaaaaatccccgactgtgcacgagggaagaatttataagcaaagtgagatcaaatgcagcgataggagctgttttccaagaagaacagggatggaccagcgcaagtgaagccgtcaacgacagcaggttttgggaattggttgataaagaaagagcacttcatcaggagggaaaatgcgagtcgtgtgtgtataatatgatgggaaaaagagagaagaaattaggagaatttggacgagcaaaaggatccagagcgatatggtacatgtggctcggagccagatttttagaatttgaagccctgggattcttgaatgaagaccactggtttgggcgagaaaatagctggtcaggagtagagggggaaggcctacatagactaggatacatactcgaagaaatcgataaaaaggacggagatctcatgtatgctgatgacacagcaggatgggatacgcgcattactgaggatgacctccaaaatgaggaactaattaccgagcaaatggccccacaccataagatattagcgaaggcaatttttaaacttacttatcaaaacaaagttgtaaaagtgttgagaccaacaccaagaggggctgtcatggacatcatctcaagaaaagatcaaagaggatctggccaagtaggaacatacggattaaacacttttaccaatatggaagttcaattgattagacaaatggaagcagagggtgtaatcacacaggatgacatgcagaatcccaaaggactcaaagagagagtagaaaaatggttaagggaatgcggtgtcgatcgactaaaaagaatggccatttcaggagatgattgtgtagttaaaccattagacgagaggtttgggacatcattattattcttaaatgacatgggaaaagtacgaaaagacatcccgcagtgggaaccttccaaaggatggaaaaattggcaagaagtgccattttgtagtcaccactttcacaagatttttatgaaggatggtcgcagccttgtagtaccctgccgaaatcaggacgaactaattggacgtgctcgtatatctcaaggggctggttggagccttagggaaacggcgtgtctaggaaaagcgtacgctcaaatgtggtcgttgatgtactttcacagacgtgacttacgattggccagtatggcaatatgttcagctgtgccaacggaatggtttccaacgtcgagaacgacttggtcaatccacgcacatcatcaatggatgactactgaagacatgttaaaagtatggaaccgtgtctggattgaagacaatcctaatatgatagacaaaactcccgttcatagttgggaagatataccttatttagggaaacgcgaagacctctggtgcggttcattgattgggttatcatctcgtgccacgtgggcgaaaaatatacacacggcgataactcaggtccgcaatctgataggtaaagaagaatatgttgactatatgccggtaatgaagagatactcggcaccatcagaaagcgaaggagttctatga

SEQ ID NO: 23615 - RNA, 9867 nt, synthetic construct
  misc_feature 1..9867: note = derived and/or modified CDS sequence (opt6) from DENV-4__GQ199882__SS-prME
  source 1..9867: mol_type = other RNA
agcacgattaccttattatgcctaattcccaccgtaatggctttccatctaagtacaagagatggggaaccgttaatgattgtagcaaaacatgaaagaggacgacccctgttatttaaaactacagaaggtataaacaaatgtacacttatagcaatggatctgggagaaatgtgcgaggatacagtaacctataaatgccctttattagtcaatacggaaccggaagatatcgactgctggtgtaacttaacgtcaacttgggtaatgtacgggacatgtacgcaaagcggtgaaagaagacgagaaaaacgttccgtagcactaacaccccatagtggtatgggattggaaacaagagcagaaacgtggatgagttctgaaggtgcatggaaacatgcgcaaagggtggaatcatggatattacgtaaccctgggttcgcgctattagcaggttttatggcatatatgattgggcaaacaggaatacaaagaaccgtattctttgtgctaatgatgcttgttgccccaagttacggtatgcggtgtgttggcgttggaaaccgggactttgttgaaggagtatcaggaggagcttgggtagatctggtactggagcatggagggtgtgttacaactatggcccaaggaaaaccaactcttgacttcgaattaacaaaaactaccgctaaagaagtagcgttattgcgcacatactgcatagaagcatctataagcaatataacaaccgcgacccgctgcccaactcaaggagaaccatacttaaaagaagaacaagaccaacaatatatctgtaggagagatgtggttgacagaggatggggtaatggctgtggattatttggcaaaggaggtgtagttacatgcgccaaatttagctgttctgggaaaatcaccggcaacctagtacaaattgaaaacttagaatatacagtcgtcgtgacagtccataatggtgacacacacgctgtaggaaacgacacgtcaaaccatggagtaactgctaccatcacaccacgctctccatcagtcgaagtcaaacttcccgattacggtgaactgacacttgattgcgaaccgagaagtggaatagattttaatgagatgattttgatgaaaatgaagaagaaaacttggttagtccacaaacagtggtttcttgaccttccgctcccatggactgccggtgcagatacaagtgaagtccactggaattacaaagagaggatggtaacctttaaagtaccgcatgcaaaaagacaagatgtaactgtgttgggaagtcaagagggagcaatgcactccgcactagcgggggcaactgaagtagattctggagatggtaaccatatgttcgctgggcaccttaaatgtaaagttagaatggagaaactccgcataaaaggaatgtcttatactatgtgttcgggtaagttttccatagataaagaaatggctgaaacacaacatgggacgactgtagttaaagtgaagtatgaaggtgccggagcaccttgtaaggtaccgatagaaatacgtgatgtgaacaaagagaaagttgtaggacgcgttatatcaagcacccccttggcagaaaataccaactcagttacgaacatcgaattggagcctccttttggagacagctacatagtcataggcgttggaaactcagccctaaccctacattggtttcgaaaaggatcttcgattggcaagatgtttgaatcaacatatagaggtgcaaagcgaatggctatattgggggaaacggcgtgggactttggaagtgtgggtgggttatttacgtcactgggcaaagcagtgcatcaagtgttcggatcagtatacaccacgatgtttggaggtgttagttggatgattcgtatcttaatcggatttttggttctctggatcggcacaaattcccgaaacacttccatggctatgacttgtatagccgtaggcggaataacattattcctagggtttactgtacaggctgacatgggatgtgtcgtatcgtggtcgggacgtgagttaaaatgcggctcgggtatattcgtggtagataacgtacacacttggactgaacaatacaagtttcaaccagagtctccagctcgtttagcaagtgcaattctcaatgcacacaaggacggagtatgtgggattagaagtacaacccgcctcgaaaacgttatgtggaaacagataacaaacgaacttaactatgtattatgggaaggaggacatgatttaacagttgtcgcaggagacgtgaagggagttctaacaaaaggcaaacgtgcactaactcccccagttagtgatctgaagtacagttggaagacgtggggcaaagcaaagatttttacccctgaggctagaaattcgacctttctaatcgacgggcctgacacatcggaatgcccaaatgaacgtcgtgcttggaactcattggaagtagaagactatggatttgggatgtttaccacgaacatatggatgaaattccgagaaggatctagtgaagtctgtgatcatagattaatgtctgcagctatcaaagatcaaaaagcagtacatgctgatatgggatattggatcgaatcaagtaaaaatcaaacttggcaaatagaaaaggcatcattaattgaagtgaaaacatgtctatggccaaaaacgcatactctttggtccaatggagtacttgagtcccaaatgcttattcccaaaagctacgctgggccattctcacaacataattatagacagggatatgcaacacaaacggttggtccgtggcatctaggaaaattagagatagatttcggagaatgccctggaactacagtaactatacaagaggattgtgaccataggggaccttctcttcgaacgaccacagcgtcaggtaaattagtaactcaatggtgctgtagatcatgtaccatgccaccgctccgttttctgggggaagatggatgttggtatggaatggaaataagacccctatcagagaaagaagaaaatatggtgaaatctcaagtggcggcaggtcaaggcacgtcagaaactttcagtatgggattactgtgtctaacactgtttgtcgaagaatgtctaagaaggagggttacacgaaaacatatgattttagcagtcgttataacactgtgtgccattatacttggtggcctgacctggatggatttacttagagctctaataatgttaggagacacaatgagcggaagaatagggggacagacgcatttagcaataatggccgtttttaaaatgagcccgggatacgtactaggagttttccttagaaaattgaccagccgagaaacggctttaatggtcatcgggatggcaatgactacaacactatcaataccacacgatctcatggagctcatagatggcataagccttggcttaattttgctaaagattgtcactcaatttgataacactcaggtaggtacgctggcactatcattgactttcatacgttcgactatgagcttagtgatggcgtggaggactataatggccgttttatttgttgtgacgttaataccactttgccgaacatcatgcttacagaaacaatcgcattgggtagagataactgcgctaatactgggtgcccaggctttaccggtgtacctaatgacattaatgaagggtgccagtcgaagatcgtggcctctaaatgaaggcattatggctgtcggtctagtcagtctgcttgggtcagcactactgaagaacgacgtgccgctcgccggacctatggtagcaggaggattattactcgccgcatacgttatgagtggatcaagcgcagacctatctctagagaaagctgcaaatgttcagtgggacgaaatggcggacataactggaagctctcccataatcgaagtaaaacaagatgaggatggtagcttttccatccgtgacgtggaggaaactaatatgattacactattagtaaaattagctttaataaccgtcagcggactgtatccgcttgctatccccgtcacaatgacactctggtatatgtggcaagtaaagactcaaagatctggagcactatgggatgtgccctctccagcggctactcagaaagcagccctgagcgaaggcgtatatagaattatgcaaagaggtttgttcggaaaaacacaagttggagtggggattcacatggaaggagtttttcacaccatgtggcatgtcacacgtggaagtgtaatatgccatgaaactggcaggttagagccaagttgggctgacgttagaaatgatatgataagctacggcggtggatggagactaggcgataagtgggataaggaagaggatgtacaagtactagcaattgaaccaggtaaaaacccaaaacatgtgcaaactaagccaggcctgttcaagactctgacgggtgaaatcggcgcagttacattggacttcaaaccaggaacttcgggaagtccaatcatcaacaggaaaggtaaagttataggcttatacggaaatggagtagtaacaaaatccggagactatgtttctgcaattacgcaagcagaaagaataggagaaccagattacgaggtagatgaagatatatttaggaagaaaaggttaacaatcatggacttacatcccggtgcaggcaagactaagcgtatattaccgtcaatagtccgcgaggctctgaaaagaagactccggacgttaattcttgcacctactcgtgtagtggcagcggaaatggaggaggcattaaggggactgcctataagatatcagactccagcagtcaaatcggagcacactgggagagaaatagtggatttaatgtgtcatgcgacttttacaaccagacttttgtcatcgaccagagtaccaaactataaccttatagttatggatgaagcacattttacagacccttctagcgtagcagcgaggggctatatttcaactcgcgtggaaatgggagaagccgccgcaatctttatgacagcgaccccaccaggtgctacagacccgttcccacaatcaaacagtcctatcgaagatatagaacgagaaatcccagagagatcctggaacacaggatttgactggataactgattatcaaggtaaaaccgtatggttcgtacctagtataaaagcgggaaacgatatagctaattgtctcagaaagtcaggaaagaaggtaatacagcttagtagaaagacgtttgatacagaataccccaaaactaaactcacagattgggattttgtagtaacaactgatataagcgaaatgggagcaaactttagggctggacgggtgatagacccaagacgatgcttaaaaccagttattttaacagacggaagcgaaagagtaatcctagctggacccatacccgtaacaccggccagcgcagcgcagagaaggggccggatagggagaaacccagcacaagaggacgaccaatacgtatttagcggcgatccactcaaaaatgacgaagatcatgcacattggacagaggctaagatgctattggacaatatatataccccagaaggtataataccgacgcttttcggacctgaaagggagaaaacacaagcaattgacggagaatttcgacttcgaggagaacagcgcaaaactttcgttgagctaatgcgaagaggcgatctacccgtatggctatcatacaaagtagcgagtgcgggtattagctacaaggacagggaatggtgctttactggtgaaagaaataatcaaatcttagaagaaaacatggaggttgagatatggacgagggaaggagagaagaagaaattaagaccccgatggttagacgccagagtatatgctgatcctatggcgttaaaggactttaaggaatttgccagcggcagaaagtccataactttagacattctaacagaaatcgcttcactgcctacctatttgagttcacgagcaaagttagcacttgataatatagttatgttacacacaaccgagagaggaggaagggcctatcaacatgctttaaatgaactacctgagagcctggaaacattaatgctagttgctttattgggcgctatgacagcaggaatctttctatttttcatgcaaggcaagggaataggtaaactcagcatgggattgataaccatagcagtcgcctcaggcttattatgggtagccgagatccagccacaatggatcgccgcttcaataatcctagaatttttcctgatggttctacttatcccagaacccgaaaaacaaagaaccccacaagataatcaactaatatatgttatactgacaattttaactataattggacttatagccgctaatgaaatggggttaatcgagaaaacgaaaactgacttcggtttttaccaagtaaaaactgaaacaacaattttagacgttgatttaagaccagcttctgcctggacattgtatgcagtcgcgacaaccatattaactccaatgctaagacatactatagaaaatacatctgcaaatttgagcctagccgcaatagctaatcaagctgcggtattaatgggattaggcaagggatggccattgcataggatggatttaggggttccacttcttgctatgggatgctatagtcaagtaaacccaaccaccctaactgcatcacttgtaatgcttttggtccactatgctattataggtccaggcttacaagcgaaagctactagagaggcacaaaagcgtacagctgctggaattatgaagaatccaaccgttgacggaataacagttatagacttagaaccaatatcgtatgatccaaaatttgaaaaacaactaggacaagtaatgttactggtcttatgtgctggacagttattactcatgcggactacatgggcattttgcgaggtattaacccttgcaaccggaccgatattgaccctttgggaaggaaacccaggtcgattttggaatacaaccatcgcagttagcaccgcgaacatttttcggggcagctatttagctggtgcaggtcttgccttctctttaataaagaatgcgcaaacaccaagacgtggaacaggtaccactggggaaactcttggcgagaaatggaaacggcaactaaattcgttagatagaaaagaatttgaggagtacaaaagaagtggaattttagaagttgacaggacggaagctaaatcagcgcttaaagacggatctaagattaaacatgcggtatctcgaggaagtagtaaaatcagatggatcgtcgaaaggggcatggtgaaaccaaaaggtaaagtagtagatctagggtgcggaagaggtggatggtcatattatatggccacgctcaaaaatgttacggaagtcaagggatacactaaaggagggccaggacatgaagaacctattcctatggcgacatatggctggaatttagtcaagctgcatagtggtgtcgacgtcttttataaacctacagaacaagtagatacgttgttgtgtgatattggagagagctcatcaaatccgacaatcgaggaaggtagaacactgcgggtattgaaaatggtagagccttggttatcatccaaacccgaattttgtattaaggtactgaatccatatatgccgactgttatagaagaactagaaaagttacaaagaaaacatggaggaaacttagtacgatgtccactctcaaggaatagcacccatgaaatgtattgggtaagtggcgctagtggcaatatagtatcgagtgtaaataccacctctaaaatgttgttgaacaggtttacgacaagacatagaaaacccacatatgaaaaggatgttgatttaggtgcgggaaccagaagcgtgtctactgaaaccgaaaaaccagacatgacaataatcggacgaagactacaacgcctacaagaagaacacaaagagacttggcactacgatcaagaaaatccctatcgtacgtgggcttaccatggatcatatgaagcacccagcaccggaagtgctagcagcatggtcaatggcgtcgtcaaactcctaacaaagccctgggatgttataccaatggtgacacaattagctatgaccgacacgacgcctttcggacagcaaagggtttttaaagaaaaggttgataccaggaccccacaacccaaacctggcacacgcatggtaatgacgacaaccgcaaattggttatgggctcttttgggcaagaagaaaaatccgcgtttatgcacgcgtgaagaatttatatcaaaagtcagaagtaacgcagcaatcggtgcagtgtttcaagaagaacaaggatggacctcagcgtcagaagcggtaaacgacagcagattttgggagctagttgacaaagaacgagccttacaccaagaaggtaaatgcgagtcttgtgtttacaatatgatgggaaagagagaaaagaaattgggcgagtttggaagggccaaagggtctcgagcaatatggtatatgtggttaggagcgcgtttcctagagttcgaagcattaggatttttaaacgaagatcactggtttggtcgcgaaaacagttggtcgggagtagaaggagaaggacttcatcgattagggtacattttagaggaaatagataagaaagatggtgatcttatgtatgcagacgatactgccgggtgggacacacgtataacagaagatgatttacaaaatgaagaactgatcacggagcagatggcgcctcaccacaagatcttggcgaaagcaatctttaaacttacatatcaaaataaagttgttaaagtattaagacccacacccagaggtgctgtcatggacataatatcacgaaaagatcaacgtggctctggccaagtgggtacatacggtttaaatacttttactaatatggaagtacagctaatccgacagatggaagccgaaggtgtaataactcaagacgatatgcagaaccccaaaggtcttaaagaacgcgtagaaaagtggctgagagagtgcggggtagatcggctaaagagaatggccatatcaggtgacgactgcgttgtaaaaccattagatgaacgttttggtacatcactactgtttctaaacgacatgggcaaagtccgaaaagatataccacaatgggaaccctcaaaaggatggaagaactggcaggaagttcctttctgtagccaccattttcacaaaatttttatgaaagatggcaggagcttagttgtgccatgcagaaatcaggatgagttaatcggcagggcaaggatcagccagggtgctggatggtcactcagagagacggcatgtctaggtaaagcatatgcacaaatgtggagcctcatgtatttccatcgcagagacttaagactcgctagtatggcaatttgctcagctgtacctactgaatggtttccaacttctagaacgacctggtcaatccatgctcatcatcaatggatgactacggaagatatgctgaaagtttggaatcgagtctggatagaagataatccgaacatgatagacaaaactccagtacattcttgggaagatatcccatatctaggaaaaagagaggatttatggtgtgggtcactcatcggactttcttctagagcaacatgggccaaaaacatacatactgcgataactcaggtaagaaatctaatcggtaaagaagaatacgtagattatatgcctgtaatgaaaagatattcagcaccaagcgaaagtgaaggagtactttag

SEQ ID NO: 23616 - RNA, 9867 nt, synthetic construct
  misc_feature 1..9867: note = derived and/or modified CDS sequence (opt6) from DENV-4__GQ199883__SS-prME
  source 1..9867: mol_type = other RNA
tcgactataaccctattatgtctaatacctactgttatggctttccacctgagtactcgcgatggtgaacctttaatgattgtagcgaaacacgaacgaggtaggcccctgctttttaaaactactgaaggcataaataaatgcacgctgattgctatggatttgggcgaaatgtgcgaagatactgtcacatacaaatgtccattgttagtaaacacggaacctgaagatatagattgttggtgtaacttgacttcaacttgggtgatgtatggaacctgtacccaatcaggggaaagacgaagagagaaacgatctgttgcattaaccccacattcgggaatgggtcttgaaaccagggcggaaacatggatgtcatcagaaggagcatggaaacatgcacaaagagtggaaagctggatactaaggaatccaggtttcgcactacttgccggatttatggcgtatatgataggtcagacgggtatacaacggacagtatttttcgttttaatgatgcttgttgccccttcttatggtatgcggtgtgtcggagtaggaaatcgggattttgtggaaggcgttagtggaggggcatgggtagaccttgtcttagaacatggtgggtgcgtgaccactatggcacaaggcaaaccaacattggattttgaattgacaaaaacaacagcaaaagaagtcgcattgctaaggacctattgcatagaggctagcatcagtaatatcactaccgcaacacgctgccctacccaaggagaaccatacctaaaagaagaacaagatcaacagtacatttgtagacgcgatgtagttgatcgtggttggggcaatggatgcggattatttgggaaaggaggtgtcgtaacttgtgctaaattttcttgttcgggaaaaataactggaaatctggtgcaaatagaaaacttagaatatacggtagtagtcacggtacataacggcgatacacatgctgttggtaatgacacaagtaaccacggcgtcactgcaacaatcactccacggagcccttccgccgaagttaaattacctgactatggagaattaactctagactgtgaacctcgctctggcatagacttcaatgaaatgatactaatgaaaatgaaaaagaaaacatggttagttcacaaacaatggtttctggacctaccacttccttggaccgcgggggctgatacatcagaagtccattggaactataaagaaagaatggtgacttttaaagttccccacgcgaaaagacaagatgttactgttttaggttcgcaagaaggcgcgatgcactccgcactagccggcgcaactgaagtagactcaggagacggcaaccacatgttcgcgggacacttaaaatgtaaagtacgcatggaaaaattacgaatcaaaggcatgagctatacaatgtgctcaggaaaattcagtatagataaagagatggccgaaacacaacacggtacgactgtagttaaagtaaaatacgaaggtgctggtgcaccatgcaaagttccaatcgagatacgggacgtaaataaggaaaaagtcgtaggtagagttatatcgagtacgccactagcagagaatacgaactcggtaaccaatattgaactggaaccaccctttggagacagttatatagtcataggagtcggcaactccgcactcaccctacattggtttagaaaaggaagcagtatcggaaaaatgtttgaatcaacatatcgtggagctaaaagaatggccatcttgggagaaactgcatgggacttcggttccgtcggtggactctttacaagtttagggaaagcggttcaccaagtttttggaagtgtatacacaacaatgttcggaggcgtaagttggatgatcagaatactcataggatttttagttctgtggattggaaccaactcgagaaatacaagcatggcgatgacatgcatagcagtaggcggaataacactttttctgggatttaccgtacaagccgatatgggttgtgtggtttcctggtcaggacgagaactgaaatgtggtagcggaatcttcgtagtggacaatgttcacacttggacagaacaatacaaattccaaccagagtcacccgcaagattagcatcggcgatattaaatgcgcacaaagacggagtatgtggaatacggtcaacgaccagattggaaaacgttatgtggaaacaaataactaacgaactgaattacgtactatgggaaggtggccatgatcttacagtagtcgccggagatgtgaaaggtgtattgactaaaggaaaacgagcacttacgccccctgtctcggacttgaagtatagttggaagacgtggggtaaggctaaaatctttacgcctgaagctagaaattctactttcctgattgacggtccagacacttctgaatgtccaaatgagcggagagcatggaatagcttagaagtcgaggattacgggtttggtatgttcacaaccaacatatggatgaaatttcgggaaggatcttcggaagtatgcgatcaccgtctaatgagcgctgcaataaaagatcaaaaagcggtacatgcagatatgggatactggatagaatcgagcaaaaatcaaacgtggcaaattgaaaaagctagcttaattgaagttaagacctgtttatggccgaagacccataccctttggagtaacggcgtgttagaaagtcagatgttaatacctaagtcatacgcaggaccgttttcacaacacaactaccgacagggatatgcaacacaaactgtcggaccttggcatttaggaaaactcgagatcgattttggcgagtgtccaggcaccacagtaactatacaggaagattgcgatcatcgcggtccatcgctacgaacgactaccgcgtcgggaaaattagttacccagtggtgctgtaggtcatgcaccatgcctccattaaggttcctgggagaggacggctgctggtatggtatggaaatccgacccctttctgaaaaggaggaaaatatggtaaaaagtcaagttgcagcaggacaaggaacatcagagacatttagcatgggattactatgtctaacgttatttgtagaagaatgtttaagaagaagagtaacacgtaaacatatgatactagcagttgttattactctatgtgctattatacttggcggtttgacatggatggatcttctaagagccttaataatgttaggtgatacgatgtcaggaagaattggtggacaaacccacctagcgatcatggcagtttttaaaatgtcacccgggtatgtgctaggagtcttcttaagaaagctgacttcaagagaaacagcattaatggttataggaatggctatgacaactacactttccataccacatgatctgatggagttaattgacggaatatcactaggactaatacttctgaaaattgtaacgcagtttgacaacacgcaagtaggtacgcttgcgttaagcctgacattcataagatcaactatgagcctagtaatggcctggagaactatcatggcagttttatttgtggtcacattaatacctctatgtagaacaagttgcctacaaaagcaatcgcattgggttgagataactgccctaatccttggggctcaagccctgccagtttacctaatgaccctaatgaaaggagcctccagaagatcctggccacttaacgaaggcatcatggctgtgggactcgtgtccttactgggctcagcgctattaaagaatgacgtccccttagcgggtcctatggtagctggcggacttttattggccgcgtacgtaatgtcaggtagcagtgcagatttatcgttagaaaaagcagcaaatgtacaatgggatgaaatggcagatataacaggatcaagtccaataatagaggtaaaacaggatgaagatggttccttcagcatcagggatgtagaagaaactaatatgattacattattagttaaacttgcactgataacagtttctggcttgtatccattagccataccggttacaatgacactatggtatatgtggcaagttaaaacgcaacggtcaggagcactctgggatgtgccatcgccagcagcaacccaaaaagctgcactttcagaaggagtgtacagaataatgcaaagaggcctattcggtaaaacacaagtaggtgtcggtatacatatggaaggagtatttcacacaatgtggcacgtaacacgcggttcagtaatatgccacgagacaggacgactagaaccctcttgggctgacgtacgtaatgatatgatttcttacggaggtggctggaggttaggagataaatgggacaaagaagaggacgtacaagtcctggccatagagccaggcaaaaaccccaagcatgtacagacaaaaccaggtttattcaaaaccctaacaggggaaattggtgcagtaacactcgacttcaaaccagggacatcaggatcgcccataattaatcgaaaaggaaaagtaataggtttatatggcaatggagtggtaaccaaatccggcgattacgttagcgcaattacccaagctgaacgaataggcgaaccagattatgaagtagatgaagatatctttagaaagaaaagacttacaatcatggatttacatcctggcgccggaaaaacaaaaaggatattgccttcaatagtacgagaagcgctaaaaaggcggctaagaacactaatattagcgcccacaagggtagtcgctgccgaaatggaagaggctttaagaggactaccgatcagataccaaacgccagcggttaaatcagaacacacaggacgggaaatagttgatctaatgtgtcatgcaacatttacaacgaggctgcttagtagcactagagtcccaaattataacttaatagtaatggatgaagcgcactttacagatccgtcttcagtggccgccaggggatatatttcaactagagtagaaatgggcgaagctgctgcaattttcatgacagctacaccgccgggagctacggatcctttcccccaaagcaatagccctatagaagatatagagagagagattccagaacgttcatggaataccggctttgattggataactgattatcagggcaagacggtatggttcgtgccctcaatcaaagctggcaatgatattgcaaattgcttaagaaaatctggtaagaaagtcattcaactttctaggaagacctttgatactgaatatccaaaaacaaaactcacagattgggacttcgttgtaacaactgatatttcggaaatgggggctaactttagggcaggaagagtaattgacccgaggcggtgtctcaagcctgtcatattaacagatggcccagagagggtaatacttgcaggacccattccagtaacgccggcaagcgccgcgcaaagacgaggacggatagggcgaaatccggcccaagaagacgatcaatatgtattttccggtgaccccctcaaaaacgatgaagatcacgcgcattggacggaagccaagatgctccttgataatatatacacccccgaaggaataattcctacattattcgggcctgagagagagaaaactcaagctatcgatggagagttcagattacggggagagcagcgcaagacgtttgtagaattaatgcgacgtggagatctccccgtttggctatcttacaaggtagcgtcagcaggtatcagttacaaggaccgagagtggtgttttacgggagagcgaaataaccaaatccttgaagagaacatggaagtggaaatatggaccagagaaggtgagaagaagaaacttcggcctagatggctcgatgcccgtgtatacgcagatcctatggcgctaaaggacttcaaagagttcgcctctgggaggaaatcaattacccttgatatattaactgaaattgcctcccttccaacatatctcagctcccgcgcaaaattggccttagacaatattgtaatgctacacaccacagagaggggaggtagagcgtatcaacatgcgttgaacgagttgccagagagtctagagactctcatgctagtagcattattaggtgctatgaccgccggaatcttcttatttttcatgcaaggtaaagggatcgggaagctatcgatgggattaataaccatagcagttgcatctggattactctgggtcgcggagattcaaccgcaatggattgccgcttccataattcttgaatttttcctcatggtactactcataccagaaccggaaaaacaaaggacacctcaagacaatcaactcatttacgttatactggctatcttaactatcattggtcttatagcagcaaatgaaatgggattaattgagaagactaaaacagattttggattctatcaagtgaaaactgaaacgacaatattagacgttgatctaagaccagcaagtgcgtggacattatatgcggtcgcaactacgatccttacaccgatgctgcgacataccattgagaacacatcggccaacctatcgctagctgcaattgctaaccaagcagcagtacttatggggctgggaaagggctggcccttacatagaatggacctaggtgttccccttttagcaatggggtgttattcacaagtgaacccaaccactctaacggctagtttggtaatgctgctcgtacattatgcaattattggccccgggttacaagctaaggcaacaagagaggcacagaaaagaacagcggccgggattatgaagaatccaacagtcgacggtataactgtaatcgacctggaacccatatcatatgatccgaaatttgaaaagcagcttggccaagtaatgctacttgtgttatgtgcagggcaattattactaatgcgcactacctgggccttttgtgaagttctaactctagcaacaggacctatacttacgttatgggaaggaaatccgggccgattttggaatacaacaatagcggtgagcacagccaacatcttcagaggaagttatctcgccggagcaggcctagcgttttctctaatcaaaaatgcacaaactcccaggagagggactgggacgactggagaaacccttggtgaaaaatggaagcgtcagttaaattctttagatcgaaaagagttcgaagaatataaaagatccggaatcctcgaggtagacagaacggaagcgaaatctgcgctgaaagacggctcaaaaatcaaacatgcagtgtctcggggctcgtcgaaaattcgctggatagtagaaaggggaatggttaaacctaaaggcaaagtcgtagatctcgggtgtgggaggggcggttggtcctattatatggcaactttgaaaaatgtcacagaagttaaaggatacacaaaaggaggaccaggacacgaagaaccaattccaatggccacttatggttggaatctagtaaagttacatagtggggtagatgttttctacaaacctaccgaacaagtagatacgttattatgcgatatcggagagtcatcaagtaatccgacaatagaggaaggaagaacgctaagggtcttgaaaatggtagaaccttggttaagttctaaaccagagttctgcatcaaagtcctaaacccctatatgccaactgtgattgaagaactagagaaacttcagagaaagcacggcggaaacttagtaaggtgtccactatctcgaaattccactcatgaaatgtactgggtatcgggagcgagcgggaacattgtatcaagtgtcaatactacctcaaagatgttactaaatcggttcactactcgacatcgcaagccaacttatgagaaggacgtagatttaggggcaggtacacggagtgtaagtacggagacagagaagccggatatgactattattggtcgaagattacaacgattacaagaggaacataaggaaacatggcattacgatcaggaaaacccatacagaacatgggcataccatggtagttatgaagctccatcaactggaagcgccagttccatggtgaatggtgtagtgaaactccttacgaaaccctgggacgttatccccatggtcacacagttagccatgaccgatacaacgccattcggacaacagcgagtcttcaaagagaaagtagatacacgaacacctcagccaaaaccaggtacacgaatggttatgaccacaacagcaaactggttatgggcactattagggaagaagaaaaacccacgactatgtacaagagaagagtttatttcaaaagtacgttcaaatgctgcgataggggctgtgttccaagaagaacaaggatggacatccgcatcagaggcagtaaacgactctagattttgggagttagtcgataaggagagagccctacatcaagagggcaaatgtgagtcatgcgtttataacatgatgggcaagagagagaaaaagctaggagaatttggcagagcaaaaggcagtagggcaatatggtacatgtggttaggggctaggtttctagaatttgaagccctgggattccttaatgaagatcattggttcggtcgtgaaaatagttggtcaggggtggaaggtgagggacttcaccgattaggatacattttagaggaaatcgacaagaaagacggagacttaatgtatgcagacgatacagcaggatgggacacacgaatcacggaagacgatctacaaaatgaagaattaataacagaacagatggcgcctcatcataaaatcctagctaaagctattttcaaattaacgtaccagaacaaagttgttaaagtactcagaccaacacctagaggagcagtcatggatataataagtagaaaagatcaacggggtagtgggcaagtgggaacatacggtttaaacactttcacgaacatggaagttcaattaattcgtcagatggaagcagaaggtgtaataacacaggatgatatgcaaaatccaaagggattgaaagaaagggttgaaaagtggctgcgagaatgcggggtagaccgtctaaaaagaatggcaattagcggtgacgactgtgtagtgaagccgctagacgagcggttcggcacaagtctcctgttcctaaatgatatgggtaaggttagaaaagacattccacaatgggaaccctcgaaaggatggaaaaactggcaagaagtaccgttctgtagccatcatttccataaaatatttatgaaagatggcagaagtctagtcgttccatgcagaaaccaagacgaattaataggacgtgcacgaataagccaaggtgcgggctggagtctcagagaaaccgcatgcctaggaaaggcatacgctcagatgtggagtctaatgtattttcacaggagagatctaagattagcctccatggcaatttgctccgcagttcccaccgaatggttccctacatctaggacaacatggtcgattcacgctcaccatcaatggatgacaactgaagatatgctaaaggtttggaatcgtgtatggatcgaagataatcctaatatgatagataaaacaccagtacatagttgggaggatattccctaccttggaaaacgggaggacctttggtgtggttcgttaataggattgagctcccgagcaacttgggctaaaaatatacatacagccataacccaagtacgtaacttgataggtaaagaggaatacgtcgattacatgcctgtaatgaagcgatattctgcccccagcgaatcagaaggtgtgttataa

SEQ ID NO: 23617 - RNA, 9867 nt, synthetic construct
  misc_feature 1..9867: note = derived and/or modified CDS sequence (opt6) from DENV-4__GQ199884__SS-prME
  source 1..9867: mol_type = other RNA
agtaccatcacactactttgtctgatacctacagtgatggcattccatttgtctacccgcgatggagaacctttaatgatcgtagcaaaacatgaaagaggaagaccactgctgtttaaaacgacagaaggcataaataaatgtacactaattgcaatggatttgggggaaatgtgtgaagatacggtcacgtacaaatgtccattgctagttaataccgaaccagaagacatagattgttggtgtaacttgacctcaacatgggttatgtatggtacatgtacacaaagtggagaacgcagaagagagaaaagatcggtcgcgttaaccccacactcggggatgggattagaaactagggctgaaacatggatgtcatctgaaggagcatggaaacacgcacaaagagttgaaagctggatattacgcaatccaggattcgcattgttagcggggtttatggcttatatgattggccagacggggatacaaaggacagtattctttgtactaatgatgttagttgcaccttcgtacggtatgcgatgcgtcggcgttgggaatcgagactttgtggaaggagtcagcggaggagcgtgggtggatttagtcctagaacacggtggttgcgtaacaaccatggcacaaggaaaaccaactttagacttcgaattaacaaaaacaaccgcaaaagaagtcgctttattaagaacatactgtatagaagcaagcatctctaacattactacagccacaagatgtccgacacaaggagaaccatatctaaaagaagaacaagatcaacaatatatttgtcggcgtgatgtggtagacagagggtggggaaacggttgtggtctattcggaaaaggtggggtagtcacatgcgccaaattttcatgcagcggaaaaataacaggtaacttagtacagattgaaaacctagagtatacagtagtagtcactgttcataatggcgacacacatgcagttggcaacgatacttcaaatcatggagtcactgctacgatcacgcctagaagtccaagtgttgaagtaaaactccctgactacggtgaattaactctagattgcgagccaaggtcaggtattgacttcaatgaaatgattctaatgaaaatgaaaaagaaaacatggctagtgcataaacaatggtttcttgacctcccattgccgtggacagccggtgcagacactagcgaagtacactggaattacaaagaaagaatggttacttttaaggtaccacatgccaagagacaagatgtgacagtattaggcagtcaagaaggagctatgcatagtgccctagcaggcgctacagaggtagacagtggggatgggaaccatatgtttgccgggcaccttaaatgcaaggtacgaatggagaagttacggattaaaggcatgagctacacgatgtgttcgggaaaatttagtatagataaggaaatggcagaaacgcaacacggaacaacagtcgtaaaagtcaaatacgaaggagcgggagcaccatgtaaggttccaatagaaattcgagacgtaaataaagaaaaagttgttggaagagtgatatcaagtacgcccttagcggagaatacaaatagtgtcacaaacatagaactagaaccaccatttggtgactcatatatcgtaatcggtgtcggaaattcagcgctaaccttacactggtttagaaaaggttcaagtataggaaaaatgtttgaaagtacatacagaggggcaaaacgtatggccatactaggtgaaacagcttgggattttggtagtgttggcggcctttttacatcattgggaaaagcagtacaccaagtgtttggatctgtttacactacaatgtttggaggggtctcatggatgataaggatacttattggcttcttagtattatggatcggtaccaattctcgaaacacgtcaatggctatgacatgtatcgcagtaggcgggataacactcttcctaggctttactgtacaagctgatatgggatgtgtcgtatcatggtctgggagagaactaaagtgtgggtcagggatctttgtcgtagacaatgtgcacacatggactgaacaatataaatttcaacccgaatcccccgcacgtcttgctagtgcaatccttaatgcccataaggatggagtgtgcggcattagatcgactacccgtttggagaatgttatgtggaaacaaataactaatgaattaaattatgtgctatgggaaggaggacatgatctaaccgttgttgccggggacgtgaaaggtgtattaactaagggaaaaagagcactcacacccccggtaagcgatctgaagtacagctggaaaacatggggaaaagctaaaatttttactcccgaagcacgaaatagcacattccttattgacggtccggatacttcagaatgcccgaatgaacggagagcttggaacagtttggaagtagaggattatggctttgggatgtttacaacaaatatttggatgaaatttcgtgaagggagtagcgaggtgtgtgatcatagactaatgagcgcggcaataaaagaccaaaaagctgtacatgcagacatgggctactggatcgagtcttcgaaaaaccaaacatggcagatcgaaaaggcctcactgatcgaagtgaaaacttgcctgtggccaaaaacacacacattatggagcaacggagttttggaaagtcagatgttaattccgaaatcatacgctggacctttcagccaacacaattacaggcaaggttatgctactcagacagtaggaccatggcatctaggaaaactcgaaattgacttcggcgagtgcccaggaactaccgtaacaatacaagaggactgtgatcatagagggccatcgctaagaacgactactgcatccggaaaacttgtaacgcaatggtgttgcagaagttgtactatgccacccctaagatttctaggtgaagacgggtgctggtatggaatggagataagacccttgagcgaaaaagaagaaaacatggtaaagtcgcaagtcgctgccggacaagggacgtctgaaactttctccatgggattgctttgtttaacactcttcgtagaagaatgcttacgacgtcgcgtaactcgaaaacatatgatcctggccgtagtaattacattgtgcgccataatacttggtggcctcacatggatggacctattaagggcattaatcatgctcggggacactatgtccgggagaatcggaggtcaaactcatctcgccatcatggcggtctttaagatgtcacctggatacgtattaggggtatttttgagaaaattaacgtcaagagaaacagccttaatggtaataggtatggcaatgaccacgaccctttctataccccatgacctcatggaactaatagacggaataagtctgggcctaatacttctcaaaatagtcacccaattcgacaatacacaggtgggaacgcttgcgcttagcctaacttttattcgttcgaccatgagccttgtaatggcgtggaggactataatggcggtcctattcgttgtaacgctaatcccactatgtagaacctcctgcttacaaaaacaatctcattgggtagagataactgctttgatactgggcgcacaagcgttaccagtatatttaatgacactgatgaaaggagcttctcgaagaagctggccgctaaatgaaggaatcatggcagtaggattagttagtctattaggctcagcacttctgaaaaatgacgtacctctagctgggccaatggtcgcaggcggactattactggccgcttacgtaatgtctggttcatccgctgatttaagtcttgaaaaagcagctaatgtacaatgggacgaaatggctgatatcacggggtcaagcccaataattgaagtcaaacaggacgaagatggaagtttctccatcagagatgtggaagagactaacatgataactttactcgtgaaacttgcacttattacagtatctggattatatccactagccattcctgtgaccatgacactttggtacatgtggcaagtcaaaacccagagaagcggagctctttgggatgtaccttctccggcggcgacacaaaaagcagcgctctctgaaggagtttaccggattatgcaacggggattgtttgggaaaacacaagtaggtgtagggattcatatggaaggagtttttcacacaatgtggcatgttacaaggggaagcgtaatatgccacgaaacaggccgattggaaccatcctgggctgacgtaagaaacgacatgatatcatatggaggaggttggaggttaggcgataaatgggacaaagaagaagatgttcaggtattagcaatagaaccaggcaaaaacccaaagcacgttcaaacgaaaccagggctctttaaaacattaacaggagaaatcggcgcggtgactctagacttcaagccaggaacgagcggttcacctattataaatagaaaaggcaaagttataggcctatatgggaatggagttgtaacaaagagtggagattatgtaagtgccataacccaggctgaaagaataggtgagccggattacgaagttgacgaagatatctttaggaagaaaaggttaacaataatggacttacatcctggagcaggcaaaacaaagaggattttaccttcaatagtgcgagaagcattaaaaaggcgactgcgtaccttgattctagcgcctacaagagtagttgcagcagaaatggaagaggcacttcggggtttacctattagatatcaaactccagctgtaaaatcagagcatactggacgcgaaattgttgaccttatgtgtcacgccacatttactacccgattattatcgtcaacaagagtccccaactataatttaatagtaatggatgaggcacactttacggacccttcatctgtggcggctcgtggttatattagcacacgcgttgaaatgggagaggctgcagctatctttatgaccgcgacaccaccgggtgctacagatccgtttcctcaatcaaacagtccaatagaagacattgaacgagaaataccagagaggtcatggaacacaggattcgactggataaccgactaccaaggaaaaacagtctggttcgttccttcgataaaagctgggaacgacattgctaactgtctgcgaaaatcaggaaagaaagtgattcaactcagtcgtaaaacgtttgacactgaatatccaaaaaccaaactcaccgactgggactttgttgtaacaaccgatataagcgaaatgggagctaattttcgagcgggacgagtcattgatccccggcgttgcttaaaaccagtaatactaaccgatggaccggagcgcgtgattcttgcggggcccatcccagtaacaccagcatccgcagcgcaaaggaggggaaggataggtaggaacccagctcaagaagatgatcaatatgtattctctggcgaccctctcaaaaatgatgaggatcatgctcactggactgaagccaagatgctactagataacatttacactcccgaagggataataccaacgttattcggacctgaacgtgagaaaacgcaggcaattgatggtgagttcagacttcgaggagagcaaaggaaaacgttcgtagaactaatgcggaggggtgacttgcccgtgtggttatcatataaagtcgcgtccgctgggatttcgtacaaagatcgggaatggtgtttcaccggagaaagaaataatcaaatactagaggaaaacatggaagttgaaatatggacacgggagggagagaagaagaaacttcgtccgcggtggctagatgccagggtatatgcagacccaatggcgttaaaagatttcaaagagttcgcttcaggacgtaaaagcatcactctggacatcctaactgaaatcgctagcctgccgacatacctaagctcaagagcaaagctagccctagataatattgtcatgttgcacacaaccgaacgaggcgggcgagcatatcaacacgctctgaatgagcttccggagagcctcgaaacattaatgttagtagccttattgggagctatgaccgcgggcatatttctgttcttcatgcaaggtaaggggatcggtaagctatcaatgggtttaatcacaatcgcagttgcgagcggattactgtgggtagcggaaatacaaccgcagtggatagcagccagcattatcctagaatttttcttaatggtattgctaataccagaacccgagaaacaacgtacgccacaggataaccagctaatatacgtaattttagcaattcttactataataggactaatcgcagcaaatgagatgggactaattgagaaaacaaaaaccgattttgggttctatcaagtaaagactgaaacaacaatactagacgttgacttaaggcccgcgtcagcgtggaccctttacgctgtcgcaaccacgatactaacgcctatgctaagacacactattgaaaatacatctgcaaacttgagcttagcagcgatcgcaaaccaagctgcggtgctaatgggacttggcaaaggatggcctttacatagaatggacctgggcgttccattactggcaatggggtgctactctcaagttaatcctacaaccctaacggctagccttgttatgttattagtacattacgctatcataggacccggcctacaagcaaaggcaactcgggaggcgcaaaagagaacagcagcagggataatgaaaaatcctaccgtagatggaataactgttatagacttggaacccatttcctacgatccaaagttcgaaaaacagttgggacaagtaatgttattagtactttgcgctggacaattattgctaatgagaaccacgtgggccttctgcgaggtgcttacgctcgcgacaggtccgatactcacgctttgggaaggcaatccaggacgattctggaacaccactattgcggtctcgacagcaaatatattcagaggttcctatttggcgggagcgggactagcattttcattgattaaaaacgctcaaactccaagaagaggtacaggaacaactggagaaaccctaggagagaagtggaaaaggcaactgaatagtttggatcgcaaggaatttgaagaatataaacgcagcggcatactagaagttgatcgcacggaagcaaaatcagccctcaaggatggaagcaagattaagcacgcagtaagtcgcgggtcgtcgaagattaggtggatagtagaaagaggaatggtaaaaccaaaagggaaagttgttgacttaggatgtggaagagggggatggagttattatatggctaccctcaaaaatgtaacagaagtgaagggatacacaaaaggaggaccaggacacgaggagccaataccgatggcaacatacggctggaatctagtgaaacttcactcaggtgttgatgtattctacaaaccaaccgaacaagttgatacccttctatgtgatattggagagtcttcgtctaaccctacaatagaagaaggtcgtacactaagagtcctcaagatggttgagccatggttgtcaagcaaacccgaattttgtataaaggtactgaatccatatatgcctacagtaatagaagaattagaaaaattacaacgaaaacatggaggtaatttggtacgatgtccattatccagaaattcaacccatgagatgtactgggtttcaggcgcttcaggaaacatcgtttcctcggtaaatactacatcgaaaatgttactaaatagatttacgacacgacaccgtaaaccgacgtacgaaaaagatgttgacctaggagcaggaacgaggagcgtatctactgaaacagagaagccagatatgacaataataggaagacgactgcagcgtctacaggaagaacacaaagaaacatggcattacgatcaagaaaacccataccgtacctgggcatatcatggatcatatgaagcaccatcgacaggctcggcttcaagcatggtgaacggagtagtaaaattactaactaagccgtgggacgtaatcccaatggtaacccagctagcaatgactgatacgacacctttcggacaacaacgagtttttaaagagaaagtggacacaaggacaccccaacctaagcctggtacacgcatggtgatgacaacaactgccaactggttatgggcattacttggtaagaagaaaaaccctaggctttgtacaagagaggagttcataagcaaagtacgctctaatgcagcaattggagcggtttttcaagaggaacaaggttggaccagtgccagtgaagcagtaaatgacagtagattttgggaactggtggataaagaaagagcattacaccaagaaggtaagtgtgagtcgtgtgtatataatatgatgggaaagcgtgagaagaaattaggtgaatttgggcgagcgaaaggatccagagccatttggtacatgtggctaggagcccgattcctagaatttgaagccctagggtttctcaacgaagaccattggtttgggcgggagaacagttggtccggcgtagagggcgagggtttgcatcgcttaggatatatacttgaggaaatagataagaaagatggagacctaatgtatgcggatgatactgcaggttgggacacaagaattaccgaggatgatcttcaaaacgaagaactgatcacagaacaaatggcgccacatcacaaaatactggccaaagcaatattcaaactcacttaccaaaataaagttgttaaagttcttagacctaccccaagaggtgcggttatggacataatttcaagaaaagatcaacgcggatcaggacaagtgggtacctacggattgaatacgtttacaaacatggaagtgcaacttatccgacagatggaagccgagggggtcattacgcaagacgacatgcagaaccccaagggattaaaagagagagttgaaaagtggctgcgagagtgtggagttgatcgtttaaaaagaatggctattagcggtgacgattgtgttgtaaaaccactagacgaaagatttggcactagcctactattcctaaacgacatgggcaaagtcagaaaagatataccccagtgggaaccatctaaaggatggaaaaattggcaagaagtcccattctgttcacaccattttcataaaatcttcatgaaagacggaagaagtttagtggtgccatgcaggaaccaagacgaacttatcggtagagcaagaatttcacaaggagccggctggagtctaagagaaacagcctgcttgggaaaggcttacgcacaaatgtggtcactaatgtatttccatagaagagatctacgactagcaagtatggcgatatgctcagcggttcccactgaatggtttcctacatctcgaacaacttggagtattcatgcccatcatcagtggatgactactgaggatatgctgaaagtctggaatcgtgtatggattgaagataatcctaatatgattgataaaacgcccgtacactcgtgggaagacatcccatatctagggaagagggaagatctctggtgcggttcgctaatcggactatcatcaagagcaacctgggctaagaatatacacaccgcaataacccaagtaagaaatttgattggaaaggaggaatatgtagattatatgcccgtaatgaagcgatattcagcaccgagtgaaagcgaaggagtgttatag

SEQ ID NO: 23618 - RNA, 9867 nt, synthetic construct
  misc_feature 1..9867: note = derived and/or modified CDS sequence (opt6) from DENV-4__FJ882595__SS-prME
  source 1..9867: mol_type = other RNA
tcgacaataaccttactatgtttgatacccacagctatggcattccacttgtctacaagagatggagaaccactaatgattgtagcaaaacatgaaagagggcgtcctttactatttaaaactacagaaggtataaataaatgtacccttatcgcaatggatttaggagaaatgtgcgaagatacagtaacttataaatgcccgctacttgtaaatacggaacctgaagatatagactgttggtgtaaccttaccagcacctgggtcatgtacggcacttgtacgcagtccggtgaaagacgccgtgagaaacgctctgttgctctaacaccgcatagtggtatgggattagaaacacgtgctgaaacatggatgtcctctgaaggcgcatggaagcatgcacaacgagtagaaagctggatattaagaaatcctgggttcgcactcttggcaggattcatggcatatatgattggacaaacggggattcagcgaacagtattctttgtactcatgatgttagtagcaccttcctatggtatgcgatgtgtaggcgtaggaaacagggactttgtcgaaggggtttccggtggtgcttgggtagacctcgttctggaacatggaggctgtgtaacaacgatggcacagggcaaacctaccttagattttgaattaactaaaactactgctaaagaggtcgcattacttcgtacttattgcatcgaagctagtatatccaacattacaacggcaacaagatgtccaacacagggagaaccctacctcaaagaagaacaagatcagcaatatatttgccgaagagacgtcgtagacaggggatggggtaatgggtgtggacttttcggtaagggaggcgtcgtcacatgcgcaaagtttagctgcagtggtaaaataactggcaatcttgtacaaatagagaacctcgagtacacagtagttgttactgttcacaatggagatactcatgcggttggaaacgacacatcaaatcatggtgtaacagctacaatcacaccgagaagcccatccgtagaagttaagttacctgattacggagaactaacgcttgattgcgaaccccgaagtggaatcgatttcaatgaaatgatcttaatgaaaatgaaaaagaagacctggctagtccataagcaatggtttctagatttgccattaccttggaccgccggtgctgacacatcagaagtacattggaactacaaagaaagaatggtcacattcaaggtcccgcatgcaaaaaggcaagatgtaaccgtactaggtagtcaggaaggagcaatgcattccgccctagccggcgcaactgaagttgatagcggagatggtaaccacatgttcgcaggacacttaaaatgtaaggtaagaatggaaaaactcagaataaaaggcatgtcgtacaccatgtgttctggcaagttctcaatagacaaagaaatggcggaaacccaacatggaactaccgtagtcaaggtaaagtatgaaggagccggggccccttgtaaggtacccatagaaattcgtgatgttaacaaagaaaaagtcgtgggacgtgtaatttcctccacaccccttgcagaaaacaccaacagtgtaacaaacatcgaacttgaaccaccattcggagacagctatatagtaatcggggtaggaaattctgcgctgacgctgcactggtttcggaaaggctcaagtatcggcaaaatgttcgagtcaacctacaggggtgcaaaaagaatggcgatattaggcgagacagcttgggactttggatcagtaggtggcttattcacgagtttaggaaaagccgttcaccaagtgtttgggtcagtttatacaacaatgtttggaggtgttagttggatgattaggatcttaataggatttttagtcttatggattggtacgaactcgcgaaatacctctatggcgatgacctgcattgcagtcggaggaattacactattcctaggattcactgttcaagccgacatggggtgcgtggttagttggtcaggacgtgaactgaaatgtggctctggtatctttgttgtagacaacgttcatacttggactgaacaatataaatttcagccagaatctcctgcacgactagctagtgccatacttaatgcccacaaggatggcgtatgtggaatacgaagtacaactcgactagaaaatgtaatgtggaaacaaataacaaatgaactaaattacgtcttatgggaaggaggccacgatttaacagtggttgcaggagacgttaagggagtgttaacgaagggaaaaagggcattaactccgccagtcagcgatctgaagtattcttggaaaacatggggaaaagctaagatctttacaccagaggcacgtaactcaaccttccttatagacgggcctgacacaagcgaatgccctaacgaaaggagagcatggaactcattagaagttgaagactatggatttggaatgttcacgactaacatttggatgaaatttagagaaggttccagtgaagtttgtgaccacagattaatgtcagctgcaataaaggaccaaaaagcagtacatgccgatatgggatattggatagaaagttctaaaaaccaaacttggcaaatagagaaagccagcttaatcgaagtaaaaacatgtttatggccaaagacgcatacattatggtcaaatggtgttcttgagagtcaaatgcttattccaaaatcctatgctggaccgttttcacagcacaattacagacaaggatacgccacccaaaccgtcggaccatggcatcttggtaaactagaaattgattttggggaatgcccaggtacaacagtaactatacaagaagattgcgatcatcgtgggccaagtttacgtactacgactgccagtggcaaattagtaacccaatggtgctgtagaagttgcacaatgccacccttacgattcttgggagaagatggttgctggtacggaatggaaattagaccactcagcgaaaaagaggaaaacatggtcaagagtcaagttgcagctgggcagggcaccagtgagacattctcgatgggcttactatgccttacattgttcgtcgaagaatgcctcagaagacgagttaccagaaaacacatgatcttagccgtagtaataaccctttgtgctataatattgggtggcttaacttggatggatttactacgcgcattaataatgttaggagacaccatgtctggcagaataggcggacaaacacatctagcaataatggcagtgttcaaaatgtcgccgggatatgtattgggtgtatttttacggaaacttaccagtcgtgagacagcactcatggttattggtatggcaatgacgacaactttatctattccacacgatcttatggaactcatcgacgggattagtttgggtttgatactactcaagattgtaactcaatttgataatacacaagtggggacacttgccttgagcctgacttttattcgcagtacgatgagcttagtgatggcgtggaggacgataatggcagtcttatttgttgtcacattaatccctctatgtcgcaccagctgccttcaaaaacaaagccactgggtggaaataacggcactgattctaggagcacaagctctgcccgtatacctaatgaccctcatgaaaggcgcctcgaggcgtagctggccactcaacgaagggattatggctgtaggcttagttagccttttaggatctgccctactaaagaatgatgtacctctagctggacccatggttgccggtggcctcctattggcagcgtatgttatgagcggcagttctgccgatctaagcctcgaaaaagccgctaatgtacaatgggacgaaatggcagatataaccggttcctcaccgataattgaggtaaaacaagatgaggacggctcatttagtatccgtgacgtagaggaaacgaacatgataacactattagtgaaattagcattaattacagtttccggtttatacccgctcgcgatcccggtaacaatgaccttgtggtatatgtggcaggttaaaactcaaaggtcaggagcactatgggatgttccatcacccgccgctacacaaaaggccgcactttcggaaggagtttatagaataatgcaacgaggactttttggaaaaacacaagtaggtgtcggtatacacatggaaggcgtatttcacacaatgtggcatgtaacacggggaagtgtaatttgtcatgaaacaggcagactcgagccttcttgggcggatgttaggaatgacatgatatcttatggaggagggtggagattgggcgataagtgggacaaagaagaagatgtacaggtgttggccatagagccggggaaaaaccccaaacacgttcaaacaaaaccaggcctcttcaaaacactgacaggagaaataggagctgtcacattagactttaaaccaggtaccagcgggtctccaatcattaatagaaaaggtaaagtaatcggactatatggtaatggtgttgtaacaaagtcaggtgattatgtgagtgcaattacacaagcggaacgtattggcgaacccgattacgaagtagatgaagatatattcagaaagaaacgtttgactattatggatttacacccaggagctggaaaaacaaaacggattttaccaagtattgtacgtgaagccttaaagagaagattacgcacattaattctagcaccgactagggttgtcgccgccgaaatggaagaggctttacgaggcttgccaattcgatatcaaactccggcagtaaaatcggaacatacaggccgagaaatagttgaccttatgtgtcacgcaacctttacaacaagactcctctctagtactagggtccctaactacaaccttatagtcatggatgaggcacattttaccgatccatcaagtgtagctgcgagaggctatatctcaacgcgcgtcgagatgggcgaggccgctgccatattcatgacggctacaccaccgggagcaaccgatccattccctcaatccaacagtccaatagaggatatagaacgcgaaatacccgaacgctcatggaatacagggtttgattggattaccgactatcaaggaaagacagtctggtttgttccgtcgattaaagcaggaaacgatattgctaattgcctgcgaaaatctggcaagaaagtaattcaattaagccggaaaacgtttgatactgaatatccaaaaacaaaactcaccgactgggactttgtagtcacaaccgatatcagtgaaatgggtgccaactttcgtgcagggagggttatcgatcctaggcggtgcttaaaaccagtgatactgacagatggtccagaacgagttattctcgcaggaccaataccagttaccccagcgtcagcagcacaacgaagaggtagaataggaagaaatcctgcacaggaagatgatcaatatgtattttccggtgatcccctcaaaaatgatgaggatcatgcgcattggaccgaggctaagatgctactagacaatatctacacgccagaaggaataatacctactctctttggccccgaaagagaaaagacacaagctatagatggtgagtttagacttcgcggtgagcaacgaaaaactttcgtagaattaatgagacgaggagacctgccggtctggctaagttataaagtagcctcggcgggtatatcatataaagacagggaatggtgtttcacaggagaaagaaacaatcagattttagaagaaaatatggaggtagaaatttggacacgcgaaggtgagaaaaagaaattaagacctagatggcttgacgcacgtgtatacgcagacccaatggcattaaaagattttaaagaatttgcatcaggccgcaaatcgataacgctagacatcttaaccgaaattgctagcttaccaacctacttatcgtctagagcaaaattagcattagacaacatagtcatgctacacactacggaacgtgggggtagagcctaccagcacgcgctcaacgagctccccgagagtctcgaaactctgatgctggttgcattactaggggctatgactgccgggatttttctattcttcatgcagggtacaggaatcggaaaattaagtatgggtttaataacaatagcagtagcatcgggtcttctatgggtagcggaaatacagccgcaatggatcgctgctagtattatcttagaatttttcctaatggtcctgttgatcccagaaccagaaaaacaacgcacaccacaagacaaccagttaatatatgtcatccttactatattgacaataataggactaatcgcggctaacgaaatgggattaatagagaaaaccaaaaccgatttcggtttttatcaagtaaaaacagagacaaccatcttagacgtggatttacgtcccgcgagtgcatggactctttacgctgtagctaccacaattttgaccccgatgctacggcacaccatcgaaaacacctctgctaacttgtccttagctgccatcgctaaccaagcggcggtgttgatgggacttggcaagggttggcctttgcacagaatggatctcggcgtccctcttctcgcgatgggatgctactcacaagtcaaccccactactttgaccgcaagccttgttatgttattagtacattacgcaatcattgggccaggtctgcaggctaaagcgacaagagaagcgcagaaacgtacggctgcaggcattatgaagaatccaacagtagacggcataaccgttattgaccttgaaccgataagctacgacccaaaattcgagaaacaactcgggcaagttatgttactcgtactatgcgccggacagctgcttttaatgagaactacatgggctttttgcgaagtactaactttggccacaggaccaatattaactctatgggaaggaaatcctgggcggttttggaacactacaatagcagtctcaacagccaatatttttagaggttcttacttagccggtgcaggattagcattttcactgataaagaatgctcaaactccgaggagaggaacaggtactacgggcgaaactctaggggagaaatggaaaaggcaattaaattcactcgataggaaagagtttgaagaatataaacgatcagggatactcgaagtggataggactgaagcaaaatctgccttaaaagatggaagcaagataaaacatgcagtctcgaggggtagcagcaaaatcagatggatagtagaaagaggcatggtaaagccaaaaggcaaggtagttgatttaggatgtggacggggaggctggtcctactacatggccactttgaaaaatgttacggaagtaaaaggttatacaaagggaggcccgggacacgaggagccaatccctatggccacatatggctggaacttagtcaaattacatagcggagtagatgtgttttataaacccacagaacaagtggatacgctgttatgtgatatcggtgagagctcctcaaatcccacaatagaagagggaaggactttacgcgttctaaaaatggttgaaccgtggttaagttcaaagccagaattttgtataaaagtactcaacccctacatgcccacggttatagaggaattggaaaaattgcaaagaaaacatggtggaaatcttgtacgatgtcccttatcacgtaactctacccatgagatgtattgggtgagtggagctagtggaaacattgtatcaagtgtaaataccacgagcaaaatgctattgaatcgattcactacgaggcatagaaagccaacttatgagaaagatgtagacctaggcgctggaacacgttcagtatctacagaaaccgaaaagcccgacatgacaataattggtagaagattacaaagattacaagaagaacataaagagacttggcattatgaccaagaaaatccgtaccggacatgggcctatcatggatcttatgaagccccttccacgggttctgctagttcaatggtcaatggggtagtaaaattactaactaaaccatgggatgtcattcctatggtaacgcaattggccatgactgatacaaccccttttgggcagcaaagagtatttaaggaaaaggtcgacacgagaactccacaaccaaaaccagggacccgaatggttatgacgactacagctaactggttatgggcgctgctcggcaagaagaaaaatccacgattgtgtacacgagaagagtttatttcaaaagttcgatccaacgccgcaataggagctgtatttcaagaggaacaaggatggactagcgcaagcgaagcggttaatgactcaagattttgggaacttgtagataaagaaagagcattacatcaggagggcaagtgtgaatcttgcgtatataacatgatgggaaaaagggagaagaaattaggagaatttggacgagctaaaggaagtagagcaatctggtatatgtggttaggggcacggtttctcgagtttgaggctctggggtttctgaatgaggaccactggttcggaagagaaaacagctggtcgggggtggagggagaggggcttcataggttaggatatatactagaagaaatcgataaaaaggatggggatcttatgtatgcagatgacacagctggctgggataccagaattactgaagatgatttacaaaatgaggaacttataaccgaacaaatggccccacaccataaaatattagctaaagcaatttttaaattaacataccagaacaaagtagttaaagttctacgacccacaccacgtggggcagtaatggatataatatcgagaaaagaccaacgaggaagcggtcaggtcggcacttatggtctgaacacgttcacgaacatggaggtgcaactaattagacaaatggaagcagaaggagtgatcacgcaagatgatatgcaaaatccaaaaggtctaaaagaaagagtagaaaaatggttacgtgagtgtggcgtagacaggttaaaacggatggcgatatctggcgatgactgcgtagttaaacctctcgatgagcgcttcggaacttctttactgttcctaaatgacatggggaaagtacggaaggatattccacagtgggagcccagcaaaggctggaaaaactggcaagaagtcccattttgtagtcatcacttccataaaattttcatgaaggacgggagatctctagttgtaccatgtagaaatcaagacgagctaataggaagggccagaatcagtcaaggagctgggtggtcactccgcgaaacagcttgtttaggtaaagcgtatgcacagatgtggtcactaatgtatttccaccgaagagatctcagacttgcttcaatggctatctgtagtgcagttccgacagaatggttcccaacctctcgaactacttggtcaatacacgcgcaccatcaatggatgacaactgaagacatgttgaaagtatggaatagagtttggattgaagacaatccaaacatgatagataaaacaccagttcattcttgggaagatataccctacctaggaaaacgggaggatttatggtgcggtagtctaataggtctctcttccagagcgacatgggctaaaaacattcatacggctataacgcaagtgaggaatctaattggaaaagaagaatacgtggactatatgcccgtaatgaaaagatattcagctcctagtgaatccgaaggtgttttatga

SEQ ID NO: 23619 - RNA, 9867 nt, synthetic construct
  misc_feature 1..9867: note = derived and/or modified CDS sequence (opt6) from DENV-4__FJ882596__SS-prME
  source 1..9867: mol_type = other RNA
tcaacaattacactcctctgccttataccaacagtaatggcatttcatctatcaactcgagacggagaacctcttatgattgtggcaaaacacgaaagaggtagaccactactgtttaaaacaaccgaagggataaataagtgcacactaatagcaatggaccttggagaaatgtgtgaagatacagtgacctataagtgcccactacttgtcaacacggaacccgaagacatagattgttggtgtaacctcacctcaacatgggtaatgtatggaacctgcacacaaagcggagaaagacgtcgggagaaacgatccgtagcattaacaccgcattcaggaatgggtctcgaaacaagagctgaaacatggatgtctagcgaaggtgcctggaaacacgcacagagagtcgaatcgtggatattgcgcaacccaggattcgctctgctcgcaggatttatggcttatatgattggacagacaggaatacaaaggacagtatttttcgttttaatgatgctagtagcacccagctacggtatgcgatgtgtaggagtaggcaatagggattttgtagaaggcgtatcaggcggggcttgggtagacctcgtattagaacatgggggctgtgttacgacaatggctcaagggaaacctacgttggattttgaattaacaaaaacgactgcaaaagaagtagccttactacggacctattgcattgaagcatcgatttcaaatataactacggccacaagatgcccgacacaaggggagccgtatctaaaagaggagcaagatcagcaatacatctgtcgaagagatgtagtggatagagggtggggaaatggctgtggtctctttggaaaaggaggagtagttacatgtgccaaatttagttgtagtggtaaaataactggaaacttagtacaaatagaaaacttagaatacacggtcgtagtcactgtacacaatggggatacccatgccgtaggcaacgataccagtaatcacggagtcactgctactattaccccaagatctccatcagtagaggttaaacttccagattacggggaattaacactagattgcgaacctagatccggaattgactttaacgaaatgatcttgatgaaaatgaagaaaaagacttggttagttcacaagcaatggtttctggatttgccattaccttggacagctggagctgacacaagcgaagtccactggaattacaaagagaggatggtcacgtttaaggttccacatgcaaaaagacaagacgtaactgttttgggttcgcaagaaggtgctatgcattccgctctagctggagctaccgaggttgattcaggtgatgggaatcacatgttcgcaggtcaccttaaatgcaaagtacgcatggaaaaactccggataaaagggatgagttacacaatgtgcagtgggaaattctcaatagataaagaaatggcggagacacaacacggtacaacagttgttaaggtaaagtatgaaggtgcaggagccccttgcaaggttcccattgaaattagagatgtgaacaaggaaaaagtcgtagggcgagtcatatcatcaaccccgttagccgaaaatacaaacagtgttacaaacatagagttagaaccaccattcggtgatagttacattgtgattggagtaggaaacagcgcattaacgcttcattggtttagaaaaggttctagtatcggaaagatgttcgaatcgacgtacagaggagccaaaagaatggctatactaggagaaacggcctgggacttcggtagcgtaggagggctttttacgagtctaggcaaagccgtgcaccaagtatttggtagtgtatacacaactatgttcggtggggtttcctggatgataaggattttaataggatttctagtgctctggataggcacaaatagtcgaaataccagtatggctatgacttgtatagcagtaggaggaataacgcttttcctgggctttacagtgcaagctgacatgggctgtgttgtgtcgtggagcggaagagaattaaagtgcgggtctggaatatttgtggtggacaatgtacatacatggaccgaacaatataaatttcaaccagagtctcccgcacgattggcttcggcaattttaaacgcgcacaaagatggggtatgtggaattaggagcaccacaagattagagaacgtaatgtggaaacaaataacgaacgaacttaattatgtgctgtgggaaggaggacacgatctaaccgtagttgctggagacgttcgaggggtacttacaaaagggaagagggctttaacacctccggtgtcagatcttaagtattcctggaaaacctggggaaaagcaaaaatcttcactccagaagctcgaaattcgacgttccttattgacggaccggataccagcgagtgtcctaacgaacgtagagcatggaactcgctagaagttgaagactacggatttggaatgtttactaccaatatatggatgaagtttagggaaggcagcagtgaggtatgcgaccaccggctgatgagcgcagcaataaaggaccaaaaagcggttcatgcagatatgggatattggatcgagagctctaagaatcaaacctggcagattgaaaaagcgtcattaatagaagtcaaaacctgcctctggcctaaaacccatacattatggtcaaacggagtactagagagtcagatgctcataccaaagtcatacgccggaccattttcccaacacaactacaggcagggatacgcgactcaaacagtaggtccatggcatttaggaaagttggaaatagacttcggggaatgtccaggtactactgtaactattcaagaagattgcgatcaccgcggaccttctttaagaactactacagcatctgggaaattagtcactcaatggtgctgtcgttcttgtacaatgccacctttacgatttttaggcgaagatggttgctggtatggaatggagattaggcctttatctgagaaagaagaaaacatggtaaagtcacaagtagctgcgggacaaggaaccagtgaaactttttcgatgggcctattatgcctcacgctatttgtggaggaatgcttacgaagaagggtaacaaggaaacacatgatcctagccgtagtcataacactttgcgccattatcctcggagggttgacatggatggacctattacgagcccttatcatgctgggagatactatgtcaggtaggattggaggacagacccatctagcgataatggctgtatttaagatgtcaccaggatatgtgctaggagttttcttaaggaaacttactagccgtgaaactgctttaatggtcattgggatggcaatgaccactacactcagcataccgcacgatttgatggagttaattgatggcatttctttaggattgattttacttaaaatcgtcacccagtttgacaatacacaagtagggactctggcactaagtctgacattcataagatcaacaatgagcctcgtaatggcgtggcgcaccataatggccgttttgttcgtagtaacacttataccactatgtcgaacatcctgcttacaaaaacaatctcattgggtagagataacagccttgatattaggcgcacaggcattgcctgtttatctaatgacattgatgaaaggagccagtagaaggtcttggcccttaaacgagggtattatggcagtggggctagtttcattgttaggtagtgcactattgaaaaacgatgtacccctagctggtcccatggtagcaggagggcttttactagcagcttatgttatgtcgggaagcagtgcagacctcagcttagagaaagcggcaaatgtccaatgggatgaaatggcagacattactgggtcttcacccattatcgaagttaaacaagatgaagatggctcgttttccatccgtgacgtcgaagagactaatatgattacacttttagtgaaattagcactaataactgttagtggattgtatcctctggcaatcccagtgacgatgactttgtggtacatgtggcaagtaaaaacgcagcgcagtggagctctctgggatgttccaagtccagccgctacacaaaaagctgctttgtctgaaggtgtatatcgaattatgcaacgtggactgtttggtaaaacacaagtcggagtaggcattcacatggagggagtatttcatacaatgtggcacgttacgaggggctctgtaatatgccacgagactggtagactcgaacccagctgggccgatgtaagaaatgatatgatttcttatggtgggggatggcgattaggagacaaatgggataaagaagaagacgttcaagtacttgcaatcgaaccaggtaagaatcctaagcatgtacaaacaaagccaggtcttttcaaaacactcactggtgagataggagcagttacgttagactttaaaccggggacgagtggttcgcctataatcaaccgtaagggaaaagttatcggactgtacggtaatggggttgtgacgaaaagcggtgattatgttagtgccataactcaagcagagcgaataggagagcctgattatgaggtcgacgaagatattttcagaaagaaacgactcaccatcatggacctacatcccggtgctggtaaaacgaagcgtatcttacctagcatagtaagagaagcattaaaacgtcgattaagaacgttgattcttgcgccaactagagtagtagctgcagaaatggaagaagcattgagaggtctacccataagatatcaaactccagctgtaaaatctgagcatacgggcagggaaattgtagacctaatgtgtcacgcaaccttcactacaagattactaagtagtaccagagtccctaattataatctaatagtaatggatgaagctcatttcactgacccatcgagtgtagctgcacgtggctatattagtactagagtggaaatgggagaagcagccgcaatctttatgacggcaacaccaccaggggccacagacccattccctcaaagtaatagcccaatagaggatatcgaaagagaaataccagaaagatcctggaatacgggctttgactggataacagattatcaaggcaaaacagtttggtttgtgcccagcataaaagcaggaaatgatatagcaaactgtttaagaaaatcaggaaagaaagttattcaacttagcagaaagacatttgatacggaatacccaaagactaaactaaccgattgggactttgtggtgacaacagacataagcgaaatgggtgcgaacttcagagccggaagagtgattgatccaagaaggtgcttaaagccagtcattctaacggatggtccagagagagttattttggcaggtcccatccctgtaacgcccgcatcggcagcccaaagaagaggacgtataggcaggaaccctgctcaagaagatgatcaatatgtctttagtggagatcctctgaaaaatgatgaagatcacgcacattggactgaggcaaaaatgttgttagacaatatttatactccagagggaatcataccgaccctctttggtccagagagagagaaaactcaggcaattgatggcgagttccgattgcgcggggaacagcggaagactttcgtagaactaatgagaagaggagatctgccagtatggctatcatacaaagttgcttcagctggaatatcgtataaagatcgtgaatggtgttttactggagaacgaaataaccaaattttagaggaaaatatggaggtggaaatatggacaagagaaggagagaagaagaaattaagacctcgatggttagacgcaagggtttatgcagatcctatggcgttaaaggacttcaaggagttcgcaagtggacgaaagagcataacgttagacatcttgacagaaatcgcttcgttaccaacctatctttctagccgagctaagttggcactagacaacatcgttatgcttcacaccacggaacggggtggacgagcatatcaacatgcgctgaacgagctcccggaatcattagaaacactaatgcttgtagctctattaggtgcaatgactgccggtatctttttattcttcatgcaagggaagggaataggaaaactaagtatgggattaataacaatagcagttgccagcggactactatgggttgcagagattcagccccaatggatagcagctagcatcattcttgagttcttccttatggtgttacttatccctgaacctgaaaaacaaagaacacctcaagataaccaacttatatatgtaatactaacaatacttacaattataggcctaattgcagcaaacgaaatgggcttaatagaaaagacaaaaacggattttgggttctatcaagtcaagacagaaaccactatcctggatgttgatcttagaccagcaagcgcgtggactctatacgcggtagcgacaacgatactcaccccaatgttgagacatacaatcgaaaatacgagcgcgaatttatcgcttgcagcgatagcaaaccaagcagcagtcttaatgggccttggtaaaggctggccccttcacaggatggacttgggagtacctctattagcaatggggtgttatagccaagtaaatcctaccacgctcacagcgtctctggtaatgctacttgtacattatgcaataatagggccgggtctacaagctaaagcaacacgagaggcacagaaaagaaccgctgcaggaattatgaagaatcccacagtggatggcatcaccgtaatcgacctggagccgatttcttatgatcctaagtttgaaaaacaactagggcaagtgatgttattagttctatgtgcaggacaactactcctaatgagaacaacgtgggctttttgtgaggtacttacactagcaactggcccgattctcacattgtgggaagggaatccaggaaggttttggaacacaacaatcgccgtttccacagctaatatatttcggggaagctatctcgcaggcgcaggtttagcgttcagcctaattaaaaacgcacaaacaccgagaagaggaaccggcacaaccggagaaacactaggcgagaaatggaagaggcaattaaacagccttgaccgcaaagagtttgaagaatataagcggtcaggcattctcgaggtagacagaacagaagcgaaatcagctctaaaggatggttcaaaaatcaagcatgcagtcagtagaggtagtagcaaaatacggtggatagtagaaagaggaatggtgaaaccaaaaggtaaagtcgtcgatctcggatgtggaagagggggctggtcgtactatatggcaacactcaaaaacgtaacagaagtaaaggggtataccaaagggggacctggtcatgaagaacctatacccatggctacatacggatggaatctagttaaattgcatagcggagtggatgtattttataagccaacagaacaagttgataccctcctttgtgacattggtgaatcatcgagtaaccctacaattgaggagggtcgcactcttagagtcctcaaaatggtagaaccatggttatcatccaaacccgagttttgcatcaaggtccttaatccttacatgccaactgtgattgaagaattagagaagttgcaacgcaagcacggtggtaatttggttagatgtcctttatcgagaaactcaacacacgaaatgtactgggttagtggagcaagtgggaatattgtatcttcagtcaacacgactagcaaaatgctactaaataggtttactacaagacacagaaaacctacatatgagaaggatgtagatttaggagcagggaccagatcggtaagcactgagacagagaaacctgacatgacaataatcggcagaagattacaaaggcttcaagaagaacataaagagacttggcactacgatcaagaaaacccatacagaacctgggcatatcacggaagttacgaagcgcctagtaccggaagcgcatcctctatggttaatggtgtcgttaaacttttgacaaagccttgggacgtaataccaatggttacacaactggcaatgaccgacactaccccgtttgggcaacagagagttttcaaggagaaggttgatacaaggacgccacagcctaaaccaggcacgcgaatggtaatgacaacaacagcgaattggctttgggcactattagggaagaagaaaaacccacgcctctgcactcgagaagaatttatctctaaagttcgatctaatgctgcaataggtgccgtattccaagaagaacaagggtggacatccgcgagtgaagcggtaaacgactcacgtttttgggaattagttgataaagagcgtgcattacaccaagagggtaaatgcgagagttgcgtctataatatgatgggcaagcgggagaagaaactaggcgagtttggacgtgccaaagggagcagagcaatttggtatatgtggctaggtgcgagattcctggagttcgaagctctgggattcttaaacgaagatcattggtttggtagggaaaacagttggagtggggtggagggcgaaggattgcatcgcctaggctacatattagaagaaatcgacaagaaagatggagatttaatgtatgcagacgacactgccggctgggatacaagaataactgaggatgatctacaaaacgaagaattaataacggaacaaatggcaccacaccacaaaatactagccaaagcgatctttaaattaacatatcagaataaagttgtgaaagttctccggccgacgccaaggggagcggtaatggatatcattagcagaaaagaccaaagagggtccggccaagtaggcacttatggacttaatactttcacaaacatggaagtacaacttattagacaaatggaagcagagggcgtgattacgcaagatgatatgcagaaccctaaaggcctgaaagaacgtgtggagaaatggcttcgagagtgtggagtcgacagactaaaaaggatggcaatatccggagatgactgtgtagtaaagccgttagatgagcgttttggtacttctctactatttttgaacgatatgggaaaagtacgcaaagatataccgcaatgggaaccttctaaaggctggaaaaattggcaagaagtacccttttgtagccaccattttcataaaatctttatgaaagatgggaggtccctagtagtaccatgccgtaaccaagacgaattaatcggtagagctagaatttcacagggagctggttggtcattacgagaaacagcttgccttggaaaagcgtacgctcagatgtggtcgttaatgtatttccatcgtagagatttacgcttagccagtatggcaatatgttcagctgtcccgacagagtggtttccgacgagccgcactacgtggtcgatccatgcacatcatcaatggatgactactgaagacatgttaaaagtctggaatcgagtttggattgaagacaaccccaacatgatagacaaaaccccagtacattcatgggaagatattccgtatttaggtaaacgtgaggatctctggtgcggctcattgataggactatcctcacgggcaacatgggctaaaaacatacacacagctatcacacaagtaagaaatctaataggcaaggaagaatatgttgattacatgccagttatgaaacgatacagtgctccctcagaaagcgaaggagttctctga

SEQ ID NO: 23620 - RNA, 9867 nt, synthetic construct
  misc_feature 1..9867: note = derived and/or modified CDS sequence (opt6) from DENV-4__FJ850059__SS-prME
  source 1..9867: mol_type = other RNA
tcaactataactcttctatgcttaataccaactgttatggcgtttcatctatcaaccagggacggggaaccacttatgatagttgcgaaacatgaacgtgggagaccgctactatttaagactaccgaaggaataaataaatgcacattaatagcgatggatttgggagaaatgtgtgaagatacggttacatacaaatgccctttattagtcaatactgaaccagaagatatcgattgctggtgcaacctcacaagtacttgggttatgtacggcacttgtacacaaagcggagaacgcagaagggagaaacgttctgtggctctgacaccacacagtggtatgggactagaaacgcgagcagaaacgtggatgtcatctgagggcgcttggaaacacgcacaaagagtagaatcatggatcctgagaaatcccggatttgcacttttagcaggttttatggcttacatgataggtcagacaggcatacaaagaacagtattctttgtactaatgatgttggtcgctccatcctacggaatgaggtgtgtaggcgttgggaatcgtgacttcgtagagggagtaagtggcggagtctgggtagacctagtattagaacatggaggttgcgttacaactatggcgcaaggtaaacctactttagatttcgaactgacaaagacgactgcgaaggaggtagcccttctacgtacctattgtatcgaagcatcaatatcgaatatcacaaccgcaaccagatgtccgacacaaggagaaccatatcttaaagaagaacaggatcagcaatatatttgtcgaagggatgtggtggataggggatggggcaatggctgcggtctctttggtaaaggaggcgtcgtcacatgtgcaaagttttcctgctctggaaagataacgggtaaccttgtacaaattgaaaaccttgaatatactgttgtggtaacagtgcacaatggtgacacacacgctgtaggcaatgacacctcaaatcacggtgttactgcaacgattacaccgagatcaccctctgtagaagttaagttaccagactacggagaactcacactggattgtgaacctcgaagtggtatagacttcaacgagatgatcttgatgaaaatgaaaaagaaaacttggcttgtacataaacaatggttcttagacctccccttaccttggacagcaggagcagacacgtcagaagtacattggaactacaaagaacgaatggttacgtttaaggtgccacacgctaaacgacaagacgtgacggtattaggcagccaggaaggtgctatgcactctgcacttgcaggagcaactgaagtagacagtggagacggaaatcatatgtttgcgggacacctgaagtgtaaagtcagaatggaaaaactaagaataaaagggatgagttacacaatgtgttcggggaaattctcaattgataaagaaatggcagaaacccaacatggcacaacggtggtaaaagtgaaatatgagggcgccggagcaccgtgtaaagtaccgattgagattcgtgacgtcaataaagagaaagtagtagggagggtaatcagttcgacgcctttagctgagaatacaaactcggtgaccaatattgaactcgaaccgcccttcggggacagctacatagtaataggagtgggaaatagcgcattaacactacactggtttcgtaaagggtcaagtattgggaaaatgttcgaaagtacatatagaggcgcgaaaagaatggcgatattaggcgaaactgcgtgggactttggttctgtgggtggattatttacaagtttaggaaaagctgtacaccaagtatttgggagtgtatatacaaccatgttcggtggagtatcatggatgattagaatcttaatcggttttctagttctttggattgggactaacagccgaaacacgagtatggcaatgacatgcattgcagtaggaggaatcactttattcttgggcttcacagtacaggcagatatgggatgcgtagtttcttggtccgggagagaactgaaatgtggtagcgggatatttgtagttgataatgtacacacttggacagagcaatacaaattccagcctgagtctccagctagattagcgagtgctatactgatagcacataaagatggggtttgcggcatcagatcaacaacaagactggaaaacgtgatgtggaagcaaattacaaacgaattgaattatgtactctgggaaggtgggcacgatttaacagtggtcgctggagatgcgaaaggagtacttacaaaaggcaaacgtgctttaactccacccgtatctgacctgaaatattcttggaaaacttggggaaaagctaaaatttttactccagaggcaagaaatagcacctttctaatagacggaccggatacctcagagtgtccgaacgagcgtcgtgcatggaactcactcgaagtagaagattacggatttggaatgttcaccacaaacatttggatgaagtttagagaaggaagctccgaagtatgtgaccatcgattaatgtcggcggccataaaagatcagaaagcagttcatgcagacatgggatattggattgaatctagcaaaaatcaaacatggcaaattgaaaaagcatcattaatagaagtgaaaacctgtctatggcctaaaacgcacactctgtggtccaatggagtgcttgagagccaaatgctaatccctaaaagttatgcagggccctttagtcagcataactaccgccaaggctacgcaacacaaacagtggggccgtggcatttagggaaattagaaattgatttcggcgaatgtcccgggaccacagtaaccatacaagaagattgtgatcatagaggacctagccttcgaacgaccacagcttccggcaaattagtaacgcaatggtgctgccgctcgtgcacaatgcctccacttagatttcttggagaggatggctgctggtatggcatggaaatacggccactatccgaaaaagaagaaaatatggttaagagtcaggtcacagcaggacagggtacatctgaaacttttagtatgggtctgttatgcttaactttattcgtggaggaatgtctaagacgtagagtcactagaaaacacatgatactggccgttgtaataactttatgcgcgatcatcctaggaggtcttacgtggatggatctcttaagggcactcataatgctcggtgatacaatgtcgggacgaattggaggtcaaacacatttagctataatggcagtatttaaaatgagccctggctacgtactaggagtgtttttgagaaaactaacgtcgagagagacagctttaatggtgatagggatggcgatgaccaccacactaagtataccccacgatcttatggaactcattgacggtatttcactaggtttaatactccttaagatcgtgacacaatttgacaatacacaagttggaacattagccctcagtttaacgttcatacgatctactatgtctttggtaatggcctggagaacaattatggctgtactatttgttgttacacttataccactatgcagaacgagttgtttacaaaagcaaagccattgggtggaaataacagcattgatattaggagcgcaggcattgcccgtctatctaatgacgttaatgaaaggagcctctcgcagatcatggccactaaacgaaggaattatggcggtgggcctagtatcgctattaggatcggcactacttaaaaatgatgttcctttagcaggaccaatggtagccggaggcctgcttttggcggcgtacgtcatgtctggaagttcagcggacctatccttagaaaaggcagccaacgttcaatgggatgaaatggcggatataacaggatcctcacctatcatagaagtcaaacaagacgaggacggatcatttagtataagagatgtagaagaaacaaacatgatcacattacttgttaagttagctctcattacagtctcaggtctctaccccctagctataccggtaactatgacgctgtggtacatgtggcaagtaaaaacgcaaaggtcaggagcactctgggatgtccctagccctgcagcaacccaaaaagcggcattaagtgagggtgtatacagaataatgcaacgcgggttatttgggaagacacaagttggcgtaggaatacatatggaaggcgtttttcatacaatgtggcatgttacacgaggcagtgttatttgccacgaaacaggaagattagaaccctcatgggcagatgtccgtaatgacatgataagctatgggggaggctggcgacttggcgacaaatgggataaagaagaagacgtacaggtactagcgatagaacctggcaaaaatccaaaacacgtacaaactaaaccgggactttttaaaactctgaccggggagatcggggccgtaacattagactttaaaccagggacaagtggatcacctataatcaatagaaagggaaaggtaatcgggctatatgggaatggtgttgtgacaaaaagcggtgactatgtatccgcaataactcaggcagaacgtattggagagcctgactatgaggtagatgaggacatttttcgcaagaaacgattaacaataatggacttacacccaggcgcaggcaaaacaaaaaggatactcccgagtattgtacgagaggcacttaagaggagactaagaaccctaatactagcacctactcgcgtagtcgcagccgaaatggaggaggctttaagaggactacctatacgataccaaactcctgcggtaaaatctgaacacacgggaagggaaatcgtagatctaatgtgtcatgctacattcacaacaaggttactgtcatcgaccagggtaccaaactacaacctgatcgtaatggatgaggcgcactttactgatccgtcatctgtggccgcaagagggtatattagtacaagagtcgaaatgggagaagcagcggcgatctttatgacggcgacgccgccaggcgcaacagatcctttcccacagtcaaactctccgatagaggatatcgagagagaaatacccgagagaagttggaatacaggttttgactggatcaccgactatcaagggaaaacagtctggtttgtaccatctatcaaagcaggtaacgatattgcaaactgtttacgaaaatctggtaagaaagtcatccaattatctcgaaaaacgttcgacactgagtatcccaaaacgaaactcacagattgggacttcgtagttactacggacattagtgaaatgggagctaactttagagcaggaagggtaatagacccaaggagatgtctcaagccagtaatactaactgatgggcctgaaagggtcatccttgccggacctatccctgttacacccgcgagtgcagctcaaagacgcggaaggataggacgcaaccccgcccaagaagacgaccaatatgtctttagtggtgacccactcaaaaacgacgaagatcacgcacactggaccgaagctaagatgctcttagacaacatatacactccagaaggaataataccaacgttatttggtccagaaagagagaaaactcaagcaatagatggcgaatttagattgaggggagaacaacgaaaaacctttgtagaactgatgcgaagaggtgacttaccggtatggttatcatataaggtagcctcagcaggaataagctacaaagacagagaatggtgttttacaggtgaaagaaataaccaaattttggaagaaaacatggaagttgaaatttggacaagggagggagagaaaaagaaactcaggccaaggtggttagatgccagagtatatgcagatccaatggctttaaaagattttaaagaatttgcaagcggtcgaaaatctatcacgctagatatccttactgagatcgcgagtctgccaacatacttatcgtctagagccaaactagcgcttgacaatattgtaatgttacatactaccgaaaggggaggtagagcctaccagcatgcattaaacgagctaccagaaagtttggaaacgcttatgctcgtcgcattgcttggagcaatgactgcgggcatattcctattctttatgcaaggaaaaggcatcgggaaacttagtatggggctaatcacaatagcggtagcgtccggtctgttatgggtggctgaaatacaaccacaatggattgcagcgagcataattctagaatttttcctaatggtactactcatcccagaacctgaaaaacagcgaactccacaagacaatcagctgatttacgtaatcctgaccatattaactataatagggctgatagctgcgaacgagatggggctaatcgagaaaactaaaacagatttcggattctaccaagtaaagacagagaccacaattttagatgttgatcttcgccctgcgtctgcatggaccttatatgctgtagcgactacaatattaacacctatgttacgacatacaatagaaaataccagtgccaatttatccttggccgctatagccaatcaggctgctgtactaatgggcttgggaaaaggatggccactacatcgaatggatttaggggtaccgcttctagccatgggatgctattcacaagtaaatccaactacccttacagcctcattagtcatgctgttagtacattacgcgataatcgggcccggtctacaagcgaaagcaacgagggaagcgcagaaaagaactgccgcggggattatgaaaaatcctacagtagatggcataactgttatagatctagaaccaattagttacgatccgaaattcgaaaagcaactgggacaagtcatgttgctagtcctctgcgctgggcaacttctacttatgcgtactacatgggcattctgtgaagtcctgactctagcgactggaccgatcttgaccttatgggagggaaaccctggtagattttggaatactactattgctgtaagcaccgctaatatttttagaggatcttatttggcaggagccggattggcattcagtcttattaaaaacgcgcagacacctagacgtgggacagggacaacaggagaaacgcttggggaaaaatggaaacgtcagttaaacagtctcgaccgaaaagaatttgaagaatataaaagaagcgggatattggaagtagacagaactgaggctaaatcggccctcaaggacggtagtaaaattaaacatgctgtttctaggggaagttcaaaaattagatggattgttgagaggggaatggttaagccaaagggtaaggtagttgaccttgggtgtgggcgagggggatggagctactatatggccacactcaaaaacgtaacagaagtcaagggatacacaaagggtggtccaggtcacgaagaacccattcctatggcaacatatggctggaatctagtcaaactccattcgggagtagatgtattttatagacctacggaacaggtggacactctactctgcgacatcggcgaatcatctagcaatcccacaatagaagaaggccgaacgcttagggtacttaagatggtagaaccttggttatcctcaaaacccgaattttgtataaaggttttgaatccatacatgccaactgtgatagaagagttggaaaaattgcaaagaaagcatggagggaacctagtaagatgtcccttaagtagaaacagcactcatgaaatgtactgggtctcaggggcgagtggtaacattgtctcgtcggtcaacacaacatcgaagatgttactaaatcgatttactacgagacacagaaaacctacatatgaaaaagacgtagacctaggtgcaggtactcgcagcgtttcaacagaaactgaaaaacctgatatgactatcattggaagacggctccaacgccttcaagaagaacacaaagaaacttggcattatgaccaggagaacccatatcgaacatgggcctatcatggaagttatgaagctccatcgacaggctcggccagtagcatggtgaatggcgtagtgaaactactaacaaagccttgggacgtaataccaatggtcacacagctggcaatgacagacactaccccatttggtcaacaaagagtttttaaagagaaagttgatacccgaacaccgcagcccaaacccggaacacgcatggtcatgactacgacggcgaattggctatgggcacttctaggcaagaagaaaaacccgcgattatgtacgcgagaagaatttatcagtaaagtccgtagtaatgcagcaataggcgcagtgtttcaggaagaacaagggtggactagcgctagcgaagcagtaaatgattccaggttctgggaattagttgacaaagaacgagctttgcaccaagagggcaaatgtgagagttgcgtctataacatgatgggtaaaagagagaaaaagttaggagagttcggacgtgcaaagggaagcagagctatatggtacatgtggctcggggctcgatttttagaatttgaagcactaggatttcttaacgaagatcactggttcggtcgggaaaattcctggagtggagtagaaggagaaggcctgcatcgccttggttacatactagaagaaattgacaagaaagacggtgaccttatgtatgcagacgatactgccggatgggatacgagaataacggaagatgatcttcaaaatgaggaactcataacggagcaaatggcaccccaccacaaaatactagctaaggcgatattcaagctcacataccagaataaagtagtcaaagtgctacgaccaacccctagaggcgcagttatggatataataagcagaaaagatcaaaggggctcggggcaagtaggaacatacggactaaatacttttaccaacatggaagtacaattgataagacaaatggaggcagaaggagttataacgcaggatgatatgcaaaatcctaaaggcttgaaagagcgagtagaaaaatggttacgagaatgcggagtagacagactaaaacgcatggcaatttccggggatgactgcgtcgttaaaccgctggatgaacgtttcggaactagcttattatttttaaacgacatgggtaaggtcaggaaagacataccccaatgggagccatcaaaaggttggaaaaactggcaagaagtgccgttttgttcacaccattttcataaaattttcatgaaagatgggagatcccttgttgtgccctgtaggaatcaagacgagttaattgggagagcaagaatttcacaaggtgctgggtggtctttacgagaaactgcttgccttggtaaagcatatgcccaaatgtggtccctaatgtatttccacagacgcgatctgcgtttagcgagcatggcaatctgcagtgcagtgcctactgagtggtttccaacatccagaacgacgtggtcgatacacgcacatcatcaatggatgactactgaagatatgttaaaagtatggaatcgggtctggatcgaagataatcccaatatgattgataaaacaccagtgcattcatgggaggatataccatatttgggtaaacgagaagatctctggtgcggtagtctaatagggctaagctcaagggcaacatgggcaaagaacattcacacagcgataacccaagtacgtaacctgataggcaaagaggaatatgttgattacatgcccgtaatgaagagatattcagcacccagcgagtctgaaggcgttctttga

SEQ ID NO: 23621 - RNA, 9867 nt, synthetic construct
  misc_feature 1..9867: note = derived and/or modified CDS sequence (opt6) from DENV-4__FJ882598__SS-prME
  source 1..9867: mol_type = other RNA
agtacaataacacttttatgcttaataccaacagctatggcatttcacttaagtaccagagacggcgaaccgctgatgatagtggcgaaacacgaaagaggacgacccctcttgtttaaaacaaccgaaggtattaataaatgcacgctgatagcaatggatttgggcgaaatgtgcgaagataccgtaacatacaaatgcccactcttagttaatacagaaccagaggatattgactgttggtgcaacctaacctcaacttgggtgatgtatggaacatgtacacaatcaggggagcgaagacgggagaaaagatcagtagcgcttacaccgcatagtggtatggggttagaaaccagggcggagacatggatgagtagtgaaggcgcatggaaacacgcacaaagagtcgaaagctggatacttagaaatccaggatttgccctacttgcgggatttatggcttatatgataggacaaaccggcatacaaagaactgtattctttgttctaatgatgttagttgcgccttcatatggcatgagatgtgtcggagttggcaatagagatttcgtagaaggggtcagcggaggcgcttgggtcgatcttgtgctagaacatggtggatgtgtaaccacaatggcccagggtaaacctaccttggactttgaattaacaaaaacgacggcaaaagaggttgccctgttaagaacttactgcatagaggcttcgatctcaaacattacaaccgcaacgagatgcccaacacaaggggaaccctacctaaaagaagaacaagatcaacaatacatctgtagaagggatgtagtagataggggatggggcaatggatgcggtcttttcggaaaaggaggagtggtcacgtgtgcaaaatttagttgttctggaaaaataacggggaatttagtgcagatcgaaaatctagaatatactgttgtggtaacagttcataatggcgatacgcatgctgtaggtaatgatacgagtaatcacggtgttactgcgacaatcactccacgttctccatctgtagaagtgaaactcccggattacggggaactaacattggattgtgaacctagaagcggaatagactttaacgagatgatattaatgaagatgaaaaagaagacttggttagttcataaacaatggtttttagatttacctctaccttggacggcaggagctgatacgtcagaagtacactggaactataaagaaaggatggttacattcaaagtgccacatgcgaaaagacaagatgtgacagtacttggttcccaagaaggcgccatgcattctgccctcgcgggggcaaccgaggttgacagcggtgacgggaatcatatgttcgcgggccacctaaaatgtaaggtacgtatggagaaactaagaattaaaggaatgtcttatacaatgtgtagtggaaaatttagcattgataaagaaatggctgaaacgcaacatggtaccaccgtagttaaggtgaagtacgaaggtgctggggccccttgcaaggtcccgattgaaattagagatgttaataaagaaaaggttgtcggaagggttatttctagcacacccctcgcagagaacacaaatagcgtaacaaacatcgagctagaaccaccctttggagactcatacatagtaattggcgtaggcaattcagctttgacactacattggtttagaaaaggttcatctattggaaaaatgtttgagagcacatacaggggtgcaaagcggatggcaatcttgggggaaactgcgtgggattttggttccgtaggaggtctatttacatcactaggaaaggcggtacatcaagtatttggttcagtatatacaaccatgtttggtggagtgagttggatgattagaattttgataggatttttggttctatggattggaactaatagcagaaacacaagtatggctatgacttgtatagcagtagggggcatcacattgttcctgggatttactgttcaagcagatatgggatgtgtagtgtcttggtccggtagagagctcaaatgcggctcagggatatttgtagtagataatgtacatacttggaccgaacaatataaattccagcctgagagtccagcccgattagcaagtgcaatacttaatgctcataaggatggagtttgtgggatacgttcaacaacgcgcttagaaaatgtcatgtggaaacaaataacaaatgagctgaactatgttctctgggaaggcggacatgatctaaccgtggtagctggagatgtaaaaggtgtccttacgaaggggaaacgggccctaactcctcccgtcagtgacctaaaatactcatggaaaacgtggggcaaagccaaaatcttcacaccagaagcacgaaactctacatttttaattgatggaccagacaccagcgaatgtccgaacgaacggagggcctggaatagcttggaagttgaagattatggctttggaatgtttacgacaaatatatggatgaagtttagggaaggatcttcagaagtgtgtgatcataggttgatgtcagccgctataaaagatcaaaaggcagtgcacgctgacatgggatattggatcgaatcatcaaagaatcagacttggcaaatagaaaaagccagtcttatagaggtgaaaacatgtttatggccaaaaacccatacactatggtctaacggagttttagagagtcaaatgctaatacctaaatcttatgccggaccatttagccaacataattatagacaaggctacgcaactcaaacggttgggccatggcatcttggaaaacttgaaatagattttggagaatgtcctggaacgactgtaaccatccaggaagattgcgatcataggggtccaagtctgcgtacaacaacagccagcggcaaactggtaacgcaatggtgttgcagaagttgtactatgccacccctgaggttcctgggggaagatggttgctggtatggaatggaaatccgaccattgtctgaaaaagaagaaaatatggttaagagtcaggttgcggcaggccaaggtacttcagagacgttttcaatgggtctattgtgtctaacactattcgtagaagaatgcctaagaaggagagtcacaagaaaacatatgatacttgcagtagttataactttgtgtgcgataattttaggcggtttaacatggatggatctattaagagctttaataatgttgggcgatacgatgagtggtcgaataggaggacaaactcacttagctatcatggcggtatttaaaatgtctccaggctacgtgctaggagtctttctgcgaaaattgacatcaagggagaccgctctgatggtaatagggatggctatgaccacaacactctctattccacacgacctaatggaacttatagatggtattagcttaggtctaatattattaaaaatcgttacgcaattcgataatactcaggtaggcacactcgccttaagtttgacattcataagatcaacaatgagcctagtcatggcgtggcgaacgattatggcagtgcttttcgtggtcacacttatacctctgtgtcgcacttcatgcctccagaagcaatctcattgggtcgaaataacagccttaatattaggtgcacaagcattgccggtttatctgatgacattgatgaaaggcgccagtagacgatcctggcccctaaatgagggaattatggctgtaggtttagtgagtttgctcggttccgccctgttaaagaacgacgttccgttagcaggcccgatggttgccggtggattattactcgctgcgtacgtcatgagcggttcttctgccgatctatcgctcgagaaagctgctaacgtccaatgggatgagatggccgatattacaggatcctctcctataatcgaagttaaacaggacgaagatggttcatttagcatacgagatgttgaagaaactaatatgattacactcttagtaaaactcgcgctaataaccgtctcaggactatacccactcgcgattcctgttaccatgacattatggtatatgtggcaagtaaaaactcagcgatcgggagctttatgggatgtcccatctccagcagcaacccaaaaagccgcattatctgaaggtgtgtacagaattatgcaacgaggactttttggaaagacacaagtcggagtaggtatacacatggagggcgtgttccataccatgtggcatgttacaagaggaagcgtaatatgccatgagaccggacgtctagaaccgtcatgggcagacgtgaggaacgatatgatctcctacggaggaggatggagacttggtgacaagtgggacaaagaagaagatgtacaggttctagctatagaaccaggtaagaacccaaaacatgtacaaacgaaacccggcctctttaaaacactcacaggggaaattggcgcagtcacattagattttaagccgggaacaagcggcagtccgattataaaccgaaaaggtaaagttataggtttatacgggaatggggtcgtgacaaaaagcggtgattacgtatcagcaattactcaggctgaaagaataggagaaccggattatgaagtagatgaagacatcttcaggaagaaacggttaacaatcatggaccttcatccgggcgcagggaagacaaaaaggatattaccatctatcgtgagagaggctttaaaacgacgcttgcggactttaatattggccccaacaagggtagttgccgcagaaatggaagaagcactaagaggattacctattcgatatcagactcctgcagttaaaagtgagcacactggacgcgaaatcgttgatctaatgtgtcacgctacttttacaacacgtctcctatccagtacaagggtacctaattacaacctgatagtcatggatgaagctcactttacagaccctagttctgtagctgcgcggggttatatttctacgcgagttgaaatgggcgaagcagcagctatattcatgactgccacaccaccaggagcaacagaccccttccctcaatcaaacagtccgattgaagacattgagagagaaattcctgaacgttcatggaacacaggatttgactggataacagattaccaagggaaaacggtgtggtttgtaccatcaataaaggcgggaaatgacatagcaaactgcctacgtaaaagtggaaagaaagtgatacaactgtctagaaaaacatttgatacagagtatcctaaaacgaaattgacagattgggactttgtagtaacaacagatatatccgaaatgggagcaaatttccgagctgggagagtgattgacccacgacgttgcttaaaacctgtgattcttacagatggaccagagcgggtgatcctggctggaccgataccagttactcctgccagtgctgcccagaggcgtggacgtattggacgtaacccagcgcaagaggacgatcaatacgtattctccggtgacccccttaaaaatgacgaagaccatgcacactggacagaagctaaaatgttactagacaatatctatacacctgaaggaattatcccgaccctatttggtccagaacgtgaaaagacccaggcgatcgatggtgaatttcgactaaggggagaacaaagaaaaacatttgttgagctcatgcgaagaggcgacttgccggtatggttaagctacaaggtggcaagtgctggtatttcgtataaagatcgtgaatggtgttttaccggagaacgcaataatcaaatattagaggaaaatatggaagttgaaatatggacccgggagggcgagaaaaagaaattgagacctaggtggttagatgcacgagtttacgccgacccgatggcactaaaagactttaaggaatttgcctcgggcagaaaatccattacacttgatattttgacagaaatagcaagtttgcctacatacttaagctccagagctaaattagcactagataacatagtgatgttgcatacaaccgaaagaggtgggagggcataccagcatgcgctaaatgaattgccggaatctttagaaactcttatgctcgttgccctattaggcgcaatgacagcaggaatcttcctattctttatgcaaggaaaaggaattggtaagttaagcatgggactaataaccatcgcggttgcttctggattattatgggtcgccgaaatacaaccacaatggattgcagcctcaattatcctagagttctttttgatggtgctgttgataccagaacctgagaaacaacgtacaccacaagataaccaattaatatacgtaatattgacaatcttgactataattggcctaattgccgcaaacgaaatggggcttatagagaaaacaaagaccgacttcggattctatcaggttaagacagagacaacaattcttgatgtagatctccgtccagcaagcgcttggacactatacgctgtggcgactacgatattaacacctatgctccgccacacaatagagaatacaagtgctaatctatcgttagcagcaatagctaaccaagcggctgttctgatgggactagggaaagggtggcctcttcatcgcatggacctaggtgtaccattattagctatggggtgttattctcaagtaaaccccaccactttaaccgctagtctagttatgcttctagttcattacgccataatagggccaggattacaagctaaggcgactagagaagcacagaaaagaacggcggcagggataatgaaaaatcctactgtagatgggattactgtcatcgacctcgaaccaattagctatgatccaaaattcgaaaaacaactaggacaagtaatgttacttgtactatgcgccggtcagctcttactcatgcgaactacatgggcgttttgtgaggtacttacacttgcgacaggaccaattctaactttatgggagggtaatcctggacgtttttggaataccacaatagcagtatccacggctaatatatttcggggaagttatttggccggtgcaggattggcattctctctaataaagaatgcacaaacaccacgtcgagggactggtacgaccggagaaactctaggagagaagtggaagcgacaactgaatagcttagatcgtaaagaatttgaagaatacaaaagaagtggaattttagaagtcgaccgaaccgaagcaaaatcagccttgaaagatggtagcaagatcaaacatgcagtaagccggggcagctcgaagataagatggattgtagaaagaggcatggtcaaacctaaaggtaaggtagtagaccttggttgtggaagaggaggatggagctattatatggctactcttaaaaatgttacagaggtaaagggttacacaaaaggtggccctggacacgaggaacctattccaatggcaacgtatgggtggaatctagtaaaattgcatagtggtgtcgatgtattttataagcccactgaacaagttgatactctattgtgcgacattggagaatcctcatctaatccaacaatagaggaaggaaggacactacgagtattgaaaatggtcgagccatggctatcctccaaaccagagttttgtattaaggtgttaaatccatatatgccaacagtgatagaggaactcgaaaaacttcaaagaaagcacggtggtaacctagtacgatgcccgttaagcagaaattcaacccacgaaatgtactgggtcagtggagctagcgggaatattgtgtcttcagttaatacaacatcaaagatgctgcttaataggttcaccacgcgacaccgtaaacctacgtatgaaaaggacgttgatttaggagcgggcaccagatccgtaagcaccgaaacagaaaagcctgacatgaccataatagggaggagattacaaaggttacaagaagaacacaaagaaacctggcactatgaccaagaaaacccatatagaacttgggcgtatcacggatcatatgaggccccatcaacaggatcagcaagttcaatggtcaatggcgtagtgaaactgcttactaaaccatgggacgtgatccctatggttactcaattagctatgacggatacaactccttttggtcaacaaagagttttcaaagagaaagtcgatacaagaactccccaacctaagcccggtactcgtatggttatgacaacaacagcaaactggttgtgggcgctcctaggcaagaagaaaaaccccaggctatgcacaagagaagagttcatttctaaagtgagatccaacgcagcaataggtgcagtattccaagaagaacagggatggacctcggcaagtgaggccgtcaatgacagccgattttgggaactcgtcgataaagaacgagctctgcatcaggaaggtaaatgtgaaagttgtgtttacaatatgatgggtaaacgagagaagaaactgggggaatttggacgtgctaaaggcagtcgagcaatatggtatatgtggttaggagctcgttttcttgaatttgaagcccttggattccttaacgaagatcactggttcggtcgagagaacagttggagtggagtggagggagaaggtctacaccgacttggctatatactagaagaaatagataagaaagatggggatcttatgtatgcggatgatactgctggttgggatacgcgaattaccgaagatgatctgcaaaatgaagaattgatcacagagcaaatggcgccacaccacaaaatcttggccaaagccatattcaagctcacgtatcaaaataaggttgtaaaagttctcaggcctacaccaagaggagcagtcatggacatcataagcagaaaggatcaacgaggatctggtcaagttgggacatacggattaaacacgtttaccaatatggaagttcaactaatccggcaaatggaagctgaaggagttatcactcaagatgatatgcaaaacccaaaagggcttaaagaacgagttgagaaatggttacgagaatgcggagtagacaggttaaaacgaatggcaataagtggagacgattgcgttgtaaaacccttagatgaacgttttggcaccagcctactatttctaaacgatatgggaaaagtgcgtaaagatataccccaatgggaaccatcaaaaggttggaaaaattggcaagaagtaccattttgtagtcatcattttcataagatatttatgaaagatggacgaagtctagtcgtaccttgtagaaaccaagacgaattaataggtagagcccgcatttctcaaggcgcaggctggagtctaagagaaaccgcgtgcctaggtaaggcgtatgcccagatgtggagcttgatgtattttcatagacgcgatttgcggttagcatccatggctatctgcagtgcagtaccaactgaatggttcccgacgtcccgaacaacgtggtctatacatgcccaccaccaatggatgacaactgaagacatgctaaaagtctggaatagggtctggatagaagacaatccaaatatgatcgacaaaacacctgtacactcatgggaagacattccatatttaggaaaaagggaagatctctggtgcggatctctaataggcctcagcagtcgagctacatgggccaaaaacatacatacagcgatcactcaagttagaaatttaataggaaaagaggaatacgttgattatatgccggtcatgaaaagatatagcgctccctccgaatctgaaggagttctttaa

SEQ ID NO: 23622 - RNA, 9867 nt, synthetic construct
  misc_feature 1..9867: note = derived and/or modified CDS sequence (opt6) from DENV-4__FJ882601__SS-prME
  source 1..9867: mol_type = other RNA
tctacgatcactttactatgtctaataccgactgtcatggcctttcatttatcgacgcgagatggcgaacctttgatgatcgtcgcaaaacatgaaaggggaagacccttacttttcaaaactaccgaaggcataaacaaatgcaccctaatagccatggatctaggggaaatgtgcgaagatactgtaacctacaaatgtccactcctagtcaatactgaaccagaagacattgactgttggtgcaatttaacaagtacttgggtaatgtatggaacatgcacacaatcaggcgaacggaggcgtgaaaaacgaagtgttgcacttacaccacacagcggtatggggttagaaacgcgcgcagaaacatggatgtcgagtgaaggggcttggaaacacgcacaacgagtagaaagttggatactaagaaatcccggatttgcacttctggctgggttcatggcctacatgataggtcaaaccgggatacaaaggacagtgttctttgtactgatgatgttagtcgcaccgagttacggaatgcgatgcgtcggggtaggtaatagagatttcgttgagggtgtctcaggaggcgcgtgggtcgacttagtacttgaacacgggggatgtgtaaccacaatggcgcaaggtaaaccgacacttgattttgaattaaccaaaacaactgctaaagaggtagctctacttagaacatactgtatagaagcgagtataagtaacataaccacagcaacgagatgtcctactcagggagagccatatctgaaagaagaacaggatcaacaatacatttgccgacgggatgtagtagatagaggatggggaaatggatgcggtttgtttggcaaagggggtgtagtgacatgcgctaaatttagttgtagcggaaaaatcacaggaaacttagtccaaatagaaaaccttgagtacacagtagtagtaacagttcataatggagatacacatgcggtaggaaatgacacttctaaccatggagtcacggctactataacacctaggagcccctccgtagaagttaagctacctgactatggggagttaacactagactgtgaaccccggtcaggtatcgacttcaacgaaatgatacttatgaagatgaagaagaaaacgtggcttgtacataaacaatggtttttagacttacctttaccgtggactgctggtgcagacacgtcggaagtacattggaattataaggagcgaatggtaacttttaaagtccctcacgctaaacgacaagacgttactgtattgggaagccaagagggtgctatgcatagcgcccttgcaggcgcaacagaagtcgactcaggagatggtaaccacatgtttgccggacatttgaaatgcaaggtaaggatggagaaattaagaatcaagggaatgtcgtatactatgtgctctggaaaattttcgattgacaaagaaatggcggaaacacaacacggtactacggttgtgaaagttaaatacgagggcgcaggcgctccttgtaaggtcccgattgaaataagagatgttaacaaagagaaagtcgtaggaagagttatttccagcacacccctagcggagaatactaactcagtcaccaatattgagcttgagccgccgtttggcgacagctacattgttataggcgttggaaattccgcgcttacattacattggtttaggaaaggaagctcgatagggaaaatgttcgaaagcacgtaccgaggcgcaaagcgaatggcgatattaggcgaaacagcgtgggattttggaagtgtaggaggactattcacaagtctaggcaaagcagtacatcaagtatttggatctgtttatacaacaatgttcggaggtgtttcctggatgatacgtattctaataggctttttagtcctctggataggcacaaattcaagaaatacttcaatggctatgacttgtattgctgtaggtggaattacgttgtttttaggatttaccgtacaagccgatatgggttgcgtagtttcttggagtggacgggaactcaaatgcggttcgggaatttttgtagtagataatgtgcatacctggacagaacagtataaatttcaacccgaatcacccgcccgactagcgtcagcaatattgaacgcacacaaggatggagtatgcggaataagaagtacaacccgcctagaaaatgttatgtggaagcaaataacgaatgaactaaactacgtactgtgggaaggaggacacgacctaaccgtagtagctggagatgttaaaggagtacttaccaaaggtaaacgtgcattaacccctcccgtatcagacctaaaatactcgtggaaaacttggggtaaggccaaaatttttaccccagaggcgcgcaatagtacattcttgatagatgggcccgacacaagcgaatgcccgaatgaaagacgagcctggaatagtttggaagtcgaagattatggatttgggatgtttacaacgaacatctggatgaagtttcgagaaggatcaagcgaagtttgtgaccatagactaatgtcggccgccattaaagaccaaaaagcagttcatgctgacatgggctattggattgagagtagcaaaaaccagacttggcaaattgaaaaggcgagtttaatagaagtaaaaacttgtctgtggcctaaaacacacacactgtggagtaatggagttttagaaagtcaaatgttgatccctaagtcttacgcaggaccattcagccagcacaattacagacaaggttacgcaacacaaacagtagggccgtggcaccttggaaagttagagatagattttggagaatgcccaggaacaacagtcacgatacaagaagattgtgaccaccgtggaccctcactgagaacgacaacagcaagcggtaagctagttacgcagtggtgctgcagatcatgcacgatgccacccttaagatttctgggcgaggacggatgttggtacggtatggaaattaggccattgtctgaaaaagaagaaaatatggtgaaatctcaagtcgccgctggacaaggaacatcagaaacattctcgatgggcttgctatgtttgaccttatttgtagaagagtgcctaagacgacgcgtcacgcgcaaacatatgatcctcgcggttgtgattaccttatgtgccataattctaggcggattaacatggatggacttacttagagcactcatcatgttaggcgatacaatgtctggtcggattggaggccagactcacctcgcaataatggcagtctttaaaatgagcccagggtacgttttgggcgtttttctgcgaaaactaacatcacgagaaacagctcttatggtaattggaatggcaatgaccaccacattgtctataccgcatgatctcatggaattaattgatgggatttctctcggcttaatcctacttaaaatagtaacacaatttgacaatacacaagtcggtactttagctttatccttaacatttattcggtccacaatgagtctagtcatggcttggaggacaataatggcagttttatttgtcgttactttaataccattatgccggacatcgtgtctccagaagcagtcgcactgggttgaaattaccgcgcttattctaggggcacaggcattgcctgtttacttgatgacgctgatgaagggagcatctaggagatcttggccattaaatgaaggaataatggcagtaggattagttagtttacttggaagtgcactactcaaaaatgacgttccgcttgcaggaccaatggtggcaggcggattgttattggcagcctacgttatgagtggttcaagcgccgatctttccttagaaaaagctgcaaatgtccaatgggatgagatggctgatataacgggatcgtctccaattatcgaagtaaagcaagatgaagatgggtcattcagtataagggacgttgaagaaaccaacatgattactctgctagtgaaattagccttgattactgtatcgggtctttacccattagctataccagttacaatgaccctgtggtacatgtggcaggttaagacgcaacgatcgggcgctttatgggatgtgccaagtccagcagcgacacaaaaagccgctcttagcgaaggggtgtacaggatcatgcaacgaggattgtttggtaaaacgcaagtaggagttggcatacatatggaaggcgtgttccatactatgtggcatgttaccagaggatcagtgatctgccatgaaactggtagactagaacccagctgggctgacgttagaaatgatatgatatcctacgggggagggtggaggcttggcgataaatgggacaaagaggaagacgtgcaagttctagccatcgaaccaggaaagaatccaaaacacgtacaaactaaaccgggtcttttcaagacgctaacgggtgaaattggtgctgtgacattagacttcaagccaggaacatcaggaagtcctatagtaaataggaaagggaaagtaataggtttgtatggaaacggggtggtgaccaaatccggagactatgttagcgctataacgcaagcagaaagaatcggagaacctgattatgaagtagatgaagacattttccgaaagaaaagactgacaatcatggacctacatccaggtgctggaaaaaccaaaaggatattgccaagtatagttagggaagcattaaaacgacgactcagaaccctaatactagccccaacaagagtggtcgccgcggaaatggaggaggctttacgtggattacctatccgttatcaaactccagccgttaagtcggaacacacgggcagagaaatagtggatttaatgtgtcatgcaacctttacgactagacttttatcgtcaacacgagtaccgaattacaatctaatcgtaatggacgaggctcattttacagatcccagtagcgtagctgctcgtggttatataagtacaagagtggaaatgggagaagccgccgctatatttatgacggcaacaccgccaggcgcaacagacccgtttccccaatcgaatagtccaattgaagacatagaaagagaaatacctgagcgttcgtggaatacaggttttgattggataaccgattatcaaggcaaaactgtttggttcgtaccatctataaaggcaggaaatgacattgcaaactgccttaggaaaagtggcaagaaagttatacaattatccaggaagacctttgacaccgaatatccaaagaccaaacttaccgattgggatttcgttgtcacaacagatataagcgagatgggtgctaacttcagggcaggaagagtaattgatccaaggcgctgtttaaaaccagtgatactaactgatggaccggagcgcgtaattctagcaggcccaattccagtaactcccgctagtgccgcacaacgccggggacggatcggccggaatcctgcccaagaagatgaccagtatgtgttttctggcgacccactgaagaatgacgaagatcatgctcattggacagaagctaaaatgctgctagataatatctacactccggaaggcattattccaacattatttggaccagaaagagagaaaactcaagcaatagatggggaatttcgtctaagaggtgaacaaagaaagacattcgtcgaacttatgaggcggggtgatctaccagtctggttatcctataaagtcgcgtctgcaggaatatcttataaagatagagaatggtgttttacgggagagcgaaataaccaaatattagaagaaaacatggaagttgaaatatggacgagagaaggagagaagaagaaactacgtccgcgatggttagatgctagagtgtatgcagatccaatggcacttaaagacttcaaagaatttgcaagcggaagaaaaagtataactctagatatactaacggagattgcctccttgccaacatatctgagctcgagagcaaaactggcattagacaacatcgtgatgctacatactactgaaaggggaggacgagcctatcaacacgctttaaatgagcttccagaatcattagaaacactgatgctggtggcattgctcggtgcaatgacagcaggaatatttttgttctttatgcaggggaaaggtattggaaaactatcaatgggactaataacaatagctgtggcaagcggtctactatgggtagcagagattcaaccccaatggatagcagcatctatcattctggaatttttcttaatggtattgctcatacccgaaccagaaaagcaacgaactccgcaagataatcaattgatatacgtgatacttgcgattctcacgattattggattgatagccgccaatgaaatggggttaatagagaaaactaaaactgattttggattctatcaggaaaagacggaaactacaattttagatgtcgatttaagacctgcaagtgcttggacactatatgcagtcgcaactactatattaacacccatgcttcgacacacgattgagaatacatcggcaaacttatcgttaacagccatcgcaaatcaagcagcagttctaatgggactaggtaaaggatggccgcttcatcgaatggacttgggcgttccccttcttgccatggggtgttattcacaggtaaatcctactactctcacagcaagtttagtgatgcttctggtacattacgccataattggcccaggattacaagccaaagcgactagggaggcacttaagaggacagctgctggaataatgaagaatcctactgtagatggcataacggttattgacttagaaccgataagttatgacccgaagtttgagaagcagctaggtcaagtaatgctgcttgtactatgtgcaggccaattattgctgatgcgaacaacgtgggccttctgtgaggtgctgactcttgcgactgggcctattttaactctatgggagggtaacccaggccgtttttggaacacgactatagccgtcagtacagcaaacatttttagaggtagttacctagccggtgcggggctagcattttctttaattaaaaatgtacaaacacctcgacgcgggacaggaacaaccggagagactcttggggagaagtggaaacggcaattaaattccttagatcgaaaagagttcgaagaatataagaggtcaggcatcctcgaggtggatagaactgaggcaaagtctgccctcaaagatgggtctaagataaagcatgcagtctctcgtggctcaagcaaaatcaggtggattgtagaaagggggatggtcaagcctaagggcaaagtagtcgatctcggatgcggaagaggaggatggtcatattacatggcgacattgaagaacgtcacagaggtcaaaggttatacgaaaggtggacccggacacgaggaaccgattccaatggctacctacggatggaatttagtaaaattgcactcaggagttgacgtattttataaaccaacagaacaagtcgataccttactctgcgatattggagaatcatcgagtaatccaacaattgaagaaggcagaacactccgtgtactaaaaatggtagaaccttggttatccagtaaaccggaattttgtataaaagttttaaatccttatatgcctactgtaattgaagaacttgagaagctacagagaaaacatggcgggaatctagtaagatgtcctctctcgagaaactcaacgcatgaaatgtattgggtgtcgggagcatctggtaatatagttagctcagtaaatacaacttcaaagatgctattgaataggtttaccactagacacaggaaaccgacatatgagaaggatgtggacttaggtgcaggtacaagaagcgtatcaactgaaacagaaaaacctgatatgacaataattggaaggagacttcaaagactacaagaggagcataaagaaacctggcattacgatcaggagaacccatacagaacgtgggcataccatggatcgtatgaagctccatctacgggaagcgcatcctcaatggtgaatggagtggtaaaactactgactaaaccttgggatgttatccctatggttacccaactagcaatgacagatacgacaccattcggacagcagcgagtattcaaagaaaaagttgacacaagaactccacaacctaaacctggtactagaatggttatgaccacgactgcaaattggttgtgggcgctcttagggaaaaagaaaaatccaagactctgcacacgggaagagtttatcagtaaagttagaagtaacgcggcaataggagcagtatttcaagaggagcaaggctggacaagtgcctccgaagctgtcaatgattcgaggttttgggagctagtagataaagaaagggcgctacaccaagaagggaagtgtgaatcatgtgtctataatatgatgggtaaaagagagaagaaattaggagagttcggacgcgcaaaaggtagcagggcaatttggtatatgtggctaggagctaggttcctagaatttgaagcattaggtttccttaacgaggatcactggtttggaagagaaaattcatggtcaggagttgaaggagaaggtttacacagacttggctacatattggaagaaatagacaagaaagatggggatctcatgtatgccgacgatactgcaggatgggatactcgaataacagaagatgatcttcaaaatgaggaactggttacagaacagatggctccccatcacaaaatacttgccaaggctatttttaaactcacatatcaaaataaggtcgtcaaagtattaaggcctactccacgaggggcagttatggatattatcagcaggaaagatcaaagaggttctggccaagttggtacttatggcttaaatacatttactaatatggaagtgcaattgataagacaaatggaagcagaaggggttataacacaagatgatatgcagaatcccaaaggcctgaaagaacgagtagaaaaatggctaagagagtgcggagtggatcgcttaaagagaatggcgattagtggcgacgactgcgttgtaaagccgctggacgagcgcttcggtacgtcccttcttttcttaaacgatatgggaaaagttagaaaagacatacctcaatgggaaccttctaaaggttggaaaaactggcaggaagtcccgttttgctcgcatcactttcacaaaattttcatgaaggatggaaggtccttagtagttccttgtagaaatcaagacgaactgattggacgagcaagaatttcccaaggcgcaggatggagtttacgagaaacagcttgcctaggcaaggcttatgctcagatgtggtctttaatgtatttccatagacgagacctaagacttgctagtatggctatttgcagtgcagttcctactgagtggtttcccacaagtagaacaacatggtcaatacatgcgcaccatcaatggatgactactgaggacatgttgaaggtatggaacagagtttggatcgaggacaatccaaacatgatagacaaaacaccagtacatagttgggaagatattccataccttgggaaacgagaagatctatggtgtggttctttaattggactaagttccagggcaacgtgggcgaaaaatattcataccgcaattacacaagtgcgtaaccttataggaaaagaagaatatgtagactacatgccggtaatgaaaagatatagtgcaccatcagagtcagaaggagtattgtag

SEQ ID NO: 23623 - RNA, 9867 nt, synthetic construct
  misc_feature 1..9867: note = derived and/or modified CDS sequence (opt6) from DENV-4__FJ226067__SS-prME
  source 1..9867: mol_type = other RNA
tctacaataacactactatgcctcattcccacagtgatggcattccatttatcaactagggatggggaacctcttatgattgtcgcaaaacacgaacgggggagacctctattgttcaaaaccactgaaggaatcaataaatgtacattgatagccatggatttaggtgaaatgtgcgaagacactgtaacgtacaaatgtccattgctagttaatacagaaccagaagatattgattgttggtgcaatcttacatccacatgggtaatgtacggaacgtgtacccaatcaggagaacgacggagggagaaaagaagtgtagctttgactccgcactcaggcatgggcttagaaacaagggccgagacgtggatgtcatctgaaggagcctggaaacatgcccaacgagtggagtcatggattctaaggaaccctggattcgcattactggcaggattcatggcatacatgatcggacagaccggcattcagcgaacggtatttttcgtcctgatgatgcttgtagcgccctcgtatggtatgagatgtgtgggagtaggaaatagagatttcgtagaaggggtaagcgggggtgcttgggtagatttggttttagaacatggagggtgtgtaacaacaatggcacaggggaaaccgaccttagatttcgaactgacaaaaacaaccgcgaaagaggtagcactactacgaacttattgtatagaggcttcaatttctaatataactactgcaacccgttgccctacacaaggcgaaccatatctgaaagaagaacaagatcaacaatacatatgccgtcgagacgtagtggacagaggatggggaaacggctgtggactattcggaaaaggtggggtggtaacttgtgccaaattctcttgtagcgggaaaataacaggaaacctagtgcaaatcgaaaatttagaatacaccgtggtggtgacagtgcacaacggagatacacatgcagtaggaaatgatacaagtaaccacggagtcactgcaacgattacaccacgtagcccatctgtggaagtaaaacttcccgactacggcgaactaacgttggactgcgaacccaggagtggtattgattttaacgaaatgattttaatgaaaatgaaaaagaaaacatggttggttcataaacaatggttcttagatttaccattaccgtggaccgcaggcgccgatacctcggaggttcactggaactataaagagagaatggttacctttaaagtaccacatgccaagcggcaagacgtaactgtattaggttcccaagaaggagcaatgcattctgctcttgctggggctacggaagtggatagcggagatggaaaccatatgtttgctggacacttgaaatgcaaggtacgaatggaaaagttaagaattaaaggtatgtcatataccatgtgctccggaaaattcagtattgacaaagaaatggcagaaactcagcatggtactacagtagtaaaagttaaatatgaaggtgccggagcaccttgcaaagtgccaattgaaatacgagatgttaacaaagaaaaggtagtcgggagggtaatctcctctacaccattagcagaaaacactaatagcgtaactaatatagaacttgagccaccattcggcgacagctatatagtcattggtgttggcaacagtgctttaactttacactggtttcgtcgcggttctagcattggaaaaatgtttgaaagcacgtatcggggtgcgaaaaggatggcgatcttaggggagacagcatgggatttcgggtccgttggagggctatttacgtctcttgggaaagctgtacaccaggtctttgggtcagtatatacaacaatgtttggtggagtgtcgtggatgatacggatcttgattgggttcttagtattgtggataggtactaattcacgaaatacatcaatggcaatgacatgtataaccgtaggcgggataaccctttttctggggtttacagtacaagccgatatgggctgcgttgtatcttggtctggtcgcgaattgaaatgcgggagcggaatattcgttgtggataatgtgcacacatggacggaacagtataaatttcaacccgagtcaccagcaagattggccagcgcgattctaaatgctcataaggatggagtttgcggaatcaggagtactaccagattggaaaatgtcatgtggaaacaaataacaaatgagcttaattatgcgttatgggaaggtggacacgatcttacagtagtagctggagatgttaaaggagtactaacaaaagggaaacgggcattaacccctcccgtgagcgatctgaagtattcatggaaaacttggggcaaagcaaaaatctttaccccagaagcaagaaactcaacgttcctaatagatggtccggacactagcgagtgtccaaatgagcgccgagcatggaacagtttggaagttgaagactatggatttggaatgtttacaactaatatatggatgaaatttagagaaggcagcagcgaagtatgtgatcaccgactaatgagcgcagcaattaaagaccagaaagcagttcacgctgatatgggttattggattgagagcagcaaaaatcaaacatggcaaatagaaaaagcaagtctgattgaggtaaaaacatgtctatggccaaagacacatacgctatggagcaatggagtactggaatcacaaatgttaattcctaaatcctacgcgggaccattcagtcaacataattaccgacagggatacgccacgcaaacagtaggaccctggcatttaggaaagttggagatagatttcggcgaatgccccggaaccacagttactatacaagaagattgtgaccatcgcgggccctccctacgaacaacaacagctagcggaaaattagttacgcaatggtgttgcagaagttgtactatgccacctctgagatttttaggcgaagacggatgttggtacggaatggaaattagaccgttaagtgaaaaagaggagaatatggtgaaaagccaagtcacagcaggtcaaggaacaagcgaaactttttcaatgggcctgctatgccttacgctttttgttgaagaatgcttgaggcggagagttacaagaaaacacatgatcctagtcgttgtaatcacactatgcgcaataatcctaggaggactaacctggatggatctactcagagcactcattatgttaggagatactatgtccggcagaatcgggggacaaatacaccttgcaataatggccgtatttaaaatgtcccccggctatgttttgggagtatttttaagaaaattaactagcagagaaaccgcattaatggtaatagggatggccatgacaacagtcttgagcattccccatgacttaatggaattaatagatggcattagcctcggtttaatattgctaaagatagtgactcagtttgataatactcaagttggaacgcttgccttgagtctgacatttatacgttcgactatgcctttggtcatggcatggcggacaattatggcagtcttatttgtcgtgactctcataccgctgtgtcgaacaagctgtcttcaaaaacagagtcattgggtggagataactgcactaatactaggtgctcaggcattaccagtatacctcatgaccctaatgaagggggcgtcacgaagatcatggccgttgaacgagggaataatggcagttggcctagtttctttacttggatcagcattactaaagaacgatgttcctctcgctgggcccatggtcgctggcggcttacttcttgcggcatacgtaatgtctggatcatcagcggacttaagtctagaaaaagctgcgaatgtacaatgggatgagatggctgatatcacaggatcctcacctatcatcgaggtcaagcaagacgaagacggttcattttccataagggatgttgaggaaacaaacatgataactttattggtcaaattagcattgataacagtatcagggttatatcccttagctatcccagtgaccatgacattatggtatatgtggcaagtaaaaacacaaagaagtggtgcgctatgggatgtgccttctcctgccgctacccaaaaagcggcattatcggaaggtgtgtatcgtataatgcaaaggggtctgtttggaaagacgcaagtgggagtgggtatacatatggaaggtgtatttcatacgatgtggcatgtgactcgaggctcagtaatatgtcatgaaacaggtagactggaaccatcatgggctgatgtccgaaatgatatgatttcttatggtggtggatggaggctaggggataaatgggataaagaggaggatgtgcaagttctagcaattgaaccaggcaaaaatcctaaacatgtgcaaacaaaaccaggattatttaaaacattgacaggcgaaataggagcagtaacgctggattttaaaccaggaacatccggaagccccataatcaatagaaaaggcaaggtaataggactatacggaaacggggtggttactaagtcaggtgattatgtaagtgccattactcaagcagaaagaattggggaaccagattacgaagttgatgaagatatttttcgtaagaaacgattgacaataatggatctacatcctggtgctggtaaaacaaaaagaatactacctagtatcgttagagaagcgttaaaacgacgattacggacactgatacttgctcccactagagttgtcgctgccgagatggaggaagcattgcggggacttccgatacgttatcaaacaccggcagttaagagtgaacatacaggtcgagagattgttgacctcatgtgtcatgccacatttacaactcgacttctatcttcaactagagtcccaaactacaatttaatagtgatggatgaagcacactttactgatccatcctcagtcgccgctcgtggatacatttcaactcgcgttgagatgggtgaagctgccgccatatttatgacagcgacaccacctggagcgactgatccgtttccacaatccaacagccccatagaagatatagaacgggaaatcccagaacgctcgtggaacacaggcttcgattggattactgattatcaaggaaaaaccgtatggtttgtaccctccatcaaagcagggaacgacatagctaactgcttaagaaaaagcggaaagaaagtaatccaattgtctagaaaaacattcgatacggagtatcctaaaacaaaacttactgattgggatttcgtcgttacaacagacatatcagagatgggagcaaacttccgggctggcagggttatagatccacgaagatgccttaaaccagttattctaacagacggcccagagagagtaatcctagccggtccaattcctgtaaccccagcctcagcggcccaaagaaggggcagaataggccgaaacccagctcaagaagatgaccaatatgtattcagtggagacccactcaaaaatgatgaagatcatgcccactggacagaagcgaaaatgttgcttgataatatctacaccccagaaggaataattccaaccctatttggaccagagcgagagaaaactcaagctattgatggtgaatttagattacgaggtgaacaaagaaaaacatttgttgagctcatgcgacgtggcgatctaccagtatggttgtcttacaaagttgccagtgccggcatatcctataaggatcgcgagtggtgttttaccggtgaacgaaataatcagatactagaggaaaatatggaagtagaaatatggacccgagaaggtgagaagaagaaactcaggcccaggtggttggatgccagagtctacgctgaccctatggcacttaaggacttcaaggaatttgccagtggtcgaaaatcaataacactagatatactaacggagatcgcgtctctccctacttatctttcatcaagagccaagttagctttggacaacatagttatgctccacaccacagaaagaggcggccgtgcatatcaacatgccctaaacgaactaccagagtcattagaaacgttaatgttagttgcccttctgggtgcaatgacagctggaatctttttatttttcatgcagggaaaaggaattgggaagctatctatggggttaatcgcgatagcagttgcaagcggcttactctgggtagcggaaatacaaccacaatggattgcagctagcattatcttagagttcttcctcatggtgttactaataccggaacctgaaaagcagcgaacgccacaagacaatcaactaatatatgttattcttaccattttaacgataattggtctgatcgctgctaatgaaatgggattaatagagaaaaccaaaacagacttcggtttttaccaggttaaaacagaaacaactatattagatgtcgatctgaggccggcaagtgcgtggaccctgtacgcagtagcgaccactatattaacccctatgcttagacacaccatagaaaacacatctgctaatttaagtcttgcagcaatcgcaaatcaagcagctgtattaatgggtctaggaaagggatggccccttcacaggatggaccttggcgtccccctattagccatgggttgctactcacaggtaaatcctacaacgttgaccgcttccttagtaatgctcctagttcattacgcgattattggccctgggttgcaagcgaaggctactagggaagcgcagaaaagaactgcggcaggaatcatgaagaatcctacagtggatggaatcacggtaatagatttagaaccaatatcttatgatcccaaattcgagaaacagttgggacaagtaatgcttctagttttatgcgcaggacaattgcttctaatgagaacgacctgggctttttgtgaagttttaacactagccactggaccgattcttactttatgggaggggaacccaggacggttctggaatactactatagcagtcagcacggctaatatattccgaggtagttatctcgcaggggcgggactcgcattttcactcattaaaaatgctcaaacacctagaaggggtacaggaacgacaggcgaaacattaggggaaaagtggaaaagacaattaaactcacttgatcgcaaggagttcgaggaatataaaagatcgggcattcttgaagtagatcgaacagaagcaaaatcggcactgaaagacggatcgaaaatcaaacacgccgtatcgcgcgggtctagtaagataagatggatagtagaacgtggaatggttaaacccaaggggaaagtagtggacttggggtgcggtcgaggtgggtggtcatattacatggcaaccctgaagaacgttaccgaggtaaagggatacacaaagggaggacccggccatgaagaaccaatccctatggcaacatatgggtggaatttagtgaagctacattccggtgttgacgtcttttacaaaccgactgagcaagttgatacactactatgtgatataggagagtcatcttctaatccaacgatagaagagggtagaacattgagagtgttaaaaatggtggaaccatggttgagttcgaagccagagttttgcataaaagttttaaacccgtacatgccgacggtcatagaggaattggaaaaactccaacggaaacatggaggaaacttagtacggtgtccactctctagaaatagcacccatgaaatgtattgggtgtcaggggcgtccggaaacatagtttctagcgtgaacactacgagtaaaatgttattaaatagattcactaccaggcatagaaaaccaacatacgaaaaggatgtagatttaggggcagggacgagatcagtatccaccgaaacggagaaacctgatatgactattatcggaagacgtttacaaaggttacaagaggaacacaaagaaacatggcactatgaccaagaaaatccataccgaacatgggcatatcatggatcttatgaagcacctagtacagggtccgcgagtagtatggtaaatggagttgtaaagttacttacaaagccctgggatgtcattccgatggttacacaactagcgatgactgatacaacaccatttggacaacaaagagtgtttaaggaaaaagtggacacaagaacaccacagcctaagccaggtacgaggatggttatgactacaacggctaactggctctgggctctgctgggcaagaagaaaaatccccgtctatgtacaagagaggaatttatatctaaagtaagatccaacgctgccataggtgcagtatttcaagaagaacagggctggacttcggcaagtgaagcagtgaatgactcgcggttttgggaattggtagacaaggaaagagccctacaccaggaaggcaaatgtgaatcgtgtgtgtacaatatgatgggaaaaagagagaagaaattaggagaatttggcagagctaagggaagccgggccatatggtatatgtggttaggtgctaggttcttagagtttgaagctcttggcttcttaaatgaagatcattggtttggtcgggaaaattcctggagtggggtagaaggtgaagggcttcacaggttgggttacatattggaagaaatagataagaaagacggagacttaatgtatgccgatgatactgcgggctgggatacacgaatcaccgaagacgacttacagaacgaagagttaatcacagaacaaatggccccacaccacaaaatattagcaaaggcaatttttaaattaacttatcaaaacaaagtagttaaagtgctacggccaaccccaaggggtgcggtgatggatatcatcagccgtaaggaccaaagaggctcgggacaggtaggtacgtatggacttaacacttttacaaatatggaagtacagctaattcgacaaatggaagcagaaggagtcataacacaagacgatatgcaaaatccaaaaggattaaaggaacgtgtggaaaaatggctaagagaatgcggcgtggacagactgaaacgcatggccattagtggcgacgactgcgtagtaaaaccattagatgaacgatttggtacgagtctactatttctcaatgatatgggtaaggtacgaaaagatattcctcagtgggaaccatcaaaaggatggaaaaattggcaagaagtacctttctgttctcaccattttcacaaaatattcatgaaagacgggaggagtttagttgttccctgtagaaaccaagatgagttaatcggacgggcacggatatcacaaggtgctggatggagcttgcgagaaacagcttgtttaggtaaggcttatgcgcagatgtggtcactgatgtatttccatcgtcgggatttaaggttagccagtatggctatttgtagtgcggtaccaaccgaatggtttccaaccagtagaacaacatggtcgatacatgcccatcaccaatggatgacaacagaagatatgttaaaagtatggaaccgagtgtggattgaagataatccgaacatgaccgacaaaaccccagttcatagttgggaggatataccctacttgggaaaacgcgaggatctatggtgtggaagtttaataggattgtcgtcacgcgccacgtgggctaagaatattcatacagcaataacgcaggtcagaaacttaataggtaaggaagaatatgtcgattacatgccggttatgaaaaggtattcagcgttgagtgagagtgagggagtattgtga

SEQ ID NO: 23624 - RNA, 9867 nt, synthetic construct
  misc_feature 1..9867: note = derived and/or modified CDS sequence (opt6) from DENV-4__EU854299__SS-prME
  source 1..9867: mol_type = other RNA
tcaactatcaccttgctatgtttaatacctaccgttatggcatttcacttaagcacacgagacggtgaacctttgatgatagtcgcaaaacacgaaagagggagaccactactttttaaaacaactgaaggtataaataaatgcacactaatagctatggatctgggagaaatgtgtgaagacaccgtcacctataaatgtcccttattagtaaatacggaacctgaagacattgactgttggtgcaatctaacatcaacctgggttatgtatggaacctgcactcagagtggagaaaggcgtcgcgagaaaaggtccgtagcccttacaccccactccggaatgggattagaaacccgggcggaaacgtggatgtcttctgaaggggcgtggaaacatgcacaacgagttgaatcatggatccttcggaatccaggatttgcgctcttagccggatttatggcgtatatgatcgggcaaacagggatacagagaactgtgtttttcgtgctaatgatgttagtagctccgtcatatgggatgagatgtgttggagtaggtaaccgcgatttcgtagaaggagtatcaggtggagcatgggtggacctagtactagaacacggcggttgtgttactacgatggcacaaggcaaacccactctagattttgaactaactaaaacgactgcaaaggaagtggcactacttagaacatattgtatagaagcattaatctcaaatatcacaactgctactagatgtccaacacaaggagaaccttacctcaaagaagaacaagatcaacaatatatttgtcgtcgcgacgtcgttgatagaggttggggcaatggatgtggattatttggcaaaggaggagttgttacgtgtgcaaagttctcatgtagtggaaagatcacaggtaatctagtccagatagaaaatctagaatataccgtcgtagtaacagttcacaatggggacacacacgcagtaggcaacgacacatctaaccacggagtgacagcgacaataactccgcggtctccttcagttgaagtcaagttgccggattatggggaattaacattagattgcgaaccgcgcagtggaatagactttaacgaaatgatactgatgaaaatgaagaagaaaacttggctagttcacaaacagtggttcttagacctaccgctaccttggactaccggtgcagacacaagtgaagtacattggaattacaaagaacgaatggtcacttttaaggttccgcacgcaaaaaggcaggatgtaaccgtacttggatcccaggagggtgctatgcattccgcacttgccggtgcaactgaagttgattctggcgatggcaaccacatgtttgcaggacacttaaaatgtaaagttagaatggaaaaattaagaataaaaggcatgagctatacaatgtgcagtggtaaatttagtatagataaagagatggcagaaactcaacatggtacaacagtcgtaaaagtgaaatatgaaggagccggagcaccatgcaaggtgcctattgaaatacgtgatgttaacaaggaaaaagtagtaggaagagtaatctccgcaactccacttgccgaaaatacaaatagcgttacgaatattgaattggaaccaccttttggagactcttacattgtcataggagtcggcaacagcgctttaaccctacattggttccgcaaggggtcatcaataggaaagatgtttgagtcaacataccggggcgccaaaagaatggcaattttgggagagacggcctgggactttgggagtgtagggggattattcacctcactaggaaaggcagttcaccaggtgttcggatcagtttacactacgatgtttggaggcgtttcttggatgattcggattctcatcggatttttggtattatggattggaacgaatagtaggaacacaagcatggcgatgacatgcatagccgtgggtggcataacgttattcctaggttttacggtacaagcggacatgggatgtgtcgtgagttggagtggccgagagctaaagtgcggaagtggaatttttgtagttgacaatgtccatacatggacagaacaatataaattccaacctgaatcacccgcgagactagcttctgcaatcttaaacgctcataaagatggggtgtgcggcattcggtcgaccactcgtcttgagaacgtcatgtggaaacagattacaaacgaattgaattatgttttgtgggaaggaggacatgatctaacagtagtcgctggtgacgtcaaaggtgtattaactaaaggaaagagagcactaacgcccccagcatcagatctcaaatattcgtggaagacatggggaaaggctaaaatctttacgccagaagctcgcaatagtacatttttaatagatggtccagatacaagcgaatgcccaaatgagcgacgagcatggaactcatttgaagtcgaagattatgggttcggtatgttcacaacaaatatatggatgaaatttagagaaggatcctcagaagtatgtgaccatagattaatgagcgcggcaataaaggaccaaaaagccgtgcacgcagacatgggctattggattgaatctagcaaaaatcaaacatggcaaattgagagggcctccttaatagaggtcaaaacttgcttatggccaaagacacacactctatggtcaaacggcgtacttgaatcacaaatgcttataccgaaatcatacgctggaccatttagtcaacacaattataggcaaggctatgcaactcagacagtaggaccttggcatctcggaaagttggaaattgactttggagagtgccctggaacaactgtgacaatacaagaaaactgtgatcatcgagggccgtcgctcagaacaactactgcaagcggaaagttagtaacacaatggtgttgccgcagctgcacaatgccgccattgcgatttctaggagaagatggttgctggtatgggatggagataaggccactaagtgagaaagaagagaatatggtgaaaagtcaggtaacagcgggacaaggaacaagtgaaactttttctatgggcttactgtgcctgacattgttcgtagaggagtgtctgagaagaagagtcactcgtaaacatatgatattagcagttgtgataacattgtgtgccataatactaggaggattaacttggatggatcttttaagagcgctaattatgcttggtgatacgatgtcgggacgaatagggggtcagacgcatcttgccataatggctgtattcaagatgagcccgggttacgtattaggagtgttcttacgcaaactaacttcaagagaaacggcgctgatggtcataggtatggccatgacaaccactttatcgataccccatgatctaatggaattgatcgacgggatttcattaggcttgatattattaaaaatcgtaactcaattcgataacacgcaggtagggacgctagccctatcccttactttcattaggagcacgatgagtttagttatggcatggcgaacaataatggccgttttgtttgtcgtaactctaattccgctatgcagaacatcatgtcttcagaaacaatcgcactgggtagagataacagcattaatcctaggggcacaagcattaccagtctatcttatgacattgatgaagggagcaagtagacgatcatggccattgaacgagggaattatggctgttggcctagtatcattactcggctcagcgttactaaagaacgatgtacctttagcgggtccaatggtcgctggaggattattgttagcagcatacgtaatgtccggctcatccgctgatctttcacttgaaaaagcagcaaacgtgcaatgggatgaaatggcagatattacgggttcaagccctatcatagaagttaaacaagacgaagacggttcgttctcaattcgcgatgtcgaagagacaaacatgattacactattagttaaactagctctgataactgtgtccggtctgtatcctctggctattccaataaccatgactctgtggtacatgtggcaagtaaagacacaacgtagtggcgctctttgggatgtcccaagtcctgcagcaacacaaaaagcggcgctatccgaaggagtgtaccgaataatgcaaagagggcttttcggaaagacccaggtgggcgtaggtatacatatggaaggtgtctttcacacaatgtggcatgttaccagaggatcagtaatatgccatgaaacgggtcggctagagccatcttgggcggacgttagaaatgacatgatcagctatggaggagggtggagactcggagataaatgggataaagaagaagacgttcaggttttggcaattgaacctggcaaaaatcccaaacatgtccaaacaaaacccgggttatttaagacattgacgggtgagattggtgcggtaactctagacttcaaaccgggaacatcgggtagcccaataattaatcgaaagggaaaagttataggattatatggtaacggcgtggttaccaaaagtggagactatgtaagcgcaataacacaagccgaaaggataggcgagccagattatgaagtagacgaagatatattcagaaagaaacgactgacgatcatggatttacacccaggagctggaaaaacaaaaaggatcttgcctagcattgttcgcgaagcgctgaaaagacgtttgcgcacactgattctggcaccaacaagagttgtagcggctgaaatggaggaagcattaagaggtttaccgataaggtatcaaacccctgcagtcaaaagcgagcatacgggacgagaaatagtagatttaatgtgtcacgccacgttcacaacaaggctactaagtagtacacgcgtacccaattataaccttatagtgatggatgaagctcactttacagatccatcctctgtagctgcacgaggctacataagcacgcgtgttgaaatgggcgaagccgccgcaatttttatgacagctacaccgccaggggcaacagacccattccctcagagtaattctccaatagaggatatagaaagagaaattccagaaagaagctggaatactggatttgattggatcaccgattaccagggtaaaactgtgtggttcgtaccgtctatcaaggccggaaatgatatagctaattgtctaagaaagtctggtaagaaagtaatccaactgagcagaaaaacctttgacaccgaatatccaaaaacgaaactaaccgactgggattttgtagtaacaactgacatatcggaaatgggggcaaattttcgcgcgggacgagtcatagacccccgaagatgcttaaaacctgtaatattaaccgatggaccagaacgggttatacttgcaggtccaattccagtaacaccagccagtgcagcgcagcggcgaggtagaataggaaggaatcctgctcaagaggacgaccaatatgtattctcaggggatccgctaaagaatgatgaagatcatgcgcattggaccgaggctaaaatgttgttagacaacatatatacccctgaaggaataatacctaccctattcgggcctgaaagagagaaaacacaagctatagacggtgagtttcgattacgaggggagcaacgaaagacattcgtggaattaatgcgaagaggggacctcccggtgtggctaagctataaagtagcgtcagccgggatatcctataaagatagagaatggtgcttcactggtgaacgcaataaccaaatattggaagaaaatatggaagtcgaaatatggactagggagggagagaaaaagaaattgagacctaaatggttagatgccagagtatacgctgatcccatggctttgaaagattttaaagagttcgctagtggacgaaaatcaataaccctagatatacttacagaaatcgcgagtttgccgacatacctatcgtcaagggctaagttggcattagataatatcgtgatgctacatacaacagagcgtggagggagagcctaccagcatgcactaaacgaattgccagagtccctcgaaacgctaatgcttgtcgctttacttggagctatgacggcgggtatttttctattctttatgcaaggaaagggaataggaaaactatctatgggacttataacaattgcggtagcatcggggttactttgggtagcagagatacaaccccaatggattgcagcatccattatacttgagtttttcttgatggtacttttaataccagaacctgagaaacagagaactccccaagacaatcaactaatctatgtaatactgactattttaaccataatagggctgatcgcagcaaacgaaatgggattaattgagaaaacaaaaacggatttcggattctatcaagtcaaaaccgaaacaacaatacttgatgtagaccttcgaccagcttcagcctggacattatacgccgttgctacaacaattttaactcctatgctgagacatacaattgagaatacgagcgcgaatcttagcttggcggcaatagctaatcaagcagcagtactaatgggactcggtaaaggatggcccttacacaggatggatttgggagtgccattattagcaatggggtgctactcccaagtaaatcctacaacactaactgccagcttggtgatgctattggtccattatgcaataataggaccaggattacaagccaaagcgacaagggaagcccagaaacgcacagcggcaggcataatgaaaaaccctaccgttgatggtataacagtcatcgatttggagcccatctcatatgatcccaaattcgagaaacagctgggacaggtgatgttactggtcttgtgtgcaggtcagcttttattgatgcgtacaacgtgggcgttctgtgaagtactcaccttggcaactgggccgattttgactctatgggaggggaatccaggaaggttttggaatactactatagcagtaagtacagctaatatatttagaggatcgtacttagcgggagctggcctagcgttcagtttaattaaaaacgcacaaacaccgagacgcggaacaggaacaactggagaaacattaggggaaaaatggaaacgtcagctaaattcgttagacagaaaagagttcgaagaatataaaagatccggaatattagaagtagaccgcacagaagctaagagtgctttgaaagatggaagtaaaattaaacatgctgtaagtcgtggatcgagtaaaatcagatggattgtcgagcgaggcatggtaaagcccaaaggaaaggtagtagaccttggttgtggccgcgggggttggagttactatatggcaaccctgaaaaacgtgacagaagtgaagggatatactaaaggagggccaggtcacgaagaacctatacctatggcaacttatggatggaatctcgtaaaattacattcaggggtagacgtattctataagccgacagaacaagtagacacattactatgcgacataggagaaagtagcagtaatcctacaatagaagaaggccggacattgcgagttttaaagatggtagagccatggttgagcagcaaaccagaattttgcatcaaagtacttaacccatatatgccaacagtgatagaagaattagagaaattacagcgtaaacacggcggaaatttagtccgttgtccgttgagcagaaattccacgcatgaaatgtactgggtatcaggtgcaagtggaaatatagttagttctgtaaatacaacaagtaaaatgctgctcaatagatttacaacacgacatcgtaaacctacttatgaaaaagatgtggatcttggagcaggaacaagatcagtttctacagaaaccgaaaaacccgacatgactataatagggcggagattgcaaaggttacaagaagaacacaaagagacatggcactatgatcaagagaatccgtatcgtacatgggcatatcatggcagttacgaagcaccatctaccggatctgcttcatctatggtaaatggcgtggtaaaattactcactaagccgtgggacgtaattcccatggtgacacagctagcgatgactgatactacaccatttggtcaacagagggtattcaaagaaaaagtcgatactcgaacaccccaacccaagccaggtacacgaatggttatgacgacaacagccaattggttatgggctctcttaggcaagaagaaaaatccaaggctttgcaccagagaagaatttatctccaaagtacgatctaacgctgcaataggcgcggtgtttcaggaagaacaagggtggacgtcagcttcagaggccgtaaatgactctagattttgggaacttgtagacaaagaaagggcactccatcaggaaggaaaatgtgaaagttgtgtgtacaatatgatgggaaaaagagaaaagaaactaggagaatttggcagagctaaaggttcgcgagccatttggtacatgtggctaggggctcgctttctagaatttgaagcactaggtttcttgaatgaagaccactggttcgggagagaaaactcgtggtcaggcgtcgaaggggagggattgcacagactcggatatatcctagaagaaatcgataagaaagatggggatcttatgtatgctgacgatacggcaggatgggacactcgtataactgaagatgacctgcaaaatgaggagctaataaccgagcaaatggcaccccaccataaaattcttgccaaggccatttttaaattgacttaccaaaataaggtagtcaaagttttaagaccaacccccagaggtgcggttatggacattatatcgcgaaaggatcagagaggcagtgggcaagttggaacctatgggctaaacactttcacaaatatggaagttcagctcatcagacaaatggaagcggaaggggtgataactcaagatgacatgcaaaaccccaaaggtctaaaagaaagagtagaaaaatggctaagggagtgcggcgtggatagattaaagcgtatggctatatcaggagacgattgcgtcgttaaaccgctagacgaacgatttgggacaagtttactattcctcaatgacatgggaaaggttcgtaaagatataccacaatgggaacctagtaaagggtggaaaaattggcaagaggtcccattctgctctcaccactttcataaaatattcatgaaagatggaagatctctggttgttccctgccggaatcaagacgagctcataggcagagcccgcatttctcaaggagcagggtggtctctgcgtgaaactgcctgcttagggaaggcgtatgcccaaatgtggtcattaatgtactttcaccgccgtgaccttagattagcaagtatggcaatctgctctgctgtcccgacagaatggtttccgacgtcacgcacaacatggagcatacatgctcatcatcaatggatgaccactgaagatatgctaaaagtatggaatcgtgtatggatagaagacaatccaaatatgatagataaaacaccagtacatagttgggaggatatcccgtatttagggaagcgagaagatctatggtgtggatctttaatcggtctatcgagcagggcgacatgggctaagaacatccatactgcaataacacaagtgcgaaacttgattggtaaagaggaatacgtggattacatgcctgtgatgaaaaggtattctgcaccttcagaatctgaaggagtcctgtaa

SEQ ID NO: 23625 - RNA, 9867 nt, synthetic construct
  misc_feature 1..9867: note = derived and/or modified CDS sequence (opt6) from DENV-4__FJ182016__SS-prME
  source 1..9867: mol_type = other RNA
agtacgataacactattatgcctgatacctacagttatggcatttcacctatcaacgcgtgacggcgagcctttaatgatcgttgcaaaacatgaacgaggacgcccactactattcaaaacgactgagggtattaacaaatgtactctcatcgcaatggatttaggggaaatgtgcgaagataccgtaacgtacaaatgtccgttattagtgaatactgaaccagaagatatagactgttggtgtaatttaacaagcacatgggttatgtacggtacctgtacacaatcaggagaaaggcgtagggaaaaacgaagtgtcgctctaacacctcactcaggaatgggactagagacccgtgcagaaacttggatgagttcagagggagcatggaaacatgcacaacgggttgaaagctggattctaaggaatcccggcttcgcacttttggccggttttatggcatacatgataggacaaacagggatacaacgtacagtatttttcgtacttatgatgctagtagctccttcatacggcatgcgttgtgtaggtgtaggtaaccgagacttcgtagaaggcgtatcaggaggagcctgggtagacttagtattggaacacggaggatgcgtaactaccatggctcaaggtaaaccaacactcgacttcgaacttaccaaaactacagcaaaagaggtcgccttactacgaacatactgtatcgaagcactcattagtaatataacgacggcaacacggtgtcctactcaaggtgaaccttatctaaaagaagaacaagatcagcaatatatctgtagaagagatgtagtagatagaggatggggcaacggatgcgggctattcggcaaaggtggagtggttacctgcgcaaaattcagttgttcaggcaaaataacaggaaaccttgtgcaaatagaaaatctagaatacacagttgtagtaacggtacataacggagatactcacgctgtagggaacgatacaagtaaccacggtgtcacagcgaccataacccccaggagtccatccgttgaagtaaaattaccagactacggtgaactgacactagactgtgaaccaagatccggaattgatttcaatgaaatgatactgatgaaaatgaaaaagaaaacatggttagtccataaacaatggttcttggatttgccgttaccatggactacaggtgcggatacctcagaagtacactggaattataaagagagaatggtaacctttaaagtaccacatgcgaaacgccaagatgttacagtactaggaagccaagaaggagctatgcacagtgcgctcgctggtgccacagaagtcgacagtggcgatggaaaccatatgtttgctggacatttgaaatgcaaagtgagaatggaaaaactccgtattaaaggaatgagttatactatgtgttctggtaaattttcaatagataaagaaatggccgagacgcaacacggtacgaccgttgtcaaagtaaaatacgagggagctggagcgccttgtaaggtacctatcgagatcagagatgtaaacaaggaaaaagtagtaggaagagtaatatctgccaccccactcgcagagaataccaattccgttacaaatattgagctagaacccccttttggtgacagttatatcgtaataggcgttggaaattctgcacttacgttacattggtttagaaaaggatcatccataggaaagatgttcgaatcgacctaccgaggtgcaaaacgtatggccatacttggagaaacagcttgggattttggatctgtaggagggctgttcacatctttgggaaaggctgtccaccaagtgtttggaagtgtatataccacaatgtttggaggcgttagctggatgataagaatattgataggttttctcgtgctatggattggtactaattcaagaaacacatcaatggctatgacatgtatagcagtgggtgggatcacattattcttaggatttacagtccaagcagatatggggtgtgttgtgtcctggtccggcagggaattgaaatgtggctcaggtatttttgtagtcgacaacgtccatacttggacagaacaatacaaatttcagccagaatccccagcccgtcttgctagtgcaattttaaatgcgcacaaagatggcgtatgtggcatcagaagtactacaaggttagaaaacgtcatgtggaaacaaattacaaacgaattaaactatgtcctgtgggaaggagggcacgatcttacagttgtagccggtgacgtcaaaggggtgcttactaagggaaagcgagctttaactccaccagctagtgaccttaaatacagctggaaaacgtggggaaaagcaaagattttcacccctgaagctcgaaatagcacattcctcattgatggaccagatacatcagaatgccctaatgaaagacgtgcatggaactcattcgaggtagaagactacggcttcgggatgttcacaacaaatatctggatgaagttcagagaagggtcaagtgaagtttgcgatcaccggctgatgagcgcagctataaaggaccagaaagcagtacatgcagacatgggttactggattgaatcaagcaagaaccaaacttggcaaatagaaagagctagcctaattgaagtcaagacttgtttgtggcccaaaacacatacattgtggagcaatggggtactagaatcacaaatgttgataccaaaatcctacgcaggacctttctcacagcacaactatcgacaaggctacgcaactcagaccgtagggccctggcatctagggaaactcgagatcgattttggagaatgccctggaacaacagttaccatccaggagaattgtgatcacagaggtccttcattgcgaacaacgacagccagcggaaagctagtcacacagtggtgctgtcggtcatgtactatgccgcccctaaggtttctcggagaagatggttgctggtacggtatggaaatacgtccgttatcagaaaaggaagaaaatatggttaaatcccaagttacggctggtcagggcacaagtgagacattttctatgggtcttttatgcctgaccctatttgtcgaagaatgcttgagacgccgagtaactagaaaacatatgatactagcggtagtgataacactttgtgcgataatcttgggtgggctaacctggatggacctactgagagctctaataatgttaggagatacaatgtctggtcgaataggcggacaaactcacctagcaataatggcagtttttaaaatgtcgcctggatacgtattaggagtgtttctgcggaagctaacatcaagagagaccgccctaatggtaataggtatggcaatgacaaccacgttaagcatcccccatgacctaatggaactcatagatggaatatcattaggtttaattcttttgaaaatcgtaacccaatttgacaatacgcaagtcggaacattagcactatcgttaacgttcatccgatcaactatgtcactggtaatggcttggagaaccattatggcagttttatttgttgtgacactgatacccctttgccgtacatcttgtctacaaaaacaaagtcattgggtagaaataactgccttgatactaggagcacaagcattgccagtgtatttaatgactttgatgaaaggggcatctcgacggtcgtggccactaaatgaaggcattatggctgtaggattggtttcattattaggatccgcattattgaagaacgacgtcccattggcaggccctatggtggcaggcggcttgttacttgctgcttatgtaatgtcagggagttccgcagatctgagtttagaaaaagctgcaaacgtccagtgggatgaaatggcagatataacagggtcgagtccaattattgaagttaagcaagacgaagacggctcgttctcaataagggatgttgaagaaacaaatatgataacacttttagtcaaacttgcattaataacagtaagtggactctatcctcttgcaataccaataacaatgactttatggtacatgtggcaagtaaagacacagagaagcggtgcgttgtgggacgtccccagtccggctgccacgcagaaggccgccctatccgagggagtatataggattatgcagagaggcttattcggtaagacacaggtgggtgttggtattcatatggagggggtgttccatactatgtggcatgttactagaggtagtgttatatgtcacgaaactggtcgtttagaaccatcttgggccgacgtacgaaacgatatgatttcctatggaggcggatggaggcttggagataaatgggataaagaagaagatgtccaggtcctcgcaatcgagccaggcaaaaatcccaaacatgtacaaacgaaaccaggactatttaagacactaactggtgaaatcggcgcagtaaccttagatttcaaaccaggcacatcaggtagtcccattatcaacaggaaagggaaagttattggattatatgggaacggtgtagtaactaaatcaggtgattatgtctcggctatcacgcaggcagaacgcattggtgagcccgactatgaagtcgatgaagatatattcagaaagaaacgactaacaattatggatcttcaccctggtgctggtaaaactaaaaggatccttccatcaatagttcgagaggcgctcaaacgaagattacgaacactaatattagccccaacacgtgttgttgcagcggaaatggaggaggcactaagaggcctaccaataagataccagactcctgcggtaaaaagtgagcacacgggtagggaaattgtagatttgatgtgtcacgcaacattcacgactagactgttgtcctcaacaagggtccccaactacaatttaatcgtaatggatgaagcacacttcacagacccttcttcagttgccgctagaggttacataagtactagagtagaaatgggtgaagcagcagctatatttatgactgcaactcccccgggtgctactgacccctttccacagtcaaactcaccaattgaagacatagaaagagaaatacctgaacgcagttggaatactggttttgattggatcacggattatcagggtaaaacagtctggttcgtacctagcattaaggctggaaacgatattgccaattgcttgagaaaaagtggtaagaaagttatacagctttcacgaaaaacattcgacacagaataccctaaaaccaaattaacagattgggatttcgtggttacaacagacatatcagaaatgggagcaaatttccgggctggacgtgttattgatcccagaagatgtctcaagccggttatcttgacagacggcccggaacgtgtgatacttgcaggacctatacccgtcacgccagcatcagctgctcaaaggagaggccgtatcggacgcaatccggcccaagaagacgatcaatatgtgtttagcggagatcctttaaagaatgacgaggatcacgctcattggacagaagctaaaatgttactggacaatatatacacaccagagggcataatacctacactgtttgggcctgaacgagagaaaactcaagcaatagatggggaatttcgacttagaggcgaacaacgtaagacgttcgttgaactaatgcgacgaggagatctacctgtctggcttagttataaagtagcttctgcgggtatatcgtataaagaccgcgagtggtgttttaccggagaacgaaacaatcaaatcctagaagaaaacatggaagttgaaatttggacgcgcgaaggggagaaaaagaagttacgcccaaaatggcttgacgcaagagtgtacgcagaccctatggctcttaaagacttcaaagaatttgcaagcggtagaaagagtataacactagacatactaacagaaattgcgtcactaccaacatatttatcttcacgtgccaaactggcactagataatatagtaatgctacacacaaccgaaagaggtgggcgggcctatcaacatgcgttgaatgagcttccggagtcactagaaactctgatgctggtggccttattaggggcaatgaccgctggaatatttttatttttcatgcagggaaaaggaataggtaaattaagtatgggactaatcaccatagcagtcgcaagtggactcctatgggtggcagaaattcaaccgcaatggattgccgcaagcatcatcctggagttctttcttatggtactactaattccagaaccggaaaaacaaaggacacctcaagacaatcaactaatatatgtcatattaacaattttaacgatcattggcttaatagctgctaacgaaatgggattgattgagaaaactaaaaccgattttggattctaccaagtcaaaacagaaacaaccatattagatgtagatctaagaccggcatcagcctggaccttatatgcggtagcaacaacaatcctaaccccaatgctacgtcatactattgagaatacgagtgcaaacttatctttagccgcaatagcgaatcaagccgcagtcttaatgggactcggaaaaggttggcctttacaccgaatggacctaggagttccattattggctatgggatgctattcacaggtaaacccaacaacacttacagcctctttagttatgctattggtacattacgcgatcattgggccaggactccaggccaaagccacacgagaagcccagaaaagaacagcggcaggaataatgaaaaacccaactgtcgacggtatcaccgttatagatctagaaccaatatcatatgatcctaaatttgaaaaacaactagggcaagtcatgttgttagtactgtgtgccggacaactactcttgatgcgaacgacatgggccttttgtgaagtcttgaccttagcgacaggaccaatattaactttatgggaaggcaatcccggaagattttggaacacaacaatagctgtttctactgcaaacatctttagaggttcatatctcgcaggggccggtcttgcgttttccttaatcaaaaatgcacaaacacccagacgtggaacaggtacaacaggagaaactctaggagaaaagtggaaacgacaattgaatagtttagaccgaaaggaatttgaggaatataaaagaagcggaatattagaggtagacagaactgaggccaagagtgccctaaaggatggaagcaagattaagcacgcagtaagccgtggaagttcgaaaatcagatggatagttgagaggggtatggttaaacccaaaggtaaggtagtggatcttgggtgtggtaggggcggatggagttactatatggctacccttaaaaacgttaccgaagttcgaggctatactaaaggaggacccggtcacgaagaaccaatcccaatggccacatatggctggaatctcgttaagctgcacagtggtgtggacgtcttctacaaaccaacagaacaagtagacaccctattatgtgatattggagaatcatcatcaaatccgactattgaagaaggtagaactctcagagtattaaaaatggttgaaccatggttaagcagcaagcccgagttttgcataaaagttctaaacccctacatgccgaccgtaatcgaggaattagaaaaactccaaagaaaacatgggggtaaccttgtacggtgtcccctgtctagaaattctacacatgaaatgtactgggtctcaggagcctctggcaatattgtttcatcagtaaacacaacatcgaaaatgttactcaacagattcacaacgcgccatcgaaaaccgacatatgagaaagatgtggatttaggcgcgggtactcgtagtgtttcgactgaaaccgagaagccggatatgactatcataggtagacgattacagagattacaggaagaacataaagaaacatggcactacgatcaggaaaatccatataggacatgggcatatcatggtagttatgaggctccatcaacaggcagtgcaagtagcatggtaaatggtgtcgtaaaattgctgacaaagccatgggatgtgataccaatggtaacccaattagcgatgactgataccactcctttcggacaacaaagagtatttaaagaaaaagttgatactagaacaccacaacccaaacccggcactagaatggtcatgacaacaaccgctaactggctatgggcgttactcgggaagaagaaaaacccgcgactatgtaccagagaggaatttattagtaaagtacgcagcaacgcagctatcggagcagtcttccaggaggagcaaggttggacttcagcttccgaagccgtcaacgactctcgattttgggaattagttgacaaggaaagagcgttacaccaggaggggaaatgtgaaagttgtgtgtataatatgatgggcaagagagaaaagaaactaggagaatttggtagggctaaaggaagtcgagctatatggtatatgtggttaggcgcaagatttctggaatttgaagcactgggctttctaaacgaagatcactggtttggtagagaaaactcatggtctggcgtggagggagaagggctccacagattgggatatatactggaagaaatcgacaagaaagatggagacttaatgtacgcggatgacactgccggctgggatacaagaataacagaagacgacttgcaaaatgaggaattgataacggaacaaatggccccacaccataaaatcttggcaaaggctatatttaaactcacttaccagaacaaagtggttaaagtgttaagaccaacacccagaggggcagtgatggatattatttcaaggaaagatcaaaggggctcgggccaagtcggcacatatggactaaatacatttacaaacatggaagtacaactaataagacaaatggaagcagagggtgtaataacacaggacgatatgcaaaatccaaaagggttaaaagaaagggttgaaaaatggcttcgggagtgcggagtagatcgattaaaaaggatggcaatatcgggagatgattgtgtagttaaaccccttgacgaacgcttcggaacgtcgctcttattcctgaacgatatgggaaaggttcgaaaagacatcccacaatgggaaccatcgaaaggttggaaaaactggcaagaagttcccttttgttcacatcattttcacagaatcttcatgaaagacggaagatcgcttgttgttccgtgtagaaatcaagatgagctcattggtcgagcaagaatttcgcaaggagcgggatggtcgctacgagaaacagcatgcctaggaaaggcttacgcccaaatgtggtctctgatgtatttccataggagagatttgaggttagcaagtatggcaatctgttcggcagtgccaactgaatggtttcctaccagtagaacgacttggtcaatacacgcccaccatcagtggatgacaaccgaagatatgttaaaagtatggaatcgcgtatggattgaggataatccaaatatgattgataagacaccagtacactcctgggaagacataccgtacctaggaaaacgcgaagacttatggtgtggtagtttaatcggattgagcagtagggcgacttgggccaaaaacatacataccgcaataacacaagtaagaaacctgattggcaaagaagagtatgtagattacatgccggtcatgaaacgatattctgcaccatctgagagtgaaggagtgttgtga

SEQ ID NO: 23626 - RNA, 9867 nt, synthetic construct
  misc_feature 1..9867: note = derived and/or modified CDS sequence (opt6) from DENV-4__EU854300__SS-prME
  source 1..9867: mol_type = other RNA
tctaccataacattactgtgtctgattcctacggtcatggcttttcatttgagcactagagatggggaacccctgatgatagtggcaaaacatgaacgtgggagacctttattgttcaaaactactgaaggaataaacaaatgcaccttaatagcgatggacctaggtgaaatgtgtgaagacaccgtaacatacaaatgcccactcctagtcaacacagaaccagaggatatcgactgctggtgtaaccttacaagcacgtgggttatgtacggtacttgtacgcaatctggagaaaggagaagagagaaaagatcggtagcacttactccgcatagcggcatggggttggaaacaagagctgagacgtggatgtccagcgaaggagcatggaaacatgcacaaagggtagaaagttggatactacgcaatccgggatttgctctattagcaggattcatggcgtacatgataggacaaactggaatccaacgtacagtatttttcgtactaatgatgctggtagcaccgtcctatggtatgcggtgcgtcggagtcggcaatagagactttgtcgaaggtgtatctggcggagcatgggtagacttggtgttggagcatggcggctgcgttactacaatggcacaaggaaaaccaacgttagattttgaacttacaaaaacaaccgccaaagaagtcgccctattaaggacttattgcatagaagcattaatcagcaacataaccacagcaaccaggtgtccaactcaaggcgaaccctacttaaaagaagaacaagatcaacaatatatatgccgacgagatgttgtagataggggatggggaaacggatgtggcttattcggaaaaggcggcgtcgttacttgcgctaaattttcatgcagtggcaaaataacagggaacctggtacaaatagagaacctagaatatacagtagtagtaactgtccataacggtgatactcacgcagttggcaacgatacatcaaatcacggggtgacagccacaatcacgcctaggtctccgtcagtagaggtaaaattacctgattatggcgaactaactttggactgcgaacctagatctggtattgatttcaatgagatgatattaatgaaaatgaagaagaaaacctggttagtacataaacaatggtttttagatctgcctcttccatggaccaccggagcagatacgtcagaagttcattggaattacaaagaaagaatggtaacctttaaagtccctcacgcaaaaagacaggatgtcaccgtactcggaagtcaagaaggagcaatgcattcagccttagctggggccacagaggtagattcgggagacggaaatcatatgtttgcgggtcatttaaaatgcaaggtaagaatggaaaaacttcgcattaaagggatgtcctacacaatgtgttcaggcaagttttcgattgacaaagagatggcagaaacacaacatggcacaaccgtagtaaaagtcaaatatgaaggagctggagcaccctgtaaagtgccaatagagataagggatgtaaataaggaaaaagtggtagggagagtaatatctgcaacgccgcttgctgagaacacaaatagtgtaacaaatatagaactggaaccacctttcggagacagctatatagtcattggcgtgggtaattctgctctaacactccattggtttaggaaaggatcatccatcgggaaaatgtttgaatccacgtacagaggtgcgaaaagaatggccattctaggggagacagcatgggactttggtagcgtaggtgggctatttacaagtttagggaaagcagtacatcaagtatttggtagtgtttatacaaccatgttcggaggtgtttcctggatgataagaatattgataggtttcctagtgctttggatcggaacaaacagtcgtaataccagtatggcaatgacttgcatagcagttggagggataactttattcttgggctttacagtacaagcagacatgggatgcgtcgtatcttggaatggtagagaactaaaatgtgggtcggggatttttgtcgtagataatgtgcatacgtggacagaacaatacaaatttcaaccagaaagtccagcgagattagcatcagctattctcaatgcgcataaggacggtgtctgcggtataagaagcacaactagattagagaatgttatgtggaaacaaatcactaacgaactgaattatgtattatgggaaggaggtcatgacctaacagtagtagccggtgatgtaaaaggcgtcctaactaaaggaaaacgtgctcttacgccaccagcttccgaccttaagtattcgtggaaaacgtggggaaaagctaaaattttcactcctgagacaagaaattctacctttttaatcgacggccctgatacaagcgagtgtccgaatgagaggagagcgtggaatagctttgaagtagaagattatgggtttggcatgttcacgacaaatatttggatgaaatttagggaggggtcgtctgaagtatgcgatcatcgcctcatgtctgctgcaattaaagatcaaaaagccgtacatgctgacatgggctattggatcgaatcaagtaagaaccaaacatggcaaatcgaacgcgcatcactaatcgaagtgaaaacatgcctatggccaaagacacataccttatggagcaacggggtactagaaagccaaatgctcatacctaagtcgtatgcaggccctttttcccaacataattatagacaaggatatgcaacacaaacagtcggaccgtggcacctgggcaagctagaaatagattttggcgagtgtccgggtactactgtaaccattcaagaaaactgcgaccacagaggaccaagtctaaggactacgacagcatcaggaaagctagtgacacagtggtgttgtcgttcttgtaccatgccgcctctacgatttctaggagaagatggatgctggtatggtatggaaatccgaccattatcagagaaagaggaaaacatggtcaaatcccaagttacagcaggacaggggaccagcgagacattcagtatgggactcttatgtcttacacttttcgttgaagagtgtttgcgaagacgcgttacaaggaaacatatgatactagcggttgttataacactatgcgcaataatactagggggattaacatggatggatctcttgagagctcttattatgttaggtgatacaatgagtggcaggataggaggccaaacgcacttggctataatggctgtatttaaaatgagcccgggatacgtgttaggggtttttcttagaaaactgacgagtagggagacagcgctaatggttataggaatggctatgaccacgacattatcgatccctcacgatctaatggaattaatagacggtatatcgttaggcttaatacttctaaagatagtgacacagttcgataatacacaagttggtaccttagcactgagcctcacctttatacgttcaacaatgtcattggtcatggcatggaggacaattatggctgtgctattcgttgttaccctaatacccttgtgcagaacatcgtgtctacagaaacaatctcattgggtagagattacggcactaatattaggggctcaggcgcttccggtatatcttatgacattaatgaaaggtgcatccagaagaagttggccgttaaacgaaggtataatggctgttggacttgtctcactgttgggatcagctttgttgaaaaacgatgtaccactagcggggcctatggtggccggtgggttactcctggcagcatatgtcatgtcaggatcatcagccgaccttagcttagagaaagcagcgaatgtgcagtgggatgagatggcagacatcacaggaagcagtccaataatcgaggttaaacaagacgaagatggatcattctcgataagagatgtggaagagacaaatatgatcacgttactcgtaaaattagcactaatcacagtatccggattgtatccactcgctatcccgatcacaatgaccctttggtacatgtggcaagttaaaacacaaagaagcggggcgctgtgggacgtaccgtccccagcagccacacagaaagcggccctttccgagggcgtatacagaattatgcaaagaggtttattcggcaaaactcaagttggcgttggcatccatattgagggcgtgtttcatacaatgtggcacgttactcgcgggagtgttatatgtcatgagacaggccgattggagccttcatgggctgacgtacgtaatgatatgatcagttatgggggtggttggagattaggagataaatgggataaagaagaggatgtacaagtacttgcaatagaacccggcaaaaacccaaaacacgttcaaacaaaacctggattattcaaaaccttaacaggagaaataggtgcggtcactctagactttaagcctggcaccagcggatcccccattatcaatcgaaaaggaaaggtaataggtctatacggcaacggtgtagtaactaagtcaggagattatgttagcgcgataacgcaagcagaacggatcggtgaaccagattatgaagtagatgaagatatatttaggaaaaagcgtttgactataatggacttacacccaggtgcaggtaaaacgaagagaatattaccttccatcgttcgagaagccctaaagagacgattaagaacgttaatactagcaccaactagggttgttgcagcagaaatggaagaagccctaagaggtttgccaataaggtatcaaacaccagcagtaaaaagcgaacataccggacgcgaaatcgtcgaccttatgtgccatgcaacatttacaactagacttctctcttccacgagagtacctaactacaacctaattgtcatggatgaagcgcatttcacagatccttcttcagttgctgctcgaggatacatttccacacgagtcgagatgggtgaagcagctgcgattttcatgacagcaaccccacctggcgctaccgatccctttccacaatccaatagtcctatcgaagatattgaacgcgaaatccctgagcgttcatggaataccggtttcgattggataaccgattatcaaggaaaaacagtctggtttgtaccaagtataaaagcgggtaatgatatagcgaattgcttaaggaaaagtggcaagaaagtcattcaactaagccgtaagacatttgatactgaatatccaaagactaagttaaccgattgggacttcgtagttacaacggatatttctgaaatgggtgccaatttcagagctggtcgcgttattgatccacgccgttgcctgaaaccagttatactaactgatggtcctgaaagagtcatactagcagggccaatccccgtaacaccagcaagcgcagctcaaaggcgtggcaggatcggtcgtaatttagcccaagaagatgaccaatacgtctttagcggagatccattaaagaacgatgaagaccacgcacactggaccgaagcaaagatgctactagataatatatatactccagaagggattataccgactctcttcgggcccgagcgagagaaaactcaagcgatcgatggggaatttagactacgcggagaacaacgaaaaacattcgtcgaactgatgcgacgaggagatttacccgtgtggttaagctataaagtagcatcagctggaattagttataaagacagagaatggtgttttaccggggaacgaaataaccaaatcttggaagaaaacatggaagtagaaatttggacacgtgagggtgagaaaaagaagttacggcctaaatggttagatgctcgtgtctacgcagatccaatggccctaaaagattttaaagaatttgcttctggtcgcaaatccataacactcgatattctgacagaaattgcctcattaccaacatacttatcatctagagcaaaactagcattagataatattgtaatgttacatacaaccgaacgtggcggtcgagcgtatcaacacgcgcttaacgaacttcctgaaagcctagaaacacttatgttggtagcactactaggcgccatgaccgcaggcatatttctatttttcatgcagggaaaaggcataggaaaattatcaatgggattaatcacaatagctgtcgcatcaggtttactttgggtcgcagaaatacaaccacaatggattgccgcttcaattattctagagttcttcctcatggtattgttgataccagaacctgagaaacagcgcaccccacaggataatcagctaatatatgtcatactaactatattgaccatcataggattaatcgcagctaatgaaatgggccttatcgagaaaacaaaagccgattttggattctatcaagtaaaaacggaaactactattttagatgtcgatctccgacccgcaagtgcatggactctttatgccgtagcaacgacaattctcacccccatgttgaggcatacaatcgaaaatacaagtgcgaatcttagcctagcagcgatagctaatcaagcggcagttctaatgggactgggaaaaggatggccgttacataggatggatttgggtgtacctttgttagcaatgggatgttacagccaagtcaatcctaccactctaactgccagtttagttatgctacttgtacattatgcgataataggccctggtttacaggccaaagcgactcgtgaggctcaaaagcgtacagcagcaggcattatgaagaatccaacggtcgacggaatcactgtaattgatctcgaaccaatatcgtacgacccgaagttcgagaaacaactgggacaagtaatgctgcttgtactttgtgcaggacaactattacttatgagaactacatgggctttctgtgaggtacttacattagccacaggacctatcctaactttgtgggagggaaaccccggcagattttggaataccactatcgctgtaagcactgccaatatcttcagaggcagttacctggcgggggcaggtttagcattctcactgattaaaaatgcacaaacaccacgaagaggaacaggaaccactggcgaaaccctcggggaaaaatggaagagacaattgaactctttagatagaaaagagttcgaagagtacaaacgctcagggatccttgaggtggatagaacagaagccaagtccgcattaaaagacggatctaaaattaaacacgctgtcagccggggatcgagtaaaatacgttggatagtagaacgggggatggttaaaccaaaagggaaagtagtagatctagggtgtggaagaggaggttggtcatattacatggctactttaaagaacgtaactgaggtaaaaggttatacaaaaggagggcctggacatgaagaaccgattccaatggcaacctacggttggaatctggtgaagctccattcaggggtagatgtattttataaacccacagagcaagtagatacgttgttatgtgatataggagagagtagctcaaatcctacgatagaagaaggacggacgctaagagtattgaagatggtagaaccatggctttcatctaaaccagagttctgcatcaaagttcttaatccatacatgccgacggttatcgaggaactggaaaaactccaaagaaaacatggaggcaatttagtaagatgcccattaagtagaaattcaactcacgagatgtactgggtatcaggcgcgtcgggaaatattgtgagctcagtgaatacaacatctaaaatgctgctcaaccggtttacaaccaggcaccgtaagccgacttatgaaaaagacgtggatttaggtgcgggaactcgttctgtttcaacagaaacagaaaagccagatatgacgattataggacgcagattgcagaggttgcaagaagaacacaaggaaacttggcattacgatcaagaaaatccatatcgtacatgggcctatcatgggagttatgaggctccatctaccggtagtgcgtcaagcatggtaaatggtgtagttaaactcttaacgaaaccttgggacgtgattcccatggtgacgcagttagctatgactgatacgactcccttcggccagcaacgagtttttaaagagaaagtagacacgagaactccgcagccaaaaccaggtacaagaatggtcatgacaacaacagcgaattggctatgggccttactaggcaagaagaaaaacccgcgtctatgcacccgtgaagaatttatctcgaaagtaagatcgaacgctgcgatcggtgctgtgtttcaagaagaacaaggctggaccagtgcaagcgaagcagtaaatgacagtagattctgggagctggtcgataaagaaagagcactccatcaagaggggaaatgcgaatcatgtgtttacaatatgatgggaaagcgtgagaagaaacttggagaatttggtcgagctaaaggaagtagagctatttggtacatgtggcttggtgcaaggttcctagagttcgaagcattggggtttctcaacgaagatcactggtttggtagggaaaactcttggtcaggagtcgaaggtgaaggcttacatcgcctcgggtatattctagaagagattgataaaaaggatggtgacttaatgtatgcggatgatactgccggctgggacacacgtattacagaagatgatcttcaaaacgaggaactgatcacagagcagatggcaccgcatcataagatattagcaaaggctatattcaaactaacataccaaaataaagtagtaaaagttctccgtccaacaccgagaggtgctgtaatggatattatctctcggaaggatcagagagggtcaggccaagtaggaacttacggattaaatactttcaccaatatggaggtacaactaatccgacaaatggaggcagaaggtgttataacacaagatgatatgcaaaaccctaaaggattaaaagagagagtagagaaatggttaagagaatgtggtgtcgatcgtctcaaacgaatggctatatctggtgacgattgtgtagtaaagcctttagatgagagatttggaacatcactacttttcctaaacgatatgggcaaagtacgaaaggatataccacagtgggaacccagcaaaggatggaagaactggcaggaggtgccattttgctcacatcatttccacaaaattttcatgaaggatgggagatccttagttgtgccatgtcgaaatcaagatgagctaatcggtagagcgcgcatatcacaaggggctggatggagtctaagagaaacagcgtgtttaggaaaggcctatgcgcaaatgtggtccttaatgtactttcatcgaagagacttaagattagcatcaatggccatttgttcagctgtgccaacagaatggtttccaacgtctcgaactacatggtcaatacatgcacatcatcaatggatgacaacagaagatatgttgaaagtctggaaccgggtgtggattgaagataaccctaacatgattgataagacaccagtacacagttgggaggatataccttatttaggcaagcgagaagacctttggtgtggatcactaatcggtttatcaagtcgtgctacctgggccaaaaacattcacaccgcaatcactcaagttcgtaatctaataggtaaagaagagtatgttgactatatgcccgtaatgaagaggtactcagcgccttctgagtcagaaggagtcctatag

SEQ ID NO: 23627 - RNA, 9867 nt, synthetic construct
  misc_feature 1..9867: note = derived and/or modified CDS sequence (opt6) from DENV-4__FJ182017__SS-prME
  source 1..9867: mol_type = other RNA
agtaccataaccctactttgtttaatacccactgtaatggcttttcatctctctacacgagacggcgaaccactgatgatagttgcaaaacatgaaaggggaagaccactactgtttaaaactactgaaggtattaataaatgtaccctaatcgcaatggatttaggagaaatgtgcgaagatacggtaacatataaatgccctctattagtaaacaccgaaccagaagatatagattgctggtgcaatcttacgtctgcatgggtcatgtatggtacctgcactcagtcgggagaaagaagacgtgaaaaacgctcggttgctttaactcctcactcagggatgggtttagaaactcgggcagaaacgtggatgtcatcggagggagcatggaaacacgctcaaagagtcgagagctggatcttgcgtaatccaggtttcgcactcttagcaggttttatggcttatatgattggacaaactggcatacaaaggacggtgttctttgtcttaatgatgttggtcgcaccttcgtacggcatgcgctgcgtgggggtaggtaaccgagatttcgtggaaggcgttagtggtggagcatgggtagatcttgttcttgagcatggtgggtgtgtcaccactatggcgcaaggaaaacctacactcgactttgagctaacaaaaaccacggcaaaagaagttgcgcttctaagaacatattgcatagaagcgttaatatcaaatatcaccactgcaaccagatgtccaactcagggagaaccttaccttaaagaagaacaagatcaacaatacatatgtcgccgcgatgtagtggacagaggatggggtaatggttgcgggctttttggaaaaggaggggtggtaacatgtgcaaaattctcatgtagtggtaaaatcaccggaaatctcgtccaaatagagaacctagaatatacggtagtagtaaccgtacacaacggtgacacgcatgcggtaggtaacgatacaagtaatcatggagtgaccgcaacgattacaccaaggtcaccatcagttgaagttaaactaccagactacggagaacttacacttgattgcgaaccccgaagcggtatagactttaatgagatgatactcatgaaaatgaagaagaaaacttggctcgtacacaaacaatggttcctagacctaccgctaccatggacaaccggtgctgacacgtcagaagtacattggaattataaagaaagaatggtaacctttaaagttcctcatgccaaacggcaagatgtgacagtcttaggaagccaagaaggagcgatgcattcagctttagcgggagccacagaggtggattcaggagatggcaatcatatgttcgcaggtcacctaaaatgtaaagttagaatggaaaaacttaggattaaagggatgagttacaccatgtgctctggtaaattttcgattgacaaagagatggcagaaacacagcatggtacaacagtggtaaaagtaaaatacgaaggagcaggagcaccttgtaaagtacccatcgaaattcgggacgtgaataaagaaaaagtagttggacgagtcataagtgcgacaccgctagctgagaacactaatagcgtaactaacatagaactggaacctccgtttggagatagttatatcgtcattggagttggaaattctgcgctgactctccattggttcagaaaggggtccagtattggtaagatgttcgaatcaacatataggggagcaaagagaatggcaattctcggtgaaacagcctgggattttggatccgtaggaggactattcacgtcacttgggaaagccgtacatcaagttttcggctctgtctataccacgatgttcggtggcgtttcatggatgattagaattttgataggctttttagtactctggatcggcaccaattcaaggaatacgtcaatggcaatgacttgcatcgctgttggaggcattactctgtttttaggattcacagttcaggcagatatgggatgcgtagtgtcgtggtcagggagagaactcaagtgtgggtcaggtatcttcgtggtagataatgtacacacgtggactgaacaatacaaatttcaaccggaaagtccggctaggcttgcttccgcaatcttgaatgctcataaagacggcgtgtgcgggattcgatctaccacacgattagaaaatgtaatgtggaaacaaatcacaaatgaattgaattatgtactttgggaagggggacatgaccttacggttgtagcaggcgatgttaagggagtacttaccaagggaaaaagagcactaactcctccggcttcggatttaaaatatagttggaaaacatggggaaaggcaaagatttttacgccagaagcccgcaatagcacatttctgatagatggacccgacacatctgagtgcccaaatgagagacgagcgtggaactcatttgaggtggaggattatggatttggcatgtttactactaacatctggatgaaattcagggaaggtagctccgaagtgtgtgaccataggttaatgtctgcggcaattaaggaccaaaaggcggtacatgctgatatgggttactggattgaatcatcgaaaaatcaaacttggcaaatagaacgtgcatcactcattgaagtaaaaacttgtctttggcctaagacacacacgctgtggtccaacggtgtgttagaatcacaaatgttaatcccaaaatcatatgcgggaccttttagtcaacataattatagacaaggatatgctacacaaacagtggggccttggcacctcggtaagctagagatcgattttggagaatgtccaggaacgactgttaccattcaagagaactgcgatcatagaggaccaagtctacggactaccaccgcatctggcaaattagttactcaatggtgctgcagatcgtgtacaatgcccccactccgattccttggagaagatggatgttggtacggaatggaaattcgtccgctaagcgagaaggaagaaaatatggtaaagtcccaagtcactgcaggccaaggtacgagtgaaacatttagtatggggttgctgtgtcttacactgttcgtagaagaatgtcttagacggagagtaacgcgaaaacacatgatcttagctgtggtcattacactatgtgccattattttagggggactaacgtggatggatcttctccgagccctgattatgttaggggacacaatgagtggacgaataggtggccaaacacacctcgcaataatggcagtatttaaaatgtctccgggttatgtgctgggggtgttcctaagaaaattaacgtctagagaaactgccctgatggtcataggaatggcgatgactaccactctctcaataccgcatgaccttatggaactaattgatggaattagtcttggcttgatactattaaaaattgtcacacaatttgataacactcaagtgggtactttagctttatcattaacattcatccgtagtaccatgtcattagtgatggcttggagaacaattatggcagtgttgttcgtagtcaccctgattccactctgtagaacttcgtgtttacaaaaacaatcacattgggtagaaatcacagcattaatactaggagcgcaagcacttccagtgtatctcatgacattaatgaagggagcaagcagaagaagttggcccctgaatgaaggtatcatggccgtaggcctagttagcctgttgggatctgcactactgaagaacgatgtaccacttgccggcccgatggtagcgggtggattactactcgcagcatacgtaatgagtggaagtagcgcagacttaagtttggaaaaggcagcaaacgtccaatgggatgaaatggctgatataacaggcagcagccctattattgaagtaaagcaagacgaagatgggtcctttagtatcagagatgttgaagaaaccaatatgatcacactactggtcaaattagccctgataactgtcagtgggctgtaccccctagcgattcctattactatgacactatggtatatgtggcaagttaaaacccagagatccggagctctgtgggatgtaccttctccagctgcgacacagaaagcagcactgagtgaaggcgtgtaccgaataatgcaacgaggtttatttggcaaaacacaggttggagtaggcatacatatggaaggtgtctttcacacaatgtggcatgtgactagaggttcagtaatatgtcacgaaactggaagattagaaccctcttgggcagacgtgcggaacgatatgatctcttacgggggcggatggcgtcttggagataaatgggataaggaagaagacgtgcaagttctggcaatagaacctggcaaaaatcctaaacatgtccaaacaaagccaggactattcaagactttaactggcgaaattggcgcagtaacccttgacttcaaaccgggaacctccggctcgcccataataaatagaaaaggcaaggtaataggtctttatggaaatggcgtggtaacaaaaagtggggactatgtaagcgctatcacgcaggcagagagaatcggcgaacctgattacgaggttgatgaggacattttccgcaagaaacgactaacgataatggatctacatcctggagctggcaaaaccaaacgcattctaccctcaatagttagagaggcattaaaaaggcgtcttcgcacattaatattagctcccacgagggtagttgcagcagagatggaggaagcgttgagagggttaccgattagataccaaacgcccgcagtaaaatcagaacacactggtagagagatagtcgatttaatgtgccatgcgaccttcacaaccaggttattgagttctactcgggtacccaattacaatctgatcgtaatggacgaagctcattttacagacccttcttcagtggctgcaagagggtatatatctactagagtagaaatgggcgaggcggcagcgatattcatgacagccaccccaccaggtgcgactgaccctttcccacaatctaacagtccaatagaagatatagaaagagagattcctgaaagaagctggaataccggattcgattggattaccgactatcaaggaaagaccgtatggttcgtaccaagcattaaagcaggtaatgatatcgctaattgtctcagaaagagtggcaagaaagtcatacaacttagcaggaaaacatttgatactgagtatcctaaaactaaactaacagattgggatttcgtagtaaccaccgacatatcagaaatgggtgccaactttagggctgggcgagtaatcgacccgcggagatgcctgaagccggtaatattgacggatggacccgagagagttatacttgcaggaccgattccagtgacacccgcttcagcagcgcaacgcagggggcgaattggaagaaacccagctcaggaagacgaccaatacgtattcagcggagatccactcaaaaacgatgaggaccacgcacattggactgaagcaaaaatgctacttgacaacatatatactccggaaggaataatacccacattatttggaccggaaagggagaaaacccaagcgatcgatggagaatttagacttcgaggagagcaaaggaaaaccttcgtggaactgatgcgaaggggagacctgcctgtctggttatcatataaagtagcctcggccggaataagttataaagatcgggaatggtgtttcacgggtgaacggaacaaccagatacttgaagaaaacatggaagtggagatctggacgcgagaaggagagaagaagaaactgagaccgaagtggctagatgctagggtatatgctgatccaatggcactaaaagatttcaaagaatttgccagtggaaggaagtcaatcacattagatatactgacagagatcgcgagcctaccgacatacttaagttctagagcaaagttagcattagacaatatagttatgctacatactactgaacgaggcggtcgagcgtaccaacacgcgctaaacgaactgccagaatctttagaaacgttaatgctggttgccttacttggagcaatgaccgcaggtatttttctatttttcatgcaaggaaaaggcatcggtaaattgtcaatggggctaattacaatagcagtagcgtccggattactatgggttgctgaaatacaaccacaatggatagcagccagtataatactagagttctttctaatggtgctattaataccagagcccgaaaaacagagaacgccccaagacaaccaattaatctatgttatactaactatcttaacaataataggtcttatagcagccaatgaaatgggattaatcgagaaaactaaaacagatttcgggttttaccaagtgaaaacagaaacgacgatattggatgttgatctaagacctgcgtccgcatggacactatatgcagtagccaccacaatattaactcctatgctgagacatactatcgagaacacatcggccaacttatcgcttgcagccattgcaaatcaagccgctgtgttgatgggtctgggtaaaggatggccactacatcgaatggatctgggagtacccttgctagcgatgggctgttattcacaggttaatccgacaactttaactgccagcttagtaatgttattagtccattatgcaataataggaccaggattgcaggcaaaagctactagggaagcacagaaaaggaccgccgcaggcataatgaaaaaccccacggtagacggaatcactgtaattgatctagagccaatatcatatgacccgaaatttgagaaacaacttggacaagtaatgctactagcactttgcgcaggtcagctacttttaatgagaacaacatgggctttctgcgaggtactgacactagcaaccggacccatacttacattgtgggaaggtaatcctgggaggttttggaacacgactattgcagtctcaactgcgaatatatttcgggggtcgtacctagcgggcgcaggcttagccttctcacttattaaaaatgctcaaacaccgcgtcgagggactgggactaccggagaaactctaggggaaaaatggaaacgacaactaaattctttagataggaaagagttcgaagagtacaaaagatcgggaatactcgaagttgacaggactgaagctaaaagcgctttaaaagatggatcaaaaataaaacacgcagtcagtagaggatccagtaaaattaggtggattgttgaaaggggaatggtaaaacccaaaggaaaggtcgtggatttaggatgcgggagaggcggatggagctattacatggcaactctcaaaaacgtcaccgaagtgaagggatacacgaaaggagggccggggcatgaagaaccgatccctatggcaacatatggctggaaccttgtcaaattacacagtggtgtagacgtattttataagccgacggagcaagttgatacacttctttgtgacataggtgagtcatcatcaaaccctactatcgaagaaggaagaactttacgtgttctaaaaatggtagaaccatggttaagcagtaaacccgaattttgtattaaggttctgaatccatacatgccaaccgttatcgaagaactcgaaaaacttcaacgcaaacacggaggaaatttagtaagatgcccgctaagtcgcaatagtacgcacgaaatgtattgggtttcaggtgcgagtggtaatatcgtatccagtgttaatacgacaagtaagatgctcttgaatagattcacaacacggcataggaaaccaacgtacgaaaaagatgtcgatttaggagccggtacacgatcagtgtcgacagaaacggaaaaacctgatatgaccatcataggacgaagattacaacgtctacaagaagaacataaggaaacttggcattatgatcaagaaaacccctatcgaacatgggcctaccatggctcctacgaggcaccatcaacgggttcagcatcaagcatggttaatggcgtcgttaagttattgacgaaaccatgggatgtaattccaatggtgacccaactagctatgacagatacaactccatttggtcaacagagagtgtttaaagaaaaagtagacactagaaccccacagcccaagccaggcactagaatggtcatgactacaacagcaaactggctctgggccttactcggcaagaagaaaaacccaaggctttgtacaagagaagaatttatttcaaaggttagatcaaacgcagctataggtgccgtctttcaagaagaacaagggtggacaagcgcttccgaggccgttaacgacagtcggttttgggaattagtagacaaggagagggctttacatcaggaaggcaaatgtgaatcctgcgtatataatatgatggggaagcgagagaagaaactaggagaatttggtagagctaaagggtcacgcgcaatatggtacatgtggttaggagcccgatttttagagttcgaagcattaggatttctaaatgaagaccattggttcggtagagagaactcctggtctggagtagaaggggaggggttgcatcgtttagggtatatcttagaggaaatcgacaagaaggatggagatttaatgtatgcagatgacaccgccggatgggatacgagaataactgaagatgacctacaaaacgaagaacttatcactgagcagatggcacctcaccacaaaattttagccaaggcaattttcaagttaacatatcaaaacaaagttgtaaaagtattacgaccaacaccaagaggagcagtaatggacattatatcaagaaaggaccaacgaggttcggggcaggtagggacatatggactcaatacctttaccaatatggaggttcaactaataaggcagatggaggcggaaggagtcataacccaagatgacatgcaaaaccccaaggggctaaaagaaagagtggaaaaatggttacgcgaatgtggagttgatcgattaaaaaggatggctatatctggcgacgattgtgtggtcaaacccttagatgaaaggttcggtacaagccttctattcttaaatgatatgggaaaagttcgaaaggatattcctcaatgggaaccttctaagggttggaagaattggcaagaagttccgttttgttctcatcatttccacaagattttcatgaaagatggaagatcactcgtagttccatgcagaaatcaagacgaattaataggacgcgcaagaatatctcaaggcgcaggctggtccctaagagagactgcttgtttaggtaaagcatatgctcaaatgtggtccctaatgtatttccaccgtcgggatcttcgtctggcctcaatggcaatttgtagcgcagtaccgacagaatggttcccaacttcaagaacaacatggagtatacatgcacaccatcaatggatgacaacagaggatatgcttaaagtctggaaccgagtttggattgaggataatccaaacatgatcgataaaacacctgtacatagctgggaagatataccgtacttaggaaagcgagaagacttatggtgtggaagtctaataggcttaagttcacgcgcgacgtgggccaagaatatacacaccgctattactcaagtgaggaatttgataggaaaggaagagtacgtcgactatatgccagtaatgaaacgctatagcgctccaagtgaatcagaaggtgtcttatga

SEQ ID NO: 23628 - RNA, 9867 nt, synthetic construct
  misc_feature 1..9867: note = derived and/or modified CDS sequence (opt6) from DENV-4__EU854301__SS-prME
  source 1..9867: mol_type = other RNA
agtactataactttactatgcttaattccaacggttatggcattccatttgtcaacgagggatggagaaccgctaatgatagttgctaaacacgaaaggggaagacccctcctttttaaaacaaccgaaggaataaacaaatgtacgttaatagcaatggatcttggtgaaatgtgcgaagacacagttacgtataaatgtcctctcctagttaatacagaaccagaagatatagattgttggtgtaatctgacgagcacatgggtcatgtatgggacgtgcacgcagagcggtgaaagacgaagagagaaaagaagcgtagctctaactccgcattctgggatgggactcgaaacacgagctgaaacatggatgtcttccgaaggtgcgtggaaacacgcgcagcgggtggaatcatggattctcagaaatcctggtttcgcgcttcttgcaggatttatggcatatatgattggacagacaggcattcaaagaaccgtattctttgtccttatgatgctcgtcgctcccagttatggtatgcggtgtgtcggcgttggaaatcgtgactttgttgaaggagtatcgggaggtgcatgggttgatctggtgcttgaacatggaggatgtgtgacaactatggcccaaggaaaaccaacattagatttcgaactaacaaaaactacagcgaaagaagttgccttgttgagaacttattgtatagaagcctcaatctcaaacataactaccgcgacccgatgtccaactcaaggggaaccatatttaaaagaagaacaggaccagcagtatatatgccgaagagacgtagtggatcgagggtggggcaatggatgcggattatttgggaaaggaggtgtagtaacatgcgccaaattctcttgttcagggaaaattacaggcaatttggttcaaatagaaaacttagagtacacagtggtcgtaaccgttcacaatggtgatactcacgcggtcggtaacgatacttccaatcacggtgtaacagctacgataacgcctcgatcaccaagcgtcgaagtaaaactaccagattacggtgaactgacgttagactgcgaaccacgttctggcattgattttaacgaaatgatactcatgaaaatgaagaagaaaacttggctggtccataaacaatggttcttggatctccctttaccatggacaacaggggcggacactagcgaagttcattggaattataaagaaagaatggtaacatttaaagttccacatgcaaaacgtcaggatgtaactgtacttggatctcaagaaggggcaatgcatagcgctttagctggtgcaacggaagtcgacagtggcgatggcaatcatatgttcgctggacatcttaaatgcaaagtacgaatggagaaacttaggatcaaaggaatgagttacacaatgtgttcaggcaagttttcaattgataaagaaatggccgagacacaacatggcacgacagtagtcaaggtaaaatacgaaggagcaggcgccccttgtaaagtaccaatagaaattcgagatgtaaacaaagagaaagtggttggacgcgttatatccgcgacaccgctagccgaaaacacaaactcagtaaccaatattgagctggaacctccttttggagacagttacatagttattggagttggaaacagtgctttaacacttcactggtttcggaaaggaagttcaatcggcaaaatgttcgaatcgacatatcggggtgcaaaacgtatggcgatcttaggtgaaacagcatgggacttcggctcagtaggaggattatttacctcacttgggaaggctgttcaccagatctttggttctgtatatacgactatgtttggaggggtttcatggatgattagaattttgattgggtttctagtattatggatcggaactaactccaggaataccagtatggcgatgacatgtattgcagtaggaggcattactcttttcttaggtttcaccgttcaagcggacatggggtgtgttgtatcttggtctgggagagaactaaaatgcgggagcggtatattcgttgttgacaacgttcatacgtggacagaacaatataagtttcaaccagaatcaccagcgcgattagcatctgcgatcttaaacgcacataaagacggtgtatgtggcattcgctcgacgacgagattagaaaatgtcatgtggaaacagatcacaaatgaattaaattacgttctttgggaaggtggacacgatttgacagtagtagccggtgatgtaaaaggagtgctcactaaaggaaaacgtgccctgactccacccgcatccgacctaaagtattcttggaaaacctggggaaaagctaaaatatttacgcccgaagctcgtaatagcacatttctgatagatggccctgatacttccgagtgcccgaatgagaggcgtgcgtggaatagcttcgaggtcgaagattacggcttcggaatgtttacaactaacatttggatgaaattccgggaaggctcgtctgaagtatgcgatcacagacttatgagcgcagcaattaaagaccagaaagcagtacacgcggacatgggatattggatagagagctcgaaaaatcaaacatggcaaattgagcgagcatcgttaatcgaggttaagacgtgtttgtggccgaaaactcacactttatggtcaaacggcgtattagagtcacaaatgcttataccaaaaagctatgcgggtccattttctcaacataattacagacaaggttatgctacacaaaccgttggcccctggcacttaggaaaactcgaaattgatttcggagaatgccccggtacgaccgtaactattcaagaaaactgcgatcatcgtggtccgtctcttcgaacaacaacagcgagcgggaaattagtcacacaatggtgctgtagatcctgcactatgccaccactccgattccttggagaagatgggtgctggtacgggatggaaattagacccttaagcgagaaggaagaaaacatggtaaaaagccaagtaacagccgggcaaggaacgtctgaaaccttcagcatgggcctattatgcctcaccttattcgtagaggaatgtctaaggagacgtgtaacaagaaaacatatgatcctagcggtagtaattacattgtgcgcaataattttaggaggattgacctggatggatttactacgtgctttaattatgctaggagacaccatgagcggaagaattggaggtcaaactcatttggcgataatggctgtgtttaaaatgagtcctggttacgtactaggggtatttttacgtaagttaaccagtcgtgagacagccttgatggttataggtatggcaatgaccacgacattaagcatccctcatgacctaatggaattgattgacggtataagtctaggactgatacttctaaaaattgtcacgcagtttgataacacacaggtgggcacattggctctatcactcaccttcattcgtagtacaatgagtctagtaatggcatggaggactattatggccgtattatttgtagttacattgataccactttgtagaacctcatgtctccagaaacaaagccattgggtagagattacagccctcatacttggtgctcaagcccttccagtttatttaatgacgctaatgaagggagcgagccggcgaagctggccattgaatgaaggaataatggcagttggtttagtgtcactcttaggtagcgctcttttgaaaaatgacgtgcctttggcaggaccgatggtagctggagggttactattagcagcatacgtaatgtcgggatccagtgcagatctatcattagagaaagctgcgaatgtacaatgggacgagatggcagacatcaccggcagctctccgataatagaggtcaaacaagatgaagacggatctttctcaattagagacgtcgaggagacaaacatgataacgctacttgtaaaattggcacttattacagtcagtggtttgtatccacttgcaatacctattacaatgacactatggtatatgtggcaagtaaaaacacagcgatccggggcgttatgggatgttcctagccctgcagcaacgcagaaagcagcattgtctgaaggagtttatagaataatgcaaagaggtttattcggtaagacacaggtaggcgtcggtatccatatggagggagttttccacacgatgtggcacgtaactagaggttcggtaatatgtcacgagaccggtagattagaaccctcatgggcagacgttagaaacgatatgataagttacggtggaggttggcgtctcggagataagtgggataaggaagaagacgtccaagtattagctatagaaccggggaagaacccaaagcacgtccagacaaaacctggtcttttcaaaacactgactggagagattggagccgtaacacttgattttaaacctggtacaagtggtagccccatcattaataggaaagggaaagtgataggactatatggaaacggagttgtaacaaaaagcggagattatgtaagcgctataactcaggcagagagaatcggtgaaccagattatgaagtcgatgaagacatattcaggaagaaaagattaacaataatggatctacatccaggtgctgggaaaactaagaggatcctgccatccatagtccgagaggctttgaagcgaagattacgaacccttattctggcgccaactcgtgttgtggctgcagaaatggaggaagcactgcgtggacttcctatacgttaccaaacgcctgctgtaaagagtgaacatacagggagggagatagtagacctcatgtgccatgctacatttacaacaagactcctaagctcgacaagagtaccgaattataatttaatagtaatggacgaggcgcactttacggatcccagcagcgttgctgcaagaggatacatttcaacgcgtgtggaaatgggagaagcagcagcgatattcatgactgccactccaccgggggccacagatcctttccctcaaagtaacagtccgatcgaagacatcgaaagagaaattccagagcgctcgtggaataccggctttgattggataaccgattatcaaggaaaaaccgtgtggttcgttcctagcatcaaagccggtaatgacatcgcaaattgcttacgaaaaagtggaaagaaagtaatacaactttcgaggaaaacttttgatacagaatacccaaaaacaaaactcacggactgggactttgtagtaacaaccgatattagtgaaatgggagcaaattttagggcaggtagagtaattgatccaagacgatgtttaaaaccagtaatacttactgacggccctgaacgcgtgatattggccggtccaattccagtgactccagcttcggcagcgcagcgtcgtgggaggattggaagaaaccccgcacaggaggatgatcaatacgtgttctctggtgaccctcttaaaaacgatgaagatcatgcacactggacagaagcaaaaatgttactagataatatctataccccagaaggaatcatacccactctattcgggccagaaagggagaaaactcaggcaatagacggtgaatttcgactgcgaggggaacagcggaaaacctttgtggaactaatgcgtaggggtgatttacccgtatggttatcctacaaagtggcgtcagcaggcatttcgtataaagacagggagtggtgcttcactggggaaaggaataatcaaattttagaggaaaacatggaagtggagatttggacaagagaaggcgagaagaagaaactaaggcctaaatggctagatgcgagagtatacgcagatccgatggcactaaaagattttaaggaatttgcatccggaagaaaatcaataaccctagatatcttaacagaaatagctagcctgccgacatacttaagctcccgagccaagttagcactggacaatatagtaatgttgcatacaaccgaaagaggaggtcgggcataccaacatgccctaaacgaacttccagaatccctagaaacactaatgctagttgccctattaggtgctatgacagctggtatattcctattcttcatgcaagggaagggcatgggaaagctatcgatgggattaataacaattgctgttgcaagcgggttactttgggttgcggagatacaaccgcagtggatagcggcaagtataattctagaatttttcctaatggtactcttaatcccagagccagaaaaacagagaaccccgcaagacaatcaactaatttatgtgattctcacaattctaactataataggactaatagctgcaaatgagatgggactaattgagaaaactaaaaccgattttgggttttaccaggtaaaaacagaaacaacaatacttgatgtagatttacggccagcttcagcatggaccttgtacgcagtagcgacaacaatattgactccaatgctacgtcatactatagaaaacacaagcgcaaatctatcgctggcagccattgcaaatcaggcagcagtattaatggggctcggcaaaggttggccgttacatagaatggatcttggggtacctttattagctatgggctgttattcacaagtaaacccaacaactttaactgcgagcctagtaatgttattagtccactacgcgataataggtccaggattacaagctaaagccactcgggaagcgcagaaaagaactgccgcgggaattatgaaaaatccaactgtagatggcataacggtaatagatctagaaccgatttcatatgacccaaagtttgaaaaacaactaggtcaagtaatgctattagtcctatgcgcaggacagctatttttaatgcgtaccacctgggccttttgcgaagtcctaaccctagcaactggtccgattctaacattgtgggaaggaaaccctggcagattttggaatactacaattgcagtgagcaccgccaacatatttcggggaagctatcttgcaggggctggattagcattcagtctcataaagaatgctcaaactcccaggcgaggaaccggaacaactggtgaaactttaggagagaagtggaagcgacaattaaatagtctcgaccgaaaggagtttgaggagtacaagaggtctggtatactcgaggtggatcgaacagaagcaaaatcagcacttaaggatggcagcaaaataaaacacgcagtatctagaggatcgagcaaaataaggtggatcgtagaacggggtatggtcaagccaaaaggcaaagtggtagatcttggttgcggtcgtggtggttggtcctattatatggcgacattgaaaaatgtaaccgaagtaaaaggctacaccaaaggaggtcccggacacgaggagccaatcccaatggcaacatacggttggaacttagtaaaactacacagcggtgtggatgtattttataaacccactgaacaagtcgacacgttattatgcgatattggcgaaagttcatccaatcccaccatagaagaaggacgtacattaagagtcttaaaaatggtggaaccatggctttcctctaagccagagttttgtatcaaagtattaaacccttacatgcctactgtcatagaagaattagaaaaactccagcggaaacacggtggaaatttagtaagatgtccactcagtcgaaattcaacacacgaaatgtattgggtatcgggcgcttcaggcaacatcgtatcaagtgtaaatacgacatccaaaatgctcctaaatagatttactaccaggcatcgaaagcccacatacgaaaaagatgttgacctcggtgcaggaacaaggagtgtcagcacagagactgaaaaacctgatatgactattatcggcagaaggctacaaaggctgcaagaagaacataaagagacatggcactacgaccaggagaacccatatagaacatgggcttaccatggatcatacgaggcgccgagcactggtagcgcgtcaagtatggttaatggagtagtcaaattgctaacaaaaccatgggacgtaatccctatggtaactcaattagcgatgacggatactacacccttcggccaacaaagagtatttaaagagaaagtcgacactagaacaccacaaccaaaacccggaactcgtatggtgatgacaacaacagcaaactggttatgggctctattggggaagaagaaaaacccaagattatgtaccagagaggagtttatttcaaaggttcgatcaaatgcagcaattggtgcagtatttcaggaagaacaaggatggacaagtgctagcgaagcagtgaatgatagtcggttctgggaattggttgacaaagagagagctttacatcaagaaggcaaatgcgaaagttgcgtatacaatatgatgggcaaacgagagaagaaattaggagaatttggtagagcaaaagggagtcgagctatctggtatatgtggcttggagctcgtttcttggagttcgaggcccttggatttcttaatgaagatcattggtttggacgagagaacagttggagcggagtagaaggagaaggtctgcatcgactcggttacattttagaggaaattgacaagaaagacggtgatttgatgtacgcagatgacacggcgggctgggacacacgcatcacagaggacgatttacaaaacgaagaattaataacagaacagatggcgcctcaccacaaaatactagcaaaagcaatcttcaaattaacgtaccaaaataaggtcgttaaagtattacgcccaaccccaagaggagccgtaatggatataatatcaaggaaagatcagagggggtccggccaggtaggaacatacggcctgaatacctttacgaatatggaagttcaattaatccgtcagatggaagcggaaggagtcattactcaggacgacatgcagaatcctaaaggccttaaagaaagggtcgagaagtggttaagagaatgtggtgtagatagactaaaaaggatggcgattagtggggatgactgtgtggtaaaacccttagatgagagattcgggacctctctattgtttttaaatgatatgggtaaagtgcgtaaagatatacctcaatgggagccgagtaagggttggaaaaactggcaagaagtacctttttgttcccatcactttcataaaatttttatgaaagacgggagatctttagtagtaccttgcaggaatcaggatgaactcatcggacgcgctaggatctcacaaggggctggatggtctctgagggaaacagcttgtcttggcaaggcttatgcacaaatgtggagcctgatgtattttcaccgtcgcgacttaagactagcaagtatggccatatgttctgcagttccaacggaatggtttcctaccagcagaacaacatggtcaattcacgctcatcatcaatggatgacaacagaagatatgcttaaggtgtggaaccgtgtatggatagaggataacccgaacatgatagataagacaccagtacatagttgggaagatattccttacctaggtaagagagaagatctctggtgcggaagtttaataggattgtcctccagggcaacatgggccaaaaatattcacactgcaattacacaagtaaggaatttaattggaaaagaagagtatgtggactatatgcccgctatgaaacgatattccgccccaagtgaatcagaaggtgttttgtaa

SEQ ID NO: 23629 - RNA, 9867 nt, synthetic construct
  misc_feature 1..9867: note = derived and/or modified CDS sequence (opt6) from DENV-4__FJ639736__SS-prME
  source 1..9867: mol_type = other RNA
tctactatgaccctattgtgtcttataccaactgcgatggcttttcatctttcaactcgcgacggtgaaccattgatgattgttgcaaaacacgaacgaggacggccattactttttaaaacaacagaaggaattaataaatgtacgctgatagccatggacctgggagaaatgtgtgaagacacagttacatataaatgtccattgttggttaataccgaaccggaagacatagactgctggtgcaatttaacttctacttgggttatgtatgggacatgtactcaatcaggagaaagacgtagagaaaaacgaagcgtggcattgaccccgcatagcggtatgggacttgagactagagctgagacttggatgtcctcagaaggagcatggaaacatgcacaacgtgttgaatcttggatattaaggaatcccggtttcgcacttcttgctggtttcatggcttacatgattggacagacagggatacagaggacagtattctttgtgttaatgatgctagttgctcctagttacggcatgcgctgcgtaggtgtcggcaacagagattttgttgaaggcgtttcaggaggagcttgggtggatctcgttttggagcacggaggatgtgtcacaacaatggcccagggtaaaccaacattagatttcgaattaaccaaaaccaccgcgaaagaagtagccttgttaagaacatattgtattgaggcattaattagcaatatcacgacggcgacacggtgtcctactcagggagagccatacttgaaagaagaacaggatcaacaatacatttgtcgacgggatgtagtagataggggctggggtaacggatgtggtttattcggtaaaggcggggtggtcacttgcgcgaaattcagctgttccggaaaaataacaggaaaccttgtacaaatagaaaatttagagtacacggtcgtagtaacagtacataatggtgatactcacgccgtggggaatgatacaagcaatcatggagttacagcaaccattacacctagatcacctagtgttgaagtgaagttacccgactatggagaactaacactagactgtgaacctagatcagggatcgactttaacgaaatgattttgatgaaaatgaagaaaaagacttggttagtgcataaacaatggttccttgatcttccattgccctggacagcgggtgctgacacatcggaagttcattggaactataaagagagaatggtaacttttaaagtgcctcacgcaaaacgacaggacgttacggttctaggttcacaagagggagcaatgcactcagctctagcaggggctacagaagttgattccggcgacggaaaccatatgtttgctgggcatttaaaatgtaaagttaggatggaaaagctcagaataaagggcatgtcatacaccatgtgctcgggaaaattctccatagataaagaaatggctgaaacacaacatgggactaccgttgtcaaggtgaaatatgagggagcaggggctccctgtaaagttcctattgaaatcagagacgtgaataaagaaaaagtagtaggtagagttattagttcaacgcctttagctgaaaacactaattccgtaacgaatattgaattagaaccgcccttcggagacagttatattgtaatcggggttggcaatagcgcgctaacattacattggtttcggaagggatcgtcaataggcaaaatgtttgaatctacatatagaggtgcgaaaagaatggcaattcttggggaaacggcatgggattttggaagcgtagggggattgttcacaagtttagggaaagcagtgcatcaagtatttggatcagtatatacaaccatgtttggtggagtttcttggatgatacgaatccttatagggtttttagttctttggattggtactaacagcagaaatacaagcatggcaatgacatgcatagcggtcggaggtatcactctgtttctcggatttacggtgcaggcagatatggggtgtgtagttagttggagtggccgagagttaaagtgtggttccggtattttcgtagttgacaatgtacatacatggacagaacagtacaaatttcaacctgaatctcctgcccgcttagcatcagctatcttgaatgcacataaggacggagtgtgcgggattagatcaacaactcgattagaaaacgtaatgtggaaacagatcaccaatgagttaaactacgtactgtgggaagggggtcatgacctaacagtggtcgcaggagatgttaagggggttttgacgaaaggtaagagggcattaactccaccggtttctgatttaaaatacagttggaaaacatggggtaaagcaaaaatattcactcctgaagcacgtaactccactttcttaatagatggaccggacacgtcggagtgtccgaacgaaagacgagcatggaactcactagaagtagaagattatggatttggaatgttcactaccaatatatggatgaaatttagagagggcagttcagaggtgtgcgatcatcgcttgatgtcagcggcgataaaagaccagaaagctgttcacgcagacatggggtattggattgagagcagcaaaaatcaaacgtggcaaattgagcgagcttccttaatcgaggtgaaaacttgcttatggccaaaaacacatacgctatggtcgaatggagtattggaatctcaaatgttaataccgaaatcatatgcaggaccctttagtcaacataactatcgtcaggggtatgcgacacagacagtcggaccttggcatctcgggaaattagagattgacttcggagaatgcccaggaaccacagtcacgatccaagaagactgcgaccacagagggcccagcttaagaactacaacggcgagcggaaagctggttacccaatggtgctgccgatcttgcacaatgccacccttgcgatttctaggagaagacggatgctggtacggaatggaaattagacccttgtcagaaaaagaagagaatatggttaaaagtcaagtaactgcgggccaagggacgtccgagacttttagcatgggcctcttgtgcctaacactattcgttgaagaatgtctgcgaaggagagttacgaggaaacatatgattttggcagtagtaatcacactctgtgccatcatcctaggaggcctaacatggatggatttattgagagcactaataatgctgggtgacacaatgtcaggacggattgggggtcaaacgcatcttgccatcatggcagtattcaaaatgagtccaggatacgtactaggcgttttcctaagaaaattgacttcaagggaaactgctttaatggttataggtatggcaatgaccacaactttatcaatcccacatgacctgatggaattgatagacggcatatctctagggctgatactgctcaagattgtaacacaattcgataacacacaagttggcacgctggcgttgtccctcacatttataagaagtactatgagtctggtaatggcttggcgaactattatggctgttctatttgtagtaacattaatcccgttatgccgtacatcgtgccttcaaaaacaatcccattgggtagaaataacagcattgatattaggcgcccaagctctacctgtatacttaatgacgctaatgaaaggtgcgtcccgtaggagttggcctttaaacgaagggataatggcagtaggcctagtaagtctactaggtagtgcgctactgaagaatgatgtaccacttgcaggtcctatggttgcgggtgggttattattagcagcgtacgtaatgtcaggaagttcagcagaccttagtttagaaaaagcagcaaatgtgcaatgggatgaaatggcagatatcaccggtagtagcccgataatcgaagtgaaacaggatgaagatggctcgttctcaattagggatgtagaagaaactaatatgattacgttacttgttaaacttgctctgataacagtatctggtctatatccacttgcgataccagtaactatgacgctatggtatatgtggcaggttaagactcagagaagtggcgcactttgggatgtcccctcgcccgctgccactcaaaaagcagcattatcggagggagtgtatagaataatgcagagaggattattcggaaaaactcaggtaggcgttggaatacatatggagggagtattccacacgatgtggcatgtgactagaggaagtgtgatttgccatgaaacaggcagactagagccctcgtgggccgatgtcaggaacgatatgataagttacgggggaggatggaggctcggggataagtgggataaagaggaagatgttcaagtcttggcaattgagcctggcaaaaatccgaagcacgtacaaacgaaacctggactttttaaaacattaacaggggaaattggtgctgtgacccttgactttaaacctggaacaagtggttccccaataattaaccgcaagggaaaagtaataggtctgtacggaaatggtgttgtcacgaagagtggagactacgttagtgcgataacacaagcagaaagaataggcgagccagactatgaagtagatgaagacatatttcgaaagaaaaggctgactattatggacttacatccaggcgctgggaaaaccaaaaggatattaccctcgatagtccgagaagctctgaagagaagattaaggacgctaattctcgcacccacgcgtgtcgttgcagcggaaatggaagaggcacttagaggattaccaattagatatcaaacaccagctgtaaaaagtgaacacacaggcagggaaattgtcgacttaatgtgtcacgccacatttactacaagactacttagcagcacacgagtaccaaattataacttaatagttatggatgaagcgcattttacagatccctctagcgtagccgctagagggtacatttctaccagagtggaaatgggtgaagcagcagcgatctttatgaccgcgacaccacccggagctacggatccgttcccacaaagtaacagcccaatagaggatatagagcgtgaaatccccgaaaggagctggaacaccgggtttgattggataaccgactaccaaggaaaaacagtatggtttgtaccatcaataaaagcgggaaacgatattgcaaattgtcttcgaaaatcaggtaaaaaggtcatacaactatcacgaaaaacctttgacaccgagtaccctaagacaaaacttacagactgggatttcgtcgtaaccacagacataagtgaaatgggcgccaattttcgtgcaggccgggtcatcgatccaaggagatgtttaaaacctgtaattttaactgatggaccagagagagtaattttagcaggtcctatccctgtcacccccgcttcagccgcccagagacggggaaggattggcaggaatccagcgcaggaagacgatcaatatgtattttcaggagacccattgaaaaacgacgaggatcatgcacattggacggaagctaaaatgttactggacaacatttacacaccggaagggataatacctacactattcggtcctgagcgagagaaaactcaagcgatagatggtgaatttcggttgagaggtgaacagcgaaagacatttgtagaactaatgcgcagaggagatctccctgtatggctctcatataaagtggcttccgcaggaatcagttataaagaccgagagtggtgtttcactggagaacgcaacaatcaaattcttgaagagaacatggaagtcgaaatttggacgagagaaggggagaaaaagaaattgcgtccaagatggttggatgcaagagtatatgccgatcctatggccctaaaagacttcaaggagttcgcaagtggaagaaaatctatcacgcttgacatactaactgaaatagcaagcctaccaacttacctgtcttcaagagctaagttggccttggacaacatagtaatgttacatacaacggaaagaggtggtagagcttaccaacatgccctcaatgaattaccggaaagtctggaaacgttaatgctagtggctttgttaggagcaatgacggccgggatattcctattctttatgcaaggaaaaggaataggtaaattatcaatgggcttgattactatagcagtagcaagtggcttattgtgggtagcagaaatacaaccccaatggatagcagcttcaataatcctagagttcttcctaatggtgttattgattccagaaccagaaaaacaacgaacacctcaagacaaccaacttatttatgtaatattaacaattttgacaattataggactgatagcagcgaacgaaatgggactaatagagaagacgaaaacggattttggattctatcaggttaaaacagaaacgaccatactagatgtagaccttcgaccagctagtgcatggactctttacgcagtagctacaacaattcttacacccatgttacgacacactatagagaatacgtcagctaacctaagtctagctgcgattgcgaatcaagcagcagtattaatgggattaggaaagggatggccattacatcgaatggacctgggcgttccactgttagcgatggggtgttattctcaggtaaacccaacaacattaacggcatccttggtaatgttattggtacattatgcgattattggacccggtttacaggccaaggcaactagggaggcacagaaaaggacggctgcaggcattatgaaaaatcctactgtggatggtataacggtgattgatcttgagccaattagttatgacccaaaatttgaaaaacaattaggtcaagtaatgctacttgtattatgtgcaggacaattattactaatgagaacaacatgggcattttgtgaagtcttgactttagcgacgggcccaatattaacgctatgggaagggaaccccggacgattctggaatactacgattgcagtgagcacagcaaacatatttcgcgggtcttatttagctggcgccgggttagcgttttcactcatcaaaaatgctcagacacctcgaagggggactggaactacaggagaaacattaggagaaaaatggaagagacaattgaactcacttgacaggaaggagttcgaggagtacaaaaggtcaggcatattagaggtagatcgcacagaggccaagtccgcattgaaagacggctccaaaatcaaacatgcggttagtcgcggaagttcaaagattcgatggatcgttgaaagaggtatggtaaagccaaagggaaaggttgtggacttgggatgtgggcgaggagggtggtcatattacatggcaacccttaaaaatgtaacggaagttaaagggtatacaaaaggtggaccaggtcacgaagaaccaattcctatggctacatatggatggaatctggtgaaactacattctggcgtagatgtattttataaacctactgaacaagtcgatacattgctttgtgacattggggaaagttcttcaaaccctactattgaagaaggacgtactttacgtgtcctgaaaatggtagaaccgtggctttccagtaaaccggagttctgcataaaagtattgaatccctacatgccaacggtaattgaagaattggaaaaactccaaaggaagcatggaggtaacttagtccgctgcccgttgtcaagaaacagcacgcacgagatgtattgggttagtggtgcaagcggaaatatcgtgagtagcgtaaacacaacatcaaaaatgctgttaaatagatttacaaccagacaccgaaaacctacatatgaaaaagatgtggacttgggagccggaacccgatcagtctccacagaaacagagaagcctgatatgacaattataggcagaagactgcagcggttgcaagaggaacataaagagacttggcattatgaccaggaaaacccgtatcgcacgtgggcatatcacggaagctacgaggctccaagtacgggttctgcatcgagtatggtaaacggagtcgtgaaacttctgaccaaaccatgggatgttatacccatggtcacgcaactagcgatgacagatacgactccttttggacaacaacgagtatttaaagagaaggtagatactcgaactccccagcctaagcccgggactagaatggtaatgacaacaactgcaaattggttatgggcattactaggcaagaagaaaaaccccagactttgtacacgcgaagagttcattagtaaagtacgaagtaacgccgcaatcggtgctgtattccaggaggaacaaggttggacttcagcatcagaagctgtaaacgatagccggttctgggaactggtggacaaggagcgagcattacatcaagaaggaaagtgtgagagttgtgtatacaatatgatgggaaaaagggagaagaaattaggagaatttggtagagccaagggaagtcgagcaatttggtatatgtggttaggagcaagattcttggaatttgaagcgttaggttttctaaacgaagaccattggtttggaagggaaaacagctggagcggcgtggagggggagggcttacatagacttggatatatcttagaagaaattgataagaaagatggagatttaatgtatgcagatgacacagcgggatgggataccagaataacggaagacgacctgcagaatgaagagttaataacggagcaaatggcgccacaccataaaattctggcaaaagcgattttcaaactcacatatcaaaacaaagttgttaaggtattaagaccaacaccacgtggagcggtcatggacattatatcacggaaggatcaacgtggttcaggacaagtaggtacatacggtctaaacacattcaccaacatggaagtccagttgattaggcaaatggaagcggaaggcgtgattacacaagatgatatgcaaaatccaaaaggactcaaggaacgggtcgaaaaatggttgagggaatgcggcgtagatagattgaaaaggatggctattagcggagatgactgtgtggtaaagccactagatgagcgtttcgggacgtccttactatttctgaatgatatggggaaggtaagaaaggacataccacaatgggaaccctccaaaggatggaaaaactggcaagaagtaccattctgtagtcatcatttccacaaaatctttatgaaagatgggcgatcacttgtagtcccctgcaggaatcaagatgaactgataggcagagcaaggataagccagggagcaggatggtcattacgagagaccgcatgtctaggcaaagcgtatgctcaaatgtggtcattgatgtatttccacaggcgcgaccttaggttagcttcaatggcaatctgctcagctgtcccgaccgaatggttcccgacgtccagaaccacctggtcaatacacgctcatcatcaatggatgaccacggaagacatgctaaaggtctggaatagagtttggattgaagacaatcccaacatgattgacaagactccagttcactcatgggaagatattccctacttaggcaaaagagaggatctttggtgcggatcgctgataggcctgagcagcagagccacatgggccaaaaacatacataccgcaatcacacaagtgcgtaatttaataggaaaagaagaatatgttgactatatgcccgtaatgaagagatactcagcaccaagcgaaagcgaaggggtgttgtaa

SEQ ID NO: 23630 - RNA, 9867 nt, synthetic construct
  misc_feature 1..9867: note = derived and/or modified CDS sequence (opt6) from DENV-4__FJ639737__SS-prME
  source 1..9867: mol_type = other RNA
tcgactataactctactttgcctaataccaaccgtaatggcatttcacttgagtactagagatggggaacctctaatgatagtagccaaacatgaacgtggtaggccattactattcaaaaccactgaagggataaataaatgtaccctaatagcaatggacttaggtgaaatgtgcgaagatacggtaacttataaatgcccattattaataaacacagaaccggaggatattgactgttggtgtaatcttacaagtacgtgggtaatgtacggtacatgcactcaatcaggtgaaaggcgtagagagaaacgaagcgttgcgttaactccacactcagggatgggattggaaactcgagcagagacatggatgtctagcgaaggtgcttggaaacacgcccaaagagtcgaatcatggatcctacgcaatcccggttttgcactactcgctggtttcatggcctatatgataggacaaactggaatacaacgtactgtcttctttgtgctgatgatgctcgtagcaccaagctacggaatgagatgtgtaggagtgggtaatcgagacttcgtagaaggagtatcaggaggggcttgggtggaccttgtgttggagcatggtggttgtgtaacaacaatggcgcaaggcaaacctaccctggatttcgagctgacaaaaactacagcaaaagaagtggcattactccgaacgtactgcatagaggcgttgatatcaaatataactaccgcaacaagatgtccaacacaaggagagccttatttaaaagaagaacaagatcaacaatatatatgtaggcgcgatgttgtagataggggatgggggaacggctgtggactttttggcaaaggaggagtagtaacttgcgcaaaattctcatgctcaggcaaaattacaggaaacttagttcaaattgagaaccttgaatatacagttgtggtgacagtacacaacggggatacccatgctgtggggaatgatacatcaaatcatggcgttaccgctacgataactccacgaagtcccagcgtagaagtcaaattaccagattacggtgaactgacgcttgattgcgaaccaagatccggtattgatttcaacgaaatgatattaatgaaaatgaaaaagaaaacttggcttgtgcataaacagtggttccttgacctaccgttaccttggacagcaggagccgatacttccgaggttcactggaattacaaagaaagaatggtaacatttaaagtgccccacgcaaaaagacaagatgtaacagtgctaggatcacaggaaggagctatgcattcagcacttgccggagcgactgaagtagacagtggagacggaaatcatatgttcgcagggcacctaaaatgcaaagtgagaatggaaaaactccgtataaaaggtatgagttacacaatgtgttcgggaaaattttctatagacaaagaaatggcagaaacccagcacggaactacagtcgtaaaagtcaaatatgaaggtgcaggcgctccttgcaaagtgccaatagaaataagagatgtcaataaagaaaaagtcgtgggtcgggtaatctcctcaaccccacttgcagagaatacaaattcagtgacaaatatagaactagaaccccctttcggtgattcttatatagtcatcggagtcggaaattccgcactaacattacattggtttagaaaaggctcgagcattgggaaaatgttcgaatcaacttataggggagcgaagcgaatggcgattttaggggagacagcatgggacttcgggtccgtaggagggcttttcacatcactgggtaaggctgtacaccaagtatttggatctgtatatactacaatgttcggaggggtaagttggatgattaggattctaataggattcttagtcttatggataggcacaaattctagaaacacttcaatggccatgacttgcatagctgtcggtggtataaccttatttctaggatttacagtccaagcagatatgggatgtgtggtatcatggtcgggaagggaactgaagtgtggaagcggtatcttcgtagtggataatgtacacacatggacggaacaatacaaatttcagcctgaatctccagcaagactggcctcagctatattaaacgcgcacaaagatggagtctgcggcatcagatcgaccactagattagaaaatgttatgtggaagcagatcacgaacgaactgaactatgttctttgggagggaggacatgatttaacagtggtagccggggatgttaaaggggtattaaccaagggaaaacgagccctcacgccaccagtgtcggatttaaaatactcttggaaaacgtggggtaaggcaaagatattcaccccagaagcccgtaattccacttttcttattgacgggcctgatacaagcgagtgtccgaatgaacgccgagcttggaatagtttggaggtcgaggactatggctttggaatgtttacaaccaatatttggatgaaattcagagaaggatcgtcagaggtttgtgaccatcgcctaatgtctgcagcaattaaggaccaaaaggctgtccacgctgatatggggtactggatagaatccagcaaaaatcaaacatggcaaattgaaagagcatcattaatagaagtaaaaacctgcttatggccgaagacacataccctttggtccaatggagtattagaaagtcaaatgttgataccaaaatcctatgcaggccccttcagccagcataattatcgtcaaggatatgcaacccaaaccgtgggaccctggcatttaggaaaacttgaaatagacttcggggaatgccctggaactacagtaactatacaagaagattgcgatcaccgcggcccatctctacgtactactacggcctcaggtaaattggttacgcaatggtgctgcagatcgtgcaccatgccaccactacgattccttggcgaagacggctgctggtacgggatggaaatacgacccctcagtgagaaagaagaaaacatggtaaagtcgcaagtgaccgcaggccaaggaacttctgaaacgtttagcatggggttactatgtttaaccttatttgtcgaggaatgtcttagaaggcgggtcacgcgaaaacacatgatattagcagtagtaatcacactgtgcgcgataatcctagggggactaacgtggatggacttattgagggccttaataatgttaggagatactatgtcagggcgaataggaggtcaaacacaccttgcgataatggccgtcttcaagatgagtcctggttatgtcttgggagtattcctcagaaaattaacatcaagggaaaccgctctaatggttattggtatggcaatgaccacaactctaagtattccacatgatctaatggaattaatagatggtatctctttggggttgatactattgaaaatagtaacacaattcgacgatactcaggtaggtacattagcactcagtcttacatttatacgtagcactatgagtttagtaatggcatggaggacaataatggcagtattattcgtcgtgacactaatcccattgtgcaggacctcatgtcttcaaaaacaatctcactgggtggagataacagcactcattctaggtgcacaggctctcccggtctacctaatgaccctcatgaaaggagcttcacgaagaagctggccattgaatgaaggaataatggcagtaggtttagtttctttattaggttcagcattactcaaaaatgacgtcccgttagcaggtcctatggttgctggagggctgttattagcagcgtatgtgatgagtggctccagcgccgatctctcattggagaaagcagcatccgtacaatgggatgagatggcggatatcaccggcagctcccctataatagaagttaaacaggatgaagacgggagtttttccattagagatgttgaagaaacaaatatgataacacttcttgtgaagctcgcacttataacagtaagcggactctatccactggcgataccagtaactatgactttatggtatatgtggcaagtaaaaacacagaggtccggagcactctgggatgtcccatctcctgcagctacacagaaggccgcactatctgaaggtgtttaccggattatgcaaagaggtctatttggaaaaacacaggttggggtaggaatccatatcgaaggcgtatttcatacaatgtggcatgttacacgtggatctgttatttgccatgaaacgggtcggcttgaaccgagttgggctgatgttcgaaatgatatgattagttatgggggcggatggaggttgggcgataagtgggataaagaagaggatgttcaagtattagcaattgaaccaggcaaaaatccgaaacacgtgcaaactaaacccgggctatttaagaccctaacgggagaaataggcgctgtcaccttagatttcaaaccaggtacaagtggctctccaattattaatcgtaaaggtaaagtaataggattgtatgggaatggcgtcgtgacaaaatcaggggattatgtatccgcaattactcaagcagagagaataggtgaaccagactacgaagtcgacgaagacatttttagaaagaaacgactaacaataatggacctgcatccaggagcgggcaaaacaaaacgaatactaccatcaattgtgagggaggctttaaaacgaagattgcggacccttatactagctcctacacgagtagtagctgcggaaatggaagaagcacttcgaggcttaccgattcgttatcaaactcctgctgttaaaagtgaacataccggaagggagattgtagacctgatgtgtcatgcaacatttacgacaaggctactatcatccacacgtgtaccaaattataacctaatcgtaatggacgaagcccattttacggatccatcgtccgtagcggcaagaggctatatatcaacccgggtggaaatgggcgaagctgcagcaatattcatgactgctacccctccaggtgctacagatcccttccctcagtcaaattcacctatcgaagatattgaacgcgaaatccccgaaagaagttggaacacaggatttgactggataacagattaccagggtaaaactgtttggtttgtcccatcgataaaagcaggcaacgatatagccaactgcttaagaaaaagcggcaagaaagtgattcagctaagtagaaaaacttttgacactgagtatccaaaaacaaaactcactgattgggactttgtagtcaccacggatataagcgaaatgggggcgaattttagggcaggacgagtaatagaccctcgcagatgtctaaaaccagtaatattaacggatggacccgaaagggtaatattagctggaccaataccagtaacacccgcctcagccgctcagagacggggcaggattgggagaaacccagcacaagaagatgatcaatatgtttttagtggtgatccacttaagaatgacgaagatcatgcacactggacagaagcaaaaatgttgttagacaatatctatacgccggagggcatcatacctactctatttggaccggaaagagagaaaacccaggcaatcgacggagagtttaggttgcggggagaacaacgtaaaacgtttgtagaactaatgagacgaggtgatcttccagtatggctctcgtataaagtggcgagcgctgggataagttacaaagatcgagaatggtgctttaccggggaaaggaataaccagattcttgaggaaaacatggaggtagaaatttggacacgcgagggtgagaagaagaaattaagaccacgatggttagacgcgcgtgtctacgcagatcccatggctttaaaggatttcaaagaatttgctagcggacgaaaatctattacccttgacattctcacagaaatagcgagtctaccgacttacctttctagtagagcgaaactagcgttagataacattgttatgcttcatacaacagagcgtggtggcagagcataccagcatgccttgaacgaattacccgaatcgttagagactctaatgttagttgcattgttgggtgccatgaccgcaggaatatttctattctttatgcaaggaaaaggtattggtaaactttcaatgggactcatcacgatagctgtagcatcgggactgctctgggttgcggagatacaaccacaatggatagctgcttcaattatactcgaatttttcctaatggttctgctgattcctgaacctgaaaaacagcgtacccctcaagataatcaattaatctatgtaatattaacaattttaactatcatcggactaatagcagcaaatgaaatgggtctaatagagaaaaccaagaccgacttcggcttttaccaggtaaaaacagaaacaacaatactagatgtggatctacgaccagcgagcgcctggacgttatacgctgtagcaactaccatccttaccccgatgttaaggcacacaatcgaaaatacgagcgctaatttatctctcgcagcgatagcaaatcaagccgcggtactgatgggtctgggtaaagggtggccactccacagaatggaccttggtgtacctttgctagcaatgggatgctactcccaagtaaatcccacaacacttacagctagcctagtgatgttattggttcactatgccatcataggaccaggacttcaagcaaaggcaactagagaggcccagaaaaggacggcagccggtataatgaaaaatccgacagtagatgggataacggtcatagatctcgagccgataagttatgaccccaaatttgaaaagcaacttggacaagtaatgctacttgtattatgtgccgggcagctattattgatgagaaccacatgggctttctgcgaggtcctgacgttagccactggacctatactcacactttgggaaggaaacccaggaagattctggaataccacaattgcagtctcaactgccaatatctttcgtggatcctacctagctggggcaggactcgcgttcagtctaataaagaatgcacagacacctagacgagggacaggtactacaggggaaacactaggagaaaagtggaaaagacaattaaacagcttagataggaaagaatttgaagaatacaagcgaagcgggatcttagaagttgaccgtaccgaagcaaaaagtgctcttaaggacggatcaaaaattaagcatgcagttagtcgtggatcttcaaagattcgctggattgtagaacgcggaatggttaaaccaaaaggtaaagttgtcgacttagggtgtggccgaggagggtggagctattatatggcaactttgaaaaatgtcacggaggtgaaaggatacacgaaagggggacctgggcacgaggaacctatacccatggcaacatatggatggaatttagttaaattacattcaggagttgatgtgttctataagcctatagagcaagttgacacccttttatgtgatataggagaatcatcatcaaacccaaccatagaagaaggtcgcactttgagagtattaaagatggttgaaccatggttatcaagtaagccggaattttgtattaaagtactaaatccatacatgccaaccgtaatcgaagaattagagaaactacaaagaaaacacggtggtaatttagtgaggtgccctttgtctaggaatagcactcatgagatgtattgggttagtggagcgagcggcaacattgtgagctctgttaacacgacgtccaagatgctgttaaatcgttttacaacacgccatagaaaacctacatacgaaaaagacgtagacttaggtgcaggaacgagaagtgtatcaaccgaaaccgaaaaaccagatatgacgattattggacgaaggttacaaagacttcaggaagaacataaagaaacatggcactatgatcaagaaaatccatacagaacgtgggcgtatcatggttcctatgaagcgccaagtaccggtagtgcgagcagtatggttaacggtgtagtgaaactcttaaccaagccttgggatgttatacctatggtcacacagttagccatgacggacacaacgccattcggtcagcaacgagttttcaaagaaaaagtagatacacgaactcctcagccaaaaccagggacgagaatggtcatgacgacaacggcaaactggttatgggcattgttgggcaagaagaaaaacccgcggctctgtacgcgagaggaatttatatccaaagtgagatcgaatgctgctataggggccgtctttcaagaagaacaaggctggacatctgcctcagaagcggtcaacgactcaagattttgggagctagtcgataaagaaagggcattacaccaagaagggaaatgtgaatcgtgtgtttataacatgatgggaaagagggagaagaaactcggagaatttggccgtgccaaaggttcaagagctatttggtatatgtggttaggggcgcgatttcttgaatttgaagcgctgggctttttaaatgaagaccactggtttggtcgagaaaacagttggtctggggttgagggtgaaggcttacaccgacttggctatatactagaagagatagacaagaaagacggagatttgatgtatgctgacgatacagcaggatgggatacgcgaataacggaggatgatttgcaaaatgaagaattgattacggagcaaatggccccgcatcataaaatactagctaaggcaatctttaaactgacgtatcaaaacaaagtagtcaaagtacttagacctacgcctagaggagctgtaatggatataatatctagaaaagatcagcgaggttcgggacaagtcgggacatacgggctaaatacatttacaaatatggaagttcaactaataagacaaatggaggcagagggcgtaattacacaggatgatatgcaaaatccgaaaggtttaaaagaaagggtggaaaagtggttaagagaatgtggcgttgatagattgaaacgtatggcaataagtggcgatgactgtgtagtgaaacccctagacgaacgattcggtacaagtttattattcttaaatgatatgggtaaagtaagaaaagatatacctcagtgggaaccatcgaaaggttggaaaaattggcaagaagtacccttttgcagccatcatttccacaaaatattcatgaaggacggaagatccttagttgtaccttgtagaaaccaggacgaattgatcggccgagctagaatcagtcaaggtgccggctggtcgttacgtgagacagcctgcctaggtaaagcatacgcgcagatgtggagtcttatgtatttccaccgtcgtgatctaaggttagcatcaatggccatttgttcggccgtacctacagaatggtttccaacatcaagaactacatggagtatccatgctcaccatcaatggatgacaacagaggatatgttgaaagtgtggaatagagtttggatagaagacaatcccaatatgattgataagaccccagtgcattcttgggaggacatcccatatttagggaaacgagaggatttatggtgcggttcgctcatcggactctcatcgagagccacgtgggccaaaaatatacatacagctataactcaagttagaaatcttattggaaaggaagagtatgtcgattacatgccggtaatgaaaagatatagcgccccaagcgagagtgaaggagtactataa

SEQ ID NO: 23631 - RNA, 9867 nt, synthetic construct
  misc_feature 1..9867: note = derived and/or modified CDS sequence (opt6) from DENV-4__FJ639738__SS-prME
  source 1..9867: mol_type = other RNA
tcgaccattacacttttatgtttaattccgacagttatggcttttcatttgagtacacgagatggtgaaccattaatgattgttgcgaaacacgaacgaggacggccacttttgttcaaaacaacagaaggaattaataaatgcacccttatagctatggatttaggagaaatgtgcgaagatactgtcacttacaaatgtcccctgctggtaaataccgaaccagaggacattgactgctggtgtaatttaacatcaacatgggtgatgtacggaacctgcacacagagtggcgaacgacgaagagagaaaagatcagtcgcgttaacccctcatagtggaatgggcctagaaacgcgtgctgaaacctggatgtcatcggagggagcctggaaacatgcccaacgtgtagaaagttggatccttcggaatccaggattcgcactcttagcgggatttatggcatacatgatcggccagacgggtatacaaaggacagtattctttgttttgatgatgttggtcgcgccaagttatggaatgagatgtgtaggagttggtaatcgggattttgtcgaaggagtttcaggcggggcttgggtagatctagtcttagaacacggtggatgcgttacaacaatggctcaagggaaaccaacacttgacttcgagttaactaaaacaactgcaaaggaagtagcattacttagaacatactgtatcgaagcattgatttccaatataaccacagcgacaagatgtccaacccagggagaaccttatctaaaagaggaacaagatcaacaatatatatgtagaagagatgtcgttgatagaggctggggaaacgggtgtggactattcggtaagggtggggtcgtgacatgtgcaaaattctcatgtagcggcaaaataacggggaatctagttcagatcgagaacctagaatacaccgtggtggtaacggttcataacggcgatacacatgcggttgggaacgatacaagcaatcatggagtcaccgcaacaatcacacctcgatcaccaagcgtggaagtgaaattaccagattacggggaactgactcttgattgcgaaccccgatcgggtatcgactttaatgaaatgatactaatgaaaatgaagaagaaaacctggcttgtccacaaacagtggtttctagacttaccgcttccatggacagccggcgcggatacttcggaagtacactggaattacaaagaacgaatggttacattcaaagtacctcacgcgaaaagacaagatgttacggtactgggatctcaagaaggagccatgcatagcgcactagcaggggcaacagaagtcgacagtggcgatggaaaccacatgttcgctggacacctaaaatgtaaagtgagaatggaaaaactaagaataaaaggtatgtcttacactatgtgctcaggtaaattctcaatcgataaagaaatggccgaaacacaacatggtacgactgttgtaaaagttaaatatgagggtgcaggggctccttgtaaagtcccgatagaaataagagatgtaaacaaagagaaggtagtcggccgtgttatatcctcaactccgttagcagaaaatactaattctgtaaccaacatagagttagaaccaccatttggcgactcctacattgtgataggcgtaggtaattctgcattgaccttgcactggtttcgaaaaggtagttctatcggaaaaatgtttgagtcaacatacaggggtgctaagcgtatggctatactaggagaaaccgcctgggacttcggaagtgttggaggactatttacgtcacttggcaaggccgtacatcaagttttcggtagcgtatacaccacaatgtttggtggagtatcttggatgattaggattctgataggatttctcgtgctatggataggaaccaattcaagaaacacttcaatggccatgacttgtatagccgtagggggaataacactatttctaggcttcaccgttcaagctgatatgggttgcgtagtatcgtggagtggtagggagctgaagtgcggatctggtatttttgtagtcgataatgttcatacgtggacagagcagtataaatttcagccggaatcgccagctagactagcaagcgctatactaaacgcccataaagacggagtttgtggaatcagaagcacaaccagattagaaaacgtgatgtggaaacaaataactaatgagctaaattacgtcttgtgggaaggcggacatgacttaacagttgtggcaggcgacgtgaagggggtgttaacaaaaggtaaacgagccttaaccccaccggtaagcgacttaaaatatagttggaaaacctggggtaaagcgaaaatatttacaccagaggcaagaaattcgacattccttattgatgggcctgataccagtgaatgtccaaacgagagacgagcatggaatagtttagaagtagaagactatggattcggaatgttcacaactaatatttggatgaagtttcgtgaaggctcctcagaagtgtgtgatcatcgactcatgagtgccgccatcaaggatcaaaaagcagttcatgcggatatgggctactggattgaatcctccaaaaatcaaacgtggcaaattgagcgggcctcattaatagaagtaaaaacctgcttatggccaaaaactcacacactttggtcaaatggggttctcgagtctcaaatgttaatccccaaatcctacgcaggaccattttcacagcacaactatcgccaaggatacgcaacgcagacagtaggaccctggcacttgggtaagctagaaatcgactttggagaatgtccaggaaccacagtgacgatacaagaagactgtgaccatagagggccatccctaaggacaacgacagcttcaggaaaacttgtgacacaatggtgttgtcgctcatgtacaatgccgccgttacgtttcttgggggaagacggatgttggtatggtatggagattcgccctctaagcgagaaggaagaaaacatggtaaaaagtcaagtaacagctggacaagggacatcagaaacgttcagcatgggactactctgcttaacattgttcgttgaagaatgcctaagaagaagagtgacgcgaaagcacatgatactagccgtagtgatcactttatgcgccatcattctcggaggactaacatggatggacctattaagggccctcattatgttaggcgacactatgagtggcaggataggtggacaaacgcacttggcaattatggcagttttcaaaatgagtcctggatacgtcctcggggttttcttacgtagactaacgtcacgagaaaccgctctaatggtaataggtatggcaatgacgacgacactttctattccgcatgacttgatggaattaatagatgggatatcattagggctgattttactgaagattgttacccaatttgataatacacaagtaggtacactcgcattatcactaacctttattcgtagtactatgagcctagtcatggcctggagaactataatggcggttttgttcgttgtaacgttgataccattatgtcgcacttcttgccttcagaaacaaagccattgggtagagatcacagctttaatattaggggcacaagcactaccagtgtatttaatgacactgatgaaaggtgccagccgaaggtcatggccattaaatgaaggcatcatggccgtaggattggtttcacttcttggctctgcattgcttaagaatgatgtgcccctcgctggaccaatggtcgcaggaggcctacttttagcagcttacgtgatgtcaggttctagtgcagacctgtcgcttgagaaagcagccaatgtgcaatgggacgagatggcggacatcacaggctcctcgcctataatagaagtgaaacaagacgaagacggatcattctcaatacgtgatgtcgaagaaactaacatgattacattgctagtcaagctggcacttatcacagttagcggactctacccactagccataccggtaactatgacactgtggtatatgtggcaagtaaaaacacaacgatcaggggcgttgtgggacgtaccaagtccagcggctacacagaaagccgcattgtcagagggagtatacaggattatgcaacgtggacttttcggaaaaacccaggttggtgtagggattcacatggagggagttttccataccatgtggcatgtcactagggggagtgtgatctgtcacgaaacaggtcgattggagccttcatgggctgatgttcgaaacgacatgatatcgtacggtggtgggtggcggttaggtgataagtgggacaaagaagaggacgtacaagtgctggcagtagaaccaggtaaaaatccaaaacacgttcagacgaaacctgggctctttaagacaataacaggagaaatcggtgctgtgactttagattttaaaccaggtacaagtggttcaccgataattaacaggaaagggaaagtgattggtttatatggtaacggagtagtaacaaaatcaggagattacgtatcagcaattacacaagcagaacgcattggggagcctgattatgaagtagacgaggacatctttaggaagaaaagattgaccattatggacttacatcctggcgctggcaaaactaagagaatcctgccatcgatagtaagagaagcattgaagagaagactacggacactaattctagccccaacacgcgttgtcgctgccgaaatggaagaggcacttcgtggattgccaatacgctaccaaactcccgctgttaaatcagaacacactggtcgagaaatagttgacttaatgtgtcatgcgacatttacaaccagactactttcttctacaagggtccctaattacaatctgatagtaatggacgaagcacactttacagatcctagttcagttgcagcaagaggctatatatccacgcgagtagaaatgggcgaagctgctgcgatatttatgacagcgaccccgccaggtgcaactgatccatttccccagagtaacagcccaatagaagacattgaaagagaaatacccgagaggagttggaatacaggtttcgactggataactgactatcaaggaaaaacagtttggtttgtaccatccataaaagcaggtaacgacattgccaattgtctgcgcaaatctggcaagaaagtgatacagttgtcacgaaaaacctttgacacggaataccccaaaacaaaattaaccgactgggattttgttgtaaccactgatatttcagaaatgggagcaaattttcgcgctggtcgagtaatcgatccgagaagatgcctaaaaccagtgatattgacagacggcccggagagggtcatcctggcgggtccaattccagtcaccccggccagtgctgcgcaacgaagaggccgtataggacgaaaccctgcacaagaggatgatcaatacgtcttcagtggggatcccctcaaaaatgatgaagatcatgcgcattggactgaagcaaaaatgcttctggataacatctacacgccggaaggtattatacctacattattcggcccggagcgcgaaaagactcaagcaatagacggcgaatttcgtctccgaggagaacaacgcaagacctttgtggaattaatgaggagaggagacctcccagtgtggctcagttacaaggtcgcaagtgccggaataagttacaaagatagagaatggtgtttcacgggggagagaaataaccaaatattggaagaaaatatggaagttgaaatatggacacgagaaggagagaaaaagaaacttcgacctagatggttagatgcgcgcgtatatgcggatcctatggcactgaaagatttcaaagaatttgcctccggtagaaaatcaattacgcttgatatcttaaccgaaatagcatccttgccaacctatttaagttcaagagcaaaactagctttagataacatcgttatgctacatacaactgagcgaggtggcagggcctaccaacatgcactaaatgaattacccgaaagtctcgagactttaatgttagtggccctcttaggcgctatgactgcgggtattttccttttcttcatgcaaggaaaaggaataggcaaattaagtatgggattaatcacaatcgcggttgcttctggactcctttgggtggcagaaatacagccgcaatggattgcagctagtattatcttagagtttttcttgatggtgctactcatcccagagccagaaaaacaaagaacaccccaggataatcaacttatctacgtaattttaacgatcttaacaataataggattgatagctgcaaacgaaatgggacttattgagaaaacgaaaaccgatttcggattttaccaggtgaaaactgaaacaacgatattagacgtagacttaagaccggcctccgcatggacactatacgctgtggctaccacaattcttacaccaatgttgaggcacacgatagaaaacacgagtgccaacttatcccttgccgcaatagctaatcaagcagctgtactgatgggtttgggaaaaggctggcctctacatcggatggacctaggcgtgcctcttttagcgatgggttgctattcacaagttaaccctactactttaactgcgagcctggttatgcttctagtacattacgctataataggaccaggactccaagcgaaagcaactagagaagcacagaaaagaaccgcagcaggtataatgaagaatcctactgtagatggtataacggtgattgacttagaacctatttcctacgacccaaaattcgaaaaacaactagggcaagtgatgcttcttgttctctgtgcaggccaacttctattaatgagaaccacatgggcgttttgtgaagtccttacgctagccactggaccaatactgacactatgggaaggtaatccaggtagattttggaacacaaccatagctgtctccactgccaacatctttaggggaagctatttagctggagctggcctcgcctttagtttaatcaaaaacgctcaaacaccaaggagggggactggaaccacaggagaaaccctaggagaaaaatggaagcgacaattaaacagtctcgatcggaaagaatttgaagaatacaaacgtagcggtatcctcgaggtagacaggactgaagccaagagcgcattaaaagatggctccaaaataaaacatgcagtttcaagaggttcatcaaagatacgatggattgtagaaagagggatggtaaagccgaaaggaaaagtggtagacttgggatgtggcagagggggatggtcttattatatggcaactctaaagaacgtaaccgaagtgaaaggatacacgaaaggaggacctggtcatgaagaacccattccgatggctacatacggctggaacttagtaaaattacacagcggggttgatgtattttacaaaccaacagaacaagtagacacactcttatgtgacataggagaaagttcatctaatcccacaatagaagagggaaggacgctgcgtgtactaaaaatggtcgaaccttggctaagctccaaaccggagttttgtattaaagtgcttaacccatacatgccgacggtaatagaagagttagagaagttacagaggaagcacgggggcaacttagttcgttgtccgctatcacgcaatagcactcatgaaatgtattgggtaagtggagcgtcagggaatatagtgagtagtgtcaacacaacaagtaaaatgctattgaatcgttttaccaccagacatagaaaacccacctacgaaaaggacgttgatctcggggcgggcactaggtccgtgtccacagagaccgagaagcctgacatgacaataataggaagaaggctgcagcgtctccaggaagaacataaagaaacatggcactatgaccaggaaaatccttataggacatgggcgtatcatggatcctacgaagcaccttcaactggcagcgcatcatcaatggtaaatggagtcgtaaaactgcttaccaaaccgtgggacgtaataccaatggtgacgcaactcgctatgaccgatactactccttttggtcagcagagggtgttcaaagaaaaagttgacactagaactccacaacctaaaccaggaacaagaatggtgatgacaactacagcaaattggttatgggcactattaggcaaaaagaaaaatccgagattatgcacaagagaagaatttatatctaaggtaagatctaatgctgctattggtgcagtctttcaagaggagcaaggttggaccagtgccagtgaagcggtgaatgacagtaggttttgggagctcgtagacaaagaacgagctctacatcaagaagggaaatgtgaatcttgtgtatacaatatgatgggtaaaagagagaagaaattaggagaatttggcagagcaaaagggagcagagcaatatggtatatgtggcttggggcaaggttccttgaatttgaggcattaggatttttaaatgaggatcactggtttggacgtgaaaacagctggagtggcgtggaaggtgaaggtcttcacagattgggttacattctagaagaaatagataagaaagatggagacttgatgtatgcagacgatactgctgggtgggacacaagaataactgaagatgacctacaaaatgaggaacttataacggaacaaatggctccacatcataaaattctcgccaaagcaatatttaagctaacataccaaaacaaagtggtaaaggtgttacgaccgactccaagaggtgcagtaatggacattatctctagaaaggatcagagaggaagtgggcaagtaggcacctatggactaaatacgtttaccaatatggaagtccaattaattagacaaatggaggcagaaggtgtaataacgcaagatgatatgcaaaaccctaaaggattaaaggagagagtagagaaatggctacgtgagtgcggtgtagacaggctaaaacgaatggccatttctggggacgattgtgttgtaaaaccactcgacgaaagattcgggacgtctttgctctttttaaacgatatgggaaaagttcggaaggatattccacaatgggaaccttcaaaaggatggaaaaattggcaagaagtacctttttgttcacatcacttccataaaatttttatgaaagatgggcgttcactggttgtaccctgccgaaaccaagatgagcttataggtagagctaggataagccaaggcgcaggatggtctttacgagaaaccgcttgtctaggaaaagcatatgcccaaatgtggagtctcatgtattttcatcgacgtgacctcagactagcaagtatggcgatatgtagcgctgttccgactgaatggttcccaacttctagaacgacttggagtattcacgcacatcatcagtggatgaccacagaggatatgttaaaagtatggaatagagtatggattgaggataatcccaatatgattgataaaacaccagttcactcgtgggaagacattccctatttaggtaaaagagaagacctatggtgcggcagcttaattggattgtcctctcgagcgacatgggcgaaaaatatccatacagctattactcaagtacgtaatctaattggcaaagaagagtacgtggactacatgccagtaatgaaaagatattcggcaccatctgagagtgagggggtattataa

SEQ ID NO: 23632 - RNA, 9867 nt, synthetic construct
  misc_feature 1..9867: note = derived and/or modified CDS sequence (opt6) from DENV-4__FJ639739__SS-prME
  source 1..9867: mol_type = other RNA
tcgacgatgactctactgtgtcttatccccacagcaatggcattccacttatctaccagagatggtgaacctctgatgatcgtagcgaaacatgaaagaggaaggccactcttatttaaaactactgaaggtataaataaatgtacgctgatagctatggatttaggagaaatgtgcgaagatacggttacctacaaatgtccacttctggttaacactgaaccagaagacatcgattgctggtgcaatctaacgtccacctgggtcatgtatgggacgtgtactcaatcaggggaaagaagacgagagaaaagaagtgtggcactaacacctcatagcggaatgggattagaaacgcgagccgaaacctggatgtcttctgaaggcgcatggaaacacgcgcaacgtgttgaaagctggatcttacggaaccctgggtttgcattactagctgggtttatggcctatatgataggacaaacaggaatccagcgtacggtcttctttgtattgatgatgctcgtggcgcctagttatgggatgcgctgcgtcggagttggaaatagagactttgtcgaaggagtatccggtggagcatgggtagacctagtactagaacacggcggctgtgttactacaatggcacaaggaaaaccaacacttgactttgaactaacgaaaacgaccgcaaaagaagtagcgctattgaggacatattgtatcgaagccctcatatcaaatatcacaactgcaacccgatgccctacacaaggtgaaccttacctaaaagaagaacaagatcaacagtatatttgcagacgcgacgtcgttgatagaggctggggtaacggttgtggactatttggaaaagggggagtagtcacatgcgcaaaatttagttgcagcggaaaaataacaggtaatttagtccaaatcgaaaacctagaatatacggtagttgtgacggttcacaatggcgatacacatgcagtgggcaacgatacaagtaatcatggagtaacagccacgatcacaccacggtcaccatctgtagaggtaaaactacctgactatggtgaactaactctagactgtgaaccaaggtcaggaatcgactttaatgagatgatattaatgaaaatgaagaagaaaacttggcttgtacacaaacaatggttcttggatctgccactgccgtggacggccggggcagatacaagcgaggtgcattggaactataaagaaagaatggttacgttcaaagtaccgcatgcaaaacgacaagacgtcaccgtactgggaagtcaagaaggagctatgcactcggcgttagcaggggctaccgaggtagactcaggggatggcaaccatatgttcgcaggtcatttaaaatgtaaagttagaatggaaaaactaagaatcaaaggaatgtcttataccatgtgctcgggtaagttctccatagataaagaaatggcagaaacacagcacggaacaaccgtagttaaagtaaagtacgagggagcgggcgccccgtgcaaagttccaatcgaaataagggatgtgaacaaggaaaaagtggttggaagggttataagtagtacaccacttgcagagaatacaaatagcgtcacaaacatcgaactagaacctccctttggggatagctatatagtgattggtgtcggtaactcagctcttacgttacattggtttaggaagggatccagtattggaaaaatgttcgaatcaacttacagaggtgcaaagcgtatggcaattctgggagaaacagcatgggactttggtagcgtagggggtctattcacttcgctcggtaaagcggttcatcaggtattcgggagcgtctacacaacgatgttcgggggagtgagctggatgatacgtatattgataggatttttagtgttatggataggaacaaattctagaaacacatctatggcaatgacttgtatcgctgtaggtggcattacgctatttttggggtttacagttcaagctgatatgggttgtgtagtctcatggagtggacgtgaattaaaatgcggctcgggcatcttcgtagtcgacaatgttcatacgtggaccgagcaatacaaatttcagcctgaatcacccgccagattagcctccgcgatcttaaatgctcataaagatggagtatgcggcatccgatctacgacaaggctggagaacgtaatgtggaaacagattacaaacgaactaaactatgttttatgggaaggtgggcatgatctaaccgttgtagctggcgacgtaaaaggagtgttgactaaaggtaagagagccttaaccccaccggtatcagatctaaaatattcgtggaagacatggggaaaagcaaaaatatttacacctgaggctcgcaattcaacattcctaatcgacggtcctgataccagcgaatgcccgaatgaaaggagagcgtggaactcattagaagtagaagattacggatttggtatgtttacaacaaacatatggatgaaatttagagagggttcttccgaagtgtgtgaccataggcttatgagtgctgccatcaaagatcaaaaggccgtacacgcagacatggggtattggattgaaagttcgaaaaatcaaacatggcaaatcgagagggcttcattaatagaggtaaagacatgtttatggccgaaaacccacacactttggtcgaacggtgtgcttgaaagccagatgctgattccgaaatcatacgcggggcccttctctcaacataactaccgacaaggctacgctactcaaacggtaggcccttggcatctaggcaaactagagattgatttcggagaatgcccaggtacaaccgtaactatacaagaagattgtgatcatagagggccctccttaagaacaacgaccgcgagtgggaaactggtgacccaatggtgttgcagaagttgtacaatgcctcctctcagatttctaggtgaagacggatgttggtatggtatggaaataaggcccctaagtgaaaaagaagaaaacatggtgaaaagtcaggttacagcaggacaagggacatctgagactttttccatgggccttttatgtcttacgctttttgtcgaggagtgcttgcgaagaagggtaacgagaaaacatatgatacttgctgttgtcattaccctatgtgcaataatactaggcggtctaacctggatggacttgctgagagcactcattatgttaggagacactatgtctggaagaattggcggacaaacacatttagctataatggctgtatttaaaatgagcccaggttatgtgcttggagtatttcttagaaaattaacaagccgcgagacggcattgatggtaattgggatggcgatgaccactacactctcaatcccccatgatttaatggaactcattgatgggatatcactgggcttgatcttacttaaaatagtaacacagtttgataatacacaagtcggcactctagcactcagtttaacatttataagatcaactatgtcacttgttatggcatggcgtactataatggctgtcttatttgttgtaactcttatacctctttgccggacctcatgcctacaaaaacaaagtcattgggttgagataaccgcactaatacttggcgctcaggccttaccagtttatctgatgacacttatgaaaggagcgtcacggagaagctggcctttgaacgagggcataatggctgttggcctagtgagcctcttaggatcagctttactgaagaacgatgtccctcttgcaggacctatggtggcaggaggactacttctagctgcatacgtcatgtctggatcaagcgcggatctctctctcgaaaaggcagctaacgtgcagtgggacgaaatggccgatatcacaggatcttccccgataatagaggtcaagcaggacgaagacgggagcttttcaatccgggatgtggaggagacgaatatgataacgttattagtgaaactcgcattgatcaccgtatcaggactatatccgttggctataccggtgacaatgacattatggtacatgtggcaagtaaaaactcaacgcagcggggcactttgggatgtacccagtccggcagccactcagaaagcagctttatctgaaggagtgtatcgcataatgcagaggggactatttggcaaaacgcaagttggagtgggcattcatatggaaggtgtctttcacactatgtggcacgtaactagagggagtgtaatttgccatgaaacgggtcgtctcgaaccttcgtgggctgacgttagaaacgacatgataagctatggaggaggatggagactaggggataaatgggataaggaagaagatgtacaagtattagcaatcgagccgggcaaaaatcctaaacatgtccaaactaaaccaggattatttaaaacacttgccggtgaaatcggagctgtgacacttgacttcaagcctggcacatcgggaagtccgataataaatcgtaagggtaaagtgataggactatacggtaatggtgtcgtaactaaatcaggtgactatgttagtgcaataacgcaagctgagcgtatcggcgagccggactatgaggtcgatgaggacatatttagaaagaagagattaacaataatggatctacatccgggtgctgggaaaacaaagcgcatcctaccaagtatcgtaagagaggctttaaaaaggcggttgcgaactctcatccttgctccaactcgagttgtagcagcagaaatggaagaggcattaagagggttgccaataagatatcaaacgcccgcagtaaaatctgaacatacgggcagagaaattgtggacctaatgtgccatgcaactttcaccacaagattactaagttcaacgcgagtgcctaattacaatttaatcgtaatggatgaagctcattttacggacccgagttcagtagcggcacgcggatacatttcaacgagagtagaaatgggtgaagcggcagcaattttcatgacggcaactccacccggagcaacagacccttttccacaatctaatagtccgatcgaagatattgaacgagagatccccgaaagatcttggaatacgggatttgattggataactgattatcaaggaaagacagtctggttcgttccttcaataaaagcaggcaatgacatagcaaattgcttacgaaaaagcggtaagaaagtaatacaattaagtagaaaaacattcgacactgaatatccaaaaacaaaattgactgactgggattttgtagtaacaactgacatttcggaaatgggggcaaattttcgggctggaagagtaatagaccctcgaaggtgtttaaaaccggtcatcttaaccgacggtccggaacgagtaattttagccggacccatcccagttaccccagcatctgctgctcaacgtcgcggacgtattggtaggaatccagctcaggaagacgaccaatatgtatttagtggggacccactaaagaacgatgaagatcatgctcactggacagaagccaaaatgctattggataatatctatactccagaagggatcattccaacattgtttggtccagaacgtgagaaaactcaagccatagatggagaatttcgactacgtggcgaacaaaggaaaactttcgtcgaattgatgagacgtggcgatttgcccgtatggttaagttataaagtggcaagcgccgggatttcttacaaggatcgtgaatggtgtttcacaggggagagaaacaatcaaatattagaggaaaatatggaagtagaaatttggacacgtgaaggggagaaaaagaaattaaggccaaggtggctcgatgccagagtatatgcagatccgatggcactaaaagactttaaggaatttgcatctggaagaaaatcaattacgttagacatattaacagagatcgcatcgttaccgacctatttaagcagtcgagcaaaattagcattagataatattgtaatgctacatacaaccgaaagaggcggccgtgcttatcaacatgcattgaatgagttaccagagtcattagaaactttaatgctggttgcgttattaggagccatgacagctggaattttcttgttcttcatgcaaggcaaaggcatcggcaaactttccatggggcttataactatagcggttgcgtcaggtcttttatgggtagcagaaatccaacctcaatggattgctgcatcaataatactagaatttttcctaatggtacttcttatccccgaaccagaaaagcaaagaactccacaagataatcaactaatatatgtaatcctaacaatcctaacaattattggtttaatagccgcaaatgaaatgggcttaatagagaaaactaagacagatttcgggttttatcaagtaaagacagaaactactatcctggatgtcgatctccggccagccagcgcctggacattgtatgcagtagcaaccacaatattaacacccatgttacgacatactatagaaaatacatcggcaaatcttagtttagctgccattgctaatcaggccgcagtattgatgggtctaggtaaaggatggcctctccaccgaatggacttgggtgtgcctctactcgctatgggttgttatagccaagttaatccaacaactctaacagcttcattagtgatgctgttggtacactatgctataatcggaccaggtcttcaagcgaaagcaactagagaggctcagaaaaggacagcagctggcatcatgaaaaacccgactgtagatggtataacggtaattgatttggaaccaataagctatgatcctaaattcgaaaaacaattaggtcaagtcatgctactggtactatgtgcaggccaactgctgctcatgcgtacaacttgggccttttgcgaggtactcacattggctacaggtccaattctaacactatgggaaggtaaccctggcagattctggaatacaactattgccgtcagtacagcaaacatctttagagggagctatttagctggggctggactagctttcagcctgattaaaaatgcacagacgccaagaaggggcacaggtacaacgggcgagacattgggtgaaaaatggaagcgacaacttaatagcttagacagaaaggaatttgaagaatataagagatcagggatcttagaagttgatcgtaccgaagctaaatcggcactgaaagatggatcaaaaataaaacacgcagtttcaagagggtcctcgaaaattaggtggattgttgaacgaggtatggtaaagccaaaaggaaagatagttgacctcggttgtggaagaggaggttggtcttactatatggcaacacttaaaaacgtaacggaggtaaaaggctacacaaaaggtggacctgggcatgaggagccaattccgatggcaacatacgggtggaacttggtcaagctacattccggagttgatgtgttctataagccgacagagcaggttgataccctattatgtgatataggggaaagttcaagtaatccgacaattgaagaaggtagaacgttaagggtattaaaaatggttgaaccatggcttagttctaaacccgaattttgcattaaggttttgaacccctacatgccaactgtcatagaagaactcgaaaaattgcaaagaaaacacggaggaaatttagtgagatgtcccctatcaagaaattctacacacgaaatgtattgggttagtggagcgagcggtaatattgtatcaagtgttaacacaacttcaaaaatgcttcttaatcgatttacaacacgacatcgaaaacccacatatgaaaaggacgtcgatcttggagcaggtacaagaagcgtaagtactgaaacggagaaaccagatatgacgatcataggcagacgattacagagattacaagaagaacataaagaaacttggcactatgatcaagaaaacccctatagaacctgggcctatcacggctcttacgaagcacctagcactggctcagcatcttcaatggttaatggggtggtcaaattacttacaaagccatgggacgttatacctatggtaactcaattggctatgaccgacaccacgccattcggacaacaaagagttttcaaggaaaaagttgatacacgaacgcctcaaccgaaaccaggcacacgtatggtgatgacaactacagctaactggctctgggcattgctaggaaagaagaaaaacccacgactatgcacgagagaagagttcatctctaaagtaagatcgaatgcagcaataggggcagtgttccaggaagaacaaggctggacgagtgcgagtgaagctgtaaatgattcccgtttctgggagctagttgacaaagaacgagctttgcatcaagaggggaaatgcgaaagctgcgtatataatatgatgggcaaaagagagaagaaactaggagaatttgggcgtgcaaaaggatcaagagcaatatggtatatgtggctaggtgcaaggtttttagaatttgaagctctcggattcttgaatgaagatcattggttcggcagagaaaactcgtggtccggggtcgaaggggaaggtctccacagactaggctacatactagaagagatcgataagaaagacggagatctaatgtatgctgatgatacggcaggttgggatacaagaattacggaggacgatttgcaaaacgaagaattgatcacagagcagatggcccctcatcataaaatattggcaaaagcaatttttaaattaacatatcaaaacaaggttgttaaggtactcaggccaactcctcgaggagctgtgatggacatcatctctcgcaaggatcagagggggtctggtcaagtcggtacctatggactaaatactttcactaatatggaagtgcaacttataaggcaaatggaagcagaaggcgtgataacacaggatgatatgcaaaacccaaaggggttaaaagaacgagtagaaaaatggttaagggaatgcggagttgatagactaaagcggatggccatttcaggagacgattgcgttgtgaaacctctcgacgaacgttttggcacttcactcttatttctaaatgacatgggaaaggtgcggaaagatattccacagtgggaaccgtcaaagggatggaaaaactggcaggaagtgccgttttgttcacaccatttccataaaattttcatgaaagatggaagatcgctagtagtcccctgtagaaaccaagatgaactaattggcagggcacgcatatcacaaggggcaggatggtcgctacgtgagacggcctgcttggggaaggcttacgcgcaaatgtggagtctaatgtatttccatcgcagggatctacgattagcaagtatggcaatatgcagcgcagtaccgacagagtggttaccaacaagtcgtacaacttggagtatacatgcacaccaccaatggatgacaacagaggacatgctaaaagtctggaatcgcgtgtggatcgaagataatccaaatatgatcgacaagacacccgtacatagttgggaagatataccatacctaggcaagagggaggatctttggtgtggtagcctcataggactcagttccagagctacatgggctaaaaatattcatactgcaatcacacaggtcagaaacttaataggtaaagaagaatacgtagattacatgccagtaatgaaaagatactctgctccgtccgaaagcgagggggttttgtga

SEQ ID NO: 23633 - RNA, 9867 nt, synthetic construct
  misc_feature 1..9867: note = derived and/or modified CDS sequence (opt6) from DENV-4__JN819409__SS-prME
  source 1..9867: mol_type = other RNA
tccacaattacgttattatgtctgatccctacagtaatggcgttccacctttcaacgcgtgatggagaaccactgatgatagtagcgaaacacgaacggggaagaccgctattattcaaaacaactgaaggaattaataaatgcacgctaatcgcaatggatttaggagaaatgtgtgaagataccgtcacatataaatgtccacttcttgtcaatacagaacccgaggatattgactgctggtgtaaccttactgctacctgggtcatgtatgggacctgtactcagtccggagaacgaaggcgagagaaaagatctgtcgcattaactccacatagcggtatgggtctggaaacaagagcggagacatggatgtccagcgagggagcatggaaacacgctcaaagagtagaatcttggatactgaggaatcccgggtttgcactattagcgggttttatggcttatatgataggtcaaaccggcattcaacgtacggtgtttttcgttctaatgatgctggtagctccatcctatgggatgcgttgtgtaggtgttggaaatagagactttgttgaaggtgtttccgggggagcatgggtcgatctcgtattagaacatggcggttgcgtgaccacaatggctcaaggaaaaccaacactcgactttgaattgacaaaaacaactgctaaagaagtagcattgcttcgcacttattgcatagaggccctaattagcaacataacaacagcaactagatgtccaacacaaggggaaccctacttaaaggaagaacaagaccagcaatacatttgccgcagagatgtcgttgatcgaggttggggcaacggatgtggacttttcggaaaaggaggagttgtgacatgcgcaaaattttcatgttcaggaaagataacagggaacctggttcaaatagaaaatttagagtacaccgttgtagtaaccgtacataatggagatacacacgcggtaggaaatgacacttctaaccacggtgtaacagcaactattacgcctcgatctccatcagtcgaagtgaaacttcctgactatggtgagctgacactagattgtgaacccagatcagggatagattttaacgaaatgatactcatgaagatgaagaagaaaacttggctagtccacaaacaatggtttctcgatttgccactaccttggacggctggtgccgacacttcggaagtacattggaactataaagaacgaatggttacatttaaggtcccgcatgccaaaagacaagacgtcaccgtgctaggaagtcaagaaggggccatgcatagtgccttagctggagcaactgaggtagacagtggagacggtaatcatatgtttgcaggacatttaaaatgtaaagttagaatggaaaaactccgtatcaagggtatgagctataccatgtgcagtggaaaattctctatagacaaagagatggcagagactcagcatggaactactgttgttaaggtaaaatatgaaggcgccggggcgccttgtaaagttcctattgaaatccgcgacgtaaacaaagaaaaagttgtaggtagagtcatatcaagtactccattggcagaaaatacaaatggtgtaactaacatcgaattggaaccaccgttcggtgatagctacattgtaataggggttggaaacagtgctttgacactgcactggttccggaaaggtagttcaataggcaaaatgtttgaaagtacctatagaggagcaaaaaggatggccatattaggagaaaccgcatgggatttcggtagcgtaggtgggttgttcacaagtttagggaaagcagttcatcaagtatttgggtcagtatacacaactatgttcggtggtgtcagctggatgattagaatccttataggatttctagtcctatggataggaactaattcacgtaacacatcaatggctatgacatgtattgcagtgggaggcataaccctatttttaggatttaccgtacaagccgacatgggctgtgtagtttcttggtcggggagggaacttaaatgcggaagcgggatattcgtcgtcgataatgtacatacgtggactgagcagtataaatttcaacctgagagccccgccagactagcttctgctatactgaatgcacacaaagatggcgtctgcgggatacgttctactacaagactcgagaatgtcatgtggaagcaaatcacaaatgaactaaactacgtactgtgggaagggggtcatgatttgacagttgtagcaggcgatgtaaaaggagttttaacaaaagggaaaagagcactgacacctcccgttagcgacctaaaatattcatggaaaacttgggggaaagccaaaatatttacgccagaggctagaaatagtaccttcttaatcgatggacccgatacatctgagtgtcctaatgagagacgagcgtggaactcattagaagtggaagattacggattcggaatgttcaccacaaatatatggatgaaattccgggaaggaagcagcgaagtatgtgaccacagactgatgagtgcggctattaaagaccaaaaagcagtgcatgccgatatgggatattggatcgaatcaagtaaaaaccagacatggcaaattgaaagggccagcttgatcgaagtgaaaacgtgtttatggcctaaaacacacacattgtggagcaacggagtacttgagagccaaatgctcattcctaaaagttatgcaggtccattctcacaacataactatagacaagggtacgctacacaaacagttggtccttggcacctaggaaaacttgaaatcgactttggcgagtgtccgggtactaccgtcacaatacaagaagactgcgaccatagaggaccgtcactaagaacaacgacagcaagcgggaaattggtaactcagtggtgctgcagaagttgtacgatgccaccgctacgatttcttggcgaggacgggtgctggtatgggatggaaattcgccctttatcagaaaaggaagagaatatggtaaagtcacaagttactgcaggacaaggaacgagtgagacctttagtatgggtttattgtgtctaaccctttttgtcgaggaatgcctgcgacgtcgagtaacccgaaaacatatgatcttggctgtgattataactttgtgtgccataatactaggtgggttaacgtggatggacttattaagggcccttattatgttaggtgatacaatgtcaggtcggataggtggacaaacacacctggcaataatggcagtatttaagatgtcaccgggatacgttctcggtgtctttctaagaaaattaacttcaagggaaacagcattaatggtaatcggaatggccatgacaactacactcagtataccccatgacctaatggagctgatcgatgggatatccttaggactaattttactaaaaatagtgactcagttcgacaatacacaagttgggacacttgcattaagtttgactttcataaggtcaaccatgtcattagtaatggcatggagaaccataatggcagttttgtttgtagtgactcttataccattatgcagaacgagctgcctacaaaaacagtcgcattgggttgagataacagcattgattttaggagctcaagcacttccagtctatttaatgacattgatgaaaggggcaagtaggagaagctggcctctaaacgaaggaataatggcagtaggattagtttcgctattggggtcggccttattgaaaaatgacgttcctcttgcagggccaatggtcgcaggcgggctattgcttgctgcttatgtcatgtcaggctcctctgctgatttaagtcttgagaaggctgctaatgttcaatgggatgaaatggcagatattaccgggagttcaccgatcatagaagtaaaacaagacgaagacgggagcttttcaataagagatgtagaagaaacaaatatgataaccttgttagtaaaattggcgctaataacagtaagtggtttatatccgctcgcaattcctgtgacgatgactctatggtatatgtggcaagtaaaaacacaaagaagtggcgctctgtgggatgttccaagccctgctgcaacccaaaaggccgccttaagtgaaggagtatatagaatcatgcagcgaggtctgttcggtaaaactcaagtaggagtagggatacatatggaaggagtatttcatacgatgtggcacgtaacgcggggtagtgtaatatgtcatgaaacgggcagactagagccaagttgggcagatgttagaaacgatatgatctcatacggaggaggttggagattgggagacaagtgggataaggaagaggacgttcaggtattagctattgaaccgggaaagaacccgaagcacgtacagactaagcctgggttatttaaaacactgactggtgagattggggctgtcacattagattttaagccaggcacaagtggcagcccgattattaatcgtaaaggtaaagtcatcggactctacggtaacggagtagtaacaaaatctggcgattacgtatcagccattacccaagcagaaagaataggcgaaccagattatgaagttgatgaagatatattccgcaagaaaagattaaccataatggatcttcacccaggagctggaaaaacaaaacgtatcctgccaagcatcgtgagagaagctctaaagcgaagattaagaactctaattctggcacccaccagagtggttgcagccgaaatggaagaagcgcttagaggcctgcccatcaggtaccagactccggcagttaaaagtgaacacactgggagagagattgtggatctaatgtgtcacgcaacgtttactacaagattgctgagtagtacacgggtaccaaactacaacttaatcgtaatggatgaggcgcatttcactgatccaagctccgtcgcagcccgcggttacatatcaacaagggtagaaatgggagaagcggctgctattttcatgacagcaacaccacccggagcgactgacccatttccacaaagcaattcacctattgaagacatagagagagaaattcctgaacgctcatggaatacaggttttgattggataactgattaccagggaaaaactgtctggtttgtaccttctataaaagcaggaaatgacatagccaattgtttgagaaaatcaggcaagaaagtaatccaactttctagaaagacgtttgacactgaatatcccaagaccaagctaacagactgggattttgtcgtaacaacagatatcagtgaaatgggtgccaattttcgtgccggaagagttatagatccaaggcgatgtttgaaaccagttattttaacagacggaccagaaagagtaattttagcaggtcccataccagtaactcctgcatccgcagctcaacgaagggggaggatcggtaggaatcctgcgcaagaagacgaccaatatgtattttcaggcgacccattaaagaatgatgaagatcacgcccattggacagaggccaagatgttacttgacaatatatacacccccgaaggaatcataccgaccctatttggaccagaacgagagaaaacgcaagctatagatggggagttccgcctccgaggcgaacaaagaaaaacttttgttgaattaatgcggagaggtgatcttccggtctggttaagctacaaagttgccagtgctggaatttcatataaagatagggaatggtgtttcacaggagagcgaaataatcaaattttagaagaaaacatggaggtcgaaatttggacccgcgagggggagaagaagaaattgcgccctcgttggttggatgcacgtgtatacgctgatccgatggcattaaaagattttaaagaatttgcttcaggacgcaagtcgataacactagacatcctaacagaaattgccagcttaccaacatatctaagcagtagggcgaaattggcgttagacaatatagtcatgcttcatacaactgaaagaggaggtagggcgtaccaacacgcgttaaacgaattgccggagtcacttgaaacattaatgcttgttgcattactaggagcgatgaccgccggaatatttttattctttatgcaaggtaaggggataggcaaactttcaatgggcttaataacgatagcggttgcctcgggcctattatgggttgcagaaatccaaccacaatggatagcagccagtatcattctggaatttttcttgatggtattgttgatccctgagccagaaaagcagagaacgcctcaggataatcagttgatctatgtaattttgacaatcctaaccataattgggttgatcgcagctaacgaaatgggattgatagagaaaacgaaaacggactttggcttttatcaagtaaaaactgaaactactatattagatgtcgaccttaggccggccagtgcatggacgctttatgcggtggctactacaatactaacaccgatgcttagacatacaatagaaaacacatcagcgaacttgagtctagcagcgatagcaaatcaagcagcagtgctaatgggactaggaaaaggatggcctctccacagaatggacttaggggtgcctttactggcaatgggatgttactcccaagttaatccaactaccctaactgcttcattagtcatgcttctggtacactatgctataataggtccaggactacaggcgaaagcgacccgagaagcgcaaaagagaacagcagctggaattatgaagaaccccactgtggatggaatcacagtcatagatctagaaccgattagttatgatccgaaatttgaaaaacaactaggacaagtcatgttgcttgtattatgtgcgggacagctactcctgatgaggaccacctgggcattctgcgaagtattgacattggcaacaggtcccatacttaccctctgggaaggaaaccccggcaggttttggaatacgacaatagcggtaagcacagcaaacatatttagaggaagttacttagccggtgcagggttggcatttagtttaattaagaatgcgcaaacacctcgacgtggtactggcacgactggcgaaactctgggagaaaaatggaaaagacaactaaattcactagataggaaagaatttgaagaatataaacgtagtgggattctggaagtagatcgcacggaggctaaaagcgcattaaaagacggttctaaaattaaacatgcagtatctaggggatcgtctaagatcaggtggatagttgaacgtggaatggtaaaacctaaaggaaaagttgttgatttaggatgcgggagaggaggttggtcatactatatggcaactcttaaaaatgtcactgaggtcaaaggttacactaaaggaggaccaggtcacgaagaaccaataccaatggcgacctacggatggaacctagtgaaactacattctggcgtggacgttttctacaagcccacagagcaagtcgacacactactgtgtgatataggagagagctcaagtaacccaactatagaagaaggccgtactttacgagttctcaaaatggtggaaccatggttgtcatcaaaaccagaattttgtatcaaagtgctaaacccgtacatgccaacagtaattgaagaactcgaaaaattacaaaggaaacatggagggaacctagttagatgccccttaagtaggaacagtactcatgaaatgtactgggtcagtggagcatcaggaaatatagtgtcgtcagtaaacaccaccagcaaaatgcttttgaatagattcacaactagacatcgtaaaccaacctacgagaaagatgttgatctaggtgcggggactcgttctgttagtacagagacagagaaacctgatatgactataatcgggagaaggctccagcgtttacaagaggaacataaagaaacgtggcattacgaccaagagaatccatataggacatgggcataccacgggtcatacgaagctccaagtacgggcagtgcatcttctatggtaaatggcgtcgttaaactgttgacgaagccatgggatgtcatccccatggtgacacaactggcgatgacggatactacaccgtttggtcaacaacgagtttttaaagaaaaagttgacaccagaacaccacaaccaaaaccgggtacgcgaatggtgatgacaactacagcaaattggttgtgggcattattagggaagaagaaaaatccacgactatgcactaaagaagagtttatttcaaaagttagatcaaatgcggcaattggagcagtcttccaagaggaacagggatggacatctgctagcgaagcagttaacgattcccgtttctgggagttagttgataaagagcgtgcattacatcaagagggtaaatgcgaaagttgtgtatacaatatgatgggtaaaagagagaagaagttaggagaatttgggagagcaaaaggaagccgagcgatatggtacatgtggctgggagccaggtttctcgagtttgaggcgcttggatttttaaatgaagatcattggtttggtagagagaactcgtggtcgggtgttgaaggggaaggtttacatagattaggatacatcttagaggaaatcgacaagaaagacggcgacttaatgtatgctgatgataccgccgggtgggacactcgtattactgaagatgacttacaaaatgaagaactgattactgaacaaatggcaccccaccataaaatattggctaaagctatattcaagttaacatatcaaaataaggtagtcaaagtattacgccccactcctagaggagctgttatggacattatatcacgaaaggaccaaagaggatcgggccaagtgggcacttatggacttaacacgttcacaaacatggaggtccaactcattcgtcaaatggaagccgagggtgtgataacacaggacgatatgcaaaatcccaaaggtttgaaggagcgcgtggagaaatggttaagagaatgcggagtcgatcgtcttaaaaggatggcgataagtggggacgactgcgtggtcaaaccacttgacgagagatttggcacgagcctattatttttaaacgatatggggaaagtgagaaaagatattccacagtgggaacctagtaaaggttggaaaaactggcaagaggtaccattctgctcacatcattttcataaaatatttatgaaagatggccgttctctagtggtaccttgtagaaatcaagatgaacttataggcagagccagaatctcacaaggagctgggtggagcttacgcgaaacagcatgtctaggaaaggcttatgcgcaaatgtggagtctcatgtattttcatcgacgggatttaaggttagcttctatggcaatatgcagtgcagtaccaacggagtggtttccgacaagtaggactacttggtcaattcatgcccaccatcagtggatgactactgaagacatgctcaaggtttggaatcgcgtttggattgaagataatcccaatatgaccgacaagacacctatacattcatgggaagacatcccttatttagggaaacgggaagatttatggtgcggcagcttaatcgggctatcttcgcgcgctacctgggctaaaaatatacataccgccataacccaagtaaggaatttaattgggaaagaagagtatgtagactatatgcctgtaatgaagcgatactcggctcccagcgaaagtgaaggcgtattatag

SEQ ID NO: 23634 - RNA, 9867 nt, synthetic construct
  misc_feature 1..9867: note = derived and/or modified CDS sequence (opt6) from DENV-4__FJ639742__SS-prME
  source 1..9867: mol_type = other RNA
agcactatgacgttactgtgtctcatacccacagcaatggcatttcacctgtctactagagatggggaaccacttatgatcgtcgcgaaacatgaacgtggaagacccctactctttaaaacaacggaagggataaacaaatgtacgttgatagctatggacttaggggaaatgtgtgaagacacagtaacatataaatgccctttgctagtcaatactgaacctgaagatatagattgttggtgtaaccttacatctacctgggtgatgtacggaacatgtactcaatcgggggaacgacgaagagaaaaacgcagtgttgctctaaccccgcatagcggtatgggattggaaacacgcgccgagacttggatgtctagcgaaggggcttggaaacatgcgcagagagtcgaatcctggatactaagaaatccgggattcgctttattagctggattcatggcctatatggtgggacaaaccggcattcaaagaactgtattctttgtattaatgatgttagtggctccatcgtacggaatgagatgtgtaggagtaggtaatcgcgatttcgtagaaggagttagtgggggagcatgggtggatctagtgctcgaacacggcgggtgcgtaaccactatggcccagggaaaaccgaccttggactttgaactgactaaaacaacagcaaaagaagtagcgctactaagaacgtactgcattgaagccctaatcagtaatataaccacagcaacacgctgccccacacagggagaaccctatcttaaagaagaacaagaccaacagtacatttgtagacgtgacgtagttgatagaggctggggaaatggatgtggtctattcgggaaaggtggagtagtaacctgtgcaaaattttcatgcagcggaaaaataaccggaaatttagttcagatagaaaatctagaatatacagtagtagtcacggtccataatggtgatactcatgcagtaggaaacgatacatctaatcatggggttactgcaacgataacaccacggtcaccaagcgtagaagtgaaattacctgattatggagagttaactctagactgcgagcctaggagtggcatcgactttaatgagatgatattaatgaaaatgaaaaagaaaacatggcttgtccataaacaatggtttcttgacttacccttaccatggacagctggtgccgacacatcagaagtgcactggaactacaaagaaaggatggtaacttttaaagtacctcatgccaagcggcaagatgtaactgttctcggtagccaagaaggagctatgcattcagcgctcgcaggagctactgaagttgactctggagacggtaaccacatgtttgcaggccacttaaaatgcaaggtacgcatggaaaaattacggattaaagggatgtcttacactatgtgcagtggaaaattttcaatcgacaaagaaatggcggaaactcagcatggtacaacggttgtaaaagttaaatatgaaggtgctggtgcaccttgcaaagtacccattgaaatacgcgatgttaataaagagaaagttgtaggaagggtaataagctcaacaccactagcggagaatacgaatagtgtgaccaacattgagttagaaccaccttttggtgattcctatatagtaatcggtgttggaaacagcgccctcacacttcactggtttaggaaagggtcaagtattggtaagatgttcgagtccacttaccgcggagcaaaacgcatggctatattgggagaaacagcatgggatttcggaagcgttgggggactattcaccagtctaggaaaggccgtacatcaggttttcggttctgtctacacaacgatgtttgggggtgtaagttggatgatacggattctaattggctttcttgtcctgtggattggaactaatagccgcaacacatctatggctatgacatgcatagctgttgggggaataaccctatttttaggatttacagtccaagcggacatgggatgtgtagtaagttggtcaggacgagaattaaaatgtgggagtggaatatttgtagtagataatgtgcacacctggacagaacaatacaagtttcaacctgaatccccagcccgcttggcttcagcaatcttgaacgcccataaagatggcgtgtgcggtattcgatctacaacaagattagaaaacgtaatgtggaagcaaattaccaacgaactgaattacgttctttgggaaggtggacacgacttgacggtagtagcaggagatgtgaaaggcgtactgactaaagggaaacgtgcactcactcctccagtgtcagatctcaaatactcatggaaaacgtggggaaaagcgaaaatatttaccccagaagcgcgaaactcaactttcttaatcgatggtccagatacatctgaatgtcctaatgagcgtcgagcttggaatagtttagaagttgaagactacgggtttggaatgtttaccactaatatatggatgaaatttagagaagggtcttccgaggtgtgcgatcatagattaatgagtgctgcaattaaagatcagaaggccgtacacgccgacatgggatattggattgaaagtagtaaaaaccaaacttggcaaattgaaagggccagcttaatagaggtgaaaacgtgcctatggccgaaaacccacacgctctggtcaaacggtgttttggaatcccagatgttgattccgaaaagttatgcaggtccattcagccagcacaactacagacaaggttacgcaactcaaacggtcggaccatggcacttaggaaaactagagatagactttggagaatgtccagggacaacagttactatccaagaagactgcgaccacagaggaccttcgttaaggacaaccaccgcgagtggaaagctagtgacacagtggtgttgtcgttcctgtacaatgcctccactgaggtttttgggtgaggatggatgttggtacggtatggaaatccgtcccctcagtgaaaaagaagagaatatggtaaaatcacaagtaactgcagggcaaggcacttcagaaactttcagcatgggattactctgtttaactttattcgtagaggaatgtttaaggagaagggttactcgaaaacacatgatactagcagttgtgataaccctttgtgctataattctaggaggcttgacctggatggacctcctgagagccttgataatgttgggagacaccatgtctggtcgcatcggaggacaaactcacttagcaatcatggcagtctttaaaatgagccctgggtatgtccttggggtctttttgcgaaaactcacatcaagggaaacggctcttatggtcataggtatggctatgacgacaacattgtcaataccacatgacttaatggaattaattgatggtatatctttaggattaattcttctcaaaatcgtcacacaatttgataacacgcaagtagggactcttgcactctcactaacattcatcagatctacaatgtcacttgtaatggcatggcgcacaataatggccgtattatttgttgtcactttgatccctctgtgtagaacaagttgcttacaaaaacagagtcactgggtggaaattacggcactgatattgggagcacaggcacttccggtttatctgatgacactaatgaaaggagctagcaggagatcatggccactcaatgagggcataatggctgtaggcttagtcagcctactgggtagcgcacttcttaaaaatgacgtacccctagcaggaccaatggtagctggtggattgctactcgcagcgtatgttatgtctgggtcatctgcagacctctctttggaaaaagctgcttcagttcaatgggatgaaatggctgatatcacaggttcatcaccgattatcgaagtgaaacaagacgaagatggtagtttctcaataagagatgtagaagaaacaaacatgattacacttttggttaagttagcgttaattactgtgtcaggactatatccattagcgatacctgtcacgatgacactatggtatatgtggcaggttaagacgcaaagaagtggtgccttatgggatgtaccctcacccgcggctacacaaaaagcagcattaagcgaaggtgtctatagaataatgcaaagaggattgtttggaaagacgcaagtcggagtaggtatacacatggaaggagtcttccataccatgtggcatgttactagaggatcggtgatttgccacgaaacgggtcgactagaaccatcatgggccgacgtgcgtaacgatatgatctcatatggcggaggatggcgacttggagataaatgggacaaagaagaagacgtacaagtattagctatagaaccaggtaaaaatcctaaacacgttcaaacaaaacctgggctattcaaaacactaacaggtgaaatcggagcggtaacgctagatttcaagccaggtacgtcgggtagtccgattataaaccggaagggaaaagtgataggtctatacggaaatggtgttgttaccaaaagcggggactatgttagcgccataacgcaagcggaaagaataggggaacctgattatgaagtcgatgaggacatatttagaaagaaacgactgacaatcatggacctacaccccggtgccggaaaaactaaaaggatactgccttccatcgtacgagaagcgctcaagagaagacttcgaacactaatattggctcctacaagagttgttgcagcagaaatggaagaagcattacgaggattgcccataaggtatcaaactccagctgtcaaatcagagcatacaggcagagaaatagttgatttaatgtgtcatgctacatttactacacgtctactgtcgtcgacccgcgtacctaactataacctaatagttatggatgaagcacatttcactgatcctagtagcgtcgctgcaagaggatatattagcactagagtagaaatgggggaagcggcagcgatatttatgacagcaacacctcccggagccactgatccatttccacagagtaactcacctatagaagacatagaacgagaaataccagaaagatcctggaatacaggcttcgattggataacggattatcagggcaagacggtatggtttgtaccgtctatcaaagctggtaatgatatcgctaattgtctacgtaaatccggcaagaaagtaatacaactgtcaagaaaaacttttgacacagagtacccaaaaacaaaattgacagattgggatttcgtggttaccaccgacattagtgaaatgggtgccaattttagagccgggcgagtgatagatccacgtagatgtttgaaacctgtgattctaacggacgggcccgagagagtaattctagcaggtcctatacctgtaaccccagcatccgctgctcaaagaagaggcagaattggaagaaatccagcacaagaagacgatcaatacgtattttccggtgacccgcttaaaaatgacgaggatcacgctcactggactgaggcaaaaatgttattagataatatatacaccccagaaggcataattcccacattattcggcccagaacgtgagaaaacacaggctatcgatggcgaatttagattgcgtggtgaacaaaggaaaacatttgtcgaattaatgcgacgcggcgatcttccagtctggctcagctacaaagtagcaagtgcaggaatcagttacaaggatcgggaatggtgtttcactggggaacgaaataatcaaatcctcgaggagaatatggaggttgaaatttggacacgcgaaggtgaaaagaagaaacttcgcccaagatggctagatgcacgtgtctatgctgatcccatggccctgaaagacttcaaagaatttgcttcgggccgcaagtctataaccttagatatactaacagaaatagcttcgttaccaacttatctgtcttcaagggcaaaacttgctctggataatattgtcatgttacatacaacggaaagaggcggacgcgcatatcaacatgcgttaaatgaattaccagaaagcctcgaaacactaatgttagtagccctattaggtgcgatgacagcaggcatatttttattctttatgcaaggcaagggaataggaaaattgtcaatgggattaattacaattgcggttgcgtctggcttactttgggttgcagaaatacaaccacaatggatagctgcatcgataattttagagttctttcttatggtcctcctaatacccgaaccagaaaaacagagaacaccgcaagataaccaactgatttatgtcattctaacaattttaacaattattgggttgatcgcagctaacgaaatgggccttatagaaaagacaaaaactgactttggattttaccaagtaaaaacagaaacgactattctagacgttgatttgaggcctgctagtgcatggacactgtatgccgtagcgacaactatactgactccgatgctacgacatacaatcgaaaatacgagtgcaaatttaagtttagccgctattgcaaatcaggctgcagttcttatgggattaggcaagggatggcctttacatcgaatggatcttggtgttcctttacttgcaatgggttgttattcccaagtaaatcctacaacattaactgctagtttagtaatgctacttgttcattatgcgattattggaccaggtttacaagcgaaagcaacgagagaagcacagaaaaggacagccgccgggataatgaaaaatcctacagtagacggaattacggtgatcgatttagaaccaatatcctacgatcctaaatttgaaaaacagctcggccaagtcatgcttttagtactatgtgcagggcaattgttacttatgagaacgacttgggctttttgtgaggtactaacattggccacagggccaatcctaacgttatgggaaggaaatcccggaaggttttggaacacaactatagcagttagtaccgcaaacatattccgcgggagctatttagcgggtgctggattagctttttcactcattaagaatgcgcaaacgcctaggagagggacaggaacaactggcgaaacattgggggagaaatggaaaagacaactgaatagtttggacagaaaagaatttgaagaatacaaacgatccggcatattagaagttgatcgaacagaagctaaaagtgctctaaaggacgggtccaaaataaagcatgccgtttcacgaggttcctcaaaaattagatggatcgttgaaaggggtatggtgaaaccaaaaggcaaagttgtagatctaggttgtggtagaggtggttggtcttactatatggcaactctaaagaatgtaactgaagttaaaggttataccaaaggaggccctggtcatgaggaaccaatacccatggcaacgtatggatggaatctggtcaagttacattcaggtgttgacgttttctataaaccgaccgaacaggtagacacactactttgtgatattggagaaagcagcagcaatcctactattgaagaaggtagaaccttaagggtattaaaaatggtagaaccatggcttagctcaaaaccagaattttgcatcaaagtcctcaatccatacatgcctactgtaatagaggaattagaaaagttacaacgaaaacatggtggtaatttggtacgttgtcccctctcgagaaattcgacacatgaaatgtattgggtatcaggagcatcagggaacatagtaagctcggtgaataccacatcaaagatgttgttaaatagattcacgacacgacacagaaagccaacatacgaaaaagatgtagatttgggcgctggaacacgatcagttagtacagagactgagaaacctgatatgactataattggcaggaggctacagagactccaggaagaacataaggagacatggcattatgatcaagaaaatccttacaggacttgggcatatcatggtagttacgaggcaccaagtaccggctctgctagctcaatggtaaacggcgtagtaaaattgcttacaaaaccgtgggatgttataccgatggtaacccagctggctatgactgatacaacacctttcggacaacagagagtatttaaagaaaaagttgatacgagaacaccccaaccaaaacccggaaccagaatggtcatgacaacaacagccaactggctatgggcactattagggaagaagaaaaatcccagattatgtactcgtgaagaatttattagtaaagtacgaagcaatgcagctataggagctgtattccaggaggaacaaggttggacttcagctagtgaagccgtcaatgattcgagattctgggaattagtagacaaggaaagagccctccatcaagagggaaaatgtgaatcatgcgtgtataatatgatgggtaaacgtgagaagaaactcggagagttcggtcgagccaaaggttctcgagccatttggtatatgtggctcggggcgcgctttctagagttcgaagcgctgggattcttaaatgaagatcattggtttggtagagaaaatagctggtctggagtggagggtgaaggtttacatcgactcggatatatactcgaggaaattgacaagaaagatggtgacttaatgtatgctgatgatacggcaggatgggatactaggataacagaagatgatctgcaaaacgaagaacttataaccgagcaaatggcaccacatcacaaaattctagcgaaagctatttttaaactcacatatcaaaataaagtagttaaagtactcagaccaacgcctaggggtgcagtaatggatattataagcagaaaagatcagagaggttcgggccaggtaggcacttatggactcaatacgttcacgaatatggaagtgcaattgatacgtcaaatggaagcagaaggcgttataacgcaagatgacatgcaaaacccgaaaggactaaaggaaagagtcgagaaatggctacgtgaatgtggcgttgatcgcctaaaacgtatggcaatctctggagacgactgtgtcgtcaaacccctagacgaacgatttggtacctcattactatttctgaacgatatgggtaaagtaagaaaggatattccgcaatgggaaccatcaaaaggatggaaaaactggcaagaagtgcctttctgttcccatcacttccataagatttttatgaaggatggacggagtttggtggtgccttgtaggaaccaagacgaattaatcggtcgtgctcgtataagtcagggtgcaggatggagtttaagagaaactgcgtgccttggtaaagcatatgctcaaatgtggtccctaatgtatttccacaggcgagacctaagactagcatctatggcaatttgctcggctgtaccgaccgaatggtttcccacaagcagaactacatggagcattcatgcacatcatcaatggatgacgacggaggatatgttaaaagtatggaacagggtatggatagaagataatcccaatatgatagataaaacacccgttcatagctgggaagatataccctatcttggcaaaagagaagatctgtggtgtgggagcttaataggtcttagttcccgtgctacctgggccaagaatatacatactgcaatcacacaagtaagaaatttgataggtaaagaagaatatgtagactacatgccagtgatgaaacgatattctgccccctcagagtcggaaggcgttctgtag

SEQ ID NO: 23635 - RNA, 9867 nt, synthetic construct
  misc_feature 1..9867: note = derived and/or modified CDS sequence (opt6) from DENV-4__FJ639745__SS-prME
  source 1..9867: mol_type = other RNA
tcgaccatgacgcttctgtgtctaataccgactgccatggcatttcacctttccaccagggatggagaaccattaatgattgttgcgaaacacgaacggggaagaccattattgtttaaaactactgaagggataaataaatgcacactgatagccatggatctcggtgaaatgtgtgaagatacagtgacctacaaatgtccactattagttaatacagagcctgaggatatagattgttggtgtaatcttacaagcacttgggtaatgtacggtacatgcacccaatcaggtgaacgtagaagagaaaaacgtagcgttgcactgacaccgcattcaggtatgggattagaaactcgagcagagacttggatgtcatctgagggagcctggaaacacgcgcaacgcgtagaatcctggatcttacgaaaccctgggtttgcgttgttggctggattcatggcatatatgattggtcaaacaggaatacaaaggacggtattctttgttctcatgatgctagtagcaccttcctatggaatgagatgtgtcggcgttggtaacagagattttgtcgaaggtgtgagcggaggagcatgggtcgacttggtattggaacatggtggatgtgtgacaacaatggcacaaggcaaacccactctagacttcgagttaaccaaaactacagcaaaagaggttgctttattaagaacttactgtattgaagcattgatatccaacataaccaccgctacaagatgcccaacacaaggtgagccgtacctcaaagaagaacaagaccaacaatatatatgccggagagatgttgtagatagaggatggggtaacggttgcggtttattcggtaaaggtggagtcgttacttgcgctaagtttagttgtagcggaaagatcacgggtaatttggttcaaattgaaaacttagaatacacagttgtcgtgaccgtgcacaacggtgatacacatgctgtaggtaacgatactagcaatcacggagttactgcaactatcacgccgagatctccttcagttgaagtaaagttgccggactacggagagcttacattagattgtgaaccaagaagtggtatcgattttaatgaaatgatactaatgaagatgaaaaagaaaacatggctggtacacaaacaatggttcttagatcttccgttgccatggacagcaggcgccgacacatcggaagtacattggaattataaagaacgcatggtaacgttcaaagtaccacatgccaagagacaagatgtgacagttttaggttctcaagaaggtgcgatgcattcagccctagcaggagctactgaggttgacagcggggatggaaaccatatgttcgcgggccatctcaaatgcaaggtaagaatggaaaaattaagaattaaaggaatgagttacactatgtgtagtggcaagtttagcattgacaaagagatggccgaaacccagcatggaacaactgtagtaaaagttaaatatgaaggagcgggggcgccatgtaaggtgccaatagaaatccgagatgtgaataaagagaaagtagttggtagagttatcagtagtacacctctagctgagaacacaaactcagtaactaatatagagttggaaccaccgtttggtgattcgtacatagtaataggggtagggaatagtgccctaaccttacattggttcagaaagggatcttcgataggaaaaatgttcgagtcgacctaccgaggagctaaacggatggccattctgggtgaaacagcatgggactttggatcagtgggtggattatttaccagtctaggaaaagctgtacaccaagtatttggaagcgtatatacaacaatgttcgggggtgtttcctggatgataaggatccttataggattgttggttctatggataggaacgaactcacggaacacgtcaatggcaatgacatgcattgcggtaggaggaattactctatttcttggtttcaccgtgcaagcagacatgggttgcgtagtgagttggtcgggtagagaactcaaatgtggcagtggtatttttgtagttgacaatgtacacacatggaccgaacaatataaatttcaaccagaatctccggcacgactagctagtgcaatactaaatgcacataaggacggagtatgtggaattaggtcaactacgaggctagaaaatgtaatgtggaaacaaataacaaacgaattaaattacgtgttgtgggagggaggtcacgatttaaccgtagtagcgggagatgtcaagggagttctaactaaaggaaaaagggctctgactccacctgtctcagatctaaaatattcatggaagacttggggcaaagcaaagatcttcacccccgaggcacgaaacagtacattcttaatcgatggaccagatacaagcgaatgtccaaatgaacgcagggcctggaactcattagaagtggaggattatggcttcggaatgttcactactaatatctggatgaagttcagagaaggtagctccgaagtttgtgaccatagattaatgtctgccgccattaaagaccaaaaagcagttcacgccgatatgggttattggattgagagtagtaaaaatcaaacttggcaaattgagagagcatcattaattgaagtgaaaacttgtctctggccaaagacacatacactttggtcaaacggtgtattagagtcacagatgctaatcccaaaaagctacgccggaccattttctcaacataattaccgacaaggatatgctacacagactgtagggccgtggcatctcggcaaactagagatagatttcggggagtgccctggaactacagtaacaatccaggaagattgtgatcatcgaggcccttcactgcgtactactacagcttcaggaaagttggtaacccagtggtgctgcagaagttgtactatgcctcctctgaggtttctaggagaagacggatgctggtacggcatggagataaggcctttatctgagaaagaagaaaacatggtcaaatcgcaggtcactgcaggacaaggaacatcagaaaccttcagcatgggattattatgtctgacactattcgtggaagaatgtctacgacgaagagtaacaagaaagcacatgatcctagctgtggtaatcaccctgtgtgctataatactaggaggcttgacatggatggacttattaagagcgctaataatgcttggagacaccatgtcaggtagaataggaggacaaacacatttagcaataatggcagtgttcaaaatgagtccaggctacgtgcttggggtatttttaagaaaactgacatcaagagaaactgcattgatggtgataggtatggcgatgactacgacactttcaatcccacacgatttaatggaattgattgacggaattagtttaggattaatattactaaaaatagtaactcaattcgacaacacacaagtaggtacattagctttatcactaacctttataagatctactatgtcacttgttatggcttggcgaaccattatggccgttcttttcgtagtcacgttaatacctctttgccgaacaagttgcctacaaaaacaaagtcactgggttgaaataactgcactaatattaggtgctcaggctttacctgtgtacttaatgacactgatgaaaggggcgtcaagaaggagctggccccttaatgaaggaataatggccgtggggctcgttagtttgctaggttcagcattactaaagaacgacgtaccattagccggtccaatggttgcgggtggacttttattagctgcttacgtcatgtccggaagctcagcagacttaagcctagaaaaggcggccaacgtgcaatgggatgaaatggctgacatcaccggatcgtcacctatcatcgaagtgaagcaagatgaggacgggagtttctcaattcgggatgtagaagaaacaaacatgattacgctactcgtcaaattagcattaataacggtatctgggctatatccattggccataccagtgactatgacactttggtacatgtggcaggtaaaaactcaaagatccggggcactatgggatgttccgagccctgccgctacccaaaaagcagctctatccgaaggcgtatatcgaataatgcagaggggactcttcggcaaaactcaggttggcgttggtatacatatggaaggcgtttttcacacgatgtggcatgtaacacgaggctctgtaatttgtcatgaaactggtagattggaaccaagttgggctgatgttcgcaatgatatgatctcttacggtgggggttggagacttggcgataaatgggacaaggaagaagatgttcaagtactagcaattgagcccggcaagaatccaaagcatgtccaaacgaaaccgggattattcaaaacactaaccggagaaattggtgctgtaacattggatttcaaaccaggaacgtcaggaagccctattataaaccggaagggaaaggttattggattatatggtaatggagtagtgactaaaagcggagattacgtcagcgcaattacacaggcagagcgaattggtgagcctgactatgaagtagatgaagatatcttcaggaaaaagagactgactatcatggatttacacccaggagcaggtaaaacgaagagaatactcccatcaatagtgagagaagcgctgaagcggaggttaagaacattaatactggcacccaccagagtcgtagctgccgagatggaggaagcattgcgaggtctaccaattagataccaaacgcctgccgtgaaatcagagcatacaggcagggaaatagtcgacctaatgtgccatgcaacttttaccacccgacttttaagcagcacgagagtaccaaactacaacctgatcgtcatggacgaagcacactttactgacccaagcagtgttgcggcgagaggatatatctctacaagagttgaaatgggtgaagccgcggcaatatttatgacagctactccaccaggtgctactgaccctttcccccaatctaacagtccaatcgaggatattgaaagggagataccagaaagatcgtggaacaccggctttgattggataacagactaccaaggtaaaactgtgtggtttgtacccagtattaaggctggtaatgacatcgcaaattgccttcgaaaatcaggcaaaaaggtaatacaactcagtcggaagacatttgacaccgaatatcctaaaaccaagttaactgattgggacttcgtggtcactacggatatatcagaaatgggagcgaatttcagggctggacgagtgatagacccaagaagatgtttaaaaccggtcatactgactgatggtccggaacgagtcatattagcaggccccataccggttacccctgcatccgcagcacaacgtagaggtagaatcgggcgaaatcccgcacaagaagatgatcaatatgtgttcagtggtgatccactcaaaaatgatgaagatcatgcccattggaccgaggctaaaatgttactagataacatatatacccctgagggcataattccaaccttattcgggccagaaagagagaaaacccaagctatagacggagagtttagattaagaggagaacagaggaaaacgtttgtagaattaatgcgaagaggggatctgcctgtatggctatcatacaaagtagcctcagcaggcatatcatataaggatcgtgaatggtgtttcacgggtgaaagaaataatcagattttagaagaaaatatggaagtggaaatctggacacgcgagggcgagaagaagaaattgagaccaagatggctggatgcccgtgtgtacgcggatcccatggccctcaaagattttaaagaatttgcatcgggtcgtaagtcaattaccttagacatattaaccgaaattgcaagtctgccaacatacttatcaagtagggcaaaacttgctctggacaacatagttatgttacacacaactgaacgaggcggcagagcataccaacacgccttaaacgagctaccagaaagtttagaaacattaatgcttgtagcacttcttggtgcaatgactgcgggtatatttttattctttatgcagggaaaaggcatagggaaactatcaatgggtctaataacaatagccgttgcaagcgggctactatgggttgcagaaatccagccgcaatggatagctgcgagcattattttagagtttttcttaatggtattattgataccagaacctgaaaagcaaagaactccacaagacaaccaacttatatatgttatccttaccattctcacgataattggattgatcgctgcaaatgaaatgggacttatagaaaagactaaaacggattttggtttctaccaggtaaaaacagaaacaaccatattagacgtagacctacgacctgcttccgcctggacattatatgccgtggccaccacaatattgacacctatgctcagacacacaatagaaaacacaagtgctaacctatccctagctgcaatagccaaccaagcagcagtcctaatggggctaggaaaaggatggcccctgcacagaatggaccttggcgtaccactgctggccatgggttgttactcccaagtaaacccaacgacattgacagcaagccttgttatgttgttagtacattatgcgataataggccctggtctacaagccaaagcaaccagagaagcacaaaagaggacggctgcgggaataatgaaaaacccgacagtggatggaattaccgttatagatctagaaccgatatcctatgacccaaaattcgaaaaacaattaggacaagtgatgcttctagtactatgtgccggacagttgctacttatgcgaacaacatgggcattttgtgaggtcctaactctggctactggaccaatattgacgctttgggaaggtaacccaggtcgattttggaataccacgattgcagttagtacggccaacatttttagaggatcatatctagctggtgcaggacttgcctttagtctaattaagaacgctcaaacacctaggaggggtacaggcaccactggggaaacacttggagaaaagtggaaacgacagttaaattccttggacaggaaggaatttgaggaatacaagcgctcaggaattttggaagtagatagaactgaagcgaagtcggcgttaaaggacggatcaaagataaagcatgcagtatcaagagggagttcgaagattaggtggatagtagaacgaggaatggttaaaccaaaaggtaaagttgttgatcttggttgtggtcgcggtgggtggtcctattatatggcaactctaaagaatgtgacagaggtcaaaggctacaccaagggaggtccaggacacgaagaacctataccaatggcgacgtatggttggaatttagtgaaattacatagcggagttgatgtcttttataaacctactgaacaagtagacacattactgtgtgacataggtgaaagcagtagtaaccccacaattgaagaaggacgtaccctacgtgtgttaaagatggtggaaccatggttgtcctcaaaacccgaattttgtataaaagttctaaatccatatatgcccactgtaatagaggaattagaaaaattacaaagaaagcacggaggcaatctggtacgatgtccactcagcagaaacagcacacatgagatgtattgggtaagtggagcctctggcaatatagtttcgagtgtaaatacaacttcaaaaatgctactgaaccgattcacaactagacaccgtaaacctacgtatgagaaagacgttgacctaggagccgggacaagaagcgttagcactgagacggagaaacctgatatgacaataattggaagaagactccaaagactacaagaggaacacaaggaaacctggcactatgatcaggaaaatccgtataggacttgggcttatcacggtagttatgaagcaccatcaactggaagtgcaagttcaatggtcaatggtgtagtcaaactcctcacgaaaccttgggatgttatacccatggtaacccaacttgcaatgacagatacaactccctttggtcaacagcgagtatttaaggagaaggtagacacaagaacgccacaaccaaagccgggtacaagaatggtcatgacaacaacagctaattggctatgggcgttattaggtaagaagaaaaatccacgcctttgtactagagaggaatttatttcaaaagttagatctaatgctgctataggagcagtcttccaggaagaacaaggttggacgagtgcaagtgaagcagttaatgactctcgtttctgggagcttgttgataaggaacgtgccctacatcaagaaggtaaatgtgaatcatgtgtctacaacatgatgggcaagcgagagaagaaattaggtgaatttggaagggcaaagggatccagagcaatatggtatatgtggctaggtgcaagattcctcgaatttgaagcactaggattcttaaacgaggaccattggtttggacgagagaacagttggtcaggtgtggaaggggagggactccatagactagggtacatcttggaggaaatagacaagaaagacggagacctaatgtacgcagacgatactgcgggatgggataccaggattacggaagatgatctccaaaacgaagaattgattacagaacaaatggccccacaccacaaaattctagctaaggccatctttaaattaacctatcaaaacaaagtagtaaaagtactgagaccgacacctcgaggagcggtcatggacattatctcacggaaggaccaacgaggatcaggccaagtcggcacttatggtttgaacacctttacaaatatggaagttcagttaatacgtcagatggaagctgaaggagtaataacgcaggacgatatgcaaaatcctaaaggactcaaagaaagagtggaaaaatggttaagggagtgcggagtagatagactcaaacgtatggccatatcgggcgatgactgcgtcgttaaacccttagacgaaaggttcgcaacaagtctattattcctaaatgatatgggaaaagtacgtaaagacataccccaatgggaaccatctaaaggttggaaaaactggcaagaagttcctttctgtagccaccacttccataagatattcatgaaagacgggcgatccttagtagtcccttgcagaaatcaagatgaactgattggcagagcacgtattagccaaggagcgggatggagtttaagagagactgcttgtcttggcaaggcctatgctcaaatgtggagtctaatgtattttcacagacgagatctccgtttagcatcaatggcaatctgtagcgcagttccgaccgaatggttccctacgtccagaacaacctggagtattcacgcccaccaccaatggatgactactgaagacatgctgaaagtgtggaatcgggtgtggatagaggacaatcccaacatgatagacaaaactccagtacatagctgggaagatattccatacctcggaaaacgggaggatttatggtgcggcagcttaataggattatcaagccgagcaacatgggcgaaaaatatacataccgcaataacgcaggtaagaaatcttattggcaaagaggagtatgtcgattatatgcctgtaatgaaacgatacagtgcgccctcggaatctgaaggggttttatag

SEQ ID NO: 23636 - RNA, 9867 nt, synthetic construct
  misc_feature 1..9867: note = derived and/or modified CDS sequence (opt6) from DENV-4__FJ850095__SS-prME
  source 1..9867: mol_type = other RNA
tcaacgatcaccctgttatgtctgataccgaccgtaatggcttttcatttgagtacaagagatggtgaacctctaatgatcgtagcaaaacacgaacgagggcgcccactattgttcaaaacaacagaaggtataaataaatgtactctgatagcaatggatcttggtgaaatgtgcgaagacaccgtgacttacaaatgtcccctattagtaaatacagaaccggaagacattgattgttggtgtaatctaaccagtacatgggtaatgtatggaacttgcacccagtcgggtgagaggagaagagaaaaacgctcagtagcactaacaccacattctggaatgggactagagacacgtgcagagacatggatgtcatccgaaggcgcatggaaacacgcacaacgagttgaatcctggatattacggaaccccggattcgcactcctagccggctttatggcttacatgataggtcagaccggaatccaaagaacagtgttctttgttcttatgatgctagtcgcaccttcgtacggcatgcgatgcgtaggagttggtaacagagatttcgtggaaggcgtatcgggaggggcatgggtagatttagtattagaacatggaggttgtgttacaacaatggcacagggaaaaccaacacttgatttcgaattaaccaaaaccactgctaaagaagtcgcgttattaagaacatattgtatagaagcgctaataagcaacatcaccacagcgactaggtgcccaacacaaggagagccatatctcaaagaagaacaagatcaacaatatatttgtagaagagatgtcgtggacaggggatggggtaacggttgtggattattcgggaaaggaggcgttgttacatgtgcaaaattcagttgctctggaaaaatcacagggaatttggttcaaattgaaaatttggaatacactgtagttgtaactgttcataatggagacactcatgcagttggaaatgatacttcaaaccacggtgttactgcaaccattaccccaaggtccccttcagtcgaggttaaattgcccgactatggtgagctcacattagattgcgaaccacgttcaggaatagactttaacgaaatgatattaatgaaaatgaagaagaaaacatggctcgtacacaaacaatggtttctagatctcccattgccttggaccactggggcagatacatcggaagtgcattggaattacaaagagcgaatggttacatttaaagtaccccatgcaaaaagacaggacgtaacagtgctagggagccaagaaggagctatgcatagtgctctagccggagcgaccgaagtagacagtggagatggcaaccacatgttcgcgggccatctaaaatgtaaagttagaatggaaaagctacgtattaaaggaatgtcgtatactatgtgttcaggaaagttcagtatcgataaagaaatggcggagactcaacacggaaccactgtagttaaagttaaatacgaaggagcaggagccccgtgcaaagtaccaattgaaattagagacgtcaataaagagaaggtcgttggtcgtgtaataagtgcaacgccattagcagaaaatacaaattcagttacaaacatagaactagaaccaccgtttggcgactcatacatcgttattggtgtaggtaattccgcattaacattacattggttcagaaagggatcatcaattggaaaaatgtttgagtcgacatacaggggagcaaaaagaatggcaatattaggtgagacagcatgggatttcggttcagtaggaggtctttttacctcactcggcaaggccgttcaccaagtctttggatcagtttatacaaccatgtttggtggggtgagttggatgataagaatcctaataggatttttagttctgtggatcggaaccaattcccgtaacacttcgatggccatgacctgcatagcagtcgggggaatcacattattcctgggattcactgttcaggcagatatggggtgcgttgtttcatggagtggtcgcgagctcaagtgcggatcgggaatttttgtagtcgataacgtacacacatggacagaacaatataaattccaaccagaatctccagcacgattagccagcgcaatcttaaatgcacataaggatggagtttgcggaatacgtagcactacacggctagagaacgtaatgtggaaacaaataactaatgaactaaattatgtactttgggaaggtggacacgacttaactgtggtcgcgggtgatgtcaagggagtactaactaaaggtaaacgtgcccttacaccgccagctagtgatctgaagtatagttggaaaacgtggggtaaagctaaaatttttacacctgaagcacgaaatagtacatttttaatagacggtccagatacatcggagtgcccaaatgaacggagagcttggaactcgtttgaagtggaagactacggattcgggatgttcacaacaaacatatggatgaaattcagagaaggaagttcagaagtctgcgaccaccggctaatgtccgctgcaataaaagatcagaaagcagtacacgcagacatggggtactggatagaatcgtctaaaaatcagacctggcaaattgaaagagcgagtcttatagaggttaaaacatgtttgtggccaaaaactcatacattgtggtctaatggtgtattagaatcacaaatgctgatacctaaaagctacgctggccctttttcccagcataattacagacaaggatatgccacacagacagtgggtccttggcacttgggcaaactggaaatagattttggagaatgtccgggtacaaccgtaaccattcaggaagactgcgatcacagggggccatccctgcgcacgactacagcgagtggtaagttagttacgcagtggtgttgccggagctgcacgatgccaccgctcagattcctaggggaagatggctgttggtacggaatggaaataaggccacttagcgaaaaagaagagaatatggtgaaatcgcaagtcactgctggacaaggaaccagcgaaacatttagcatgggattactatgcctaacattattcgtagaagaatgtcttagacgaagagtcacacgaaaacatatgatattagcggttgttattacgctatgcgctattatacttggaggattaacatggatggacctactgcgagctttaataatgttaggagatactatgtctggaaggattgggggtcaaactcatcttgcgattatggcagtatttaaaatgtctccaggatatgtactaggagtgttcttaagaaaattaacttctagggagacggctttgatggtcattggtatggcaatgacaactactctatccataccgcatgatttgatggaattaattgacggaatctctctgggactaattctattaaagatagttacacaatttgataatacacaagtaggcacattagctctgtctttaacattcattaggtcaactatgtccttggtcatggcatggcggaccattatggctgtgctatttgttgtgactctcatacccctatgtcgaacaagttgccttcaaaaacaatcccactgggtcgaaataaccgcattaatactcggagctcaagcgctccctgtatacctgatgactttaatgaagggcgctagcaggagaagctggcctctaaacgaaggaataatggcagtcggcctagtctccttactcggtagcgcactacttaaaaatgatgtacctcttgctgggcccatggtagccggtggtttgttgcttgcagcctacgtaatgtcaggaagctctgccgacttatctttagaaaaagctgcaaacgttcagtgggatgaaatggcggatatcactgggtctagtcctatcattgaagtaaaacaagatgaggacggttctttctccataagagatgtggaggaaacaaacatgattaccctcctagttaaactagctctaataacagtaagcggattatatccattagccatacccgtaactatgactctatggtatatgtggcaagtgaaaacacagaggagcggggcattatgggacgtcccatctcccgctgcaacccaaaaggcagcgctaagcgaaggagtgtaccgcataatgcaacgaggtctgttcggcaaaacacaggtaggtgttgggatccatatggagggagtctttcatactatgtggcacgttacacgaggaagtgttatatgtcatgaaacgggacgtctcgaaccatcctgggcggacgtcagaaacgacatgatttcatatggaggagggtggaggcttggggataaatgggataaagaggaagacgtacaagttctagcaatagaaccaggtaaaaatccgaaacacgttcaaaccaagcctggacttttcaaaacactcacaggagaaataggagccgtgaccttggactttaaacctggaaccagcggaagtccaataatcaatcgtaaaggcaaggttattggattatatggaaatggcgttgtgacaaagagcggggactatgtaagcgctataacacaagcagagagaataggtgaaccagattacgaagtcgatgaagacatatttagaaagaaaaggctgactattatggacttacatcctggtgcaggtaaaacaaagagaatattaccaagtatagttagagaagcactaaaacggcgtttacgtacattaatattggcacccacacgagtcgttgcagcggagatggaagaggcattaagaggtttacctatcaggtatcaaactcctgcagtaaaatcagagcacacaggtcgagaaattgttgatctaatgtgtcatgctacctttacgacaagactactgtctagtactcgcgtacccaattataacttgattgttatggatgaagcccacttcacagacccatcaagtgtcgccgcaagaggatacatatccacacgcgtagaaatgggcgaagcagcagctatatttatgacagcaacccctcctggtgcgactgaccccttcccccaatcaaacagtccaatagaagatatagagagagaaattccggaaaggagctggaatacaggtttcgactggataacagactatcaaggtaagacggtgtggtttgtaccgagcataaaagcggggaatgatattgccaactgtttacgtaagtccgggaaaaaggtaattcaattaagtcgtaaaacatttgacacagaatatcctaagacaaaattaacggattgggattttgtggtgactacggacattagtgaaatgggagccaattttcgagcaggcagagttatagatccccgaaggtgtctaaagcccgtaatactaacagatggcccggaaagagtgatactcgccggcccaatccctgtgacgccagcaagcgccgcgcaacgaagaggacgaatcggacgcaacccagcacaagaagacgatcaatacgtatttagtggtgatcccctcaaaaatgatgaggatcacgctcactggaccgaagctaaaatgttattggataatatatacactcctgagggaattataccgacattattcggaccggaaagagagaaaactcaggcaatcgacggagaatttagattgaggggagagcaacgaaagacctttgttgagttaatgagacggggagacctcccagtttggctgagttataaggtagcaagtgccggaatatcatataaagacagagaatggtgctttaccggggagagaaataaccaaatattagaagagaacatggaggtagaaatttggacgagagagggagagaagaagaaactcagacccaaatggctggacgcaagagtatatgcagacccgatggctttaaaagacttcaaagaatttgcctcagggcgtaaatctatcactttagacattctgacggaaatagcttcactgccaacatacctaagttcaagagcaaaactagctttggataatatagtcatgctccacacgacggaacggggtgggagagcatatcaacacgctctcaatgagttacctgagagcctagaaacgctaatgttggtcgccctgttaggagcaatgactgcagggattttccttttctttatgcaaggcaaaggcatagggaagctatctatgggactcattactattgcggtagctagcggtctattgtgggtcgcggaaattcaaccacagtggatagcggctagtatcattttagagtttttcttaatggttctactgatacccgaaccagaaaaacaacgaacaccacaggataaccagttgatatatgttattctcacaatcttaacgataataggattaatagcagcaaacgaaatggggctaattgaaaagactaagactgacttcggattctatcaagtgaaaacagaaaccactatactagatgttgacttacgacccgcttcagcatggacattatatgcagttgcaactacgatacttaccccgatgttgcgacatacgatcgaaaacacaagtgccaacctctcattggcagcaatagctaatcaagcagctgtactgatgggattagggaaaggatggccactacatcgaatggatctaggtgttccattactcgctatgggatgctattcgcaagttaacccaacaacgttgacagcttcattagtcatgttattagtacattacgctataatcgggccaggattacaggcgaaagctacgcgagaagcgcaaaaacgtactgcagctgggattatgaaaaacccaacagtggatgggattactgtgattgacttagaaccaatcagttatgacccaaagttcgaaaagcaattaggtcaggttatgctcctagttttgtgtgctggacagttactcctgatgagaactacatgggcattttgtgaggtacttaccttggccaccggcccaatcttgactctgtgggagggcaatcccggacgcttctggaatactactatagcagtttcaacagctaatatttttagaggaagttatttagccggtgcgggcctcgcttttagccttataaagaacgcacaaactccgcgtcgtgggacaggaacgactggcgaaacgctcggcgaaaaatggaagaggcaattaaacagtcttgatcggaaagaatttgaagaatacaaaagaagcggcatccttgaagtcgatagaaccgaagcgaagtccgcgctcaaagacggaagtaagataaagcacgccgtaagcagaggaagcagtaaaattcgatggattgtggaaagaggaatggttaaacctaaagggaaagttgtggatctaggttgcgggagaggtggctggtcttactacatggcaactttgaaaaatgttacagaagtcaagggatatacaaaaggtggtccaggccatgaagaacccatcccaatggcaacgtacggctggaacttggtaaaactgcatagtggcgttgatgtattttataagcctacggaacaagtagatacattactttgtgacattggggaatcatcttccaaccctacaatagaagagggtcgcaccttacgcgttctaaaaatggtagagccctggctaagcagcaaacctgaattttgcataaaagtattaaatccatacatgccaacggtcatcgaagaattagaaaaactacaaaggaaacatgggggtaatctggttagatgtccactcagccgtaattccactcacgaaatgtattgggtttccggcgcatcgggtaatatagttagctcagtaaatacgacgagtaaaatgttacttaatcgatttacaacaagacatagaaaaccgacgtatgaaaaagacgttgatttaggagcgggaactagaagcgttagcacagaaacggaaaagccggatatgaccataataggcagacgactacaacgcctacaggaagaacataaggaaacatggcattacgatcaggaaaatccgtacagaacctgggcttaccacggtagttacgaagcgcccagtaccggatcagcttcaagtatggtaaacggagttgttaaattactaacaaaaccatgggacgtcataccaatggtaactcaactcgctatgacggataccaccccgttcggtcagcagagagtttttaaagaaaaagttgacacccggacaccgcaacctaaacccggcacaagaatggtcatgacaactacagcaaactggctatgggcactcttaggcaagaagaagaaccctaggttgtgcacgcgagaagaatttatatcaaaagtaagatctaatgctgcgataggcgctgtgttccaagaagaacagggatggacaagcgcgagtgaagcagtaaatgactctagattttgggaattagttgataaggaacgagctctacaccaagaaggcaaatgcgaaagttgtgtctacaacatgatgggcaagagggagaagaaattaggggagttcggaagggctaaaggatctcgtgcaatctggtatatgtggctaggagcaagattcctggaatttgaggctctagggttcttgaatgaagatcactggtttggacgagagaatagttggtcgggcgtcgaaggggaaggattacataggctgggatacatcttagaggaaatagataaaaaggacggtgacttaatgtatgcagatgacactgcaggatgggacacgcgaataaccgaggatgacttacagaacgaggagttaattacggaacaaatggctccacaccataaaatcctggctaaggcaatatttaaacttacctatcagaacaaggttgttaaggttttacgacctactccaagaggagctgtaatggatataatatcaagaaaggaccaacgaggttcagggcaagtcggcacctacggactaaacacttttacaaacatggaagtgcaattaataagacaaatggaagcagagggtgttatcactcaagacgatatgcaaaatccaaaaggattaaaagaacgggtagaaaaatggctaagagagtgcggagtggatcgcttgaaaagaatggcaatatccggagacgactgtgtcgtgaaaccactagacgaaaggttcgggacatccttactctttctaaatgatatggggaaagttaggaaagatataccgcaatgggaaccaagtaagggttggaagaactggcaagaggtacccttctgctctcaccatttccataaaatatttatgaaagatggtcgtagcctcgtagttccttgtaggaatcaagatgaattaatcgggagagctcgaatatctcaaggagctggctggtccctaagagagacagcatgccttggaaaagcatatgctcagatgtggagcttaatgtatttccacagaagggatcttcggcttgcaagtatggcgatatgttctgcagtaccaactgaatggtttccgactagccgaacaacgtggtcaatacacgcacaccatcaatggatgactaccgaagacatgctgaaagtgtggaaccgagtatggatagaagataaccccaatatgatcgataagactccagtacatagctgggaagacatcccatatttaggtaaacgtgaagatttgtggtgcggaagcctcatagggctatcatcacgagccacttgggctaagaatattcatacagccatcactcaagtgcgaaacctaattggaaaagaggaatatgtcgactatatgccagtcatgaagaggtatagtgcaccttcagaaagtgagggagtattataa

SEQ ID NO: 23637 - RNA, 9867 nt, synthetic construct
  misc_feature 1..9867: note = derived and/or modified CDS sequence (opt6) from DENV-4__FJ639748__SS-prME
  source 1..9867: mol_type = other RNA
agtactatgactctactgtgtctaataccgactgccatggcatttcaccttagcaccagggacggtgaacccttgatgatagtagccaaacatgaacgtggaagacctttactcttcaaaacaacagaaggtataaataaatgtaccttaattgcaatggacctaggagaaatgtgtgaagacactgtcacatataaatgtccattgctggtcaatacagaaccagaagacatagattgctggtgtaacttgacaagcacgtgggtgatgtatggaacgtgtacgcaaagcggtgaacgtagacgtgaaaaacgatccgtggctcttacaccccatagtgggatgggactagaaacaagagcggaaacctggatgagcagtgaaggagcctggaaacatgcacaaagggttgaaagttggatactcagaaatcctggattcgcacttttagcaggatttatggcgtatatgataggccagaccggtattcaaagaacggtgttcttcgtattaatgatgcttgtggcaccttcatacggtatgcgatgcgttggcgtaggcaacagagatttcgttgaaggtgtgtcaggaggagcgtgggttgacttagtgcttgaacatgggggttgcgtaactacaatggcacaaggcaaacccactctcgattttgaattaacaaaaacaacggcaaaagaagttgctctactacgtacatattgcattgaggctttaatatcgaacataacaactgcaacgagatgccccacacaaggggaaccatatctaaaagaagaacaggatcagcaatacatctgtagaagagacgttgtagatcgtggatggggtaatggatgcggtttgtttggtaaaggaggagtagtgacttgtgctaaattctcctgtagtggcaaaataacaggcaacctagtacagatcgaaaatctggaatacaccgtagtggttacggttcacaatggagacacacacgctgtaggaaatgacacatctaatcacggcgttacagcgacgataactccaagaagtccaagcgtagaagttcaacttccagattacggagagctcacgctggactgtgaacccagatccggcatcgattttaatgaaatgattctaatgaaaatgaagaagaaaacttggcttgttcacaaacaatggttcttggatttgccacttccctggaccgcaggagccgatacgtcggaggtgcattggaattacaaagaacgaatggtgacctttaaagttccacatgccaaacgacaggatgtaacagtacttggatcgcaggaaggagcaatgcatagcgccctagctggtgctactgaggttgattccggagacggtaatcatatgttcgcaggccacctgaaatgcaaagtccgtatggaaaaactcagaatcaaaggaatgtcttatacaatgtgttccggtaaattctcgattgataaagaaatggcagaaacacagcatgggactacagtggtgaaagtaaaatatgaaggtgcgggtgcaccctgcaaggtcccaatcgaaattagggacgtgaacaaagaaaaggttgtcggacgagttatatcatcaacgccgttagcagaaaacactaattcagtcacaaatattgaacttgagcctccgttcggtgattcgtacatcgttattggcgttggaaactcagcattaactcttcattggtttcgaaaaggttcatctattggaaaaatgtttgaatcaacatacaggggcgccaaacgaatggctatattaggggagaccgcatgggattttggatcagtaggtggacttttcacaagccttggtaaagctgttcaccaagtttttgggtccgtatataccacaatgtttggtggggtcagttggatgataagaatactgataggattattggttctgtggataggcaccaacagtcgaaatactagcatggccatgacatgcatagccgtaggaggtataacattgtttcttgggttcacagtgcaggcggatgtgggatgtgttgtatcgtggtctggacgggaattaaaatgtggatcaggtattttcgttgtagataacgtccatacatggaccgaacaatacaagtttcaacccgagtcgcctgctcgtcttgccagcgcgattttgaacgcacataaggatggggtgtgtggcattcgatcgactactaggctagagaacgtcatgtggaaacaaatcactaatgaattgaactacgtcctatgggaaggcggtcatgatttaacagtggtcgcaggagatgtaaaaggtgtacttacgaaagggaaacgggctcttactcccccagtcagtgacttgaaatattcctggaaaacgtggggcaaagcaaaaatttttacaccagaagctcggaactcaacgtttttaatcgacggtccagacaccagtgaatgtcctaacgagcggagagcatggaacagcttagaagtagaggattatggatttggaatgtttacgacaaacatatggatgaaatttcgagagggatctagtgaggtttgtgatcataggctgatgagcgctgctataaaagaccaaaaagctgtacatgctgatatgggctattggattgaatctagcaagaaccaaacctggcaaattgagagagcatccttaatagaagtaaagacttgtctatggccaaaaacacatacactgtggtcaaatggagtgttagaatcacaaatgcttataccgaagtcctatgcagggcccttttcccaacacaactatcgtcaaggatatgcaactcagacagttggaccttggcacttgggaaaactcgagatagatttcggggagtgcccaggcaccactgtaactatacaggaagattgtgaccatcgaggaccttccttaaggacaacaacagcctcaggcaaactcgttactcagtggtgctgcagaagctgcacaatgccaccattacgattccttggagaagatgggtgttggtatggcatggaaataagacctttaagcgaaaaagaggaaaatatggtaaaatcacaagttactgcgggccagggaacaagcgaaactttctcaatgggcctactttgcttaacacttttcgtggaagaatgtctaaggagacgagtaactaggaaacatatgatattagccgtagtaattacactatgtgcgataatattgggaggtctgacttggatggacctcttaagagctctaattatgcttggcgacacgatgtccggaagaatcggtggacaaacacatctggcgataatggcagtatttaaaatgagcccaggatatgtcttgggtgtctttttaaggaagctcacctcgcgagagacagcattaatggttataggcatggcaatgacaaccacgctatcaataccccacgatttaatggaacttatcgatgggatctcgttaggtttaatattactaaaaattgtaacacaattcgataatacgcaagtaggaacgttggcattaagtctaacttttatacgaagtacgatgagcctcgttatggcatggcgtactattatggccgtgctgtttgttgtaacattaatcccattatgcagaacttcttgcctacaaaaacagtcacactgggtcgaaatcactgcacttattttgggcgctcaagctctgcccgtatacttaatgaccttaatgaaaggagctagtagaagaagctggccattaaacgaaggaataatggctgtgggcttagtatctttattaggttcggcattgttgaaaaacgacgtaccgctagccggtcctatggtagcagggggactcttactggccgcctacgttatgtcgggatcgtcggcagatctgtctctagaaaaagcagctaatgtacaatgggacgagatggcagatataacaggcagtagtccaataatagaagtaaagcaggatgaagacggatcattttctataagggatgtcgaggaaaccaacatgataacactgctagttaaattagcgctgattacagtcagtggattgtatcctctagcaatccctgtaacgatgacactgtggtatatgtggcaagttaagactcaacgctcaggtgccttatgggatgtcccatcgcccgctgcaacacaaaaggcggcactaagtgagggcgtttacagaatcatgcaaagaggattgttcggtaaaacgcaagtaggcgttggtatacatatggaaggggtgttccacactatgtggcatgttacgcgaggatcagtgatctgtcatgagacagggcgtttagagccaagttgggcggatgtgcggaacgacatgatttcgtatggtggcgggtggcgactgggagataaatgggacaaagaagaggatgtgcaagtccttgcgatagaacccggcaaaaaccccaaacatgttcaaacgaaaccaggactatttaaaacgttgactggtgaaataggagccgtaacattggattttaaaccaggaaccagcggttcaccgataataaacagaaaaggtaaagtaatagggctatacggaaatggtgtagtgaccaaaagtggagattatgtaagtgcaattacacaagcagaacgaattggtgagcccgattatgaagtagatgaggatatattcaggaagaaacgtctaactatcatggatctacatcctggtgcaggcaaaactaaaagaatactacctagcatagttcgagaggctttgaaacgccgtctacgaaccttgatactagcacctactagagtagtggcagcagaaatggaagaagcacttcgaggtctgccaattagataccaaaccccagccgttaaaagcgaacatacaggaagagagatagttgacctcatgtgccatgcaacttttacaacaagattgctcagtagcactagagtgcctaattataatcttattgttatggatgaagctcactttacagacccatcatcagtggcagccaggggttatattagcacaagagtggagatgggcgaagccgcagcgatatttatgaccgccactccaccaggagcgacggatccctttcctcaatccaatagtccgattgaagacatagagagagaaataccagaacggagctggaacactggatttgactggataaccgactaccaaggaaagacagtctggtttgtcccatcgataaaggctggaaatgatatcgcaaactgtttgcgcaaaagcggtaagaaagtaatacaattatcgaggaagacttttgatactgagtatccaaaaactaaactaactgactgggattttgtagtgaccactgatatctcagaaatgggggctaattttagagccggacgagttatcgacccaagaagatgtcttaagcctgtcatattaacagacggtccagagagggtaattctagccgggccaataccagtaaccccagcttcagctgcccaaagaagaggacggataggaaggaacccggcccaagaggacgatcaatatgtcttctcaggtgacccactcaaaaatgatgaggatcacgcccactggacagaagcaaaaatgctcctagacaacatctatacaccagaaggaataatacccaccttatttgggccggaacgggagaaaacacaagccatagacggggaatttagactaagaggggaacaaagaaaaacgtttgtagaactgatgcgaagaggtgacctaccggtatggcttagttataaagtcgcgagcgctggtatcagctataaagatcgagaatggtgttttacaggagaaagaaataaccaaattctggaagaaaatatggaggtagaaatatggacaagagaaggggagaagaagaaactacgcccacgttggctagatgctagggtatatgccgacccaatggcattaaaagactttaaagagtttgccagtggacgaaaatcaatcacattagatatactaactgaaattgcaagtttgcctacatatctttccagcagggcaaaattggctttggacaatatcgtgatgttacatacaactgaacgtggaggtagagcatatcaacatgcccttaacgagttgccagaatccctggaaacgctcatgttggtggcattactaggtgccatgacggccggcatattcttgttcttcatgcaaggcaaaggtataggaaaattaagtatgggactaattacaatagcggtagcaagtggattattgtgggtggcagagatccaaccgcaatggatagcagcaagcattatactagagttctttcttatggtactacttataccagaaccagaaaagcaacgtacgccccaggataaccaattaatatatgtcattttaaccattttaacaattataggactaatagcagccaacgaaatgggattaatcgagaaaacaaaaactgattttggattttaccaagtaaaaacggagacaacgatactggatgttgacttacgaccggctagtgcatggacactatacgccgtggctacgacaatattgactccaatgcttagacatacaatagaaaacacgagtgccaacctgagtctagcagcaatcgctaatcaagcagctgtattaatgggcttaggtaaaggatggccactacatagaatggatctaggggtccctctcttagctatgggatgctatagccaagttaatcccaccacacttacagcatcattagtaatgcttcttgtacattatgcgataatcggaccagggctacaagcgaaagcaacaagagaagctcaaaaacgcacagcagcaggcataatgaaaaacccaacggtcgatggcataacggtaattgatcttgaacctataagttacgacccaaaattcgaaaaacaactgggtcaagttatgcttctcgttttatgcgctggtcaacttctattaatgcgtacaacatgggccttctgtgaagtactgactttagcaaccggtcccatactcaccttatgggaagggaatcccggtcgtttttggaataccactattgccgtctcaacagcaaatatctttagaggtagttacttagcaggagcagggctggcctttagcttaataaagaatgctcagacaccaagaagaggcacgggtacaacaggagaaacactaggcgagaaatggaaaagacaattaaacagcttagatcgtaaagaatttgaggaatataaaagatcagggatactagaggtagacaggactgaagcgaaatctgctttaaaagatggctccaagattaaacacgccgtgtctagaggttccagcaaaatccgatggatagttgaacgaggaatggtcaaaccaaaaggcaaagtagtagatttggggtgtggtaggggaggttggtcctactatatggctactctgaagaacgtgacagaagtcaagggatacacgaaaggcggcccaggacatgaagaaccaataccaatggctacatatggatggaatctagtcaaactacacagcggagttgacgtcttttataaacccactgaacaggtggacactcttttatgcgacattggagagtcaagcagcaacccaactatagaagaagggcggacactaagggtattaaagatggtcgaaccatggctatcatctaaaccagagttctgtataaaagtccttaacccgtatatgccaacagtgatcgaagaactggaaaaacttcagcgaaaacacggaggaaatttggttagatgccccctctcaagaaattcaactcatgagatgtattgggtttctggagcgtctggaaatatagtaagttctgttaacacaactagcaaaatgttactaaaccgcttcaccactaggcatagaaaacctacttatgaaaaggacgttgacttaggtgctggtacacgaagtgtatctacagaaacagaaaaacctgacatgactatcataggcagaagattacaacgcctacaagaagaacataaggaaacatggcattatgaccaagaaaatccctatagaacatgggcctatcatggctcgtatgaggccccgtcaacgggatcagcttcaagtatggtcaatggagttgttaagttactcacgaaaccatgggatgtaattcccatggtaactcagctagcaatgaccgatactaccccatttgggcaacaacgagtatttaaagaaaaagtagatactcgaacacctcaaagtaaacccggaaccagaatggttatgacaactactgctaactggttatgggcattattagggaagaaaaagaatcccaggctatgtaccagagaagagtttatttccaaagtacggtccaacgctgctataggagccgtcttccaggaagaacagggatggacgagcgccagcgaggcagttaatgatagtcgtttttgggaattagtggacaaagaaagggcgttacaccaagaaggtaaatgtgaatcatgtgtttacaacatgatgggaaaacgtgagaagaaattgggagagttcgggagagcaaaaggttcccgagcaatctggtatatgtggttaggggctcgatttctagagttcgaggcacttggtttcttaaatgaggatcactggttcggacgcgagaatagttggtcaggtgttgaaggagaaggattacacagattaggatacattttagaggaaattgataagaaagacggggatttaatgtatgcggatgacacggcaggctgggacacgcgaattaccgaggatgatcttcaaaacgaagaacttataacagaacaaatggcgcctcatcacaaaatccttgctaaggccatatttaaattaacctaccaaaataaagtagtaaaagtactaaggccaaccccaagaggagctgtaatggacataatatcaaggaaagatcaaagaggatcagggcaagtagggacctacggattaaatactttcacaaatatggaggtacaattgataaggcagatggaggctgaaggcgtcataacgcaagatgatatgcagaacccgaagggtctaaaggaaagagtggaaaaatggttgcgggagtgcggtgtggatagactaaaaagaatggctatatcaggcgatgactgtgtggtgaaacctctagatgagcgcttcgctacctctttattattcctaaacgatatgggaaaagtaaggaaagacattcctcagtgggagccgtcgaaaggatggaaaaattggcaagaagtcccattttgtagtcaccatttccataaaatctttatgaaagatggaagatcacttgtggtaccttgccggaatcaagatgaactaataggacgagcaagaataagtcagggtgcaggttggagcttaagagagactgcttgccttggtaaagcatatgcacagatgtggtccctaatgtattttcaccggcgagatttaaggcttgcaagcatggctatatgctcggcagtacctactgaatggttccctacatcgagaacgacatggtcaatacatgcacatcaccaatggatgaccacagaagacatgttaaaagtgtggaatagagtatggatagaggataatcccaacatgatagacaaaacacctgtacacagctgggaagatattccgtacctaggcaagagagaagatctgtggtgtgggagtctgatcggattgtcatcaagagcaacatgggcgaaaaacattcatactgctatcactcaagttcgaaacctgataggtaaagaagaatacgttgattacatgccagtaatgaagcgatatagtgctccgagcgagaacgagggcgtcttatag

SEQ ID NO: 23638 - RNA, 9867 nt, synthetic construct
  misc_feature 1..9867: note = derived and/or modified CDS sequence (opt6) from DENV-4__FJ639764__SS-prME
  source 1..9867: mol_type = other RNA
tctacgataactctattatgtctgataccaacagtcatggctttccatctgtcaactagagatggagaaccactaatgatagttgcaaaacatgaaagaggacggcccttactctttaaaactacggaagggaccaacaaatgtactttgattgctatggatctgggagaaatgtgtgaagacacggttacatacaaatgccccctattagtaaatactgaacctgaagacattgactgctggtgcaatctcacgtcaacatgggttatgtatgggacatgtacacaaagcggagaacggagaagagaaaaacgtagtgtagctctaactccacatagtggaatgggattagaaacacgtgctgaaacatggatgagttcggaaggagcttggaaacacgcacaacgggtagaaagctggatactacgtaaccctggtttcgctttattggcaggatttatggcatacatgatcggacaaactggaatccaacgaaccgtatttttcgtcctgatgatgttagtagcaccatcctacggtatgcggtgcgtaggagttggcaatcgcgactttgttgaaggtgtatcaggtggagcttgggtggatttagtattagaacatggcggctgcgtcactactatggctcaaggaaaacccactctggatttcgaactcactaaaacaacagccaaagaagtagctctactacgcacttattgcattgaagctctaatatcaaatattacaactgccactagatgccccacgcaaggagaaccttatttaaaagaagaacaagaccagcagtatatatgccgacgtgatgttgtggaccgaggttggggtaatggctgcgggctgttcggcaaaggtggagtagtaacctgtgctaaattttcatgctccggtaaaattactggcaatttagtgcaaatcgaaaacctagaatacacggttgtggtaacggtacataacggagacacacatgcagtgggaaacgatacatccaatcatggtgtaactgcgaccattacaccccgatctccgagtgtggaggtcaaattgcctgattatggggaactaacgcttgattgtgaacccagaagcgggatagactttaatgaaatgatccttatgaaaatgaagaagaaaacgtggctagtacataaacaatggttccttgatctaccactaccatggacagccggtgctgacacaagtgaggtccattggaattataaagaaagaatggttacttttaaagtcccacacgctaaaagacaagacgttactgtattaggaagccaagaaggtgctatgcattcagccttggcaggagcgacagaagtcgactctggagatggaaaccatatgtttgcaggccatctaaaatgtaaagtgagaatggaaaaattgaggataaaaggcatgtcctatacgatgtgttctggcaaattcagtatcgacaaagaaatggcggagacacaacatgggaccactgtagtaaaagttaaatatgaaggagcaggggccccctgtaaagttccgatagaaataagagacgtcaataaagagaaggttgtagggagggtgattagttcaacacccctagcagagaacacaaattcagtaactaacattgagttggaacctccatttggcgactcgtatattgtaataggtgtaggtaatagtgcactaactttgcactggtttagaaaaggttcctctataggaaaaatgttcgaaagtacataccgcggggcaaaaaggatggcaattttgggcgaaactgcctgggactttggcagtgtcggaggtctatttacaagtctagggaaggcagtacaccaagtctttggaagtgtttatacaaccatgtttggtggcgtatcttggatgataagaattttaatagggttcttagttctatggattggaacaaatagcagaaacacaagtatggctatgacctgcatagcggtaggtggcataacactgttccttggatttacagtgcaggctgatatgggctgcgtggtatcatggtctggcagagaattaaaatgcggttcgggcatatttgtagtagataatgtacatacttggatagaacaatacaaattccaacccgaatcgcccgctagattagctagcgcgatacttaacgcacacaaagacggagtatgtggtataaggtcaacaactcggttagaaaacgtgatgtggaaacaaataacaaacgaactaaattatgttctatgggaaggtggtcacgacttaactgttgtggctggagacgtcaagggagttttgactaagggtaaaagaacattaacaccccctgtatctgacctaaaatattcttggaagacatggggcaaagcaaagatattcaccccagaggcacgtaattctacattcctaatagatggtccagacaccagcgaatgcccaaacgagagaagggcatggaactcgctagaagtggaggactatggattcggaatgtttacaacaaatatttggatgaagtttagagagggaagtagtgaagtatgtgaccaccgtctgatgtctgcggcaattaaagaccagaaagcagtgcatgctgatatgggttattggatagaatccagcaaaaatcaaacatggcaaattgaaagagcgtcgctaatcgaagtcaaaacctgtctatggcctaagacccatacattatggagcaacggagtccttgaaagccaaatgcttatacctaaatcgtacgcaggaccttttagtcagcataattatagacaaggatacgctacccaaacagttggaccttggcacttaggaaagttagaaatcgattttggggagtgccctggaacaacagtcacaatacaagaggactgcgatcaccgtggaccgtcgctacgaaccacaacagcgtctggcaagttagttacacaatggtgttgtaggagttgtacgatgccgccattaaggttccttggggaagacgggtgctggtacggaatggaaataaggcctctgtcggaaaaagaggagaatatggtaaagagtcaggtaacagcaggacaaggtacatcagaaaccttctccatgggtttactatgtctaactttattcgtggaagaatgtcttagacgacgggtcacacgtaaacatatgatactagcagtagtaattacattgtgcgccataatactgggaggactcacatggatggatctcctaagagcgcttattatgcttggcgatacaatgagtggccgaataggaggacaaacccatttagcaataatggcagtatttaaaatgtccccggggtatgtattgggtgtatttcttaggagattgacttctcgtgagacagcgctaatggtaattggaatggcaatgacaacaactttaagcatccctcacgatctcatggaattaatagatggaataagcctaggattaattttactgaagatcgttacacaattcgataatacccaggttggaactttagctttatcattaacatttattcgtagtactatgtccctggtcatggcgtggaggaccataatggctgtcctttttgtagtaacattaatacctctatgccgcacttcatgcttgcaaaaacaatcacattgggtagaaataacggcacttattctaggtgctcaagcattgccagtttatttaatgacattaatgaaaggagcgtcaagacgctcctggcctctaaacgaaggaattatggcggttgggctcgtaagcctcctaggtagcgccttactcaaaaatgacgtgcctctagccggcccaatggtggctggaggattattgttagctgcatatgtcatgagtggttcaagtgctgacttatcgctagaaaaagcagctaacgtacaatgggacgagatggctgatatcactggtagttcacctattattgaagttaagcaagatgaagatggaagtttctcgatcagagacgtcgaagaaacaaacatgataacgttactggtcaaactcgccctaataaccgtatctggattataccctttagcgatccctgtaacgatgactctatggtatatgtggcaagtaaaaacgcaacggagcggggctctatgggatgtaccaagccccgctgctacgcagaaagccgcattatcagaaggcgtttatcgaattatgcagagggggctgtttggcaaaactcaagtgggagtcggaatccacatggaaggggtgttccatactatgtggcacgttaccagaggatcagtgatctgtcatgaaactggtagactcgaaccaagctgggccgatgtgcgaaacgatatgatatcatacggaggtgggtggaggctgggtgacaaatgggacaaggaagaggacgttcaagttttggccgttgaacccggaaagaatccaaaacatgtacaaacgaaaccaggtctattcaagacgataactggggaaattggtgccgtaacactagacttcaaaccaggaacttccggatcaccaatcattaaccgcaagggaaaagttattggcctatacggaaatggtgtagttacgaagtcaggagactatgtttcagcaataactcaagctgaacgaataggggaaccagactatgaagtagatgaagacatatttaggaagaaacgattgactataatggatttgcatccgggcgcaggtaagactaaaagaatacttccatcaatagttcgtgaagcactaaaaagaaggttaaggactctaatactggcaccgacgagagttgtagcagctgaaatggaggaagcactacgtggcttacccatacgatatcaaacacccgcagtgaaatctgagcacacaggtagagaaattgtcgatttaatgtgtcacgcaacattcacaacacgattattgagttcaactcgtgttccaaattataacttaattgtcatggacgaagcgcactttactgatcccagtagtgtagcagcgagaggatatataagcactcgtgtcgaaatgggagaagcagcagcaatattcatgaccgctacaccacctggggctacagatccgtttcctcaatcgaatagcccaatagaagacatcgaaagagaaattccagaacggtcttggaatactggcttcgactggattacagactatcaaggaaagacagtttggtttgtaccaagtattaaagccggtaatgacatagcaaattgcctaaggaaatcaggcaagaaagtcatccagcttagtaggaaaacattcgacacagagtatccaaagacaaaactgacagattgggactttgtcgtaaccacagatatatctgaaatgggggcaaactttcgagctggacgagtaatagatcccagacgatgcctaaaaccagtaatattgaccgacggtcctgagcgagtaatactcgccggtcctataccagtgactccggcatcggcagcccagagacgaggaaggataggacgtaaccctgcacaagaagacgatcaatatgttttctctggagatccgttaaagaacgatgaagaccatgcacattggactgaggctaaaatgctattagacaatatctatacaccagaaggtataataccaacgttatttggacccgagagagagaaaacgcaagcaatagatggagaatttcgtttaagaggtgaacagagaaaaacatttgtagaactcatgcgacgaggtgatcttccagtctggttatcttacaaagttgccagtgcgggaataagctataaagatagagagtggtgctttacaggcgaaaggaataatcaaatacttgaagaaaacatggaagtagaaatttggactagggaaggagagaagaagaaattgcgaccaagatggcttgatgcaagagtatatgctgatcctatggctttaaaagatttcaaagagttcgcatccgggcgaaaatcgataacactagatattttaactgaaatagcttccttaccgacatatttgtccagtagggctaaattagcattagataacatcgttatgcttcacacgacggaacgcggcggtcgcgcttatcaacatgcccttaatgagctaccagaatccttggaaaccctcatgttagtagctctattaggggcaatgacagcaggaatattccttttcttcatgcaagggaaggggattggaaaattatctatgggattaatcactatcgctgtagctagcggcctgttgtgggtggcagagatccagccacaatggatagcagcctccataattttagagttcttcctcatggtattattaatccctgaaccagagaaacagaggacaccgcaagataatcaactaatctacgtgattcttactatattaaccataattggtctcatagcggcaaatgaaatgggccttatagaaaagacaaaaactgattttggattctatcaagtgaaaactgaaaccacgatattagatgttgatctgaggcctgccagcgcctggacattatacgctgttgcaactactatactgactccaatgctcaggcacacgatagaaaatacaagtgctaacctaagtcttgctgccatagctaaccaagctgcggtattgatgggactaggaaaaggctggccgcttcatcgcatggatctcggtgtacctctattagctatgggctgttattcccaagttaatccaacaactctcacagccagcttagtgatgctattagtacactatgctattatcgggcccggtttgcaagcgaaagcaacccgagaggctcagaagcgtacggctgctggcataatgaagaatccaacagtagatggtataactgtaatagatctcgaaccaatttcctacgatcccaaattcgagaagcaattaggacaagtaatgttactcgtcctctgtgcagggcagttgctacttatgagaacaacgtgggcattctgtgaagtacttactcttgcgactggacccattttaaccttatgggagggcaatccagggcgattctggaacacgacaatagcagtatctactgcaaacatatttagaggctcgtatttagcgggggcaggtctagcttttagtttgattaaaaatgcacaaacacctaggaggggtacgggtactaccggcgaaacactcggggaaaagtggaagagacaactaaatagtttagataggaaggagtttgaagaatataaacgaagcggtatactggaagtagatagaacggaagcaaaaagcgcactaaaggatggttcaaagataaagcatgcggtaagccgaggttcatctaaaataagatggatagtcgaaagaggcatggttaaacctaaagggaaagtagtggacttagggtgtggccgcggaggttggtcgtattacatggcgacattgaaaaacgtaacagaagtcaaggggtataccaaaggaggacctggccacgaagaacctattccgatggcaacatacggatggaatctagtcaaattacacagtggagtcgatgtgttttacaaaccaactgaacaggttgatacactgctttgcgacataggggaaagttcctcaaatccaacaattgaagaaggtagaaccctaagagtacttaaaatggttgagccgtggttatcatctaaaccggagttctgcatcaaagttttaaacccgtatatgcccactgtaatcgaagaacttgagaaacttcaaagaaaacatggtgggaatctagtacgatgtccattgtctcgcaattcaactcatgaaatgtattgggtgagtggggcatcagggaatatcgtgtcaagcgtaaacaccacaagtaaaatgcttttaaacaggttcacgactcgacaccgcaagcctacatatgagaaagatgtcgatttaggtgctggcacacgctccgtatcgacggaaactgaaaaacctgatatgacgataatcgggagacgacttcaaagactacaagaagaacataaagaaacttggcactacgaccaagaaaatccctacaggacatgggcatatcatggttcatacgaagcaccgtctacggggtctgccagttcgatggtaaacggggttgtaaagttactaaccaagccatgggatgttattccaatggtgacacaactggcgatgacagatactactccatttggccaacagcgggtatttaaagagaaagtggatactcgtacaccacaacctaagcctggaactagaatggtaatgacaaccacagcaaattggctctgggcattacttggcaagaagaaaaacccaagactgtgtacacgagaagaatttatatctaaagttagaagtaatgctgctataggagctgtttttcaagaggagcaaggttggacgtcagcatcagaagctgttaatgatagccgtttttgggaattagtagataaagaaagagcattacatcaagagggcaagtgtgaatcttgtgtttataacatgatgggcaaaagagaaaagaagctgggagaatttggaagggcaaagggatcgcgggcaatatggtatatgtggttaggagcccgatttcttgaatttgaagcgctagggttcttaaacgaagatcattggttcggtcgtgaaaattcatggagtggcgtagagggtgaaggacttcataggttaggctatatacttgaagaaattgacaaaaaggatggtgatttaatgtatgcagacgacactgcagggtgggacacgcgtattacagaagatgatttacaaaatgaagaactcattacagaacaaatggcccctcatcacaagatactagcgaaagcgatcttcaaactaacctaccaaaacaaagtagtaaaagtgttaaggccaacccccagaggcgcggtaatggatattatatcgcgcaaagatcaacgaggatctggtcaggtaggtacttacggattaaacaccttcaccaacatggaagtccaactcattcgccaaatggaagcagaaggagtaataacccaagatgatatgcaaaatcctaaaggtttaaaggaaagagtagaaaaatggctccgagaatgtggagtagatagacttaagcgtatggcaatttctggggacgattgtgtagtaaagccattagacgaacgattcggaaccagtctcttatttttaaacgatatgggaaaggtgcgtaaggatataccccaatgggaaccaagcaaaggatggaaaaattggcaggaggttccgttctgttctcaccacttccacaagatattcatgaaggatggacgaagtttagtagtgccatgtagaaatcaagacgaattaataggcagagcacgaataagccaaggggcaggatggagcctaagagagaccgcctgtttaggcaaggcttatgctcaaatgtggtcacttatgtacttccacagacgggacctacgtttagcaagtatggcaatatgttcagccgtgccaacagaatggttccctactagccgtactacttggagtatacatgcccatcaccaatggatgactacggaagatatgttaaaagtttggaatagagtgtggatagaggataatcccaatatgattgacaagacccctgtacattcatgggaggatataccatatttaggcaaaagagaagatttatggtgtggttctttaattggattaagtagtagagcgacttgggcgaaaaatattcacactgccattacacaagttaggaaccttatagggaaagaagagtacgttgattatatgcctgtgatgaaaaggtactctgcgccatcagaatcggagggagtactgtaa

SEQ ID NO: 23639 - RNA, 9867 nt, synthetic construct
  misc_feature 1..9867: note = derived and/or modified CDS sequence (opt6) from DENV-4__FJ639773__SS-prME
  source 1..9867: mol_type = other RNA
tcaacaataacccttttatgtcttattccaactgtgatggcgttccacttgtccaccagagacggggaaccactaatgatagtagcgaaacatgaaaggggtagacctcttctttttaaaacaaccgaaggtattaacaaatgcacattaatcgcaatggacttgggggaaatgtgtgaagacacggttacatataaatgtccgctattagttaatacagaacccgaagatatagactgctggtgtaatctgacttccacttgggtaatgtacggtacttgtacgcaatcgggggaacgacgacgcgagaaaagatctgtggcattaacacctcattctggaatgggactagaaacgagggcggaaacctggatgtcttcagaaggagcttggaaacacgcacaaagagtagaatcatggatcttaagaaacccaggattcgcgctacttgctggatttatggcatatatgataggacaaaccggcattcaaagaactgtatttttcgtgttaatgatgcttgtagctccttcttacgggatgcggtgtgtcggagtaggaaatagagatttcgtagaaggagtgagtggaggagcatgggtagatctagtgttggaacatggaggttgcgttactacgatggctcaaggaaaaccaacgttagatttcgaattaactaaaacaacagcgaaagaagtggctttgcttaggacatattgcattgaagcgctgatatcgaatataacaaccgccacacgttgcccaacccaaggcgaaccgtatctcaaagaagaacaagaccaacaatacatttgccgaagggacgttgttgatagaggttggggcaacggttgcgggcttttcggaaaaggcggcgtcgttacatgtgcaaaattctcgtgttcaggcaaaattaccggtaatttagttcagatagaaaatctagaatacactgtcgtcgtcacggttcacaatggtgatactcacgcagtgggtaatgatacttcgaatcatggtgtgacggcaaccattactccccggtccccttcagtagaagtaaaattgccagactatggagaactaacattggactgcgaaccaagatcaggaatagattttaacgaaatgatactaatgaaaatgaagaagaaaacgtggctggtacataaacagtggtttctagatcttcccctcccatggacaacaggagcagatacatcggaagtccattggaattacaaagagagaatggtcacttttaaagtaccacacgcaaaacggcaagatgttaccgtattgggtagtcaagaaggcgctatgcatagtgctctcgctggtgcgacggaagttgactctggtgacggtaatcacatgtttgccggacatttaaaatgcaaagttagaatggaaagattaaggataaaaggcatgtcctacactatgtgttcaggaaaattttctattgacaaagaaatggcagaaacacaacacggtaccacagtggtcaaggtaaaatatgaaggagccggggcaccatgtaaagtacctatagaaattcgcgatgtcaataaagaaaaagtcgtgggccgagtcataagtgcaactccactggcagaaaatactaattccgttaccaacatcgaactagaacctccattcggagatagttacatcgttatcggtgtaggaaattcagccttaactcttcattggttcagaaaaggatcaagtataggcaaaatgtttgaatcaacatatcgtggagcaaaacgaatggcaattttaggagaaacagcttgggatttcgggtcggtcgggggcttattcacaagccttggaaaagcggtacaccaagtttttggatccgtttataccactatgttcgggggagtaagttggatgatacgtatactcatcgggtttctggtcctgtggataggcacaaattctagaaatacgagtatggctatgacttgtatcgcagttggaggaatcactcttttcctcggctttaccgtacaagcagacatgggatgtgtggtttcatggtcaggtcgagagttaaaatgcggctcaggaatatttgtcgtagacaatgtgcacacttggacagaacaatacaaatttcagccagaaagccctgcaagactggctagtgcgatactcaatgcccacaaagacggagtatgtggtataaggagtaccacacgactagaaaacgtcatgtggaaacaaataacaaacgaattaaattatgtattgtgggaaggcggccacgatctaactgtcgtggctggagatgttaaaggcgtcctgacgaaaggaaaaagggcgttgacaccccctgcatccgacttaaaatattcgtggaaaacatggggtaaagcaaaaatatttaccccagaagcgagaaatagtacatttctaatagatggaccagacacatctgaatgccctaatgaacgacgtgcatggaactctttcgaagtggaagattatggtttcggtatgtttactacgaatatttggatgaaattcagggaaggatcctcagaagtctgcgatcaccgactaatgagcgccgctattaaagaccaaaaagcagtacatgcagacatgggctactggatcgaatctagcaaaaaccaaacatggcagatcgagagagcatccttgatcgaagtaaagacatgtctatggcctaaaacacacacattatggtccaatggtgttttagaatcccaaatgctaataccaaaaagctacgctggcccattcagccaacacaactatcgtcaaggatacgcgactcaaactgtcgggccatggcatttgggcaaattagaaatcgattttggtgaatgtcccggaaccaccgtcacaatacaagaggactgcgatcatcgaggtcctagccttagaactacaacagctagtggaaagctagtaacacaatggtgttgcagaagctgcactatgccacctctgagatttttaggcgaggatggatgctggtacggtatggaaattaggccactctcagaaaaagaggaaaatatggttaagtcccaggtaacagctgggcagggaacatcagaaacattctcaatgggtcttttatgtctaactttatttgttgaagaatgtctcaggagaagggtgacacggaagcacatgatcttggctgtcgtaattaccctctgtgcaataattcttggaggcctgacgtggatggatctcttgcgagctttgataatgcttggcgatacaatgagtgggaggatcggcggccagactcatctggcaataatggctgtgttcaaaatgtctccgggatacgtactaggagtgttcctccgaaaattaacaagtcgagaaacggcattaatggtaatcggaatggctatgacaacgacattatccataccgcatgaccttatggagttaattgatggtatatctttgggactaatccttctcaagatagtaactcaattcgataacactcaagtcggaactcttgccttatcccttacatttatacgatctacaatgagcttagtaatggcctggagaacaataatggcggtattatttgttgtaacacttatacctctctgtcgaacttcatgcttacagaagcaaagtcactgggtcgagatcactgcattaatactaggagcccaagcactgcctgtttacttaatgactttgatgaaaggtgcatcccgaagatcatggccactgaatgagggaataatggctgtaggcctagtgagcctacttggaagcgctctcttgaaaaatgacgtcccattagctggaccgatggtcgccggaggcttattactagcggcatatgtaatgagtggaagtagtgccgatctatctttagaaaaagctgcgaacgtgcagtgggatgaaatggccgatattaccgggtcttccccaatcatagaggtcaagcaagatgaggatgggagtttctcaataagggatgtcgaagaaacaaacatgataactctgctagtcaaactcgcactaataacagtaagcggtttatatcctttagcaatccctgttacaatgactctatggtacatgtggcaagtcaaaactcaaagaagcggtgctttatgggatgtcccgagcccagcaactactcaaaaagctgctctatcggagggtgtctatagaattatgcaacgcggcttgtttggaaaaacccaagttggagtaggtatccatatggaaggagtatttcacacaatgtggcatgtgacacgaggatcggtgatatgtcacgaaacaggaagactcgaaccatcgtgggcagatgtgcgaaatgatatgatttcatatggcggaggctggagactcggagataagtgggataaagaagaagatgtgcaagttttagcgatagaacctggcaaaaatccaaagcatgtgcaaactaaacccggcctgtttaagacactcacaggcgaaataggagccgtgactttagacttcaaacctggcacaagcggctcccctattatcaatcgtaaagggaaagtaattgggttatatggaaatggagtcgtaacaaaaagcggggactacgtttcggctattactcaagcagaaaggattggtgaacctgactatgaggttgacgaagatatatttaggaaaaagcgcttgactatcatggacctacacccaggggccggaaaaactaagagaatactccccagtattgtacgagaagcattaaaacgacgcctaaggactctaatcttagcgccgacaagagttgttgcggctgagatggaagaagcattaaggggtctaccaataagatatcagacccctgccgtaaaatcagaacatacagggcgtgaaatagtcgacttaatgtgtcacgctacatttacaactcgattgctatcttcgacaagagtcccaaactacaatttaatagttatggacgaagctcattttaccgacccatcctcggttgcagctcgcggttatatatcaaccagagttgaaatgggtgaagctgccgctatatttatgacggccacacctcctggtgccacagatccattcccgcagtctaacagccctatagaagacattgaaagagagattccagaaagaagttggaacacaggatttgattggataacagattatcaaggaaaaacagtatggttcgtcccatcaataaaagccggcaacgatatagcaaactgtttaagaaaatcaggcaagaaagtgattcaactaagtcgaaaaacttttgataccgaatatccaaaaacaaaactgactgactgggatttcgtagttactactgatatatcagaaatgggagcgaactttcgtgctggtagggtgattgatccacggcgctgccttaagcctgtaatactcactgatggaccagaaagagtaattctggctggtcctatacctgttactccagcaagtgcagctcagcgcagaggtagaataggcagaaatccagctcaagaagatgatcagtacgtgtttagtggggatcccttaaagaatgatgaagaccacgcgcattggactgaagcaaaaatgttactggataacatatatactcccgaaggcattatcccaactctatttggaccagaaagggagaaaacccaagccatagatggagagttcagactacgtggagaacagagaaagacgttcgtcgaattgatgcgaagaggagacttaccagtttggctctcatataaagtcgcaagcgcagggatatcatacaaagacagagaatggtgttttaccggcgaaagaaataatcaaatattggaagaaaacatggaggtagaaatttggactagagaaggcgagaagaagaaattgcgcccaaaatggttggatgctcgcgtgtatgctgacccaatggcactaaaagatttcaaagagttcgcttcaggcaggaagtctataacattagacattttaacagagatagcgagtctacccacatatctatcgagtcgtgctaaattagcactcgataacatagtgatgctccatacaacggagagaggaggccgcgcatatcaacatgctcttaatgagttacctgaatccttagaaaccttaatgttagttgctttattaggtgcaatgactgccggaatttttctcttcttcatgcaaggtaaagggattggaaagttgagtatggggcttataacaattgcggtagcttccggattgttatgggttgccgaaatacaaccacaatggatagctgcctcaatcatattagagttcttcctaatggtcttattgataccagaacctgagaaacagaggacacctcaagacaatcaactaatatatgtaatacttacaatattaactataattggcctaatagctgccaatgaaatgggcttaattgaaaagactaaaacggattttggtttttaccaagagaaaacagagacaacaatcctagatgtggatttgcgcccagcatccgcctggacgttatatgctgtcgcgactaccattcttacgccaatgctaagacatacaatagaaaacacatctgctaatctatccttagctgcgatagcgaatcaagcagcagtactgatgggactaggaaaaggatggccattgcataggatggatttaggagttccgttattagctatgggctgttactctcaagtaaacccaactactctaacagctagcttagttatgttattagtgcactatgcgatcataggaccaggattacaggcaaaagccactcgggaagcacagaaaaggactgcagcaggaataatgaaaaatcccactgtagatggtatcacggttattgatcttgaaccaataagctatgacccaaagttcgagaaacaactgggtcaagtgatgttattagttttatgtgccggacaacttctactgatgcgaacgacatgggcgttttgcgaggttttaactttggctaccggaccaatattaactttatgggagggcaacccaggacgtttctggaataccacaatcgctgtaagcacagcaaacatctttagaggctcatatctagctggagcaggtttagcattctcactaataaagaacgcgcaaacaccgaggagagggactggaacgacaggcgaaaccttgggggaaaagtggaaaagacaactaaattcactggatcgaaaagaatttgaggaatacaagcgcagtggaatattagaagtagatcggacagaagccaaatcggcattaaaagatgggtctaaaataaaacatgctgttagtcgcggaagctcgaagatcagatggatcgtagaacgtgggatggtaaaacccaagggaaaggtagtagacttaggatgtggtcgaggcggttggtcatactatatggcgactcttaaaaacgtaacagaagtaaaaggatataccaagggcggtcccggtcacgaagaacccatacctatggccacatacggatggaatttggtaaaactacattcaggcgtagatgtattctacaagccaacggaacaagtggacactttattatgtgacataggtgaaagctcctccaatccgactattgaagaagggaggacacttagagttctaaaaatggtggagccatggcttagctctaagcctgagttctgcattaaagtcttaaacccctatatgcccacggtgatagaagaacttgaaaaactacaacgtaaacatggcggtaatctagtacgatgtccattgtctcgtaattccacacatgagatgtactgggtttcaggcgcatctggcaatatcgtcagtagcgtaaatactacatcaaaaatgctattaaatcgcttcacgactcgacatagaaaaccaacctatgagaaggacgttgaccttggggccggtaccagaagtgtaagcacggagacggagaaaccggatatgacgattattggaagacgcttacaaaggttacaggaagaacataaagaaacttggcactatgaccaggagaatccatatcgcacatgggcatatcacggcagctatgaagcgccatctactggttcagcatcgtctatggtgaacggagttgtgaaacttttaacgaaaccatgggatgttatcccaatggtgacacaactcgctatgactgacacaacaccattcggacaacaacgagttttcaaagaaaaggtcgacactagaacaccacagccaaaaccgggaacccgcatggttatgactacgacagcaaattggttatgggcattacttggtaaaaagaaaaatcccagactctgcactagagaagagttcatatcaaaagtacgctcaaatgcggcaatcggagcagtttttcaagaagaacagggatggacaagtgcttcagaagctgtaaatgattcaagattttgggagcttgttgataaagaacgtgcacttcatcaagaaggtaaatgtgaatcatgcgtatataatatgatgggcaaacgggagaagaaactaggtgagttcggacgggctaaaggatcgcgcgccatctggtacatgtggttaggagcaagatttctagaatttgaagctcttggatttttaaacgaagatcattggttcggtcgtgaaaactcgtggtcaggtgtagaaggtgaagggcttcatagattaggatatatactagaagaaatcgataagaaagatggggacctaatgtatgctgacgacacagcaggttgggatacacgcattactgaagatgatctacaaaatgaggagctcatcacagaacaaatggcaccgcatcataaaatcttagctaaagcgatattcaaactgacttatcaaaacaaagttgtaaaagtactcagaccaactccgagaggggcagtgatggatataataagtagaaaagaccagagaggcagcgggcaagtggggacatatggtttgaacacatttaccaacatggaggtacagctgatcagacaaatggaagcggaaggagtaataacgcaagatgacatgcaaaatccgaaagggttaaaagaacgcgtagaaaaatggctccgagaatgtggtgtggatcgactcaaaagaatggcgatttcaggagatgactgcgtcgtaaagccccttgatgagaggttcggaacctcactgctatttttaaacgatatgggtaaagttcgcaaggacataccacagtgggaacccagcaagggatggaaaaattggcaagaagtacctttctgttcgcaccattttcataaaatattcatgaaggatggccgtagcttagtcgttccatgcagaaaccaggatgagcttatagggagagctcgaatatctcagggtgcaggatggtctctccgtgaaactgcatgtctaggaaaagcgtacgcacagatgtggtcattaatgtatttccatagacgagacttaagattggcatccatggcaatctgttccgcggtaccgaccgaatggttcccgacgagcaggacgacatggtctattcatgctcaccaccaatggatgacgacagaggatatgctaaaagtttggaatagagtttggattgaagacaacccaaatatgattgataaaacgccagttcactcctgggaggatatcccatatctcggaaaaagggaagacttatggtgcggatccctaattgggttgtcatcccgagcaacttgggccaaaaacatacataccgctataacacaagtccgaaacttgataggaaaagaagagtatgtagattacatgcctgtaatgaaaaggtattcagctccgagtgaatcagaaggtgttctctaa

SEQ ID NO: 23640 - RNA, 9867 nt, synthetic construct
  misc_feature 1..9867: note = derived and/or modified CDS sequence (opt6) from DENV-4__FJ882580__SS-prME
  source 1..9867: mol_type = other RNA
tcaacgataacacttttatgcttaatcccaactgtcatggcttttcacctatctaccagagacggagaacctttaatgatagttgcaaaacatgaaagagggcgtccacttttatttaaaacgacagaagggattaacaaatgtacactaattgcgatggatttaggagaaatgtgtgaagacactgtaacctataagtgccctctcttagtaaacactgaaccggaagatatcgattgctggtgcaatctaacgtcaacctgggttatgtatggtacatgtacccaaagtggtgaaaggcgccgagagaaaagatcagttgcattaactccgcactcaggaatgggacttgaaaccagggcggaaacgtggatgtcatcagaaggagcatggaaacatgctcaaagggttgaaagttggattctaagaaatccggggtttgcattactagctggctttatggcttacatgattggacagacgggcatacagagaacggttttcttcgtattgatgatgctagttgcaccctcttatggaatgaggtgtgtcggtgtcggaaaccgagatttcgtagaaggtgtatctggtggggcatgggttgatcttgtattagaacacggcggatgtgtgaccaccatggcccaagggaaacccacattagactttgagctgaccaagacaacggcgaaagaggtagcactacttcgaacgtattgtatagaagcgttaatatcaaacataacaacggctacccgctgcccaacccaaggagagccttatttgaaagaagaacaagatcaacaatatatatgtcgccgtgatgttgtagatagaggatgggggaacggttgtggcttgttcggcaaagggggagtggtaacatgcgcaaaattttcttgttcaggcaaaatcaccggtaatctcgtccagatcgaaaaccttgaatatacagtcgtagttacagtacataatggagatacgcatgcagtagggaacgatacgtcaaaccacggcgtaacagccacaatcacacctcgttcaccaagtgtggaagttaagttgcctgactatggggagctaaccctagactgtgaacccaggtcaggaatagacttcaacgaaatgatcctgatgaaaatgaagaagaagacttggttagttcataagcagtggttcctagatctaccactaccatggacaacgggagctgatacgtctgaagtacattggaactataaggaacgaatggtaacttttaaagtgcctcacgccaaaagacaggatgtaacagtcttaggaagccaagaaggggccatgcactctgccctagctggagcgacagaagtagattcaggcgatggaaatcacatgtttgcaggacacctgaaatgtaaagtccgtatggaaaaactaaggataaaaggaatgagctacaccatgtgcagtggtaagttttcaattgacaaggaaatggcagaaacccaacatggaacaacggtagtaaaagtaaagtatgaaggagcgggtgcaccgtgtaaagtgccaattgagatcagagacgttaataaagaaagagtagtgggacgggtaatatcagcaaccccactagcagaaaatacaaattcggtgacaaacatcgaattagagccacccttcggagacagttatattgtaattggcgttggaaattccgcactgaccttacactggtttagaaaaggaagcagtataggtaaaatgtttgaatcgacatatcgaggagcaaaacgaatggctatattaggtgaaactgcatgggactttggatcagtagggggactatttactagcttaggaaaagctgttcatcaagtttttggatcagtttacaccactatgtttgggggcgtctcttggatgataagaatactgataggatttttagtattgtggatcgggacaaattccagaaacacgtccatggcaatgacatgcattgcggtagggggaatcacgctatttttaggtttcaccgtacaagcggacatgggttgtgtggtgtcctggagtggtcgtgaactaaaatgcggctctgggatttttgttgtcgataacgtacatacctggacagaacaatacaaattccaaccggaatctccagcccgtttagcatcagcaatactcaacgcccataaagatggagtttgcggtatacgcagcacaactcgattggagaatgtaatgtggaagcaaattacaaacgagttaaactatgtgctgtgggaaggaggccacgatctaactatagtagctggagacgtcaaaggtgtattaacaaagggaaaaagagcattaaccccgccagcaagtgacttaaaatacagttggaagacttggggcaaagcaaagatcttcaccccggaagcgagaaactcgacatttctaatagatggtcccgatacaagtgaatgccctaacgaacgtagagcctggaactctttcgaggttgaagattatggattcgggatgtttacgaccaatatatggatgaaattccgtgagggcagttcagaagtatgtgaccatcggttgatgagcgcagcaataaaagatcagaaggctgttcatgctgacatgggatactggatcgaatcttcaaagaatcagacctggcagatagaacgggcaagtttaattgaagttaaaacttgcttatggcctaagacccacacattatggtcaaatggagttcttgagagccaaatgctaattccgaaatcatacgcaggtcctttcagtcagcataattacagacaaggctacgcgacgcaaactgtgggtccatggcatcttggtaaactagagattgatttcggggaatgtcccgggactacagtgacaatacaagagaattgtgaccacagaggaccgtcactccgtacaaccaccgcatcagggaagttagtcactcaatggtgttgcaggtcctgtacaatgccaccgttgcgttttctaggggaggatggatgttggtatggtatggaaattcggcccttatcagaaaaggaagaaaacatggtaaaaagtcaggttacggctggtcaaggaacttcagaaacattttcgatggggcttctctgcctcaccttgtttgtagaagaatgcctaagacgaagagttacaagaaaacatatgatcttagccgttgtaattactttgtgcgctatcatcttgggagggctcacttggatggatttacttcgagcccttattatgctcggtgacacaatgtccggaaggattggtggacaaacgcatttagcgataatggcagtatttaagatgagtcctggttatgtcctaggtgttttccttcgaaagttgacgtcaagggagactgcgttaatggtaataggaatggccatgaccactacattgtctatcccgcatgaccttatggaattaatagatggaatatcattagggctaatactactcaaaattgtgacacaatttgataacactcaggtcggaacattagcactatcgctaacattcataagatcaacaatgtcattagtcatggcctggcgaacaatcatggcagtactatttgttgttacattaatccctctctgcagaaccagttgtctacagaaacagtcacattgggttgagatcacagccctaattctaggagcacaagcacttcctgtctacttaatgacattaatgaaaggtgccagtagaagatcatggcctttaaatgaagggattatggcggtagggttagtaagtttattggggtcggccctcctgaaaaatgacgttccactagccggaccaatggtagctggtggtctactactagcagcatacgtaatgtctggttcatccgccgacttaagtttagagaaagcagcaaatgtacaatgggacgaaatggcggatattacaggctcctcaccgatcatagaagtcaaacaagatgaagatggctcattttccataagagatgttgaggagacaaatatgataacattgttagtcaaactagcgttgattacagtatcagggttatatccactggcaataccgataacaatgacgttgtggtacatgtggcaagtaaagacccagcggagtggagctttgtgggacgtgccaagtcccgcggcaactcaaaaagctgcattgtcagaaggtgtttaccgtattatgcaaagaggtctctttggtaaaacccaggtcggagtggggatacatatggaaggggtctttcatactatgtggcatgtgactagaggtagtgtaatctgtcacgagacaggtcgattagaaccgagttgggctgatgtaagaaatgacatgatcagctatggaggaggctggaggctaggcgataaatgggataaggaagaggacgttcaggtattagccattgaacccggtaagaatcccaaacacgttcaaactaagccgggattattcaagacattaacgggagaaataggagctgtgactctagactttaaaccgggtacatcaggaagcccaattataaataggaaaggaaaagtcataggactatatggtaacggtgttgtaacaaaatcaggggattacgtgtctgcaataacacaagccgaacgaatcggagagccagattacgaagtagatgaagatatattccggaaaaagagactaaccataatggatttacatcctggcgccgggaaaaccaagagaattttacctagtatagtcagagaggcactaaaaagaagactccggacattaatattggcccctacgagagtcgtagctgcagagatggaggaagcgttacgaggtttaccaataagatatcaaactcccgctgtaaaaagcgaacatactggcagagaaattgtagatcttatgtgccacgcaacatttacaacccgactcctaagttccactcgcgtcccaaactacaatctaattgtgatggacgaagcacatttcaccgacccctcaagtgtagctgcgaggggctatatttcaacccgagtggagatgggagaagccgcagctatattcatgacggcaacacccccaggtgctacagacccgtttccacaaagtaattctccaattgaagatatagaacgggaaattcccgaaagatcgtggaataccggtttcgattggatcacggattatcaagggaagacggtatggttcgttccgagcattaaagcgggtaacgatattgcgaattgtttaagaaaaagtggtaagaaggtaatccagctctcgcgcaaaacattcgataccgaatatccgaagactaaacttacggattgggatttcgtagtgacaactgatatatcggaaatgggagctaactttcgagctggaagagttatagatccgcgaagatgtctaaagcccgtcatcttaactgatggccccgaacgagtgatactagcaggccctataccagttacgcccgcatcggcggcacaacgaaggggtagaatagggagaaatcctgcacaagaagatgatcaatacgtcttttcgggggatccgctcaaaaatgacgaggaccacgctcattggacggaagcaaaaatgcttcttgacaacatttatacacctgaaggtattatacctacgttgtttggcccagaaagagagaaaactcaggctatcgacggtgaatttagactgagaggtgaacaaagaaagacgtttgtggaactaatgaggcgtggagatctaccggtctggttaagctacaaagtagcctcagcaggaataagctacaaagacagagagtggtgcttcacaggggaacgcaacaatcaaattcttgaagaaaatatggaagtggaaatctggactcgggaaggagagaagaagaaactacgaccaaaatggctagatgctagagtttatgcagatcctatggccttgaaagacttcaaagaatttgccagcggaagaaaaagtattacattggacatcctcacagaaatagctagtttgccgacgtatctatcatccagagcaaaactggcacttgataatattgtaatgttgcatacaacagaacggggaggcagagcttaccaacatgccttaaatgaactacccgaatctttagaaacattaatgctggtagctctattaggagccatgactgcgggcattttcttatttttcatgcagggaaaaggaattgggaaactgagcatggggctaataaccatagcagtcgcatctggtcttttatgggttgcagaaattcagcctcaatggattgcagcaagcataatacttgagttctttctcatggttctattaatacccgaacccgaaaaacaaagaacaccacaggataatcaattaatatacgttattttaactattctgaccataattggtcttatcgcggcaaacgagatggggcttatagagaaaactaaaacagatttcggattttaccaagtaaaaacggaaacaactatattggatgtcgacctacgtcccgcaagcgcttggacactgtatgcagtagccaccacaattctgacgccaatgctaagacacaccatagaaaacacttctgcaaatttaagcctcgcagccatagcaaaccaagcagcggtacttatgggattgggtaagggatggcctttacacagaatggatctaggcgttcctttacttgcgatgggctgctattctcaagtaaacccaacaacactaactgcttcattagtaatgctattagtgcattatgctatcatcgggccaggtcttcaagcaaaagctactcgagaagcacagaaaagaaccgccgctggaataatgaaaaacccaaccgtagacggcatcacagtcatagatctagagccaataagttatgatccaaagttcgagaaacaattaggtcaagtaatgctattagtcttgtgtgcaggacaactgttattaatgagaacgacatgggcattttgtgaggtattgacactagctacagggcctatattgactttgtgggaaggcaatcccggaagattctggaatacgaccatcgcagtcagtactgccaacatatttagaggctcgtatctagccggggccggtctcgcattctcattgattaaaaatgcccaaacaccaagacggggaactggtactacaggagaaactttaggcgaaaaatggaagagacaacttaattccctagatagaaaagaatttgaggaatataaacgaagtggtatattagaagttgataggacggaagctaagagtgcgctaaaggatggatcaaagatcaaacatgcagtctctagaggaagttccaaaatccgatggatagtagaaagagggatggttaaacccaagggtaaagtcgtagatctaggttgtggaagagggggctggtcttattatatggctacgcttaaaaatgtaacagaggtaaaaggatatacaaaaggtggaccaggtcatgaagaacctataccgatggcaacctatggatggaatctagtaaaactacattctggcgttgacgtattctacaaaccgacagaacaagtggataccttattatgtgacataggcgagtcatcaagtaacccaacaatagaagaaggtcgtacacttcgggttttaaaaatggtagagccatggttatcatcgaaacccgaattttgcataaaggtgttaaatccctatatgcctactgtgatagaagagttagaaaaacttcaacgtaagcatggtggcaacttagtacgatgccccctttcgcgtaacagtactcatgagatgtattgggtatctggagcaagtggcaatatcgtatcttcagtgaatactacttccaagatgttattaaatagatttactacaaggcataggaagccaacgtatgaaaaggatgttgatctaggggcaggaaccaggagcgtgagtacagagacagagaaaccagatatgactatcattggaagacgcctacagcgattacaagaagaacataaagaaacttggcattatgaccaagagaacccatatcgcacatgggcatatcacggttcttacgaggcaccctccactgggagtgcaagctctatggtaaatggtgtagtgaaattactaacgaaaccttgggacgtaattcctatggtaactcaattagcaatgacggatacaacaccatttggacagcagcgtgtctttaaagaaaaagtcgacacccgcacccctcaacctaaacctggcacaagaatggtaatgaccacaactgccaattggttgtgggccttattgggcaaaaagaaaaacccaagactctgcacaagggaagaatttatttcgaaagtcagaagcaatgcagcaattggtgccgttttccaagaagaacaagggtggacatccgcttccgaagccgtgaacgacagccgattctgggaactggtagacaaagaaagagcgttacaccaggaaggcaaatgtgaatcttgtgtatataacatgatgggcaaaagagaaaagaagctaggtgagtttgggagagctaaaggttcccgtgcaatttggtatatgtggctgggcgcgaggtttctggagtttgaggctttaggattccttaatgaagaccactggtttggaagagaaaattcgtggtcgggcgtagaaggagaaggactacatagacttgggtatatactggaagaaatcgataagaaagacggcgacctaatgtacgcagacgatacagcgggatgggatacaagaataacagaggatgaccttcaaaatgaggaactaatcacggaacagatggcacctcatcacaaaatcttggcaaaagccatctttaaattaacgtaccaaaacaaagtggtcaaggtattaagacctactccaagaggggcagttatggatatcatatcacggaaagatcaaaggggatccgggcaggtcgggacatacggactaaatacgtttactaatatggaagtacaattgatccgtcagatggaggccgaaggggtaataacacaagacgatatgcagaaccctaagggactaaaagaaagggttgagaagtggttacgtgaatgtggagtcgatcgccttaaaagaatggcaatatcaggtgacgactgtgtagtaaagccgctggatgaaagattcggtacatcattattattcttaaatgacatgggaaaagtgagaaaagacataccacaatgggaaccaagcaaaggatggaaaaattggcaagaggtaccgttttgttcacaccatttccacaagatttttatgaaagatggacggagtttagttgtaccgtgcagaaaccaagacgaattaattgggagggcgagaatatcacaaggcgccgggtggagtctacgggagacagcttgcttggggaaggcttatgcccagatgtggtcccttatgtattttcatagaagagacttacggttggcatccatggcaatatgcagcgccgttccaacggagtggtttccaacaagtcgcaccacatggtcaatacacgcacaccaccagtggatgaccacagaggacatgctaaaagtttggaaccgcgtttggatagaagacaaccccaacatgatagacaaaacacccgtccattcatgggaggatataccatacctaggtaaaagagaagatttatggtgtggttctctcataggtttgtccagtagagcgacatgggccaaaaatatacatactgctataactcaagtaagaaacctaataggaaaagaagaatatgtagattatatgcctgttatgaaacgttactctgccccttcagagtcggaaggagtactttaa

SEQ ID NO: 23641 - RNA, 9867 nt, synthetic construct
  misc_feature 1..9867: note = derived and/or modified CDS sequence (opt6) from DENV-4__FJ882581__SS-prME
  source 1..9867: mol_type = other RNA
agcacgattactttattatgccttataccaactgtgatggcgtttcatctctctacgagagatggagaaccacttatgatagtcgcgaaacatgagcgcggaagaccattactattcaaaactacagaaggaattaacaaatgcacattaatagcaatggatctaggagaaatgtgtgaagatactgttacatataaatgtccccttcttgttaatactgaaccggaagatatagattgttggtgtaacctgacaagtacgtgggttatgtacggaacctgtactcaaagtggggaaagaagacgagaaaaacgttcagttgccctgacgccgcattcaggtatggggctagaaactagagcagagacctggatgagtagcgaaggagcatggaaacatgcgcaacgagtcgaaagctggatacttcgaaaccctgggtttgcactattagccggattcatggcctacatgataggacagacggggattcaaaggacagtattctttgttttaatgatgttagttgcaccgtcgtacggtatgaggtgcgttggagtgggcaacagggactttgtagagggggtctcagggggcgcatgggttgatttggttttagagcatggtgggtgtgttacaacaatggcacaaggaaaaccgacattagacttcgaactaaccaaaaccactgccaaagaggtagcactgctaagaacctactgtatagaagcccttatctctaatatcacgactgctactcgttgtcccacccaaggcgaaccatatttaaaagaagaacaagaccaacaatatatatgtcgcagagatgtggtcgatagagggtgggggaacggatgcgggctttttggcaaaggtggggttgtaacatgcgcaaaattttcttgtagcggtaaaattacaggcaatttggtacaaatagaaaatctggaatatacagtagtcgttaccgttcacaatggtgatacgcatgctgtgggaaatgatacaagtaatcatggagttacagcgacaataaccccaagaagcccaagtgtcgaagtgaaattaccggattatggcgaattaaccctagattgcgaaccaagatccggaatagatttcaatgaaatgatattaatgaaaatgaagaagaaaacttggttagtccacaaacaatggttccttgatctaccactaccatggaccacaggtgctgatacaagcgaggttcattggaactataaagagcgaatggtcaccttcaaagtcccacatgcgaaaagacaagacgtgacagttcttggcagccaagagggcgcaatgcacagcgcgcttgcgggtgcgacagaggtggattccggggatggaaatcatatgtttgcaggacatcttaaatgtaaagtaagaatggaaaaacttcgaataaagggcatgtcatatacaatgtgtagtgggaaattttccattgacaaagaaatggcagaaacgcagcatggaacaaccgtggtcaaagttaagtacgaaggtgcaggcgcaccatgtaaagtacccatagagataagagatgtaaacaaggaaaaggtagtgggccgtgtaatttctgcaacacctttagcagaaaacacaaattcagtaacaaatatagaacttgagcctcctttcggagacagttatatagtaattggtgtaggcaattccgctctaactctccactggtttagaaaaggtagcagcattgggaaaatgtttgaatcaacgtatagaggcgctaagagaatggcaattctgggagagaccgcgtgggactttgggagcgttgggggcctttttacgtccttgggtaaggctgtgcaccaggtctttggcagcgtatatacaaccatgttcgggggagtaagttggatgatccgaatactaataggatttttagttctgtggatcggcaccaattccagaaacacgagtatggcaatgacatgtatagcggtaggtggaataacattattcctcggatttacagttcaagcggatatgggatgcgttgtttcatggaacgggagagaacttaaatgtgggtctggtatatttgtagtagataatgtacatacatggactgaacaatataagtttcaacccgagtcaccagctagactcgcttcggccatcctaaacgcacacaaagatggagtttgtgggataagatcgaccaccagactggaaaacgtaatgtggaaacaaataactaacgaactaaattatgtcttgtgggaaggaggtcatgatcttacagtagttgccggcgatgtgaaaggggtactcactaaaggtaaacgcgctttaactcctccagctagcgacttgaaatactcttggaagacatggggaaaagcaaaaatatttactcctgaggcgagaaattccactttcctcattgatggaccggataccagcgaatgccctaacgaaagacgagcctggaactcatttgaagtagaagattatggtttcggcatgtttacaacgaatatatggatgaaattcagggaaggtagctcagaagtttgcgaccatagacttatgagcgcggctattaaagaccaaaaagcggtgcatgccgatatgggttattggatagaatcttctaaaaaccaaacatggcaaatagagagagcgtcgctcatagaagtaaaaacttgcttatggcccaaaacacatacattatggtcgaacggagttctagaatcacaaatgcttatccccaagtcgtatgcggggccgttctctcaacataattaccgccaaggatatgcaacacaaactgttggaccttggcatttgggcaaattagaaatcgacttcggtgagtgccctggaaccaccgtaacaatacaagaaaactgtgatcaccggggaccatcgttaagaaccacgaccgcttcgggtaaactcgtaactcagtggtgttgtagatcttgtactatgcctccgctacgtttcctaggtgaggacggttgttggtacggtatggaaattcgacctcttagcgaaaaagaagaaaatatggtgaaaagccaggtaacggctggtcaaggaacttcagagacttttagtatgggcttgctttgcctaaccctttttgtggaagaatgtctaaggagaagagtaactaggaaacatatgattttggcagtcgtgatcactctatgtgcgattattctaggagggttaacatggatggatttacttagagctttaatcatgcttggcgatacgatgtccgggcgaattggtggacaaacgcatttagccattatggccgtctttaagatgtcccccggatatgttctgggggtattcctccgaaaacttacaagtagagagactgcgttgatggtcataggaatggcaatgacaacaacgttaagtataccacatgacctcatggaattaatcgatggcatcagccttggcttaatcttattgaaaatcgtaacgcaatttgataacacccaggttgggacactggcgttatctcttacgtttatacgtagcactatgtcgctagtaatggcctggcgcactatcatggcggtattatttgttgtgacactaatacccctgtgtcgaacaagttgcctacaaaaacaatcacattgggtggagataaccgcgcttatattaggggcacaagcacttccggtatatttaatgacattaatgaagggtgcctctaggagatcttggccgcttaacgaaggaataatggccgtcggcctcgtctcacttcttggctcagctctactaaagaatgacgtaccattagctggcccaatggtagccggaggactcttactagctgcatacgtaatgtcaggttcaagcgctgatctatcactcgagaaagccgcaaatgttcaatgggatgaaatggcagatattaccgggagctcaccaattatagaggttaaacaagatgaagacggatccttctctatacgcgatgtagaggagaccaatatgataactttactggtcaaactagccttaataacagtttctgggttatacccactagccataccgataacaatgactctctggtatatgtggcaagttaaaacccaaaggtccggagcattatgggacgtcccatctcccgcagccactcaaaaagcagctttatctgaaggcgtatatagaatcatgcaacgtggacttttcggtaaaacacaggtgggggtaggcatccatatggagggtgtattccacaccatgtggcatgtaacacgtggatccgtaatttgccatgaaacgggtcgtttggaaccctcatgggcggatgtgcgtaatgacatgatcagttacggtgggggatggcgactaggcgataaatgggataaagaagaagacgttcaagtattagccatagaaccagggaaaaacccaaaacacgtacaaacgaagccaggtttgtttaaaactcttaccggggaaataggggcagtaacactagactttaaacctggcacatcaggatcccctattataaaccgaaaaggtaaagtaattggtctttacggcaacggagtagtgaccaaatccggagattatgtaagtgcaataacccaggcagaacggataggagaaccggactatgaggttgatgaagatattttcagaaagaaaaggctaaccataatggatctccatccaggtgcaggcaaaaccaaaaggattttaccatccatagtaagagaagcacttaaaagacgcttaagaacgctaatattagcgcctactcgagttgttgcagcggaaatggaagaagcactacggggtttaccgatcaggtaccaaacacccgcagttaagtctgagcatacaggacgagaaatcgtagatctgatgtgccacgccacttttaccacccgcctgctaagttcaactcgagtaccgaactataacctgattgtcatggatgaagcgcactttaccgaccccagttcagtagcggctcgaggatacatctctacaagagtcgaaatgggggaagccgctgctatatttatgacagcgacaccaccaggtgctacagacccatttcctcaatcaaactctccgattgaagacatagaacgggaaataccagaacggtcatggaatacggggttcgactggataacagattaccaaggtaaaaccgtatggtttgtaccgagcataaaagctggaaacgatatcgccaattgtctacgcaaatcagggaagaaagtaatacagttaagtaggaaaacattcgatacagagtatccaaaaactaagttaacagactgggattttgtagtaacaactgacatttcagaaatgggggcgaatttccgcgctggaagagtaattgatcccagacgatgcctcaaacctgtaatcctgactgatggtccggaacgagtaatactggcgggaccaattcctgtgacccctgcttccgctgcgcaacgtagaggacgtatcggacgtaatttagcgcaagaagatgaccaatatgtattttcgggggatcccttaaagaacgatgaagaccacgcacattggactgaagcaaaaatgttactggataacatttatactccagagggaataataccaacattatttggaccggaaagagagaaaactcaagcaatagacggagaatttcgattaagaggggaacaacgcaaaacatttgtcgaattaatgaggcgtggcgatcttcctgtgtggttaagttacaaagtagcatctgccggaattagttacaaagatagggaatggtgttttacaggagaacgaaataaccaaattttagaggagaacatggaggtagagatctggacgagagagggtgaaaagaagaagctacggcctaaatggttagatgcacgggtatatgcggatccaatggcactaaaagatttcaaagaatttgctagcggccggaaaagtataaccctggacattctcactgaaatagcgtcgctcccaacctacctgtcgagcagggcaaaattggccttagataatatagtaatgttacacacaacggaacgcggcgggcgagcttatcaacatgcactaaatgagttaccggaatcactagaaacattaatgttagttgctctactaggtgccatgacagctggtatatttttgttcttcatgcagggtaaggggatagggaaactgtccatgggactcataacgatagctgtagcttccggattattgtgggtggccgagattcaacctcagtggatagctgctagcattattctagagttctttttaatggtgttgttaatacctgaaccggaaaagcaacgtacaccacaagataatcagttaatctatgtcatattgacaatattaacaattataggtctaattgcagcaaacgaaatggggctgattgaaaagactaaaacagattttgggttctatcaagtgaaaactgaaaccacaatattggacgttgatttacgtcccgcaagtgcttggacgctgtatgcagtagccactaccatattgacaccaatgctgagacacacaatagaaaatacttcggccaaccttagtttagccgcaattgcaaatcaagcggctgtcttaatgggcttgggtaaaggatggccactacatcggatggatttaggtgtaccactcctagctatgggctgttattcccaggtaaacccaacaactctaactgcatcactcgttatgctattggttcattacgctatcataggtcctggattgcaggcgaaagctactcgtgaggcacaaaagcgaacagccgcaggaataatgaaaaatccgactgttgatggtatcaccgttattgatcttgaacccattagttatgaccctaaattcgaaaagcagttaggacaagtaatgttattggtcctttgcgcaggacagctgctgttgatgagaacaacttgggcattttgtgaagtactgacactggcaacagggccgattctcacactatgggagggcaatccaggccggttctggaacacaacaatagccgtgtccaccgctaacattttcagaggtagctatttagcaggagctggactggcgttttcactaatcaaaaatgcacaaacccctagacgagggacaggaacaactggtgaaactctcggagagaaatggaaaaggcaactaaattcattagaccgaaaagaatttgaagaatataaacgtagcggaatcttagaagtggatagaaccgaggccaaatcagcacttaaagatggaagtaaaataaagcatgcagttagtagaggttctagtaaaatcagatggatagtcgaaaggggcatggtaaaaccaaaaggcaaagtagtggatttagggtgtgggcgtggtggttggtcttactatatggcaactcttaaaaatgtaactgaagtgaaaggctacacgaaaggtggtccggggcacgaagaaccaattcctatggcgacatatggttggaacctagtaaaattacacagcggcgtagatgtcttttacaagcctacggaacaggtcgacacgttgttatgcgacattggggaatcaagttctaatccaacgatagaggagggcagaaccttgcgagtgcttaagatggttgagccatggcttagtagtaagccagaattttgtattaaggtcttaaatccatatatgcccaccgtgatagaagaattagaaaaactgcaacgtaaacatggaggaaatctagtgaggtgcccactctcacgaaacagtacgcacgaaatgtattgggtaagtggagcgtccggaaatatagtttcaagcgtcaacaccactagcaaaatgttattaaacagatttacaacacgccatagaaagcccacatatgagaaggatgttgatcttggcgcaggaacaagaagtgtatcgacagagaccgaaaaaccagatatgactataatcggcagacggttacaacgactccaggaggaacacaaggaaacttggcattatgaccaagaaaatccataccgaacctgggcatatcatggttcgtatgaagcaccaagtacaggatctgcgagcagcatggtaaatggagtagttaaattactcacaaaaccatgggatgtaatacccatggtcactcaactagcaatgacagatactacgccattcggtcaacaaagggtattcaaagagaaagttgatacccgaacacctcaaccaaagccaggcactcgtatggtaatgacaaccacagcaaactggttatgggcacttttaggcaagaagaaaaatcctcgcttatgtactagagaagagttcatttcaaaggtcagaagtaatgcagcaattggagcagtcttccaagaagaacaaggatggacaagtgcctcagaagcggttaatgactcccgattctgggaacttgtggacaaggaacgtgcgttacatcaagaaggtaaatgcgagagctgcgtatacaatatgatggggaaaagagagaagaaacttggggagttcgggcgagccaaaggatcgagagcaatatggtatatgtggctaggagccagatttttagagtttgaagccctaggtttcttgaatgaggatcactggtttggaagagaaaattcttggtctggcgtagagggagaaggattacacaggcttgggtacattttggaagaaatagacaagaaagatggagacctaatgtatgccgatgatactgcgggatgggatacgcgtatcacggaagatgatctccaaaacgaagaattgataacagaacagatggcgcctcatcacaaaattctagccaaagcgatatttaaattaacctaccaaaataaagttgttaaagtcttacgacccacacccaggggagcggtgatggacataataagccgcaaagatcaaagaggatcaggtcaagtcggtacatacggtctaaatactttcaccaatatggaagtacagcttataagacagatggaggcggaaggggtcataacacaagatgacatgcagaatccaaaaggcttaaaagaaagggtcgagaaatggctaagggaatgtggagtggatcgactaaaaagaatggccatatcaggcgatgattgcgtcgtcaagccgttagatgaacgattcggaacctctcttctgtttttaaatgatatgggaaaagtccgtaaagatatccctcagtgggaaccctcaaaaggatggaaaaattggcaagaagtaccattttgtagtcatcacttccacaaaatatttatgaaagacgggagatcactcgtcgttccatgccgaaaccaagatgaacttatagggcgagctcgtatatcgcaaggcgcgggatggagcttaagagaaacggcctgtctcggaaaagcgtatgcacaaatgtggagccttatgtactttcacagaagagatctacgtctcgcctcaatggcgatttgtagtgccgtgcccacggaatggtttcccacatcaagaacaacttggagcatacacgcgcatcatcagtggatgacgactgaagatatgttaaaagtgtggaaccgtgtgtggattgaagacaacccaaatatgatagataaaacacctgtacactcatgggaagatataccatatttaggaaaaagggaggacttatggtgcggatcactgattggactgtcctctagagctacttgggcaaagaatatacacactgccatcacgcaggttcgaaatcttattggtaaagaagaatacgtagattacatgccagtcatgaaacgatattcagcaccgagcgaatcagagggcgtattgtaa

SEQ ID NO: 23642 - RNA, 9867 nt, synthetic construct
  misc_feature 1..9867: note = derived and/or modified CDS sequence (opt6) from DENV-4__FJ882582__SS-prME
  source 1..9867: mol_type = other RNA
tcgaccataactttattgtgcctaataccgactgtgatggcttttcatttaagcacacgggatggtgaaccactaatgatagttgcaaaacatgaaagaggacgaccactgcttttcaaaacaacagaaggaataaacaaatgtacacttatagctatggatctaggagaaatgtgtgaagacactgtcacatacaaatgtcccctactcgtcaacactgaaccggaagacatcgattgttggtgtaacttaacctcaacatgggtcatgtacggaacatgtacacaatcaggagaacgtagacgggaaaaacgttctgtagcattaaccccacatagtggaatgggattagaaacgagagcagaaacgtggatgtctagtgaaggagcttggaaacacgcgcaacgggtcgaaagttggatacttcgtaacccagggtttgccttactcgctggtttcatggcgtacatgattgggcaaacaggcattcaaagaacagtattcttcgtcttaatgatgcttgtagcgccaagttatgggatgaggtgtgtaggagttgggaaccgcgactttgtcgaaggggtatctggtggagcttgggtagatctagtacttgaacatggaggctgtgtaacaacgatggctcaaggaaaaccaacacttgacttcgaattaacgaaaacaaccgccaaagaagtcgccctattgcgaacatattgcattgaagcattaatatctaacataacaacggcaacccgctgtcctactcaaggtgaaccatatttaaaagaagaacaggaccaacaatatatctgtagaagggacgtggtagaccgaggttgggggaatgggtgtggtctattcggaaaaggtggtgttgtgacctgcgccaaattcagctgttcaggaaaaataactggaaacttggtccagatcgaaaacttagaatatacagttgtcgtgactgttcacaatggagacacccatgcagtaggcaatgacacatctaaccacggtgttacagcaacaattaccccacgaagtccatccgttgaagtaaaactaccagactacggagaattaacactagattgtgaaccaagatccgggattgactttaatgaaatgattcttatgaaaatgaagaagaaaacctggttagtacataaacagtggtttcttgatttaccacttccttggactacaggagccgatacaagtgaagttcactggaattacaaagaaaggatggttacattcaaagtcccacatgctaaacgacaagatgtaactgtattaggaagccaagaaggagcaatgcactctgctctagccggtgctacagaagttgacagcggcgatggaaaccatatgtttgcaggccatttaaaatgtaaagtgagaatggaaaaacttagaattaaaggtatgtcctacacaatgtgttcaggaaaattttcaattgataaagaaatggctgagactcagcacgggacgacagttgttaaagtaaagtatgaaggagcaggagctccatgcaaagtacctatcgaaatacgtgatgtcaataaagaaaaggtagtaggaagagtaatctctgcaacacccttagctgaaaacactaacagcgtaacaaacatagagctcgaaccgccatttggagattcatatatagtcattggtgttggaaactcggctttaaccctccactggtttagaaaaggttcctcgattggtaaaatgtttgaatcaacttacagaggagcgaaaagaatggccatactaggcgagacggcatgggactttggctctgtagggggattatttacatctctaggtaaggcagtgcaccaagtcttcgggtcagtatatacaaccatgttcggaggagtgtcatggatgattagaatacttattgggtttttagtactttggatcggcaccaatagtagaaatacatcaatggccatgacttgtattgcagtaggtggcattaccttgtttcttggatttacagttcaagctgacatggggtgtgtggttagctggaacggtagagaactgaaatgtgggagtggcatttttgttgttgacaacgtacatacatggaccgaacagtacaagttccaaccagaatccccggctagattagcgtccgcgatactaaacgcacataaggatggagtgtgcggcatccgatcgacaaccagacttgaaaatgtaatgtggaaacaaatcacaaacgagcttaactatgtgctatgggagggaggacacgatctaacagttgtcgcgggtgacgtcaaaggtgtacttacgaaaggcaaaagggccttaacacctcctgcttctgatctaaaatactcttggaagacctgggggaaagctaaaatcttcacgcccgaggctagaaactcaaccttcttaatagatggacctgatacatctgaatgtccgaatgaacgtagagcgtggaactcatttgaggttgaagattatggattcggcatgtttacaactaatatatggatgaaattccgggagggtagttcggaagtatgtgaccatcgcttaatgagtgctgctattaaagatcaaaaggctgtacatgccgacatggggtattggatagaaagctctaaaaaccaaacttggcaaattgaacgagcttctttaattgaagttaagacttgtctgtggccaaagacacacaccttatggtcaaacggagttctagaatctcaaatgctcataccgaaaagctacgctggtccattcagtcaacataattacagacaaggctatgctacgcagaccgttggaccatggcacttaggaaagctcgaaatagacttcggagaatgcccgggtacaaccgtaactatccaggaaaactgcgaccaccgagggccgtcattgaggactacaacagctagtggtaaacttgtaacacagtggtgttgcaggtcatgcacgatgccaccgttgaggtttctgggtgaggatggatgttggtatggcatggaaataaggccattaagcgaaaaggaggagaatatggttaagtcacaagtcacagcaggacaaggaacgtcggaaacgtttagcatgggtttgttgtgtctcacgttatttgttgaagaatgtctacgtcgtagagtaacaagaaaacacatgatattagccgtagttataactttatgcgcaattatattaggtggcctaacatggatggatttactaagagccctaattatgcttggcgataccatgagtggcaggattggcggccagacacatctcgctataatggcagtgtttaaaatgagtccaggttacgttttgggtgtttttctacggaaattaacgagtagggaaacagcgttaatggtgattggaatggcaatgacaacaacactatcaattcctcatgatctaatggaattaatagacggtataagtctaggattaattctcctaaaaatcgttacacaatttgacaatactcaagtagggacgctggctctgagtctaacttttataaggagcaccatgtcgttggtaatggcatggagaaccatcatggctgtcttatttgtagtaaccttaatacccttatgcagaacatcctgcctacaaaagcaaagtcactgggtagaaataacggcgttgatcttaggagcacaagccttaccggtgtatctgatgaccttaatgaaaggtgcttcgaggcgatcgtggccattgaatgagggtattatggctgtaggccttgtatccctactaggaagtgcccttttaaagaatgacgtaccactagcgggaccaatggtagcaggaggcttactgttagctgcatacgtgatgtcaggtagttcagcagatttgtccttagaaaaggcagctaatgttcagtgggatgaaatggcagacattacaggatcgtctccgataattgaagtaaagcaagatgaagacggatcattctctatcagggatgttgaagagacaaacatgattacactacttgttaagttagccttgataacagtatctggattatatcccttggcaatccctattacaatgacactatggtatatgtggcaggtaaaaacgcaaagatcaggggcactttgggatgtcccgtcaccagctgcgacgcagaaggcagccctttctgagggagtatatcgcataatgcaacgaggcttattcggaaaaacacaagtaggcgtcggcatccacatggaaggagtgtttcatactatgtggcacgtcaccagaggatccgttatttgccatgaaactgggagactagagccatcatgggcagatgttagaaatgatatgatctcatacggcggaggatggaggttaggtgataaatgggataaagaagaagacgttcaggttctcgccatagagcccggtaaaaatcctaaacatgtgcaaactaaacctgggctttttaaaacattgaccggagagatcggcgctgtgacacttgattttaagccagggacatcaggttccccaatcatcaatcgcaaaggcaaagtcataggcctttatgggaacggcgtggtgaccaaatctggggactacgtaagtgctatcacacaagcagaaaggattggagaaccagactatgaagtagatgaagatatattccgtaagaaacgtttaaccataatggatctacatccaggcgccggcaaaaccaaacgtatcctgcccagtatagttagagaagcgctcaaaagaaggctaagaacattgattttagcacccacgagagtagtagcagctgaaatggaagaagccctcagaggtttacctataagataccagacccccgcagtcaaatcggaacacacaggacgagagatagtggatctaatgtgtcacgctacattcaccacacgccttctaagcagtactcgagtcccaaattacaacctgatcgtaatggatgaagcacactttacagacccctccagcgttgcggctagagggtacataagtacacgcgtggaaatgggagaagcagccgcgatattcatgacagcaaccccacctggtgcaacagatccctttccacaaagtaatagtcctatagaagacatagaacgagaaattcccgaacgatcttggaacactggctttgactggataacagactaccaaggtaaaactgtatggtttgtaccatccattaaggcaggcaacgatattgcaaactgccttcgaaagtcgggtaagaaagtaatacaactctccagaaaaacatttgatacggagtatccgaaaacgaaattgactgattgggacttcgttgtcacaacggatatatctgaaatgggtgccaattttcgggcgggtcgagtaatagatccaagacgctgtctgaaacctgtaattcttactgatggtcctgaaagagtgatactggctggaccgataccggttacacccgcaagcgctgcccaacgacgtggtcgcataggtagaaatctcgctcaagaagatgatcagtatgtcttctctggcgatccactcaaaaatgacgaagatcatgctcattggacagaggctaaaatgttattagacaacatttacactccggaggggataataccaacattatttggtcccgaacgagaaaagactcaagcaatagacggggagtttagactacgaggcgaacaacgaaaaacatttgtagaactaatgagaagaggcgacctacctgtttggctatcctacaaggttgccagtgccggcatcagctataaagaccgagagtggtgttttacaggcgaaagaaataatcagattttagaagaaaatatggaagtagaaatttggacccgagaaggagagaagaagaaactaagaccaaaatggttggatgcaagggtctacgcagaccccatggcgttaaaggattttaaagagttcgcaagcggtcgcaagtcaatcacccttgatatattgaccgaaattgcatccctacctacatacctgagctctagagcaaaactcgcactagataacatagtaatgttgcacactaccgaaaggggaggacgcgcatatcagcatgcattaaacgaactaccagaaagtttggaaacattaatgttggttgccctgctcggcgcaatgacagccggtatattcttgttctttatgcaaggtaaagggattggaaaactcagtatgggtctgataacaattgccgtagcttccggtctattgtgggtggccgaaatacaacctcaatggatagcagcatcaattatcttagagtttttcttaatggtattactcattccagagcccgaaaaacaaagaactccgcaggataatcaattgatctacgttatcctaacaattttgacaataattggtctaatagcagcgaatgaaatgggtcttatcgaaaagactaaaaccgattttggcttctaccaagtaaaaacagagacgactattttggatgtggacctccgacctgcaagcgcttggacactgtatgcagtcgcaaccacaatattgacacccatgttacgacatacaatagaaaatacaagcgcgaatctgagtctagctgccattgcgaaccaagcggctgtgttaatgggattaggcaaaggttggccactgcaccgcatggatctaggagttccactacttgcgatggggtgctatagtcaagttaatccgacaacattaacggctagtcttgtaatgcttttggttcattacgcaattataggtcctggactgcaagcaaaagctacaagagaggctcagaagagaacagctgccggcattatgaaaaatcctaccgtcgatggaataaccgtgattgacttagagcccatcagctatgatccaaagtttgaaaaacaactcggccaagtaatgcttctggtcctatgtgcaggacaactactactgatgagaacaacatgggcgttttgcgaagttttgacattagcgacaggaccaattctaacattgtgggaaggaaatcctggaagattctggaatacaactattgcagtttctacagcgaatatattcaggggtagttatcttgcgggcgcgggactagcgtttagtctaattaagaatgctcaaactcctcgtcgaggtacgggtacgacaggtgagacgctgggcgaaaaatggaaacgacagcttaattcactagatcgtaaggagtttgaagaatataaaagaagcggaatattagaagtagataggactgaagcaaaatcagcactaaaagatggatcgaaaataaaacatgctgtaagtcgaggatcctcgaaaataagatggattgtggaacgaggtatggttaaacctaagggaaaagtagtagatcttggatgtggaagagggggttggtcatattacatggcaacgctgaagaacgtaacagaggtaaaaggttatactaaaggaggaccaggtcacgaagaacctatacctatggcaacatatggatggaatctagtaaagttacattctggtgtcgacgtattttacaaaccaacggagcaggtagatactttactatgtgatataggagaatcttcctcaaatcctaccatagaagaaggacgtacacttagagtcttgaagatggtagaaccttggctctcctctaaacccgaattttgcattaaagtcctaaacccgtacatgccaactgtcatagaagaattagagaaattacaaagaaaacatggagggaatttagtaagatgtccgctatcgaggaatagtactcatgaaatgtactgggtctccggggcttccggaaatatagtgtccagcgtgaatacaacctccaaaatgctgctgaaccgttttacgacacggcacaggaagccaacttacgaaaaagacgtagacttgggggccgggacacggtcggtctcgacagaaacagagaaacctgacatgactattataggaaggaggctgcaaaggcttcaagaggaacacaaagaaacatggcattacgatcaagaaaacccgtatagaacatgggcctatcatggaagctatgaagcaccttcgacgggatccgcaagctctatggtaaatggagtcgtaaagttattaacaaaaccatgggacgttatcccaatggttacgcagttagcaatgacagatacaacaccatttggccagcaaagagtttttaaggaaaaagtagacacgagaactcctcaaccaaaaccaggtacaagaatggttatgacaactacggcgaactggttatgggcattgttaggtaagaagaaaaatccccgattatgcaccagagaggaatttatcagtaaagtacgcagtaacgcagcgatcggggcggttttccaagaggaacaaggatggacaagcgcatcagaagcagtaaacgactcacgtttctgggaattagtagataaagaaagggcactgcatcaagaagggaagtgcgagagctgtgtgtataatatgatggggaagcgcgagaagaaattaggtgaatttggcagggctaaaggtagccgagctatatggtacatgtggttaggcgcaagatttttagagtttgaggctttaggctttttaaatgaggaccactggttcgggagagaaaattcgtggagcggagtagagggggaaggcttacacagattaggctacattttggaagaaatagataagaaagatggagatttgatgtatgccgacgataccgcaggttgggatacccgaatcactgaagatgacttacagaacgaggagctcattacagaacagatggctccccatcacaaaattcttgccaaagcaatctttaaattgacttatcaaaataaagtcgtgaaagtactaaggccaaccccacgcggagcggtaatggatataatatcaagaaaagaccaacgcggttccggtcaagttggcacgtacggattaaatacattcacaaacatggaggtacaactaatacgccaaatggaagcagaaggggtaataactcaagacgacatgcaaaatcctaaaggcttaaaagaaagagtagaaaaatggctacgcgaatgtggcgtagacagattaaaacgaatggcaatttccggagacgattgcgtagtgaaacctctagacgagagatttggaacatccttattatttctcaacgatatggggaaagtgcgaaaggatattccacaatgggagcctagtaaaggctggaagaactggcaagaagtcccgttttgctcacatcattttcataaaatctttatgaaggacggacgttcactcgttgttccatgcagaaaccaagatgagctaatcggcagagcacgaataagccagggggcggggtggtcattgagggagactgcgtgtttaggaaaggcttatgcacaaatgtggtccttaatgtatttccaccgacgggacctaaggttggcctccatggcaatctgttcggcagtaccaacggaatggtttccgacgtcaagaactacctggtcaattcatgcgcatcatcaatggatgacaacagaagatatgcttaaagtctggaatcgggtctggattgaagataatcccaatatgatcgacaaaacacctgtacactcctgggaagatattccatatttaggtaaaagagaagatttgtggtgcgggtcgttgataggtctttcatcccgggccacatgggctaaaaatatacacacagccattacacaagttagaaacctaattggaaaagaggaatacgccgattacatgccagttatgaaaagatacagtgctccaagtgaatcagagggagtgctctaa

SEQ ID NO: 23643 - RNA, 9867 nt, synthetic construct
  misc_feature 1..9867: note = derived and/or modified CDS sequence (opt6) from DENV-4__FJ882584__SS-prME
  source 1..9867: mol_type = other RNA
tcgaccataaccttgctatgtctaataccaactgttatggcatttcacttgagtacccgcgatggagaaccactaatgattgtagcgaaacatgaaagaggtaggccacttctattcaaaacaactgaaggaataaataaatgtacactaatagccatggatctaggtgaaatgtgtgaagatacagtaacctataaatgtccactattagtgaacaccgaaccagaagatatagactgctggtgcaacttaacttcgacatgggttatgtatggaacctgcacccaatcaggtgaacgaaggagagagaagaggtcagtagcattaacgccacattcaggaatgggtctagaaactcgagcggaaacgtggatgtctagtgaaggagcttggaaacacgcacaaagagtagaatcgtggatcctaagaaatccaggctttgcattgttggcagggtttatggcctacatgataggtcaaactggaatacagaggactgtattctttgtcctaatgatgctagtcgcaccgtcatatggaatgaggtgcgtaggagttggtaacagagattttgtggaaggtgtaagtggtggagcatgggtagacttagtattagagcacgggggttgtgttactacaatggcacagggaaagcctacgttagattttgaactgactaaaaccacggctaaggaagttgcattgttacgcacgtattgcatcgaagcgagcataagcaacataaccacggccacgagatgccccacacagggagaaccatatttaaaagaagaacaagaccagcaatacatttgcaggcgcgatgtggtagatcgggggtggggaaatggatgtggcctttttggaaaaggtggcgtggtcacatgcgccaagttttcatgcagcggtaaaattacggggaatctagtacaaatcgagaacttagaatataccgtggtagtaaccgttcataatggggacactcatgccgtgggcaatgatacttcaaatcatggagtaacagctaccataacacctaggtcaccgtctgttgaagttaaattacccgactatggagaactaacacttgactgtgaacctcgcagtggaatagacttcaatgaaatgattttgatgaaaatgaagaagaaaacatggttggtacacaaacagtggtttttagacttgcccctgccatggacgactggcgcagatacatcagaagttcattggaattataaggaacggatggtgacctttaaagtgccacatgcaaaacgccaagatgttacggtacttggtagtcaggaaggagcaatgcactctgctttagctggggccaccgaagtagattcgggagacggaaatcacatgttcgccgggcatctaaaatgtaaagtgaggatggaaaaactacgaataaaagggatgtcctacacgatgtgcagtggcaaattttccattgataaggaaatggctgaaactcagcatggtaccacagtggttaaagtaaagtatgaaggggctggtgcaccttgtaaagtccccattgaaataagagacgttaataaagaaaaggtagtaggtagggtaatctcagcaacccctttagcagaaaatacgaactcggtaaccaacatcgaactggaacccccatttggagatagttatatagtcattggtgtgggcaactcagctttgactttacattggtttaggaaaggcagcagtatcggtaaaatgtttgaatcaacatacagaggagctaaaagaatggcaatcctgggtgaaacagcttgggattttggttctgttggaggtttattcactagcctaggtaaagcggttcatcaagtgttcggatcagtctacaccacaatgttcgggggcgttagttggatgatccgtatcctaattggattcttggtactctggataggaactaactcacgaaacacaagcatggcaatgacctgcatagcagtcggaggtataacattatttctcggcttcacggtgcaagctgatatgggctgcgttgtatcttggtcaggaagagaattgaaatgtgggagtggtatatttgtagtagacaacgtacacacatggacggagcaatacaaatttcagcctgagagcccagcacgtttagcttctgcaatattaaacgcacataaagatggcgtatgcggcattcgtagcacaacacggttagaaaatgtaatgtggaaacaaatcaccaatgagctaaattatgtattgtgggaaggtggacacgatttaaccgtagtcgcaggcgatgtaaagggagttctgactaagggcaaaagggccttaacaccccctgcatccgatttaaaatactcatggaaaacctggggaaaagcaaagatatttacacccgaggcaagaaacagtacattcttaatagatgggccagatacgtcggaatgtccgaacgaacgacgagcatggaatagcttcgaagtcgaagattacggatttggaatgttcactacaaacatatggatgaaatttcgggaagggtcgtcagaagtctgtgaccatagactaatgagtgcagcgataaaagaccaaaaagcagtacacgctgatatgggatactggattgagagttctaagaaccaaacctggcagattgaaagagctagcctgattgaagttaaaacctgtctgtggccaaaaacgcatacattgtggagtaatggtgtgttagaaagccaaatgttaattccgaaatcatatgcaggaccatttagccaacacaattatcgccaaggatacgcgacacagaccgtcggtccatggcacttaggtaagttggaaattgacttcggagagtgcccaggaactactgtaacaatccaggaaaattgtgatcacagagggccatctttaagaactactacggcatccgggaagttggtgacacagtggtgttgtcgaagctgcacaatgcctcctctaagatttctcggtgaggatggatgttggtacggcatggagataagaccgctatctgagaaggaagaaaacatggtcaagtcgcaagttacagcagggcaagggaccagtgaaactttttcaatggggttactatgtttaacattgtttgttgaagaatgtttgcgacgccgggtaacgcgtaagcatatgatacttgccgttgttattaccttatgcgcaataatcctaggaggtttgacttggatggacctactaagagcgttgatcatgttgggcgatacaatgagcggaagaatcggaggtcaaacacacttagcgataatggcagtttttaaaatgtctcctggatatgtactaggggttttcctgaggaaactgacaagtagagaaactgccttaatggttataggaatggccatgacaaccacattaagcatccctcatgacctcatggaactgatcgacgggatttccttagggttgatattgctgaaaatagtcacacaattcgataatacacaagtaggcacgcttgcgctatcattaacatttataaggtccaccatgagcttagttatggcctggcgaacaataatggctgtgcttttcgtggttacgctcatccctctatgtagaacatcttgcttacagaaacaaagtcattgggtagaaattaccgctctgatcttaggggcacaagcactaccagtgtaccttatgactctaatgaaaggtgcgagcagacggagttggccattaaacgaggggataatggcagtgggtcttgtatccctattgggatctgccctcctaaagaacgatgtgccattagccggacctatggtggctggtggactgttgctagctgcttatgtaatgagcggcagcagtgccgatctcagccttgaaaaagccgcaaacgtccaatgggatgaaatggcggacataaccggatctagccctattatagaagtgaaacaagacgaagatggatcctttagtatacgtgacgtagaagaaacaaacatgataacgttgttggtaaaattagcattaataacggtctcaggactttatccacttgcaattcctataactatgaccctatggtacatgtggcaggtcaaaacacaaaggtctggagcattatgggatgtcccatctccggcagcaacgcaaaaagctgcgttatcagaaggcgtatacaggataatgcaacgaggactgtttggcaaaactcaagttggcgtaggaatacatatggaaggagtattccacactatgtggcatgtcacccgcggtagtgtaatctgtcatgagacaggtagactggaaccaagctgggctgacgtacgcaacgatatgatctcatacggaggtggatggaggttaggggacaaatgggataaggaagaagatgttcaggtgctcgctattgaaccaggcaaaaaccctaaacatgttcaaaccaagccaggactatttaaaaccctaacgggggaaataggcgcggtaactttagattttaaacctggaactagcggatcacctattatcaatagaaagggaaaagtaatcggactctatgggaacggagtagtcaccaagtccggagattatgtgtccgctataactcaagctgaaagaattggggaaccggactacgaggtagatgaggatatatttagaaagaaacgcttaactataatggatctacatcctggggcagggaaaaccaaacgtatactcccgtcaatagtcagagaggcgctaaagagacgacttagaactttaattcttgcaccaactagagtagtggccgctgaaatggaggaagcccttagaggactacctatccgctaccaaaccccagcagttaaaagcgaacacacagggagggaaattgtagatctcatgtgtcatgcaacattcacaacaagattgctctcatcgacacgagtacctaactataacttgatagtaatggatgaggcccattttaccgacccatcatctgtggcggcccgcggatatataagtacacgtgtagagatgggcgaggctgctgcaatcttcatgacagcaaccccgcctggagccacagacccgtttcctcaatctaactctccaatagaagacatagaaagggaaataccggaacggtcctggaacacgggatttgattggatcacagattatcaaggaaaaacagtttggtttgttccgtctatcaaagcagggaacgatattgcaaattgtcttcgaaaatcgggaaagaaagtgatccaattaagcagaaaaacattcgacaccgaatatcctaagactaaactaacagattgggatttcgtagttacaacagacatttccgaaatgggggcaaattttcgagcaggtagagttatagatcccagaagatgcctaaagcccgtaatcctgactgacggtcctgaaagggtaatactagcgggaccaataccagtcactcctgcctcggcagctcaaaggagaggcagaattggaaggaaccctgcgcaggaagatgaccagtatgtcttcagtggcgaccccctcaaaaacgacgaagaccatgcacattggacagaagccaaaatgttgttggacaatatatatactcctgaaggtataataccaacactatttggacctgagagggaaaagacgcaggcaattgacggtgagtttaggcttaggggagaacagagaaagacttttgtggaactaatgagacgcggcgacttgcccgtttggctttcctacaaggtcgcgtctgcagggatatcctacaaagacagagaatggtgttttacaggagaaagaaataaccaaatcttagaagaaaatatggaagtggagatttggactagggaaggcgaaaagaagaagctaagaccaaaatggttagatgcacgagtatacgcagatcccatggcgcttaaagacttcaaagagttcgctagcggacggaagtctattacactcgatattctaacagagatcgcctcactcccaacatatttatcatccagagctaaattagcattagacaacattgtcatgctccatactaccgagcgcggaggtagagcctatcaacatgccttaaacgaattaccagaaagtttagaaacacttatgctagtagctttacttggtgctatgacagcagggatattcctatttttcatgcaagggaaaggaataggcaagttatccatgggtttaatcactatagcggtcgcctcaggtttattgtgggttgctgagatacaacctcaatggattgctgcaagtataatattggagttcttccttatggtattgctaataccggaacccgaaaaacaaagaacaccccaggataatcagttaatatacgtaatactcaccatattaacaataatagggcttattgcggcgaacgagatgggactcatcgagaaaacgaaaacagattttggattttatcaggtcaagacagaaacaactatactcgacgtagatcttcgtccggcgagtgcatggacattgtacgctgtcgctactaccatactcacacccatgctaagacatacgatcgaaaatacctcggccaaccttagtctagcggccattgcgaaccaagccgcagttttgatggggcttggtaaaggatggcctctgcataggatggatcttggagtacctctactagctatggggtgttactcacaagtcaaccccacaacattaacagcaagtttagtgatgttactggtgcactatgcgataataggccctggattacaggcgaaggccaccagggaagcacagaaaaggactgctgcggggatcatgaaaaatcctacagtagatggtataacagtcattgatttggaacctatatcatatgacccaaagttcgagaaacagctaggacaagtgatgttgttagtactatgtgctggacagctcctactaatgcgaacgacatgggccttttgtgaggtactaacattagctactggaccaatactcactctctgggaaggaaacccaggaaggttttggaacactactatagctgtatctactgccaacatttttaggggcagttatttggcaggcgcaggcttggctttctccttaataaagaatgcccagactccacgacgaggcaccggtaccactggcgagacccttggcgaaaagtggaaacggcagctaaattcactagatcgtaaagagtttgaagaatacaagaggtccggtatactggaggtagatagaacagaggcaaaatcagctttgaaagatggttcaaagataaaacacgccgtctcaagaggttcctcaaaaattcgctggatagttgaacggggtatggtaaaacctaaaggaaaggttgtagacttaggatgtggtcgaggcggatggagctattatatggccacactaaagaatgttaccgaggtaaaagggtatacaaaagggggaccaggacacgaggagccaatccctatggcaacctacggatggaaccttgtaaaattgcacagcggtgtagatgtattttacaaaccgaccgaacaagtggatacactattatgcgacataggcgagtctagtagtaatcctacgattgaggaaggccgcactctcagggtattaaaaatggtagaaccatggttgtccagcaaaccagagttctgtatcaaagttttaaacccttatatgccaacagttatagaggagttagaaaaattgcaacgaaagcacggtggaaatctagtaagatgtcccttatcgcggaatagtacgcatgaaatgtattgggtgtcgggcgcaagtggaaacattgtctcatccgtgaatactacatcaaaaatgctcctgaatcggtttaccactcggcaccgtaagccaacgtacgagaaagacgtagacttgggagcaggaacccgatctgtaagtacagagacagaaaagccagacatgaccataataggaagacggctacaaaggctccaagaagaacataaggagacgtggcattatgaccaggaaaatccatatcgaacgtgggcatatcatggctcatatgaagctccttcaactggttctgcttcatccatggtaaatggagtagtaaaattgttaaccaagccttgggatgtgattcccatggtcacccaactagctatgaccgatacgacgccattcggtcaacaacgtgttttcaaagaaaaggtagacaccagaactccacaacctaagccaggaacaagaatggtaatgacgactaccgcaaattggctatgggcattacttggcaaaaagaagaacccccgactttgtacaagagaagaatttatatcaaaagtaagatcaaacgccgctataggtgccgtctttcaagaagaacaaggatggacaagtgcttctgaagccgtaaacgatagcagattttgggaactcgtcgacaaggaaagagcacttcatcaagaaggtaagtgtgagtcgtgtgtatataacatgatgggtaaaagagagaaaaagttaggagaatttgggagagccaaggggtcgcgagcaatttggtatatgtggttaggtgccaggtttttagagttcgaagcgctgggatttttaaatgaagatcactggtttgggcgcgagaacagttggagtggcgtagaaggagaaggattacaccgtctcgggtatatattagaagaaatagataaaaaggatggagatctaatgtatgcggatgatacagcagggtgggacaccaggataacagaagatgaccttcaaaacgaagaactaataaccgagcaaatggcaccacatcataagattttagctaaggcaatattcaagttgacgtatcagaacaaagtagtcaaagtattacgaccaactcccagaggggcggttatggatattataagtcggaaagatcaacgagggtcagggcaagtgggcacatacggtttaaacactttcacaaacatggaagttcaattaataagacaaatggaagcagaaggagtcataacccaagatgatatgcaaaatccaaagggcctaaaggaaagggtagagaaatggttgagagaatgtggggttgatcgtctaaagagaatggccatcagtggagatgactgcgttgtaaagcccttggacgaaagatttggaacgagccttttattcctcaatgacatgggtaaagttagaaaagatataccacaatgggaacctagcaagggttggaaaaactggcaagaagtaccattctgtagccaccacttccacaaaatctttatgaaagacggtagaagtttagtggttccgtgcaggaaccaagatgagctgataggtagagcacgaatatcccaaggggcgggatggtcattaagagaaacagcgtgcctgggaaaagcatatgcccaaatgtggagtctaatgtatttccacagaagagatttacgactagcgtcgatggcaatctgctcggcagtaccaactgagtggtttcctacgtctagaacaacatggtcgatacatgcacatcatcaatggatgacgacagaggatatgctcaaggtgtggaatagagtgtggatcgaagataaccctaatatgatagataagacaccagtacacagttgggaagacataccatacctggggaaaagggaggatttatggtgtggaagtttgataggactttcgagtcgcgcgacttgggcgaaaaacatacatacagcaataactcaagtacggaacttaataggtaaagaagagtacgtcgattacatgcccgttatgaagagatactctgcaccatcagaatccgaaggcgtgctatga

SEQ ID NO: 23644 - RNA, 9867 nt, synthetic construct
  misc_feature 1..9867: note = derived and/or modified CDS sequence (opt6) from DENV-4__FJ882585__SS-prME
  source 1..9867: mol_type = other RNA
agcactataacattattatgtttgatacctacagttatggcttttcacctttctactcgagatggagaaccgcttatgattgtagctaaacacgaaagaggcagacccctccttttcaaaactactgaaggaataaataaatgcacgcttatagcaatggacctaggtgaaatgtgtgaagatacggttacatataaatgtccacttttggttaacacagaaccagaagatattgattgctggtgcaacctaaccagtacgtgggtcatgtatggaacatgtacccaaagtggcgaaagaagaagagagaaaaggtctgttgcacttacaccacatagtggaatgggattggaaaccagagcggaaacttggatgtcatcagaaggtgcctggaagcacgcacaacgtgtggaatcttggattctgcgtaatcccggttttgcgttactagcagggttcatggcttacatgattggacaaaccggcatccagaggacggtattctttgtgctaatgatgcttgttgctccaagttacggaatgcgatgcgtcggagtgggtaaccgagacttcgtcgaaggtgtttctggaggagcctgggtagatttagtgttagaacatggaggatgtgtcaccactatggcccaaggaaagccgacactagactttgaactcacaaagactactgctaaagaagtggcgctccttagaacatattgtatagaagcactgattagcaacataactacagcaactcgttgtcctactcaaggagaaccatatcttaaagaagaacaagaccaacaatatatctgtcggcgtgatgtcgttgataggggttggggtaatggctgcggtctattcggcaaaggcggtgtggtcacttgtgcaaaatttagctgcagcggaaaaataaccggcaacttagttcaaatagaaaacttggaatacaccgtggtggttaccgttcataacggagatacacatgcagtgggaaatgacacctcaaaccatggagtaacggctacgatcacaccacggtccccaagtgtagaagtgaaacttcccgattatggcgagcttacgctagactgcgaaccacgttctgggatagacttcaacgagatgatactaatgaagatgaagaagaaaacttggctagtgcataaacagtggtttctagatctacctttaccttggacaacaggtgcagacacgagtgaggtacactggaactacaaagaacggatggtaacgtttaaagtcccacacgcaaaaagacaagatgtcacggtcttaggtagccaagaaggcgcaatgcattcagccttagcaggagcaacggaagtcgattccggcgacggaaatcatatgtttgcagggcatttaaagtgtaaagtaagaatggaaaagttaagaataaaagggatgtcttatacaatgtgttcaggtaaattttctatcgacaaagaaatggctgagactcaacacgggacgacagtcgtaaaagtaaaatatgaaggtgccggagctccttgcaaagttccaatcgaaataagagacgtaaacaaagaaaaagtagtgggaagagtaatatcagcaacacctttagctgaaaacactaattcagtaacaaatatagaattagaaccaccttttggcgattcatatattgttataggcgtcggcaacagtgcgctgacattacattggtttagaaaaggttcttcaatcggtaaaatgttcgaatcaacatatagaggagcgaaaagaatggcgattttaggggaaactgcatgggattttggatcggtcggaggcctgttcacaagtctagggaaagcagtccatcaagtgttcgggagtgtttatactactatgttcggaggtgtaagctggatgatacgtattttaatagggttcttagtattatggattggaaccaatagccgcaataccagtatggcaatgacatgtatagcagtcggagggataacattatttctgggtttcaccgttcaggcagacatgggctgtgtagtttcatggtccggtcgagaattgaaatgtggttcaggaatattcgtagtagataatgttcacacttggacagaacaatacaaattccaaccggaatctcctgcaaggttggcgtcagcgatattaaacgcacataaggatggagtgtgcggcatccgctcaacaacccgactggagaacgttatgtggaagcaaattacgaacgaacttaactacgtcctctgggagggaggacacgaccttactgtagttgccggcgatgtgaagggagtgttaacaaaagggaaacgagctttgacgccaccggcttctgacttaaagtacagctggaaaacgtggggtaaagccaaaatatttactcccgaggcaagaaattcaacatttctcatcgatgggcctgacacttcggaatgtccaaatgaaaggagagcctggaactcgttcgaagtagaggactatggattcggaatgttcacaacaaacatttggatgaagtttcgtgagggaagcagtgaagtatgtgaccaccgactcatgtcagcagctataaaagatcaaaaagctgtccatgcggatatgggctactggatagagagctcaaagaaccaaacctggcaaattgaacgcgcatcactcattgaagtcaagacatgtctctggccaaaaactcatactctatggagcaacggagtacttgaatcacaaatgctcatacctaaatcttatgcaggtccattttcacaacataattacagacaaggatacgccactcagacggttgggccgtggcatctgggaaaattagaaatagattttggtgagtgtcccgggacaacagtaacgatacaagaaaactgcgaccaccggggaccaagtttgagaaccacaacggcgtcggggaaattagtcactcaatggtgttgtcgctcatgcacaatgcctcctttgcgtttcttaggtgaagacggatgctggtacggtatggaaatcagaccgctttcagaaaaagaagaaaatatggttaaaagccaggtaacagcaggccaggggactagcgagacattctctatgggactgctttgcctcacattatttgtagaagaatgtctaagacgtagagtcacacgaaagcatatgatattggctgttgtgataacgttatgtgctacaatattgggaggtcttacctggatggatttgttgagggcattaataatgttaggagataccatgagtgggagaattggcgggcaaacgcacctcgccattatggccgttttcaaaatgagtcctggatatgttttaggtgtatttctaagaaaattaacctctagagagactgccttgatggtgataggtatggccatgacaacaactctgtcaataccacacgatttaatggaactaatagatggaataagcctaggactcattttactcaaaatagtaacccagtttgacaatacccaagtgggaacattggcattatccttaacctttattcgaagtacaatgtctttagtaatggcttggagaactatcatggccgttcttttcgtagtgacgttaataccgctgtgcagaaccagttgtctacaaaagcaatcccattgggtagaaataacagccttgatacttggcgcgcaagcccttccagtatacctaatgactctaatgaagggcgcatcacgaagaagctggcctctaaacgaaggaataatggctgttggccttgtttcattattgggttcagcgttattgaaaaacgatgttcctcttgctggaccaatggtagctggaggattactattagcagcctacgtaatgtcaggatcttctgcagacctcagtttggagaaagcagcgaatgttcaatgggatgagatggctgctattactggatcttcaccaataatagaagttaaacaagatgaagatggatctttctcgatacgggatgtagaggagacgaacatgataacattactcgtcaagttggcactgattactgtctctggactatatccattagctataccaatcactatgaccttatggtatatgtggcaagtgaagacacagcgcagtggcgcattgtgggatgttccttcaccagcagcgacgcaaaaagcagccttatcagaaggcgtatataggataatgcaaaggggactatttggtaaaactcaggtaggcgtgggaatacatatggaaggtgtctttcatacgatgtggcacgtaacaagagggtctgtaatatgccatgagaccggaagattggaaccgtcgtgggccgatgtgcggaacgatatgatatcatacggaggaggatggagactcggagataaatgggataaagaagaagatgttcaagttttggcgatagaacctgggaaaaatccaaaacacgtacaaacaaagccaggattatttaaaacgttgacaggagaaattggagcagtaacacttgacttcaaaccaggtacttccggaagtccaatcataaatcgaaaagggaaagttatagggttatacggcaatggagtcgtaacaaaaagtggagattatgtaagtgctatcactcaggctgaacgtattggagaaccagattatgaggttgatgaggatatttttaggaagaaaagactcacgataatggatctccatccaggagccggcaagacgaaaagaatacttcccagcatcgtgagagaagcgttaaaaagaagattgcggactctaattctagccccaacaagagtggtagctgctgagatggaagaggctttaaggggccttccgataagataccagactccagctgtaaaatcagaacatacagggagggaaatagtcgacctaatgtgtcatgctacttttactactaggttgctctcttccacgcgagtgcctaattataatctcattgttatggatgaagcacattttacggacccatcgtccgttgctgcacgtggttatatctcaaccagagtagaaatgggagaagcagcagcaatctttatgactgccacacctccaggggccactgatcccttcccacaatctaattcgccaatagaagacatagagcgagaaattccagaaaggtcttggaatacagggttcgactggataactgattatcaaggcaaaacggtttggtttgtgcctagtatcaaagcagggaatgatatagctaactgcttacgtaaaagtgggaaaaaggttattcaactcagtagaaaaacgtttgatactgaataccctaaaacaaaattaacagattgggattttgttgtgactacggacatatctgagatgggtgctaatttcagagctggaagggttatagatcccagacggtgtttgaaaccagtaatactcacagacgggcctgaacgagttattttagcaggtccaataccagttactccagcctcagcggcccagagacgaggaagaataggaagaaatccagcacaagaagatgatcagtatgttttcagcggtgacccccttaaaaatgatgaggatcacgcgcactggacggaggcaaaaatgcttttagacaacatatatactccagagggtataataccgacactatttgggccagaaagagagaaaacacaagcaattgacggcgaatttcgtttgagaggtgagcagaggaaaacatttgtagaattaatgaggcgaggagacttacctgtatggttatcgtataaagttgcttccgctggaatcagttacaaagacagggaatggtgcttcacaggagaaaggaacaatcaaatcctcgaagaaaacatggaggtagagatttggacaagagaaggagagaagaagaaactacgacctaaatggttagatgcaagagtctatgctgatccgatggcactcaaagattttaaagagttcgcgagtgggcggaaaagtacaaccctggacattctcacagaaatagcatctttacctacttacttgtcctcgagggcgaagttggcactggataatattgtcatgctgcacacaacggagagaggtggtcgcgcatatcaacatgcattaaacgaactaccagagagcttagaaacattaatgttggtcgcccttctaggagctatgacggcaggtatattcctattctttatgcaaggaaaaggtattggtaaactatcgatgggacttataacgatagccgtagcctcaggtttactatgggtggcagaaattcaaccgcaatggattgcagcgtcaattatacttgaatttttccttatggtattactaattccagaaccggaaaaacagagaacacctcaggataaccaattgatttacgtcatacttacaatactaacaattatcggtctcatcgcggcaaatgagatgggacttattgagaaaacaaagacagattttgggttctatcaagtaaagaccgaaactacaattttagacgttgacctaagaccggcctccgcttggacattatatgcagtagctactactattctaactccgatgttacgtcatacaatagaaaacacatcagcaaatctatcattagccgcaatagcaaatcaggcagctgttctaatgggactgggaaaaggatggccattgcacagaatggatttaggtgtacccctacttgccatgggttgctacagccaagttaatccaacaacacttacagctagccttgtcatgctattagtgcactacgccatcataggcccagggctacaggctaaagcaacgagagaagcacagaaaagaacagcagcagggataatgaagaaccctacagtagacggcataacggtaatcgacctagaacctatttcgtatgatcctaaattcgaaaaacaattgggtcaagtaatgctcttagtcctctgcgctgggcaattattattaatgcgcacaacgtgggccttttgtgaagtgctcacgcttgcgacagggcctatcctaactctgtgggaagggaatcctggaagattctggaacactacaattgcagtctcaacagcgaatattttcagaggttcctacctggcgggtgcgggattggcattctctttaattaaaaacgcacaaacaccgcgcaggggaacaggaactaccggagagacattaggagaaaaatggaaaagacaacttaactcactagaccggaaagagttcgaagaatataagagatcgggcattcttgaagtagatagaacagaagctaaaagtgcacttaaagacggatctaaaataaaacatgctgtaagtagaggttcgagcaaaatacgttggattgtcgaacgcggaatggttaaaccaaaaggtaaggtcgtagaccttggctgtggtagaggtggatggagttactatatggctacgttgaaaaatgtaacagaagtaaagggttatacaaagggaggtccaggacatgaggagccgataccgatggcaacttatggatggaatctagtcaaactacatagcggggtagatgtcttctacaaaccaactgaacaagttgatacattgctttgtgatatcggcgaatcttctagtaatcctacaatagaagagggtagaacacttcgagtattaaaaatggttgagccatggcttagcagtaagcctgagttttgcataaaagtcttgaacccatatatgcctacagttattgaagaactcgagaaactacaacgaaaacacggcggcaacttagtacgttgtccgctttcaagaaattcaactcacgaaatgtattgggtatcaggagcctccggcaatattgttagctcggttaacacgacatctaagatgctacttaatcggtttactaccagacaccgtaaaccgacgtatgagaaagatgttgatctaggcgcgggcaccagatcggtatcaactgagactgaaaaaccagatatgacgattatcgggcggagacttcaaagattgcaagaagaacataaagaaacttggcactatgatcaagaaaatccatatcgaacttgggcatatcatgggagctatgaagctccttccactggttctgcgtcatcaatggttaacggtgtagttaaattgctcacgaaaccttgggatgtaatccctatggttacacagctcgcgatgaccgacacaacaccattcgggcaacagcgcgtctttaaggaaaaggtcgacacccgaacgccccagcctaaaccaggaactcgaatggtcatgacgactacagcaaactggttatgggcattactgggaaagaagaaaaatccaagattatgcacaaaagaggagttcatctctaaagtacggtccaatgcagcaataggtgcggtatttcaggaagaacaaggttggacttccgcaagtgaagcagtaaatgactcacgtttttgggagttagtcgataaagagagggctttacatcaagaaggaaaatgcgaatcctgtgtatacaatatgatgggaaaaagagagaagaaactcggtgagttcggacgtgcaaaaggtagcagggcgatttggtacatgtggttaggagcgcgattcctggagttcgaagcgttaggatttttaaatgaggaccattggtttggtagagaaaatagctggtctggtgtggaaggagaaggattgcacaggttaggttatatactagaagagatcgataagaaagacggagacctcatgtacgcggacgacactgcaggctgggacacacgaataacagaggacgacctacaaaatgaagaactaatcactgaacagatggcgccacaccataaaatcttagcaaaagctatctttaaactaacttatcaaaacaaagtggtaaaagttctaagacccacgcctagaggtgcggtcatggacataatatctaggaaagaccaacgaggtagtggacaagtcggtacatacggattaaacacattcaccaatatggaagtgcaattaatccgccagatggaagctgaaggtgtcatcacacaagacgatatgcagaatccaaaaggactgaaagaaagagttgaaaaatggttgagagaatgtggtgtggatagattaaaacgaatggcaataagcggtgatgattgcgttgtaaaaccattggacgagcgctttggtaccagcctcctattccttaacgatatgggaaaagtacgcaaagacatccctcaatgggaaccttctaaagggtggaaaaactggcaagaagtaccgttttgctctcatcattttcataaaatattcatgaaagatggcaggtctttagtggtcccatgccgtaatcaagacgaactgatagggagagcacgtataagtcaaggagctggatggtctcttagagaaacagcatgtcttggtaaagcctacgcacaaatgtggtcacttatgtattttcaccgcagagatctaagattagccagtatggctatatgttcggcagttccaacagagtggttcccgacctcaagaaccacctggtctatccatgcccaccatcaatggatgactacggaagatatgcttaaagtttggaaccgagtatggattgaagataaccccaacatgactgacaaaactccagtacactcctgggaggatataccgtatttgggtaaaagagaagatctatggtgtggaagtctgattggtctgtcgtcgcgtgcaacttgggccaaaaatattcacactgccataacacaagtacgaaacttaataggaaaagaagaatatgtcgactatatgccagttatgaagcgctactcagcaccatcggaatctgaaggggtactatga

SEQ ID NO: 23645 - RNA, 9867 nt, synthetic construct
  misc_feature 1..9867: note = derived and/or modified CDS sequence (opt6) from DENV-4__FJ882586__SS-prME
  source 1..9867: mol_type = other RNA
tctactataaccctcctatgtcttatccctactgttatggcttttcacttatccacaagagacggtgaacctttaatgatagtggccaaacacgaaaggggcagaccccttttatttaaaaccacggaaggcataaataaatgcactcttatcgccatggacttaggcgaaatgtgtgaagacactgtgacgtataaatgtccactcctggtaaacaccgaaccggaagacattgattgctggtgcaacttgacatcaacctgggtaatgtatggcacatgcacacaatcaggagagcggcgaagagagaaaaggtccgtggcgctcacgcctcactcgggaatgggactagaaacaagagcggaaacgtggatgagcagtgagggagcttggaaacacgctcaacgagtagaatcatggattttgcggaatccaggatttgccctgctagctggatttatggcttatatgatcggtcaaacgggtatacagaggactgtattctttgttttaatgatgctagtagcgccctcatatggtatgagatgtgttggggttgggaatagagactttgttgagggcgtaagcgggggtgcgtgggttgacctcgtcctagaacacggtgggtgcgtcactaccatggcgcaaggcaaacccacactcgacttcgagcttacaaaaacaactgccaaagaagtcgcattgctgcgcacatactgtattgaagcacttatttcaaatataactacagctacgcgatgtccaacccagggtgagccgtacttaaaggaggaacaggaccaacaatacatctgcagaagggatgtagtggaccgaggttggggtaatggatgcggcctgttcggtaaaggaggggtagtgacgtgcgcgaagttttcctgttcaggaaaaatcactggtaacttagtgcaaatagagaatttagaatatacagttgttgtaacggtacataatggagatacacatgcagtaggaaatgacacaagtaatcatggagtcaccgcgacaataacgcccagatcaccctctgtggaagtaaagctccccgattatggagaactcacactagactgtgaacctagaagcgggatagatttcaacgaaatgatcctaatgaaaatgaagaagaaaacatggttagtacacaaacaatggttcttggatttaccgctaccctggacgactggtgcagatacgagtgaagttcactggaattacaaagagagaatggtaacatttaaagtccctcatgcaaagagacaagatgtgactgtacttggatcacaggaaggggcaatgcatagcgcactagctggagcaaccgaagtagatagtggtgacgggaatcacatgttcgcaggacacctcaaatgtaaggtaaggatggagaaattaagaatcaaaggaatgtcgtacacgatgtgttcagggaaatttagtatcgacaaggaaatggcggagactcaacacgggactacagtggtaaaagtgaaatatgaaggtgcaggcgcaccgtgtaaagtacccatagaaattcgtgacgtaaacaaagaaaaagtggtagggcgagtaatttctgcaactcccctggcagagaatactaacagtgtaacaaatatcgaactagagccaccctttggagatagctatatagtaataggtgtgggaaattccgccctaacgttgcactggtttagaaaaggaagctcaattggtaaaatgttcgaatcaacatataggggagcaaaaagaatggccattctaggagaaacggcctgggactttggatccgtgggtggactctttacctccctaggaaaggctgtccaccaagtcttcggtagtgtatacaccacaatgtttggaggcgtgtcttggatgatccgtatactaataggattccttgtgttatggattggaactaatagtcgtaacactagcatggcgatgacttgcatagctgtaggaggaattacattatttttgggatttactgtgcaagcagatatggggtgtgttgtatcctggtccggtcgtgaacttaagtgcgggagcggtatattcgtagtagacaatgtacacacatggaccgaacaatataaatttcaacctgaatctcctgctcgtttggcatcggcaatcttaaatgcacataaagatggggtatgtggaatcagatcaacaactcgattagaaaacgttatgtggaagcagataacaaatgaattaaattatgttttgtgggaaggagggcacgatttaactgttgtggcaggagatgttaaaggggtgctgaccaaaggcaaacgagcactgacgcctccggcatctgatctaaaatattcatggaaaacttggggaaaagcaaagatatttacacctgaagccagaaatagtacgttcctaatagatggaccagatacatcagagtgtccaaacgagagaagggcatggaactcattcgaagttgaagattatggatttggtatgtttacaactaacatatggatgaaatttagggaaggatccagcgaagtatgtgaccataggctaatgagtgcagcaattaaagaccaaaaggcagtgcacgcagacatgggttattggatagaaagtagcaaaaatcaaacttggcaaatagaaagagcatccttgattgaagtgaaaacatgtttatggccgaaaacacatactttgtggtcaaatggagtattagaaagtcagatgttaattcccaaatcgtatgccgggcccttttctcagcacaattaccggcaaggttacgcaacccaaacggtagggccatggcatctaggaaaactagaaatagactttggtgaatgtcctggaactactgttacaatacaagagaattgtgatcatagaggaccttcattacgtacaacgacggcgtctggaaaattggttacccaatggtgttgtaggtcttgcacgatgccacccttaagatttttaggagaagatggatgttggtacggtatggaaattagaccattaagtgaaaaagaagagaacatggtaaaatcgcaggtaacggcaggacaaggcacatctgaaaccttcagtatgggcctactttgtttaacattatttgtagaagaatgtttgcgacgccgagtaactaggaagcacatgatacttgccgtggtaataacgttatgtgcaataatattagggggtctaacctggatggatttactaagggctctcattatgttaggtgataccatgagcgggcggatagggggacagacccatttagcgataatggcggtgtttaaaatgtcccctggctacgtacttggtgtattcttaaggaaacttacctcacgtgaaacggctctgatggttataggtatggcaatgaccacgacattgtctataccacatgatttaatggaactcatagacggaatatcgttgggactcatactattgaaaatagtaacacaattcgacaatacacaagtaggtacactagccctttcactgacatttataagatcaacaatgtctttagtaatggcatggagaacgattatggcagtattatttgtggtaacgttaattccactctgtaggacctcgtgcctgcaaaaacaatcccattgggttgaaataacagcattaatattgggtgcacaggcgctaccagtatacctgatgacactcatgaagggggcttcacggagatcctggcccctcaatgagggcattatggcggttggcttagtcagtctattaggatcggcgctactcaagaacgatgtaccattagcgggcccaatggtcgcaggagggcttctgttagcagcctacgttatgtctggatcgtcggcagacctgagtctggagaaggcggcaaacgttcagtgggacgaaatggcggatattaccgggtcatcccccattatagaagtaaaacaagatgaggacggaagtttctcaattagagatgttgaagaaacaaatatgatcaccctgttagttaaacttgcgctcatcacagtttccggtctttatcccttggcaattcctataacgatgacgttgtggtacatgtggcaagtgaaaacacaaagaagcggcgcattatgggatgtaccgtctcctgcggcaacacagaaagcagcactgtcagaaggagtatataggatcatgcaaaggggtttatttggtaaaactcaggttggagtcggtatacacatggaaggagtgttccacactatgtggcatgtaaccagaggctccgtaatatgtcacgaaacaggtcgactcgaaccttcatgggctgatgtccgaaacgacatgatctcatatggaggaggatggcgattgggagataagtgggacaaagaagaagatgtacaggtgttagcgatagaaccaggaaagaatccaaagcatgttcaaacaaaaccaggattatttaagactttgacaggcgaaataggtgcggtaacattagatttcaaacccgggacatccggatcccctattataaatcgtaaaggtaaggttatagggttatatggaaacggagtcgttacgaaaagtggcgactatgtaagtgctattacacaagctgagcgaatcggagaaccagattatgaggtggatgaagatatattcagaaagaaaaggctaacaattatggatctacatcccggggccggcaaaacaaaaagaatattgccgagtatcgttagagaagcactcaaacgaagacttcgtacactaattctggctcccacccgggttgttgccgcagaaatggaggaggcattacgaggcctcccaattcgttaccaaacaccggcggtaaaatccgaacacaccggaagagaaatcgtagatttgatgtgccacgctacttttaccaccaggctattatcaagcacgagagtacccaactacaatttaatagtaatggatgaagcacattttaccgacccctccagcgtagcagcgaggggttatatttcaacccgagtggaaatgggggaggcagcagcgatatttatgacggcaacccctcccggagctactgatccatttccacaatcgaactcaccaattgaagatatagagagagagatacctgaacgttcttggaacaccggcttcgactggataaccgactatcaaggtaaaacggtgtggttcgtacccagcattaaagcaggtaatgacatagctaattgtcttcgtaagagtgggaagaaagtaatacaacttagccgaaaaacatttgacacggaatacccaaaaactaaactcacagactgggacttcgtggtaacaacagatatatcggaaatgggggcaaattttagagctgggcgagttatcgatccgagaagatgtctaaagcctgtaattttgactgacggtcccgaacgagtcatcttggcgggccccatccctgttaccccagcaagtgcagcccaaagaaggggacgaattggtcgaaaccccgctcaagaggacgatcaatacgtattttcaggagatcctctaaagaacgacgaggaccatgctcattggacagaagccaagatgttattggataacatctacacacctgaaggaataatcccgacactgttcgggcctgaaagagaaaagacacaagcaattgatggagagttcagactaagaggcgagcaaagaaaaacttttgttgaactaatgagaagaggcgatttaccagtttggttaagttacaaagtagcaagcgcgggaatcagttacaaagacagagagtggtgtttcacgggagagagaaataaccagattttagaggaaaacatggaagtcgaaatttggactagagaaggggaaaagaagaaactgagacccaaatggctagatgctcgagtttacgctgaccccatggcactaaaggactttaaagaatttgcctcaggacgcaaatctattacccttgatatactcacagaaatcgcgtccctaccgacatatctttcgtccagagcgaaattggctctagacaatatagtaatgctacacacaactgaacgtggagggcgagcttaccaacatgcattgaatgagctacctgaaagtctagaaacactaatgttagtagcgttactcggtgccatgactgcaggaatttttctgtttttcatgcagggcaaaggaattggaaaattgtcgatgggactgataaccatagcagtagcgagcggcttactatgggtcgcagaaatccaaccacagtggatagctgcgtcgataattctggagttctttctaatggtactactaattccggaacccgaaaaacaaaggacgccgcaagataatcaattaatctatgtcatattaacgatcctaacaataatcgggttgatagcggctaatgagatgggactaatagaaaagacaaagaccgattttggcttttaccaagtcaaaacggaaacaacaatcctggatgtagacttaagaccagcgagcgcttggacactttatgctgtagctacaaccatactaacacccatgttacggcatactattgaaaacacaagtgctaacctaagtctagcagccatagcaaaccaggcagcagttctgatgggacttggcaaagggtggcctttgcatcgaatggatttgggagtgccattgctagcaatgggatgttatagtcaagtaaacccaactacactaacagccagcttagtcatgctattagtacattatgcaataataggtccaggtttacaagctaaagctacgagggaagctcaaaaacgtacagccgcaggcataatgaaaaatccaactgtagacggcatcacggttatagacttagagccaatatcatatgaccctaaatttgaaaaacagttaggacaagtgatgttacttgtgctttgtgcaggacagctcttattaatgagaacaacctgggcattttgtgaagtcttaacactagctacgggccctatccttactctatgggaaggtaatcctggtcgtttttggaacacaacaatagcggtgtcaacggcaaatatatttagaggaagttatttagcgggagcaggtctagcattctctttaattaaaaatgcccaaacccctcgaagaggaacgggcacgactggtgaaaccctaggagagaaatggaaacgacaactaaattcactagacagaaaagaatttgaagagtacaagcgttcagggattctcgaagtagatcgtactgaagctaaatcagcacttaaagatggtagtaagatcaaacacgcagtctctcgcggctcgtcaaaaatcaggtggattgtagaaagaggaatggtaaagcccaagggaaaggtggtcgacttaggatgtggaagaggaggatggtcatattacatggctacgttgaagaacgtgactgaggtaaaaggttacaccaaaggtggaccaggacatgaagaacccatacccatggcaacatatgggtggaatttagtgaaactacatagtggagttgatgtattctataaacctacagaacaggtagatacattactatgtgatattggagaatcctcttccaacccaactatagaagagggtaggactctcagggttttgaaaatggtcgaaccatggctgtcttccaaaccggaattttgtatcaaagttctcaatccctatatgccaacagtaatagaagaactggaaaaattacagagaaagcatggaggcaacttggttagatgcccgctttcaaggaacagtacacacgaaatgtactgggtttccggagcttcaggaaacattgtatcatcagtaaacaccacatctaaaatgcttttaaatcgttttacaacgagacacagaaaacctacgtatgaaaaagacgttgatttgggagcagggactcgttcagtttcaacagagactgagaaaccagatatgacaataattggaagaagactgcaaagattgcaagaggaacacaaggaaacatggcattacgatcaagaaaatccctatcgtacgtgggcataccatggatcttacgaagcaccctcgacaggatcagcctcttcaatggttaatggggtagtaaaattactgaccaagccatgggacgtcataccaatggtaacgcaactagccatgaccgatactacaccctttggccaacaacgcgtatttaaagaaaaagtcgatactcgcactccccaaccaaagccaggcacaagaatggtaatgacaaccaccgctaactggctatgggctctactaggaaagaagaaaaatccaagactatgcacccgagaggagttcatctcaaaggtaagaagtaatgcagcgataggcgcggtattccaggaagaacaaggatggacaagcgcttctgaggcggtaaatgattcacgtttttgggaattagtggataaagaaagagcactgcaccaagagggcaaatgtgaatcttgcgtctataatatgatgggaaaacgagaaaagaaattgggtgaatttggccgtgcaaaggggtccagagctatctggtacatgtggttaggcgctagatttttagaatttgaagcactaggctttttaaacgaagaccattggtttggcagggaaaattcttggtctggagttgaaggcgaaggactacatagactaggttacattcttgaagagatcgacaagaaggatggtgacctaatgtatgctgatgatactgcaggatgggacacaagaattacggaagacgatctccaaaacgaagaactaattacagaacaaatggcaccccaccataaaatattagctaaagcaatttttaaactaacgtatcaaaacaaagtagttaaagttctgcgtccaacaccacggggtgctgtaatggatataattagtagaaaagatcaacgcggttctggtcaggtaggaacttatgggttaaatacgtttaccaatatggaagtacaacttataaggcaaatggaagcagaaggagtgattactcaagatgacatgcaaaacccaaaagggttaaaagaaagagttgaaaaatggcttcgggagtgcggcgtagacagacttaagcgcatggctataagcggagacgattgcgttgtgaaaccgctagacgaacggttcggaacatccctgctgtttttaaatgacatgggaaaggtaagaaaagacataccacaatgggaaccatcaaagggatggaagaattggcaagaagtacctttctgtagtcatcatttccataaaatattcatgaaagatgggcgctccttggtagtaccatgccgaaatcaagacgaacttataggtagggcaaggatcagtcaaggagcgggatggtcgttaagagagacagcgtgcttaggtaaagcgtacgcacaaatgtggtcactcatgtattttcacagaagagacctcagattagcgtcaatggcgatatgctccgctgtccctacggagtggttccctacgagtcggacgacgtggtcaatacatgcgcatcaccaatggatgaccacggaagatatgttaaaagtttggaacagggtttggattgaggacaatccaaatatgatagataaaacaccagtgcatagctgggaggacattccgtatttgggaaaaagagaagatctctggtgcgggtcactgattggtttaagctcaagagcgacatgggctaagaatatacacacagctatcgctcaagttcgaaacctaattggtaaggaggaatacgtggattatatgccggtcatgaagaggtactcagcaccttcagagtccgaaggtgtattataa

SEQ ID NO: 23646 - RNA, 9867 nt, synthetic construct
  misc_feature 1..9867: note = derived and/or modified CDS sequence (opt6) from DENV-4__JN819406__SS-prME
  source 1..9867: mol_type = other RNA
agtactataactttactgtgcttaattcccacagtaatggctttccacttatcgactcgagacggagagcccttaatgatagttgcaaaacatgaacgcggacggcccttattatttaaaacgaccgaaggaataaataaatgcacactcattgcaatggacctcggagaaatgtgtgaagataccgttacctacaagtgcccactattagtaaatacagaaccggaagacattgactgttggtgtaatctaacatctacctgggttatgtatggaacatgtactcaatcgggggaacgacgtcgtgaaaagagatcagtagctctaaccccacatagcgggatgggattagaaacacgagctgaaacctggatgtcttcggaaggtgcatggaaacatgcacagcgggtggaatcctggatcttaagaaatcctggttttgcattacttgccggttttatggcttatatgattggacaaactggtatacaacgcactgtattctttgtattaatgatgttagttgcaccatcgtatggaatgcgttgtgtaggtgtaggaaacagagactttgtagaaggcgtttctggtggagcatgggtggaccttgtcctagaacacggaggatgtgtaaccaccatggctcaaggaaagccgactctagatttcgaactaactaaaactactgctaaggaagtcgccttattacggacctactgcatagaagcgctaataagtaacataactacagcaactagatgcccaactcaaggagaaccttaccttaaagaggaacaggaccagcaatacatctgcaggagagatgtagtagatagaggttgggggaatggatgtggactttttggtaaaggaggtgtggtaacttgtgcaaaattctcatgcagtggaaaaataacaggaaatctcgtacaaatagaaaatttagaatatactgttgtcgtcactgtccacaatggtgatacacatgccgtaggcaacgatacttccaaccatggtgttaccgctactatcacgccacgatctccatctgttgaagtaaagctaccagactacggagagctaacactagattgcgaaccgaggagtgggattgacttcaatgagatgatcctaatgaaaatgaagaagaaaacgtggttggtacataaacagtggtttttagatcttccactgccttggacaacaggagcggacaccagtgaggttcactggaactacaaagagcgaatggtaacattcaaagtaccacatgccaaaagacaggacgtcactgtcctaggctctcaagaaggagcgatgcacagtgcattagctggggcgactgaagtagactcaggagacggcaatcacatgtttgcgggacatctaaaatgtaaagtacgaatggagaaacttagaattaaaggtatgtcttacacaatgtgcagtgggaaattctcgattgataaggaaatggcagagactcagcatggaacaaccgtggttaaggtaaaatacgaaggcgccggggcaccctgcaaagtaccgatagaaatacgtgacgtcaataaagaaaaagtggtagggcgtgtgattagcgctacacctcttgccgaaaacacaaactctgtcaccaatatagaattagaaccaccgttcggtgacagttatatcgtgatcggagtaggtaattcagcacttacactacactggtttagaaaaggatctagtattggaaaaatgtttgagtccacgtatcgcggtgcaaaaagaatggcaatcttgggggaaacggcgtgggatttcggatcggtaggcggacttttcaccagcttgggaaaagctgtgcatcaagtattcggaagtgtttacacaacaatgttcggaggagtgtcatggatgattagaatactcataggcttcctagtactctggatcggaacaaatagtaggaacacatcgatggcaatgacctgtatagctgtaggcggaataactttatttctaggtttcaccgtgcaagcagatatgggctgtgtcgtctcatggtcggcccgtgaattaaaatgtggaagtggaatctttgtagtcgacaacgttcatacgtggacagaacaataccaatttcagcccgagtctccagcccgtttagcgagcgccatattgaacgcacataaggatggggtatgcggaattagaagtacgacaagacttgaaaatgttatgtggaaacaaatcacgaacgagttgaactatgtattatgggaagggggacacgacttaacagtcgtagccggcgatgttaaaggagttctaaccaaaggaaagcgtgcattaacgccaccagcaagtgacctaaagtattcatggaaaacttggggaaaagctaaaatctttacaccagaagctaggaactcaacattcttgatagacggtcccgatacatcagaatgccccaatgaaaggagagcatggaactctttcgaagtagaggattacggattcggcatgttcaccacaaatatatggatgaaatttagggaaggatcgagtgaagtctgcgaccacagattgatgtcagctgccataaaagatcaaaaagcagttcacgcagatatgggctactggatagaatctagcaaaaatcaaacttggcagatcgaaagagcaagtcttattgaagttaaaacttgtctatggccaaagacgcataccttgtggtcaaatggcgtactcgaaagccagatgctaattcctaaatcgtatgcaggaccgtttagccagcacaattacagacaaggttacgctactcagacagttggtccatggcacctaggaaaattagagatagactttggtgaatgtccaggaacaactgtaacaatccaggaaaactgtgaccaccgtggaccgagcttaagaacaacaactgcttcgggaaaactggttacacagtggtgctgtagaagctgcactatgcccccactcagattcctaggagaagacggttgttggtatggcatggaaatacgacccttatcagaaaaagaagaaaatatggtcaaaagccaagttacagctggacaaggaactagcgaaacattctctatgggcctcctatgtctaacattatttgttgaagagtgtttaagaagaagggtaaccagaaaacatatgatcctcgcggtagttatcaccttatgtgccataatcttaggaggtcttacttggatggatctattgcgagccctaataatgctgggagatacaatgagcggcaggataggtggccaaacacatttagcaatcatggcagtttttaaaatgagccctggatacgttttaggagtctttttgagaaaacttacctctagagagacagctttgatggtaatagggatggcgatgactactacacttagcataccacatgatctgatggagttgattgatggaatttctctgggtcttatattattaaaaatagtgactcaatttgacaacacgcaagttggaacgttagcgttatcgttaacatttataagatcaacaatgagcctagttatggcgtggcgcaccattatggcagtactgttcgtcgtcactctgatacctctgtgccgtacaagctgtctgcaaaaacaatcccattgggtagaaataacagctttaatacttggggcacaagcccttccagtctacttgatgactctaatgaagggcgccagtagacgctcttggccccttaacgaaggtataatggcagtaggcttagtaagtctactaggatcagcgcttcttaaaaatgatgtgccacttgccggaccgatggtcgctggtggactactactggccgcctacgttatgagcggaagtagcgctgacctcagtttagaaaaagcagcaaatgtacaatgggacgaaatggccgatattactgggagtagtcctataatagaagtgaaacaagacgaagacggatcattttcgattagggacgtggaagagaccaacatgattactctcttggttaaacttgcattaataaccgtttcaggtctctacccgttagcaataccaattaccatgacactgtggtatatgtggcaagtgaaaacacaacgctccggagcgttatgggatgtacctagtcccgcagcgacccaaaaagctgccttgagcgaaggggtatatcgaataatgcaaagaggtttatttggaaaaacacaagtaggggtaggtatacatatggaaggagtgtttcatactatgtggcatgttaccagaggcagtgtaatttgtcatgaaacaggacgactcgaaccgtcctgggcagatgtgagaaatgacatgatttcctatggtgggggctggcgacttggagataaatgggacaaagaagaagatgtccaagttctagcaatcgagcccggcaaaaatccaaagcatgtgcaaacaaaaccaggtttattcaaaacactcacgggagaaattggagcagtaactttggactttaagccgggaaccagtggctcacccattattaaccgcaaagggaaagtcatcggactgtatggaaatggtgtagtgacaaaaagtggcgattatgtatccgccataacccaagcagaacgtattggagagccagattacgaagtggacgaagacatatttcgtaagaaaagattaactattatggacctacacccgggtgcaggaaagacaaaacggatactacccagtatagttagagaggcgctgaaacgacggcttcgaactctgatcctggcacctacaagagtagtagcagcagaaatggaagaagccttgcgagggctacctattcgatatcaaacacccgcagtcaagtcagaacatacaggaagagagatcgttgatttaatgtgtcatgctaccttcaccacaagactattgagcagcacgagagttcctaattacaatctaatagtgatggacgaggctcacttcactgacccatcgtccgttgcagccaggggttatataagtacaagagtagaaatgggtgaggcggccgcgatatttatgactgctactccacccggggctacagatccattcccccaaagtaacagtcctattgaagacatcgaaagggagatacccgaaagatcatggaataccggatttgactggattacagactaccagggtaaaacagtgtggtttgtaccttccataaaagcaggcaatgatattgctaactgcctacgtaaaagtggaaagaaagttattcaactatctcggaaaacgtttgataccgaatatcctaaaacaaaactcacggactgggattttgtcgttactaccgacatatctgagatgggcgccaattttcgtgccggcagagttattgatcctagacgatgtctaaagcccgttattctaactgatggtcccgaaagagtaatattagccgggcctatcccagtcactccggcatcggcagcacagaggagaggccgaataggaaggaatccagcgcaggaagatgatcaatatgtattttctggagatcctctcaaaaacgatgaagatcacgcacattggacagaggcaaaaatgttgctcgacaacatatacacaccggaagggataattcccacgttattcggcccagagagagagaagacccaggcaatagatggtgagttcagattacgaggtgaacaaaggaagacgttcgtagaattaatgcgcagaggagatttgccagtttggttatcatataaggtggcttcagccggaatatcttataaggaccgagaatggtgcttcacaggagagaggaacaatcaaattttagaagaaaatatggaagtagaaatttggacacgggagggcgagaaaaagaaattgaggcctaaatggctcgacgcgagagtttacgcagatccaatggcactaaaagactttaaagagttcgcttcgggacggaaatcaataactttagatattcttaccgaaatagcatcactacccacctatctatcctctagagctaaactagctttagacaatattgttatgttacacacgacagagcgcggaggcagagcttaccaacacgcactaaacgaactccccgaaagcctagagaccttaatgcttgttgctttgcttggagcgatgactgcgggtatatttctattcttcatgcaagggaagggcatcggtaagctaagtatgggtttaattacgatcgccgtggcttctggcctattatgggtagctgaaattcaaccacaatggatcgcagcatcaatcatactagaatttttcttaatggtcttgctgattcctgagccagaaaagcaaaggactccccaggataaccaattaatttatgttattctaaccatcctaactataattggtctaattgctgcaaatgaaatgggcttgattgaaaagacaaaaaccgactttggattctaccaagtgaaaacagaaacgacaatactcgatgttgatttgaggcccgcatcagcatggactctatatgccgttgcaacaacaatccttacacctatgttaaggcacacaatagagaataccagcgcgaatctatctttggctgccatagcaaaccaggctgccgtacttatgggtttagggaaagggtggccacttcatagaatggatttaggagtacccttgttggcgatgggatgctactcccaagtcaatcctactactctaaccgcaagtctagtcatgttattagttcactacgcaataattgggcccgggcttcaagcgaaagcaacaagggaagctcaaaaacggactgcagctggcataatgaagaaccctaccgtagatggcattactgttattgatcttgaaccaataagttacgatcccaagttcgaaaaacaacttggacaagtaatgttattggttctttgcgcaggacagttactactaatgcgaacaacctgggctttctgtgaagtattgacactcgcgaccggcccaatactgacactttgggagggcaaccctggccgattttggaatacaacgatcgcagtaagcaccgcaaatatattcaggggttcgtacctggccggtgcaggacttgcattctccctaataaagaacgctcagactccacgacgaggtaccggcactactggagagacacttggcgaaaagtggaaacgacaacttaactcactagacagaaaagaatttgaggagtacaaaagaagtggtatattagaagtggataggacagaggccaaaagcgcgttaaaagatggctccaaaataaagcatgcagtaagcagaggatcgtccaaaatacgttggatagtggagagaggcatggtcaaaccgaaaggaaaggtggttgatttaggttgtggaagagggggatggtcttattatatggcgactctaaagaatgtaacggaagttaaaggatatacaaaaggtggtccgggtcacgaagaaccaattcccatggcaacgtatgggtggaatttagtcaaacttcatagcggagttgatgtattctataaaccaacagaacaagtggatacattactatgtgatataggcgaatcatccagtaatccaaccatagaagaaggtcggactttaagagtactcaaaatggtggaaccatggctatcttcaaaaccggaattttgcataaaggttctaaacccttacatgccgactgtaattgaagaacttgaaaagttacaacgtaaacatgggggcaacctagtccgatgcccactttccaggaatagcacacacgaaatgtattgggtaagtggtgcaagcggaaatatcgtgtcttctgtaaatactacgtctaagatgctgttaaacagatttactaccaggcacaggaaaccgacttatgagaaagatgtagatttaggcgcaggaactaggtccgtatcgactgagacggaaaaaccagatatgacaataataggaagaagactgcaacgcttacaagaggaacacaaagaaacttggcactatgatcaggagaatccctatcgcacgtgggcttatcatggaagttatgaggccccatcgaccggatcagctagctcaatggtaaatggagtcgtaaaactattaacgaaaccctgggacgttattccgatggtaactcaattagcaatgactgatacgacgccatttggtcaacaacgtgttttcaaagaaaaagtagacactcgaacgccacaaccgaaacccgggacaaggatggtaatgaccacaacagctaattggctttgggcattactcggcaagaagaagaatccccggttatgtacgagggaggaatttatcagtaaagtcagaagcaatgctgccataggggcggtattccaagaagaacaaggatggacatcagcatcagaggcagttaatgacagtagattctgggaattggtcgataaggaaagagcattacaccaagagggaaaatgtgaaagttgcgtatataatatgatgggaaagagagagaaaaagctaggcgaatttggcagagccaaaggttcgcgtgcaatatggtacatgtggttgggagcaagatttctcgaatttgaagccctaggatttttaaatgaggatcattggttcggtagagaaaactcctggtcaggagtagagggtgagggattacatagattaggatacatcctggaggaaatagacaagaaagacggcgatttaatgtatgccgacgatacagctggatgggacaccaggattactgaagatgacctacagaatgaagaattaataacagaacagatggcgcctcatcataaaattctagccaaagccatatttaaattaacttatcaaaataaggtagtgaaagttctaaggccgacgccacgtggagccgtaatggatatcatatctagaaaggatcaaagaggatcaggacaagttggtacgtatggattaaacacatttacgaatatggaagtccaactgatacgacaaatggaagctgagggagtaataactcaagatgacatgcaaaatcctaagggacttaaagagcgagttgagaaatggttacgcgaatgtggagttgaccgattgaaaagaatggcaataagcggagatgattgtgtagtgaagcctttagatgaacggtttggcacttcattattgtttcttaatgacatgggtaaagttcgaaaggacataccacaatgggaaccatcaaaaggttggaagaattggcaagaggtacctttctgtagccatcattttcacaaaatcttcatgaaagacggccgtagtctggttgtaccctgtagaaatcaagacgaacttataggacgcgcgcggatcagtcagggagctggctggagccttcgcgaaacagcatgtttaggtaaggcttatgcacagatgtggtctttaatgtacttccataggagagatctgaggctagcaagtatggccatttgttcagctgtccctacagaatggttccctacatctcggacaacttggtctatacacgcgcaccaccagtggatgacgactgaggatatgctaaaagtttggaatcgagtatggatagaagataatcctaatatgatagacaaaactcctgttcattcatgggaagatataccctatttgggaaaaagggaagatttatggtgcggctctctaatcggattaagttctagagctacatgggccaaaaacatacacaccgcaataactcaagtacgtaatctaatcggtaaggaagaatacgtagactacatgcctgtaatgaagcggtactctgcaccttccgagtcggaaggggtgttgtaa

SEQ ID NO: 23647 - RNA, 9867 nt, synthetic construct
  misc_feature 1..9867: note = derived and/or modified CDS sequence (opt6) from DENV-4__GQ199876__SS-prME
  source 1..9867: mol_type = other RNA
tccactattactcttctgtgcttgatcccaacagttatggcatttcatctctcgactcgtgatggggaaccattaatgatcgttgctaaacatgaacgcggtcggcctctcctattcaaaacaacagaaggaataaacaaatgtacacttattgcaatggatttaggagaaatgtgcgaagacaccgtaacatataaatgcccgctattagtcaatacagaacctgaagatattgattgttggtgtaatttaacaagtacttgggttatgtacggaacatgtacccaatccggtgaaagaagacgagaaaaacgttcagtagcgttaacaccacatagtggaatgggcttagaaacccgagctgaaacttggatgagctcagaaggagcttggaaacatgcgcagagggttgaaagttggatcctaaggaatcctggtttcgctctgttagcagggttcatggcatacatgatagggcaaacgggcattcaacgcactgtatttttcgttctaatgatgttagtcgcgccaagctatggtatgcgctgcgtgggagttgggaacagagattttgttgaaggggtatcaggtggagcatgggtagatctagttctcgaacacggcggctgtgtgactacaatggcacaaggcaaaccaacattagattttgaattaacaaaaacgacggctaaagaagtggccttattaagaacgtactgtatagaagcgttaatttccaatataaccaccgcaacacgatgccctacacaaggtgaaccgtacctcaaagaagaacaagatcaacagtacatttgtcgcagggatgtagtagacagaggatggggaaatggttgtggtttatttggcaagggcggagtcgttacatgtgcaaagtttagctgtagcggtaagataactggaaacctcgtacaaatagaaaatttagaatacaccgttgttgttactgtacataacggagacacccatgcggtaggaaatgacacaagtaatcatggtgtaactgccacaataacgccacgctcgccttcggtagaagtaaaactaccagattatggagaattaaccctagactgcgaaccaagatcagggatagacttcaacgaaatgattctcatgaaaatgaagaagaaaacgtggcttgtacataagcaatggtttctagatttacctttgccgtggaccaccggagcagatacaagtgaagtacattggaattataaagaacgaatggtcacattcaaagtccctcatgctaagagacaagatgtaacagttttaggatctcaagaaggagcgatgcattcggccttggcgggtgccacggaagtggacagcggagatggaaaccatatgtttgcaggccatctcaagtgtaaagtcaggatggagaaattaagaataaagggaatgtcatacactatgtgttctggcaaattttcaattgacaaagaaatggcagaaactcagcatggtacaacagtagtaaaagttaaatatgaaggagctggtgctccgtgtaaagtccccatagaaataagagacgtaaataaagaaaaggttataggaagagtcatttctgctacaccacttgcagaaaacactaactcagtcaccaatatagaattagagccaccgttcggggattcttatatagtgatcggagtgggaaattctgctctaacattacattggttcagaaagggatcgtcgattggtaaaatgtttgaatccacgtatcgcggagctaaaagaatggcaatactaggagagaccgcctgggactttggttcagttggtggattatttacgtcgctaggtaaagctgtacaccaagtctttggttcagtatacaccacaatgttcggaggagtctcctggatgatcagaatacttattggattcttagtattgtggataggtaccaattcacgaaacacaagcatggcgatgacttgtatagcagttggaggtatcaccttatttctaggttttacagttcaagcggatatgggttgtgtggtaagttggtcaggaagagaactaaaatgtggatcaggaattttcgtagtggataatgttcatacctggactgagcaatataaatttcaaccagaatcccctgctaggctagccagcgcaattttgaacgcgcataaagacggagtttgtggaataaggtctacaacccgtttagaaaacgtgatgtggaaacagattaccaatgaattaaattacgtactctgggagggaggacacgatctaaccgtggtggcaggcgatgtaaagggggtattgacgaagggaaaacgagcattaactccccctgctagtgatctgaaatactcatggaaaacctggggcaaggctaaaatttttactcctgaggcgagaaatagtacttttctcatagacgggcctgatacatccgaatgtccaaatgagagacgggcatggaacagctttgaagttgaagattatgggttcggaatgtttactaccaatatctggatgaaatttagagaaggaagctcagaggtttgtgaccataggttaatgagcgcggcaataaaagaccaaaaagcagttcatgcagatatggggtactggatcgaatcgtctaaaaaccaaacgtggcaaattgaacgagcatcactcattgaagtgaaaacatgcttgtggcctaaaactcatacattatggagtaacggtgtactagagagtcaaatgttaataccaaaaagctacgcaggaccattcagccagcataactacagacaaggttacgcaactcaaacagtaggtccgtggcatttagggaaactagaaatcgatttcggcgaatgccctggtactactgttaccatacaagaaaactgtgatcaccgtggtccatcgttaagaacaaccacggctagcggaaaattagtgactcaatggtgttgcaggagttgtactatgccaccgctacgcttcctaggagaggacggttgttggtacggaatggaaatcagacctctctcggagaaggaagagaacatggttaaatcacaagtaacagcgggtcaaggtacatctgagacgttttcaatgggattactctgcttaaccttatttgtcgaagaatgtttgaggaggagagtaacgcgtaagcatatgatattggccgtagtaataacactatgtgctattattttaggaggactcacttggatggacctacttagagccctaataatgttaggtgatacaatgtccggtaggattgggggacaaacccatcttgcaattatggctgtatttaaaatgtcaccaggatatgtcttaggtgtgttcctacgtaaactaacgtccagagagacagcccttatggtgataggaatggccatgaccacaactttatctataccgcacgatttgatggaattgatcgatggcatatcattaggattaattttattaaaaatagttacacaatttgacaacactcaggtcggtacgttagccttgagccttaccttcattcgcagcacaatgtcactggtaatggcgtggagaacgatcatggcagtcctatttgtagtaacgttaataccactttgcagaacatcctgtctgcaaaaacaaagtcattgggtagaaattaccgcacttatattaggagcccaagcccttccagtatatctgatgacgcttatgaaaggtgcgagccggcgcagctggcctttaaacgaaggaatcatggccgtgggattagtaagcctcctaggaagtgccttactgaaaaacgatgttccattagctggtccgatggttgcaggagggcttttactggctgcttacgtgatgtctggatcatcggcagacttaagtctagaaaaagctgcgaatgtccagtgggacgagatggctgatatcacgggaagcagtccaataatagaagtaaagcaagacgaagacgggagtttttcaatccgggacgtagaagagactaacatgatcactttgctagtgaaactagcgttaataactgtctcggggctatatcctctggcaattccaatcactatgacactttggtacatgtggcaagtaaagacacagcgctcaggagccctctgggacgtcccatcacccgccgcgacgcaaaaagcagccctatcggaaggagtatatcgaataatgcagagaggtctgttcgggaaaactcaggttggtgttggcatccacatggagggggtttttcacactatgtggcacgtgactagaggaagcgttatttgtcatgagacaggcagattagaaccttcatgggctgacgtaaggaatgatatgatatcttatggtgggggatggagattgggagataaatgggacaaagaagaagatgtccaggtactggcaatagagccaggtaaaaacccaaaacacgtgcaaaccaaaccggggttatttaagactctaacgggagaaattggcgcagtaacgctagattttaaacctggaacaagcggatctccgataataaatagaaagggaaaagtaataggactatatggtaacggcgtagtaacaaaatcaggggattatgtgagcgccataactcaagcagagcgcattggcgagccggattacgaagtagatgaagatattttccgcaagaaaagattaactataatggatcttcatcctggcgcgggtaaaacaaaaagaatattaccaagcatagtcagagaagcgctaaaaagacgtctgagaaccctcatcctagctccgacgagagtcgtagcagcggaaatggaggaagctctacgaggattgcccgttcggtatcaaactcccgcagtgaaatctgaacataccgggcgggaaattgtcgatctaatgtgccatgcaaccttcaccacaaggctattatcctcgaccagagtgccaaattataatcttatagttatggatgaagcgcattttaccgatccatcaagtgtggcagctagaggatacatttcaacacgagtcgaaatgggagaggctgctgcgattttcatgacagccacaccacccggagccacggatcctttcccgcagtccaactcaccgatagaagacatcgaaagagaaattccagagcgatcctggaacacaggatttgactggattacagactaccagggcaaaacagtttggtttgtaccgtccatcaaagcaggcaacgacattgccaattgtctaagaaaatcaggaaagaaggtaatccaattaagtagaaaaaccttcgacacagaataccctaaaacaaaattaacagactgggatttcgttgtaacaactgacatcagcgaaatgggagctaacttcagagctggtagagttatagacccacgtcgatgccttaaaccagtaatattgaccgatggaccagagagagtaatacttgcaggtccaataccagtgactccagcatcagctgctcaaaggcgaggaagaatcggacggaatccagctcaggaggacgatcagtacgtcttttcaggggatcccttgaaaaacgacgaagaccacgctcactggacagaagcaaagatgcttttagacaacatctacactcctgaaggtataataccaacactgtttggacctgaacgagagaaaacccaagccatagatggagagtttcgactgagaggcgaacaacgaaaaacgtttgtggagttaatgcgccgaggagatttacctgtatggttgtcatacaaagttgcaagcgcaggaataagctacaaggaccgtgagtggtgttttaccggagaacgaaataatcaaatactggaagaaaatatggaggtggagatatggacaagagaaggagagaagaagaaattgagaccaaaatggctcgatgcaagagtctatgctgatcccatggcactaaaagacttcaaagaatttgcaagcggaagaaaaagtatcaccttggacatacttacagaaatcgctagcctgcccacgtacttgtcaagtagagctaaacttgcattggataacatcgtcatgctccatactactgaaaggggcgggcgcgcgtatcaacatgcgttgaacgaactaccagaatccctagaaactttaatgttagtcgctctgctaggcgcaatgaccgccggaatatttttattctttatgcaagggaaaggaataggtaagctatccatgggattgataactatagcagttgcctctggattattatgggtagcagaaatacagcctcaatggatagcagcaagcattatactagagtttttcttaatggttcttctcataccagaacctgaaaaacaacgtacaccccaggacaaccaattaatatatgtaatactcacgatattaactataatcggattgatagcagcgaatgaaatgggactaattgagaaaacgaaaactgattttggattttatcaagtgaaaacagaaactacgatattagatgtagatttaagacccgccagcgcttggacattatatgcagtagccacaacaatactcacacctatgctacgacacacaatcgaaaatacatcagcgaatctgtccttagctgcaatcgcaaaccaagcagccgtcctaatgggcctaggtaaaggatggccactacacagaatggatctaggtgtgccgcttctagccatgggatgctattctcaagtcaatccaaccacgctcacagcaagcctagtaatgttgctagttcattacgcgataatcggaccagggttgcaagctaaagcaacacgagaggcacaaaaacgaaccgccgcggggataatgaaaaatccgacggtggacggaataaccgttattgacttagaacctatctcttatgatcctaaatttgaaaagcaattaggtcaagtcatgctattagtgttgtgtgctggtcaattgcttttaatgcgaactacctgggcattctgtgaagtgctaacactggcaacgggaccaattctaaccctctgggaaggaaatcctggtcgtttttggaacacaaccatagctgtgtctaccgcaaatattttcagaggtagctatttggcaggagccggattagcgttttccctaatcaaaaatgcccagacgcctcgtcgaggaactggaacgacaggagaaacactaggcgaaaaatggaagcgtcaattgaactcattagatagaaaagaatttgaagaatacaaacgaagtggtattcttgaagtggacaggacagaagcaaaatctgcattaaaagatggatcaaaaattaaacatgcggtatcacgaggttcatcaaagattagatggatagttgaaaggggcatggtgaaacctaaggggaaagtcgtagacttaggatgcggacgtggtggctggtcttactatatggctacgcttaaaaacgttacagaggtaaaagggtacaccaagggaggaccgggtcatgaagaacccattcctatggcaacatatgggtggaatctagttaaactccactcaggtgttgacgtgttctataagccaacagaacaagttgataccttgctctgcgatatcggagaaagttcaagcaatccaacgatagaggaaggacgtacattgagggttctaaaaatggttgaaccttggctaagctcaaaaccagagttctgcattaaggtgcttaatccctatatgcctacagtcattgaagaacttgaaaaacttcagagaaagcatgggggtaacctggtgcgttgtccattaagccggaacagcacacatgaaatgtactgggtttcaggtgcaagcggtaacatagtgagttcagtaaacacgacatccaaaatgttgctaaatagatttaccacgaggcaccgcaaaccaacttatgaaaaagatgtcgatcttggtgccggcactcgaagtgtatcaacggaaaccgagaaacccgatatgacgataataggacgtagactacaacgactccaggaagaacacaaagaaacttggcattatgatcaagagaatccttatcgaacatgggcataccatggctcatatgaagctccctcaaccggatcggctagttccatggtgaatggagtggtaaaattactaactaaaccgtgggatgtgatacccatggtaactcaacttgccatgacagatacaactccattcggacagcaacgtgtattcaaagaaaaggtggatacacgaactccgcaacctaagcctgggacaagaatggtgatgacaaccacagctaattggctttgggctctcttagggaaaaagaaaaatccgcgtctgtgcacgagagaagagttcatatctaaagtaagaagcaatgctgcaataggagccgtgtttcaagaggaacaaggatggacatcagcatctgaagcggtaaacgatagtaggttctgggaactggttgataaggaaagagccctacatcaagaaggtaaatgtgagtcatgtgtttataatatgatggggaaaagagagaagaaattgggcgagttcggccgcgccaaaggaagtagagccatatggtacatgtggttaggtgcccgattccttgagttcgaggccttaggttttctaaacgaggaccattggtttggaagagaaaacagttggtcaggtgtcgaaggcgaaggattacatcgattagggtatatattagaagaaatagataaaaaggatggggatctgatgtatgctgatgatacagcagggtgggacactagaattacagaagacgatctgcaaaatgaagaattgattactgaacaaatggccccacaccataaaattcttgcgaaagcaatcttcaaattaacgtaccaaaataaagtagtaaaagtattacgtccgacaccacgcggggcggtaatggacataatctcgcgtaaggaccaacgaggctctggacaagtggggacatatggattaaataccttcacaaacatggaggtacagctaattagacaaatggaagcggagggtgttataacccaagatgacatgcaaaaccctaaggggctaaaagaacgagtagaaaaatggctaagagagtgcggagtggataggcttaaaaggatggccatcagcggtgacgactgcgtagttaaacctctggatgaaagattcggtacatctctgctattcttgaatgatatggggaaagtaagaaaagatataccacaatgggagccatctaagggttggaaaaattggcaggaagtcccgttttgtagtcaccacttccacaaaatattcatgaaagatggacgttctctggtagtcccttgtaggaatcaagatgaacttattggacgcgcaaggattagtcaaggtgcaggctggtcactacgtgaaacagcgtgtttaggaaaagcatatgcacaaatgtggagtttaatgtactttcatcggagagatttacgattggcttctatggcaatatgctcagcagttcctacagaatggtttcctacatcacggacaacatggtccatacatgcccaccatcaatggatgactacagaagacatgttaaaggtgtggaatagagtttggatagaagacaatcccaatatgacggataaaactccagtccattcatgggaggatataccgtatttaggtaaaagagaagatttatggtgtggatcgctaatcggtttatcgtcacgagcaacctgggcaaagaatatccacacagcaataacccaggtgagaaatctaataggtaaagaggaatacgtcgattacatgcctgttatgaaaagatacagtgccccatcggagagcgaaggagtactataa

SEQ ID NO: 23648 - RNA, 9867 nt, synthetic construct
  misc_feature 1..9867: note = derived and/or modified CDS sequence (opt6) from DENV-4__KP723482__SS-prME
  source 1..9867: mol_type = other RNA
tcaaccatgacgctcctctgtttaatccccactgttatggcatttcacttaagtacaagagatggagaacccttaatgatagtagctaaacatgaaagagggagaccattgttattcaaaacaacggaaggaataaacaaatgtacgttgatagcaatggatctaggagaaatgtgtgaagataccgtcacctataaatgtccattactcgttaacacagaacccgaagacattgattgttggtgcaatctaacttcaacctgggtgatgtatggaacttgtacacagtcaggagaacggcgcagagaaaagagatccgtagcactaactccacactccggaatgggtcttgaaactcgcgcagaaacatggatgagcagcgaaggggcatggaaacatgcacagcgagtggaatcctggatccttcgaaaccccggtttcgctcttttggcaggattcatggcttatatgataggtcaaaccggcattcaacgaactgtattctttgtcctaatgatgctagttgctccttcttacggcatgcgatgtgtaggtgtcggaaacagagactttgttgagggagttagtggtggagcatgggtagacctggttctagaacatgggggatgtgtaaccacaatggcgcaaggaaaaccaactcttgattttgaactaacgaaaacaactgcaaaagaagtagccttattgcgcacatattgtattgaggcttccatctcaaatataactacagccacaagatgcccaacacaaggtgaaccatatttaaaggaagaacaagatcagcaatacatatgccgaagagacgtcgtagatcgaggttggggtaacggttgcgggctatttggaaagggaggtgtagtcacatgtgctaaatttctatgttctgggaagatcaccggaaatctagtacagattgaaaatttagagtatacagtagtagtaaccgtacacaatgggaatacacatgccgtaggcaacgatacttcgaatcatggggtcacagcgaccatcacacctagatctccatcagttgaagtaaaactacctgattatggtgaattaacactcgattgcgaaccaagatctggaattgacttcaatgaaatgatattgatgaagatgaagaagaaaacttggttggtgcataaacaatggtttctagatttaccgttaccatggaccgctggcgcagacacttcggaggtccattggaattacaaagaacgaatggttacatttaaagtacctcatgctaaacgtcaggatgtcacagtattgggaagccaagaaggagcgatgcattcagcgctagccggtgccacagaagttgattcaggggacgggaatcatatgttcgcgggacatctcaaatgtaaagttcgaatggagaaacttcgaatcaaaggtatgtcatatacaatgtgtagtggaaaattcagtattgacaaggaaatggcggaaacacaacatggcacaacggtagtaaaagtcaaatacgaaggagccggagcgccttgcaaagtgccaattgaaataagagatgtaaataaagaaaaagtagtaggaagaattataagcagtaccccgtttgcagaaaatacaaatagcgtcacaaacatagagctagaaccccctttcggggattcatatatagttataggagtaggtgactcagcactaacacttcactggttccgaaagggtagttctataggtaaaatgttcgagagtacttacagaggtgctaagaggatggctatactaggagaaacggcgtgggattttggatcggtaggaggattattcacgtcattgggaaaggcagtgcaccaggttttcgggtccgtgtataccacgatgttcggaggagtatcatggatgatcagaatactaataggatttttagtactttggatcggtactaattcaagaaatacgtctatggccatgacctgtatagcagtaggcgggattaccttatttttaggatttacagtccaagctgatatggggtgtgtggtgagttggaatggcaaggagctaaaatgcgggtcaggtatatttgttgttgataacgtccatacctggactgaacaatacaaatttcagcccgagagccctgcacgattggcatcagcaatactgaacgcgcataaagacggtgtatgcggcataagaagtacaacgcgtctggaaaacgtaatgtggaaacaaataactaatgaactaaattacgttttgtgggaaggaggacatgacctaactgtggtagctggagatgttaaaggagtcttaactaaaggtaaacgagcactaacacccccagttaatgatctaaaatactcttggaagacatggggaaaggcaaagatatttacaccagaagcgagaaattcaacatttttaatagatggaccggacacttcagaatgccctaatgaaagacgggcttggaactttttcgaagtcgaagattacggtttcggaatgtttacaacaaatatatggatgaaattcagggaaggatcgtcggaagtatgcgaccataggttgatgagtgctgcgatcaaagatcaaaaggcagttcacgcagatatgggctattggatagaatcatcaaagaaccaaacgtggcaaattgaaaaagcctcgttaatagaagtgaagacatgcctttggcctaagactcatactctatggagtaacggagtacttgaaagtcaaatgctaattcctcgatcctatgcaggaccatttagtcaacataattaccgccaaggttatgctactcagactgccggaccctggcatcttgggaaattagaaatcgattttggagaatgtccaggaacaacagtaacgattcaagaggattgtgaccatagaggcccatctcttcgaactacaactgcctcgggtaaattggtaacgcaatggtgttgtagatcatgtactatgccacccttaagatttcttggagaagacggatgttggtacggcatggagatccgacccctctcggaaaaggaagaaaatatggtcaaatcacaagtgacggctggacaagggacatcagaaacattctcaatggggctcctttgtttaactctatttgtggaggaatgtctaagacggcgcgtaactagaaagcacatgattttagcagttgtcataacattctgtgctataattttgggtggactaacttggatggacttacttagagtccttattatgcttggtgacaccatgagcggtcgtataggaggacagatacatctggcgataatggctgtattcaaaatgagtcctgggtacgtgctaggagttttcttacgaaagttaacatcacgtgagacggctctaatggtgatcggaatggctatgactacagtgttttcgatacctcatgatctgatggaacttatcgatggcataagcctcggacttatcctattaaagatagtcactcactttgataatacgcaagtcggaactctagccctatcactaacgttcattcgctccaccacaccgctagtaatggcttggaggacgatcatggcggtctttttcgtcgtcacactaattcctctatgccgaacctcatgcctacaaaaacaaagtcattgggtagagattacagcactcattttgggagcgcaagcactgccagtatacctaatgacactcatgaaaggggcaagcaggagaagttggccgctaaatgaggggattatggccgtaggtctcgtgagtttgttgggttctgcgctgttaaagaacgacgtaccgttagcagggccaatggtcgctggaggtctgttgttagctgcctacgtgatgtcgggaagtagcgctgacttatctctagagaaagccgcgaatgtgcagtgggacgaaatggcagacattacaggaagcagtcccatcatagaagtaaaacaagatgaagatggctcattctcaatcagagatgtggaagaaactaacatgattaccctattagtgaaattagcactaattacagtgtcaggactatatcctttagcaataccagtaacaatggcattatggtacgtatggcaagtgaaaactcaaagatctggagctttgtgggacgtaccgtcaccgtctgcaacacaaaaagctacattaagtgagggggtgtatcgaatcatgcaacgcggattgtttggaaaaacacaagtaggggtaggtatccacatggagggtgtatttcatactatgtggcacgtgacgagaggcagtgttatatgtcatgaaacagggcgattagagccgtcgtgggcagatgtacgtaatgacatgattagttatggtgggggatggagattaggtgacaaatgggacaaagaggaggatgtacaggttcttgctatcgaacctggcaaaaatccgaaacatgtgcagactaagccaggtctttttaaaactctaaccggtgaaatcggtgcagtaacattagactttaaacccggtacatccggttcgcctataataaataagaaaggaaaagttattggactatatggaaacggagttgtaactaaatccggagattacgtttcagctataacacaagccgagaggataggagaaccagactacgaggttgatgaggacatttttaggaagaaaaggttgaccattatggatcttcatccaggcgcgggaaaaaccaagaggattctcccgtcaattgttagggaggcgcttaaacgcagattaagaacgctcattttggctcctacacgcgtcgttgcagctgaaatggaagaagccctcagaggattacctataagatatcaaacacccgctgtcaaatcggaacatactggaagagaaatagtagatttaatgtgtcacgccacattcactacaagactgctcagcagtacaagagttcctaattacaacttaatagtgatggacgaagcacattttacggatccttgttcagtcgctgcaaggggatatatttctacaagggtagaaatgggtgaagcggcagcaatctttatgactgcgacaccacctggaagtattgaccccttcccacaaagcaactccccgatagaagatatagagcgggaaatccctgagagaagctggaacaccggatttgactggataactgattatcaaggtaagaccgtttggtttgtcccgtcaataaaagcaggtaatgacattgcgaattgcttacgtaagagcgggaaacgggtaatccaactatcccgaaaaacatttgacacagaatatccaaaaacaaaattgacagattgggattttgtggttacgacagatatcagtgagatgggtgccaacttccgagccggaagagttatcgaccctagacgatgtctcaagcctgtaatactgacagatgggccagaacgggttatactagcaggacccatcccagttacaccggcttctgctgcgcaacgtagaggtcggattggacgaaatccggcgcaggaagatgatcaatacgtgtttagcggggaccccctgaagaacgatgaagatcatgctcactggactgaagcaaaaatgttgttagataatatttatacacccgagggaataatcccaacactattcgggcccgaacgcgagaaaactcaggcaatcgatggagagtttcgtttaagaggtgaacaacgcaaaacctttgttgaacttatgagaagaggcgatttgcctgtttggttgagttacaaagtagcaagtgcaggtataagctataaagacagagagtggtgcttcacaggcgaaagaaacaaccaaatattagaagaaaatatggaagtcgaaatatggacacgcgaaggtgagaagaagaaactccgacccaaatggttggacgcaagagtttacgctgatccaatggcactcaaagacttcaaagaatttgcctcaggcaggaaatcaatcactttggatatattaacggagattgccactttacccacatatctatcctcaaaagctaaattagctctagataatatcgttatgctacacaccacagagaaaggaggtagagcataccaacacgctttaaatgaattacccgaatcgctggagaccctgatgctagtagctttactgggtgccatgactgctggcatcttcctgttctttatgcaaggaaagggaattggtaaactaagtatgggattgatagcgatagcggtagcgtctgggttactgtgggtggccgagatccaaccccaatggatagcagcatctatcatactagagttctttttaatggtcctactaataccagaacccgaaaaacaacgtacacctcaagacaaccaattgatctacgttattttaactatactaactataattggattaatagctgctaatgagatgggcctaatagaaaagacaaaaaccgactttggtttttatcaggtaaaaccggaaacaacgatattagacgtagacttacgaccagcttctgcctggacgctgtacgctgttgccactactatccttacaccaatgttacggcacacaatcgaaaatacctctgccaacctctctctagcggcaatcgctaaccaagcggcagtattaatgggtttagggaaaggttggcctctacatcgtatggatcttggagtacctcttttggcaatgggttgttattcccaagtaaatcctaccacgctaacagcctcattagtaatgctcctagttcattacgcaatcataggtccaggcctacaagccaaggccacaagggaggcccagaaacgcacagcagcaggaatcatgaaaaatccaaccgtggacggaatcactgtaatcgatctggaaccgatctcctatgacccaaagttcgaaaagcaactcggtcaagtcatgctgttggtgctatgtgtgggccaattattattaatgaggaccacgtgggctttatgcgaagtattaacactcgcgacgggcccagtaatgaccttatgggaaggaaacccaggtaggttttggaacacgacaatagcagtctcaacggcaaatatatttcggggctcttacctcgcgggagctggactagctttttcgttaattaaaaatgcgcagacaccaaggagaggcaccggaacaactggcgagaccctaggagagaagtggaaacgacaattaaattcacttgataggaaagagtttgaggagtataagagaagtggaatacttgaggtagacagaacggaagcgaaaagcgcattaagagatgggactaaaataaaatacgcagtaagccgaggttcgtccaaaataagatggatagtggaaagaggtatgatcaagccaaaagggaaagttgtggatctaggctgtggtcgcggtggttggtcctattatatggctactcttaaaaatgttaccgaagtcaaagggtataccaaaggaggtcctggacatgaggagcctataccaatggcaacatatgggtggaatttagtgaaattacactcaggtgtagacgtattttataaaccaaccgaacaagttgacacactattatgcgatataggtgaatcatcatctaacccgacgatagaagagggtagaacgctaagagtgttaaaaatggttgaaccctggttgtcgtcaaaacctgagttctgtataaaagtcttgaatccctacatgcccaccgttatagaggaattggaaaagttacagcgtagacatggagggtcattagttaggtgtccgttgtcacgaaatagtacgcatgagatgtattgggtatcaggagctagtggaaatatagtatcgtccgtgaacacgattagcaagatgcttctcaacagattcactacacgacacagaaaaccaacttatgaaaaagatgttgatctcggcgcgggcacgaggagtgtttcaaccgaaaccgagaaacctgatatgacggttatcggacgaagattacaacgactgcgcgaggagcataaagaaacctggcattatgatcaagaaaacccataccgaacgtgggcgtatcatggatcatacgaagctccatccactggaagcgcaagctcaatggttaacggtgtcgtcaaacttctaacaaaaccatgggatgtaataccaatggtaactcagcttgctatgaccgacactaccccattcggacaacagcgtgtattcaaggaaaaggttgatacacgaactccccaacccaaacccggcacacgaatgatcatgacaacaactgctaattggctttgggccctattaggaaagaagaaaagccctaggttgtgtacaagagaggaatttataagtaaagttagatcaaatgcggctataggggctgtctttcaagaagaacaaggctggacctctgcatcagaagcagtcaacgattcaagattttgggagctagttgataaagaacgtgccttgcatcaagaaggtaagtgtgaaagttgcgtctacaacatgatgggaaagcgagagaagaaacttggagaatttggacgtgctaaaggaagtagagcaatatggtatatgtggctgggcgcgagatttttagagttcgaagcactaggattcttgaatgaggatcattggttcagcagagaaaattcatggtcaggagttgaaggagaaggactacatagactgggatatatcttggaagatatagataagaaagatggtgacttaatatatgctgatgacaccgcaggttgggatacgcgtataacagaagatgacctgttgaatgaagaactaattactgaacaaatggctccacatcacaagactttggcgaaggcaatcttcaaacttacctatcaaaataaagtagttaaagtgctcagaccaaccccaaagggcgctgttatggatataattagcaggaaggaccaaagaggttcaggacaagtgggaacttatggactaaatacatttactaatatggaagttcagttaattaggcaaatggaagctgaaggtgtaataacacaagatgacatgcaaaatccaaaaggcttaaaagaaagggtagagaagtggctaaaagaatgcggggttgacagacttaaaagaatggctatctccggagatgactgcgtagtaaagccactagatgaaaggttcagtacgtcgttactatttctgaatgatatgggcaaagtaaggaaggatattccacagtgggaaccaagcaaaggatggaagaattggcaagaagtacctttctgtagtcaccatttccataagatttttatgaaggatggcaggagcctagtcgtaccatgcagaaaccaggacgaattaataggtcgagcaagaatctcacagggagcggggtggagtctgagggaaacggcttgcctaggtaaggcctacgcacaaatgtggagcttgatgtatttccacagaagagacttaaggctggcatcgatggcaatttgctcagctgtacccacggaatggtttccaacatctagaaccacatggagtattcatgcgcatcaccaatggatgaccactgaggatatgttaaaagtgtggaacagagtatggattgaggataatccaaatatgacagataaaacgccagtacactcatgggaagatatcccctatttaggaaaaagagaagatttatggtgcggttctctcattgggctatcctcaagagccacttgggctaaaaacattcacacggcgataactcaagtgaggaatttaataggtaaagaagaatacgtagattacatgccagcaatgaaacgatactcggccccatttgaaagcgaaggtgttctgtaa

SEQ ID NO: 23649 - RNA, 9867 nt, synthetic construct
  misc_feature 1..9867: note = derived and/or modified CDS sequence (opt6) from DENV-4__JN638570__SS-prME
  source 1..9867: mol_type = other RNA
tcgacgatcacactattatgccttatacctacggtaatggcatttcatctttcaacaagagatggagaaccgctgatgatcgtagcgaaacatgaaagaggtagacctttattgtttaaaacaacagaaggaataaacaaatgtactttaattgctatggatctaggagaaatgtgcgaagataccgtcacgtataaatgtccacttcttgttaatacggaaccagaagacattgattgttggtgtaatctcacctcagcatgggttatgtatggaacatgcacccaaagcggtgaacgtagacgtgaaaaacgaagcgttgcattaactccacactcgggaatgggattagaaacaagagcagaaacctggatgtcgtctgaaggagcatggaaacatgcacaaagagttgaaagttggattctaagaaatcctggttttgcgctattagcaggctttatggcatacatgatagggcaaactggaatacaaagaactgtcttcttcattttaatgatgctagtagcaccatcttatggcatgagatgtgtaggagttggcaaccgggacttcgtcgaaggagtctcaggcggtgcctgggttgaccttgtgctggaacacggaggatgcgtaacaactatggcacaaggtaaacccaccttagactttgaattgattaaaacaacagctaaagaagtagccttattaagaacttactgcattgaagcgtctattagcaatattacaacagccaccagatgtcctacgcaaggtgaaccctacctaaaagaggaacaagaccaacaatatatatgtcgtcgagatatggtagatagaggatgggggaatggatgtggtctattcggtaaagggggtgttgtaacttgtgcaaaattctcatgcttaggaaaaatcacaggtaatctagttcaaatagaaaatcttgaatatacagtagtcgttacagttcacaatggggatactcacgctgtagggaatgacacttcaaaccatggggtaacggcaacaattacgcccagatcacctagcgtagaagttaaattaccagattatggagaattaacactagattgcgaacctagatcagggatagacttcaatgaaatgatcctgatgaaaatgaaaaccaagacatggctagtccacaaacaatggtttctagacctcccgcttccatggaccacaggagctgatacattagaagtgcattggaaccacaaagagcgaatggtcacgttcaaagtgcctcacgcaaaacgtcaggatgtaacggtcttaggttctcaagaaggtgccatgcatagtgcattagcaggcgcaacagaagtagattcaggcgatggcaaccatatgtttgcaggacacttaaaatgcaaagtaagaatggaaaaattgagaattaagggaatgtcatatacgatgtgtagcggaaaattcagtattgataaagaaatggcagaaacccaacatggaactacagtcgtcaaggtcaaatatgaaggaacaggcgcaccctgtaaggttccaatagaaattcgtgatgtcaacaaagaaaaagtagtaggaagaattattagtagtactccatttgctgaaaacaccaactcagtaactaacatagaactagaaccaccttttggtgactcatatattgttataggagtcggggacggtgccttaacactgcattggtttcgaaaaggttctagtattggaaaaatgtttgaatcaacatataggggcgccaagcgaatggcgattttgggagagacagcatgggattttggtagtgtaggaggattactcacgagtctcgggaaagcagtacatcaagtatttggaagtgtttatacaacaatgttcggtggtgtaagttggatggtacgaattttaatagggttgctagtcttatggataggaacgaatagtagaaatacaagcatggcaatgtcttgtatcgctgttggcggaataacgctgttcctaggatttacagtacatgcagacatgggttgcgttgtctcttggagcggaaaagaactaaaatgcggttcaggaattttcgtaattgacaatgttcatacgtggactgaacaatacaaatttcaacctgaaagcccagcaagattagcttcagctatactaaacgctcataaagaaggtgtatgtggtataaggagtactacaagactagagaatgttatgtggaaacaaataacaaacgagttgaattatgtactatgggaaggagggcacgatcttaccgtggtcgccggtgatgtgaagggtgtgctcagtaaaggtaaacgtgcactggccccacctgtgaacgaccttaaatatagttggaaaacctggggaaaggcaaaaatctttacccctgaaactcgaaatagtacgttcctagtggatggtcccgacacttctgaatgtcctaacgaaagacgagcatggaattttctagaagtagaagattacggcttcggtatgttcaccacaaacatttggatgaagttccgcgaagggtcgcctgaagtatgcgaccacagactgatgtctgctgctataaaagaccagaaagcggtgcacgcagatatgggttactggatcgagtccagtaaaaatcagacctggcaaatcgaaaaagccagtttgatcgaagttaagacatgtttgtggcccaaaacacatacactgtggtcaaatggagtcttggaaagtcaaatgctgatccctaaggcttacgctggaccaatttcacagcacaattataggcaaggttacgcaacccagacagctggtccatggcacttaggaaaacttgagatcgactttggagagtgtcctggcactacggttacagtgcaagaagattgtgatcaccgaggacctagccttcgcacaactactgcctccggcaaattagtcacacaatggtgttgtcggagttgtacgatgcctccactgagatttctgggggaagatggatgttggtacggaatggaaattcgaccacttaacgagaaagaggaaaacatggttaaatcacaggtatcagccggacaagggacctcagaaacgtttagcatgggattattatgtctaactttgtttgtagaggaatgcttacgaagaagagtgacaagaaaacatatgatgttggtagttgttacaactttatgtgcaatcattttaggaggtctaacgtggatggatcttctacgggccctaatcatgctgggcgacactatgagtggacgtatgggtggacagatacaccttgcaattatggcagtatttaaaatgtctccgggatacgtgttaggaatattcctccgcaaactaacaagtcgtgaaacggcgctcatggtcataggaatggcgatgacgacggtccttgctataccgcatgacttaatggagttcatagacggaatatcattaggactcattctgcttaaaatggtaacacatttcgataatactcaagttggaaccctggcactagcgttaacattcataaagtctacaatgcctctagtgatggcatggcgaacgataatggcagtactgttcgtggtcactcttatccctttgtgtcgaacgtcatgccttcaaaaacaaagccattgggtagaaataacggcattaattttaggagcacaggccctaccagtctacctaatgacccttatgaaaggtgcctcaaagagaagttggcctttgaatgaaggtataatggcagtggggctagtatctctcttaggtagcgcccttctcaaaaatgacgtaccattagcagggcccatggtggctggtggtctacttttggcagcatatgtaatgagcggatcgagtgccgatttaagcctagagaaggctgcaaacgtacgctgggacgagatggcagacatcacaggctctagtccaattatagaagtaaaacaagatgaagatggatccttctcaatacgtgatgtagaggaaactaatatgattacgcttctagttaagctagcactaataaccgttagcggtctttatccactggccatcccagtgacaatgacattatggtatatgtggcaggttaaaacacaacgatccggtgctctgtgggatgttccttcaccagcagccgctcaaaaggcaacattgaccgaaggggtttatcggataatgcaacgtggattgtttggtaaaacacaggttggggtaggcattcatactgaaggcgtatttcacacgatgtggcacgtcacacgtggatcagttatatgccacgaatcagggagattagaacctagttgggcagacgtcagaaatgacatgataagttacggtgggggttggaggttgggcgataagtgggataaagaagaagatgtccaggtgttggcaatagaacctggcaaaaacccgaagcatgtacagacaaaacctggattgtttaaaacccttacaggggaaataggggcagtcacgttggactttaaacccggcacaagtggatctccgattatcaatagaaaaggaaaagtaatcggtttatatggcaacggcgttgtgactaaatcgggtgattatgtaagtgccataactcaagcagaaagaataggagaacctgactatgaagttgatgaagatatattccgtaaaaagcggttaactatcatggatttacacccaggtgccgggaaaacaaaaaggattttgccttcgatagttagagaagcacttaaacggcgattgcgtactttaatcttagctccgactcgagtggtcgcagccgagatggaagaagcattacggggccttcccattcgatatcaaacgccggcggtaaaatccgaacatactggaagggaaattgtagatttaatgtgtcatgcgacattcactacgagactattaagtagcacaagggtgccgaattataatttaatagttatggatgaagcgcattttactgaccctagttctgtagctgcccgaggttatatatcaaccagagtagaaatgggcgaagcagccgctatctttatgactgcaacgccacctgggactactgatccattcccacaatcaaattcaccaattgaagatatagaacgagaaataccagaacgaagctggaatacggggtttgattggatcactgattaccaaggtaagaccgtttggttcgtaccgtcaataaaagcagggaatgacattgcaaactgtctacgcaaatctggtaaaaaggtgatacaactaagccgcaagacatttgacacagaatatccaaaaacaaaattaacagattgggactttgtagtaacgacggacataagcgaaatgggtgctaacttcagggctggccgagttatagacccaagacgctgtctgaaaccagtaattctgacggatggacctgaaagagtgatattagccggtcccatacccgtaacgcctgcatcagccgcacagaggagaggtagaattggtcgaaaccccgcccaggaagacgaccaatatgtcttttccggtgaccctctacgaaacgacgaagatcacgcacattggacggaagcgaaaatgcttttggataatatctatactccagagggcataatccctactttattcggtcctgagcgcgagaaaacccaagcaatagacggtgagtttaggctacggggcgaacaaagaaaaacatttgtagaattaatgaggagaggcgatttacccgtatggctaagctacaaagtggcaagtgcgggaatatcctacaaagatcgtgaatggtgtttcaccggtgaaagaaataaccagatcctggaagaaaatatggaagtagaaatatggacgagagagggagagaagaagaaactgagacctaaatggcttgatgcaagagtatacgctgatccaatggcgctcaaagatttcaaggagttcgcatcgggaagaaaatccatcaccttggatatcctcacagaaatagcctctttaccgacatatttaagttcacgagctaaattagcattagataatatagtgatgttacataccaccgagcgtggtggaaaagcatatcaacatgcccttaatgaacttcctgagtctctggagacgttgatgttggttgcattattaggagcaatgacagcgggcatattcctattcttcatgcaaggtaaaggtataggcaaactatcaatgggacttatagccattgcagtagctagcgggctgttgtgggtggcggaaatacagccccaatggatagccgcttccattatattggagttctttctcatggttttattggttccagaaccggaaaaacaacgtacaccacaagataatcaactcatttacgtaatactgacgatactaacaataatagcacttgtagcagccaacgaaatgggattaatagagaaaactaaaactgatttcggtttttatcaagtaaaagcagaaacaactattttagacgttgatttacgacctgcgtctgcatggacactctatgctgtcgcaacaactatattgacgccaatgttaaggcatacgatagaaaatacatcggctaacctatcgctagcagcaatagccaaccaagccgcagtgctaatgggattgggaaaagggtggccattacatcgaatggatttaggagttccattacttgcaatgggatgttattcacaagtcaaccccaccacgttaacagctagtctagttatgttacttgtacattatgcaattattggccccggccttcaggcaaaagccaccagagaagcacagaaaagaacagcggcaggtattatgaaaaatcccactgtggatggaatcacggtaatagatttagaaccgatttcatatgatccgaaattcgaaaagcagttgggacaagtgatgctattagtattatgtgctggacaactactcttaatgcgcacaacatgggctttttgcgaagtactgacacttgcgaccgggccaatactaaccctttgggaaggaaatccaggccgtttttggaacaccacgattgcagtttcgactgccaacatattccgtggctcgtatttagcaggggcaggattggcttttagccttatcaagaatgctcaaacgcccagaagaggaacagggacaactggtgaaacgctcggggagaagtggaaacggcaactcaatagtttagatagaaaagagttcgaggagtataagagaagtggaatcttagaagtagacagaacagaggcaaagagtgcactcaaagacggatcaaagataaagtatgccgttagtcggggaactagcaaaatacgatggattgtggaacgtggaatggtcaaaccaaaaggaaaggtcgtagaccttggttgcggtcgaggaggatggtcttattacatggcgacactgaagaacgtaacagaagtaaaaggttacacgaaaggagggccgggacatgaagaacctataccaatggccacttatggatggaatctagtgaaattgcatagtggcgtagatgtcttttataaaccaacagagcaagtggacacattgttatgcgacataggcgaaagctcatctaacccaacaatcgaagaaggacgaactttaagggttctcaagatggtggaaccatggcttagttcaaaacctgagttttgtatcaaagttttgaatccttatatgccaactgtaatcgaagaacttgaaaaactgcaaaggagatatgggggtagtctagtccgctgtccactttcacgaaactcaacacatgagatgtattgggtttcaggggtcagtggaaacatcgtgtcttcagtgaatacgacttcgaagatgctactcaacagatttacaacccgacacagaaaacccacatacgaacgcgacgcagacctgggcgccggtacgagaagcgtatcgaccgaaacagaaaaaccagatatgacgatcattgggcgaagactgcaaagattacaagaagaacacaaagagacttggcattacgatcatgagaacccatatcgaacttgggcctaccacggaagttatgaagcaccgtctacagggtcagcctcatctatggtaaatggtgtagttaagttactcactaaaccttgggatgtcgtacccatggtaacgcaattggcaatgactgatacaacaccatttggacaacaacgtgtatttaaagaaaaagtcgatactcgaacgccacaacccaagccgggtacccgagtagttatgactacaacagctaattggctatggacactattaggtagaaagaaaaacccgaggttgtgtacaagagaagagttcatcagtaaagtgagaagtaacgccgctataggggccgtattccaggaagaacaaggttggacatctgcctccgaagcagtaaatgacagccgtttttgggagctagttgataaagaacgtgcgttacatcaagaaggaaaatgcgaaagttgtgtatacaacatgatgggaaaacgggagaagaaactgggagagtttggcagagcaaaaggaagtcgggctatttggtacatgtggttaggcgcgagattcctagaatttgaagccttaggatttttaaatgaagatcattggtttgggagagaaaattcttggagcggtgtcgaaggcgaagggttgcaccgtctcggatacatactagaggatatagacaagaaagatggagatctgatatacgcggacgatactgcagggtgggatacgagaattactgaagacgatctattaaatgaagaactgataactgaacagatggctccacatcacaaaattttagcaaaagcgatattcaaattaacatatcaaaataaggtagtgaaagttcttcggccaacgcccaaaggggcggttatggatattataagcaggaaagatcaaagaggttcaggacaagtgggaacctacggacttaacacatttacaaatatggaagtacaacttataagacaaatggaagctgaaggggtaataactagagacgatatgcataatcctaaaggtttaaaggagagggtagaaaagtggttaaaagagtgtggtgtcgatagacttaagcgaatggcaatatcaggcgatgactgcgtagtaaaacctctcgacgaaagattttctacgtccctactattcttaaatgatatgggaaaagtccggaaagatatcccacaatgggagccgtccaagggatggaaaaactggcaggaagtaccgttttgctcccatcattttcacaaaatatttatgaaagatggaaggagcttagtcgtcccctgcagaaaccaagatgaactgataggacgcgcacgtatatcacagggggccggttggagcttaagagaaactgcatgtcttggtaaagcatacgcacaaatgtggagtctaatgtattttcaccgacgtgatcttagattagcaagcatggctatatgttcagcggtacccaccgaatggtttccaacgagtcgaacaacgtggtctattcatgcacaccaccagtggatgactacggaggacatgctaaaggtctggaaccgcgtgtggattgaggacaatcccaatatgatagataaaaccccagtacatagttgggaagatattccataccttggtaaacgagaagacctgtggtgtggcagtctaattggcctaagtagccgtgccacttgggcgaaaaacatacatacagctatcacacaagtcagaaatctaataggcaaagaagagtacgtggattatatgccggccatgagaagatattcagcccactttgaaagtgagggcgtgctgtga

SEQ ID NO: 23650 - RNA, 9867 nt, synthetic construct
  misc_feature 1..9867: note = derived and/or modified CDS sequence (opt6) from DENV-4__JN638571__SS-prME
  source 1..9867: mol_type = other RNA
tcaacaataacattattatgtcttataccaactgttatggcatttcatttatcaactagagatggggaacccctgatgattgttgcaaaacatgaaaggggtagaccgttattatttaaaacaaccgaaggaataaacaaatgtacacttattgctatggatcttggtgagatgtgcgaagatactgtgacttataaatgcccacttctcgtcaatacggaaccggaagatattgattgctggtgtaatctcacttccgcatgggtgatgtacggtacctgcacgcagagcggtgaaagacgccgagagaaaaggtcagtagcgctcactccccattcaggaatgggtttagaaactcgcgctgaaacatggatgagttccgaaggcgcgtggaaacatgctcaacgagtcgaatcttggatactaagaaatccaggttttgccctactagccggttttatggcttatatgattggacaaactgggattcaaaggacggtgttcttcatattgatgatgttggtagcaccaagttatggaatgagatgcgtaggagtgggtaacagggatttcgttgagggagtgtcgggtggagcatgggtagacctagtactagaacacggaggctgtgtaacgacaatggcccaaggcaaaccgacattagattttgaactaattaaaactaccgctaaagaagtagcattattaagaacctactgtattgaagctagtatcagcaatataacaacagctacacgctgtccaacacaaggcgaaccgtatttaaaagaagaacaggatcaacagtacatatgtaggagagatatggtggaccgaggatggggtaacggatgcggactattcggcaaagggggagttgtaacatgtgcaaagttttcttgtctaggcaaaatcaccggtaacttagttcagatcgaaaatctcgaatatacagttgtcgtaaccgtacataacggagatacacacgccgtcgggaacgatacttctaatcacggtgttaccgcaaccataactcccaggtcaccaagtgtggaagtaaaattaccagagtacggtgaattgactcttgattgtgaaccacgtagtggtattgattttaatgagatgattttaatgaagatgaaaacaaagacatggttagtacataaacaatggtttttggacttaccattaccttggacaactggagcagatacccttgaggttcactggaatcataaagaacgaatggttacattcaaggtcccacacgcaaagaggcaagatgttacggtattagggagccaagagggagcaatgcattcagctctcgctggagcaactgaggtagatagcggtgatggcaatcatatgtttgcaggacatttgaaatgtaaagttaggatggaaaagttaagaataaaaggaatgagctacacaatgtgcagtggaaagttttcgatcgacaaagagatggcagaaactcaacacggtacaacagtagttaaagtcaaatacgagggaacaggagcaccatgcaaagtgcctatagagatacgagatgtaaataaagaaaaagtcgtaggacgaataatttcaagtacaccgtttgccgaaaataccaattccgtgacaaatatagaactagaacccccatttggcgattcatatattgttataggagttggagacggagcgctcacgctccattggtttcggaaaggatcttcgataggaaagatgttcgaatcgacttatcgcggcgccaaacgaatggcgattctaggagaaacagcatgggacttcggaagtgttggtggcttattaacttcgttggggaaagcagtacaccaggtctttggatcagtttatactactatgtttggtggagtaagctggatggtgcgcatcttaattggactattagttttatggataggaactaattccagaaataccagtatggcgatgagctgtatagccgtaggtggtattacactatttctgggttttactgtgcatgcagatatgggatgtgtagtttcatggtccggcaaagaattaaaatgtggatcaggcatatttgtgatagataacgtccacacttggacagaacagtacaaattccaaccagagtcacccgcgagattagcctcagcaatcctaaatgctcataaagaaggagtatgtggaataagatcaacgactaggctagaaaacgttatgtggaaacaaataactaatgagttaaattatgtcctatgggaagggggtcatgacttaactgtggtggctggtgatgtaaaaggagtcttgtcgaaggggaaaagggcattggcaccccctgtaaacgatctcaaatattcctggaaaacctggggtaaggctaaaatattcaccccagaaacacgaaattcaactttcttggtagacggtcctgacacgtctgaatgcccaaacgaacgtagggcctggaattttctggaagtagaagattacggattcggcatgtttactacaaatatttggatgaaattccgagagggaagcagtgaagtatgcgatcatagactaatgagcgcagcaatcaaagaccaaaaagcagtgcacgctgatatgggatattggattgaaagcagcaaaaatcaaacttggcagatcgagaaagcatctctaatagaagtaaagacatgcttatggcccaaaacacatactctatggagcaatggagtgctagaaagccagatgttgatcccaaaggcgtacgctggacccatatcgcaacataattatagacagggatacgccacgcaaacagctggcccttggcatttaggcaagttagagatcgatttcggggaatgtccaggaactacagtcaccgttcaagaagactgcgatcataggggaccgagtctacgaacaacaacagcgtccggaaagctagttacccaatggtgttgtagaagttgtacaatgccgccccttagattcctaggtgaagatggttgttggtatggtatggagataagacctttaaacgaaaaagaagaaaacatggtgaagtcccaagtttcagcgggtcagggaacatcagaaacgtttagcatggggttgttatgtttaactttgtttgtagaagaatgtttacgacgaagagtcactagaaaacacatgatgttagtagtagtcacaactttatgcgctattatactgggaggtctaacatggatggatcttcttagagccctcataatgttaggtgacacgatgtctgggagaatgggtggacaaattcacctcgcaataatggctgtatttaagatgtcaccaggatatgtattagggatattcttacgtaaattgaccagtagagaaactgcacttatggttataggtatggctatgacaacagtattagcaatacctcatgatttaatggaatttatagacggtatctctctcggattaatattactaaagatggtaacacattttgataacacacaagttggaactctagcactagcactcacgttcatcaaaagcaccatgccccttgtaatggcatggcgtacaataatggccgtactttttgtggtaactctaatcccattgtgtagaacaagttgtctgcaaaaacagtctcactgggtagaaattaccgcgctaatacttggtgcccaggcactaccagtgtacttgatgaccttgatgaaaggagctagtaagcgcagctggccattaaatgagggtatcatggcagttggattggtgtctttgttaggttcggcgttgctgaaaaatgatgtacccctagcgggtcccatggttgccggtggcctacttctcgctgcatacgtcatgagcggatcttcggccgacctttctctagaaaaagcagcaaatgtcaggtgggacgaaatggcggatataaccggctcatcacctattatagaggtaaagcaagacgaagatggttcctttagtattagggatgtcgaagaaacgaatatgataacattgctagtaaaattagcattgataacagtatcaggtctttatccattagccatacccgttacaatgacactgtggtacatgtggcaagtaaagacccaaagaagcggagctctatgggatgtgccgtcccccgcagcggcgcagaaggcaactttaactgagggcgtataccggattatgcaacgtggtttatttggtaaaactcaagtgggcgtaggtatccatacagagggagtatttcacactatgtggcatgtaacgagaggatctgtgatttgccatgaaagtggccggctcgaaccttcctgggcagacgtgaggaacgatatgataagttacggtggcggatggaggctcggcgacaaatgggacaaagaggaggacgtacaagtgttagccatcgaacctggcaaaaatccgaagcatgtacaaacgaaaccaggcttatttaagaccctaactggcgaaattggggctgtaacattagattttaagccaggaacatctgggagccctataatcaatcgcaagggaaaggtgattggcctatacggcaatggtgtagttacaaaatcaggagactatgtcagtgcgatcacacaagcagaaagaattggagaaccagactacgaagtggacgaagatatttttcggaagaaaaggttaacaataatggatttacaccccggtgcaggtaagacaaaaaggatactaccatcaattgtacgggaagcgttaaaaagacggttaagaacactaattcttgcgcctactagggtggtagcagcagaaatggaagaagccttacgcggtctgcctatacgataccagacccctgctgtaaaatcagagcacacaggacgtgagattgtagacctgatgtgtcacgcaacgttcacgactagacttctttcaagcacaagggttccaaattataatttgatcgtcatggatgaagcccacttcacagatccgagcagcgtagccgctagaggttacatcagtacacgcgtagaaatgggagaggcagctgcaatctttatgaccgccaccccaccgggaactaccgacccatttcctcaatcaaattcgccgatagaggacatcgaacgtgaaattccagaaagaagttggaatacgggattcgactggattacagactatcaaggcaaaactgtctggttcgtaccgtccattaaagcaggtaatgatatagccaactgtctaagaaaaagtgggaagaaagtgatacaactatcacgtaagacgtttgataccgagtacccgaaaacgaaattaactgactgggatttcgtagtgacaactgatatttcagaaatgggagcaaacttcagagccggaagggtgattgatccccggaggtgtctaaaaccggtcattctaactgatggaccagaaagagtaatcctagctggaccaatacctgtgacaccagcatcagcagcgcaacgtaggggccgaataggaagaaatccagcgcaggaggacgatcaatatgtattcagtggcgatccattaagaaacgatgaggaccacgctcattggaccgaagcaaaaatgcttttagacaacatatatacgcccgaaggtataatcccaacactattcggaccagaacgagaaaagacacaagcaatagacggtgaatttagactgcgaggggaacagagaaaaacatttgtcgaattgatgaggagaggagacctaccagtttggctgagttacaaagttgcgtccgcaggaattagctacaaagacagagagtggtgcttcaccggagaaaggaacaaccaaatacttgaagaaaacatggaagtagaaatttggacaagggaaggagagaagaagaaactccggcccaaatggctggacgctcgggtatacgctgatcctatggcactaaaagatttcaaagaatttgccagcggacgtaaaagtatcacccttgacatacttacagaaattgcgtcactaccgacctacctatctagtcgcgctaaattagcgttagacaatatagtaatgttacatacaacagaaagaggcggcaaagcctaccaacacgccttaaacgaactaccagagtccttagaaactctgatgctggtagctttacttggagcaatgactgcagggatatttttattctttatgcaaggtaaaggtataggtaaattatcaatggggctgatagcaatcgcagtggcttctggtctattgtgggtagccgaaattcaaccacaatggatagctgcctcaataatattggaatttttccttatggtattattggtccctgaacctgaaaaacaaaggacgccacaagacaaccagttaatatacgtgattctcacaatactaacaataatcgcactggtagccgcgaatgaaatggggctcatagagaaaacaaaaacagacttcggattctaccaggtaaaagcagaaactaccattcttgatgtagaccttcgtcctgcatcagcatggacactgtatgcagttgctacaaccattttaacgcccatgctaagacacaccattgaaaacacttctgctaatttaagtctggctgcgatcgctaatcaagcggcagttttgatgggattaggcaaagggtggccattacaccgtatggatttaggagttccactactcgctatggggtgctactcacaggttaatccaacaactttaaccgcttcgttggttatgttattagtgcactacgcaatcattggtccgggtttacaagcgaaagcgactagggaggcacagaaaaggaccgccgcaggtattatgaaaaatccgactgtcgatggcataacggttatcgatctggaacccataagctatgacccaaagttcgagaaacaattaggtcaagtcatgttactcgtactttgtgcaggacaattgttattaatgagaacaacctgggcattctgtgaagtccttacattagcgacgggaccgatactaactttatgggaagggaatccgggccgattttggaataccaccatcgcagtaagcacagccaatatttttcgaggtagctatctcgcgggagcaggtctagcgtttagcctcatcaaaaatgctcagactccacgacgaggaacaggcacaactggagaaacacttggcgaaaagtggaagaggcaattaaattcattagaccgaaaagaatttgaagaatacaaaagaagtgggattctcgaagtagatagaaccgaagcaaaaagcgccttaaaagatggttcaaaaataaaatacgcagtatcccgtgggactagcaaaatcagatggattgttgaacggggcatggtgaaaccaaaagggaaagttgtagatctcggctgtgggagaggaggttggtcctattacatggctacattgaagaacgttactgaggtaaaaggttataccaagggaggcccaggtcatgaagaaccgataccgatggctacatacggatggaacttagtgaagttacactcgggtgttgatgtattttataaacctactgagcaagtagatactctgctatgtgatataggtgaaagttctagcaatcccacaatagaagaaggacgcaccttacgagtgttgaagatggtcgaaccctggcttagttcaaaaccggaattttgcattaaagttttgaatccttatatgccaactgtaattgaagaactagaaaaattgcagcggcgatacggaggttctttagttaggtgcccgcttagtaggaactcaacacatgaaatgtattgggtttcgggagtatcaggtaatatagttagcagcgtcaatactacaagcaaaatgctcttaaataggttcacaacgcgccatcgtaaacctacctacgaaagggacgctgatttaggtgcgggaactcggtcagtgtccaccgaaacggaaaagccggacatgacaataataggtcggaggttacaacgattacaagaggaacataaagagacctggcattacgaccacgaaaatccttatagaacttgggcgtatcacggctcatacgaggcccccagtactggatctgccagtagtatggttaatggcgtggttaaattactaacaaaaccgtgggacgtggtcccaatggtcactcaactcgcgatgacagacacaacgccattcggccagcagcgcgtttttaaagaaaaagtcgatacccggacacctcaaccgaaaccggggacaagagtggtaatgacaacaacagcaaactggctctggacactgttgggaagaaagaaaaatcctcgcttgtgcacaagggaagagttcatatctaaggtaaggcttaacgcagcaatcggcgcagtattccaggaagaacaaggatggacatcagcaagtgaagcagtaaatgactcacgattttgggaactggtcgacaaagaacgggccctccatcaagaaggtaaatgtgaatcctgtgtatacaatatgatgggaaaaagagagaagaagctgggggaatttggccgggctaaaggatctcgagcaatatggtacatgtggttaggtgcaagattcctggaatttgaggcgttgggctttctaaatgaagaccattggtttggacgagaaaacagctggtcgggagtagaaggcgaggggttacacagactaggctacatacttgaagatatagataagaaagatggtgacctaatatacgcagatgacacggcgggatgggatacaagaataacagaagatgatttacttaacgaagaattaataactgaacaaatggctccacatcacaaaattttagcaaaagcaatatttaaactgacttatcagaacaaagtggtgaaagttctaagacctacaccgaaaggcgcggtaatggacataattagtcgtaaagatcaacgaggaagtggacaagtaggtacttatggattaaatacatttacgaacatggaggttcaattaataagacagatggaagcagaaggtgtaatcacaagggacgatatgcataacccgaagggtctgaaagaaagagtggaaaaatggttgaaagaatgcggagtcgatcggctaaaaagaatggcaatatctggggatgattgtgttgtaaaaccactcgacgaaagattctcaacaagtttattattccttaatgacatggggaaagtgaggaaagacatcccacaatgggaaccctcaaaggggtggaaaaattggcaagaggtaccattctgttctcatcacttccataaaatatttatgaaagatggtagatccttggtagttccttgtagaaaccaagacgaacttattggccgggccagaattagtcaaggtgctggttggtctctacgcgaaactgcttgtcttggaaaggcatatgcacaaatgtggagtttaatgtattttcatagacgtgacctaagattggcatcaatggcaatctgtagtgcagtgcccactgagtggtttcctacttctagaactacttggtcaatacatgcacatcatcagtggatgacaacggaagatatgttaaaggtctggaaccgtgtatggatagaagataatccaaacatgatcgataaaacaccagtccatagctgggaagatataccttacctgggcaagagagaagatctatggtgtggaagccttatcggattaagttcacgcgcaacttgggctaagaacatacacacggcaattacgcaagtccgtaaccttataggaaaagaagagtatgtggactacatgccagccatgcggagatattcggcgcactttgaaagcgagggtgtgttataa

SEQ ID NO: 23651 - RNA, 9867 nt, synthetic construct
  misc_feature 1..9867: note = derived and/or modified CDS sequence (opt6) from DENV-4__JN638572__SS-prME
  source 1..9867: mol_type = other RNA
tcaactatcacgctactttgcctaattccaaccgtgatggcattccatttgtctactagggatggtgaaccactaatgatagtagctaaacatgaacgcggacgtccactgctgtttaaaactaccgaagggataaacaaatgtacattaattgctatggacttaggagaaatgtgtgaagacacggttacctataaatgcccattactcgtcaacacagaacctgaagatatagattgttggtgtaatctgacaagtgcttgggtgatgtatggaacatgtacccaatcaggagaacgcaggagggaaaaacgatcagttgcacttacaccgcattccggtatgggactcgaaacaagggcagaaacatggatgtcaagtgaaggagcatggaaacacgcccaaagggtggaaagttggattttacgaaaccctggatttgcacttttagcggggtttatggcatatatgataggccagactggaatacaaagaacagtatttttcattctgatgatgctagttgcgccttcttatggtatgagatgtgtaggcgtcggcaacagagacttcgtcgaaggtgtttcagggggcgcttgggtagacttagtactggaacacggaggctgtgtaacaacaatggcacaaggtaaaccaactctggatttcgaattaataaaaaccactgctaaagaagtagccttactaagaacatactgtatcgaagcatctatttcgaatataacgacggcaacacgttgtccgactcaaggtgaaccatatttaaaagaagaacaagatcaacagtacatctgtagaagagacatggtagatcgagggtggggtaatggatgcggtttattcggaaaaggaggggtagtaacatgtgccaaattttcatgtctcggaaaaattacgggaaaccttgtacaaattgaaaatctggaatatacagtagttgtaacggtacataacggtgatacacatgccgttggcaacgacacgtccaatcacggagttactgccacaataactccaagaagcccatccgtagaagtcaagctccctgaatacggtgaattaacacttgactgcgagcctagatctggtatagattttaatgaaatgatattaatgaaaatgaaaacaaagacttggttagtgcacaaacagtggttcttggacctaccgctaccatggaccaccggcgcagatacgttagaagttcattggaaccataaggaaaggatggtcacgtttaaagtgccgcatgcaaagagacaggatgtcacagtgctggggtcccaggagggtgcaatgcattctgcccttgctggggcaaccgaagtggacagtggagatggaaatcatatgttcgcaggccatttgaagtgtaaagtcagaatggaaaagctgaggataaaggggatgtcgtatacgatgtgtagtggtaaattctcgatcgataaagaaatggctgaaacccaacacggtaccactgtggtcaaagtgaagtatgagggtacaggagctccgtgcaaagtgcccatagagatacgagatgtaaataaagaaaaagttgtaggcagaataatatcgtcaacaccgtttgcagagaacacaaatagtgttactaacattgaattagaaccaccctttggcgacagttatatagttattggtgtcggagacggagcccttaccctccattggtttcgtaaggggagtagtataggtaagatgttcgaatcgacgtaccggggagcgaagaggatggcgatactgggcgaaacggcatgggatttcggttctgttggagggctcttaacaagccttgggaaggctgtgcatcaagtgttcggaagtgtatatactacaatgttcggcggtgtgagctggatggtaagaatattaataggcctattggtactgtggatagggacaaatagccgtaatacaagtatggccatgtcttgcatagccgtcggaggaataactttattccttggatttacggttcatgcagacatgggatgcgtggtttcttggtctggtaaagaacttaaatgcgggagcggtgtattcgtaatagacaacgtgcacacatggacagaacaatataaattccaaccagaaagccctgctcgccttgcctccgctatactcaatgcacacaaagaaggagtatgtgggattcgaagtacaacacgactagaaaatgtaatgtggaaacagattacgaatgaactcaattacgtcttatgggaaggtggccacgatctaacggtcgtagctggtgacgtgaaaggagtacttagtaaaggaaagagagctctagctccacctgtaaacgatttaaaatatagctggaaaacttggggaaaggcaaaaatatttacgccagagacacgaaactccaccttcttagtagatggaccagatacctcggaatgcccaaatgaaagaagggcatggaatttcctcgaagtggaagattatggttttggaatgttcaccactaatatatggatgaaatttagagaaggaagctcagaagtatgtgatcacagacttatgtcggctgctataaaagaccaaaaagcagtacacgcagatatgggttattggatagaatcgtccaagaaccaaacttggcaaatcgaaaaagcaagtttaatagaagtaaaaacatgtctctggcccaagacacacacattgtggtcaaacggagtcttggaatcccaaatgctaatcccaaaagcatatgcaggcccaatatcacaacacaattatcggcaaggatatgcaactcagacagcaggaccctggcaccttggaaaattagaaatagatttcggagagtgtccggggactacagtcacagtacaagaagattgtgatcataggggtccatcattaagaaccacaacagcttctgggaagttagtgacgcaatggtgttgcaggagttgtactatgccaccactacgatttttaggcgaagatggatgctggtatggcatggaaatcagaccgcttaacgaaaaagaagagaatatggtcaaaagccaagtttcagcaggtcaaggtacctcagaaacattttccatggggttattatgtcttacgttattcgttgaagaatgtttaaggcggagagtcactcgtaaacatatgatactggtggtagtgacgaccctttgtgccattattctaggcggactaacttggatggatcttcttcgtgcccttataatgctcggagatacaatgtctggtcgcatgggcggccaaattcatctagcaattatggcagttttcaaaatgagtcccggatacgtattaggcatattccttcgcaaacttacatcacgggagacggcattaatggtaatagggatggcaatgaccactgttttggccattccccatgatttgatggaatttattgatggaatatccttaggcctaatattacttaaaatggtaacacacttcgataatacacaggttggtactctagcattagcgctaactttcattaaaagtactatgcctcttgtaatggcatggagaaccataatggcagtactattcgtagtcacgctaatccccttatgtcgaacatcgtgtttacaaaaacaaagccactgggtagagattactgcactaatattaggcgcccaggctttgcctgtctatctaatgacactaatgaaaggagctagtaaaagaagctggccgctaaacgaaggtattatggctgtcggcctagtcagcctgttaggatcagcgctgttgaaaaatgatgtccctctagcaggacccatggtggctggaggtttattgctagcagcttacgtaatgagtggcagctcagcagatctatccctagaaaaagcagcaaacgttagatgggatgaaatggctgatattacgggctcatctcctatcatcgaagtgaaacaagatgaggacggaagtttttctatacgggacgtagaagaaacaaatatgataactcttcttgttaagctagcgctaatcaccgtttcagggctatacccgttggccataccggtaacaatgacactatggtatatgtggcaggtcaaaacgcagcgatctggggcattatgggatgttccatcccccgcggccgcccaaaaagcaacgttaaccgaaggagtttaccgaataatgcaaaggggtctgttcggaaagacacaagttggggttggcattcatacagagggtgtgttccacacgatgtggcacgtgacaagagggagtgtcatatgccatgagagcggtaggctagaacctagttgggccgacgtgaggaatgacatgatttcctacggtggagggtggcgacttggagataagtgggacaaggaggaggatgtacaggtattagcaatagaaccaggaaagaatccaaaacatgtccagacaaaacctggtttattcaaaacactaaccggtgagataggtgccgtaactttggattttaaaccgggcacctcgggcagccctataattaatagaaagggaaaagtcattggcctgtatgggaacggagtggtcaccaagtcaggtgactacgtatcagcaattacacaggcggaacgaatcggagaaccagattatgaagtggacgaggatatattccggaagaaacgactcacgattatggatttgcatcccggagctggaaaaacaaagcgtattttgccaagtatagtacgggaagcactgaaacgacgactccgaaccctaatcttggctcctacgcgggtcgtagctgctgagatggaagaggctttgagaggtctgcctataaggtatcaaacccccgctgtcaagagcgaacacaccggacgagaaattgtcgaccttatgtgccacgcaacttttacaacgcgattactttcaagtaccagagtaccaaactacaatcttatagtaatggacgaagcacatttcacagatccatcatcagtagctgcaagaggttatataagcacaagagttgaaatgggtgaagccgcagcgatctttatgacagctacaccacctgggacgactgatccgttcccacagtcaaattcccctatagaagacatcgaaagagagatacccgaaagatcatggaataccggttttgattggattactgattaccagggtaaaacggtgtggtttgtgcccagcataaaagcaggtaatgacatcgcaaactgtcttaggaaatcaggcaagaaggtaatacaattatctagaaagacttttgacactgaatacccaaaaacaaaactaacagattgggattttgtagttactacggatatttcagaaatgggggcaaactttcgtgccggcagagttattgacccgagaagatgcctgaaacccgtgatattgacagatggaccagaaagagttattttggctgggcctataccagttacaccggcgtctgctgcccaacgtcggggaagaatagggcgcaatccagcgcaagaagatgatcagtatgtctttagtggggatcctttaagaaacgacgaagatcatgctcattggacagaagcaaagatgctactagataatatatatactcccgaaggaattataccaacattattcggcccagagcgtgaaaagacacaggcaatagacggggagttcaggttgaggggagaacaacgaaaaacattcgtagaattaatgagaagaggcgacctacctgtttggttgtcctacaaagttgcatctgcaggcatatcgtataaagacagagaatggtgtttcacaggcgaaagaaacaatcaaatattagaagaaaatatggaagtagagatatggactcgcgagggtgagaaaaagaaattaagaccaaaatggttagatgcgagggtatatgcagatcctatggccctgaaagattttaaagaatttgcatcaggtagaaaatcaataactttggacatattaacggaaattgctagcttacctacatatttaagctcgagagctaagctagcactcgacaatatagtaatgctacacacaacggaaaggggaggaaaagcataccaacacgcacttaatgaactaccagagagcttagaaactctcatgctagttgcacttcttggagctatgacggcaggtatatttcttttctttatgcagggtaaaggtattgggaaattaagtatgggactaattgccatcgcggtcgcctcgggattgttatgggtagctgaaatccaaccacaatggattgcagcatcgataattttagagttctttttgatggttttactcgtcccagaacctgaaaaacaacgaacacctcaagataatcagctcatctacgtaattttaactatactgactataatagctctagtagcagcaaatgaaatgggactcatagagaaaacgaaaacagattttgggttctaccaggttaaagcagaaactacaattttagatgtcgaccttagaccagcttcggcatggacattatatgcagtagcgacgacaatcctaacacccatgttacgacatactatcgagaacacaagtgctaacttatctttagcagcaatagctaatcaggcagcagtgttaatgggcctaggtaaagggtggcctttacaccggatggacttgggcgttccactattagctatgggatgctattcacaagttaacccaactactctaactgcatcattagtcatgctcctagtccattacgcaatcattggacccggtctccaagctaaagcaacacgggaagctcaaaagaggactgctgcaggtattatgaaaaaccctactgttgatggaatcacagtgattgatttagaaccaattagctatgatcctaaattcgaaaaacagttgggacaagtaatgctattggtgctttgcgtaggccagctattattaatgagaaccacatgggcattgtgtgaagtccttacattagcaacaggtccaattatgactctatgggaaggaaacccgggcaggttttggaataccaccatagcagtaagtactgccaatatatttagaggatcatatctagccggagctggactagccttcagcttgatcaaaaacgcgcaaacacctaggcgaggtacagggactacaggagagacgctcggtgaaaagtggaaacgtcagctcaattcgttagatagaaaagagttcgaggaatataaacgtagcggcatcttagaagtagataggactgaagcaaaatcagcactacgtgatggatcgaaaacaaaacacgccgtaagtcgggggtccagtaaaatcagatggatagtagagaggggaatgataaaacctaaaggaaaagtggttgatttaggatgcggcagaggtggttggtcatattatatggcgacgcttcaaaacgttaccgaagttaaagggtatacaaaagggggtccaggccatgaggaaccaatacctatggctacatacggttggaatctggttaaattgcactctggagtagatgttttctacaaaccgacagaacaagtggacactcttctgtgtgatataggggagtcatcctcaaaccctacaatagaagaaggtagaaccctcagagttttaaaaatggtagaaccttggttatcgtcaaaacctgaattttgtataaaagtactaaatccatatatgcctactgttatcgaggaactggaaaaactacagaggaggtacggtgggagtctcgtacggtgccctttgagtagaaattctacacatgaaatgtattgggtgtctggagtatctggtaatattgtttcaagtgttaacacaacttcaaaaatgttactaaatcggtttactacgagacatagaaaaccaacctacgaacgggacgcagatttaggtgcaggaactagaagcgtttcaacagaaacggaaaaacctgacatgactataataggccgccgattgcaaagattacaggaagaacataaagagacctggcattacgaccatgaaaatccctacagaacttgggcttaccacgggtcatacgaggcaccaagcacgggatccgcaagttcgatggtaaacggagttgttaaattgctcacgaaaccatgggatgtagtgcccatggttacacagttagccatgacagacacaacaccttttggtcaacagagagttttcaaagaaaaagtcgacactaggaccccacaacccaaacctggaactcgcgtagtaatgacaaccacggctaattggctttggacactcttaggaagaaagaaaaacccacgcctatgtacacgggaggagttcatttcaaaagtgagatcaaacgcagcaataggggcagtatttcaagaagaacaaggatggaccagcgcaagtgaggctgttaatgactcaaggttttgggagcttgtcgataaggaacgtgcattacaccaggagggaaagtgtgaaagctgtgtatataatatgatgggtaaacgtgagaagaaacttggagagtttggacgagcaaagggctctagggctatatggtatatgtggctgggggcacggttcttggaatttgaagcgctaggcttcttaaacgaagatcactggttcgggagggaaaatagttggtcaggtgttgaaggcgaaggtttacatcgcttaggatatatattagaagacattgataagaaagatggtgatttaatctatgcggatgacactgccggctgggatacacgaataacggaagatgacttactaaatgaagaactaattacagaacaaatggccccacaccacaaagttttagccaaggccatttttaagttgacgtatcaaaacaaagttgtcaaagtacttcgccctaccccaaagggagccgtaatggatattatatcaagaaaagatcagcgagggagcgggcaggtaggaacttacggtctcaatacatttacaaatatggaagtccaattaataagacagatggaagcagaaggagttataaccagggatgacatgcataatcccaaaggcttaaaggaaagagtggagaagtggttaaaagaatgcggagtagacaggctgaaaaggatggccatctcaggagatgactgtgtcgtcaaaccattggatgaacgtttttcaacttctttactattcttgaacgatatgggtaaggttagaaaagatatcccacaatgggagccgtcgaaaggctggaaaaactggcaagaggttccattctgttcccatcatttccataaaatatttatgaaagatggtagaagcctagtggtaccatgcagaaatcaagatgaacttattggacgagcacgcattagtcaaggtgcaggctggagtttacgggaaacagcatgcctaggtaaggcttacgcccagatgtggtcgctaatgtacttccatcggcgggatctgcgccttgcctctatggctatttgtagcgcagtacctacagaatggtttccaacttcccgtacaacctggtcaatacatgcacatcatcaatggatgactaccgaagacatgctaaaggtatggaatagggtatggatagaagataaccctaatatgactgataaaacgccagtacattcttgggaggatataccatatctaggtaagcgtgaagatttatggtgcggatcattgataggacttagttcaagggcgacatgggccaaaaacatacatacggcgataactcaagtacgaaatctaatagggaaagaagaatacatggactatatgccagttatgaaaagatactcagcaccaagcgagtcagaaggagtcttgtga

SEQ ID NO: 23652 - RNA, 9867 nt, synthetic construct
  misc_feature 1..9867: note = derived and/or modified CDS sequence (opt6) from DENV-4__JX024757__SS-prME
  source 1..9867: mol_type = other RNA
tctacgatgacacttttatgcttaattccaactgtgatggcgttccacttaagtacgcgtgacggtgaaccattaatgatagttgcaaaacatgaacgagggcgccccttgttatttaaaactaccgaaggtataaacaaatgcacactaatagctatggatctaggagaaatgtgcgaagatacagtgacttataaatgtccattgttggtgaacaccgaacccgaagatatagattgttggtgtaatttaacttcgacgtgggtaatgtacggaacatgtacgcaatctggtgaaaggcgcagggaaaaacgttcagtggctttaactcctcattctggaatgggactggaaacaagagcagaaacatggatgtcctcggaaggtgcttggaaacatgcacaaagagttgaaagctggattctcagaaaccccgggttcgcactactagcaggctttatggcatatatgattggtcaaaccggtattcaaaggaccgtctttttcgtattgatgatgcttgtagcaccttcttatggaatgcgttgcgtaggtgtcggaaatcgcgattttgtggaaggtgttagtgggggagcatgggtcgaccttgtgttagaacacggcggatgtgttacaacgatggctcaaggaaaaccaacattagacttcgaattaacaaaaacgactgctaaagaagtcgctttactaagaacttattgcattgaagcctcgatatctaacattactacagcaacacggtgcccaacacagggcgaaccctacctgaaagaagaacaagaccaacagtatatctgcagacgtgatgttgtagatcgaggttgggggaatgggtgtggactattcggaaaaggtggagtggttacttgtgccaaattcctgtgtagcggcaaaatcacgggaaatctggtacagatagaaaacttagaatacactgtggttgtgacggttcacaacggagatactcatgctgtgggaaatgatacgtctaaccatggagtaacagcgactataactcccaggtcaccgagcgtagaagttaaattacccgactatggagaattaacccttgactgcgaacctcgatccggaatcgatttcaatgaaatgatacttatgaaaatgaagaagaaaacctggctggtacataaacaatggtttctggatttgcctttaccgtggtcagcaggcgcggatacttcagaagtgcactggaattacaaagaaaggatggtgacatttaaagtccctcatgccaaacggcaagacgtgactgtcttaggctcacaagaaggtgcaatgcactccgcattggcaggagcaactgaagtggactcaggcgacggcaaccacatgttcgcaggacatctcaaatgtaaagtaagaatggaaaaacttagaataaaaggaatgagttacacgatgtgttctggcaaattctcaattgacaaagaaatggctgaaactcaacatggaaccacagtggtaaaagtgaaatatgaaggtgcaggagctccatgtaaggtacctatagaaatacgagatgtcaataaagagaaagtagtagggagaataatatcatcaacccctttcgctgaaaacactaactcagttaccaatatcgaattagaacctcctttcggggattcttacattgtcataggagtgggagattccgccttaactttacactggtttcgaaaaggtagtagtatcggaaaaatgtttgaatcgacctaccggggtgcaaaaaggatggcgattctaggggaaactgcgtgggattttgggagtgtaggaggactgtttacatcgcttgggaaggcagtccatcaggtatttggcagtgtctatactacgatgtttggcggggtatcatggatgataagaatacttataggattcttagtcctctggataggaacaaacagtaggaatacctccatggcgatgacatgtatagcagtcggtggcattacattatttttagggtttactgtacaggcagacatgggttgtgtcgtatcttggaatggaaaagagctcaaatgcggctccggcatattcgtagttgataatgttcacacatggacagaacaatataagtttcagcccgaaagtccggcacgactagcctcagccatactgaatgcacataaggatggcgtatgtggaatacgctctacaactcgcctggagaacgtaatgtggaaacaaattacgaacgaactaaactatgttctctgggaaggaggccatgatctcaccgtagtcgctggtgatgtaaagggcgtcttaaccaaaggaaaacgagctttaacccctccggttaacgacttaaaatatagttggaaaacctgggggaaagcaaaaatttttacacccgaagcacgtaattctacattcctaatagatggtccggatacatcggagtgtccaaatggtagacgcgcatggaactttttggaagtcgaggactatggttttggcatgtttacaaccaacatatggatgaagtttcgagaaggatcctctgaagtttgcgatcatcggctaatgtcagctgcaataaaagatcagaaagcagttcacgccgacatgggatactggatcgaatctagtaagaatcagacatggcaaatagaaaaggcttcactaattgaagtgaagacatgcttatggccaaaaactcatacattatggtccaacggagtattagagtctcaaatgttaatcccacgctcctatgctggaccattctcacaacacaattaccgacaagggtatgcgactcaaacggccggtccatggcatttaggtaaacttgagattgattttggcgagtgtccaggcacaacagtgaccatacaagaagactgtgatcatcgtggcccaagcctacgtacaacaaccgcttcgggtaagctagttacccaatggtgttgccgcagttgcacaatgcctccactacgattcttgggagaggatggttgctggtatgggatggagatcagacctttatcagagaaggaagaaaatatggtgaaatcgcaagtaactgctggtcaagggacgtcagaaacatttagcatgggtttattatgtctaacactattcgtagaagaatgtctacgcaggagagtaacgagaaaatatatgatgttagtagtcgtgattactttttgtgcgatcatattaggtggtttaacttggatggacttactgcgtgcattaataatgttaggtgatacaatgtctggccgaattggcggacaaattcatttagcaattatggcagtatttaagatgtctccaggttacgtattgggagtatttcttcgaaaactgacatcccgggaaactgcactaatggtaataggtatggcaatgacaacagttttctctataccgcatgacttaatggagcttattgacggaatttcgcttggactaattttgctacgtatagtaacacacttcgacaacacccaagttggcacactggctttgagtttaacgttcataagaagtactacaccgctagtcatggcatggcgaacaatcatggccgtattcttcgtggtcacacttataccactttgtaggacgtcctgcttacaaaaacaatcgcactgggtagaaatcacggcactcatcctaggggcgcaggcattaccagtatacctaatgacactcatgaaaggagctagcagaaggagctggccactgaatgaagggattatggcagtgggcctagtttcgttactcggaagtgcattacttaaaaatgacgtgcctttggcaggaccgatggtagctggtggactgttactggcagcatatgtgatgagcggatcttctgccgatctttcactagaaaaagcggcaaacgttcagtgggatgaaatggcagacataacaggtagcagcccaataattgaggtcaaacaggatgaagacggatctttttcgatacgagatgtagaggaaacgaacatgataactcttcttgtgaaactggcactcataaccgtatctggcttataccccctggccataccagttaccatggcattatggtatatttggcaggtcaaaactcaacgcagcggtgcgttatgggatgtaccatctcctgccgctacacaaaaggcgacattaagtgaaggagtttacaggatcatgcagcgcggcttattcggtaagacccaagtgggcgtaggcatacacatggaaggcgtttttcatacgatgtggcatgtaacgaggggaagtgtaatttgccacgaaactggtcgattggagccttcgtgggcagacgtgagaaacgatatgatttcatatgggggagggtggcgactaggagataaatgggacaaagaggaagatgtacaggtattggcaattgaaccaggtaaaaatcccaaacacgtacaaacaaagccaggcttatttaaaacactaaccggtgagatcggagctgttactttagattttaagccaggaacctccggctcgcccattataaataaaaaggggaaagttatcggactatacggaaatggcgttgtaactaaaagtggggattacgtgagcgctataacccaggcagagagaataggagaaccagattacgaagtggatgaagatattttccgtaagaaaaggttgacaattatggatctccatccaggtgctgggaaaacaaaacgcatcctaccaagcattgtaagggaagcactcaagcgccgacttcggacactaatccttgctccaacgcgagtagttgcggctgagatggaagaggccctacgaggtctccctattaggtatcagacaccagcagtgaaatctgaacacacaggaagggaaattgtagatttgatgtgtcacgcaacctttactacacgattattaagctcaactcgggttccaaactacaacttaattgtaatggatgaagcacattttacagacccttgtagtgttgcagcgaggggctatataagtactagagtagagatgggagaagctgcagcgatatttatgactgcaactcctccaggcagtatagatccattcccccaaagtaacagccccatagaagacatcgagagagagatcccagagagaagctggaacactgggtttgattggataactgattatcaaggcaaaacagtatggttcgttccatctatcaaggcgggcaacgacatcgcaaattgtctacgaaagtcaggtaagcgagtcatacaactaagcagaaaaacgtttgacactgaataccctaagacgaagctaactgattgggatttcgtagtaaccaccgatatttcggagatgggggctaactttcgcgctggtagggtgatagatccccgaagatgtttaaaaccggtaatattaacggatggtccagaaagagtgatcctagccggacctataccagtaactccagcatcagccgcgcaaaggagaggtcgtataggtagaaacccagcgcaagaagacgaccaatatgtctttagcggagatccgctgaagaacgacgaagatcatgcgcactggacggaagcaaaaatgctcttagataacatatacactcccgagggaattataccaacgctatttgggccagaacgagagaaaactcaagctatagatggagaatttcgacttcgcggcgagcaaagaaagacgttcgtcgaacttatgcgccggggagatctcccagtgtggttatcttacaaggtagcatctgcgggcatatcctacaaagatagagaatggtgctttactggagagcgaaacaatcaaattcttgaagagaacatggaagttgaaatttggacgcgtgagggggagaagaagaaactaaggccaaaatggttagacgcaagggtatacgcagatccaatggccttaaaagatttcaaagagttcgcgagtggtaggaaaagtataacattggacatattaacagaaatcgcgacattacctacatatctcagctcgaaagcaaagctggcactcgacaacatcgttatgttgcacaccacggaaaaagggggccgcgcataccaacacgcattaaatgaattacccgaatccctcgaaacattaatgttagtggccctattaggagctttgacagcaggcatcttcttattctttatgcaaggcaaaggaataggaaaattaagcatgggtttaatagcaattgcagtagcatcgggcttactctgggtagctgagatacaaccccaatggatcgcggccagcattattcttgagtttttcttaatggtattgctaataccggaaccagaaaagcagagaacaccgcaagataatcaactgatctatgttatattgacaatactaaccataataggtttaatagcagcgaacgaaatgggactaatagagaaaacgaaaactgactttgggttttaccaagtaaaaacagaaactacaatacttgacgtagatcttcgtcctgctagtgcctggactctttacgcagtagcaacaacgattttgactccaatgttacgccatactatagaaaatacatctgcaaacctctctttagcagcaatagctaaccaggctgcagtgttaatgggtctaggtaaaggatggccgttgcacagaatggatttgggtgtaccattgctagcaatgggatgctacagccaagtcaatccgactacacttacagctagcctagttatgctgttggttcattacgccataatagggccaggactccaagcaaaagctacccgggaagcccaaaagcggacagcagccggcataatgaagaaccctacagttgacggtataacggtcatcgaccttgagccaatcagttacgatccaaaattcgaaaagcaattggggcaagtaatgctcctagtactttgtgttggacaactattactcatgaggacaacttgggccttatgcgaggtgctcactctcgcgactggtccaataatgacgttatgggaagggaaccccggaaggttttggaatactaccatagccgtttcaacagcaaacatattccgaggtagttatcttgcaggggccggactggctttcagtttaattaagaacgcacaaacccctcgccgaggtacaggaacaactggcgaaacgcttggtgaaaagtggaaaagacagttaaactctttagatcgaaaagagtttgaagaatataaacgctcaggcatactcgaagtagatagaaccgaagcaaaatcagcccttcgagacggtagtaagattaagcacgcagtatcacgaggatcatccaaaattcgatggatcgtagaacgtggcatgataaagccaaaaggtaaggtagtagatctaggctgtggcagaggtggttggtcttattatatggcaacacttaaaaatgtgaccgaagtgaaagggtacacaaaaggaggaccagggcatgaagaacctatccctatggcaacatatggttggaatctagtaaagttacactcaggcgtggacgtattttacaaacctactgaacaagtcgatacacttttgtgtgatataggggagtccagctctaatcctacaatagaagaaggtcgcactctgagagtgctaaaaatggttgaaccatggttatcttccaagcctgagttttgcataaaggtcttaaatccctacatgccaacggttatagaagaattagaaaaattacaacgaagacacggtggctcgttagtgagatgccctctaagccgcaacagcacacacgagatgtactgggtatcaggtgcgagtggcaatattgtctctagcgtaaatacaattagtaaaatgctacttaatcgatttacaacaagacacagaaaacctacgtacgaaaaggatgtcgacctaggtgcgggaaccagaagcgtgagtacagagactgaaaaaccagacatgacaataataggcagacggcttcagaggctaagagaagaacacaaggaaacatggcattatgaccaagaaaatccatacaggacgtgggcgtatcatggttcatatgaggctccctcgaccggaagtgcgtctagtatggtcaatggagtcgtaaagctattaactaaaccctgggatgtaatacctatggtaacccaattagctatgactgatacaacaccgttcgggcaacagcgcgtgttcaaagaaaaagtggacactcgtactccccagccaaaaccaggcacaagaatgattatgacaatgactgcaaattggttatgggcactactaggcaagaagaaatcaccacggttatgtactcgcgaggaatttataagtaaggttagaagtaacgcagctatcggtgcggtgtttcaagaagaacaaggttggacttcagcttcagaagctgtaaacgactccaggttctgggaattagtagacaaagaaagggcattacaccaagaaggaaaatgtgaatcatgcgtgtataacatgatgggaaaacgagagaagaaactgggtgaatttggcagagctaaaggttcgagagcgatatggtacatgtggttaggtgcgagattcttagagttcgaagccttaggttttcttaatgaagatcactggtttagtagggaaaactcttggtcaggtgtagaaggtgaaggactgcatagactagggtatatattagaagatatcgacaagaaagacggtgacttaatctacgcggatgatactgccggctgggatacaagaataacggaagatgatttactaaacgaagaactaataactgaacagatggcacctcatcataaaactttagcaaaagcgatattcaaacttacgtatcagaataaggtcgttaaggtattaagaccaactcctaaaggagcagtcatggatataatcagtaggaaggaccagcggggttcaggccaggtaggcacgtacggattaaacaccttcaccaacatggaggtgcaattaattagacaaatggaagctgagggcgttataacgcaagatgacatgcaaaatcctaggggcctaaaagagagagtcgaaaaatggttaaaggaatgcggggttgatcgattaaagagaatggctatatctggcgacgattgtgtagtaaaaccaatagatgagcggttttcaacaagcctattgtttttaaatgacatggggaaagtaagaaaagacataccacaatgggaacccagtaaggggtggaaaaattggcaagaagttcccttttgttcacatcatttccataaaattttcatgaaggatggcagatctttggttgtcccttgcagaaaccaagatgagttaataggtcgagcgcgcattagtcaaggagcaggatggtcattaagagaaaccgcttgcctcggcaaagcatatgcgcagatgtggtccctaatgtattttcataggcgtgatctgagattagcttcaatggccatctgcagtgcggtaccaacggaatggttcccaacatcaagaaccacctggtcaattcacgcacatcaccagtggatgacaacagaagacatgctaaaagtttggaatcgtgtctggatagaagacaacccaaacatgactgacaaaactccagttcacagttgggaagatataccatatctcggaaaacgcgaagatctatggtgtggatcattgataggactctcgtctcgtgccacctgggcaaagaatatacacactgcgataacgcaagtgagaaatcttataggaaaggaggaatatgtcgattacatgcctgcgatgaaaaggtattcagctccctttgagagtgaaggggtactttaa

SEQ ID NO: 23653 - RNA, 9867 nt, synthetic construct
  misc_feature 1..9867: note = derived and/or modified CDS sequence (opt6) from DENV-4__JF741967__SS-prME
  source 1..9867: mol_type = other RNA
tctaccatgactctgttatgccttattcctacggttatggctttccatctatctacgcgcgacggtgaacctctgatgatagtggcaaaacacgaacgaggacgtcccttacttttcaaaaccacagaaggaataaacaaatgcaccttaattgcaatggacttgggagaaatgtgtgaagacacagtaacttacaaatgtcctcttctggtcaatactgaacctgaagacatagattgttggtgcaacttaacgtctacgtgggtcatgtatgggacatgtacacaatcaggagaaagacgacgagagaaaagaagtgtagccctaacgccacactcagggatggggttggaaactagagccgaaacctggatgtcaagtgaaggagcatggaaacatgctcagcgtgttgaaagttggattcttagaaatccagggttcgcgttgttggctggttttatggcatatatgattggacagaccgggatacaaaggactgtcttctttgttttgatgatgttagtagcgccatcatacggaatgagatgtgtgggtgttggaaacagggactttgtagaaggagtttccggcggtgcttgggtggatttggtgttagaacacggaggctgtgtcacaacaatggcacaaggaaaaccaactttagattttgaactaacaaaaacaacagcgaaagaagtagcattgttaagaacttactgcatagaagcatctatatccaacataacaaccgcaacaagatgtcccacacaaggcgaaccctacctcaaagaggagcaagaccaacaatatatatgtaggagggacgtcgttgatcgtggatggggaaacggttgcggtctatttggaaaaggtggtgtggtaacgtgcgccaaatttctctgtagtggaaagataactggtaacttagtacaaatcgagaatctagaatacacagtagtcgtaactgtacacaatggaaacacacatgcagtaggaaacgacacaagtaaccatggggtcacagcaacaatcaccccacgtagtccaagcgtagaagtcaaacttccggattacggagaactaaccttagattgcgaaccacggtccggcattgacttcaacgagatgatactaatgaaaatgaagaagaaaacttggttagttcacaaacaatggtttctggaccttccgcttccgtggactgccggagcagatacatctgaagttcattggaattataaagagagaatggttacctttaaagttcctcatgctaaaagacaagacgtaactgtcttaggatcacaggaaggagctatgcactctgccctcgctggtgccaccgaggtagacagcggagacggaaaccacatgttcgctggtcatttaaagtgtaaagtacgtatggagaaattaagaattaaaggtatgagctataccatgtgctcgggaaaattttcaattgataaagaaatggctgaaacacaacacggaacaacggtggttaaagttaaatatgagggcgcgggagcaccatgtaaagtacccatagagataagagacgtaaataaagaaaaggtagtaggacggatcatttccagtactccattcgcagaaaatacaaatagtgtaacaaacatagaacttgaaccaccttttggtgattcatacattgtgataggagtaggagatagtgctcttactctacattggttcagaaaaggaagttcgattggaaagatgtttgaaagcacatatcgcggagctaagagaatggcaatattaggagagactgcatgggacttcggctcagtaggcggcttgttcacaagtctaggtaaggcagttcatcaagtattcggcagtgtatatacaacaatgtttggcggtgtatcatggatgattagaatacttataggattcttagtcctctggataggaacaaatagccgaaataccagtatggccatgacctgtatagcggtaggagggataacgctatttctgggttttacggtccaggcagatatgggctgtgtcgtaagttggaatggaaaagaactgaagtgtggaagtggcatcttcgtagtcgacaatgttcatacctggacggagcaatataaattccaacccgaaagcccagcacgattagcctccgcaatattaaatgcgcataaagatggagtgtgcggaatacgatccaccacgagactcgagaatgtcatgtggaaacaaataaccaatgaattgaactatgttctgtgggaaggtgggcatgatttgactgtcgtagctggtgacgtcaaaggtgtgctcacaaaaggcaaaagagccctaacgccccctgttaatgacttaaagtacagttggaagacatggggcaaagctaaaatattcacacctgaggcgcgtaactctactttcctaatcgacggcccagatacaagtgaatgcccaaatgaacgcagggcttggaatttcttcgaagtagaggactatggatttggaatgttcactacaaacatctggatgaagtttagagagggcagctcggaagtgtgtgatcatagattaatgagcgccgccattaaagatcaaaaagctgtccacgcggacatgggatattggattgaaagtagtaagaatcagacctggcaaatagaaaaggcctcattgatcgaagtgaagacatgtttgtggccaaaaacacatacactatggagcaacggagttttggaatcgcaaatgctaataccaagatcatacgcagggccattctctcaacacaattatagacagggttatgcaactcaaaccgcaggtccttggcatctaggaaaacttgaaattgatttcggtgaatgtcctggaacaacagttacgattcaagaagattgcgaccatcgtgggccatcattgagaaccacaactgcaagcggtaagctagttacgcaatggtgctgcaggagctgcacaatgcctcccttacgcttcttaggtgaagatggatgttggtatggtatggaaatacgcccgctctccgagaaagaagaaaacatggtaaaatctcaagtaacagcgggacaaggaacatcggaaacattctcaatgggtttactgtgtctgaccctctttgtagaagaatgtttacgaaggcgggtaacacgcaaacatatgatattggcggtcgtaataacgttttgtgcaataattttaggtggactgacgtggatggacttgttgagagtattaataatgttaggagacaccatgtctggacgcatcggtggacaaatacatttagcaatcatggccgtattcaaaatgagtccaggatatgtgctgggagtgtttttacgaaaactcacatcacgtgaaaccgccctaatggtaatcggaatggcgatgacaacagtctttagtataccacatgatctaatggagttaattgatgggatatcgcttgggttaatactcctcaaaatcgttacccattttgataacacccaagtcggaaccttagctctctcactaacattcataagatcaacaacaccattagttatggcctggagaacaattatggcagtattctttgtagtcacacttataccgttatgtaggacttcatgtctgcaaaaacagtctcactgggtcgaaattactgctttaatattaggcgctcaagccttaccagtatacctaatgacgctaatgaaaggtgcaagtaggaggtcttggccactaaatgaaggtataatggcagtaggattggtgagcttactcggaagtgccttattaaagaatgatgtcccattagctggtccaatggtagctggaggattactacttgcagcttacgtgatgtcaggatcttctgctgatttatcactagaaaaagcggcaaacgtacagtgggatgagatggcggatataacaggatcatctcccatcattgaggtaaaacaagacgaagacgggagcttttcgattcgagaagtagaggaaacaaatatgatcacactgttagtgaaacttgcgttaattactgtttcaggactatatccactggcaattccagtcaccatggcattatggtatgtatggcaagtcaagacacaaaggagtggtgcgctatgggatgtacccagtcctgccgcaacacacaaagcaactttaagtgagggtgtatacagaattatgcagagaggcttatttggaaaaacccaagttggtgtaggcatccatatggaaggtgtattccacacagtaggacatgtaacccgcggaagcgttatatgtcacgaaacaggcagactggaaccgtcttggggagacgtcagaaatgacatgatatcatatggaggaggatggagattaggcgataaatgggataaagaggaggatgtacaagttctagctatcgaaccaggcaaaaatcccaaacacgtgcaaactaaaccgggcctattcaagacgctcacaggcgagatcggagccgtcactcttgacttcaagccgggtacgtcgggttcacccataataaataagaaaggaaaagtcatcggtctatatggaaacggagtggtgaccaagtcgggtgactatgtttcagcaataacacaagcagaacgaataggagaaccggattatgaggtagacgaagacatcttcagaaagaaacgcctaactattatggatctacatccaggcgcaggaaaaacgaagagaatactaccgtcaatagtacgcgaagcgttaaagcgaagactaaggaccttaatactagctcccactagagttgttgctgctgaaatggaggaggctctcaggggattgccaatacgttaccaaacgcctgccgttaaatcagaacatacgggacgagaaatcgtagacctcatgtgccacgcaacgtttacaactcgattattatcttcaactcgagttccaaactacaatctcatagttatggacgaagcccatttcacagatccgtgcagtgtggcagcgcgtggttacattagtacaagagtggaaatgggagaagcagctgcaatttttatgactgctacaccacctggatcaatagacccattcccgcaatcaaacagcccaatagaagacatagaaagggaaataccggaacgatcatggaacacaggttttgactggataactgattaccaaggcaaaacagtatggttcgtaccgtcaataaaggcaggtaacgacattgcaaactgcttacgcaaatcgggaaaaagggtcatacagctatcgcgaaaaacctttgatacagaatatcctaaaaccaaattaacagattgggactttgtggtcaccaccgacatctcggagatgggagccaactttcgagcgggtcgtgtaatagatcccagaagatgtctcaaaccggttatactaacagatgggcctgaaagagtcatattagctggtcctatccccgtgaccccagcttcagctgcgcagcgtagaggccgcatcggtaggaatccagctcaggaggacgatcagtacgtattttctggagatccattaaagaacgacgaagaccacgcacactggacagaggccaagatgttattagataacatatatacaccagaaggaataataccgacactttttggacccgaaagagagaaaacccaggccatagatggagaatttcggcttagaggagaacaaagaaagacattcgtcgaactaatgcgccgcggggacctgccagtctggttatcttataaagtagcaagcgcaggcatatcttacaaggaccgcgaatggtgctttactggagaacgaaacaatcaaatactagaagaaaacatggaggtagaaatctggacgagagaaggtgaaaagaagaaattgaggcccaaatggttagatgcccgcgtatatgctgatcctatggctttaaaagatttcaaagagttcgcatcaggtagaaaatcgattactctcgacatactaactgaaatagcgaccttaccgacatacctaagttcaaaagcaaaattagcactagacaatatcgttatgctccatacgacagagaagggaggccgtgcatatcaacacgcgcttaacgaactacctgaatcattagaaacgcttatgttagttgcattactaggtgcaatgacagccggtatatttttatttttcatgcaaggcaaaggcataggaaagttatctatgggtcttattgccatagcagtagcctctggtttgctttgggtagcggaaatccaaccacagtggattgctgcatctattatactagagttcttcctcatggtcctactaatcccagaaccagagaaacaaaggacaccccaggacaaccagctaatatacgtcatattaactattttaacaataataggtctcatcgcggcgaacgagatggggttaattgagaaaactaaaacagattttggtttttatcaggttaaaccggaaactacaatattggatgtggacctaaggcctgcgagtgcttggactttatatgcagttgcaacaacgatcttgactccgatgttaagacatacaatagaaaacacgtctgctaacctatcactagcagcgatcgccaatcaagctgctgtgctaatggggttaggtaaaggatggcccttacaccgcatggacctcggtgtcccattactggcaatgggttgctatagccaagtaaatccgactactttgactgcttcgttagtaatgttattagtccattatgcgatcatcggaccaggactgcaagctaaagcaaccagggaagcacaaaagcgaactgcagcaggcataatgaagaatccaacagtagacggaataacagtaatcgacctagaacccatctcatatgatcctaaatttgaaaaacaactagggcaagttatgttactggtgttatgtgttggccaactgctattgatgcgcactacatgggcattatgtgaggtacttacgctagccacaggacctgtaatgaccctttgggaaggcaatcccggccgattctggaatactacgatagctgtatcaacagccaatatattccgcgggtcctacttggcaggagcaggattagcattttctttaatcaaaaatgcccagacacctaggagaggtaccgggacaacaggagaaacgcttggagaaaagtggaaaagacaactcaactcgttagatcgtaaagagttcgaagaatataaacgcagcggcatattagaagtggacaggactgaagcaaaatcagcactgagagacggaactaaaatcaagtacgcagtttctcgaggatctagtaaaatcagatggatagtagaacgaggaatgattaaacctaaagggaaagttgttgatttaggatgtggtcgagggggttggagctattatatggcaacgttaaagaacgtaaccgaagttaaagggtataccaaaggtggtcccggacacgaggaaccgatacctatggcgacctacggttggaatctagtgaagctacattcaggtgtagatgtgttttataagccaacggagcaggttgatactctattatgcgatataggagagtctagctcgaatccgacaattgaagagggcagaaccttaagagtcctaaaaatggtggaaccatggctttcatcaaagcccgaattttgtattaaagtccttaatccatatatgccaaccgtaatagaggagctggaaaagctacagagaaggcacggcggctcgctagttaggtgcccattatcaaggaacagcacacatgaaatgtactgggtttcaggagcctccggtaatatagtatcatccgtaaatactatctcaaaaatgttacttaatcgatttacaactcggcaccgaaaaccaacttatgaaaaagatgtagacttgggagctggtacgcgtagtgtgtctactgagacagaaaaacctgatatgacagtaatcggacgccgcttgcaacgacttagagaagaacacaaagaaacatggcattatgaccaggaaaatccgtatagaacgtgggcttaccacgggagctacgaagccccaagtaccggttcagcttcgtcgatggttaatggtgtcgttaaattacttacaaaaccatgggatgtcatacccatggtcacacaattggcgatgacagatacaacccccttcggtcaacaacgagtatttaaagaaaaggttgacactcgtacaccgcaaccgaaacctggcactaggatgattatgacaacgacggcgaattggctctgggctctcctgggtaagaagaaatctccgagattatgcacccgagaagaatttatatcaaaagtacgtagcaacgcagcaattggagccgtttttcaggaggaacaagggtggacctcagccagtgaagctgtgaacgacagcagattttgggaattagtcgacaaagagagagctctacatcaagagggaaaatgcgaaagctgtgtttacaacatgatgggaaaaagagagaagaaactgggagagttcgggagagcaaaaggtagcagagctatttggtatatgtggctaggtgctcgattcctagagttcgaagcactagggttcttaaatgaagaccactggttcagtagggaaaattcttggtcaggtgtagagggtgaaggcctgcacagattaggttatatcctggaagatatcgacaagaaagacggggatctaatttatgcagatgataccgcgggatgggatacccgtataactgaggacgacttactaaacgaagaattaataaccgagcaaatggcaccacaccacaaaacactagcaaaagccatattcaaattaacatatcagaataaagttgtaaaagttttaagacctaccccaaaaggagctgtgatggatattatttcacgtaaagaccagagaggcagtgggcaggtaggtacatacggcctaaacacatttacaaacatggaagtacagttgatccgtcaaatggaagcagaaggtgtaataactcaagacgacatgcagaaccctaaaggtcttaaagaaagagttgaaaaatggcttaaagagtgtggagtagaccgtttgaaaagaatggccatatcaggggatgactgcgtagtaaaacccttggatgagagattctctacttcattgttatttttaaatgatatggggaaagtccggaaagatatacctcaatgggaaccgtcaaaaggctggaaaaactggcaagaagtgccattttgtagccatcatttccataagatattcatgaaagacggaagatcgttagttgtaccatgccgtaaccaggatgaactaataggcagagcaagaataagtcaaggcgcgggctggagcctcagggaaactgcttgcttaggtaaagcatacgcacagatgtggtcattaatgtattttcacaggagggatttaagattggcctctatggcaatttgttcggcagtacccacagaatggtttcccacctctaggacgacatggagcatacacgcccatcatcaatggatgacaactgaagatatgctaaaggtgtggaaccgagtttggatagaagataatcctaacatgactgacaaaacgccagtacactcatgggaagatataccctatcttggtaaaagagaagacctttggtgcggctctctaatcggattaagttctagggctacatgggccaaaaacattcacacagcaattacacaagtacgtaaccttattggtaaggaagagtatgtcgattatatgccggcaatgaaacgatactctgcaccttttgaatcagaaggtgtactgtag

SEQ ID NO: 23654 - RNA, 9867 nt, synthetic construct
  misc_feature 1..9867: note = derived and/or modified CDS sequence (opt6) from DENV-4__JQ822247__SS-prME
  source 1..9867: mol_type = other RNA
tcaacaatgactttactatgcttaattccaactgttatggcgttccatctttcaacacgagacggggaaccattaatgatagttgcaaaacacgaacgagggagacctttattgtttaaaaccactgaaggaataaataaatgtaccctcattgctatggatctaggagaaatgtgcgaagatacggttacctacaagtgtccactgcttgtgaatacagaacccgaagatatagattgctggtgtaatctaacatcaacatgggtgatgtatgggacatgcacacaatcgggagaacggcgacgtgaaaagcgatccgtagcactgacaccacatagcggaatgggtttggagactcgagcagaaacatggatgtcaagtgaaggagcatggaagcacgctcaacgcgtcgagtcatggattctccgtaatccgggcttcgcactactggccggttttatggcctatatgataggtcaaaccgggattcaaagaacagtatttttcgtcctgatgatgctagtagctccttcatacggcatgagatgtgtcggagttggaaacagagactttgtggaaggagtgtctggtggagcctgggtagatttagtcctagaacacggagggtgtgtcacgaccatggcccagggaaagccaacactagattttgaattaaccaaaactacggctaaagaagtcgcgctgttaaggacatactgtattgaggcttccatatctaatataacgacagccacaagatgtcctacgcaaggcgaaccgtacctgaaggaagaacaggaccaacaatatatttgtcgcagggatgtagtggatcgaggatggggcaatggttgcggattgtttggaaaaggaggcgtggtcacctgtgcaaaattcctatgttcgggaaaaataacaggcaatctagtccaaatcgaaaatctagagtacactgtagtcgtaacggtacataacggtaatactcatgcagttggtaacgacacgagtaatcatggagtcactgccacgataacccctagaagcccaagcgtagaagttaaactcccagattacggtgagcttacattagattgcgaaccccgaagtggaatagattttaatgagatgattttaatgaagatgaagaagaaaacttggttggtacataaacagtggtttcttgatttaccacttccgtggacagctggagctgatacctcagaagtgcattggaattataaagaacgtatggtcacttttaaagtcccacatgcaaaaaggcaagacgtcactgtacttggcagtcaagaaggggcaatgcatagcgcgcttgctggtgcaacggaagttgactctggcgatggaaaccatatgtttgcaggacaccttaaatgtaaagtgaggatggaaaaattaagaatcaagggaatgtcatatacaatgtgttcgggtaagttctctatagataaagaaatggcagagactcaacacggtacaacagtagttaaagtcaaatatgagggcgcgggggcaccttgcaaagttccgatcgaaatacgggatgtgaacaaagaaaaggttgtaggtagaatcataagtagcactccattcgcagaaaatacaaactcagtgacaaatatcgaattagaacctccatttggtgatagttatattgttataggggtaggagattcagcactaacattacattggtttagaaaaggtagctctattggaaaaatgttcgaaagcacctatagaggagcaaaaaggatggcgatactaggcgaaaccgcgtgggattttggaagtgttggtggtctatttacttccttaggaaaagcagttcatcaagtatttgggtctgtatatacgacaatgtttggaggagtttcttggatgattcgaatactgatagggtttttagttctttggataggcactaactcaagaaataccagcatggccatgacctgcatagctgtaggcggtataacattattcctaggatttacagtgcaagcggatatgggttgcgtagtatcctggaacgggaaggaactcaaatgcgggagtggaatctttgtagtagataacgtccatacatggacagagcaatataaatttcagccggaatcaccagcaagacttgcctcagcgattttgaacgcccataaagatggagtatgtggaatacgcagtacaacaaggttagagaacgtcatgtggaagcaaatcactaatgagttaaattacgttctttgggaaggtggccacgatcttacagttgtggccggagacgtaaagggagtactaacaaaaggaaaaagagcattaactcccccggttaatgatctaaaatactcatggaaaacatgggggaaggccaagatttttacaccggaagcccgaaacagcactttcctgattgatggtcccgacacatctgaatgtcctaacgagagacgagcatggaacttctttgaagtagaagactatggatttggaatgtttacaacaaacatttggatgaaatttagagaagggtcctcagaggtctgcgatcaccgcctgatgtccgccgccataaaagaccaaaaagccgttcacgctgacatgggttattggatagagtcctctaaaaatcagacgtggcaaattgagaaggcttccctgattgaagttaaaacctgtctttggccaaaaactcacacattatggtcaaatggtgtactagaaagtcagatgttgatccccagaagctatgcggggccgttctcacaacataattatagacaggggtatgcgacacagactgcagggccctggcacttgggaaaactcgaaatagactttggggaatgtcccggaacgactgtaactatccaagaagattgcgaccatagaggaccctcgctaaggacgactacggcttcaggcaaacttgtaacacaatggtgttgtagaagttgtactatgccaccattaagattcttaggagaggacggctgttggtacggcatggaaatcagaccattaagtgaaaaagaggaaaacatggtgaaatctcaagtaacagctggacagggtacaagtgagacattttcaatgggactcttatgcctaaccttatttgttgaagaatgtctacgtcgaagagtaacccgaaagcatatgatcttagcagtggtaatcacattttgtgcgattatcctaggtgggctaacctggatggacctgctgagagttctaataatgctaggcgacaccatgagtggccgaatcggcgggcaaatacacctagctataatggctgtttttaaaatgtctcctggatacgtccttggagtgttcttgcgcaaactcacatcacgggaaaccgctctgatggtaatcgggatggccatgacgactgtttttagtataccacatgaccttatggagttgatagacgggatcagtcttgggcttatattattgaaaatagtgacccacttcgataatacacaagtcggcactttagcgttatcgctaacgttcataagatcaaccacgccacttgtgatggcctggagaaccataatggcagtattctttgtggttaccttgataccattatgccgaacaagctgccttcagaaacaatcacactgggtagagataactgctttaattcttggagcacaggccctcccggtatatttgatgacacttatgaaaggtgcttcgagacgttcatggccattaaacgaggggattatggccgttggcctagtttcacttctaggatcggccttactcaagaatgacgtaccattagccggacctatggtcgcaggaggattattattagcggcctatgtaatgtccggaagtagcgcagatttatcattagagaaagccgcaaatgtacagtgggacgaaatggctgacattacaggctccagtccaataattgaggtcaaacaagatgaagacggatcgttttccatacgcgatgtagaagaaactaatatgataacactgcttgtaaaactggcattaataacagtctcaggactatatcctttagccatcccagttaccatggcgctttggtatgtttggcaggtaaagacgcaacgtagtggggctctatgggacgtcccgtcccccgcagcaacacaaaaagcaaccttgtcagaaggtgtttaccgaattatgcagagaggattatttggtaagacacaagtgggagtcggtattcacatggaaggcgtatttcatacaatgtggcatgtaactagaggttcagttatatgtcatgaaactggccgattagaacctagttgggctgacgtcagaaatgacatgattagttacggtgggggttggagattaggagacaagtgggataaggaagaagatgtgcaagtattagctatagaacccggtaagaacccaaagcatgtacaaacaaaacctggattatttaaaactttaactggtgaaataggagctgttacactggatttcaagcccggaactagcggcagtccaataataaacaagaaaggcaaggtaattggcctatacggtaacggcgtagtaacaaaatcaggagattatgtgagtgctataactcaagcggaacgcatcggtgagccagattatgaggtcgacgaagatatattccgcaagaaacgcttaacgataatggatttacacccaggagcagggaagactaaaagaatcttaccatctattgttagggaagcccttaaacggcgactaagaacactaatattagctccaacacgagtagtagcagcagagatggaggaggcattacggggcttgccaataagatatcaaaccccagcagtaaaatctgaacatactggtagagaaatcgtggatttaatgtgtcatgcaacattcactacacgtttgttaagctcaacaagggtacctaactacaacctaatagtaatggatgaagcacattttacagacccttgtagtgttgctgccagagggtacataagcacgagggtagaaatgggagaggccgcggcgatttttatgacagcgacaccgcccggaagtatcgatccatttccacaatctaactctcctatagaagacatagaaagggagataccggaaagatcgtggaatactgggtttgattggatcaccgactaccagggaaaaacggtctggtttgtaccgagcattaaggccggaaacgacatcgctaactgccttaggaaatcgggaaaaagagtaattcaattgagccggaaaacgtttgatactgaataccccaagacaaaattaacagattgggatttcgtagtgacgaccgatatcagcgaaatgggagcgaattttagagctggacgagtcatagatccgcgaagatgcttaaagcctgttatattgacagacggaccagagcgcgtaatactggctggtccaataccggtcacgccagcatcggcggcccagcgtagaggaagaatcggtagaaatcccgcgcaagaagacgatcaatatgttttcagcggcgacccactgaaaaatgatgaagatcatgcacactggacagaagccaaaatgttattagataacatctataccccagagggtattatacctacactttttgggccagagagagagaaaacgcaagccatcgacggagagttccggcttaggggtgaacagcgaaaaacatttgtagagctcatgagacgaggcgatttaccagtttggctgtcgtataaagtcgcgtccgctggcatcagctacaaagatcgagagtggtgttttacaggtgaaaggaacaatcaaatattagaagaaaacatggaagtggaaatatggacacgggaaggtgagaaaaagaagctaaggccaaaatggcttgatgctagggtatatgcagaccctatggcgttaaaagactttaaagaatttgcatccggaagaaaaagtataaccttagacattctgaccgaaattgcaacacttccaacatacttgtcgagtaaagcgaaattggcattagataacatagtcatgctgcacactacagaaaaaggaggtagagcataccaacacgcattaaacgaactaccagaaagtctggaaacactcatgcttgtggccctcctgggagcaatgacagctggcatttttctgttctttatgcaaggcaagggtatagggaaacttagtatgggattaatcgcaatagcagtagcatcaggactactttgggttgcagagatacaacctcaatggatcgcagcctcgataatattagagttctttctcatggttttacttattcctgaacctgaaaaacagagaactccgcaagacaatcaactgatctatgtaatactcactattttgacaataattggcttgatagcagcaaatgaaatgggacttattgagaaaacgaagactgacttcgggttttatcaggttaaacccgaaacaaccattttagatgtcgatctcaggcctgcttcagcctggacattatatgctgttgccacgaccatattgacacctatgttgagacatacgattgaaaatacttcagcaaacctcagtttagctgcgatagccaaccaagccgcggttctaatgggcttaggcaaaggatggcctctccatcgaatggatttgggtgtgcccctcctggctatgggttgttattcacaagtcaaccctacaactttgacggcatctctagtaatgcttctcgttcactacgctatcatcggcccaggtcttcaagccaaggcaacgcgagaagcgcaaaagagaactgcagccggtataatgaaaaatccaaccgtagatggtataactgtcattgatctagaaccaatatcatacgaccccaaattcgaaaaacaactaggacaagtgatgctactcgtgttatgtgtagggcaactactgctaatgcgaacgacgtgggccctgtgtgaagtattaactctagccaccggaccagtgatgacattatgggaaggaaaccccggccgcttttggaacacaaccattgcagtatccacagcgaatatatttaggggaagttatttggctggtgcaggcctcgctttctcattgatcaaaaatgctcaaacacccagacgaggcacgggtaccacaggcgaaacactgggagaaaaatggaaacgacagctaaactcccttgatagaaaggaatttgaagagtataaacgttcaggaatacttgaagtagaccgtactgaggcgaaatccgcactcagagacggaacaaaaataaaatacgctgtgagcaggggttcaagtaaaatacgatggatagtagagagaggaatgattaaaccaaaaggaaaggtagtagatctgggatgtggaagaggcggatggtcatattatatggcaacactaaagaatgtcacggaggtaaaaggatatacgaaaggcggtccaggtcatgaggaacccataccaatggcaacatatggttggaacttagtaaaactacattctggcgtagacgtattttacaaaccaacagaacaggttgatacgctattatgtgacatcggagaatcttcaagtaacccgactatcgaagaagggaggactcttcgagtgctaaaaatggtagagccatggcttagttctaagcccgaattttgtattaaggttttaaatccgtatatgcctacggtgatcgaggaattagaaaaacttcaaagaagacacggtggcagcttggtacgctgcccgttgagccgaaactcaacgcatgaaatgtattgggtaagtggtgctagcggaaacatcgtctcttctgtcaacacaatcagtaaaatgttattgaatcgatttacaactcgccatagaaaaccaacatacgaaaaagacgtcgatttaggagctgggacaagaagcgtaagcacagaaactgaaaagccagatatgaccgtcataggaagaaggctacagcgcttaagagaagaacataaagaaacttggcactacgatcaagaaaatccatacagaacttgggcatatcatggatcttatgaagcaccatcgacaggatcagcctcaagcatggtcaatggcgtcgttaaactattgacaaaaccatgggacgttataccgatggtcacacaattagctatgactgacactactcccttcggacaacaaagagtttttaaagaaaaagtggacactagaacaccgcagccgaaacccggcacaagaatgataatgacgacaactgccaattggctatgggcactactaggcaaaaagaaaagcccacggctatgtacacgtgaggaatttatctcgaaagtgcgttcaaacgcagctatcggagcggtttttcaggaagaacaaggatggaccagcgcgtcagaggctgtaaacgatagtcgattttgggagctggtcgataaagaaagagcactacaccaagaaggtaaatgtgaatcatgcgtatataatatgatgggtaaaagggagaagaaattaggtgagttcggaagggctaaaggatcgcgtgctatatggtatatgtggttaggagcgcgatttctagaatttgaagcgttaggatttctaaatgaagatcattggtttagtagagaaaactcatggtccggagtggaaggagaaggcctacataggctaggatacatactggaagacattgataagaaggatggtgatcttatatatgctgatgatacagccggatgggatacaaggataaccgaagatgacctgctaaatgaggaattgataacagagcaaatggcgccacatcacaaaacactcgcaaaggcgatatttaaactaacgtatcaaaataaagtcgtaaaagtgttacgtccaacgcctaaaggggctgtgatggacataatctcacgaaaagaccaacgtggatcgggacaggttggcacttacggtttaaacacatttacaaatatggaagtacagttgattaggcaaatggaagcggaaggagtaataactcaagatgacatgcaaaatccaaaagggctaaaggaacgagtcgaaaaatggttaaaagaatgtggggtagacagactaaaaaggatggcgataagcggcgatgattgcgttgtcaaaccacttgatgaaagattttcaacgagtctactatttctcaacgatatgggcaaagttagaaaagatataccgcagtgggaaccttcaaaaggatggaaaaattggcaagaagtaccattctgcagccaccacttccataagatatttatgaaggacggtcgttctcttgtagttccttgcagaaaccaggacgagcttattggtcgagctagaataagccaaggcgcaggttggagtttacgggaaactgcttgtttaggaaaggcttacgctcaaatgtggtcactcatgtactttcaccgtcgggacttaagactagcaagcatggctatctgttctgcagtaccaacggaatggttccctactagcaggacaacctggtcaatacacgcacaccaccaatggatgacaacggaggatatgctcaaggtatggaatcgagtatggattgaagataacccaaatatgactgataaaacgcctgtacacagctgggaggacatcccctatttaggaaaaagagaggatttatggtgcggaagtttgataggtttgagtagtagagctacatgggccaaaaatattcatacagctattactcaagtaaggaatttgataggaaaagaagaatacgttgattatatgcctgctatgaagcggtattctgctccattcgaatctgaaggcgtactataa

SEQ ID NO: 23655 - RNA, 9867 nt, synthetic construct
  misc_feature 1..9867: note = derived and/or modified CDS sequence (opt6) from DENV-4__JF262783__SS-prME
  source 1..9867: mol_type = other RNA
tcaacagtaacccttctttgcttgatacccacggtaatggcttttcacttaagcactcgagacggcgagcctttgatgattgttgctaaacacgaaagaggaaggcccttactatttaaaacaacagaaggcattaacaaatgcactttaatagcaatggatttaggagaaatgtgtgaagacactgtcatgtacaaatgtcccctattagtaaatactgagcctgaagacatagattgctggtgcaacttgacttcgacttgggtgatgtacggcacatgtacccaaagcggtgaacgacggagggaaaaacgatccgtagcgctaacacctcactctggtatgggcctggagacacgagcagaaacgtggatgtcgagcgaaggagcgtggaaacatgcgcaaagggtggaaagctggatacttcgtaacccaggtttcgcactgctggcgggatttatggcatacatgataggacaaactggtatacaaagaacagtatttttcgtgttaatgatgctagttgcaccatcctatggaatgcgctgtgttggtgtaggaaatagagattttgtcgaaggtgtcagtggtggagcgtgggtcgacctggtattagaacacggcggatgtgtaacaactatggcccagggtaaacccacattagatttcgagcttattaaaaccacagcaaaagaagtaacactactaagaacatactgcatagaggcgtctattagcaacattacaacggcaaccagatgccctacccaaggtgaaccttatttaaaagaagaacaagaccaacaatatatctgcagaagagatgtcgttgacagaggctggggaaatggctgtggactatttggaaaaggtggggttgtaacatgcgccaaatttttatgtagtggaaaaataacaggaaatttagtacagatcgaaaatctagaatacactgtagtagttacggttcataacggtgatacgcacgtagtcggaaaagatacctcaaaccatggtgtaaccgccacgataaccccacgctcaccatcagtcgaagtaaaactaccagattacggagaactgacactggactgtgaacctcggtcaggcatcgattttaacgagatgattttgatgaaaatgaagaagaaaacctggttagtccataaacagtggtttcttgatttacccttaccctggactgccggagcagatactagcgaagtccaatggaattacaaagagcgtatggtaacttttaaagttccccatgcaaaaaggcaggacgtaaccgtgttaggctctcaagaaggcgctatgcatagtgcactaacaggagctaccgaagtagattcaggagacggtaaccacatgttcgccggtcacctaaagtgcaaggtcagaatggaaaagctacgaataaaaggcatgtcatatacaatgtgtagcgggaagtttagtatagataaagaaatggctgaaacacaacacggtacgacggttgttaaggtcaagtatgaaggagctggagccccgtgtaaagtacccatagaaataagagatgtcaataaagaaaaagtcgttggtcgcattataagttcaacacctttcgccgaaaacactaactccgtaactaatatagaattggaacctccatttggagactcttatattgttattggtgttggggatagcgcgctcaccctccattggttcagaaagggaagtagtataggtaagatgtttgaaagcacatacagaggagcaaagaggatggcaattttaggagagactgcttgggacttcggatcagtcggaggactttttacatctttaggaaaagcagtccaccaggttttcggctcagtttacactacaatgttcggaggtgtaagttggatggttaggatcctgattggactcttagtcctttggatcggtacgaactcaagaaatacaagtatggcaatgacatgtattgcaataggtggcataacacttttcctcggcttcactgtacacgccgacatggggtgcgcagtctcctggtcgggaaaagaactaaaatgcggcagcggaatcttcgttatagataacgtccatacatggacagaacaatataaatttcagcctgaatctcctgcacgcttagcatcagcgatactcaacgcccataaagacggagtttgcggtatcaggagtacaactaggcttgaaaatgtaatgtggaaacagataaccaatgagttaaactatgtcttatgggaaggaggacacgatctcacagtagtcgcgggtgatgtgaagggggtattgacaaaaggaaaaagagcacttacacctcccgttaatgatttaaaatactcctggaaaacatggggaaaggctaaaatttttacacctgaagctagaaattctacctttttaatagacggccccgacacttctgaatgcccaaatgaacgaagggcatggaattttctagaggtagaagattatgggtttggaatgtttgcaactaacatatggatgaaattcagagaaggctcatcagaagtttgcgatcacagattaatgtcagcggcaattaaagatcagaaagctgttcatgcagatatgggttactggatagaaagtagtaaaaaccaaacatggcaaatcgaaaaggcttccttaatcgaagttaaaacgtgcctatggcctaaaacccacactctatggtcaaatgaagtcctggagagccagatgcttattcccaaggcgtacgcaggaccttttagccaacataactatcgacaagggtacgctacacaaactatagggccatggcacttagggaagctagagatagatttcggcgaatgccctgggactacagtaacaatccaagaggattgtaaccatcgaggcccatctttacgcactacaaccgcatcaggcaagttggttacccaatggtgctgtcgaagttgcaccatgccacccttaaggtttttgggagaagacggttgctggtacggaatggaaattaggccgctatccgaaaaagaagaaaatatggtgaaatctcaagtctcggctggacagggcacgagtgaaacattttcaatgggattgctttgcttaactttatttgtcgaagaatgtttaagaagacgggtaactaggaaacacatgatcttagtggtcgtcacaaccctgtgtgctataatacttggcgggctaacctggatggacttactacgagccctaatcatgctcggggataccatgtcaggaagaatgggagggcaaattcacttaaccataatggcagtattcaaaatgtcgccaggatacgtattgggtgtattccttcgcaaactgacctccagagaaacggctctaatagtgattggtatggcaatgactacggtgctctccataccccatgatctgatggaatttatagatgggatatcacttggcctcatccttctaaagatggtagcacattttgataacacacaagtaggcactttggcactatctcttacattcatcaggtccactatgcctttagtaatggcatggcgaacaataatggcggtactcttcgtagttacattaatcccgctttgccggacatcgtgtcttcaaaaacagagccactgggtcgaaattaccgctttgattctaggtgcccaagctctaccagtttatttaatgaccctcatgaaaggtgcatcaaagcgtagctggccgctaaacgagggcataatggctgttggcctagtatcattgttagggtcagcacttctgaaaaatgacgtaccactcgcaggtccaatggtcgccgggggcttattactagccgcctacgtcatgagcggatcttcagcagatctttcgttagaaaaagccgcaaatgtacagtgggacgagatggctgatatcacgggtagtagccccattatagaagtaaaacaagatgaggatggtagcttttctattcgtgacgtagaagaaacaaacatgattacactattagttaaacttgccttaattacagttagcggattgtatccgcttgctattccagttacgatggccctttggtatatgtggcaagtgaagacacagaggtcaggggcactttgggatgtcccttcaccggctgctgcacaaaaagcaactttaaccgaaggcgtgtatcgtatcatgcaaagaggattattcggcaaaactcaagtgggcgtgggaatccacatggaaggcgttttccacacaatgtggcacgttacaagggggagtgtaatatgccatgagactggcaggttggaaccctcctgggcagatgtacgtaacgacatgatctcatacggaggtggttggcgtttaggagataaatgggacaaagaagaagatgtacaagtactagccattgaacccggtaaaaatcctaaacatgtgcaaacaaaaccaggcctattcaaaacactaaccggtgaaataggtgccgtcacattggattttaaaccaggaacatctggatcccccataattaacaagaagggcagagtgattggcttatacggaaacggcatagtcactaagtcgggtgactatgtttcagctatcacacaagcggagaggatcggtgagccagattacgaagtggatgaggacatattcaggaaaaagcgattaacggtgatggacttacacccgggtgcaggaaagactaaaaggatcttaccatcaatcgttagagaggcgttaaaacggcggttaaggacactcatactcgcaccgacacgagtggtagcagcagagatggaagaagcgttaaggggtttgccaatcagataccaaacgcctgccgtgaaatctgagcatacaggccgagaaattgtggaccttatgtgtcacgcgacattcactaccagattgttaagctccaccagagtaccaaattataaccttattgtgatggatgaagctcatttcactgatccctcctccgtcgcagcaagaggatatataagtacgagagttgaaatgggagaggctgctgctatatttatgacagcgacccctcctggggcaactgaccccttcccacaatccaattcgccaatagaagacattgagagagaaatcccggaacgatcgtggaatacaggatttgactggattacagactatcaaggaaaaaccgtgtggtttgttccgtcgatcaaggctggaaacgatatcgcgaattgtctacggaaaagtggcaagaaagtaatacaattgtcaagaaaaacctttgacactgagtaccctaaaacaaaactaaccgattgggattttgtcgtcactacagacatctctgagatgggtgccaattttagggccaggcgggttatcgacccaagaaggtgtctaaaaccagtgattttgactgacggaccggaacgagtaatactggctggaccaataccggttacaccagcatcagcagctcaaagacggggtcgcattggcaggaatcccgcgcaagaagacgatcaatatgtcttctcaggagatcctcttaaaaatgatgaagaccacgcgcactggaccgaggcaaagatgctacttgataatatttacacccccgagggaataatacctactttattcggtcctgaacgtgaaaagatacaagctatagatggtgaatttagattacgaggtgaacaaaggaaaacattcgtagaattaatgcgtagaggtgatttgccagtttggttatcttataaagtggcaagcgcaggaatatcatacaaagatagagagtggtgttttacaggtgagaggaacaaccaaattcttgaagagaatatggaagtagaaatatggacgagagaaggagaaaagaagaaacttcgaccaaaatggctagatgcccgtgtctatgccgatccgatggcgttaaaagatttcaaagaatttgcatctggacggaagtcaattactctagacattttaacggaaattgcgtctctccccacttatctctctagtagggcaaagctggccctggacaacatcgtgatgcttcatacaaccgaacgaggaggtcgcgcatatcaacacgcattgaacgaattaccagagagtcttgagaccttaatgctagttgcacttcttggagcgatgacggcaggaatatttttattctttatgcagggaaagggaattgggaagctaagtatgggcttaatggcaatagcagttgcgtctggactgctatgggtcgcagaaatacaaccacaatggatagccgcctcaataatcctcgaatttttcttaatggcactattaattccagaaccagaaaaacaaagaacaccccaggataatcaattaatatacgtgatactcactatccttacgataataggattgatagctgcaaacgaaatgggattgattgagaaaacgaaaacagattttggcttctatcaagtaaaaacggagacaacaattttagatgtagacctaagaccggctagtgcgtggacattgtatgcagtagcgaccactatactaactcccatgttgcggcatactatagaaaataccagcgcaaacttaagtttagctgctatagctaatcaagcagccgtcttaatgggattagggaaaggatggccactccatcgaatggacttaggagttccactcttagcgatgggctgctactcacaggttaatcctactacattaactgcatcactcgtaatgctctcagtccattatgctataatcggccctggacttcaagctaaagcaacacgtgaagcgcaaaaacgtactgcggcaggaatcatgaagaatccaacggttgatggaataaccgttatagacttagaacccattagttatgatccgaaatttgaaaaacaattaggacaagtaatgttacttgccctttgtgcaggccaactcctgcttatgcggacaacatgggctttttgcgaagttttgacacttgcaactggacctatacttacactttgggaaggaaatccaggaagattctggaacacaacaatcgcagtatcaacagctaacatatttcgaggaagttatctcgccggtgcaggtctggccttcagtctgattaaaaatgcacaaacaccccgacgtggcaccggaactaccggagaaactctcggggaaaaatggaaaagacagttaaatagtctggataggaaagaatttgaagaatataaaagaagcggaattttagaggtagacagaaccgaggccaagtccgcactaaaggatggatcaaaaataaagcacgcagtatccagggggtcatcaaaaatcaggtggattgtggagagggggatggtaaagcctaagggtaaggtggtagacttgggatgtgggcgaggtggatggagttactatatggcaacactcaaaaacgtgacagaagtgaagggttacacaaagggtggaccaggtcatgaggaaccaataccaatggccacatatggatggaacctggtaaaacttcacagtggagtagacgtcttctacaagcctacggaacaagtagatacgcttctatgtgatattggtgaatcgagtagcaatccaacaatagaagaaggtcgcaccttgcgggttctaaaaatggtagagccatggctcagttctaaaccagaattttgcataaaggtactcaatccctatatgccaacagttatcgaagaattagaaaagttgcaacggaagcacggaggtagcttagtcagatgccctctatcgcgaaactcgacacacgaaatgtattgggtttcaggagcctctggcaatatagtcagcagtgtaaataccacaagtaagatgttattaaatcggtttactacaaggcatcgtaaaccaacatacgagaaagacgtcaatttgggagcaggaacccggtcagtaagcacagaaacagagaaaccagacatgacaataattggtagaaggctgcaaagactacgagaagaacataaggaaacatggcattacgatcaagaaaatccttataggacttgggcttatcatggaagctatgaagccccatcaacaggatcggccagttcgatggttaacggggtggttaaattattgaccaaaccatgggatgtaatcccaatggtcacccaactggcaatgacagacactacgccattcggtcagcaaagagtatttaaagagaaagtcgataccagaacaccacagcccaaacctggaacacggatggtaatgacgacaaccgcaaattggctatgggcacttctgggaaagaaaaagtccccacgattatgcacgcgagaagaatttatatccaaagttcgctcgaatgccgcaatcggagcggtgttccaagaagaacaaggttggaccagcgcctcagaagctgttaacgattcacgattctgggaacttgttgacaaagaacgggccttacatcaagaaggtaagtgcgagagttgcgtatataatatgatgggtaaacgagagaagaaattaggtgaatttgggagagctaaggggagtagagctatctggtatatgtggctaggagcaaggtttcttgaatttgaagccttgggatttcttaatgaggaccattggtttggccgggagaactcatggagtggagtggaaggggaaggattacacagactaggctacatccttgaagacattgacaagaaagatggagatttaatttacgcagatgacacagcagggtgggacactaggataactgaggatgatctgttaaatgaggagctaataactgaacaaatggcaccccaccatcggatcttagcaaaagccatttttaaactaacataccaaaataaagtagtaaaagtactaagaccgactcccaagggggccgttatggacataatcagtagaaaagatcaacgcggctccggacaggtgggtacctatggtttaaatacatttaccaatatggaggtacagttaatccgccaaatggaagcagagggagtcattacacaagatgatatgcaaaacccaaagggcctaaaggaaagagtagaaaaatggttaaaagaatgtggagtggataggcttaaaagaatggcaataagcggcgacgattgtgtcgtgaaacctctggacgaacgttttagcacatctcttctatttctaaatgatatgggtaaagtgagaaaagatatcccccaatgggagccctccaagggatggaaaaattggcaagaggtacccttctgttcacatcattttcacaaaatattcatgaaagatggaagaagtctcgtcgtaccgtgccgtaaccaagacgaattaattggaagggcaagaatcagtcaaggagctggttggtctcttcgagaaacagcttgcctaggtaaagcatatgcccaaatgtggagcttaatgtatttccatcgccgtgacttgagattagcaagcatggcgatttgtagtgcagttccaaccgaatggttccccacaagtaggacgacatggtcaatacatgcacatcatcaatggatgaccacagaagatatgctaaaggtatggaatcgagtttggatagaagataatccaaatatgacagataaaaccccagtgcactcttgggaggacataccctacttaggtaaacgggaagacctatggtgcggaagcctaataggactttcttcaagagcaacctgggccaaaaatatacacacagcaataacccaagtacgaaatctgataggcaaagaggagtatgttgattatatgccagtcatgaaacgctacagcgcaccatttgagtcggaaggagtgttgtaa

SEQ ID NO: 23656 - RNA, 9867 nt, synthetic construct
  misc_feature 1..9867: note = derived and/or modified CDS sequence (opt6) from DENV-4__KU513441__SS-prME
  source 1..9867: mol_type = other RNA
tcaacaataactttgttgtgtttaatacctacagtgatggcttttcacctcagcacaagggacggtgaacctctcatgatagtagctaaacacgaacgagggaggcctttactatttaaaacaaccgaaggtataaacaaatgtacgttaatagcaatggatctaggagaaatgtgcgaggatacagttacttataaatgtccacttttagtcaataccgaaccagaggatatagattgctggtgcaatcttacgtcgacctgggtcatgtatggtacatgtacgcaaagcggagaacgaagacgtgagaaaagatcggtcgcacttacgccacatagcggaatgggtttagaaacaagagcagagacatggatgagtagtgaaggagcatggaaacacgcacaacgagtcgaaagctggattttacgaaaccctggatttgctctactagcggggtttatggcttatatgataggacaaacaggtatacagagaaccgttttcttcgtactaatgatgcttgtagcacctagttacggaatgaggtgtgtaggcgttggaaatcgcgatttcgtagagggagtaagcggaggagcttgggtagatttggtactagaacacggaggatgcgttaccacgatggcacaggggaaacccactttagacttcgaacttactaaaaccactgctaaagaagttgccttattacgtacctactgtatagaagcccttatttccaatatcacaacggcaacacgttgtccgacccaaggagagccttacctcaaagaagaacaagatcagcaatacatctgccggagggatgtagttgataggggttggggcaacgggtgtggactatttggaaaaggaggagtagtcacttgcgccaaatttagctgctcaggcaaaataacaggcaacttggttcagatcgaaaatctcgaatacaccgtcgttgtaacagtccacaatggcgatacccatgcagtcgggaatgacacttcaaatcatggcgttacagcgaccatcacaccaagatcaccgagtgtagaagttaaattgccagactatggcgaacttacactagattgtgaacccagatcaggaatcgacttcaacgaaatgatactcatgaaaatgaaaaagaaaacctggttagtacacaaacagtggtttttagatctacccctaccttggacgacgggtgcagatacatcggaagtccattggaattataaagagcgaatggtaacgttcaaagtccctcacgcaaaaaggcaagatgtgacagtattggggagccaagaaggtgctatgcactcagcgttagctggggctacagaagtggactcaggggatgggaaccatatgttcgctggccaccttaaatgtaaggttagaatggagaaactaagaatcaaggggatgagctatacgatgtgttctggcaaattttcaatagacaaagaaatggctgaaacgcaacatggaacaactgtagttaaagtaaaatacgaaggggctggagcgccatgcaaagttcccatagaaattagagacgttaataaagaaagggtcgttggtagagttatttccgcaacaccacttgctgagaatacaaattctgtcacaaacatagaactcgagccgccgttcggagatagctatatagtgattggggtaggtaattcagccttaacactgcattggtttagaaaaggatcgtcaataggaaaaatgttcgagtcaacttatcgaggagcgaaaagaatggcaatactgggcgaaacagcatgggactttggctcagtaggaggattatttaccagtcttggtaaagctgtccatcaagttttcggatccgtctatacaaccatgttcggcggagtctcatggatgataagaatactgattggttttctagtattatggataggaaccaacagcagaaatacaagcatggctatgacgtgtatcgctgtagggggaattacgctatttttgggttttacagtgcaagctgacatgggatgtgttgtgtcgtggtctggacgtgaactcaaatgtggaagtggcatatttgtagtcgataacgtacacacatggaccgagcaatacaaattccaaccagagtcaccggcccgtctagcatcggccatcctcaacgcccataaagacggtgtttgcggaataaggtcaactaccaggttggagaatgtaatgtggaaacaaatcacgaatgaactgaactatgtcctttgggaaggtggtcatgatctaaccgtagtagctggcgatgttaaaggagtattaactaaggggaagcgcgcactaacaccaccagcgagtgatctaaaatattcatggaaaacatgggggaaagcgaagatcttcacaccagaggcaagaaattctacatttttaattgacggaccagatacatcagaatgtcctaatgagcgtcgtgcatggaatagctttgaggtggaggactatggttttggcatgttcacaacgaatatttggatgaaatttagagaaggttcctcagaggtatgtgatcaccggcttatgagtgctgcgattaaagaccaaaaagcggttcatgcggatatgggatactggattgaatcttctaagaatcaaacatggcaaattgaaagagcatctttgatcgaggtaaaaacatgtttgtggccgaaaacgcacacgctttggtcaaatggagttctggaaagtcagatgttaatacctaaaagttacgccggcccattcagtcagcacaactacagacaaggttatgctacgcagaccgtagggccatggcatctgggaaaactagagatcgactttggtgaatgcccagggactacagttacaattcaggaaaactgtgatcaccgcggtccaagtttaaggactacaaccgcaagcggaaagttggtgacccagtggtgctgtcgttcttgtaccatgcccccactgcgttttctaggcgaagatggttgctggtatggtatggaaatcagacccctttccgaaaaagaggaaaatatggtaaagagtcaagtgactgccggacaaggtacatcagaaactttctctatgggattactttgcctaacgctatttgtagaagaatgccttcgacgacgcgttacaagaaagcacatgatattagcagtagtaataacactctgtgctataatattgggtggtttaacttggatggatttattgagagcgctcattatgttaggtgatactatgtctggtagaattgggggtcaaacccacctggcaataatagccgtcttcaagatgtcaccaggatatgtactaggcgtattccttcgtaagctgacatcacgagaaacagcactaatggtaattggaatggcaatgactacaacgcttagcattccacacgatctcatggaacttatagatggaataagtttaggattaatactcctaaagatagtgacgcagtttgataatacccaggtaggtacccttgcattatccttaacatttattcgatcaacaatgtcgctagtaatggcttggagaacaatcatggcagtgctctttgtagttacactcattcctctatgtagaacaagttgtctacagaaacaatctcattgggtcgagattacagcactgattctaggtgctcaagctctcccagtgtatttaatgactctaatgaagggtgcttcaagaagatcgtggccactgaatgaaggaatcatggctgtagggttagtgtcgttgctaggaagtgcgctattgaaaaatgatgttcctttggcaggaccaatggtagccggtggcttgttgttagccgcttatgtgatgtccggttcatcggctgatctatctttagaaaaagccgcaaatgtacaatgggatgagatggcggacataaccggaagtagtccaatcattgaggtaaaacaagatgaagatggctctttcagtatcagagacgttgaagaaaccaatatgataacattgcttgtaaagctagccttaataacagtttctggcctatacccactcgcaataccaataacaatgacattgtggtacatgtggcaagtgaaaacccagcgttctggtgcactatgggatgtcccttcgcccgcagcaactcagaaggcagctttaagtgaaggagtatatcgaatcatgcaacgcggtctgttcggaaaaacacaagtaggtgttggaatccacatggaaggtgtttttcatacgatgtggcacgtaacgcgaggctctgttatatgtcatgaaacgggtagactagaaccttcttgggcagatgttcgaaatgatatgatatcttacggagggggatggagactaggcgataagtgggacaaagaagaagatgtacaagtgttagccattgaacctggtaaaaacccaaagcacgtccaaactaaacccggcctattcaaaactctcactggtgaaataggggctgttactttagatttcaaacctggcacaagcggaagccccatcattaaccgaaaaggtaaagtaatcggtttgtatggaaacggtgtggtaactaagagcggtgactatgtaagtgctattacgcaagccgaaagaataggagaacccgattatgaagttgatgaagacatctttcgaaagaaaagattaacaataatggatcttcatcccggagcgggaaagaccaagagaatattaccatcgattgtgcgagaagcacttaagagaagattgcggaccctaattcttgcgcccacacgagtggtggctgccgagatggaagaagccttaagaggcctacctattcgttatcaaactccagctgtaaaatcagagcacacaggtagagaaatagtagatctaatgtgccacgcaacttttacaacacgcctactgtcatcaacaagagtacctaactataacttaatcgtaatggatgaggcccactttacagacccttcgtcagttgcagcgcgtggatatataagtactagggtagaaatgggggaagccgccgcaatctttatgacagcaacgcctccaggagcgacagacccattccctcaaagcaatagcccaatcgaagacattgagagagagattccggagagatcctggaatacaggttttgactggataacggactaccaaggcaaaacagtgtggttcgttcctagtattaaagcaggaaatgacatcgctaattgtttaaggaaaagcggcaagaaagtcatacaactatcccgcaagacgttcgatactgaatatccgaaaacaaagttaaccgattgggacttcgttgtaacaacagatatctccgaaatgggtgccaatttcagagcaggacgagtaatagatcctcgcagatgcttaaaaccggttatacttacagatggaccggaacgggttattttagcagggcctattcccgttactccagctagtgcagcacaaagaaggggtcgaataggaaggaaccccgcccaagaagacgatcaatacgtattttcgggagaccctctaaagaatgatgaagatcacgcacactggacggaagctaaaatgttgctggacaatatttatacgcctgaaggcataataccaacattattcggaccagaaagagagaaaacgcaggcaatagatggtgaatttagactaagaggcgaacagagaaaaacgttcgttgaattgatgcgacgtggcgacttaccagtgtggctcagttacaaagtagcaagtgccggaatctcatataaggatagagaatggtgctttactggcgaacgaaataaccaaatactagaagagaacatggaagttgagatatggactagagagggcgagaagaagaaattaagacccaaatggttagatgcacgagtatatgcagacccgatggcactaaaagattttaaggaatttgctagcgggagaaagtcgataacattagatatattaactgaaatagccagcttgccaacttacctctcaagtagggccaaactagccctagacaacatagttatgctacataccaccgaaagaggaggccgagcttaccagcacgccttaaatgaattgccggaatctcttgaaaccttaatgcttgttgcattacttggtgcaatgacagcagggattttcctctttttcatgcaaggaaagggcatagggaaactctcaatggggctcataacaatagcagttgcgtccggattattgtgggttgcagaaatccaacctcaatggattgccgcaagtatcatccttgagttctttttaatggtactgttaattccagaacctgaaaaacaaagaacaccgcaagataatcagcttatatatgttattctaacaatactaaccatcataggtttaattgcggcaaacgaaatggggttaatcgagaaaactaaaacagactttggattctaccaggttaaaactgaaactactatcctagatgtagacctgagaccagcatcagcatggacattatatgcagtagctactacaatacttactcccatgcttagacatacaatcgaaaataccagtgcaaatctttccctggcagctatagcaaaccaagcagcagtgctcatggggttagggaaaggatggcctttacatagaatggatttgggtgttcccctattagcaatgggttgttattcacaggtaaatcctacaactctaacagctagtttagtcatgttattagtccactacgcaattattggaccaggactacaagcgaaagccacacgggaagcacaaaaacggaccgcagctgggattatgaaaaatcccactgtagatggtatcacagttatcgaccttgaacctatatcatatgatccaaaatttgaaaaacaactgggacaggtaatgttactcgtgttatgcgcaggccaactattattaatgagaacaacctgggcattctgtgaagtgttaacactagccacaggaccgatcctaacactttgggagggtaatccgggaagattctggaatactacgatcgcagtttcgacagcaaatatttttcgtggctcatatttagcgggagcaggtttagcgttcagcttgatcaaaaacgcccaaacaccgaggcggggaacgggaacagcaggagaaactctaggagaaaaatggaaaagacaattaaatagtctcgatagaaaagaatttgaagaatataaaagatcaggtatattggaggtcgacagaactgaggccaaatcagcgctgaaagacggaagtaaaattaagcacgcggtcagccgaggatcgtcaaaaatacggtggatagtcgaacgaggaatggtgaaaccgaaagggaaagttgttgatctaggttgtggaagaggaggttggagctattatatggcaacattaaagaacgtaacggaagtaaaaggatatactaaagggggcccggggcatgaagaacccattcctatggcaacatatggttggaatttagtaaaactgcactcaggtgttgacgtcttttataaaccaaccgaacaagtggatacactactctgtgacattggcgagagttcttctaatcccacaatagaagaaggaagaactctgcgagtgctcaaaatggtagaaccttggttatccagcaaaccagagttctgtataaaagtgcttaatccatacatgcccaccgtcattgaagaattagaaaagttacaacgcaagcatggtgggaacttggttcgatgtcctctttcaagaaattctactcatgaaatgtattgggtatctggggcatcgggaaatattgtaagttcagtgaatacgacatctaaaatgctactaaatagattcacaactagacatcgcaaaccgacatatgaaaaggacgtagatctcggcgcaggtactcgaagcgtgtccaccgaaatcgaaaaacccgatatgactataataggacgccgtcttcagagattgcaagaagaacataaagagacttggcactatgaccaggagaacccttatcgcacatgggcttatcacggttcatatgaagccccctcaactggctccgctagctccatggtgaacggggttgtaaagttactgacgaaaccgtgggacgtgatacctatggtcacccaactagcaatgaccgataccacaccatttggacaacaaagagtatttaaggagaaagtagataccagaacaccccaaccaaagccaggtacaagaatggtaatgacaactactgcaaactggttatgggcattgttgggaaagaaaaagaacccaagactatgtacaagagaagagttcatatcgaaagtgaggtctaatgctgctatcggggccgtgtttcaagaggaacaaggttggacgagtgcttcagaagcggtaaatgactcacgattttgggagctagttgacaaagaaagggcactccatcaggaaggaaagtgtgaatcctgtgtttataacatgatggggaaacgagagaagaaattaggagagttcggacgtgcaaaaggaagtcgagccatatggtatatgtggttaggagcaaggtttcttgagtttgaggcactcggcttccttaatgaggaccattggtttgggagagaaaacagttggagtggtgtagaaggagaaggacttcaccgactaggctatatattggaagaaatcgataagaaagatggagaccttatgtatgcagacgacaccgcaggctgggacacacgcataaccgaggatgatttacaaaatgaggaattgattacagaacaaatggctcctcaccacaaaatattagcaaaagccatcttcaaattgacgtatcaaaacaaagtggtaaaagttttaagacctacaccaagaggagccgttatggatattattagcagaaaagatcaacggggttcagggcaagtcggtacctatggattaaacacattcacaaacatggaggtgcaattaattcgacaaatggaagctgagggagtaatcactcaagatgacatgcagaaccctaaaggactcaaggaacgggttgagaaatggttaagggagtgtggagttgatagattaaaacgcatggccatatctggcgatgattgtgttgttaaacctctagatgaaagatttggtacatcattactgttccttaacgatatgggaaaggtaagaaaagatataccccaatgggaaccaagtaaaggctggaaaaattggcaagaagtgcccttctgttcacatcactttcataaaatatttatgaaagatggccgtagcttagtcgttccgtgcagaaaccaagatgaactaatagggcgggctcgcatatcgcaaggagctggatggtcactcagagaaactgcctgtctgggtaaggcttatgcacagatgtggtccttaatgtacttccatagaagagatttgcgactagcgagtatggcaatatgttccgcagttccaacagaatggtttccaacatctcggacaacatggagtatacatgcccaccatcagtggatgacaacagaagatatgttgaaagtatggaatcgagtttggatagaagataacccgaatatgatcgacaagacaccggtacatagctgggaagacataccttatctcggtaagcgtgaagacttatggtgcggatcattaataggattgagcagcagagctacatgggctaaaaatattcacaccgcaattacccaagtgagaaatcttataggaaaggaagaatacgtagattatatgtccgtgatgaaaaggtattctgctccttcagaatcagaaggcgtgctataa

SEQ ID NO: 23657 - RNA, 9867 nt, synthetic construct
  misc_feature 1..9867: note = derived and/or modified CDS sequence (opt6) from DENV-4__KC762694__SS-prME
  source 1..9867: mol_type = other RNA
agtactatgacacttctatgcctaattccaactgtcatggcttttcacctctctactagagatggagaacctttgatgatagtggcgaagcatgaaagaggtcgaccccttttatttaaaacaacggaaggtataaataaatgtactttaatcgcaatggaccttggagaaatgtgtgaagatacggtcacatacaaatgcccattgctggtaaacactgaacctgaagatatagattgctggtgcaatcttacttcaacatgggttatgtatgggacatgcacgcaaagcggtgagaggcgacgtgaaaaacgaagcgttgctctcaccccacatagtggaatgggactcgaaacgcgagcagaaacttggatgtcgagtgaaggtgcctggaagcacgcgcagcgagtggaatcctggattctacgtaatcctggatttgctcttttggctggttttatggcgtacatgattggtcagactggaatacaaagaacagtcttctttgttttgatgatgctagtagccccaagttatggtatgcgctgtgtgggagtgggaaacagagatttcgtagaaggcgtaagtgggggagcttgggtcgacctagtcttagaacacggtgggtgcgtcacaacaatggcgcaaggcaagcccacgctggattttgagctgacaaaaacaacagctaaagaggtagcgctacttagaacgtactgcatagaagcctccataagtaatatcacgacagcgactagatgcccaacacaaggtgagccttatttaaaagaagagcaggatcaacaatatatttgcaggagagatgttgtagatagaggctggggaaacggatgcgggttgtttggtaaagggggagttgttacctgtgcaaagtttctttgctcaggtaaaataaccggaaatcttgttcaaatcgaaaatctagaatatacggtagttgtgacggtacataatggggacactcatgcagtagggaacgatacatcaaatcacggcgtaactgcgactataacaccaagaagcccatccgtagaggtaaagctgcccgattacggtgaactaactttggactgcgaaccgagaagtgggatcgacttcaatgagatgattctaatgaaaatgaaaaaaaaaacatggcttgtgcataaacagtggtttttagacttaccattaccctggacggcgggggcagacacatcggaagtccactggaactataaagaacgaatggttacgtttaaagtaccccatgcaaaacgccaagacgtcactgtattaggatctcaagaaggtgctatgcactccgcgctggctggtgcgacagaagtagactctggtgatggtaaccatatgttcgcaggacatctaaaatgtaaggtaagaatggaaaaactacgaatcaaaggaatgagctacacaatgtgctcaggtaaattcagcatcgataaggaaatggcggagacccaacatggtactactgtggttaaagtgaaatacgaaggggcaggagctccatgtaaggtacctatagaaataagggacgttaacaaagaaaaagtagttggaagaataatatcatcaacaccctttgccgaaaacaccaattctgtaacaaatatagaactcgaaccaccgttcggagattcatatatcgttataggagtaggagactcagcattgactttgcattggttccgaaaaggctcttcgatcggaaaaatgttcgaatctacctaccgaggagctaaacgcatggcaatattgggagaaactgcatgggattttggttctgttggaggactcttcacaagccttggaaaggccgtacatcaggtatttggtagcgtgtacactacgatgttcggaggtgtgtcatggatgataagaatcttaatagggttcttggtattatggataggaacaaactctcgaaatacatcgatggcaatgacctgcattgctgtgggaggtatcactttattcttgggattcacagtacaggcggacatgggttgtgttgtttcatggaatgggaaagagttaaaatgtggctctggaatattcgtcgtggacaacgtccacacttggactgaacaatacaaattccagccggaatcaccagcacggttagcgtccgcgatactcaatgcgcacaaagatggagtgtgtgggataagaagtacatcccgtttagagaatgttatgtggaaacagataacgaacgaattaaactacgttttatgggaaggcggccacgacttaacagtagtcgcgggcgatgtaaaaggtgtcttaacaaaaggaaagcgggcactaaccccaccagttaacgatttaaaatatagctggaagacctggggaaaggctaaaatattcactccggaagctcgcaatagtactttccttatagatggaccagacacaagcgaatgtcctaacgaacgacgggcctggaactttttcgaagtagaagattatggtttcggaatgttcaccactaatatttggatgaaatttcgtgaaggctctagcgaagtttgcgaccatcggctcatgagtgccgcgattaaagaccaaaaagctgttcatgcggatatgggctattggatagaatcaagcaaaaaccaaacttggcaaattgaaaaagcttccctaatagaagtaaaaacatgcttatggcccaaaactcatacactatggtctaatggagtcctagaatctcaaatgttgatcccccgatcctacgccggcccgtttagtcaacataactatcggcagggctatgcaacacagactgcaggaccatggcatctaggaaaattagagatagacttcggggagtgtcctggaacgacggtcacgatacaagaagattgtgatcatagagggccttcgctaagaacaacaacagcatctggtaaactcgtgacacaatggtgttgcaggtcatgtacaatgcctccactaagatttctaggtgaggacgggtgttggtacggaatggaaattcgaccactatcagaaaaggaagaaaatatggttaaaagccaagttactgcgggacaaggtacatcagaaacatttagtatgggtctgttgtgccttacattatttgtagaagaatgtctacgtaggcgagtaacaagaaaacacatgattctagtagtcgtaataacattttgtgccattatcttgggcggtttaacatggatggatttattacgtgcattgataatgctaggggacactatgtccggaagaatcggaggccaaattcatctagcaattatggcagtctttaaaatgtcaccaggatatgtcctaggcgtattcctgcgtaaacttacttcacgcgaaacagcgcttatggtgattggaatggcaatgacaacggtcttttcaataccacatgacctgatggaactaatagatggcataagtttgggactaatcctgttaaagatagtgacacattttgacaacacacaagtcgggactttggctctcagtctgacatttatacgttccacaacacctctagtaatggcctggcgcacaattatggcagtattctttgtagttactcttatccctttatgccgaacctcttgcctacagaaacaatcacattgggtagaaataacagcacttattctaggggcacaagcactaccagtttacctaatgactcttatgaaaggggcaagtcgtcgatcctggccactgaatgaaggaataatggcagtgggattagtaagtctattaggttcagcgctactaaaaaatgatgtccctttggctggcccaatggttgcaggtggtttactcctggcagcctatgtaatgagtggatccagcgctgatctatctctggaaaaagcagccaatgtccaatgggatgaaatggcagatattactggatcttcgccaataatcgaagtaaagcaagacgaagatggttcttttagtattcgggacgttgaagaaacaaatatgataacactattagtaaagctcgcattaataacagttagcggcttatacccgttggccatccctgtaacgatggcactttggtacgtttggcaagtaaaaacgcaaagatctggagcactctgggatgttccttcgccggcagcaacacaaaaagctacactcagtgagggtgtctaccgcattatgcaacgtggcctgttcggaaaaacgcaggttggtgtaggcatccatatggaaggagtgttccatacgatgtggcatgtgacacgaggcagcgtcatctgccatgaaaccggaaggctagaacccagctgggccgacgttagaaacgatatgatttcatacggaggcggttggcgactaggagataaatgggataaagaagaggatgtacaagtacttgccattgaacctggcaaaaatccaaagcatgtgcaaactaaaccaggactattcaaaacacttacaggtgagataggcgcagtcacacttgattttaaacctggaacaagtggatcgccaattataaacaaaaagggaaaagtcattggtttgtatggcaatggggtagtaactaaaagcggcgattatgtctcagcaataacccaagcggagaggataggcgaaccagattacgaagtggatgaggatatttttagaaaaaaacggttaacaataatggatctacatccaggagcaggcaaaacaaaacgaatacttccaagcattgtgagagaagctttaaaacgacgtctgcgaacgcttattcttgctccgacgagggtcgttgcagctgagatggaggaagccttaagaggactgccgattcgttaccaaacgccggctgtaaaatcagaacacactgggagggaaattgtcgatctcatgtgtcacgcaactttcacaacaagattgttatcttctacaagagtcccaaactataacttaatagtaatggatgaagcacatttcactgacccttgttccgtagcggccagaggatacatttctactcgagtggaaatgggtgaagcagcagctatatttatgacagcaacgccgccgggatcaatagaccctttcccacaatcaaactcacccatagaagacatcgaaagagaaataccagaaagaagctggaatacgggttttgattggataaccgattaccaaggaaaaactgtgtggttcgtaccatccataaaggcaggtaatgacattgctaactgcttgaggaagtctgggaaacgagtaatccagctcagtagaaaaactttcgacacagagtatccgaagacaaaactgaccgattgggacttcgtagtaacgaccgacataagcgagatgggagcgaattttcgagctggcagagtaatcgacccccgccggtgtttgaaacctgtaatattaacggatggaccagagagagttatactggctggcccgatccccgtaacaccggcatccgctgcacaaagaagaggtcgtatagggagaaatccagcccaagaagacgatcaatatgtattctcaggtgatccactaaaaaacgacgaagatcacgcacattggacggaagctaaaatgttactcgataatatctataccccagaaggcatcatccccacactcttcgggcccgagagagaaaagacacaagcaattgatggagaattcaggttgcgaggagaacaaagaaagacttttgtagaattaatgcgtaggggcgacttaccggtatggttaagttacaaggtcgcaagcgccggaatatcctacaaagatagggagtggtgttttacaggagagagaaataatcaaatacttgaagaaaatatggaagtggagatctggacacgagagggtgaaaagaaaaaattaagacccaaatggctcgatgctagggtatatgcggatccaatggcactcaaagacttcaaagagtttgctagtggtcggaaatctataacacttgacattttaaccgaaattgcgactttgccgacatacctttcttccaaggctaaattagctttagacaatattgtgatgctgcatacaacagaaaaaggcggcagagcataccaacatgctttaaacgagttaccggaatctctagaaactttgatgttggtagcgctgctaggcgccatgaccgctggcatctttctattttttatgcagggcaaaggaattggtaaactaagcatggggttgatcgcaattgcagtagctagtggactactctgggtagcagagatccaaccccaatggatcgcagcctccataattttagaattcttccttatggtattactaattcccgaaccagaaaaacaaaggacacctcaagataatcaattaatatacgtcattttgacgattctgacaataattggattgatagctgccaacgaaatgggtctgatagaaaaaacaaagactgactttggattctatcaagtgaagaccgaaacaaccatacttgatgtagatctaagacccgcatctgcttggacgctatacgctgtcgcgactacaatattaactccaatgttaaggcatactattgaaaataccagcgcaaatcttagtctggctgccatcgcaaatcaagctgcagtacttatgggactaggaaagggctggcctctccatagaatggacttgggtgttccgttgctagcaatgggttgctacagtcaagtaaatccaaccacactaacagcttctttagtaatgttattagttcactatgcaattattgggccgggattacaagcaaaagctacccgagaagcccaaaaacgaacggccgcaggaattatgaaaaatcccacagtagatggaataacagtcatagatctggaacccatcagttatgacccaaagttcgaaaaacaattaggccaagtaatgttactggttttatgtgttggccagttactactcatgaggactacgtgggcactttgcgaagtactaacactagcaacgggacccgttatgactttatgggaaggaaatccaggacgattctggaatactaccatagctgtcagcacagccaatatatttcgcggaagctatttggctggtgcaggtttagcattttcgttaataaaaaacgcccaaacaccgaggagaggaactggaaccaccggtgagaccctaggtgaaaaatggaaaaggcaactaaattcgttagataggaaagaatttgaggagtacaagcgttcgggaatcctggaagttgatcgaactgaagcaaaatcggctctaagagacggctcgaaaataaaatacgctgtgagtcgtggaagttcaaaaataagatggatagtagaaaggggaatgattaagcctaaaggcaaagtagttgatctaggttgtggcagaggaggttggtcctattatatggctacactaaaaaacgtgactgaagttaaaggctacactaaagggggacctggacacgaagaacccatccctatggcgacctacgggtggaatctagtgaagttacatagcggagtggatgtgttttacaagcctacagaacaagtagatacattattgtgcgacattggggaaagtagctctaacccgacgattgaagaagggaggacgctaagagtattaaaaatggtagagccgtggctatcttcgaaaccagaattttgtataaaggttttgaacccttacatgcccacagtaattgaagaactagaaaagcttcaaaggagacacggagggagtttagttaggtgccctctaagcagaaacagcacacatgaaatgtactgggtaagtggagcatcggggaatattgtatcatcagtaaacaccataagcaaaatgctattaaaccgattcactacacgccacagaaagccaacttacgaaaaagacgtggatctaggtgcggggacacgctctgtgagcactgagaccgaaaaacccgatatgacgatcatcgggcgtagactacaaagattaagggaagaacataaagaaacatggcactacgatcaagagaatccgtatcgaacctgggcctaccatggatcttatgaggctccatcaacaggatctgcatcctccatggttaacggagttgtaaagcttctcaccaagccgtgggatgttatacccatggtcacacaacttgcgatgaccgatacgacgccattcggccaacagcgtgtcttcaaggaaaaagttgacacaaggacccctcaacctaaaccggggactagaatgattatgactacaactgcaaattggctatgggctttgctaggaaagaaaaaatctccacgactatgtacacgtgaagagtttattagcaaagttcggtcgaacgctgctataggcgctgttttccaggaagaacaagggtggacgagtgcctccgaagcagtaaatgattcgagattttgggaactagttgataaagaaagggccttgcatcaagaaggtaaatgtgagtcatgcgtttacaacatgatgggtaaaagggaaaaaaaattaggagaattcggaagagcaaaagggagtagagcaatttggtacatgtggcttggagcgagatttttagaatttgaagcgctaggctttcttaatgaagaccattggtttagtcgagaaaacagctggagtggggttgaaggagaagggttgcatcgtctaggttacatattagaagacatcgataaaaaagatggggaccttatatacgctgatgataccgcaggctgggatacaagaatcactgaagatgacttattgaatgaagaactgataacagaacaaatggctcctcaccataaaacactggccaaagctatatttaaactcacttatcagaataaagttgtcaaggtccttcgaccaactccaaagggagccgtgatggatataatttcaagaaaagatcaaagaggatccgggcaggtcggaacatacggattaaacaccttcacaaatatggaagtgcagttgatccgtcaaatggaagcagagggagtcataacacaggatgatatgcaaaatccaaagggacttaaagaacgtgtagaaaaatggcttaaggaatgtggcgtagatcgacttaaaagaatggccatatcaggggacgattgtgttgttaaaccactcgatgagcgattcagtacaagtcttctttttctcaacgacatgggcaaggtgagaaaagacattcctcagtgggaaccatcaaaaggttggaaaaattggcaagaggttcctttctgttcacaccattttcataaaatttttatgaaagatggccgttctctagtggtaccctgtagaaatcaagatgaattgattggacgggcacgaatatcccagggcgctggctggagtctaagggaaactgcctgtttaggtaaggcttacgcgcagatgtggagcttgatgtatttccatcgaagagacctgcgtctagcctctatggcaatatgttctgccgtcccaacggagtggtttcctacatccagaacaacgtggagcatacacgcacatcatcaatggatgacgacagaagatatgttaaaagtatggaacagggtatggatcgaagataatcccaatatgactgacaaaactcctgtacactcctgggaagatattccatacttagggaagagggaggatttatggtgtggttcactgatcgggctttcgagtcgagcgacatgggctaaaaatatacatactgccatcactcaggtcagaaatctcataggcaaggaagagtatgttgactacatgccagcaatgaaaagatatagtgctccatttgaatcagaaggcgtgttataa

SEQ ID NO: 23658 - RNA, 9867 nt, synthetic construct
  misc_feature 1..9867: note = derived and/or modified CDS sequence (opt6) from DENV-4__KC762695__SS-prME
  source 1..9867: mol_type = other RNA
tctaccatgactctgctatgcttaataccaaccgccatggcattccacttgtctacaagggatggcgaacccttgatgatagttgctaaacatgaaagggggagacctttattatttaaaacaaccgaagggattaacaaatgtacattaattgcgatggatctaggggaaatgtgcgaagataccgtgacatacaaatgccctttattggtaaacaccgaaccagaggacattgactcctggtgcaatttaacatcaacctgggtaatgtacggtacatgtacacaaagtggggaaagaagacgagagaaaagatccgttgcattaactccccatagtgggatgggattggagacccgagcagagacttggatgtcatcagaaggcgcatggaaacatgcacagagagttgagtcctggatattaaggaatccggggttcgcacttctggcaggcttcatggcatatatgattggtcagacaggcatacaacgaaccgtattctttgtgttaatgatgctagtggcacccagttatgggatgagatgtgtaggagtaggaaaccgcgatttcgtagaaggcgtttcagggggcgcttgggtggatcttgtgttggaacatggcggctgcgttacgactatggctcaaggaaaaccaactctcgactttgaactcacaaaaactacggctaaggaagtcgctttgttacgaacttattgcatagaggcttcaatttcaaatataactactgctactaggtgtccaacccaaggagaaccatatttaaaagaagaacaggaccaacaatacatttgtagaagagatgtagttgaccgaggctggggaaacggctgtggcctttttggaaaaggtggagttgtgacctgtgccaaatttctgtgcagtgggaaaatcactggtaacttagtgcagatagagaacctagaatacacggtcgtcgtaacagtacacaacggagacacgcatgcagtcggaaatgatacctccaaccatggtgttactgcaacgataactcctagaagtccttcggttgaagttaagttaccggattatggagaattaacactggattgtgagccgaggagcgggatagattttaatgaaatgattctaatgaaaatgaagaagaaaacatggctagtacacaaacaatggttcttagatctaccgctcccctggacggcaggagctgatacatcagaagtacactggaattataaggaaaggatggtaacttttaaagtaccacacgcaaaaagacaagacgtcacagtactaggaagtcaagaaggtgctatgcactcagctttagcaggggctacagaagttgactctgggaacggaaatcacatgttcgccggacatttgaaatgtaaggtaagaatggagaagctccgaataaaaggaatgtcatataccatgtgttccggtaagttttctattgataaggagatggcagaaacacaacacggtaccactgttgtaaaggtcaaatacgaaggagccggagctccctgtaaagttcctattgaaataagagacgttaataaggaaaaggtggttggcagaataatatcatcaaccccttttgccgagaataccaactctgtaacgaatattgaactagaaccaccattcggcgactcatacattgttattggggtaggggacagtgccctaactcttcactggtttagaaaaggttcaagtattggtaaaatgtttgagagtacctacagaggtgcaaaaagaatggcaatattgggcgaaacagcttgggattttggtagcgtcggagggctatttacaagtttaggaaaggctattcatcaagtattcggctcagtatatacaaccatgttcggaggcgtaagttggatgatccgaatcctaattggactcttagtcctttggattggtaccaactcaaggaacacttctatggctatgacttgcattgcagttggtgggataacgctgtttttaggtttcaccgtccaagcagatatgggatgcgttgtctcgtggaacggaaaagagctaaagtgcgggagtgggatatttgtagtcgacaacgtgcatacttggactgaacaatataaatttcagcctgaatcaccagcaagattagcatcagctattttaaacgcacataaagatggagtctgtggaataagaagtacgacacgactggaaaatgtgatgtggaaacaaataacgaatgaattaaattatgtgctgtgggaaggaggacatgacctaacagtagtagccggagacgtcaagggagtgctaactaaaggcaaaagagctttgactcctccagtaaatgatctgaaatacagttggaaaacatgggggaaagcgaaaatatttaccccagaagccaggaacagtacctttttaatagatggacctgacacatctgagtgcccaaatgaaaggagagcatggaactttcttgaagtcgaagattacggattcggcatgttcagcaccaatatatggatgaaattcagggaaggttcaagtgaagtatgtgaccatcgcttaatgtcagcagcaataaaagaccaaaaagcagttcatgccgacatggggtactggatagagagctccaagaatcaaacttggcaaatcgaaaaagctagcttaatcgaagttaaaacatgcctatggcccaagacgcacacgctatggtcaaacggagtcttagaaagccaaatgcttattcctcgctcctatgcaggaccattcagccagcacaactacagacagggctatgcaacacagatagcagggccttggcacttgggcaaactggaaatagattttggtgaatgtccggggacaacagtaacaatacaagaagattgtgaccaccgaggtcctagtctcaggacaacaacagcaagcggaaagctagtaacccagtggtgctgtagaagctgtacgatgccacctttaaggtttttgggcgaggatggatgctggtatggcatggaaatccgtccgttatcagagaaagaagaaaacatggttaaaagtcaagttactgcaggccaaggcacaagtgaaacgtttagcatgggcctattatgcttaactttatttgtagaagagtgcctaaggagaagagtaacccgtaaacatatgatactcgttgtgaccattacattttgtgcaataattttaggaggattaacttggatggatttattaagggctttgataatgctaggtgacactatgtccggtagaataggtggacaaatacacctagctattatggctgtgtttaaaatgtcaccgggctatgtcctaggggtcttccttagaaaattaacaagccgcgaaacagccctgatggttatcggtatggcaatgacaactgtatttagcataccacatgacctaatggagcttattgatggtataagcctgggtttgattttgttaaagatcgtcacccattttgacgacactcaagtaggaactcttgcgttaagtcttacttttatcaggtcaaccacgccgttggtgatggcttggaggactataatggcagtcttctttgtagtaacattaataccattgtgtaggacatcctgcttgcaaaaacaatcgcattgggtagaaataactgcgttaattcttggcgcgcaagcactgccagtgtatcttatgactttaatgaagggagcttcaagacgatcatggccactcaacgaaggtattatggctgtaggcttagtgtcactattaggtagtgccttattgaagaatgacgtacctctagcaggacccatggtagccggcggattacttttagcagcttacgttatgagcggctcgagtgctgacctttccctagaaaaagctgctaacgttcaatgggacgaaatggctgacattactggttcttcaccaatcatagaagttaaacaagacgaagacggatcgttctctatacgagacgtagaagaaacaaacatgattacacttctcgtaaaacttgctttgataacggtgtcaggactttatcccttagcaattccggtgacaatggcgttatggtatatatggcaagtaaaaacacaacgatcaggtgctctctgggatgtaccatcgcctgtggcaactcaaaaagctacattaagtgaaggggtttatcgtattatgcagagaggattatttggaaaaacacaagtaggggttggcatacatatggagggagttttccacaccatgtggcatgttacgaggggaagcgtgatctgtcatgagacaggtcgacttgaaccgtcatgggccgatgtacgtaatgatatgatatcctacggcggaggttggcgactcggggataaatgggataaagaggaagatgtgcaagttctagcaatagagccaggcaaaaatcctaaacacgtacaaactaagcctggtctcttcaaaactcttacaggagaaattggcgcagttacattagactttaaaccaggcacctcagggtctccaataatcaataagaaaggaaaggtaatcgggttatatggaaacggcgtcgtaactaagtcaggtgattatgtctcagcaataactcaagcagagaggataggagaacctgactacgaggtcgatgaagacatattcaggaagaaaaggcttacaatcatggatttacatcctggagctgggaaaactaaacggattttacccagtatagtgcgggaagccctaaaacgaagattaagaacattaatcctcgcccctactagagttgtagctgccgaaatggaagaagcattaaggggtcttccaataagataccaaactccagcagtgaaaagtgaacacacagggcgcgagatcgtggatttgatgtgtcacgcaactttcacgacaagactcttgtcgtctacacgagtaccaaactacaatttgattgtcatggacgaagcacactttacagatccctgttcagtagcagcacggggatacatatcaacaagagtagaaatgggagaggccgccgcaatattcatgactgctaccccaccgggatctacggatccattcccccaatcaaattcaccgatcgaagacattgaaagagagatcccagaaagaagttggaacacgggatttgattggataacagattatcaaggtaagacagtttggtttgtacccagtataaaggcgggaaatgatatagcaaactgcttacgaaaaagtggaaagagggtaatacaactatcgagaaagacgtttgataccgagtatcccaaaaccaaactaacagactgggactttgtagtaacgaccgacatatccgaaatgggtgcgaattttagagcgggaagagtaatcgatccaaggagatgcttaaaaccggtaattcttactgatggacctgaacgcgtaatcttagccggtccgattcctgtcaccccagcaagtgctgcacaacgccggggcagaataggtaggaatccagcccaagaagacgatcagtatgtcttttcaggtgacccgctgaaaaatgacgaagatcacgctcactggactgaggccaagatgctactagacaacatatatacccctgagggaataattccgaccttatttggcccagagagggagaaaactcaggcaatagatggagaatttaggctaagaggggaacaaaggaagacattcgttgaattaatgcgtaggggtgatttacctgtctggctatcatataaagtcgcatctgctggaatttcctataaagacagagaatggtgcttcactggagaaagaaacaatcagattctagaggagaacatggaagtggagatatggacaagggaaggagagaagaagaagctacgaccaaaatggttagacgcaagagtgtacgccgaccctatggccttgaaggatttcaaagagttcgcgtcaggtcgaaaatcaattactttggacatactaaccgagatagctacactacccacctacttgagttctaaagcaaaattagcgcttgataatatagtaatgttacatactactgaaaaaggtggaagggcatatcaacacgctttgaatgagctaccagaatcattagagacattaatgctcgtagcactactaggggcaatgacagccgggatatttctatttttcatgcaggggaaaggtattggtaaactaagcattggccttatagctatagcagtcgcttcagggctattatgggttgctgaaatacaacctcaatggatcgctgcttcaattattttagagttcttcttgatggttctcctaatccctgagccagaaaaacaaagaacaccccaggataaccaattaatatacgtaatccttacaattctaacaataataggtctcatcgcagctaatgaaatgggacttattgagaaaaccaaaacagactttgggttttaccaggtaaaaactgaaactactatcctagacgtcgacctcagacccgcttcagcatggactttgtatgcagtcgcaactactatattgacacccatgttacgccatacaatagaaaacacatcggccaacttatccctcgctgcaatagcaaatcaagctgcagttttgatgggtttaggaaaaggttggccactacacagaatggatctaggggtacccttactagccatgggatgttatagccaagtaaatccaactaccttgaccgcgagtcttgttatgctgttagttcactatgcaataattggtccaggtctacaagccaaagcaacacgtgaagcccagaaacgcactgcagctggcattatgaaaaatcctactgttgatggaatcacagtaattgatctcgaacccatttcttatgatccgaaatttgaaaaacaactagggcaagtaatgctcttagtcctatgtgtgggtcaattacttttgatgagaacaacctgggcactatgcgaagtactgactctggcaacaggacccatcatgactttatgggagggaaatcctgggaggttctggaacacgaccattgcggttagtaccgctaacatcttcaggggaagctatttagcaggggccggtttagcctttagtttaatcaaaaacgcacaaaccccacgacgcgggacaggaaccaccggagaaacattgggagaaaaatggaagcgacaactgaatagcttagatcgcaaagagttcgaggaatataagaggagtggcatattggaagttgacaggactgaagcgaagtcagcattaagagatggctcaaaaataaaacatgctgttagtagaggatcatcaaaaataaggtggatagtggaaagaggcatgatcaaacccaagggaaaggtagttgatctaggctgcggccgaggtgggtggagttactatatggcaactttaaagaacgttaccgaggtaaaaggatacacgaaaggtggaccgggccatgaagaaccaataccaatggctacgtatggatggaacctggttaaattacacagtggagttgatgtattctataaacccacagaacaagttgacaccttactgtgtgatatcggagagtcatcatcaaatccaacaatagaagaaggaagaacacttcgagtattaaaaatggttgagccatggttgtcgtcgaagccagaattttgcattaaagttttaaatccttatatgcccacagtgattgaagaactagaaaaactacagcgtcgacatggagggagcctagtaagatgtcctctatcgcgaaacagcacccatgaaatgtactgggtatcaggtgctagcgggaacatcgtgagctcagtcaacacaatttcgaaaatgttgcttaatcgttttacaacacgacatcgaaaaccaacatacgagaaggacgtagacctaggagctggaacgcgaagcgtgtccacagaaactgagaaacctgatatgacaattataggaaggcgtctacaaaggctgcgagaagaacataaagagacatggcattatgatcaggaaaacccatacagaacatgggcatatcatggtagctacgaagcaccgtctacgggaagtgcaagcagtatggtcaacggtgtagtaaaacttcttacaaaaccatgggatgtaataccaatggtgacacaattagctatgaccgataccactccgttcggacaacaacgagtgttcaaagaaaaggtggatactaggacaccacagccaaaacccggtacgagaatgataatgaccaccactgcaaattggttgtgggcgctgctcggaaagaagaaatcaccaagactttgcacgagggaagaatttatctccaaggtgcgatctaatgctgccataggcgcagtattccaagaggaacaaggctggacaagcgccagcgaagcagtaaacgattctagattttgggagctagttgacaaagaacgcgctctccaccaagaaggaaaatgtgaaagttgcgtttataatatgatgggtaaacgagaaaagaaacttggcgaatttggacgtgcgaaaggcagcagagctatttggtatatgtggttgggagcaaggttcctagagttcgaggcacttggatttcttaatgaagaccattggttctcccgagagaacagttggtcaggcgttgaaggcgaggggcttcatcggctcggatacatactagaagatattgataaaaaggacggggatcttatctatgctgatgatacagctggatgggataccagaataactgaagatgacctattaaatgaagaactaattacggaacaaatggcaccccaccataaaactttggcgaaggccatattcaaacttacgtatcaaaacaaggtggtcaaagtgcttagacctactcctaagggagcagtgatggatataataagtcgtaaggatcaacgaggaagtgggcaagttggaacctatggactaaatacctttacgaatatggaagtacaattaatacgccagatggaggcggaaggagtcataacacaagatgacatgcaaaaccccaaaggcttagaagaacgtgtagaaaagtggctcaaagaatgcggagttgaccgacttaaacgaatggcgatatccggagacgactgcgtagtaaaacctctagatgaaagattttctacgagcctattatttctaaatgacatgggaaaggtacgaaaagacattcctcaatgggaaccctcgaaaggatggaaaaactggcaagaggttccattttgctctcatcatttccataaaatctttatgaaagatggacgttcacttgttgttccttgcaggaatcaggatgaactaatcggtcgcgcaagaattagtcaaggggctggttggtctcttagggaaacagcatgtttaggtaaagcatatgctcaaatgtggagcctaatgtatttccatcgtagggatctcagactagcaagtatggcaatatgtagtgcagtcccaactgagtggtttccgatcagtcggactacatggtccatccatgcccaccaccagtggatgactactgaagatatgctcaaggtatggaacagagtatggatagaagataatccgaacatgacagataaaacgccaatacacagttgggaggacatcccctatttaggaaaaagggaagatttgtggtgcggatccttaattgggctaagttcacgcgccacatgggctaaaaatatacacactgcaatatctcaggtaaggaatctaatagggaaggaagagtacgttgattacatgcctgtaatgaaacgttactcagctccaagcgaatccgaaggtgtattatag

SEQ ID NO: 23659 - RNA, 9867 nt, synthetic construct
  misc_feature 1..9867: note = derived and/or modified CDS sequence (opt6) from DENV-4__KC762696__SS-prME
  source 1..9867: mol_type = other RNA
tccactatgacgctcctttgcttaattcctactgtaatggcattccacttaagtacaagagatggtgaacctctgatgatagtggcgaaacatgaaagaggaaggcctctattatttaaaaccacagaaggaataaataaatgcacccttatagcgatggatctaggtgaaatgtgtgaagacacggtgacatacaaatgtccccttttagttaacaccgaacccgaagatatagactgttggtgtaacctaacatcgacatgggtaatgtacggaacctgcacgcaaagcggtgaaagacgtcgagagaaaaggtcagtagcgctgacgccacacagcggaatgggactcgaaacgagagcggaaacttggatgtcaagtgaaggcgcgtggaaacatgcgcagagagtagagagttggatactacgaaacccaggatttgctctgttagcgggatttatggcatacatgataggccagacaggtatacagaggacagtcttctttgtcctaatgatgttagtagctccgtcatatggtatgcgatgcgtaggagttggaaatagagattttgttgaaggggtctcaggcggagcatgggtagacttagttttagaacatggcggttgcgtaaccacaatggcacaaggaaaaccgactttagattttgagctcacaaaaacaaccgcaaaggaagtagctctattgcgaacgtattgcatagaagcatcaatatcaaatattaccactgctactagatgcccaacccaaggggaaccctatttaaaagaagaacaagaccagcaatatatatgccgcagggatgtggtcgatagagggtggggcaacgggtgcggtttattcgggaaaggtggggtcgtcacatgtgcgaaatttctttgtagtggtaaaatcactgggaatttagtccagattgaaaatttggaatacaccgtcgtagtaacagttcataacggtgatacacacgcggttggtaatgatacatcgaatcacggagttactgccacaataacaccacgctcgccttctgtagaagtaaaattacctgactatggtgaactaacattagactgtgagccccgtagcgggattgatttcaatgaaatgatcttaatgaagatgaagaagaaaacatggttagtccataaacagtggttcttagatctaccattaccttggaccgccggagccgatacatcagaagtccattggaattataaagagagaatggtgacattcaaagttccacatgcaaaacggcaagatgtaacagttctcggatctcaagagggcgccatgcacagtgctttggccggtgcaaccgaagtagacagtggagacggaaatcacatgttcgcaggacatttaaaatgcaaagtaagaatggaaaaactgcgtataaaaggaatgtcttacaccatgtgttctggaaaattcagcatagacaaagagatggctgaaacgcaacacggaaccaccgtagtaaaagttaaatacgagggtgccggcgcaccgtgcaaggtacctatagaaataagggatgtaaataaggagaaagttgtaggcagaattatctcatcaacgccttttgctgaaaacaccaatagcgttacaaatatcgaactagaaccaccttttggcgattcatacatagtaataggtgtcggggactcagctttgacattgcactggttcagaaaaggaagttcaattggaaaaatgtttgaatctacatatagaggagctaaacggatggcaatactaggcgaaaccgcttgggattttggaagtgtagggggtctttttacttctcttggaaaagcggtgcatcaagtattcggatcggtttataccacaatgttcggtggtgtatcttggatgattagaatattaataggatttctagttttgtggattggaaccaatagtaggaacacaagtatggcaatgacctgcatagcagtagggggaataacattattcctaggatttactgtacaagcagacatgggatgtgttgtaagttggaacggcaaggaactaaagtgcggctctggtatctttgtcgtcgacaatgtacatacttggacagaacagtataaattccaaccagaaagcccagctcgccttgcatcggcaatcttgaatgcccataaagacggtgtctgtggcattcgttcaactacacgactagagaatgtgatgtggaaacaaatcacgaatgaattgaattacgttttatgggaaggaggacacgatcttactgtcgttgcgggagacgtgaagggagtgcttactaaaggcaaaagagctttaactccaccggttaatgatttaaaatactcctggaagacgtggggaaaagccaaaatatttacccccgaagccaggaatagtacattcttgattgacggtcctgacacctcagaatgccctaatgagagacgagcatggaatttctttgaggttgaagactacggttttggcatgtttaccacgaatatctggatgaaatttcgtgaaggaagctctgaagtatgtgatcacaggttgatgtcagcagctatcaaggatcagaaagcagtacacgcagatatgggttactggatagaatcatccaaaaatcagacatggcaaatagaaaaagcgtcacttatagaagtgaaaacttgcctctggccaaaaacgcacaccttgtggtctaacggagtcttagagtcacaaatgctaataccgcggtcatatgcaggcccgttttcccaacataattatcggcagggatacgccactcaaaccgcgggaccctggcacttaggaaagttagaaattgacttcggcgaatgcccggggacaacagtcaccatacaagaagactgtgaccatagagggccaagtctaagaacaactacagcaagcgggaaattagttactcaatggtgctgtagatcatgtacaatgcctcctttaaggtttttaggtgaagatggttgttggtacggaatggaaataaggccattatcggaaaaagaggaaaatatggtaaagagtcaagtaaccgctggacaaggcacgagtgaaacctttagtatggggcttctatgcctcactctcttcgtcgaagagtgtctccgccgacgcgtaacacggaagcacatgatcctagtagttgtcattactttctgtgccataattttaggtggcctcacatggatggacttgttacgtgcactgataatgctaggggataccatgtcaggacgtatagggggccaaatccatctagcaataatggcagttttcaaaatgtcaccaggatatgtactcggtgtgttcctcagaaaactaacatctcgagaaactgctctaatggtcattggaatggctatgacgacggtgttttctattccacacgacttgatggaattaatcgatggaatttccctaggtttaatcatcttaaaaatagtaacccactttgacaacacgcaagtcggcacattagctctaagcctcacgtttatccgcagtacgacgcccttagtcatggcgtggcgcactattatggcagtattctttgtagttacattaataccactatgtagaacttcttgtttacagaaacaatctcactgggtagaaattacggcattaattcttggtgcgcaggcactgccggtttacttaatgaccttaatgaagggagctagtaggaggtcgtggccgttaaacgaagggataatggctgttggtctagtatctttactcggttctgcgttgctaaagaacgatgttccactagctggaccaatggtagcgggaggattattgcttgccgcatatgtaatgagtggatccagtgccgacctcagtctagagaaagcagcaaatgtacagtgggatgagatggcggatataacaggctctagtcctatcatagaagtcaagcaagacgaggatggtagtttttcaatacgtgacgtagaggagacaaacatgataacgcttctagttaaattggctcttataacggtatcaggactatatccattggccatcccagttactatggcactctggtatgtatggcaggttaaaacacaacgatcaggcgcgctttgggacgtaccaagtccagctgcaacgcagaaagccaccttgagcgaaggagtatacagaatcatgcagcgaggattattcggaaaaactcaagtaggtgtaggaatacatatggagggagtatttcatactatgtggcacgttacgcgaggctcagtaatttgccacgaaacaggaagactagaacccagctgggcagacgttcgcaatgacatgatttcttacgggggtggttggagattgggagacaaatgggataaagaagaagatgtacaagtactcgcaatagaaccaggcaagaacccaaaacacgtacagacaaaacccggtttattcaaaactctaacaggggaaataggtgcagtaacactagatttcaaaccaggcacatcgggatcaccgataataaataaaaagggaaaggtcatagggctatatggtaatggggtggtcactaagagcggtgactatgtctctgcaataactcaggctgagcgaattggcgagcccgattacgaagtagatgaagacatctttcgaaagaagagactaacgattatggatttgcatccaggggcaggaaagacgaaacgaatattaccaagcatagtgcgagaagcgttgaaaagacgtcttcgcactttaattcttgcacccacgagagttgtcgcggctgaaatggaggaagcgttaagagggttaccaataagatatcaaacgccggcagttaaatccgaacacacagggcgagaaatagtagacctaatgtgtcatgcaacgttcaccacaaggctattatcaagtactagggtgcctaattataatctcatcgtaatggatgaagctcattttactgatccttgtagtgtggcagctcggggctacatttcgaccagagtcgaaatgggcgaagcagcagcaatcttcatgaccgcaacaccaccaggcagcatagatccatttccacaatcaaattctccgatagaggatatagagagagaaataccagaacggtcttggaatactggttttgactggataacagactaccagggaaagacagtctggtttgtaccgtcaatcaaggcaggaaacgacattgctaattgtctccgaaaaagcgggaagcgggttatacaactaagtaggaagactttcgataccgaataccctaaaacaaaactaacggattgggacttcgtagtcacaactgacatatcagagatgggagcaaacttccgagcagggagagttatagacccgcgaagatgcttgaaacctgttattctgacagacggtccagaaagggtaatccttgcgggaccaatccctgtgactcctgcttcagcggcgcaaagaaggggtagaatcggtagaaatccagcgcaagaagatgaccaatacgtattttctggagatccactaaagaatgacgaagatcatgcacattggaccgaagccaaaatgcttttagacaacatctatacgccggaaggtataatacctactttgtttggtcctgaaagagagaaaactcaagccatcgatggagaatttcgcctacgaggggaacaaaggaaaaccttcgtagaattaatgcgacgaggcgacctgcctgtgtggctttcttataaagtggcttccgccggaataagttataaagatagggaatggtgcttcacgggagagagaaacaatcagatattagaagaaaacatggaagtagagatctggacgagagagggagagaaaaagaaacttcgacccaagtggttggatgctcgtgtatacgcagatcccatggcgctaaaagattttaaagagttcgcaagtggtagaaaaagtatcactttagatatcctgacagaaatcgctactcttccaacctacctatcatcgaaagctaaattagccctagataatatagtaatgttacacaccacagaaaagggaggacgagcctaccaacacgcccttaacgaactacctgagagcttagagactctgatgttagtcgccctgttgggtgcaatgaccgcaggcatatttttgttctttatgcaaggaaaaggtataggaaaactgtcgatggggctcattgcaatagcggtcgcatccggcctactttgggtcgctgaaatacaaccccaatggatagcagcaagcattattctagaatttttcttgatggtacttttaattcccgaacccgagaaacaaaggacgccacaggataaccagttgatatacgtaatacttactattctgacaataataggacttatagcagcgaacgaaatgggcttaatcgagaaaacgaagaccgatttcggattttaccaagtcaaaactgaaacaacaatattagatgtagacctaagacccgccagtgcatggaccttgtatgctgtggcaacaaccatattaacacccatgcttcggcatacaatagagaacacgagcgctaatttatcattagcggccatagcaaatcaggccgcagtgttaatgggactgggaaaaggttggccattacaccgcatggaccttggagtccctctcttagccatggggtgctacagtcaagtgaatcctactaccctaacggcatcgctagtaatgttattagtgcactatgccataattgggcctggattacaagcaaaggcgactcgtgaagcacagaaacgtacagcagcaggaatcatgaaaaatcctacagtagatggtataacggttattgatctcgagccaatctcatatgacccaaagtttgaaaaacagttaggccaagtaatgttacttgttctttgtgttggtcaactccttcttatgcggacaacgtgggcattatgtgaggttttaacccttgctacaggcccggtcatgacattatgggaaggaaatccgggtagattttggaacacgacaatcgctgtcagtacggcaaacatattcagaggtagctacttagcgggagccggactcgcgttttcgttaatcaaaaatgcacaaacaccgagaagaggaacaggcacgacaggagaaactttaggagaaaaatggaaacgacaattaaattccttagatcgaaaagaatttgaggagtacaaaagaagtggcatcctagaagtagatcggacagaagccaaatctgcgttgcgagacgggtctaaaataaaatatgccgtttctagaggctcctctaagataagatggatagtagagagaggcatgatcaaacccaaaggcaaagtagtggatttggggtgcggaaggggcgggtggtcttactacatggctactcttaaaaatgttacggaagtaaaaggatatacgaaagggggccctggacatgaagaacccattccaatggctacatacgggtggaatttagtcaaactccattccggggttgatgtattctataagccaacagaacaggtagatacactactctgtgacataggagaatcaagttcaaatcctaccatagaagaaggcagaacacttagagtcttaaaaatggtagaaccatggctaagctccaagccggagttctgtattaaagtactaaatccttatatgccgacagtaatagaagaactagaaaaacttcaacgaagacatggcggatcgttagtgcgatgccctttatctcgaaattcaactcatgaaatgtattgggtatctggagcaagtggaaatatagtatcgtcagttaacacaataagcaaaatgctgctaaataggttcacgacaaggcatagaaaacccacatacgaaaaagacgtagatctaggcgcgggcacaaggtcagttagcacggaaacagaaaagccagatatgacaattatcggcagacgtttacaacgccttagagaagaacataaagaaacttggcattacgaccaagaaaacccatacagaacttgggcatatcatgggtcatatgaagcaccgagtacaggtagcgccagcagtatggtcaatggtgtagtaaaacttttaacaaaaccatgggatgtaatacctatggtaacacaattagcaatgactgatacaacacctttcggacaacagagagtattcaaagagaaggtggacacaagaaccccacaaccgaaacctggtacgagaatgattatgaccacaaccgcaaattggctgtgggcactattaggcaagaagaaatcaccgcgtttatgcaccagggaagaatttattagcaaagtacgtagtaatgcggcaatcggagctgtttttcaagaagaacaaggctggacatcagcgagcgaagctgtaaacgattcgagattctgggagctagtagacaaagaacgtgctttacaccaggagggtaagtgcgaatcatgtgtttataacatgatgggaaaaagggaaaagaaattaggagaatttggaagggcgaaagggagtcgtgctatatggtacatgtggctaggtgcaaggtttctggaatttgaagcactaggcttcttaaatgaagaccactggttttcacgcgaaaattcatggtcgggagttgaaggcgaaggactccaccgattgggatacattctagaagacatagacaaaaaggacggtgacctcatatatgctgatgatacagcaggttgggatacacgaatcactgaagacgacctgttaaatgaagaattaataacggaacaaatggctccacatcataagacactagctaaggccatatttaagctgacctaccaaaataaggtagttaaggtactaagaccaactcctaagggggcagtcatggatataatctcaagaaaagaccagagaggaagcggtcaggtcggcacctatggtttaaacacatttaccaacatggaggtccaacttataaggcagatggaagctgaaggtgttataactcaggatgacatgcaaaatccgaaaggtcttaaagaacgtgtagaaaaatggctaaaagagtgtggtgtagaccgactaaaaagaatggccattagtggtgacgattgtgttgttaaaccattagacgagcgtttttcgacatctttactttttcttaatgatatgggaaaggtaagaaaagatatcccgcagtgggagccctcgaaaggttggaaaaattggcaagaagtacctttctgctcacaccattttcacaagatcttcatgaaagatggtagaagtctcgtggtaccttgccgaaatccagatgagctaattggtagggcacgcatttctcaaggtgccggctggagcttgagagaaacagcctgccttgggaaggcttacgctcaaatgtggtcactcatgtattttcacagaagggacttaagattagcatcaatggcgatttgctcagccgtaccaacagaatggtttcctacttcacgcacaacctggtcgattcacgcacaccaccaatggatgacaaccgaggatatgctaaaggtatggaacagagtttggatcgaagacaatccgaacatgacagataagactccagtgcattcatgggaagatataccatacttggggaaacgagaagatttatggtgcgggagcctaattggtctaagtagtagagcgacgtgggcgaaaaacatacacacagcaattactcaagtgagaaatttaatagggaaagaagaatatgtagattatatgccagctatgaagaggtacagcgcacctttcgagagcgagggagttttatag

SEQ ID NO: 23660 - RNA, 9867 nt, synthetic construct
  misc_feature 1..9867: note = derived and/or modified CDS sequence (opt6) from DENV-4__KC762697__SS-prME
  source 1..9867: mol_type = other RNA
agcactatgacattactatgtttaattcctacagccatggcatttcacctctcaacacgggatggtgaaccattaatgatagtcgccaaacacgaacgcggacggccattactattcaaaactacagagggaattaacaaatgcacattgatagcgatggacctcggagaaatgtgtgaagatacagtaacgtataaatgccccctcctagttaacactgaacctgaagatatagattgttggtgcaatttaaccagtacgtgggtaatgtatgggacctgcactcaatcgggtgagcgcagaagagaaaaacggtcagtggctctcacgcctcattcaggaatgggattagaaacccgcgcagaaacgtggatgtcttctgagggagcgtggaaacacgcacagagggttgaatcttggatattacgaaatcctggttttgcattattagctggctttatggcatatatgattgggcagacagggattcaacgaacagtattctttgttctaatgatgcttgtcgctccctcatatggaatgcgctgcgtaggggtaggaaatcgggattttgtcgaaggagtgagtggtggagcatgggtagatctcgtcttggagcatggtggctgtgttacaacaatggcccaaggcaaaccgactttagattttgaattaacaaaaactacggctaaagaggttgcactactgagaacatattgtattgaggcctcaatatcaaatatcaccacagctacgaggtgccccacacaaggtgaaccctatttaaaagaagaacaagatcaacagtacatatgccgacgtgatgttgttgataggggttggggaaatggctgtggactgttcggcaaaggtggtgtagtgacatgcgcaaaatttctatgtagcgggaaaataactggaaatctcgtacagatcgaaaatctagagtatacagtggtagtaactgttcataatggcgatacccatgcagtaggaaatgacaccagtaatcatggcgtaactgcaacgataacccccagatctccctcagtggaggttaaactgcccgattacggggaactaacactagactgtgaaccgaggtctggaattgacttcaatgaaatgattcttatgaagatgaagaaaaagacatggttggttcataagcagtggtttttagatctaccccttccatggacggcaggagctgatacaagtgaggttcattggaactacaaagaaaggatggtaacttttaaagtgccgcatgcaaaacgccaagatgtcacggtattgggatcccaagaaggggcaatgcacagcgcactagccggtgcgacagaagtagattctggggatgggaatcacatgtttgccggccatttaaaatgtaaagtacgtatggagaaactgaggataaaaggtatgtcttacacgatgtgtagcggtaaattctcaatagacaaggaaatggcggagacccaacatggaacgactgtcgtgaaagtaaaatacgagggagcgggtgcgccttgtaaagtaccgattgaaatacgtgatgttaataaggaaaaggtagtagggagaataatttcatcaactccgtttgcagaaaatactaactctgtgaccaatatcgagctagagccaccctttggtgattcttatatcgtaataggagttggagattcggcattaactctgcactggttcaggaaaggtagctccataggaaaaatgttcgaaagcacgtatcgaggagcaaaaaggatggctattcttggcgaaacggcatgggacttcggttccgttggtgggctgtttacttccttggggaaagcagtacatcaagttttcgggtcggtatacacaactatgttcggtggagtttcctggatgataaggattctcattggcctcctagtcttatggattgggacgaactctcgtaatactagcatggccatgacttgcattgctgtcggaggcataacattatttctaggattcacagtccaagcagatatgggctgcgtggtcagctggaatggaaaagaattgaaatgcggatcgggaatttttgtggtcgataacgtccatacatggactgaacaatataaattccaaccggagagccctgcaagacttgctagtgctatattgaatgctcacaaagatggtgtctgtggaatcaggagtaccacccgactcgagaatgtaatgtggaagcaaataaccaatgaactaaactatgtattatgggagggtggccacgatttaactgtagtcgcaggggatgttaaaggtgtactgactaaagggaaacgtgttcttaccccaccagttaatgatctaaagtatagctggaaaacctggggtaaggcaaaaattttcacccctgaagcaagaaattctacatttctcattgatggccctgacaccagtgaatgccccaatgaacgcagggcatggaatttcttcgaagtcgaagactatggatttggtatgttctcgacaaacatctggatgaaatttagggaaggaagcagtgaagtatgtgaccacagattaatgagtgcagccataaaggatcaaaaagctgtgcacgcggatatgggctattggatagaaagttctaaaaaccaaacctggcaaatcgaaaaagcatctctaattgaagtcaagacctgcttgtggcctaaaactcatacgctatggtcaaatggtgttctagaaagccaaatgttaattcctagaagctacgcgggccctttttcgcagcataactataggcaaggatacgctacccagatagccggtccgtggcaccttggaaaattagaaatagattttggagaatgcccaggaactaccgttaccattcaagaagattgtgaccacagagggccatcgctaagaaccacgaccgcaagcggtaagttagtaacacaatggtgctgcaggtcttgcactatgccaccactgagattcctaggagaagatggttgctggtatggaatggaaatcagaccactgtctgaaaaagaagagaatatggtaaaatcgcaggtaactgcgggacaggggacgtctgaaacattttctatgggtctactatgtctcactctttttgtagaagagtgtttaagacgacgcgtcactaggaaacacatgatactcgtcgtagctatcactttttgcgctataattctaggaggactaacatggatggatttacttagagcactgataatgttaggagatacgatgagcggacggataggcggccaaatacatttagcaataatggctgttttcaaaatgtcccctggttatgtactcggtgtcttcttaagaaagttaaccagtagagaaacagctcttatggtaataggcatggccatgacgacagtgttttcaatcccacatgacctcatggaattaattgatggaatttcgttaggcctaattcttctaaaaatagtgactcattttgacgatacacaagtcggtacgttagctctatccctgacgttcattcgtagcacgacaccccttgtgatggcatggcgaactattatggccgttttcttcatggttactctcataccgctatgtaggacgtcctgcctacaaaaacaaagtcattgggtagaaataacagctttgatacttggcgcgcaagcactgcccgtatacttaatgacattgatgaaaggagcaagtagacgtagctggccactaaatgagggtattatggccgttggcctagtgagcttgttggggtcagcacttttgaaaaacgacgttccattagctggacccatggtagcgggcggtctattattagcagcctatgtcatgtctggtagcagtgctgatctgtcattagaaaaagcggcaaatgtccagtgggacgaaatggcagatataactggcagtagtccaattatagaagtaaaacaagacgaagacggtagtttcagtataagggatgttgaagagactaacatgatcactctcttagtgaaacttgctctaataacagtcagtggattgtatcccctagcaatacccgtaacaatggcattatggtatatttggcaggtaaaaacacaaagatcaggtgctctttgggatgttccctcacccgcagcaacacaaaaagcaacattgtcagaaggtgtataccgaataatgcaaagagggcttttcggcaaaacacaggttggtgtgggcatacacatggaaggtgtttttcacactatgtggcatgttacaagaggatcggtgatatgccatgagacaggccgtcttgaaccatcatgggccgatgtgaggaatgacatgatcagttacggagggggttggagattaggagacaaatgggataaagaggaggatgttcaagtactagccatagaaccaggaaagaatcctaaacatgttcaaacaaaacctgggcttttcaaaacactgactggagaaattggggctgtcactctggacttcaagcctggcacaagtggttcaccgatcataaataagaaagggaaagtcattggcttatatggcaatggagtggtgacaaagagcggggattatgtaagtgcaattactcaagccgaaagaattggagaaccggactatgaagtagacgaagacatctttaggaagaaaagacttaccattatggatctccatccgggagcgggaaagactaagaggatccttcctagcattgtcagagaagcattaaagaggcgattaaggacgttaatcctagcacccactcgagtagtagcagctgagatggaagaggcattgcgagggctcccaatccgataccaaacgcctgcggtgaaggcagaacataccggacgtgaaatagtcgatctaatgtgtcacgctacatttactaccagactactatcgtctacaagggttcctaactacaatttaattgtaatggatgaagcgcacttcactgacccatgttcagtagcagcacgtggctacataagtacgcgcgtggagatgggagaagcggctgcaattttcatgaccgcgacacctcctggaagtactgatccttttccgcaaagcaatagtccaatagaagatattgagagggagataccagaaagatcatggaacacagggtttgattggatcaccgattatcaaggcaaaactgtatggtttgtgccatctattaaagcaggaaacgacattgctaactgccttaggaaatcgggcaagagagttatacaactaagtagaaagacatttgatactgaataccctaaaacgaaactaacagattgggattttgtggtaacaacggacataagtgaaatgggggcgaacttccgagctgggagagttattgatccaagaagatgtttgaagccggtgatactaacagatggtccagagagggtcatcctcgcaggaccaatccctgtcacccctgcatcagctgcacagagaagaggaagaatcggtcgaaaccccgcacaagaagacgatcagtacgtatttagcggagacccgttaaagaatgatgaggatcatgctcattggacagaggcaaagatgcttcttgataacatatatacaccggaaggcattataccaacgctgtttggaccagaacgggagaaaacccaagcaattgacggtgaatttcgattaagaggggaacaaaggaaaacattcgtagaattgatgcgccgcggggatttaccagtgtggttaagctacaaagttgcatcggcaggaatttcgtataaagatagagaatggtgtttcacaggagaaagaaacaatcaaatacttgaagaaaatatggaggtagagatttggacacgagagggcgagaaaaagaaactaaggccaaaatggttggatgccagggtctacgctgatccaatggcactgaaggattttaaagagttcgcgagcggcagaaaatctataacactggacatactaacagaaattgccactttaccaacataccttagcagtaaagccaagctagcattggataatatagttatgttacatacaactgaaaaaggcggtagggcgtatcaacacgctttaaatgagttgccagaatcacttgaaaccctcatgttagtcgcgctactaggcgcgatgacggctggcatttttctcttctttatgcagggaaaagggatagggaaattatctatgggattaatagcaatagcagttgcatcaggactattatgggtcgcagaaattcaacctcagtggattgcagcatctatcattctcgagttctttttaatggtactacttatcccagaacctgaaaaacaaagaacaccacaggataatcagctaatctatgttatacttacaatactaacaataatcggattaatagctgctaatgaaatgggtcttatagagaaaactaagacagatttcggattttatcaagctaaaacggaaaccactattttagatgtcgatttaaggcccgcgtcggcgtggaccttatacgcagtcgctacaacaatattaacacccatgttgaggcatactattgaaaatacttctgctaatttatctttagccgcaattgcgaatcaagccgctgtcctgatgggactaggtaaaggatggccgttacatcgaatggaccttggagtaccgcttctagcaatggggtgctattcacaagtaaatccaacaaccttaacggctagcctggttatgttgctggtacattatgcaataatagggccaggtttgcaagcaaaagccactcgtgaagcccagaaaagaacggcagcagggataatgaagaatcctaccgtggatggcataactgtgattgacctagaaccaatctcgtacgatccaaaatttgaaaaacaattaggacaagtgatgctattagtattatgcgtaggccaattacttcttatgagaacaacttgggcgctatgcgaagtcctcacgttggcaaccggaccaataatgacactatgggaagggaatccaggtcgattctggaatacaactattgcagtaagcacagcaaatatcttcaggggttcgtatttagccggagccggcctagcattttctcttattaagaacgcgcaaacacctcgtcgaggcacgggcaccacaggagaaacgctcggagaaaaatggaagagacagctaaacagcctagatagaaaagaatttgaagagtataaaagaagcggtattctggaagtcgatcgaactgaagcaaagtccgcattaagagacggatccaagataaaatatgccgtctctcggggtagcagcaaaatacgatggatagtcgagagaggtatggtgaaaccgaaaggtaaagtagttgacctgggatgtggacgaggtggatggagttattatatggcaacactcaaaaacgtgaccgaagtcaaaggctatactaagggaggacccggccatgaagaaccgataccaatggctacttatggatggaatctagtaaagctccatagcggagtcgatgtgttttataaaccgacggaacaggttgatactttgctgtgtgacatcggtgaatcatcatcgaatccaacaatcgaggaaggaagaactttacgagtgttaaaaatggtggagccttggctaagtagtaaacccgaattttgcataaaagttctgaacccatatatgccaacggtgattgaggaactagaaaaattgcagagacgtcacggtggtagcttagtacgttgtccgctctcgagaaatagtacccatgagatgtattgggtaagcggggcgtccggtaatattgtaagtagtgttaatacgatatcaaaaatgctactaaacagatttactacacgtcacaggaaaccaacatacgaaaaagatgtggacttaggtgcggggactagaagtgtaagcactgaaactgaaaagccagacatgactataatcggaaggagattacaaaggctaagagaggaacacaaagaaacatggcattacgatcaggaaaacccatacagaacatgggcataccacggttcctatgaagcaccgagtacaggatctgcctcttccatggttaacggggtagtgaaactgttaacaaaaccgtgggacgtaatccccatggtaacccaacttgccatgacagacacaaccccattcggccaacaaagagtcttcaaggagaaagtcgacacaaggacaccacaaccaaagcctggaacgagaatgataatgaccacaacagctaactggctctgggcgctcttagggaagaagaaatcaccaaggctatgcactagagaagaatttatttcgaaagttcggtcaaatgccgccataggagctgtatttcaggaagaacaaggttggacatcggcgtcagaggcagtcaacgactcaagattctgggagttagtagacaaggaacgagccctgcaccaagaggggaaatgtgaatcttgtgtgtacaacatgatggggaagagggagaagaaactcggagagtttggcagagcgaaaggctcacgtgcaatttggtacatgtggttaggagcacggttcttggaatttgaagctcttggatttttgaatgaagaccattggtttagtagggaaaacagctggtcaggtgtagagggagaaggtttacacagactgggttatatattagaagatatagataagaaggacggggatttaatatatgccgacgatacggcagggtgggatacacggattacggaagatgacttactgaacgaagaactcattacagaacaaatggcacctcatcataagacgcttgcaaaagcaatttttaaactaacctaccaaaataaggttgtaaaagtccttaggccaacaccaaagggagctgtcatggacattatatctagaaaggatcagaggggatcaggacaagtagggacatatggcctaaacaccttcactaacatggaagtacaactgataaggcaaatggaagctgaaggcgtgatcactcaggacgacatgcaaaaccctaaaggactagaagaaagagtcgagaaatggcttaaagagtgtggtgttgataggctcaagagaatggcaataagtggcgatgattgtgttgtaaaacccttagacgaaagattctctacaagtttgttgttcttaaacgacatgggcaaggtacgaaaagacataccgcaatgggaaccctcaaaaggttggaaaaattggcaggaagtaccattttgtagccatcacttccacaaaatatttatgaaagacggaagatcgttggtcgtcccatgtcggaatcaagatgaattgataggtcgagcaagaatatcacagggtgcaggctggagcctaagagaaaccgcatgccttggtaaggcttatgctcaaatgtggtcacttatgtacttccacagacgggatttaaggttagcaagtatggctatatgctcagcagtgccaaccgagtggttcccaacgagtagaactacttggtcaattcatgcccatcaccaatggatgacaactgaggatatgttaaaagtctggaacagagtatggatcgaagacaatcctaacatgacggataaaacaccaatacacagctgggaggacattccatatctcggtaaacgggaggacttatggtgcggttcattgattggactgagttctagagccacatgggccaaaaacatacataccgcaataactcaagtaagaaatctaattggaaaagaggaatacgtcgactacatgccagtaatgaaacgttattccgcaccttcagaatcggaaggtgtcctttga

SEQ ID NO: 23661 - RNA, 9867 nt, synthetic construct
  misc_feature 1..9867: note = derived and/or modified CDS sequence (opt6) from DENV-4__KC762698__SS-prME
  source 1..9867: mol_type = other RNA
agcactatgactcttctgtgtctaataccaacagttatggcatttcatttaagtacgcgagacggggaaccattaatgattgtcgctaaacacgaaaggggtcggcccctactttttaaaaccaccgaaggaatcaataaatgcacgcttatagcgatggacttaggggaaatgtgtgaagacactgtgacttacaaatgtcctctgttggtaaacacagaacctgaagatatagtatgctggtgcaacttaacaagtacatgggtaatgtatggaacttgcactcaatcgggagaaagacgccgtgaaaaacgctcggttgcattaacacctcatagcggaatgggtctggaaacgagagcagaaacatggatgtcttctgaaggagcatggaaacacgcgcagcgagtcgagtcgtggatattacgtaatccaggttttgcgctgttagcaggatttatggcttatatgataggacaaactgggattcagagaacagtcttctttgtgcttatgatgctagtggcaccgtcttacggaatgagatgcgtcggagttgggaacagagatttcgttgaaggagtatcaggaggcgcatgggttgacctagttctcgaacatggaggctgtgtcacgactatggcacagggcaaaccaaccttagattttgaactaacaaaaaccacagcaaaagaagttgctttgttaagaacttactgtattgaagcctcgataagtaatattacaaccgcgacgcgatgcccaacacagggagaaccatatcttaaagaagaacaggatcaacagtatatatgccgtagagacgtggttgatagaggctggggcaatggatgtgggttattcggaaaaggaggagtagttacgtgcgctaaatttctatgtagcgggaaaatcacgggaaatcttgtacaaatagaaaacctagaatatactgtagtcgtcacagtacacaacggagacacccatgctgttgggaacgatacatcaaatcacggggtgacagctaccataacaccaagaagtccatcggtagaggtgaaactcccagattatggtgaattaaccctagattgtgagccacgatcgggaattgacttcaacgaaatgatattaatgaaaatgaagaagaaaacttggttagtacataaacaatggtttctcgatttaccattaccttggaccgctggagctgatacctctgaggtccattggaactataaagaaagaatggttacattcaaagtcccccacgctaaacgacaagatgttacagttctcggatctcaagagggtgcgatgcacagcgcacttgccggagcaactgaggtcgattcaggagacggaaatcatatgtttgctggacatttgaagtgtaaagttagaatggagaaattaagaataaaaggaatgtcatacacaatgtgctcagggaaattcagtattgataaagagatggcagaaacgcaacatggaacaacagtagtcaaagtgaaatatgaaggtgcaggagcaccatgcaaggttccaattgaaattagggatgtaaataaagaaaaagtggttggaagaattatcagtagcacaccattcgctgagaataccaattctgtaactaatattgaactagaaccgccttttggggattcatacattgttataggtgccggagactcagctttaactcttcattggttcaggaaaggtagctccatcggaaaaatgtttgaaagcacttatcgaggtgcaaaacgcatggcaattttaggggaaacagcatgggactttggaagtgtaggtggtctattcacatcactaggtaaagcagttcaccaagtatttggaagtgtgtacacaacaatgtttggaggtgtttcttggatgattcgcatattaatagggtttttagtgttatggataggaaccaattcacgaaacacaagtatggctatgacatgcatagccgttggcggaataacacttttcctaggatttacagtccaagctgacatgggttgtgttgtctcgtggaacggaaaggaattaaagtgcggttctggcatatttgttgttgataacgtgcatacatggacagagcaatataaatttcagccggagagtccagcaaggcttgcatcagctattttgaatgctcataaagacggcgtctgcgggataaggtcaacaactcgattggagaatgtaatgtggaagcagattaccaatgaattaaattacgttctatgggaagggggacacgatctaactgtggtcgccggagacgtaaaaggagttttaactaagggtaaaagggccttaacacccccagttaacgatctaaaatattcttggaaaacgtggggtaaagcaaaaattttcacacctgaagcacggaatagtacttttctaatcgatggaccggatacatcagaatgtcctaacgagagacgagcgtggaacttctttgaagtggaagattatggtttcggcatgtttaccactaacatctggatgaaatttagggaaggaagtagtgaagtgtgtgatcataggctaatgtcggcagctataaaagatcaaaaagcagttcatgcggatatgggctattggattgaaagttctaagaatcaaacatggcaaattgaaaaagcatcgctaatagaagttaaaacttgcttatggccaaaaacacataccctttggtctaatggagtgcttgaatcgcagatgctaatacctagatcatacgcaggtccattttcacaacacaattacagacaaggatatgcaacacagacagcgggcccttggcacctaggaaaactcgaaatagattttggggaatgtcccggaacgacggtaacaatacaagaagactgtgatcatagaggaccatcactacgaactacgacggcgtctggtaaattagtgactcaatggtgttgccgaagctgcacgatgccccctttgaggtttctcggtgaagatgggtgctggtacgggatggaaatacgacctctgtcggaaaaagaagaaaatatggtaaaatcacaagtgactgcagggcaggggacatctgagacctttagtatgggactattatgccttacattgttcgtagaagagtgccttaggcgtcgagttacaaggaagcatatgatcctcgtagtagtgattactttttgtgcaattatacttggaggtctaacatggatggatctattaagggcattgattatgttgggcgacacaatgtcgggtagaatcggagggcagatacatttggccatcatggccgtcttcaaaatgtcgcctggatacgttttaggagtattcttacgcaaattgacgtcacgagaaactgctctgatggttatcggcatggccatgactacagtatttagtataccccatgatctaatggaactaattgatggtatcagtttagggctaattctactaaagatagtaacgcacttcgataacacacaggtcggtacattggcactctcactcacgtttatccggagtactactccgttggtaatggcttggcggactattatggcagtattctttgtagtgacccttatccctctatgtagaactagctgtcttcaaaaacaatcacattgggtagagatcacagccctcatactaggtgcacaagccttacctgtgtatttgatgacactcatgaaaggagcaagtagaagatcatggcccttaaatgaagggatcatggcagtcggattagtctcactactgggaagcgcattactgaaaaatgatgtaccactagcaggccccatggtggccggtggattattattagcagcctacgtaatgtccggaagctcagctgatttgtctttggaaaaagctgctaatgtccagtgggatgagatggctgatataacaggaagttcacctatcatcgaggtaaaacaagatgaagatggaagtttcagcataagagacgtagaagaaacaaacatgatcaccctcttagttaaactggctctcattacggtatcaggactataccccctcgctatacccgttacaatggcattgtggtacgtgtggcaagtaaagacacaaagatcaggcgctctatgggatgtaccgagtccagctgcaactcagaaagcaacactcagtgaaggtgtttataggatcatgcaacgagggctatttggaaagactcaagtgggcgtaggcatccatatggaaggtgttttccatacaatgtggcacgtaacaagaggtagcgttatatgtcatgagaccggaaggcttgaaccttcatgggcggacgtacgcaacgatatgatatcctatggaggaggttggcgattaggagataaatgggacaaagaagaagatgtgcaagtactcgcaatcgagcccgggaagaacccaaaacatgtgcaaacgaaaccaggtttattcaaaacgctaacgggcgagataggagctgtgaccctagattttaaacctgggaccagcggaagtcccataattaataaaaagggtaaggtaatcggcttatacggaaatggcgtcgttaccaaaagtggagattatgtcagtgcaatcacacaagcagagagaataggtgagccagactatgaggtagatgaagacattttcagaaagaaacgcttaaccataatggacttacatcctggagcaggtaagacgaaacgtatattaccatcgatagtaagggaggcattaaaacgtaggttaagaacccttatattagctcccacccgggtcgtcgctgcggaaatggaggaagcgcttcgcggtttacccatacgatatcagaccccagctgtcaagtcagaacacacagggcgcgaaatagttgacttaatgtgccacgcaacattcaccacacgtcttctaagtagtaccagagtacctaactataacctaattgtaatggacgaagcacattttaccgatccatgttccgtcgcagcaagaggatatataagtacccgggtagaaatgggggaggctgctgctatctttatgacggctacacctccaggaagtatagatcccttcccccaatccaattcacccatagaagatatagagagggagatacctgaaaggagttggaacacaggatttgattggataactgattatcaaggaaaaacggtatggtttgtaccgtctataaaagctggaaacgatattgcaaattgcttacggaaatcgggaaagaaagtcatacaactatctcgaaaaacgtttgacacagagtatcccaaaacaaaattgactgattgggattttgtggtcacaacagacatatctgaaatgggtgcgaatttcagagcgggacgtgtaattgacccaagacgctgcttaaaacctgtcatcttaacagacggtccagaacgtgttatccttgcaggaccgataccggtaacaccggcatcagctgcacaaaggagggggaggataggacgaaacccagcgcaggaggacgatcaatacgtattttcgggtgacccacttaaaaatgatgaagatcacgctcattggactgaagctaaaatgttgttagacaatatctacactccagagggaataataccaacattattcggtccagaacgagaaaagacgcaagcgatcgacggtgaatttagacttaggggtgagcaaaggaaaaccttcgtagaactaatgaggcgaggagacctgccggtttggctaagttataaagtggcatccgcagggatatcctataaggatagagaatggtgttttacaggtgaacgaaataatcagatcctagaagaaaacatggaggtagaaatttggactcgtgaaggagagaagaagaaactccgacctaaatggttggatgccagagtgtatgcagatccaatggcattaaaagattttaaagaatttgctagtggaagaaaatctattacattggatatccttaccgaaattgcaacattaccaacttatctatcttctaaagctaaacttgctcttgataatatcgtaatgctacatactacagagaagggcggcagagcttaccaacacgcacttaacgaattacccgaaagtctcgaaacattaatgttagtcgccctcttaggtgcaatgacggcaggaatattcttgttctttatgcagggaaagggcatcggaaaactttcaatgggcctaatagccatagctgtagccagtggtctactatgggtagcggagattcagccgcagtggattgcagcctcaataatattagaatttttcttaatggtattattgattcccgagcctgagaaacaacgtacacctcaagataatcagttaatatacgtaatcctcacgatcttgacgatcataggcttaatagccgcaaatgagatgggtttgatagagaaaactaagacagacttcggattttaccaggtcaagactgaaaacactatcctagacgttgatctaaggccagcatcagcctggaccttgtatgctgtcgcaacaactatacttacacccatgttaaggcatactattgaaaacacatcggcaaacttaagtttagctgcaatagcgaatcaagccgccgtacttatgggattaggcaaagggtggccacttcatagaatggaccttggtgtacctctgctggctatggggtgttactcacaggtaaaccctacgacattgactgcttccctagtaatgttacttgttcactacgccataataggtcctggtctacaagccaaagcaacaagagaggcacaaaaacgaaccgccgccggaataatgaagaaccccacagtggacggaataacagtaattgatctagaaccaatttcctatgaccctaagttcgaaaaacaactcgggcaagtcatgctattggttctgtgtgtaggacagttactcctaatgagaacaacctgggccctttgcgaagtactaacactagctactggtcctgtaatgacattatgggaaggtaaccctggccgattttggaatacaactatagctgttagtacagcaaacatattcagaggcagctatctagcaggagctggcctagcttttagcctgataaagaatgcccagacaccaagaagaggtactggaacaactggggaaacattaggagaaaaatggaagcgacaactgaatagcctagacagaaaagaatttgaagaatataaacgctccgggatacttgaggtagatagaacggaagcgaaaagtgccctaagagatggatcaaaaataaaatacgcagttagtagggggtccagtaagataagatggatagtagaacgaggaatgatcaaaccaaaaggtaaagtagtagacttaggatgcgggcgtggcggatggtcatattacatggctacgcttaagaatgtaacagaagttaaaggatatacaaaaggtggtcccggtcacgaagaacccatacccatggcgacgtatggatggaatctggtaaaactgcactcaggagtagatgtattttacaagcctacggagcaagtagatactttactgtgcgacataggagagtcgtcatccaaccccacaatagaagaggggagaacattaagagttttaaaaatggtagaaccctggttatcttctaaacccgagttctgcataaaagtgctgaacccgtatatgcccacagtcatcgaagaattggagaaattgcaaaggcgtcatggagggtcattagtgaggtgtcctctaagccgtaattccacacatgaaatgtattgggtatcgggggcatccggcaacatagtttcttcagttaatacaattagtaaaatgttattaaaccgatttacaacaagacatcgaaagccaacgtatgaaaaggacgtagatctaggggccggtaccaggtcagttagtacggagatcgaaaaaccggacatgactattataggtagaagactacagagactccgcgaagaacataaagagacgtggcattatgaccacgagaacccttacagaacatgggcctaccatggctcttatgaagcccccagcaccggatccgctagtagcatggtaaacgggattgtaaaactcctgactaaaccttgggatgtcataccaatggtcacgcaactggccatgacagacacaacaccctttggacaacaaagagtattcaaagagaaagttgatactcgcacgccgcaacccaaacctggcacaagaatgataatgacaaccacagcaaattggttgtgggcacttttggggaagaagaaaagtccgcggctttgcacaagggaagaatttatttcaaaagtcaggagtaacgctgcaataggagcggttttccaagaagaacagggatggacttcagcaagcgaagcggtaaacgatagccggttttgggagctagttgataaggaacgagccctacatcaagaggggaagtgtgaatcttgtgtgtacaatatgatggggaagagagagaagaagctgggtgaatttggacgtgcaaagggatcaagagcgatatggtatatgtggttgggagctcgatttttagaatttgaagccttaggatttctaaacgaagatcattggttttcaagagaaaacagctggagcggggtagaaggagagggattacataggctcggttacattttggaagacatcgacaagaaagatggcgatttaatttatgcggatgatacagctggttgggatacgaggattacagaagacgatctattgaacgaggaactaataacagaacaaatggcacctcatcataaaacattagctaaagctatttttaaactcacgtaccaaaacaaagtagtcaaagtcctgagaccaacaccaaaaggggcagtaatggatataatatccagaaaagatcagagaggctcaggccaagtgggtacatatggtctaaacacatttactaatatggaagttcaactcataagacagatggaagcagaaggagtaataacacaggacgatatgcaaaacccgaaaggtttaaaagagagggtggaaaagtggctgaaagaatgcggtgtggaccggttggaaaggatggcgatatcgggagacgactgtgtagtaaaacctctagatgaaagatttagtacatctttactcttcttgaacgatatgggcaaggttcgcaaggacatcccccaatgggaaccaagtaaaggttggaaaaattggcaagaagtgccattttgctctcatcatttccacaaaatttttatgaaagacggcagatcattagtagtaccttgcaggaatcaagacgaattaataggcagggcaagaatctcacaaggagccggttggagcttaagagagactgcatgcctagggaaggcttatgctcaaatgtggttactcatgtacttccatagaagagatctaagattggcgagtatggccatttgtagtgcagtgcccacagaatggttccctacatcgcggacaacatggtccatacatgcacaccatcaatggatgacaactgaagatatgttgaaggtatggaacagggtatggatcgaagacaaccccaatatgacggacaagactccggtccactcttgggaagacataccatatctaggaaaaagagaggacctttggtgtgggagtttgataggcctgtcgagcagggccacttgggcaaagaatatacatactgccattactcaagtacgtaatctaattggaaaggaagaatatgtggattatatgcctgctatgaaacgctactctgcgccatttgaatctgagggcgtactatga

SEQ ID NO: 23662 - RNA, 9867 nt, synthetic construct
  misc_feature 1..9867: note = derived and/or modified CDS sequence (opt6) from DENV-4__KC762699__SS-prME
  source 1..9867: mol_type = other RNA
tcgacaatgacccttctatgtcttataccaactgtgatggcctttcacctttcgacaagagacggggaaccactaatgattgtagctaaacatgagagaggtagaccgctactttttaaaacaacagagggcatcaacaaatgcactcttatagcgatggacttaggtgagatgtgtgaagataccgttacctataaatgtcctcttttagttaacactgaacctgaagatattgactgttggtgtaatctcacatcaacttgggtaatgtacggaacatgtacgcagtcaggagagaggagaagagagaaaagatcggtggctttaactccccattccggtatgggtctagaaacgagggcagagacatggatgagtagtgaaggagcttggaaacacgcccagcgggttgaaagctggattctaagaaatccgggttttgcactcctggcaggctttatggcatacatgattggacagactggaatccagaggacagtcttcttcgttcttatgatgttagtcgccccatcctatggaatgcgctgcgtaggagtaggaaatagggatttcgtagaaggagtgtcaggaggtgcctgggtagatctcgtcctagagcacggaggatgtgtgacaacgatggctcagggtaaaccaactttagactttgaactgaccaaaacaacagccaaagaagtcgctttactgcgaacttactgtattgaagctagtatttcgaacattaccactgctactcgatgtccaactcaaggtgaaccctatctcaaagaagaacaggaccaacaatacatttgtaggagggacgtagtagatcgcgggtggggtaacgggtgcggcttattcgggaaaggtggagtggtaacatgcgccaaatttctgtgcagtggaaaaattacagggaacttagtccaaattgaaaatctagaatatacagtagtagtcactgtacataatggcgatacccatgcagtaggcaatgatacttcaaatcatggagtcacagcaactataacaccacgaagtccatcagttgaagtcaaattaccagattatggggaactaacattagattgcgaaccccgatcaggaattgatttcaacgaaatgattctaatgaaaatgaaaaaaaaaacgtggcttgtccataaacagtggtttttagatctccctttgccttggacggcgggagctgatactagtgaagtgcactggaattataaagaacgcatggtgacatttaaggttccacacgcgaaacgacaggatgttaccgtgttaggatctcaagagggagcaatgcattcagccttggctggagcgacagaagtagatagtggcgatggtaatcatatgtttgctggacatttaaaatgtaaagtaagaatggaaaaattgagaatcaagggtatgagttatactatgtgttcagggaaattttcgattgataaggaaatggctgaaacccaacatgggacaacagtagttaaagttaaatacgaaggagctggtgcgccatgtaaagtacccatcgagataagagacgtaaataaggaaaaggtggtcggacgtattatctcttcaacgccgtttgctgagaacaccaattctgttacaaatatagaattggaacccccatttggagattcatatatagtaataggggtcggggactctgcactcacactgcattggtttaggaaaggaagctctataggaaaaatgttcgaatctacgtataggggagccaagcgaatggcgatcttgggggagacggcatgggattttggtagtgttggtggtctattcactagtttaggcaaagctgtacatcaagtatttggaagtgtatatacaactatgttcggcggagtatcatggatgattcgcattttaattggttttttagtattatggatagggactaatagcaggaatacatcgatggccatgacgtgcatcgcagttggtggaataacgttatttttagggtttacagttcaggctgacatgggatgtgtagtatcctggaatggaaaggaattgaaatgtggatcaggcatatttgtagtcgataatgtacacacctggactgagcagtacaaatttcaaccagaaagcccggctagattggcatcagctatactcaatgcacataaagatggagtatgtggtataagatccaccacgcgattagaaaacgtaatgtggaaacaaataactaatgaattgaactatgtcttgtgggaggggggacacgacctaacagttgttgctggtgacgttaaaggagtcttgactaagggaaaacgcgcgctcactccacctgttaacgaccttaagtatagctggaaaacatgggggaaagctaaaatttttacacctgaagcgagaaacagtacatttttaattgacgggccagatacatcagaatgccctaacgaacgtcgagcctggaatttcttcgaagtcgaagattacggatttggaatgttcacaactaacatctggatgaaattccgggaaggtagctctgaggtgtgtgatcaccgcttaatgtcggcggcaatcaaagaccaaaaagcagtacacgctgatatgggatattggatagaaagctcaaaaaatcaaacatggcaaatcgaaaaagcaagtcttattgaagtcaaaacgtgtctgtggcctaaaacacacacactatggtcaaatggcgtactagaatctcaaatgttaattccgcgatcgtatgcaggacctttcagccaacacaattatcggcagggatacgctacacaaactgccggtccctggcatctgggaaaactcgaaatagattttggtgagtgtccgggaactacagtaactattcaagaagattgtgatcatcgtggaccgagcctaaggacaactacagcatcgggcaagttggtaacccagtggtgctgcagatcttgtacaatgcccccgctccgttttttgggtgaagacgggtgttggtatggcatggaaataagacctttgtccgagaaggaagaaaacatggttaagagtcaagtaaccgcgggccaaggtacttccgaaactttctccatgggattgctatgccttacattgtttgtagaagaatgtctacgtagaagagttaccagaaaacatatgatattagtagtggttataacgttctgtgccattatcctcggtggacttacttggatggacttattgagggctctcatcatgcttggggacacaatgtcggggagaataggaggacaaattcatttagccatcatggcagtttttaaaatgtcaccaggctacgtcttaggcgtgtttttgaggaagttaacatctagagaaacagctttaatggttattgggatggccatgacaacagtattttcaatacctcatgaattaatggagctaatagatggaataagcttaggactgattctgctaaagatcgtaacacattttgacaatactcaagtcgggacactggcactaagtctaacattcattcgatccacaaccccactggtaatggcgtggcgaacaataatggccgtattcttcgtagtcaccctaatccccttatgtcgtacctcatgtttgcagaaacaaagccattgggtggaaattacagcactgattcttggagcccaagcgctacccgtgtacctaatgacattaatgaaaggagcaagcagaagatcgtggccattgaacgaaggaatcatggcagtcggtctcgtctcgctattgggttctgcacttttaaaaaatgatgtaccgctagctggtcctatggtcgctggaggactattattagcggcctatgtaatgtctggaagctccgcggacctaagtctagaaaaagcggccaatgtgcagtgggatgaaatggcagatataacgggctcatctcccataatagaggtcaagcaagatgaagacggttctttttcaataagggacgtagaagaaacaaatatgatcactttattagttaaactagccctcataactgtatcgggactatatccactagcgatacctgttactatggcattgtggtatgtttggcaagtgaagacacaacggagtggagctttatgggacgtgccaagcccagctgctacacagaaagctactttatctgaaggagtataccgtataatgcaaaggggtttgtttggcaagacacaagtaggcgtcggaattcacatggaaggggtgttccacacaatgtggcatgtaacgcgaggaagtgttatatgtcatgaaacaggaagactcgagccttcatgggcggacgttcgcaacgatatgattagctatggtggaggatggaggctaggagataagtgggacaaggaagaggatgtgcaagtccttgcaatcgaaccagggaaaaatcctaaacatgtccagacaaagccaggtttgtttaagacattaacaggtgaaattggggcagtaacgctcgattttaaacccggtacctccggatctcctattataaataaaaagggaaaagtcatagggctatatggaaatggagttgtaaccaaatcaggagactacgtttcggcaataacacaagcagagcggataggagaacctgactatgaagttgatgaagatatctttcgaaagaaacggcttacaatcatggacctgcacccgggtgcaggtaaaacaaaacgtattcttccatcaattgtacgtgaagcgctgaaacgacgactacgcacattaattttggctccaactcgagttgtcgctgcggaaatggaagaggcattaagaggactacccatacgttatcaaactccagcggttaaaagtgagcatacaggccgagaaatagtcgatcttatgtgtcacgctacgtttaccacccgcttgttatcaagtactcgggtgcccaactataatcttatagtgatggacgaagcgcattttacagatccctgctctgtggctgcaagaggatatatatcgacacgagtcgaaatgggcgaagccgcagcaatttttatgacagccacccccccaggcagcatcgatccgtttcctcagtcgaattcgcccattgaagatatagagagagaaatcccagaacgtagctggaatacagggtttgattggataacagattaccagggaaaaacggtctggttcgtgccatccattaaagcagggaacgacatagctaattgtctcagaaagtcaggtaaaagggttatacaattatcacgaaaaactttcgatacagaatacccaaagacaaaactaacagattgggacttcgttgtaaccacggacattagcgagatgggagctaattttagagcgggtcgagtcattgatccgaggcgatgcttaaaacctgtgattctaaccgacggacctgaaagagtgatattagccggacctatcccagtaaccccggccagtgcggcacaaagacgtggccgtatcggtagaaatccagcgcaggaagacgaccaatacgtattttcaggggatcctttaaaaaacgatgaagaccatgcgcattggacggaggcaaaaatgttattagataacatttatacccccgagggcataataccaacattgtttggtcctgaacgagaaaagacacaggcaatagacggggaattccgccttaggggagagcagcgcaaaacgtttgtagaactgatgagacgaggagacttacctgtctggctatcatacaaagtggcttccgcaggaatttcttataaagaccgcgaatggtgttttacaggagagcgcaataaccaaatcttggaggagaatatggaagtagaaatttggaccagagaaggagagaagaagaaactaaggcccaaatggctagacgctagggtatatgcagatccaatggctcttaaagacttcaaggaatttgcaagcggtaggaaatcgattacattagatatactaactgaaatagccactcttccaacctatcttagctcaaaagcaaaactagccttagacaatatagtcatgttacacacaacggaaaagggaggaagagcgtaccaacatgctctaaacgaactgcctgagtcactggaaaccttaatgttagtagcgttactaggagcaatgacagcagggatatttctattctttatgcaaggcaaaggaataggaaagctgagcatgggtcttatcgcaattgcagtagcaagtggattactttgggtagcggaaatacaaccgcagtggattgcagcatcgataattttagaattcttcttaatggtgctcttaataccagaaccggaaaaacagagaactccacaggataatcagctaatatacgttatattaacaatattgaccataataggacttatagcggcgaatgaaatgggtctcatagaaaagaccaaaacggatttcggattttaccaagtcaaaacggaaactacaatactcgatgtagacttacgacctgcctctgcatggacattgtatgcagttgctacaaccatcctaactccaatgctgagacatactatagaaaatacttctgcaaatctcagcctggcagctatagcaaaccaagccgcggtgctcatgggcctaggtaagggttggccattacatcggatggacttaggagtaccattactagcgatgggttgctattctcaagttaacccaacaacacttactgcatctttagtaatgctattagttcattatgctataataggccccgggcttcaggctaaagcaacaagagaggcacagaaacgtacagcagcaggtataatgaaaaatccaactgtagacggcataactgtcattgacttggaacccatttcatatgatccaaaattcgaaaaacagctcggacaagttatgttgttggtcttatgcgtcggacaactgttattaatgaggacaacatgggcactatgtgaagttttaacgctcgcgacgggacccgtaatgacactatgggaggggaatcccgggagattctggaatacaactattgcggtaagcaccgcaaacatcttccgaggaagttacctagcgggagcggggttggctttcagtttaatcaaaaacgcgcagacaccgagaagaggcacgggaacaacaggtgaaactctaggggagaaatggaaacgacagttaaattcattagatcgtaaagaatttgaagaatacaaacgttcaggtattcttgaagtggaccggacggaagctaaatcagcgctaagagatggatctaaaataaagtacgcggtaagtagaggaagtagtaagataaggtggatagttgagaggggcatgattaaacccaaagggaaagtagtcgatcttgggtgtggaagaggtggttggtcttattatatggcgactttaaaaaacgtgactgaagtaaaaggttacacaaaaggtggccctggacatgaagagccaatcccaatggcaacctatggttggaacttagttaaactacattctggagtcgatgtcttctacaagccaacagagcaagtcgatacattactctgcgacataggagaaagttccagtaatcccaccatcgaagaaggtagaacattacgagtgctaaagatggttgaaccctggctttcatcaaagcccgagttttgtataaaagttttaaacccttacatgcctacagttatcgaagagttggaaaagcttcaacgcaggcacgggggcagtctagttcgctgtccactatcgcgcaattcaacccacgaaatgtactgggtaagcggcgcctctggtaatatcgtgagctccgtaaacacaattagcaaaatgttgcttaatagattcactacaagacataggaaacccacgtatgagaaagacgtggaccttggagcaggtacacgttcggtttctactgaaacggaaaaacctgacatgactataattggtcgaaggctgcagaggttacgcgaagaacacaaagagacttggcattacgatcaggagaatccatacagaacttgggcttaccatggctcttacgaagctccctccacagggagcgcgagttcaatggtaaatggcgtagtaaagcttctcacgaaaccctgggatgtcattccaatggtaactcaactagcaatgaccgacactacaccattcgggcagcaacgagtattcaaagaaaaggtagacacccgtactccgcaacccaaaccaggaactagaatgatcatgacaacgacggcaaactggctatgggctcttctcgggaaaaaaaaaagccccaggctttgtacgagagaagaatttatatcaaaagtacgcagtaatgcagccattggggcagtgtttcaagaggaacagggatggactagtgcgtcagaagctgtaaacgattcacgattttgggaattagtagacaaggaaagagcattgcatcaagaaggaaaatgtgaaagttgcgtttacaacatgatgggtaaaagagaaaaaaagctgggagaattcggaagagccaaagggtcaagggcaatatggtacatgtggctgggagctcggtttttggaatttgaagcgttaggcttcttaaatgaagaccactggttctcacgtgaaaattcttggtctggagtagaaggagagggactacatcgattgggctacatacttgaagatattgataaaaaagatggagacctcatatatgctgacgacacagcggggtgggatacaaggataacagaggatgatttactgaatgaagaattaatcactgaacaaatggctccacatcataaaacgttagcaaaagcaatatttaaactaacgtaccaaaacaaagtcgttaaagtattaaggccgactcccaaaggcgcggtaatggatattatatctcggaaggaccaaagaggttcaggccaagtagggacctatggattaaatacttttaccaacatggaagtacaactgattcgacaaatggaagctgagggagttatcacgcaagatgatatgcaaaatccaaaggggcttaaagagcgagtagaaaaatggcttaaagagtgtggcgtagataggctaaagagaatggcaatatcaggtgacgactgtgtagtgaagcctttagacgaaagattttcaactagcctcctcttcctaaacgacatgggcaaagtcagaaaggacataccacagtgggaaccttctaaaggatggaaaaactggcaagaagtacctttttgttctcatcattttcataagattttcatgaaagacggacgctcactagttgttccttgtagaaaccaagatgaacttataggtcgagcccgtatctctcaaggggcaggatggagtttacgggagaccgcctgtttgggaaaagcatatgcgcaaatgtggagtttaatgtatttccataggcgagatcttagactagcatccatggcaatatgtagcgccgtacccacggagtggttccctacttcacgtactacatggtctatacatgcacatcatcaatggatgacaacagaggatatgttaaaagtatggaacagagtttggatcgaagataatccgaatatgaccgataaaacaccggtgcattcatgggaagatataccttacctgggaaaaagagaggacctttggtgtggatcattgataggcctatcatcacgtgctacctgggctaagaacatccatacggccattacacaagtgcgcaacctaataggaaaagaagaatatgtcgattatatgcctgcaatgaaacggtactcagctccatttgaaagtgagggagtgttatga

SEQ ID NO: 23663 - RNA, 9867 nt, synthetic construct
  misc_feature 1..9867: note = derived and/or modified CDS sequence (opt6) from DENV-4__JQ915085__SS-prME
  source 1..9867: mol_type = other RNA
agtacaatgactctattatgccttattcctacagtaatggcttttcatctaagcactagagatggggaaccattgatgattgtggcgaaacacgaacgaggaagaccattactatttaaaacaacagaaggaataaacaaatgcacattaatagcaatggaccttggcgaaatgtgtgaagatacagtaacttacaaatgtccactattagttaatacagaaccggaagatatagactgttggtgtaacttaactagcacgtgggttatgtatggcacgtgtacacaaagtggagaaaggcgcagagagaaaagatctgtagccctaacacctcacagcggtatgggattggaaacacgagcagaaacttggatgagttcagaaggagcatggaaacatgcacaacgagtagaaagttggatacttcgaaatcctggattcgcactgttggcgggttttatggcatacatgattgggcaaactggtattcaacggaccgtcttctttgttctaatgatgttggtagcaccgtcctatggtatgcggtgtgtaggagttggtaatcgggacttcgtagagggagtatcaggtggggcgtgggtcgatctcgtgttagaacacggaggatgtgtaaccacgatggcccagggtaaacctacacttgattttgaactaactaaaactacagccaaagaagtagcactgttaagaacatattgtatagaagcatctatatccaatataactaccgcaactcgctgtccaacacaaggagagccctatttgaaagaagaacaggaccaacaatatatttgccgacgcgatgtagtcgataggggatggggcaacggttgcggcctctttggaaaaggaggggttgttacttgcgctaaatttctatgcagtggaaaaataacgggaaacttagtccaaattgaaaatttagaatataccgttgttgtaacagttcataacggtgatacacatgccgtaggaaatgacacctcaaatcacggcgtcacagcaacgataacaccacgctcaccgtcagtagaagtaaaattacctgattacggggaattaacattagactgcgagccgcgaagcggaattgattttaatgaaatgatattaatgaaaatgaagaagaaaacatggttggtacataaacaatggtttttggacttaccattaccttggactgccggggctgataccagtgaagttcactggaattataaagaaagaatggtaaccttcaaagtaccgcacgccaaaagacaggatgtaactgtgctagggagtcaagaaggagcaatgcattcggccttggccggagctactgaagtggatagcggtgacggaaatcatatgttcgctggacaccttaaatgcaaagtacgtatggaaaaactacgcataaagggcatgtcttatacaatgtgctcaggtaagttcagtatagataaggagatggctgaaacgcaacacggtacaacggtcgtgaaagtcaaatacgagggcgcaggagcaccatgcaaagttcccattgaaatacgtgacgtcaacaaagaaaaggttgttggacgaataataagttcaacaccatttgctgaaaatacgaacagcgttacaaatatagaactagagccaccattcggagattcgtatattgtcataggtgtgggcgattctgctttaacattacattggttcagaaaaggttcgtctatagggaaaatgtttgaaagcacttataggggtgcaaagaggatggccattttgggagaaactgcctgggactttgggtcggtgggtggcctattcacctctttgggaaaagcggtccaccaagtattcggatccgtttataccacgatgttcgggggtgtaagttggattatacggattttgataggctttctggtactctggataggcactaattccagaaatacttcaatggcaatgacatgtatagctgttggtggtataacactttttctgggatttaccgtacaagctgatatgggatgtgtagtatcatggaatggaaaagaattgaaatgtggatctggaatattcgttgtcgataacgttcacacttggacggaacaatataagtttcaaccagaatctccggcaaggctagcttcagcgatattaaatgcacataaagacggagtctgcggaatccgatccacgacgagattggagaatgtaatgtggaagcaaataactaatgaattaaattatgtcctttgggaagggggccacgatctaacggtagttgcaggggacgttaaaggtgtgctcaccaaaggaaaaagagctcttacacctccggtaaacgacctcaaatattcttggaaaacttggggtaaggcaaaaatatttaccccagaagcgagaaatagcacgtttctgatcgatggccccgatacatccgaatgcccaaacgagcgccgcgcatggaatttctttgaagttgaggattacggttttggcatgttcactacgaatatttggatgaaattcagagaaggaagtagtgaagtatgtgatcatcgcctcatgtctgcagctattaaagaccaaaaagcggttcatgccgatatgggatattggatagagagctcgaagaaccaaacatggcaaattgaaaaagctagtttaatcgaggtaaaaacttgcttatggccgaagacacacacactctggtctaatggtgttttggaatcacaaatgttaatcccccgttcttatgccggaccattttcacaacataattaccgacaaggatacgcgacccagaccgcaggtccctggcatttaggaaaattagaaattgacttcggagaatgtccaggaacgacggtcactattcaagaagattgtgaccacagaggcccctctcttcgtactaccacagcgagcggaaaattagtgacacaatggtgctgcaggagctgtacgatgccacctctccgcttcttaggcgaagacggatgctggtatggaatggaaataaggccactaagtgaaaaagaagagaatatggttaaaagtcaggtaacagccggacaaggaacgtcggagacgttttcaatgggattactttgcctaactctttttgtagaggaatgccttagacgtagggtaacaagaaaacatatgattctcgtagttgtaattactttttgtgcgatcatattaggaggattaacatgggtagatttactaagagctttaataatgcttggtgatacaatgagtggaagaatcgggggacaaatacatttagcgataatggctgtattcaaaatgtcaccaggatatgttcttggcgtattccttcgtaaattgacttcacgagaaactgccctcatggtgataggtatggcaatgacaacagtattctctatccctagggatttaatggaattaatagatggcatctccttgggcttgatattattaaagatagtgacgcatttcgataacacccaagttgggacgctcgcattgagtctcaccttcatcagaagcacgacacccctagtaatggcgtggcgcacaatcatggtcgtattctttgttgttacgctaataccactctgtcgcacaagctgcttacagaaacaatcacattgggtcgagataacagccttgatacttggagcacaagcattaccggtgtatttaatgaccctaatgaagggagcctccagaagatcttggcctctcaatgaaggtatcatggcagttggtctagtgagtttgttaggatctgcactgctcaaaaatgatgtcccactagctggaccaatggtcgctggaggtttactcctagcagcatatgtaatgagcggaagctcggctgatctatctttagaaaaagccgcaaacgtgcaatgggatgaaatggcagatattacgggtagttcgccaataatcgaagttaaacaggatgaagatgggagcttttccataagagacgtagaagaaacaaatatgattactctcctcgtaaaactcgctctcataactgtctcgggattatacccgttagcgattccggtaacaatggcactgtggtatatatggcaagtcaaaacacaacggagtggagcattatgggatgtgccatcgccagcggcaatacaaaaggcgactctatccgaaggagtgtacaggatcatgcaaaggggcctatttgggaagacgcaggttggtgtcggtattcacatggaaggagtatttcacacgatgtggcacgtaacacggggttctgtaatctgccatgaaaccgggagattagaaccaagctgggcggacgtcagaaacgacatgatttcatacggcggaggatggagattgggcgacaaatgggataaagaggaggatgtccaggtccttgctatagaacccggcaaaaaccctaaacacgtgcaaactaagccaggcttatttaaaactttgacaggagaaattggggcagtaacacttgatttcaaaccaggaactagcggatcacccattattaataagaaagggaaagtaattggactctacggcaacggagtcgtaacaaagagcggagactatgtgtctgcaatcacccaagcagagaggatcggcgagcctgactatgaagtcgatgaagatatttttcgaaagaaacgtttaacaattatggatcttcatcctggtgccgggaaaacaaaaagaattttaccctcgatagtaagagaggctttaaaacgccggttaagaacactaatattagctccaacaagggtagtcgcagcagagatggaagaggcccttaggggattaccgattagataccaaactcctgcagtaaaaagtgagcatacagggcgagaaatcgtagacctaatgtgtcacgcaacattcaccacgaggttactatcaagtacaagagtaccgaactataacctgattgttatggatgaggctcactttactgatccatgctcggtagcagctcgtggctacatatctactcgcgtcgagatgggcgaagcagcggctatatttatgacagcgacacctcctgggagcatagatccgttcccacagtctaacagccccatagaagatatagaaagggaaatcccggaacgatcttggaatactggcttcgactggattacagattatcagggaaaaacggtctggttcgtaccatcaatcaaagcgggaaatgatatagcaaactgtctgcggaaaagtggtaaaaaggtgatacaattaagccgaaaaacattcgacacagaataccccaaaacaaaacttacagattgggatttcgtcgttacgacagacatttcagaaatgggtgcaaatttcagggcaggaagagttatcgaccctagaagatgtctgaaacctgtaatattaacggatggaccagaaagagtcattctagcaggtcccatacccgtgaccccagcttcggcggcacaacgaagaggtcgaattggtagaaatccagcacaagaagatgatcaatatgtattttcaggagacccactcaaaaacgatgaagatcatgcacactggacagaagcgaagatgttacttgataacatatatacacccgaaggaataatacccacattattcggtccagagagagagaaaactcaagctattgatggtgagttcagactgaggggtgagcaacgaaaaacctttgtagaattaatgcgaagaggagatttacctgtgtggctatcgtataaagtagctagcgcaggtattagttataaagacagggaatggtgtttcacaggggaacggaataaccaaatactagaagaaaatatggaggtcgaaatttggactcgtgaaggggagaagaagaaattaagaccaaagtggttagatgccagggtgtacgcggaccccatggcattaaaggatttcaaagaatttgcatcgggacgaaagtcgataactctggatatattaaccgaaatagccacattaccaacgtacctgagctcaaaggcgaaattagcactagacaatattgtaatgctccatacggctgaaaaaggagggcgtgcgtaccaacatgcgttaaatgaattaccagaaagtttagaaacacttatgcttgttgctttgcttggcgcaatgacagcaggaatttttctgttctttatgcaaggaaaagggataggtaaattaagcatgggccttatagcaattgcagtagcatcaggcttgctctgggttgctgaaatccaaccacaatggatagcagcatctataattttagagttctttctaatggtgttattgataccagaacccgaaaagcaaaggacgccacaagataaccaacttatttatgtaattttaacaattctaacaataataggtttgatcgcagcaaacgaaatggggttaatcgagaaaacgaaaacagacttcgggttttatcaagtaaaaacggaaacaacgatattagatgtagaccttcgcccagcgagcgcgtggacactatatgcagtcgcgacaaccatactaactccgatgttgcgacatacaatagaaaacacctcagcgaaccttagcttagcagctattgcgaatcaagcagccgttctaatgggattaggtaaaggctggccccttcacagaatggaccttggcgttccactattggcaatggggtgttatagccaagttaatccgacaactctaacagcctcacttgtgatgcttttagtgcattatgcaattataggtcctggcctacaagctaaagctacaagggaagcacagaagagaacagcggccggtataatgaagaatccaacagttgacggtatcactgtgatagacctagagccaatatcttatgatccaaaatttgaaaaacaactcggacaagtaatgttgttagtattatgtgtcggacaattacttcttatgagaacaacatgggcactatgtgaggtccttacattagcaaccggaccgataatgacactctgggaaggcaaccctggtcgattttggaatactactattgctgtttcaaccgccaatatatttcgaggatcatacctagcaggcgccggtcttgcttttagcttaataaagaatgcacaaacaccacgacggggtacaggaacgacaggggagactcttggcgaaaaatggaagagacagttgaactcattagacagaaaggaatttgaagaatataaacgcagtggcatactagaagttgatcgaactgaagctaagtctgctctacgtgatggctccaaaattaaacatgcagtgagccgaggaagttctaaaataagatggatagtcgaaaggggaatgataaaacctaagggtaaagtagtagatttagggtgtggtcgcggtggttggagctattacatggccactcttaaaaacgtgactgaagtaaaaggatataccaaaggcggacctggacacgaggagcctattccaatggcgacctacggctggaatttagtgaaattacacagtggggtggatgtgttttacaagcctacagagcaagtagatacattactttgtgacattggagagtcctcgtccaacccaacgatagaagagggtcgcacattaagggtactaaaaatggtagaaccatggctgagtagcaaacctgaattttgtataaaggtgctaaatccgtatatgcctactgtaatagaagaattagagaagctccaacggaggcatggtggtagccttgtgcggtgtccattatctaggaactctactcatgaaatgtactgggttagtggtgcatccggaaatatagttagtagcgtaaacaccatatcaaaaatgctacttaatcggtttacaacacgacaccgaaaaccaacgtatgagaaagatgtagatctgggtgcgggtacacgttcagtctcgacagaaaccgaaaaacccgatatgactataatcgggcgtagactacaacgattgcgcgaagaacacaaagaaacttggcactatgatcaagagaatccctacagaacatgggcatatcatggatcatacgaggcaccaagcacaggaagcgcatcctctatggtaaacggcgtggttaaacttcttactaaaccttgggatgtcatcccaatggtcacacaactggcaatgacagatacaaccccattcggacagcaaagagttttcaaagaaaaagttgatacgcgtacacctcaaccaaaaccaggaactaggatgatcatgactaccacggcaaactggctctgggctctattaggcaaaaagaagagtccacgtctatgtacgcgtgaagaatttatcagtaaggtaagaagtaacgcggctattggagcggtattccaggaagaacaaggttggacaagtgcgtcagaagcggttaacgactcacggttttgggaactcgttgacaaggagcgggctctgcatcaagaagggaaatgtgaatcatgcgtttataacatgatggggaaaagagagaagaaacttggagagttcggtcgcgcaaaaggtagcagggcaatctggtacatgtggctgggcgcgcgttttctagaatttgaggctttaggatttctaaacgaggaccactggttcagccgcgagaatagttggagtggagtagaaggagaaggactccacaggttgggatatatattagaagacatagacaagaaagacggggacttgatttacgctgacgatactgctggttgggatacaagaattacagaagacgatctattgaacgaagaactgattacagagcaaatggcaccacatcataaaacattggcaaaagcgatatttaaacttacctatcaaaataaagtagtgaaagtactaagaccaacacctaaaggagccgtgatggatataatatccagaaaagaccagaggggttccggacaagtgggaacgtatggactgaatacgttcaccaatatggaggttcaattaattcggcagatggaggcagaaggggtaataacgcaagatgacatgcaaaaccccaaaggcctaaaggaacgggtcgaaaaatggctaaaggagtgcggagtcgataggctaaaaagaatggcaatttctggggacgactgtgtggtaaagccattggatgagagattcagcaccagccttctttttctaaatgatatggggaaggtacgaaaagacatacctcaatgggaaccttcaaaaggctggaaaaattggcaagaggtccctttctgctcacaccactttcacaaaatatttatgaaagacggtcgaagtctggtagtgccttgtagaaatcaggatgaattaataggtagagcaagaatctcacaaggagctggttggagtcttcgagagacagcttgccttgggaaagcatacgcacaaatgtggtctcttatgtacttccacagaagggatttaagactcgcaagtatggcgatatgttcagcagttccaactgaatggtttccaacctctcgtaccacctggtcaattcatgcacatcatcagtggatgacgacagaagatatgttaaaagtctggaaccgagtttggatagaagacaatcctaatatgactgataagacgccagtacattcatgggaagatattccctatttaggaaaaagagaagatctttggtgtggatcactaataggactaagctctcgagctacatgggctaaaaacatacatacggcaatcacccaggtccgaaacctgatcggaaaagaggagtacgttgattacatgcctgctatgaaacgttattccgcaccctttgaatcagaaggtgtactttaa

SEQ ID NO: 23664 - RNA, 9867 nt, synthetic construct
  misc_feature 1..9867: note = derived and/or modified CDS sequence (opt6) from DENV-4__JQ915088__SS-prME
  source 1..9867: mol_type = other RNA
agtacgatgactttactttgcctaatcccaacagtaatggcgttccatctttcaaccagagatggagaaccactaatgatcgtagcaaagcatgaaagaggaaggcctcttcttttcaaaacaacagaaggaataaacaagtgcacattaattgcaatggacttgggtgaaatgtgtgaagacaccgtaacctataaatgtccactactggtaaataccgaaccagaagatatcgattgctggtgtaatttgacatcaacttgggtgatgtacggtacttgtacacaaagtggggaaagaaggcgcgagaaaagaagcgtagctttaacaccacattctggtatgggattagaaacccgggcagaaacttggatgtcgtcagaaggagcctggaaacacgcccaaagggttgagagctggatactacgaaacccaggattcgctctacttgccggtttcatggcttacatgatagggcaaacaggcattcaaagaattgtattctttgtattaatgatgcttgtagccccaagttacggaatgcgatgtgtaggtgtgggtaacagggattttgtcgaaggtgtctcagggggagcatgggtggatttagtacttgaacatggaggttgcgttacgacgatggcccagggtaaacctacattagacttcgaactgactaaaaccacagcgaaagaagtagctctattgagaacatattgtatcgaggcttctataagcaatataacaacggctacaagatgtcctacacaaggagagccctatttaaaggaagaacaagatcaacagtatatttgtaggcgagatgtcgtggataggggctggggaaacggatgtggtctatttggaaagggaggagtagtcacctgtgcaaagttcttgtgcagcggcaaaataacggggaatttagttcaaatagaaaaccttgaatatacggttgtggtaacggtacacaacggtgacacgcatgcggtagggaacgatacgtctaaccacggggtaacagcaactatcacgcccagatcaccctcagtcgaagtaaagctgccggattatggggaactcaccctagattgtgaaccaaggagtggtatagactttaatgaaatgatattaatgaaaatgaagaagaaaacatggctagtacacaaacaatggtttctagatctacctttaccttggactgctggagctgatacgagtgaggtacattggaactataaagaacgcatggttacgttcaaagtaccacacgccaaacgtcaagatgtcaccgttttagggtctcaggaaggagcgatgcattcagcgttagctggcgcaacagaagtagattctggagatggtaaccatatgttcgcgggtcatttaaaatgtaaagtacgtatggaaaagctacgaataaaaggaatgtcatatacaatgtgctcaggaaaattttctattgataaagaaatggcagaaacacaacacggaacaactgttgttaaggttaaatacgaaggcgctggcgcaccgtgcaaaatcccaatagaaataagagatgttaacaaagaaaaagtggtaggtcggataatttcttccaccccatttgcagaaaatactaattcagttataaacatagaactagagcctccattcggcgattcttacatagtcataggggtgggggattcagcgctaacactacattggttccggaaaggttcatccataggaaaaatgttcgagtctacatatcgtggggctaagaggatggcaattctaggagaaaccgcctgggatttcggatcggtaggtggcctttttacatcattaggtaaagcggttcaccaggtcttcgggtcagtatacactacaatgtttgggggagtaagttggatgattcgaatacttatcggatttttagttctttggattggaacaaactcacgtaacacctcaatggcgatgacatgtatcgcagtgggcggaattacgctctttttgggctttacagtgcaagctgatatggggtgtgtggttagttggaatggaaaagaactcaagtgcgggtcaggtatcttcgtagttgacaatgtccatacatggacagaacaatataaattccagcctgaatctccagcacgattagctagtgcaatattgaacgcacacaaagacggcgtttgtggaattagaagtactacacgattggaaaatgtaatgtggaaacaaattactaacgaattaaattacgtcttatgggaaggtggccatgatcttacggtcgttgcgggggatgttaaaggagtcttaacaaaaggcaaaagagcacttaccccgccggtgaatgatcttaagtactcctggaaaacctgggggaaggcaaaaatttcgacaccagaagctcgtaatagtactttcctaatcgatggtcctgacacgagtgaatgcccgaacgaacgcagagcctggaacttctttgaagttgaggattatggatttggaatgtttacgaccaacatttggatgaaattcagagaaggatcttcagaagtttgtgatcacagattaatgtcagcggccattaaagatcaaaaggctgtacacgcagatatgggatattggatagaatcaagcaaaaaccaaacctggcagatagaaaaagcctcattaattgaggtaaaaacttgcttatggcccaaaacccatacactctggagcaacggcgttctagaatcacaaatgctaataccgcgctcttatgctggacccttttcgcaacataattaccgtcaggggtacgctacacagacggcggggccatggcatttaggcaaattagaaatagattttggagagtgtccaggcacaacagtaaagatacaagaagattgcgatcatcgaggtcctagtttacggactacaactgcgagtggaaagttggttactcaatggtgttgtagatcatgtacaatgcctcccctaaggtttttaggagaagacggttgctggtatgggatggagattaggcccctatctgagaaagaagagaatatggttaaatcccaagtaacggctggacaaggtacatctgaaactttcagtatgggattattatgcttaacattgtttgttgaggagtgtcttcgcagaagagtaacaagaaaacatatgatcttagtcgtagtaataactttttgcgcaataatacttggaggtctcacttggatggatctactaagagcactcatcatgttgggggatacgatgagtggacggataggtggccagatacacttggctattatgaccgtattcaaaatgtcaccaggatacgttttaggtgtattcctaagaaaactaaccagtagagaaacggcacttatggtgataggaatggcaatgacaacagtcttctcgataccccatgatttaatggaattaattgacgggataagcctaggactaatcttattgaaaatagttacccatttcgacaatactcaggttggtacacttgcactgtcattgacattcatgagatccacaacacccctagtaatggcctggaggaccataatggcagtgttctttgtaatcacattaatacccttatgtaggacatcatgcctgcagaaacaatcgcattgggtagaaataactgcactaattctcggagcacaagctctacctgtatacttaatgacactaatgaaaggcgcatccaggaggagctggcctctcaacgaaggcattatggcagtaggcctagtttctttgttaggttctgccctactcaaaaatgacgtacctctggccggtccaatggtcgctggcggtttattgctagcagcatatgttatgtcaggttccagcgcagatttgtctttagaaaaagcggcaaatgttcaatgggatgaaatggctgacataacaggttctagccccatcatagaggtaaaacaagatgaagatggatcattctctatacgtgacgtagaagaaacaaacatgatcactctcctagtcaaattggcactgattactgtatctggcttatatcccctagcgatacctgttacaatggccctatggtacatatggcaggtcaaaacacaaaggtcaggggctttgtgggacgtcccatcgccagctgcaacgcaaaaagcaacattgtctgagggagtctaccgcatcatgcaaagaggcttatttgggaaaacacaagttggggtaggaatacacatggagggtgtctttcatacaatgtggcacgtaacaaggggatcagtgatatgtcatgagacgggcagactagaaccctcttgggctgatgtgcgaaacgatatgatctcttatggtggagggtggcgattaggagataaatgggacaaagaagaagatgttcaagtgttggccattgagccaggcaaaaacccacgccacgttcaaacaaagcccggactttttaaaaccctcacaggggaaataggagccgtgacattagattttaaacccggtacatcgggaagcccaataataaacaagaaaggaaaagtaattggattgtatggaaacggggttgtaacgaaatcaggagattatgttagtgctattacacaagcagagcgtatcggggaacctgactatgaagttgatgaagatatatttagaaagaaaagattaacaataatggatctacacccaggcgcaggaaaaactaaaaggattcttccttcgatagtacgcgaggctttaaaacgtcgtctacgtacactaattctagctcctacacgagtagtagcagctgagatggaagaggcactaagaggattacccattaggtatcagacacccgccgtgaaaagtgaacacacgggacgagaaatcgttgacctaatgtgtcacgctacattcaccacccggttgctgtcatcgaccagggttccgaattataatctgattgtcatggatgaagctcattttactgacccctgctctgtagccgcgcgaggttacataagtacgagagtagagatgggggaagcagctgcaatttttatgacggcgactcccccaggctcgattgatcccttccctcagagtaactcacctatcgaagatatagagagggaaataccagagcgcagttggaacacgggattcgactggataactgattatcaaggtaaaacagtgtggttcgttccatcgataaaagcgggcaacgacattgcaaactgcctgagaaaatccggtaaacgagtcatacaactttctcgtaaaaccttcgataccgaatatcctaaaacgaaactcaccgactgggactttgttgtgaccactgatatctccgaaatgggcgcaaatttcagggccggacgagtgatagatcctcgtcgttgtcttaaacctgttatattaaccgatggcccagaacgagttatcctagctggaccaataccagtaaccccagcaagcgctgcacaaaggagagggagaataggtaggaatcctgctcaggaagacgatcaatacgtattctcgggagacccattgaaaaacgacgaggaccatgcgcattggacagaagccaagatgcttctagacaatatatatacaccggaaggcattattcctacacttttcggacctgaacgagagaaaacccaagccattgatggtgaatttagactaagaggtgaacagagaaaaacttttgtagaattgatgagacgtggtgacctaccagtatggttatcatataaagtagctagcgccggtatatcatataaagacagagaatggtgctttaccggggaaaggaacaatcaaattctagaagaaaacatggaagttgaaatttggactagggaaggagagaaaaagaaactacgaccaaaatggttagatgcgcgagtttatgcggatccgatggcattaaaagactttaaagaatttgcaagtggaaggaaatcgacaactctagacatactaacagagatagcaaccctgccaacttacctatcatcgaaagcaaaacttgcattagacaatatagtaatgctacacactaccgagaaagggggtagagcctaccagcatgccttaaatgaattgccagaatcgctagaaacgttaatgttagtagcgttgctgggagcaatgactgctgggatttttctcttctttatgcagggaaaaggcatcgggaaactatccatgggtttaatcgcgatggctgtggcaagtggtctcttgtgggtcgcggaaattcaaccgcaatggattgccgcctcgataatccttgaatttttcctaatggtgttattaatcccagagcccgaaaaacaaaggacgccacaagataatcaattgatttatgtaatattgacaattctaacgataatcggtctaatagcggctaacgagatgggtctcatcgagaaaactaaaactgactttggattttatcaagtaaaaactgaaacaacaatattagatgtcgatttaagaccagctagcgcatggacactatatgctgttgctaccacaatcctaacacctatgttgcgacataccatagagaatacaagtgcgaacctttcattagctgccatagctaatcaagccgctgttttaatgggactcggaaaaggctggccactacatagaatggacttaggagtaccgttactagcaatgggatgttattcccaggttaaccctacaacgctaacagcgagtctggtgatgctcttaattcactatgcaattattggcccgggcctccaagcaaaagctactagggaggcacaaaagagaacagcggcaggtattatgaagaatcccacagttgacggcataaccgtgattgatctggaaccgatttcctatgaccctaaatttgaaaaacaactagggcaagtaatgctcctagttttatgtgtcggtcagcttcttctcatgagaacaacatgggccctatgcgaagtactaacgttagcgacgggacccatcatgacgttatgggagggaaacccaggtagattttggaatacaacaatagcagtttcaacagctaatatattcaggggtagttatttggcgggggcaggacttgcgttttctctaatcaaaaacgctcaaaccccgagacgaggcactggaaccacaggtgaaactcttggggagaaatggaaacggcaactcaattctttggacagaaaagagttcgaggagtataaacgatcagggattctagaagtagatagaactgaagccaagtcggcgctacgtgacggttctaaaataaagcatgcagtatctcgtggatcatctaaaatccgatggatagtcgaaaggggcatgataaaaccaaaaggtaaagttgtagaccttggatgtggccgagggggatggtcctactatatggctacacttaagaatgtaacagaagtgaaagggtatactaaaggcggacctggacatgaagaaccaattccaatggctacatatggatggaatctcgtaaaattgcactctggagtcgacgtattttataaaccaacagaacaggttgatacgttgttgtgcgatattggagaaagctcctcaaaccctacaattgaagagggacgaacactaaggatacttaagatggtagaaccttggctaagctctaaaccagaattttgcatcaaagtattaaatccctatatgcctacagtaatagaagaacttgaaaaattacaacgacgtcacggaggcagtttggttaggtgtccgctatcacgcaatagcacacacgaaatgtactgggtttcgggagcatctggtaacattgttagttcagttaacactatttctaaaatgttattgaaccgattcaccacaagacatcgaaaaccaacttatgaaaaagacgtcgacctaggtgctggtacaagaagtgttagcactgagaccgaaaaacccgacatgacaataatcggtagaaggctccaacgcctacaagaggaacacaaagaaacttggcattatgaccaagagaacccttacagaacatgggcgtatcacggctcttacgaagcaccttctaccggtagtgcctcttctatggtcaatggcgttgtgaaacttttaacaaaaccatgggatgtcatacccatggtaactcaacttgctatgactgataccacacctttcggacaacaacgagtatttaaagaaaaagttgatacacgaacacctcaaccaaaactggggacacggatgataatgacgacaacggcaaattggttgtgggcactactcggcaagaaaaagtctcccagactttgcacaagagaagaatttatttctaaggtgcgcagcaacgcggctattggtgctgtgtttcaggaggaacaaggttggacatcagcaagtgaggcggtgaatgactcacggttttgggaattagtggacaaagaaagagcattgcaccaggaaggaaaatgtgaatcttgcgtatacaacatgatggggaaacgggagaagaaattgggggagttcggtagagcaaaaggatcaagagcgatttggtatatgtggttaggtgcccgatttttggagtttgaagcactaggtttcttaaatgaagaccactggttttcgcgggaaaattcgtggtcaggagtagagggggaaggtcttcacagactaggatatattttggaagatattgacaagaaagacggagacttaatatatgcagacgacacagccgggtgggacacaaggattaccgaagatgatctccttaatgaagagttaattactgaacaaatggcgcctcatcacaaaactctggcgaaagctatttttaaactaacgtaccaaaataaggttgtgaaagtattgcgacctacacctaagggtgccgtcatggatataattagtagaaaagatcaaaggggaagcggtcaagtcggtacatatgggcttaacacattcacaaatatggaagtccaacttataagacagatggaagcagagggagtaatcactcaagacgatatgcagaaccccaaagggctgaaagaacgcgtagagaagtggttgaaggaatgtggtgtcgataggctaaaacgcatggctatttccggagatgactgcgttgtgaagccactcgatgaaagatttagcacaagcctcttgtttttgaatgatatgggcaaagttcgaaaggatgtccctcaatgggagccaagtaaagggtggaaaaactggcaagaggtaccattctgttcacatcactttcataaaatttttatgaaggatggcagatccctcgtggtaccatgtcggaaccaagatgaactcataggccgggctcgaattagccaaggagctggctggagcttgagagaaacagcatgtttaggaaaagcatatgcccaaatgtggtcactcatgtatttccaccgcagggatcttcggctggccagcatggctatttgtagtgccgtacctactgagtggtttcctacatcccggacaacctggtccattcatgcacaacaccaatggatgactacggaagacatgttgaaagtgtggaacagagtttggatagaagataaccccaacatgacagataaaacacctgtacattcgtgggaagacataccctacctcggaaagcgagaagatctatggtgtggttcactgataggcttaagctcaagggcaacctgggccaaaaatattcatacagccatcacgcaggtacgcaatctcataggaaaggaagaatatgtagattacatgccagtaatgaaaaggtactctagccccagcgaatccgaaggcgttctataa

SEQ ID NO: 23665 - RNA, 9867 nt, synthetic construct
  misc_feature 1..9867: note = derived and/or modified CDS sequence (opt6) from DENV-4__JQ915086__SS-prME
  source 1..9867: mol_type = other RNA
agtacaatgacattattgtgcctaatccctactgtaatggcattccatttaagcactagggatggagaaccattaatgatagtcgccaaacacgaaagagggcgacccttattatttaaaacaaccgaagggatcaataaatgcacgctaatagcgatggatttaggtgaaatgtgtgaagacactgtaacatataaatgtccacttttggtaaacacggaaccagaagatattgactgctggtgtaacctgacaagtacatgggtaatgtacggaacttgtacacagtcaggtgaacggagaagagaaaagaggagtgtcgcactaacaccccatagtggaatgggtctagaaacacgtgctgaaacatggatgagctccgaaggagcctggaagcatgcacaaagagtggaatcatggatattacgaaacccgggcttcgcactgctagcaggttttatggcatatatgattggtcaaactggtatacagagaacagttttcttcgttctcatgatgttagtagctccttcgtacggtatgagatgtgtgggcgttggaaatagggatttcgtcgaaggagttagtggtggcgcatgggtcgacctagtattagaacatggaggatgtgtaactacaatggcacaaggaaaaccaacattggatttcgaactaacgaaaaccaccgctaaagaagtagcgttacttcgtacttactgcatagaagcatccattagtaacatcactactgcaactcgctgtccaacacagggagaaccttatctaaaagaagaacaagatcagcaatacatttgcagaagggatgtagtcgataggggctggggcaatggttgtggtctatttggaaaaggaggagtcgttacttgtgcgaagtttctttgttcaggaaaaattacaggtaatttagtccagatagaaaacctcgaatatacagtagttgttacagtccataatggggatacacacgcagtcggcaatgatacctccaaccatggggtcactgctacgattacgcccagaagtccgtcagtagaagtcaaattgcccgattatggggagctgacgctagactgtgagccacgtagtggcattgattttaatgaaatgatactcatgaaaatgaagaagaaaacctggttggtccataaacaatggtttctagacctccccctgccatggacggctggggcggatacaagcgaagtccactggaactataaagaacgaatggtcacctttaaagtaccacatgcgaaacggcaagacgtaaccgtactgggttcacaagaaggagcgatgcatagtgcactcgctggtgctacagaagttgatagtggagacgggaaccatatgttcgcaggtcatttaaaatgcaaagtgagaatggagaaattacgaataaaaggtatgtcatataccatgtgttcaggaaaattcagtatagacaaagagatggcagaaacccagcacggaacaacagtcgtcaaggtaaaatatgaaggagcaggagctccatgtaaaatcccaattgaaatcagggatgttaacaaagaaaaagtagtgggaaggatcataagcagcacgcctttcgctgaaaatactaattcagtaataaatatcgaactggaaccaccattcggagatagttatatcgtaataggagttggggatagtgcactaacgttgcactggttcaggaagggaagttccataggcaaaatgtttgaaagtacgtatcgcggagcgaaaagaatggcgattttaggagaaacggcatgggatttcgggagcgttggaggtttgttcacatctttaggtaaagcagtgcatcaagtattcggttcggtatatacaacaatgtttggaggagtgtcatggatgattagaatccttattggttttctagttttatggatcggcactaattcacgaaacacatcaatggccatgacctgtatagccgtgggtggaatcacactatttttaggctttacagtacaagctgatatgggatgtgttgtttcatggaatggtaaggaattaaagtgtggtagtggtatttttgtggttgacaacgtgcacacatggacagaacaatataaattccaaccagagagccctgcccgtttagcgagtgcaattctgaacgcacacaaagatggtgtctgcggaatacgttccactactaggttagaaaacgtgatgtggaagcaaattactaacgagctcaattatgtgttgtgggaaggaggtcatgacttgaccgttgtagcgggagatgtaaagggagttctaaccaagggtaaacgtgttcttaccccacccgtaaatgatcttaagtacagttggaagacgtggggaaaagcaaaaatttttacgcccgaggcgagaaactcaacttttctgatagacggacctgacacatccgaatgccctaatgagcggcgtgcatggaacttctttgaggtcgaagattatggttttggcatgttcactactaacatttggatgaaattcagggaaggttcgtcagaagtctgtgaccatagactgatgtcggctgcaataaaagatcagaaggccgttcatgctgatatgggctattggatagaaagctccaagaatcagacatggcaaatagaaaaagcatcattgattgaagtcaaaacatgtttatggcccaagactcacacactatggtcgaatggtgtgctagaatcccagatgctcataccccggtcatacgcagggccattcagtcaacataattacagacagggatatgcgacgcaaacagcaggcccatggcatctgggaaaattggagatagacttcggcgagtgtccagggacaactgttaaaattcaggaagattgtgatcaccgtggaccaagtttacgcacgacaactgcttctgggaagttagttactcaatggtgttgcagatcatgcaccatgccccctttaagatttctaggggaagacggatgctggtacggaatggagattagaccactttcggagaaagaagaaaacatggttaagagtcaagtaacagctggtcaaggaacgagtgaaacattttcgatggggctgctatgccttacattattcgtcgaggaatgcctaagacgaagggtcacgagaaaacatatgatattagtagtagtaataacgttttgtgccataatcctaggaggcctaacctggatggatttattacgtgcattaatcatgctcggcgacactatgagcggtcgaatcgggggacaaatacatctcgcgataatgacagtctttaagatgagtccaggctatgttttaggggtgtttcttagaaaattgacaagtcgtgagacagcattgatggtaatcggtatggcaatgacaacggtattcagcatcccgcatgacctgatggaattgatagatggaatttcattaggactgattttattgaaaatcgtcacccattttgataacactcaggtagggacattagctttgtcactcacctttataagaagcactacgccattagtcatggcttggagaacaatcatggcagtattctttgttattacactaattcccctgtgccgcacgtcctgtttgcaaaaacagtctcactgggttgagataaccgcacttatactaggtgcacaggcattaccagtatatctaatgacgttgatgaagggagcatccaggagatcttggcccttaaacgaaggtatcatggccgttggcttagttagtctactaggatcagctttacttaaaaatgacgttcccttggctggcccaatggttgccggaggcttattgttagctgcttacgtaatgagtgggtcgtcagcagatttgtccttggaaaaggcagcgaatgttcagtgggatgaaatggctgacatcacggggagttcacccattattgaagtcaaacaagacgaggatggttcatttagtatcagagacgtggaagaaacaaatatgataacactacttgtcaaattggccctaatcacggtaagcggattatatccacttgctattcctgtaacaatggcactttggtatatatggcaagtaaaaactcaacggagcggtgcactttgggacgtacctagccctgcagcgacacaaaaagctactttatcggaaggcgtttatagaataatgcaaaggggtttattcggcaagactcaggttggagttggcatccatatggaaggtgtatttcacacaatgtggcatgtgactcgaggatccgtaatctgtcatgaaaccggtcggctagaaccttcctgggcagatgtaagaaacgatatgatatcatatggaggtggatggcgactaggtgacaagtgggataaagaagaagacgttcaggttctagccattgaacctggaaagaatccacgtcatgtgcagaccaaaccgggattatttaaaacgctaaccggagaaataggtgcagttacactagactttaaacccggtacgtctggcagcccgataattaacaagaagggaaaagttatagggctctacggaaacggagtagtgaccaaaagtggggattacgtatcagcaatcactcaagccgaacgcataggagaaccagactacgaagtagatgaagatattttccggaagaaaaggctaactattatggatctacatccaggtgctggaaaaacgaaaaggattttaccctcaatagttcgcgaagccttaaagagacgattaaggacactaatactggctcctactagagttgtcgccgctgagatggaagaagcgctaagagggttaccaattaggtaccaaacccctgcagtcaaatctgaacatacgggcagggaaattgttgacctgatgtgtcatgcgacttttactacaaggctactatcaagcactcgcgtaccaaattataatttaattgtcatggatgaagctcacttcacagatccctgtagtgttgcggccagagggtacatatcgacaagagtggagatgggcgaagcagcggcaatctttatgacagcaactccccctggaagcattgacccttttcctcaaagtaattctccaattgaagatatagaaagagaaattcccgaaagatcttggaataccggatttgattggataactgactatcaagggaaaactgtttggttcgttccctcgattaaggcaggtaacgatatagctaactgtttgcgtaaaagtggaaaacgagtaatacagctcagtaggaagacatttgacacggagtatcctaaaaccaagctgacagattgggactttgttgtgacaacagatataagcgaaatgggcgcgaatttccgagcaggtcgagtaattgatccaagaagatgcctcaaaccagtaatattgacagatggaccagaaagagttatcctggctgggccaatacctgtcacccctgccagcgctgcgcaacgtcgggggaggattggtagaaacccagctcaggaagacgatcagtacgtattttcaggagatccattgaaaaatgatgaggatcatgcccattggaccgaagcaaaaatgctactagacaacatttatacacctgaagggataataccaacattattcggccccgaaagagaaaagactcaggctattgacggtgaatttagattaagaggagaacagagaaaaacctttgttgaattaatgaggaggggtgaccttccagtttggcttagttataaagtggcatccgcagggatatcatataaagacagagaatggtgcttcaccggagaaaggaataaccaaatattggaagaaaacatggaagtcgagatatggacaagagaaggtgagaagaagaaactaagacccaaatggctagatgccagagtatacgctgatccaatggcgctaaaagattttaaggaatttgcttctggaagaaagtcaacaacgctcgatattctgactgaaattgcaacactaccaacttatctatccagcaaagccaaattagcacttgataatattgtaatgttacatacaacagaaaaaggagggagagcataccaacacgcattgaatgagctgccagagtcattagaaacgcttatgcttgttgcattattaggtgctatgacagctggaatttttctattctttatgcaaggaaagggaatcggcaaactttcgatgggactcatagctattgctgttgcatcgggtctactttgggtcgctgaaatacaacctcaatggatagcagccagtataatcctggagttctttctcatggtattactgatccctgaacccgaaaaacaacgcaccccacaagacaaccaattaatttacgtaattttaactattctaaccattattgggttaatagctgcaaatgaaatgggtctaatcgagaaaacgaaaactgactttgggttttaccaagtcaagaccgaaacaaccattttagatgtggatcttcgccctgcttccgcgtggactttatatgcagttgcaactacaatattaacccccatgttaagacatacaatcgagaatacttcagccaatcttagcctagctgctatagctaatcaagcagcggtcctaatgggcctcggtaaaggatggcctctgcatcgcatggaccttggagttccattacttgcaatgggttgttactcccaagttaaccccacaacactaaccgcgtcattagtaatgttattaattcattatgcgattataggaccaggtttgcaggccaaggcgacccgtgaagcgcagaagcgaaccgccgctggcattatgaaaaacccaactgtagatgggataaccgtaattgacttggaaccaataagttatgaccctaaatttgaaaagcaactaggacaggttatgctgcttgtcctgtgcgttggacaactattattaatgagaacaacttgggctttatgtgaggttcttaccttagcaacgggaccaataatgacactttgggaagggaacccaggaaggttctggaatactaccatagcagtaagcacagctaacatcttcaggggttcatatttagctggagcaggcctagctttcagcttaatcaaaaatgcacagacacctagaagaggaacaggaactactggagagactctgggtgaaaagtggaaaagacaacttaatagtttagatcgaaaggaatttgaggaatacaaaagatctggtattcttgaagtagatcgtacagaagcgaaatctgctttaagggatggatctaaaattaaacatgctgtatcacgaggaagttctaaaattagatggattgtggaaagaggaatgattaagcctaaaggaaaagtcgtagatctaggttgcggacgtggcggatggtcttattacatggcaacactaaagaatgtaactgaagtgaaaggttacacgaaaggagggccaggtcatgaagaaccaattcctatggcaacatatggttggaatctagtcaaactacatagcggagtagacgtattttacaaaccaacggagcaagttgacactttattatgtgatattggagagtctagttcaaacccgacgatagaggaaggtagaacgctcagaatattaaaaatggttgaaccctggctttcatcaaaacccgaattttgtataaaagtcctcaacccatacatgcccacagtgatagaggaattagagaaattgcaacgaagacacggcggatcattggttaggtgcccgttatcaagaaattcgacccatgaaatgtactgggtatcaggcgcgagtgggaatatcgtgtcatcagttaacaccatatctaaaatgttactcaatcgatttacaactaggcatcgcaaacctacatatgaaaaagatgtcgatttaggagctggtactagatccgtatccactgaaacggaaaagccggatatgaccataataggtagacgtttacaaagattgcaggaagaacacaaggaaacttggcattatgatcaggaaaacccctacagaacgtgggcatatcacggatcatatgaagcaccatcaacaggaagtgcatcatctatggtgaatggagtagtaaagttactcacgaagccatgggacgttattccaatggtaactcaattagccatgaccgatactaccccgtttggacagcaacgcgtatttaaagaaaaagttgacacgaggactccacagcccaaacttggcacaagaatgatcatgacaactaccgccaactggctttgggccctactaggaaagaagaaaagtccaaggttgtgtactcgtgaggaatttatatccaaagtacgatccaacgccgcaattggcgcggtattccaagaagaacaaggatggacttctgcaagcgaggcagtaaatgactcgcgtttttgggagcttgtagataaagaaagggcgctacatcaggaagggaaatgtgagagttgtgtgtacaacatgatgggaaaacgtgaaaagaaactaggagagttcgggagagcaaaaggaagtcgggcgatctggtacatgtggctaggcgcacggttcctcgaatttgaagcattaggcttcctgaacgaagatcactggtttagcagagaaaattcctggtcaggtgtagaaggggagggactgcatagattagggtatatattggaagatatcgataagaaagacggtgatctcatttatgctgatgatacagctggttgggacaccagaattaccgaagacgacctattgaatgaggaactaataacagaacaaatggctccgcaccataaaacattagcgaaagccattttcaaattaacataccaaaataaagtagtaaaagtattgaggccaacacctaaaggagcagtaatggatatcatatcaaggaaagatcagcgtggaagcggacaagtagggacctacgggctaaatacatttactaatatggaagtccagctcataaggcaaatggaagctgagggagtaataacacaagacgacatgcaaaatccaaaaggattgaaagagcgtgtagagaaatggttaaaagaatgcggagtagacagactaaaacgaatggcaataagcggcgacgactgtgtagtcaaacccctggacgaacgctttagcacgtctcttttatttcttaatgacatgggaaaagtacgaaaagatgtaccccagtgggagcccagcaaaggatggaagaattggcaagaagttcccttctgctctcaccactttcataaaatatttatgaaggatggaagatcattggtggtaccatgtagaaatcaagatgagctcataggcagagccaggatctcacaaggcgcgggatggagccttagagagacggcatgtctgggtaaggcatacgcacaaatgtggtccttgatgtactttcatagacgtgaccttcgactagcatcaatggcaatatgttcagcagtaccgacagaatggtttccaacttcaagaacaacttggtcaattcacgctcaacaccaatggatgactactgaagacatgctcaaagtttggaaccgtgtctggattgaagacaacccgaacatgacagataaaacgccagtacactcttgggaagatattccctacttaggtaaaagagaagatctttggtgcgggagccttatcggactttcctccagggcaacatgggccaagaacatacacaccgccataacccaagtcagaaatctaataggaaaagaagaatacgttgattacatgcctgtgatgaaacgatatagtgccccgtcagagtcagagggcgtattataa

SEQ ID NO: 23666 - RNA, 9867 nt, synthetic construct
  misc_feature 1..9867: note = derived and/or modified CDS sequence (opt6) from DENV-4__JQ915087__SS-prME
  source 1..9867: mol_type = other RNA
agtacaatgaccttattgtgccttatacctacagtcatggcattccatttaagtacaagagacggagaacctttaatgatagtagccaaacacgaacgcggacggcctttattatttaaaacaaccgaaggaataaataaatgtaccctaatagcgatggatttaggagagatgtgtgaagataccgttacttacaaatgtcctctattagtcaacactgaacctgaagatatagattgttggtgtaatctaacctcaacctgggtgatgtatgggacatgtactcagtcaggagagaggagaagagagaaaaggagtgtagcattaacgccccacagtggaatgggactagagacacgagcggaaacgtggatgtcaagtgagggtgcctggaaacatgctcagagagtcgaatcgtggattttacgaaacccgggttttgctttactggctggttttatggcatatatgattggtcagacagggattcaaagaatagtattcttcgttctaatgatgctggtggcgccgtcttatggaatgagatgcgtcggagtgggtaatagagattttgtagaaggagttagtgggggtgcatgggtagatttagtcttggagcatggagggtgtgtcacaaccatggcacaaggaaaaccaacattagatttcgagctaacaaaaacgaccgctaaagaagtggcattacttcgaacatattgtatagaagcaagtataagcaatataactacggccacccgatgtcctactcagggagaaccctacctaaaagaagaacaagaccaacaatatatatgccgtcgagatgtagttgacagagggtggggaaacggctgtggtctattcggaaaaggcggggtagtaacttgtgctaaattcttatgtagtggtaaaataactggtaatctcgttcaaattgaaaaccttgagtatacagtggtagtaaccgtccacaatggagacacgcacgcagtcggaaatgacacgtcaaaccatggcgttacggccaccataacaccaaggagcccatcagtagaagttaaattaccagattacggcgaattaacgttggactgtgaaccgcgttcaggtatagattttaatgaaatgattttaatgaaaatgaaaaagaaaacatggcttgtccataagcaatggttcttagatctgccacttccctggactgccggtgctgatacctcagaagtacattggaactataaagaaagaatggtaacgttcaaagtgcctcacgcaaaaaggcaagatgtgacggtactaggctcacaagaaggcgccatgcattcagcgctagctggagcaaccgaggtagatagtggtgatggaaaccatatgttcgctggccatttaaaatgtaaggtacgcatggaaaaactccgcataaagggcatgtcatacacaatgtgctctggcaagttttcaatcgataaagaaatggctgaaactcaacatgggaccaccgtcgtgaaagttaaatacgaaggggccggggcaccatgtaaaataccaatagaaattagagacgtgaataaagagaaagtagtcggacgaattatcagcagtacaccctttgcagagaatacaaattcggtcataaatattgagctagaaccaccgtttggagattcatacattgtgataggggttggtgacagtgccttaactctgcattggtttagaaaaggatcatcaataggcaaaatgtttgaatctacatacagaggtgcaaaacgaatggcaatactaggagagactgcttgggattttggtagcgtcggtggactgtttacctcactaggaaaggcagttcatcaggtttttggctcggtgtataccacaatgttcggaggcgtctcttggatgataagaatactcataggattccttgttttatggatcggcactaatagtaggaatacgtcgatggcaatgacctgcatagcagtaggaggcataactctcttcctaggattcacggtacaggcagatatgggatgtgtagtatcatggaatggtaaagagctgaagtgtggtagtggaatattcgtcgtagacaatgttcatacatggaccgaacagtataagtttcaaccagaatcccctgctagactggcatcagcaatattaaatgctcacaaggatggtgtttgtggcatacggtcaacgacgcggcttgaaaatgttatgtggaaacagataactaacgagctaaattacgttttatgggaaggaggacatgacttgacagtggtggcaggagatgtaaaaggagtcttgaccaaaggtaagagggcactcactcctcctgttaacgacctaaaatacagctggaaaacctggggcaaggccaagattttcacgcccgaagcaaggaactcgacgtttcttatcgatggaccagatacaagtgagtgcccaaacgagaggagggcatggaacttctttgaggtcgaagactatggtttcggaatgttcacgacaaatatctggatgaagttcagagaaggaagtagcgaagtttgcgatcatcgtttaatgtcagcagctataaaagatcaaaaagctgtgcatgctgacatgggatattggattgaaagttccaaaaatcagacttggcagattgaaaaagcctcgctaattgaggttaaaacatgtctctggccgaaaacacatacactatggtcgaatggtgttttggaatcgcaaatgttaataccaagatcttacgcaggaccttttagtcagcacaattataggcaagggtatgcgactcaaacggcagggccatggcacttgggtaaactagaaatagatttcggggaatgtccaggtactactgttaaaatccaagaggattgtgatcatcggggtccgtctctgcgcaccaccactgcctcgggcaaactggtgacgcaatggtgctgtcgttcatgcacgatgcctcccttgagattcctaggagaagacggttgttggtatggcatggaaattcgtccgttaagcgagaaagaagaaaacatggtcaaatcacaagtaacagctggtcaaggaacgtcagaaacctttagtatgggcctattatgtcttactctgtttgtcgaagaatgcttacgaagacgagtgacccgtaagcatatgatcttagtagtagtcataacattttgtgctataatcctaggaggtctaacatggatggaccttttaagagccttaattatgcttggcgatacaatgagcggacgcataggtggtcaaatccatctagccataatgacagtttttaagatgtccccgggatacgtattaggagttttcttacgaaaactcacaagcagagaaactgcgcttatggttatagggatggctatgacgacggtgttctcaatcccccatgatttaatggaattgattgacgggatcagcttaggtctaatattattaaagattgtgactcacttcgacaatacgcaagtcggcacattagcgttaagtcttacgttcataaggtccacgacaccacttgttatggcatggcgaacaatcatggccgtattctttgtcataacacttatacccctatgtagaacgtcatgtctacaaaaacaatcacactgggtcgagataacggcattgatacttggagcccaggcgctacctgtttatttgatgacgttaatgaaaggggcgtcaagaaggtcttggcccttaaacgagggcataatggcagtaggtcttgtttccctactagggtcagcattactcaaaaacgatgtacccttagctgggcctatggttgcgggcggtcttttattagcggcctatgtcatgagcggatcgtctgcagacctatcattagagaaagcagctaacgttcaatgggatgaaatggccgatatcaccgggagttcaccaattatcgaagttaaacaagacgaagatggttcattttccattagagacgtagaagagaccaatatgataacattgctagtcaaactagctcttataacagtatctgggttatatcccctagcaattccagtgacaatggcgctatggtacatttggcaagtaaaaacccaacgatcaggagctttatgggatgttccatcaccggcggccacacaaaaagccacactttcagaaggtgtatatcgcataatgcagagaggtctattcggaaagactcaagtgggcgtggggattcatatggaaggggtttttcacactatgtggcatgtaacgcgaggatcggttatttgtcatgaaaccggtagactagaaccctcgtgggcagatgtacgaaatgatatgatctcctacggcggcggttggaggcttggagacaaatgggataaggaagaagacgtacaagtcttagcgatcgaaccaggaaagaatccccgacatgttcaaacaaaaccaggcctatttaaaacattaaccggcgaaataggagcggtcacgcttgattttaaacccggaacctctggaagtccaatcataaacaagaaaggtaaggttataggattatatgggaatggcgtagtcacaaaaagtggcgactatgttagtgctataacacaagccgagagaataggtgagcctgactacgaagtggatgaagatattttcagaaagaaacgactgacgattatggatttacatcctggcgccggaaaaacaaagagaatcctaccttcaatcgtgagagaggcacttaaaagaaggttgcgaactttaatattagcgcccacgcgtgtggtagcagcagaaatggaggaagcgctaaggggtttacccataagataccaaaccccagcagtaaaaagtgaacacactggtagggagatagtcgatttgatgtgccatgcgactttcacaacgaggttacttagtagtacacgagtgccaaactataaccttatagttatggacgaggcgcattttacagacccatgtagtgtggcagcaagaggttacatctcaactcgagttgaaatgggagaagctgctgctatctttatgaccgccaccccgccaggatccatagatccattcccacaatctaactcaccaatcgaagatattgaacgagaaataccagagagaagttggaacaccggattcgactggatcactgactaccaaggcaagaccgtctggttcgtaccgagtataaaagcaggtaacgatatcgctaactgtctaagaaaatcaggtaagagagttatacaactttcaagaaaaacatttgatacggagtatcctaaaacaaaactgacggactgggacttcgtcgtaacaacagatatatcagagatgggagcaaattttagagctgggcgtgttatagatccaagaagatgtttaaaacctgtaattttaacagatgggccggaaagagtaattcttgcaggaccgattccagtaacccctgcgtcggccgcccagcgccgaggacgaatcggaagaaaccctgcacaagaggatgaccaatatgtattcagtggagacccgttgaaaaacgacgaagatcatgcacactggactgaagccaaaatgttactggataatatatatacgcctgaagggataatcccgaccctatttggcccagaaagagaaaagactcaggctatagatggagaatttcgcttacgtggggagcagcggaaaacttttgtggaattaatgagaagaggagaccttcctgtatggttgtcctacaaagtggcaagtgcaggtatatcatataaagatagagagtggtgctttactggagagcggaataatcaaatccttgaggaaaatatggaagtagaaatatggacacgggaaggagagaagaagaaacttagaccaaaatggttagacgcacgagtatatgccgatcctatggctctgaaagactttaaagaatttgcttcaggaaggaaatcaaccactttagacattttgacggagatcgcaaccttacctacctatttatcgtccaaagcaaaactcgcattagataatattgtcatgttacacacaaccgaaaaaggcggtagagcttatcaacatgcgctaaatgaattaccagaaagtctagaaaccttaatgctagtagcattgttaggtgctatgactgcagggatctttttattcttcatgcagggaaaaggaataggaaagttaagtatggggttgatagccatagcagtagctagcggactcttatgggttgctgaaatacaaccacagtggattgccgcgagtataatactggagttctttctaatggttttgttgataccagaacctgaaaagcaaagaacaccgcaagataatcaattaatctacgtaatcttaaccatactaacgataatcggacttatagccgccaatgaaatgggtttaatagagaaaacaaaaaccgattttgggttctatcaagttaaaacggaaacgacaatactagatgtagacctccgtcccgcttcagcatggacgctatatgcagtagcaacaactatcctaacaccaatgctcagacatacaatagaaaacacaagtgccaacctatcattagccgcaattgcaaatcaggccgcagtcttgatggggttgggtaaaggatggcctttgcaccgaatggatttgggagtacctcttttagcaatgggatgctattctcaggtgaaccccacaaccttaaccgcatcgctcgttatgttgctcatacattacgcaataatcgggccaggattacaggcaaaagcaacaagggaagctcaaaagagaacggctgcgggtataatgaaaaatccgacggtagacggaataaccgttatagatttagagccaatttcctacgatccaaaatttgaaaaacagcttggccaagtaatgttgttggtattatgtgttggtcaactactgttgatgagaaccacttgggctctttgtgaagttttaaccctcgccaccggaccaattatgacactatgggaaggtaatccaggaaggttctggaatacaaccatagcagtctctactgctaatatcttccgtgggtcatatctagcaggcgctggcttggcctttagtttaatcaaaaacgcgcaaacaccaagaagaggaacaggcacaacaggagaaaccctaggagaaaagtggaagagacaacttaactcactagatagaaaggaatttgaggaatacaaacgttcagggattttggaagtagatcgaactgaagcaaagagcgctctacgagatggatcgaaaattaaacacgcggtatcgcggggctccagcaagattagatggattgttgaacgaggaatgatcaaacctaaaggtaaagtagtagacttaggatgcggaaggggtgggtggagttactacatggcaacgttgaaaaatgtaacggaagtaaaaggttatacaaaaggcgggccgggccatgaggaaccaatccccatggccacatacggatggaacctagttaaactgcactctggcgttgatgtattttacaaaccaacagagcaagtagatacgctattatgtgatattggggaatcatctagtaaccctactatcgaagaaggccgaacattgcggattctcaaaatggtcgaaccttggctcagctcaaaacccgaattttgcataaaggttttaaacccatacatgcctacggtcatagaggaactagaaaaattacagagacgtcatggtggaagcctagttagatgtccattatcacgaaactcaacgcatgaaatgtattgggtgagtggcgcaagcggcaatattgtcagctctgttaataccattagtaaaatgctgctaaacagatttacaaccagacatagaaagccaacctacgagaaagatgttgacttaggtgcaggtactcggtccgtatcgaccgaaactgaaaaacctgatatgactatcataggtcgcaggcttcagagattacaagaagaacataaggaaacttggcactacgaccaagaaaatccatataggacgtgggcttatcatggatcatatgaggcccctagcacaggatctgcgagctctatggtgaatggagttgtaaaattattaacgaaaccatgggacgtaattcccatggtaacccaattggcaatgactgatacaacaccttttggacaacagagagtatttaaagaaaaagttgatacaagaacaccacagcctaaactcggcaccagaatgatcatgaccactactgccaactggctatgggccctattgggcaagaagaaatctccaaggttgtgcacacgtgaagagtttatatcaaaagtccgatccaatgcagctatcggcgctgtgttccaagaagaacaaggatggacatcagctagtgaggcagtaaacgactcaagattttgggagttggtcgacaaagaaagagcacttcatcaagaaggaaaatgtgaaagctgcgtttataatatgatgggcaagcgtgagaagaaattgggggaatttggtagagctaagggatcaagggccatatggtacatgtggctcggggcccgtttcttagagtttgaagcattgggattcttgaatgaagatcactggttttctagagaaaattcatggagcggtgttgaaggcgaaggtttacattctcttggatatatactcgaagacatagataaaaaggatggggatttaatttatgctgacgacaccgcaggttgggatacacgaattacagaagatgatctactgaatgaagaattgataacagaacagatggctccacatcacaaaacgttggcaaaagccatatttaaactaacgtaccagaataaagtggtgaaagtcctaagaccaacacccaagggtgcagtcatggacattatatctagaaaggatcaacgaggatcaggtcaagtggggacttatggcctgaacacattcactaacatggaggtgcaattaatccgacaaatggaagcagaaggggtcataactcaggacgatatgcaaaatccaaaaggattgaaagagagagtcgaaaaatggttaaaagaatgtggagtagacagactcaaacgaatggctatttctggagacgattgtgtggtaaaaccattagatgaaagattttcaacgagccttctattccttaatgatatggggaaagtcagaaaagacgtaccacaatgggaaccaagcaaaggatggaaaaattggcaggaagttccattctgctcacatcatttccacaaaatatttatgaaagatggacgatctttagtagttccgtgtagaaatcaagacgaactgataggaagggcacgtattagtcaaggcgctggttggagcttaagagagacagcatgtttgggcaaagcatatgcccaaatgtggtcgcttatgtactttcatagaagagatcttagactcgcttcgatggctatctgttcagcagttcccaccgaatggtttcctacaagtcgtactacgtggagcatacacgctcagcaccaatggatgacaacagaagatatgctaaaagtgtggaatagagtatggatcgaggataatcccaacatgacagacaaaaccccagtccattcatgggaagacataccatatctaggaaagcgagaagatctttggtgtggatcattgataggcctttcatctcgcgcaacatgggccaaaaacatccatacagcaattacgcaggtacggaacctaatagggaaagaagaatatgtggactatatgcctgtaatgaaaaggtattccgcgccgtccgaatcagaaggagtattatga

SEQ ID NO: 23667 - RNA, 9867 nt, synthetic construct
  misc_feature 1..9867: note = derived and/or modified CDS sequence (opt6) from DENV-4__JQ915089__SS-prME
  source 1..9867: mol_type = other RNA
tcaactatgacccttttatgtctaatacctaccgttatggcttttcatctaagtactcgtgacggagaaccactaatgatagtagcaaaacacgaaaggggacgacccctattattcaaaacgaccgaaggaataaacaaatgtactctaatagcgatggatcttggagaaatgtgtgaagatactgtgacttacaaatgtccactattagtcaatacagaaccagaagatatagattgctggtgcaacctaacctctacttgggtgatgtacggaacctgtacgcagagtggagaaagaaggagagagaaaagatcagttgcattaacgcctcactcaggtatgggtctagaaacccgagccgaaacatggatgtctagcgaaggtgcatggaaacatgcacaaagagtagaatcatggattttacgaaacccaggttttgctctactagctggattcatggcatacatgataggacaaaccgggattcaacgaacagtatttttcgtattaatgatgctagtggctccttcatatggaatgcggtgtgtgggggttggaaatagagatttcgtagaaggcgtaagtggtggagcgtgggtggacctagtattagaacacggagggtgcgtaacaactatggctcaaggcaaacccacactagattttgaactaaccaaaacaactgctaaagaagtagccttactacgaacatactgtatagaagctagcataagcaatattactactgcaactcgttgtccaacccaaggtgaaccctatctcaaagaagaacaagatcaacaatatatatgtcgaagagacgttgtagatcgaggttggggaaatggctgtggcttgtttggaaaaggaggggtagtcacatgtgcgaaatttttgtgctcaggaaaaattaccggaaacctcgtgcagatagaaaatttagaatatacggttgtagtaactgttcataatggagacacccatgcagtgggaaacgacacaagtaaccacggtgtaaccgcaactataacaccccgatcacctagtgtagaagttaaattgccagactacggggaattgacacttgattgtgaaccacgatccggtatagacttcaacgaaatgatactcatgaaaatgaagaagaaaacatggcttgtccacaaacaatggtttttagatttacctctcccatggaccgctggtgctgacacttcagaagtacattggaattataaagaacgaatggtaacattcaaagtaccacatgccaaaagacaggatgtaaccgttctgggttcccaagaaggtgcaatgcattctgcactcgctggggcaacggaagtagactcaggagacgggaatcacatgtttgccgggcacttaaaatgtaaagtaaggatggaaaaactccgtattaaaggcatgtcatacacgatgtgttcaggaaaattttccatcgataaggaaatggctgaaactcaacatgggactacagtagtgaaagtaaagtacgaaggcgcaggagccccgtgtaagatccccatagaaattagggatgtaaacaaagaaaaagtagttggaaggataatatcttcgacgccatttgcagaaaacacaaattcggtaataaatattgaattagaaccccctttcggagatagctatatagtaatcggagttggagactctgcactcaccctccactggtttcggaaaggctcatcaatcggaaaaatgtttgaaagtacctatagaggggctaagagaatggcaatccttggcgaaacagcgtgggactttggcagtgttggtggtctttttacatcacttggaaaagcggtccatcaggtatttggaagcgtctatacaacaatgtttggaggagtttcgtggatgattaggatattgattgggtttttagttctatggatagggacaaactcgaggaatacgtctatggctatgacatgtatagccgtaggaggaatcactcttttcctaggctttacagtgcaggccgacatgggatgcgtcgttagttggaacggtaaagagctgaaatgcggatcgggaatttttgtagtagataatgtacatacttggacagaacaatacaaatttcaaccagaaagtcctgcccgtcttgccagtgcgatactaaatgcccataaagatggagtgtgcggaataagaagcacaacacggttagagaacgtcatgtggaaacaaattacaaatgaacttaactatgtgctatgggaaggtggtcatgacttgacagtcgtggctggggacgttaaaggggtattaacgaaagggaaacgggttctaacacctcctgtaaacgacttgaaatactcatggaaaacatggggaaaagctaaaatcttcacacctgaagcaagaaactcaacctttttaatagacgggcccgatacttctgaatgtccgaatgaacgacgagcatggaacttctttgaggtggaggactatggttttggaatgttcacaacgaatatatggatgaagttccgagagggtagttctgaagtgtgcgatcatcgattaatgagcgcggctattaaagaccagaaagcagtacacgcagatatgggttactggatcgaatctagcaaaaatcaaacatggcaaatagagaaggcatccctcatagaagtcaagacatgtttatggccaaaaacgcatacactctggagcaatggagtattagaaagtcaaatgctaattcctagatcatatgcgggtcctttcagtcaacataattacagacaaggctatgcgactcaaacagcgggaccttggcacctaggcaaattagagattgatttcggagaatgcccaggtacaactgtaaaaatacaggaagactgtgatcatagaggcccgagtttaaggaccactaccgcaagtggtaagttagttacacaatggtgttgtcgatcctgcacgatgccgccattaaggtttttgggggaagatggttgttggtatgggatggaaataagacccctgtcggagaaggaagaaaatatggtaaaatcacaagtaactgcaggtcagggcacctcagaaacttttagcatgggtttactgtgtttaacacttttcgtagaagagtgtttacgaagacgagtgacccgaaaacacatgatcctagtggtcgtaattacgttctgcgctataatattgggtggccttacatggatggatttgctacgagcacttataatgctaggagacacaatgagcggtcgcataggtgggcaaatacacttagccatcatgacggtattcaaaatgagcccggggtacgtactaggtgtcttcttgagaaaactaacaagtcgggaaacggcattaatggtaattggaatggctatgactacagtcttcagtatcccacatgacctcatggagctaatcgacgggatttctctaggattaatactattaaaaattgttacgcatttcgataatacccaagttggtaccctcgctttgtcgttaacatttatacgttcgacaactcctctcgtgatggcatggcggacaataatggctgtgttctttgtaataacattaatcccgttatgtagaacttcctgccttcaaaaacagagtcactgggtagaaattaccgcgctgattttaggtgcacaagcactcccggtctacctaatgactttaatgaagggggcatcctctagatcatggccgttgaatgaaggaatcatggcagttggattggtatcacttcttggctccgcattactaaagaatgacgttccgctagctgggccaatggtagctgggggattattattggcggcttatgtaatgagcggatcgtcggcagatctttctctcgaaaaagccgccaatgtccaatgggatgaaatggctgacataacaggatcttccccaattatagaagttaaacaagatgaagatggttcattctcgattcgtgacgtcgaagaaactaatatgattacgctcttagtaaaattagcactaataacagtatccggcctttaccctctagctattccagtaactatggcattatggtatatatggcaagtaaaaacccaacgttctggggccttgtgggacgtccctagcccggcggccacccagaaagccactctatcagagggagtctatagaatcatgcaacgagggctgtttggcaaaacccaagttggagtaggtatacacatggaaggggtgttccataccatgtggcacgttacaagaggtagcgtaatatgtcacgaaacaggaagactagaaccatcttgggctgatgtaagaaatgatatgatatcatatggaggaggatggcgtttgggtgataaatgggataaagaggaagatgtacaggttcttgctattgaacccggcaaaaatcctcgccacgtccagacaaaaccgggtttattcaaaacgttaacaggcgaaataggtgctgtaaccttagacttcaaaccaggtacgtccggtagtccaatcataaacaagaaaggaaaagtaatagggttatatgggaatggagtagtcacaaaatccggagattatgtatcggcaatcacacaggctgaacgtatcggagagccagattatgagattgacgaagacatctttaggaagaaaagacttactataatggatctgcaccccggagcaggtaaaacgaagaggattctaccgtccatagtgagagaagcattaaagcggagacttcgcaccttaatactcgctcctaccagggtggtcgcggccgaaatggaagaggctttgaggggcctaccaatacggtatcaaaccccagccgttaagtcagagcatacgggacgcgaaatagttgacctaatgtgtcacgccacattcacgactagattactatcctcgacacgcgttccaaactacaatttaatagtaatggatgaagcccattttacggacccatgctccgtggcggctcgaggatacatcagcacacgagtcgagatgggagaggcagcagcaatattcatgacagctacgccgccaggcagcattgatcccttcccgcaatcaaactcaccaatcgaagatatagagagagaaattcctgaacgtagttggaataccggatttgattggataactgactaccaaggtaaaactgtctggtttgtgccatcaattaaggcaggcaacgacattgcaaattgcctgagaaaatctggcaaacgagtaatacaactgagtagaaaaacttttgatactgaatatcctaaaacaaagttgacagactgggactttgtagtaacaaccgatataagtgaaatgggtgcaaattttagagctggtagagtaatagatcctcgacgttgtctaaagcccgtcatacttacagacggaccagaaagggtcatattggcaggcccaataccagtcactccagcctcagcagcccagcgaagaggacgaattggaagaaatccagcacaagaggacgatcaatatgtatttagcggagatcctctcaaaaacgacgaagatcatgcacactggaccgaagcgaaaatgttgctcgataacatatacactcctgaaggaataattcctaccttattcggtcccgaacgagagaaaacccaggctattgacggtgaatttagattaagaggtgagcagagaaaaacttttgttgaacttatgcgtagaggtgacctaccagtatggctcagttataaggtggcttctgcggggatcagctataaagatcgagaatggtgttttacaggagaaaggaataaccaaatactagaggagaatatggaggtggaaatatggactagagaaggagagaagaagaaattaaggcctaaatggttagatgcaagagtttacgccgaccccatggccttgaaagattttaaggaatttgcgagcggtagaaaaagcactaccctagacatcttgaccgaaatagctacactacctacttacttaagctcgaaagccaaattagcgcttgataatatagttatgctccatacaacggagaaaggagggagagcataccaacatgccttgaacgaattaccggaatcacttgaaacactaatgttagttgcactattgggagccatgacagcaggtatctttctattctttatgcaaggaaagggaattggtaaactttcgatgggcctgattgcgatagcggttgccagcggcctattatgggttgctgaaatacaaccacagtggatagcagcctcaataatactcgaatttttcttgatggtcctattaataccagagccagaaaaacagcggacaccacaagataatcaattaatttatgtaatactaactatcttaacaatcatcggtctaattgccgccaacgagatggggctaatcgagaaaactaaaacagattttgggttttatcaagtgaaaacagaaacgactatattagacgttgatcttcgacccgcttcggcctggactttatatgcagtcgctactactatcctaacaccaatgttgaggcataccatcgaaaatacctcggcaaatttgagcttagctgctatagcaaatcaagctgcagtcttgatgggattaggtaaaggatggcccttacatagaatggacctaggtgtacctttacttgcgatgggatgttacagtcaagtaaacccgaccacattaacagcatcattggttatgttactgattcattatgcaattatcggccctggtctccaggcaaaagccacgcgagaagcccaaaagcggactgctgcaggaataatgaaaaatcctaccgtggatggcattactgtaattgatttagaaccaatatcatatgatccaaaatttgaaaaacaacttggacaagtaatgttattagtactatgcgtagggcaattattactgatgagaacaacatgggctctttgtgaagttctaactctagcaaccggtcctataatgacgttgtgggaaggaaatcctgggcgattctggaacacaactatagcagtaagcactgcaaatatctttagagggtcatacttagctggcgcaggtttggcatttagcttgatcaaaaatgcccagacacccagacgaggtactggcacaacgggcgaaactctcggagagaaatggaaacgacaattaaactcccttgacaggaaagagttcgaagaatacaaacgtagtggaatactagaggtcgaccgaacagaagctaagtctgcactgcgtgatggctccaagataaaacatgctgttagccgaggaagcagcaaaattagatggatcgtagaaagaggaatgataaaacccaaaggcaaggtagttgatctaggttgtgggaggggcgggtggtcatactatatggcaactttgaaaaatgttacggaggtaaaaggttatacgaaaggaggtcctggacatgaggaacctatacctatggccacatatggatggaacctagtaaagttgcacagtggagtagatgtattttataaaccaactgagcaagtagacactttattgtgtgacataggggaaagtagttccaatcctacaatagaagagggtcgaaccttaagaatactgaaaatggtcgaaccctggttatcttccaagccagagttctgtataaaggtactaaacccatacatgcctaccgtaatagaggaactagaaaaacttcaacgaaggcatggaggctcattagtaagatgtcctctttcaagaaattcaacgcatgaaatgtactgggtgtctggagcttctggcaacattgtctcgagtgtcaacactatatctaagatgcttctaaacagatttacaacacgacataggaagccaacttatgaaaaggatgtcgatttaggcgcaggaactaggtctgtatcaaccgaaacagaaaaacccgacatgactataatagggaggaggttacaacgcttacaggaggaacacaaagaaacgtggcactacgaccaggagaatccctatagaacatgggcgtaccacggaagttatgaagcccctagtaccggttcggcttcatctatggtcaacggtgtagtaaaattgctaacaaaaccatgggatgtcatcccaatggtaacgcaattggcaatgacagatacaacccccttcggccaacaaagagtctttaaagaaaaagtagacactcggacaccacaaccaaaattaggaacacgtatgatcatgacaacgacggcgaattggctttgggcactgctaggcaagaagaaaagtcccagattgtgtacgagagaagaatttatatcaaaagtgaggagcaacgctgcaattggggcagtttttcaggaagaacaagggtggacgagcgcgagtgaagcggtaaatgacagccgcttttgggagctagtggacaaagagcgagcattacaccaagaaggcaaatgcgaaagttgcgtttacaatatgatgggtaagagggaaaagaaattaggagagttcggacgcgccaaaggctcgagagcaatctggtacatgtggttaggcgctaggtttctagaatttgaagcattgggctttctaaatgaagatcattggttcagccgggaaaactcatggtcaggagtagagggcgagggactgcatagattggggtacatcttagaagatatagacaagaaggacggcgatttaatatacgctgacgatacagcaggatgggatacaagaataactgaagatgacctattaaatgaagaactgattacagaacaaatggctccacatcataaaacgttagcaaaagcaattttcaaacttacttatcaaaacaaggtcgtaaaggtgctacggccgacccccaagggggccgttatggacattataagtagaaaggaccaaagagggtctggacaagttggtacttatggcctcaataccttcacgaatatggaagtacagttgatccgacaaatggaagccgaaggagtaataacacaagatgatatgcaaaatccgaaaggcctgaaagagagagtagaaaagtggttaaaagaatgtggagttgataggctaaaaaggatggcaattagcggagatgactgcgttgtaaaaccactagatgaacgattttctacatcgttactctttctaaatgacatgggtaaagtgagaaaggacgttccgcagtgggagccctctaaaggttggaagaattggcaagaggtccctttttgttcgcaccatttccataaaatatttatgaaagatggcaggagtttggtggtgccttgcagaaatcaagacgaactaatcggtcgagctagaataagtcaaggagccgggtggtcactcagagaaactgcatgtttaggtaaagcgtatgcacaaatgtggagcctcatgtattttcatcgcagggatctgaggctggcctctatggccatctgctcagcagtccccacagaatggtttcccacgagtcgaacgacctggtcaatacatgctcagcatcagtggatgactaccgaagacatgttaaaagtatggaaccgagtatggatagaagataatcccaatatgacggataagactccggtgcactcttgggaggacattccatacttaggcaagcgcgaagacttatggtgtgggtcgctaataggcctgtcttctcgggccacatgggccaaaaatatacacacagctattacacaggtgagaaacttgattggtaaggaagagtacgtagactatatgccagttatgaaacgatattcagcccctagtgaaagtgagggcgtactttaa

SEQ ID NO: 23668 - RNA, 9867 nt, synthetic construct
  misc_feature 1..9867: note = derived and/or modified CDS sequence (opt6) from DENV-4__JQ915082__SS-prME
  source 1..9867: mol_type = other RNA
tctactatgaccttactttgccttattcctactgttatggcgttccatctaagtacaagggatggtgagccattaatgatagtagcgaaacacgaacgagggaggccactattgtttaaaacaacagaagggattaacaaatgtacattaatagctatggatttgggagaaatgtgcgaggatactgttacatataaatgcccattactcgttaatacggaaccggaggatattgattgttggtgtaatctaacatctacatgggtaatgtatggtacatgcacgcagtcaggagaaagaaggagagaaaaacgctcagtagccctaacaccccatagtggaatgggattagaaactagggctgaaacttggatgagctcagagggtgcatggaaacatgcccagagagtcgaatcctggatattacgaaaccctggtttcgcattactggcagggttcatggcgtatatgatagggcaaacgggaatacagagaatagtattctttgttttgatgatgttggtggcaccctcatatgggatgcgatgtgttggtgtgggaaatagggattttgtcgaaggagtaagtggaggagcgtgggtcgacttagttctagagcacggaggatgtgttactacaatggcacaaggaaaacctacacttgatttcgaacttacgaaaactacggcaaaagaggtcgcccttctaagaacatattgtattgaagcatcaatatccaatattaccacagctaccagatgtccaacccagggggaaccatacttaaaagaagaacaagaccaacaatacatttgtaggcgtgatgtagtagatcgaggatggggtaatggatgtggactattcggaaaaggtggggtagtaacctgtgctaaatttctatgcagcgggaaaattactgggaaccttgtacaaattgagaacttagaatataccgttgtcgtaactgtccataatggagacacacatgctgttggaaatgataccagcaatcatggagtcacagcaaccataaccccgcgctcaccgagtgtcgaagtgaaattacctgattatggagaattgacgttagactgtgaacccagatctggaatagactttaacgagatgattttaatgaaaatgaaaaagaaaacatggctcgttcataaacagtggttcttagatttaccactaccctggaccgcgggtgcagacacttcagaggttcactggaactacaaagaaagaatggttacatttaaagtcccccacgcaaaaagacaggacgtaaccgttctaggtagccaggaaggggctatgcactccgcactagcaggggctactgaagttgactcaggtgacggaaatcatatgtttgcaggccatctaaaatgtaaagttagaatggagaaacttagaattaaaggaatgagttatacaatgtgcagtggtaaattttcaatagacaaagaaatggcggaaacccaacatggtactaccgtagttaaagttaagtacgaaggtgccggagcaccatgtaaaatcccgatagagattagagacgtgaataaggaaaaagttgtaggaagaattatatcaagcactccgttcgcagaaaataccaacagcgttataaatatcgaacttgaaccaccattcggagattcttatattgtgataggtgtcggagactctgctcttacactacactggttccgcaaaggaagcagtatcggtaaaatgtttgaaagtacataccggggagctaaaagaatggccatactaggggagacagcttgggactttggttcagtaggagggctgttcacttcccttggaaaggccgtgcatcaagtttttggaagcgtgtatacgacaatgtttggcggagtttcgtggatgatccgtatattgataggcttccttgttctttggataggtacaaattcacgtaatacaagtatggcaatgacttgtatagctgttggtggaataactttgtttttaggattcacagtacaagcggacatgggatgtgtagtgagttggaacggtaaagaattgaagtgtgggagcggaatctttgtcgttgataatgttcatacatggaccgaacaatacaaattccaaccagagagcccagcaaggttagcttctgctatcctgaatgcacacaaagacggggtgtgtggcatacgatcaacaacacgattggaaaatgtgatgtggaagcagataacaaacgagttaaattacgttttatgggaaggaggtcacgatttaacagtagtagcaggagacgttaagggtgttttgacgaaaggtaaacgtgcactaactccaccggtcaatgatttaaagtatagttggaaaacgtgggggaaagcaaagatatttacacctgaagcaaggaactcaacattcttgatagatgggcctgatacatcagaatgccctaatgaacggcgtgcttggaatttctttgaggtggaggattacgggttcgggatgttcactacaaatatctggatgaaattcagagaaggctcatctgaagtctgcgatcacaggttaatgagtgccgcaataaaagaccaaaaagcggtgcatgcagacatgggctactggatagagtctagcaaaaaccaaacatggcaaattgaaaaagcatccctaattgaggtaaaaacatgtttatggcctaagacccatactctatggtcaaatggtgtcttggaatcgcaaatgttgatccctcgcagctacgcagggccattctcccaacacaactatagacaaggatatgcgacccagactgctggtccttggcacttaggcaaactggaaattgactttggagaatgcccaggcacgacagtcaaaattcaggaagactgtgaccatagaggtcctagtctaagaacaacaaccgcaagcggaaaattagtgactcaatggtgctgtcgctcatgtactatgccaccattacgatttcttggcgaggatgggtgctggtatggtatggaaattagacctctatcggaaaaagaggaaaatatggtaaaaagtcaagtaaccgccggtcaaggcacatccgagactttcagtatggggctattatgcttaacactttttgttgaagaatgccttcgccgtagagtaacacggaaacacatgatattagttgttgttattacattctgcgccatcatcttgggaggattaacttggatggatttgctgagggcattaataatgttaggagatacgatgtctggaaggataggaggccaaatacacctagctattatgacagttttcaaaatgagccctggatatgtacttggagtctttttaagaaaattaacaagtagagagactgcgctgatggtaatagggatggcaatgacgactgtgttttcaatcccgcatgatcttatggaactcattgacggaatctccttaggcttaatattactaaaaatcgtcacacacttcgataatacgcaagttggcacattagccctttctctaacatttatcagaagtacaactcctttagtaatggcgtggcgtaccattatggcggtattctttgttatcacactaattccgctatgcagaacttcttgcctgcaaaaacaaagtcactgggtcgagataacagcactgattctgggcgcacaagcgctcccggtgtacctaatgactttgatgaaaggcgctagtcgcagatcctggccattaaatgaaggtataatggcggtggggttagttagcttattaggctcagcattactcaaaaatgacgtaccattagccgggccgatggtggccggaggactactgttggctgcctatgtaatgtcaggaagtagcgctgatttatcattggagaaggcggctaatgtacagtgggatgaaatggcagacattactgggagttctcctattattgaggttaaacaagatgaggatggttcttttagcataagagatgtagaggaaacaaatatgatcactctgttagtaaaactagcactaataactgtatctggtctatatcctttggccatacctgtcactatggcactatggtacatttggcaagtaaaaacacaacgctctggagccctttgggacgtaccaagtcctgctgcaacacaaaaagcaactcttagcgaaggcgtgtatagaattatgcaaagagggctatttggtaaaacacaagtaggagtaggcattcacatggaaggcgtcttccatacaatgtggcatgtaacaagaggaagtgttatatgccacgaaacgggacgacttgagccatcttgggccgacgtgaggaacgatatgatatcttacggaggcggttggaggcttggagacaaatgggacaaagaggaagatgtgcaagtactggccatagaacctggcaaaaatccgagacatgttcaaacgaaacccggcctattcaaaaccctaaccggcgaaataggcgccgtgacgttagatttcaaacctggaacatctggttcacccataataaataagaaaggtaaggttataggcctctatggtaacggggtagtaaccaaaagcggggactatgtctctgcgattacacaggcggagaggattggagaaccagattacgaggtcgatgaagacatttttcgcaagaagagactaacaatcatggatcttcaccccggagcggggaagactaaaagaatcctaccatcaatagtaagagaggctttaaagcgaaggttaagaacactaattcttgcaccgacccgagtggttgcggcagaaatggaagaggctctccgcggcctccctatccgataccaaacgcctgctgttaaatcagaacacacaggcagagaaatagtagacctaatgtgtcacgctacattcaccaccagattattatcaagcacaagggtccctaactataatttaatagtcatggatgaagcgcatttcacggacccttgttctgttgctgcaaggggctatattagcaccagggtcgaaatgggggaagctgcagctatatttatgaccgcaacaccgcccggttctattgatccattcccccaatctaactcaccaattgaagatatcgagcgcgaaatcccggaacgatcatggaatacaggcttcgattggattacagattatcagggtaaaactgtgtggtttgtaccttcaatcaaggctggcaacgatatagcaaattgcctaaggaaaagtggaaaaagggttatacaattatcgcgtaaaacatttgatactgagtatccaaaaactaaattgaccgattgggacttcgtcgtaacaactgacatatcagaaatgggagccaacttccgagcaggaagagtgattgaccctcgtagatgcttaaaaccagttatcttaacagatggacctgaaagagtgattcttgcaggaccaatcccggtcactcccgcttccgcagcacagcgccgaggaaggataggtcgaaacccagctcaagaggatgaccaatatgtatttagtggggacccgttgaaaaatgacgaagatcatgctcactggacggaagcaaaaatgctacttgacaatatctacactcctgagggaataataccaacgctttttggaccagagagggagaaaacgcaggccatagatggcgagttccgtttaagaggtgaacaaagaaaaacatttgtagaactaatgcgacgtggggatctaccagtgtggttgtcatataaggttgcatcagccggtattagctacaaagacagagagtggtgtttcacaggagagaggaataaccagatactggaagaaaacatggaagttgaaatatggacgagagaaggcgagaaaaagaaattaaggcctaaatggctggatgcaagagtatacgcagacccaatggcgttaaaggatttcaaagaatttgcgtcaggccgaaagagcactacactggatatactcactgaaattgcgacacttcccacttacctctcatcaaaagcaaaattggcattagacaatatagtaatgctgcatacaacagaaaaaggtggtagggcctatcagcatgcgttaaacgagttacccgagtcgctggaaactttaatgctagttgctctgttaggagcgatgacagcagggattttcctattctttatgcagggaaaaggcattggcaaactaagcatgggtcttattgctattgccgtagcaagtgggttactctgggtagcagaaatccaaccgcaatggattgctgctagtattattttggagttctttctaatggtgcttttgattccagaacctgaaaaacaaaggactccacaagataatcaactaatttacgtaattcttaccatactcacaataatcgggctgattgctgcaaacgaaatggggttgatagagaaaactaaaaccgatttcggattctatcaggtaaaaacagaaacgacaattctagatgtggatctacgtcccgcatcagcgtggacattgtatgccgtagccaccacaatattaacaccgatgctccgccacacaattgaaaacatgtctgctaatttatctctagcagcaattgcaaaccaggcggctgttttaatgggtttggggaaaggttggccattacataggatggaccttggtgtacccctacttgcgatgggttgctacagtcaagttaaccccacgaccttaacagcgtcattagtcatgctactgatccattatgctatcatcggaccaggtctacaggcaaaagcaacacgagaagcgcaaaagcgaactgctgctggtattatgaaaaatcctacagttgacgggataacagtgatcgatttggaaccaatctcgtatgaccctaaatttgaaaaacaactaggtcaggtaatgctattagtcctctgtgttgggcaattactactgatgcgcacaacatgggcactgtgtgaagttctaacacttgctacaggaccaattataacattatgggaaggaaacccaggaagattttggaatacaaccatagctgtatcaactgcaaatatcttcagaggcagctatcttgccggtgctggcctcgcgttttcattaatcaaaaacgcccagactcctcggagaggaacaggtactacaggcgaaactcttggagaaaaatggaagaggcaactgaacagtctagaccgtaaagaatttgaggaatataaaagaagtggaatcctagaagtagatcggaccgaagccaaatcggcacttcgtgatggttcgaaaatcaaacatgctgtatcccggggatcctccaaaatacgatggatcgtggaaagaggaatgataaaacctaagggaaaagtagtcgacctgggatgtggaagaggaggttggtcatactatatggcaacattgaaaaacgtaactgaagttaaaggatacacaaaaggaggaccagggcatgaggagcctataccaatggctacatatggatggaacctagttaaattacacagcggtgtcgacgtattttataagcctaccgagcaagtagacactttattatgtgacattggtgaaagctcctccaatcctacgattgaggagggtagaacattgagaatactaaaaatggttgagccatggcttagctccaaaccagagttttgtattaaggtactaaacccatatatgcctacagttatagaagaacttgaaaaactccaaagacgacatggaggttccctggtccgctgcccattgagccgaaattctacccacgaaatgtactgggtatctggagcaagcggtaacatagtcagtagtgttaatactatttccaagatgctattgaaccgattcacaacacgacataggaaacccacgtatgagaaggatgtagacttgggtgcagggacccgatctgtatcaacagaaacagagaaaccagatatgacaattattgggaggcgattgcaacgcctacaagaagaacacaaagaaacttggcattatgaccaagaaaacccgtatagaacatgggcgtaccacggatcgtacgaggctccatcaacgggtagtgcaagttctatggtaaacggagtagtaaaattacttactaaaccgtgggacgtcatcccaatggtaacacagctcgctatgactgatactacaccattcggacaacagagagttttcaaagaaaaagttgatacgcgaactccgcaaccgaaattgggaactaggatgataatgacaactacggctaattggttatgggcgttactcggcaagaagaaaagccctaggctatgcacacgtgaagagttcatttctaaagtaagaagcaacgcagctataggtgcggtgtttcaggaagaacaaggatggacaagtgcgagcgaagcagtaaatgacagtcgattttgggaattggtagacaaggaacgcgcgctacaccaagaagggaaatgtgaatcatgtgtttataacatgatgggcaaacgagagaagaaactaggagaatttggcagagctaaaggatcgcgcgcgatatggtacatgtggttaggcgcccggttcctcgaatttgaggctttgggatttttaaacgaagatcattggttttccagagaaaacagctggtcaggagtggaaggtgaaggtttacatagactaggttatatattagaggatattgataagaaagatggagaccttatttatgcagacgataccgcaggctgggacacacgaataacggaagatgatctgttgaacgaggaactcataacagaacaaatggcgccccatcataaaactctagctaaggccatatttaaactaacttatcaaaataaagtagtaaaagtactgaggcccaccccaaagggagctgtaatggacataatttcccgaaaagatcaaaggggctcaggacaagtaggtacgtacggattgaacacatttactaatatggaagtacagttaattcggcaaatggaagccgagggagtaattacacaggacgacatgcaaaatccaaaagggttaaaagaacgtgtagagaagtggttaaaggaatgtggggtagatcggttaaaacgtatggcaataagcggtgatgactgtgtggtaaaacctctcgatgaaagattttccacctccctactatttttaaacgatatgggaaaagtaagaaaggacgtaccacaatgggacccatcgaaaggatggaagaattggcaggaagtgcctttctgttcccatcattttcataaaatcttcatgaaggacggccgatctttagttgtgccttgccgtaatcaagatgaattgatcggtcgcgccaggatatctcaaggagctgggtggtccctacgtgaaacggcgtgcctaggcaaagcctatgctcaaatgtggagtctaatgtattttcatcgcagagatctacgattagcttcaatggctatatgctcagcggttccaacggaatggttcccgacatcccgaacaacctggtctatccatgcacaacaccaatggatgacaacagaggacatgcttaaagtctggaacagagtatggatagaagacaatccaaatatgacagataagacacccgtccattcatgggaagacataccatacttgggtaaacgcgaagatctatggtgtggcagcttaattggtctctcatcgagggctacctgggcgaaaaacatacacacggccataactcaagtacggaacctcatcggaaaagaagagtacgttgattatatgcccgtaatgaaacgctactctgctccaagtgaatcagaaggagttctttga

SEQ ID NO: 23669 - RNA, 9867 nt, synthetic construct
  misc_feature 1..9867: note = derived and/or modified CDS sequence (opt6) from DENV-4__JQ915081__SS-prME
  source 1..9867: mol_type = other RNA
tccacgatgacattactatgtttgatacctacagtgatggcatttcatctgagtacacgcgacggcgaaccattaatgattgtggcaaaacatgaaagaggacgacctttgctatttaaaacgactgagggtataaataaatgcactttaatagcgatggatttaggcgaaatgtgcgaagataccgtcacctataaatgtcctctattagtcaatacggagcccgaagatattgactgctggtgtaacttaaccagtacatgggtcatgtatggaacatgtactcaaagtggggaacgcagaagggagaaaagaagtgttgcactaactccacactcaggtatggggctagaaaccagggcagaaacttggatgtctagcgagggggcatggaaacatgcacagcgagtcgaatcgtggatattaaggaatcccggttttgctttactggctggttttatggcatacatgataggtcaaacggggatacaaagaattgtgttcttcgtgctaatgatgttagtcgccccatcctatggtatgcgttgtgtcggagttgggaatagagacttcgtggaaggggtgtcgggaggagcttgggtcgatttggtgctcgaacacggtgggtgcgttactacgatggcacagggaaaaccaacattagattttgaactcacaaaaaccacagcaaaagaagttgctttgctgcgcacgtattgtatcgaggcatcaatctcgaacattacaacagcaacaagatgtcctacacaaggagaaccatatttgaaagaagaacaagaccagcaatacatctgccgaagggatgtcgtcgaccgaggatggggaaacggctgcggtctattcggcaaaggaggagtagtaacatgtgctaaattcttgtgcagcggaaaaatcaccggcaacctagtacaaatagaaaatttagaatacacagtagtagtaacagttcataatggagatactcacgcggtaggaaatgacaccagtaaccatggagtaaccgcgactattacacccagatcgccatcagttgaagtaaaattgccagactacggtgaactaacacttgattgcgagccaagaagtggtatagacttcaatgaaatgatactaatgaaaatgaagaagaaaacttggctagtacacaaacaatggttcctagatctaccattgccctggacggccggtgctgacacatcagaagtccattggaattataaagaaagaatggttacgttcaaagtcccgcatgcaaaacgacaggacgttaccgtcctaggatctcaagaaggtgcaatgcatagtgcactagctggagctacagaggtagactcaggcgatggtaaccatatgtttgctggacatctaaaatgcaaagtccggatggagaaactgagaataaaaggaatgagttatacaatgtgtagtggcaaattctctattgacaaagaaatggcagaaacacagcatggaacaaccgtagtaaaagttaaatatgagggagcaggggcgccttgtaaaatacctatcgaaatacgcgacgttaataaagaaaaagtggtgggaagaattatctcttctaccccatttgctgaaaataccaacagtgtgatcaatatagaattagaaccaccttttggagattcctacattgtaataggtgtaggcgacagcgctctaaccttacattggtttagaaaaggtagctctatagggaaaatgtttgagtcgacctacaggggagctaaacgaatggctatacttggcgaaacagcatgggatttcgggtctgtagggggtttatttacctcactaggcaaagcagtacaccaagtttttggatctgtttataccacaatgttcggcggtgtatcatggatgattcgaattttgattggatttctagtattatggataggaacaaactctagaaatacgtcaatggctatgacatgtatagcggtcggagggataactctcttcctaggattcaccgttcaagccgacatgggatgtgtagtttcatggaatggtaaagaattgaaatgcggcagtggaatattcgtggttgataacgttcatacctggacagaacaatataaattccagccggaaagccctgctcgactagcgagtgccatattaaatgctcacaaagatggcgtttgcggtataagatccacaactagactagaaaatgtaatgtggaaacaaataactaatgaattgaattatgtcctatgggaaggaggccatgatctaacagtagtagcaggcgatgtaaaaggagtattgacaaaaggtaaaagagcacttacgccgcctgtaaatgatctgaaatactcttggaaaacctggggcaaagcaaagatatttactccagaggcgagaaattccacttttcttattgatggacctgatactagcgaatgccccaatgaacggagggcttggaacttctttgaggtcgaagattatggctttggtatgtttaccaccaacatttggatgaagttccgagaaggaagcagtgaagtatgtgaccataggctcatgagtgccgccattaaagatcaaaaagctgtacacgcagatatgggttactggatagaatcgtcgaaaaatcagacatggcaaattgagaaggcatcactgatagaggtaaaaacatgtttatggccaaaaacacatacactatggtccaatggagttttagaatcacaaatgcttatcccgagatcttacgcagggccattttctcagcataactaccgacaagggtatgctactcaaaccgctggtccttggcacctagggaaactcgagatagactttggtgaatgcccgggaacaacagtaaaaattcaggaagattgtgaccatagagggccttcacttaggacaacaacagcgagcggaaaattagtgactcaatggtgttgcaggtcatgtacaatgcccccattacgatttttgggagaggatggctgctggtacggtatggaaattcggccactatcagaaaaagaggaaaatatggttaaatcacaagtcactgccggtcaaggaacaagcgaaaccttcagcatgggccttttatgcctcactttatttgtagaagaatgcctacgtagaagagtcactagaaagcatatgatattagtggtggtaattactttctgtgcaattatactcggagggctaacttggatggacttgttgcgtgcgctaataatgcttggagatactatgagcggacgtattggtggtcaaattcatctggctattatgactgtattcaaaatgagtcccggttatgttttgggagttttccttagaaagttaacttcaagagaaaccgcgttaatggttattggaatggcaatgactactgttttctctattcctcatgacctaatggaactgatagacggtatatcattaggtctgatattattaaaaatagtaacacatttcgacaatacgcaagttggcacactagccctgagtttgacatttatacgttccaccactcctctggtaatggcctggagaaccattatggcagtgttctttgtaataaccctaatacctctctgccgtacctcatgtcttcaaaagcagagtcactgggtagagataacagccttgatattaggggcccaggccctccccgtctacttgatgacacttatgaaaggtgcctcgcgacgttcttggcccttaaatgaagggattatggccgtaggtttagtgtccttactaggtagtgctctactcaaaaatgacgttccgttggcagggccgatggtagccggtgggttattattggcagcctatgtgatgtctggaagttcagccgacctgagcctagagaaggctgctaatgtacaatgggacgaaatggctgacattactggcagttcacctataattgaagtaaaacaggatgaggatgggagtttcagtattagagatgtcgaggaaacaaatatgataacgcttcttgttaaacttgccctcattactgtaagtggattatatcccttagcgatacccgtcacgatggccttatggtacatctggcaagtaaagacacagaggagcggcgctttatgggacgtcccttctcccgccgcaacacaaaaggcgaccttaagcgaaggagtataccggataatgcaacgaggactatttggaaaaacacaagttggggtaggaatacatatggaaggtgttttccataccatgtggcatgtgacgagaggatcagtaatttgtcatgaaaccggcagattagaaccatcatgggctgatgttagaaatgacatgatcagctatgggggtggatggaggcttggggataaatgggataaagaagaggatgttcaggttcttgcaatagaaccagggaaaaatccaagacatgttcaaacaaaaccaggactattcaagacactcacaggagaaattggtgctgttaccttagacttcaaaccgggcacatctggttccccaattattaataagaaaggaaaagttataggattatatggaaatggtgttgtaaccaaatcaggagattatgtgtccgctatcactcaggcagaaagaataggagagccagactatgaagtagatgaagacatctttaggaagaaacgtctcacaataatggatctccatccaggcgcaggcaagacaaagaggatattgccaagtatagtgagagaagcgctaaagcgaaggcttaggacacttatattagcacctactcgagtcgtcgctgctgaaatggaagaagcacttcgaggtttacctataagataccagactccagctgttaaaagcgaacataccggtagggagattgtagatctgatgtgccatgcaaccttcaccacacgactattaagctcaacacgagtgccgaattataatctaatcgtaatggatgaggcacactttactgatccgtgttctgtggctgcccgggggtacatcagcaccagagtagaaatgggagaggcagcagcaatttttatgactgccacaccaccaggcagcatagacccattcccacagtcaaattcgccgattgaggatattgagagagagatcccagagagaagttggaatactggatttgattggattacggattaccaaggtaaaacagtttggttcgttccctccattaaagccggaaacgatatcgctaactgtctgagaaaatcagggaaacgagtcatacaactgtcgcggaaaactttcgatacagaatatccaaaaacaaaattaacggactgggatttcgtagttacaactgacataagtgaaatgggcgctaattttcgagctggaagagtaatagatccaagacgctgtcttaaacctgtgattttaactgatggacctgaacgagtcattttagcaggtccaatcccggtcactccggcttccgcagcccaaagacgaggcagaatcggtagaaaccccgcacaagaggatgatcaatacgttttctcaggtgacccacttaaaaatgatgaagaccatgcgcattggacagaagcgaagatgttactggataatatttacacaccggagggaattataccaactctgtttggccccgaacgagaaaagacgcaggcgatagatggggaatttcgcctacgtggagaacaacgtaagacattcgtagaactcatgcgacgtggagatttacctgtttggctttcctacaaagtagcctccgcaggtataagttataaagatagagaatggtgctttacaggagaacggaacaatcaaatattagaagaaaatatggaagtggaaatatggacaagagaaggagagaagaagaaattacgaccgaaatggttagatgctagagtgtacgcggaccccatggctctaaaagatttcaaagaatttgcttccgggagaaaaagtacaacattagatattttaactgaaatagcaacacttcctacctatctttcctcaaaagccaagctagcattagacaatatagtcatgcttcatacaacggaaaaaggaggacgggcatatcagcatgcattaaacgaacttccagagagcctcgagacgttgatgttggtagcactattgggtgcaatgacagcaggaatatttttattctttatgcaaggaaagggtattggtaagttatctatgggattaatagcgattgctgtggcaagtgggctattgtgggttgccgagatccaaccccaatggattgctgctagcattatacttgaatttttcctaatggtactacttataccagaacctgagaaacaaagaacaccacaagataaccaactaatatatgtgattctaacgattcttacaataataggattaatagccgcaaacgaaatgggtctcattgagaaaacgaaaacagatttcggattctatcaagtgaaaacagaaacaacgatattagatgtagacctcagacctgcttcagcatggaccttatatgctgttgccacaactatactaactccaatgcttagacatactatagaaaatatgtcagcgaacctatcactagcagctatagccaatcaggctgccgtcttaatgggattggggaaaggatggcccctccatagaatggaccttggtgtaccacttctagcaatggggtgttatagccaggttaatcccactaccttaaccgcctcattggtaatgctacttattcattatgcaataataggcccgggattgcaggcaaaagccacccgggaagcacagaaaagaaccgcggcaggaatcatgaaaaatccaactgtggatggaatcacagttatcgaccttgagcctattagttatgatcccaaatttgaaaaacagttgggtcaagtaatgttattagtattatgtgtaggacaattgctgttaatgaggacaacatgggctttgtgtgaggtattgactttagcaactggaccaataataactctctgggaaggtaatccgggaagattctggaacacgacaatcgctgtttcgacggccaacatcttccggggatcatacctagccggtgcaggccttgctttttctttaattaagaacgcccaaacgcctaggaggggaactggaacaacgggtgaaacgctaggggaaaaatggaagagacagctaaacagcctagatagaaaggagttcgaagaatacaaaagatcgggtatactggaagttgaccgaacagaagcgaaaagtgccctaagggatggatcaaaaattaaacacgctgtgtcccgaggttccagcaaaataagatggattgtggaaaggggaatgattaagcccaaaggaaaagtcgtagatctgggttgcgggcggggtggctggagctattatatggcgactttaaagaacgttaccgaggtaaaaggttacacaaaaggcgggcccggccacgaagaaccaataccgatggctacctatggctggaatttggttaaactacactctggagtagatgtcttttataaaccaactgagcaagtggatacattactttgcgatattggagaatcgtctagcaatccaacaattgaagaaggtagaactctcaggatattgaaaatggtagaaccatggctatcttccaaacctgaattttgtatcaaagtactaaacccctatatgcctactgtcattgaggaacttgaaaagctacaacgtcgacatggaggatcattagtaaggtgtccactatcaagaaactcgactcacgaaatgtattgggtctcgggagcatcaggtaacattgtatcatctgtaaacaccataagtaaaatgcttctaaatcgtttcactacgcgacacagaaaaccaacctacgagaaggacgttgacttaggagctgggacccgaagtgtttcgatagagacagaaaaaccggacatgacaataatcggcagacggctacaacgattacaggaagaacacaaggaaacatggcactatgatcaagaaaatccatacagaacgtgggcctaccacgggagctacgaagccccttctactggcagtgcttcatctatggtaaatggggtcgtaaaattgttgacaaaaccttgggatgtcatcccgatggtaacacaattagctatgacggataccaccccatttggacaacaacgggtatttaaggagaaagtagatacaagaaccccacaacccaaattgggtacgaggatgattatgacaactacggcaaactggctctgggcgcttcttggtaagaagaaatctccacgcctgtgcacaagagaagaatttatatcaaaagtcagaagtaatgctgcaataggagctgtattccaggaagaacaaggttggacgagcgcgtcagaggcagtaaatgattcaaggttttgggagctagtcgataaggaacgagctctgcatcaagagggaaaatgcgaatcgtgtgtgtacaacatgatgggcaaaagagagaagaaattaggcgagtttggtagagctaaaggaagtcgggcaatatggtatatgtggttaggagcaaggttcttagaatttgaagcattaggttttctgaatgaggatcattggttctccagagaaaattcttggtcaggtgtggaaggggaagggctacacaggcttggatatatattagaagacatagacaaaaaggatggggatctaatatatgctgatgacacagcggggtgggatacaaggataacggaagatgatcttttgaacgaagaacttataactgagcagatggccccacatcataaaacactcgcaaaggctattttcaaactcacgtatcaaaataaagttgtgaaagtattgaggcccacaccaaagggagcagtaatggatataatatctaggaaggatcaacggggttctggccaagtcggaacatatggcttgaacactttcacgaatatggaagtacaactcataagacaaatggaagcggaaggtgtaataacccaggatgatatgcaaaatcctaaaggccttaaagaacgggtagagaaatggttaaaagagtgtggggttgatagactgaaacgaatggcaatcagcggagatgattgcgtagtcaaaccattagacgaacgattctcaacttcacttctattcttaaacgacatgggaaaggtgagaaaagatgtgccccaatgggacccatccaagggttggaagaactggcaagaagtgccattctgctcacaccatttccataagattttcatgaaggacggacgtagtttagtagtaccctgcagaaatcaagatgagctcataggtcgagcacgtatttctcagggtgctggttggtcattacgagaaacagcttgtctaggtaaggcttacgcacaaatgtggtcactaatgtatttccacagaagagacctaagattggcttcgatggccatatgttcagcagttccaacagaatggtttccgaccagcaggacaacctggagtatacatgcacaacatcaatggatgacaactgaagatatgctcaaggtatggaacagagtctggatagaagataacccaaacatgacggacaaaacacctgtacactcatgggaagatataccatacttaggtaagagagaagacttatggtgcggctcgttaatagggctcagtagccgtgctacgtgggcgaaaaatatccatacggcaattacccaagttagaaaccttataggcaaagaagagtatgtagactatatgccggtaatgaagagatactcagctccaagtgaaagtgagggagtactataa

SEQ ID NO: 23670 - RNA, 9867 nt, synthetic construct
  misc_feature 1..9867: note = derived and/or modified CDS sequence (opt6) from DENV-4__JQ915084__SS-prME
  source 1..9867: mol_type = other RNA
tccacgatgactttactatgtctaataccgacagtaatggcttttcacttgagcaccagagatggagaacctttaatgattgttgctaaacatgaacggggacgtccacttctctttaaaacaacggaagggattaataaatgtacactaattgctatggatttaggtgaaatgtgtgaagacactgtaacatacaaatgccctctactggtaaatactgaaccagaagacattgattgttggtgcaatttgacaagcacatgggtgatgtatggaacttgtacacaatctggtgaaagaaggcgagaaaaacgctctgttgcgctaactccacatagtggtatgggactcgaaacaagagctgaaacttggatgtcatcggaaggggcttggaaacatgcgcaaagagtagaaagctggattctgcgaaatccaggttttgctttattagctggttttatggcatacatgattggtcaaaccgggatccaacgaattgtcttcttcgttttaatgatgcttgtagcgccctcatacggaatgagatgtgtaggcgtgggaaaccgagattttgtcgaaggggtaagtggaggcgcatgggtcgatctagtattagaacacggcggatgtgtgaccacaatggcacagggaaaacccacacttgacttcgaattaacgaaaactaccgccaaagaagttgcactcctgcgtacctattgtattgaagcctccatttctaacatcacaactgcgacgaggtgtccaactcagggagaaccatatctaaaagaagaacaggatcagcaatacatttgccgaagagatgtagtagataggggatggggcaatggttgtggcttgtttggtaaagggggagtcgtaacatgtgcaaaatttttatgttcgggaaaaattactggtaacctggttcaaatagaaaatttggaatacacggtcgtcgtaacagtacacaatggagatactcacgcagtaggaaatgataccagcaatcacggtgtaacagccacgattacaccacgcagtccatctgtagaggtgaaattaccagattatggagagctaactctcgattgcgaaccgagatctggaatagacttcaacgaaatgatactaatgaaaatgaagaagaaaacctggcttgtgcacaaacaatggttcctagacttaccactaccatggacggctggggcagatacatctgaagtacattggaactataaagaaagaatggtaacgtttaaagtgcctcacgcaaaaagacaagatgtaacagttctaggaagccaggaaggagcaatgcacagcgcactggcgggagcaacagaagtagacagcggggatgggaatcatatgtttgctggtcatttaaaatgtaaagtacgaatggagaagctaagaataaaaggaatgtcatatacaatgtgttctggaaaattctctattgataaggagatggcggagacacaacacggaacaactgtggttaaagtaaaatacgagggtgcaggcgcaccatgtaaaattcccatagagattcgagatgtaaacaaagaaaaagtcgtaggtcgaataattagtagtacaccatttgcggaaaacacaaactcagtaattaacatcgaactagaacctccatttggcgatagttacatagtcataggagtaggtgactctgcactaacacttcattggtttcgtaaaggctcctcaataggtaaaatgtttgagtctacatatcgtggggccaaacgtatggcaatattaggcgaaactgcttgggactttggatcggttggtggtttgttcacgtcattaggaaaagccgtacatcaagttttcggaagtgtatatacaacaatgtttgggggcgtatcatggatgataagaatactgatcggatttttagtcttatggatcggcacaaactctaggaacacttcaatggcaatgacgtgcatagctgtaggcgggataactttattcctaggatttaccgtgcaagccgacatgggctgcgtcgtatcatggaatggtaaggaattaaagtgcggctcgggtatctttgttgtggacaatgtccatacatggaccgagcaatataagtttcaacctgagagtcctgcacgactcgcttcggctatacttaacgcacataaagatggcgtatgtggaatacgaagtacaacaagattggagaatgttatgtggaagcaaataacaaatgagcttaattatgtattgtgggaaggtgggcacgacctcacagttgttgctggtgacgtaaaaggagtgcttactaaaggcaaacgtgcacttaccccgccagtaaacgatttaaaatatagttggaaaacttggggtaaagcaaaaatattcacgcctgaagctagaaattcaacatttctgatagatggaccagatacaagtgaatgcccgaatgagagacgagcttggaacttcttcgaagtagaggattatggttttggtatgttcaccacaaacatatggatgaaatttagagaaggatccagcgaggtatgcgaccacaggttgatgtcagccgcgataaaagatcaaaaggcggtacacgctgatatgggttattggatagagtccagtaaaaatcagacgtggcaaattgaaaaggcgtcattaattgaagtaaaaacttgtctatggcctaaaacccacacactatggagcaatggagtattagaatcacagatgttgataccgagatcctacgctggaccgttcagtcaacataattatcgtcaagggtatgccacccaaacagctggtccatggcacttaggtaaactagaaatagattttggtgaatgccctggtacaaccgtaaagatccaggaagactgtgatcatagagggccaagcctaagaaccactacagcctctggaaaacttgtaactcagtggtgttgcagatcgtgcactatgccaccgctacgattcttaggtgaagatggatgctggtatgggatggaaatcagacccctcagtgaaaaagaagaaaacatggtaaaatcccaagtcaccgctggtcaaggaacgtcggagacattctctatgggattgctatgtttgactttatttgtagaagaatgtcttcggagacgagtaactcgaaaacatatgatattagtagtcgtgatcacattttgcgcaattattctaggaggcctcacttggatggatttattgcgtgcattaataatgttaggggacactatgagtggccgaataggcggacaaatacatctagctattatgacggtgtttaaaatgtctcccggatatgtcttaggagtttttctgcgaaaactaactagcagagagacagcattaatggtgataggcatggcaatgactactgtcttttctataccccatgatctgatggagttaatagacggtattagtttaggattaatactattaaaaatagtaactcattttgacaacacacaagttggtaccttagccctatccctgacctttatgaggtcaacgacaccattggtgatggcatggcggacaatcatggcagtatttttcgtaataacgctcattccattgtgtagaacatcatgcttacaaaaacagagccattgggtagaaataacagcgctaatattaggagcacaggccctgccagtttatcttatgacgcttatgaaaggagcatcaagaaggagctggccattgaatgaggggatcatggcagtaggattagtgtctctactaggttccgcattgctcaaaaatgacgtaccgctcgctggccccatggttgccggtgggttgctgttagccgcttacgtaatgagtggaagctcggcggacctgtcacttgaaaaagcagcaaacgtccaatgggacgaaatggctgacataaccggttcaagcccgatcatcgaggttaaacaagacgaggacggttcattttctatccgcgacgtagaagaaaccaacatgattactctgttggtaaaacttgcattaataactgtaagtggtctataccccctagctataccagtaaccatggcgctatggtatatctggcaagttaagactcaacgaagtggggccctctgggatgtaccctcaccggccgccacgcaaaaagcaacattgtcagaaggtgtatataggattatgcaacgtggtctttttggaaaaacacaagtaggcgtaggcatacacatggaaggagtgtttcacacaatgtggcatgtaactcgtggcagtgtcatctgtcatgaaactgggcgacttgagccgtcatgggcagatgtgcgcaacgatatgatttcatacggcgggggctggaggctaggagataaatgggataaggaagaggatgtacaagtactggcaatagaacctggtaaaaacccaagacacgtacaaacaaagcctggactatttaaaacattaaccggggaaattggagcagttactctcgactttaaacctggcacgagcggctccccaataattaacaagaaaggtaaagtaataggactttacggaaacggcgttgtaacaaaaagtggcgactatgtatccgcaattacacaagcagaaagaatcggggagccagactatgaagtagacgaagacatattccgcaagaaaagactgacgattatggatttgcaccccggagcaggcaagacaaaacgaatcctgccatcaatagttagggaggctctgaaacgacgcctgcgcaccttaatattggctccgacccgagttgttgcagcagaaatggaagaagccttaagaggcttacctatcaggtatcagactcccgcagtgaagtctgaacacacaggcagggagatagtcgatttgatgtgtcacgctaccttcaccactagactattatcgtctacaagagtaccgaattataacctgatcgtcatggatgaagcgcactttaccgatccttgcagtgtagcagcaagaggttatataagtacgagggttgaaatgggtgaagcggcagcaatatttatgacagcaactcctccaggatcgatagacccattcccacaatctaattctccgattgaagatattgaaagagaaattcctgagcgaagttggaatacaggattcgactggataactgactatcaaggaaagactgtatggtttgtaccatcaataaaagcaggaaatgatatagcaaactgtctcagaaagtccggaaagcgcgtaatacaattgtcaagaaagacgtttgacaccgaatatccaaaaaccaaacttacagactgggattttgttgtaacaactgatatatcagaaatgggcgctaacttcagagcaggaagagtgatagatcccagacgatgtctcaaaccagtaatattaaccgatgggcccgaacgtgttatactggctggaccaataccggtaaccccagcgagtgccgcccagcggagaggtaggattggtaggaatccggctcaagaagacgatcaatacgtcttctccggggatccccttaaaaatgacgaagaccatgctcattggaccgaggctaaaatgctactcgataatatatacactccagaagggataattccaactttatttggtccagaacgagagaaaacccaggcgatagacggtgagttccgacttagaggagaacaacgaaaaactttcgtagaacttatgagacggggagatttacctgtatggctgtcgtataaggtagcatctgccggtatctcctacaaagaccgcgaatggtgctttacaggagaaagaaacaatcagattttagaggaaaatatggaagtagaaatatggacacgggaaggtgagaagaagaaactacgtccaaaatggctagatgctagagtatacgcagatccaatggctctaaaagattttaaagagttcgcgtctgggcgtaaatcaacaactttagatatcttaaccgagattgcgacacttcccacatatctgtcatctaaagcaaaactagcacttgataatatagtcatgcttcatacgactgaaaaaggagggagagcatatcagcacgccttgaatgaattaccggaatccctggaaacccttatgctggtagcgttactcggggcaatgacggcaggaatatttttgttctttatgcaagggaaagggataggaaagctctccatggggctaatagctatagcagtcgcaagcgggctattatgggttgccgaaattcaaccgcagtggatagcagctagtataattctcgagtttttcctaatggtactactcataccagaaccggaaaaacaacgcacaccacaagataaccaactgatatatgtcatcctgaccatcttagcaataataggtctgattgcagctaacgaaatgggtcttatagagaaaaccaaaacagattttggtttttatcaggttaaaacggagacaacaattttagatgttgatttaagaccagcaagcgcgtggacattatacgctgttgctaccaccatattaactccaatgctacgtcatacaattgaaaacacaagtgccaatttatcgctagctgcaattgcaaatcaagcggccgtactgatgggtctagggaaagggtggccactgcatcgaatggatctaggagttcctctcctcgctatgggatgttattcacaagtgaacccaactaccttaaccgccagcctagtgatgttactaattcattatgcgataataggaccaggccttcaagcaaaggcaacacgagaggcacagaaaaggacagcagcgggaataatgaaaaacccaacggtcgatgggataacggtcatcgatttagagccaatatcttatgacccaaaatttgaaaaacaattgggtcaagtaatgctactggtgttatgcgtaggccaactccttctgatgaggactacctgggcactatgtgaagttttgaccctagcgactggtcctatcatgactctatgggaaggaaaccccggaagattctggaacacgacgatagccgttagcacagccaatatttttcgaggatcatatcttgccggtgctggtctggcattcagtcttataaagaatgcccaaaccccacgtcgagggactggtaccactggtgagacactaggggaaaaatggaagagacagttaaattcattagataggaaagaatttgaggagtacaaaagatcaggcatattggaagttgaccgtaccgaagctaaatccgccctgagagacggatcaaaaataaaacacgcagtaagtcgtggatctagcaagattaggtggattgtcgagagaggaatgataaaacctaaaggtaaagtcgtagacttaggctgcgggagagggggttggtcatattatatggctactctcaaaaatgtaacggaggtgaaagggtatactaaaggtggccccggacacgaagaacctatccccatggctacttatggatggaacttagtcaaattacatagcggagttgatgttttctacaagcccaccgaacaagtggatacactattgtgcgatattggggaaagttcaagtaatccaacaatagaagaagggcgaacattacgaatcttaaaaatggtagaaccctggttgagctcgaaaccagaattttgcataaaagttttaaacccatatatgccgacagtgattgaagaacttgaaaagctgcaacggagacacggtggttcgcttgtacggtgtccactctctcgaaattctacacacgaaatgtactgggtttcaggagcttccggaaacatagtctccagtgttaacacaataagcaaaatgttactgaacagattcacaactaggcatagaaaaccaacatatgagaaagatgtagaccttggtgctggaacacgttcagtcagcacagaaactgaaaaacccgatatgacaatcataggaagaagattgcagagattacaagaagaacataaagaaacatggcattatgatcaggaaaatccctacagaacatgggcgtaccacggaagttatgaagcaccgtcgacaggttcggcatcatctatggtgaatggtgtagtaaaattgctaacaaaaccatgggatgtgataccaatggtaacccaactggcgatgacggatactacaccctttggacaacaaagagtatttaaggaaaaggtagatacccgaactccacaaccaaaaatcgggactcgcatgataatgactacgacggcaaattggctatgggcgcttttaggaaagaagaaaagcccaagattgtgtacaagagaagaatttatatctaaagtaagaagcaatgctgcaattggtgcagtttttcaagaggaacaagggtggacaagtgcatcagaagcggtaaatgactctagattctgggagctagtagataaagaacgcgctttacatcaagaaggaaaatgtgagagttgcgtgtacaacatgatgggtaaaagagagaagaaacttggagagttcggcagagcaaaaggatctcgtgccatatggtacatgtggttaggtgcacgatttcttgaatttgaagcactcggctttttaaatgaagatcactggttcagtagagaaaattcttggagcggcgtagaaggagaaggattgcaccgcctgggatacatcttagaagacatcgataagaaagacggcgatttaatatacgctgatgacaccgctggttgggacacacgtattactgaagatgacctactgaacgaagaattaatcacagagcaaatggctccgcaccacaaaacattggctaaagcaatatttaaactaacataccaaaacaaggtagtaaaagtactacgaccaactccaaaaggcgctgtaatggacattatctctcgaaaagatcaacgtggcagtggtcaagttggaacgtacggtttgaacacattcacaaatatggaggttcagctaatacgccagatggaagccgagggcgtaattactcaagacgatatgcaaaatccgaaaggacttaaagaacgagtagaaaaatggctgaaagaatgtggtgtcgataggcttaaaaggatggctataagcggtgacgactgtgttgtaaaaccattggatgaaaggtttagtacatcacttctatttctaaatgatatgggcaaagtacgaaaagatgttccgcaatgggaaccctctaaagggtggaaaaattggcaagaagttccattctgcagtcatcattttcacaaaatctttatgaaggatggacgctctttggtagtgccatgtcgtaatcaggacgaattgatagggcgtgcacggataagccaaggcgcaggttggtcgttgcgtgaaacggcatgtttgggcaaggcttacgctcaaatgtggtctctaatgtactttcaccgtcgagacctcaggttagcctcaatggcgatttgctctgctgtcccgacggaatggttccccacgtcacgtacaacatggagcatccacgcacaacatcaatggatgacaactgaagacatgctaaaagtttggaaccgagtgtggatcgaggacaatcccaatatgacagataaaaccccggtgcatagttgggaggatataccgtatctggggaagagagaagacttgtggtgtgggtctctcataggactaagctcccgtgctacgtgggcgaaaaatatacacacagcaataacccaggttcgaaatctaatcggtaaggaagaatacgtagactatatgcccgtaatgaaacgctatagttcgccatcggaatctgaaggcgttttatag

SEQ ID NO: 23671 - RNA, 9867 nt, synthetic construct
  misc_feature 1..9867: note = derived and/or modified CDS sequence (opt6) from DENV-4__KM190936__SS-prME
  source 1..9867: mol_type = other RNA
tcaacaataactttattgtgtctaataccaactgttatggctttctcattgagtacacgtgatggagaacctttaatgatagtagcgaagcatgaaagaggaagacctttattatttaaaacgacagaaggaatcaataagtgcacactaattgcgatggatctcggagaaatgtgcgaagacactgttacatataaatgtccactacttgttaatacagaaccagaagacattgattgctggtgcaacctaacgagtacttgggttatgtatgggacctgcactcagtcaggagaacgtagaagagaaaaacggtctgtcgctttgactccacacagcggaatgggattagaaacacgagcagaaacatggatgtctagtgaaggagcatggaaacatgctcagcgtgttgaatcttggattttaaggaaccctggatttgcattattagccggtttcatggcatacatgataggacaaacaggcattcagagaacagtattcttcgttctaatgatgttagttgcaccaagctacggaatgcgttgtgttggagtgggtaaccgggatttcgtagaaggcgtatccggaggtgcttgggtagacttagtattggagcatggaggttgtgtgactacaatggcacagggtaagccaacattggactttgaattgacaaagacaactgcaaaagaggtcgcactactacgaacgtattgcatagaagcgtcaattagtaatataacaacagctactagatgccccactcaaggtgaaccttacttaaaagaggagcaagaccaacaatatatctgcagacgagatgtagtagaccgtggatggggaaacgggtgtggcttgtttggaaagggcggagttgttacgtgtgcgaagttttcctgttcaggcaagatcacaggtaaccttgttcagatcgagaatcttgaatatacggtggttgttacagtgcacaatggtgatacccatgcagtaggaaatgatacgtcgaatcatggtgtgactgcaatgatcacaccaagatccccatccgtcgaagttaaattacccgactatggagaattgacattggactgtgaacccaggtcgggaatagatttcaacgagatgattctaatgaaaatgaagaagaaaacatggttggttcataaacagtggtttctggacctgccgttaccgtggactgcgggcgctgacacatcggaagtacattggaattacaaagaacgaatggtaacgtttaaagtcccacatgcaaaacgacaagatgttaccgtattaggttcccaagaaggagctatgcacagtgctttagctggtgcgactgaagtggactcaggtgacggcaaccacatgtttgccggccacttaaaatgtaaagtgcgaatggagaaacttcggataaaaggaatgagttatacaatgtgtagcggaaaattttccatcgataaagaaatggcagaaacacaacacggaaccaccgtggtaaaggtaaaatacgaaggagctggggcaccatgtaaagttccaatcgagataagggacgttaataaggaaaaggtagtgggtcgaattatatcaagcacacctttagcagaaaatactaactcagtaacgaatattgaacttgaacctccatttggcgatagctatattgttattggagtgggaaattcagcgctgacgctacattggtttagaaaagggtcaagtatcggtaaaatgttcgagtccacttatagaggcgccaaaagaatggccatattaggtgagacggcatgggattttggcagtgtaggcggattattcacaagcctcggcaaagccgtacatcaggtttttggatcagtctacacaacaatgtttggaggagttagttggatgatacgaatactgatcgggtttctcgtcctatggataggaactaacagtcggaatacaagtatggcgatgacatgcatagctgtcggcggaataacgctctttttgggctttacagttcaagccgatatgggatgtgttgtaagctggtcaggaaaagaattaaagtgtggaagtggaatattcgttgtagataacgtacatacatggacggaacagtataagtttcagcctgaaagcccggctaggttagcctcagcgatcttaaatgcgcataaagatggtgtgtgtggaattagatccactactagactggaaaacgtaatgtggaagcaaataactaacgaattaaattatgtcctttgggaagggggccatgatttgactgtagtcgcaggagatgtaaagggcgtactcacaaaaggaaaaagggctctgacacccccagtaagtgatttgaaatatagttggaagacttggggaaaggctaaaatatttactcctgaagcgagaaattcgacattcctaatagatggaccggatacaagcgaatgtcccaatgagcgcagagcatggaatagcctagaggtagaagattatggattcggtatgtttaccactaatatctggatgaagtttagagaaggatcatcggaagtgtgtgatcaccgcctgatgagtgccgccatcaaagatcaaaaagccgtccacgctgatatgggatattggatagaaagttccaagaaccaaacatggcaaattgaaaaagcgagtctaattgaagtaaagacatgcctttggccaaaaacacacacattatggtctaacggtgtactggagtctcaaatgttaatacccaaaagctatgctggtccattttcccagcacaactatagacaaggatacgcaacccagactgtaggtccatggcacttaggaaagttggaaattgactttggtgaatgtccagggactaccgtaacaatacaagaagactgcgaccacaggggtccctctttaagaacaacaactgcaagtggtaaacttgtgacacagtggtgttgccgctcgtgtactatgccaccactaagattcttaggcgaggatggatgttggtacgggatggaaatcagaccattaagcgaaaaagaagaaaatatggttaaaagtcaagttacagcgggtcaaggaacctcggagacgttttctatgggtttgctttgtctcactctctttgtcgaagaatgcctgagacgcagggtcaccagaaaacacatgattctagtagtagttataacactatgtgcaattatattaggcggtttgacgtggatggatttgctgagagcactaataatgcttggcgatacaatgtcgggcagaattgggggacagatacacctcgccatcatggcagtatttaaaatgagtccaggatatgtactaggagtatttttacggaaattaacatcgagggagacagcgttaatggtaattggtatggcaatgacgactgtattgagcatacctcatgatttgatggaattaatagacggcatatccttaggattgattttattgaaaatcgtcacccaattcgacaacactcaggttggaacattggctttatcacttactttcatacgatctacgatgccacttgtaatggcgtggaggactattatggccgttctttttgtagtaacattaatccctctttgtagaacaagttgtttacagaagcagagccattgggtcgagatcacagcgttaatattaggcgcgcaagcactaccggtatatctcatgacactaatgaagggagcctcgaggagaagttggccattaaatgagggtatcatggcggtaggacttgtaagcctactaggtagtgctctactcaaaaacgatgtacccttagcaggtccaatggtcgcaggaggcctactgctggccgcctacgtcatgtctggttcctcagcggacctgtctttagaaaaagcggcaaacgttcaatgggatgagatggctgatataactggcagctccccaattattgaagttaaacaggatgaagatggatccttttcaatacgcgatgtagaagaaaccaatatgataactctgttagtgaagttagcccttattacagttagtggactttaccccctagcaataccagtgaccatgactttgtggtacatgtggcaagtaaaaactcagagaagcggtgctttgtgggatgtcccaagtcctgcagcgacccaaaaagctgcactatcagaaggggtctatcggataatgcaaaggggactatttggaaagacacaagttggagttggtattcatatggaaggagtatttcacacaatgtggcacgtaaccagaggctctgtcatttgccacgaaaccggtagacttgagccttcgtgggctgacgttcgaaacgatatgatatcatacggaggcggctggagacttggggataaatgggacaaagaggaagatgttcaagtgcttgccatagaacccggtaaaaatccgaaacatgtacagacgaaaccaggattattcaagaccttaacaggggaaattggggccgtaaccttagattttaaacctggcacgtcgggaagccccattataaatcgcaagggtaaagtaatcggattatacggaaacggagttgttacaaagtcgggagattatgtatcagcaatcacacaagcggaaagaataggagagccagactatgaggtagacgaagacatttttaggaagaaaagacttacaattatggatcttcatccaggtgcaggaaaaactaaacgtatattaccaagtatagtaagagaggctttaaagcggcgtctacggacattaatattggcaccaacaagagtggtggcggctgaaatggaagaagcactacgaggattacctattcgctatcaaactccagcagtaaaatctgaacatactggacgcgaaattgtagatcttatgtgtcacgcaactttcacaactcggctattaagctcaactagggtcccaaattacaacctaatcgtgatggacgaagctcattttacggatccaagttcagtagcggccagaggatacatatcaacaagggtagaaatgggagaagcagctgctatttttatgacagctacgccgccgggggcaacagatcctttcccacaatcaaactcccctatagaagacattgaacgtgagataccagaacgatcgtggaatacgggatttgactggataacggattaccaaggaaaaacagtgtggtttgtaccaagcattaaagcaggaaatgatatagcaaattgtctcagaaagagtggaaagaaagttattcaactttctcgaaagacatttgacactgaatacccaaaaactaagttaacagactgggattttgttgtaacaacggacatttcagaaatgggagctaattttagagcagggcgggtaattgatcctcgaagatgccttaaaccggttatcctaacagacgggccagagagagtcatattagcaggcccgatacccgtgacgcccgcatcggcggcgcaacgacgtggtagaataggacgaaatccagcacaggaagacgatcaatacgtattcagtggcgatcctttaaagaatgacgaagaccacgcacactggacggaagccaaaatgcttcttgataatatatatactccggaaggcattataccgacactattcgggcctgagagggaaaagacacaagccattgacggtgagttcagattaaggggagaacagagaaaaacttttgtagaattaatgaggagaggggacttacccgtatggttgagttataaagtagcaagcgccggcataagctacaaagatcgagagtggtgtttcacaggcgaaaggaacaaccaaattctagaggaaaatatggaggtcgaaatttggactagagaaggtgagaaaaagaagttgcggcctcgatggctagatgctcgtgtctacgcggatccaatggcattaaaagattttaaggagtttgcttcagggaggaaaagtataacacttgatattctaactgagatcgcaagtttacccacgtacttaagctcaagagcaaagttagccttggacaacatagttatgctccatactacagagcgaggagggagagcttatcagcatgcgctaaatgaattacctgagagcttagagacactaatgctagtagcattgcttggggcaatgactgcaggcattttcctcttctttatgcaaggaaagggtattggtaagctgtctatgggtttaattacgatagcagtggcatcgggtttactgtgggttgctgaaatccaaccacagtggatagcagctagtatcatcctagaatttttcttaatggtcttattgatacctgagcccgaaaaacaacgaacgccccaagataaccagctaatatacgtaattctaacgatcctcacaataataggtctaatagccgcaaatgagatgggacttatcgagaaaacaaaaactgactttgggttttaccaagtaaaaacagagactactattcttgatgtggacttgcgacctgcatcagcttggactttatatgctgtagcaacaacgattttaacacccatgttacgtcatacgatagagaatacaagcgcaaatctttcattagctgcaatagcaaaccaagcagcggtactaatgggactaggtaagggatggcccctacacaggatggatctgggggtcccgctgctagcaatgggttgttacagtcaggttaatcccactaccctaaccgcgtccttagtaatgttattagttcattatgcgataataggaccagggctccaagcgaaagcaacaagagaagctcaaaaacgtactgcggctggaataatgaagaatccgactgttgatggaataacagtaatagacttagaacccataagctatgatccgaaatttgaaaaacaattaggacaagtcatgctattagtgttgtgcgcaggacaactattactaatgagaactacatgggccttttgtgaagtgttgacgctggccacgggtcctattctgactttatgggaagggaatccaggacgcttctggaatacaaccatcgcagtctcaactgctaatatattcagggggtcatacctagctggtgctggactggcctttagcttaattaaaaatgctcagacaccacgccgtggaactggtactaccggtgaaacactaggtgaaaaatggaaaagacaattgaactcactagaccgtaaagaatttgaagaatacaaaagatcgggcattctagaagtagatagaacagaagctaaaagcgcccttaaggacggatcaaaaataaaacatgcagtaagtagaggtagttcaaaaataaggtggatcgttgaacgaggaatggttaaaccgaaaggaaaagtagtagacttaggatgtggaagaggaggatggtcatactacatggcaaccctgaaaaatgtaacagaagtaaagggctatacaaaaggtgggccagggcatgaagaacccattcctatggctacatacgggtggaatttagtcaaattgcacagcggggtcgatgtattttacaaacctacagagcaagtagatacgttactgtgtgacataggtgaatcctcttctaatcctacaatagaagaaggcagaacactaagagtattaaaaatggtggaaccatggctatcaagtaaaccggagttctgtattaaagtactaaacccatacatgccaactgttattgaagaacttgagaaattacaaagaaagcatggcggaaacctcgtaaggtgtccgctgtcgcgtaacagcacacatgaaatgtattgggtgtctggagcgtcgggaaacatagtttcttcagttaacactacatcaaagatgttgttaaatagatttaccactagacaccgaaagccgacatacgaaaaagatgtagatttaggtgccggaacacgatctgttagtactgaaactgaaaaaccagatatgacaatcataggaaggcggttgcagagacttcaagaggaacataaggaaacttggcactatgatcaggaaaacccttatcggacttgggcatatcacggtagttatgaagctccatcaacgggatcagcgtcatcaatggtgaacggcgtagtaaaactactgactaagccatgggacgtaatacctatggtgacacaattagctatgacagatactacacccttcggacagcaaagagttttcaaagaaaaagttgacactcggacaccccaacctaaacctgggactagaatggtcatgaccacgacagcgaattggctatgggcccttctgggcaagaagaaaaaccctagattatgcacacgtgaagagtttatctctaaggtacgaagtaacgctgcgatcggtgcagtatttcaagaagaacaaggctggacatctgcctcagaggcagtaaatgattcacgattttgggaattagtagacaaagaaagggccctccatcaagaaggtaaatgcgaaagttgcgtatataacatgatggggaagcgcgagaagaaactcggggaatttggcagagctaaagggtcacgagcaatttggtatatgtggttaggtgcaagatttctagagttcgaagcgttaggatttctgaacgaggaccattggttcgggagggaaaacagttggagcggtgtcgaaggagagggtttacatagactgggttacatacttgaggagattgataagaaggacggggatctaatgtacgcagacgatacggccggctgggatactcgaattacggaggacgacttacaaaatgaagaactaataactgaacaaatggcacctcatcacaaaatcttggctaaggcgatatttaaattgacgtaccaaaataaagtagttaaagtactaagaccaacacccagaggagctgttatggacataattagtagaaaagatcaaaggggaagtgggcaggtaggtacatacggcctgaatacattcacaaacatggaggtacaactcattaggcaaatggaagcagaaggggtaattacacaggatgacatgcaaaatccaaaaggacttaaagagagagtggaaaaatggttaaaagaatgcggtgtggatagattgaagaggatggcaatttctggtgatgattgtgtcgtcaaaccacttgacgaacgtttcggcacttctttgctctttcttaatgacatgggaaaagtacgcaaagacatacctcaatgggaaccaagtaaaggttggaaaaattggcaggaagtacctttctgtagtcatcattttcataaaatctttatgaaggatggcagaagtttggtagtaccatgtagaaatcaggatgagttgattgggagggcaagaatatctcaaggggctggctggagcttaagagaaaccgcttgcttaggaaaagcatatgcacaaatgtggtccttaatgtactttcaccggagggatctgaggctggcgagcatggccatttgtagtgcagtgccaactgaatggttcccaacatcacggaccacctggagtatacatgcacatcatcaatggatgacaacagaagatatgctgaaagtatggaatcgagtatggatagaagataatccaaatatgacagataaaacaccggtacatagttgggaagatataccttacctaggaaaacgagaggatttatggtgtggctcactcataggtctatcttcacgtgccacctgggctaaaaacattcacacagctataacacaggtaagaaacctgataggtaaagaagaatacgtagactatatgcctgtaatgaaaagatacagcgccccatcggaaagcgagggcgtactataa

SEQ ID NO: 23672 - RNA, 9867 nt, synthetic construct
  misc_feature 1..9867: note = derived and/or modified CDS sequence (opt6) from DENV-4__JQ915090__SS-prME
  source 1..9867: mol_type = other RNA
agcacgatgactcttctttgtctaatacctactgttatggcattccatttgagtactagggatggggaacccctaatgatagttgcaaaacacgaaagggggcgtccacttctgttcaaaaccacggaaggaataaataaatgcactttgatcgcaatggatttaggtgaaatgtgcgaagacacggttacatacaaatgtccattattagttaatactgaacccgaagatatagactgctggtgcaatcttacatctacttgggttatgtacgggacttgcactcaatcgggagaaaggcggagagagaaacgaagcgtagccttaactccacattcgggaatgggactggaaacaagagcagaaacatggatgagtagtgagggtgcctggaaacatgcccaacgagtcgaatcatggatattacggaatccagggtttgcactactggcgggcttcatggcatatatgattggacaaactggcattcaacgaattgtattctttgtattgatgatgcttgttgcaccgtcatacgggatgagatgcgtcggagtagggaatagagatttcgtagaaggtgttagcggtggcgcttgggttgatttagtactagaacatggtgggtgcgttaccacaatggcccaaggcaaacctaccctagattttgaactagcgaaaacaacagcaaaggaggttgcactattgcgtacctactgcatagaagcgagtatttccaatatcacgaccgcaacgagatgtccaacccaaggtgaaccttatcttaaagaagaacaggatcaacagtatatatgtaggagagatgtggttgaccggggctggggtaatggctgtggcctatttggaaaaggaggagtagtaacatgtgctaaattcctatgttcaggaaaaataacaggtaatttagtacagatagaaaacctagaatataccgtagttgtgacggttcacaatggtgacactcacgccgtcggaaacgacacatcgaatcatggggtaacagcaacaataacaccaagaagtccgtcagtagaagtaaaactaccagattatggcgagcttacactagactgcgaaccaagaagcggaatagattttaacgagatgattctcatgaaaatgaagaagaaaacgtggttagttcacaaacaatggttcttagatcttccgctgccatggacagcaggagccgatacaagtgaggtacattggaactacaaagaacgaatggtgactttcaaagttccgcatgcaaagagacaggatgttacggtattaggaagtcaagaaggagcaatgcatagtgcacttgccggagcgacagaagttgatagtggggatggcaatcatatgtttgcaggacatttaaaatgtaaagtacggatggagaaactgcgaatcaaggggatgagctatacaatgtgttccggaaaatttagcattgacaaagaaatggcggaaacccaacatggaactactgtcgtaaaagttaaatatgagggtgctggagccccgtgcaaaataccgatagaaattagagatgttaataaggagaaagtggtgggcagaataatatcttccacaccattcgcagaaaatacaaactccgttataaacatagaactagaaccaccctttggagatagctatatagtcataggtgtcggggattctgcgctcacgctacactggtttaggaagggatcgtcaattgggaaaatgtttgaaagtacctatagaggggcaaaacgcatggcaattttgggtgaaaccgcatgggattttggtagcgttggaggcttatttacatcactcggtaaggcggttcaccaagtctttggaagcgtttatacgacaatgttcggaggggtgagctggatgatcaggatacttattggttttctagtgttatggataggtactaacagtcgaaatacttcgatggccatgacttgtatagcagtaggagggataaccttatttttggggttcacagtacaagccgacatgggatgtgtagtatcttggaatggtaaagaattgaagtgcggctccggaatatttgtagttgataatgtacacacttggacagagcagtacaagttccaacccgaatcgccagcacgtttggcaagcgcaatcttaaacgcacataaagacggtgtctgtggaatacgttcaacaaccagattagaaaacgtaatgtggaagcaaataacaaacgaacttaattatgttctatgggaaggtgggcacgatctgacagtggttgccggggatgtgaaaggcgtactgacaaaaggaaagagagcgttaacgccaccggtcaatgatcttaaatatagttggaagacttggggaaaagcaaaaatttttacaccggaagcaagaaattctacgtttttgattgatggaccagacacaagtgagtgtcctaacgagaggagagcctggaacttcttcgaagtagaagattatggtttcggaatgttcactacaaacatatggatgaaatttcgagagggctcaagtgaagtgtgtgaccacagactcatgtcagctgcaattaaagatcagaaagccgtgcacgctgatatgggatactggatagagagttccaaaaatcaaacatggcaaattgaaaaggcaagtctgatcgaagtaaaaacttgtctttggcctaagacacataccttatggagtaacggagtgttagagagtcaaatgttaatccctcgatcttacgccggaccattttcacaacacaactacagacagggttacgctacacaaaccgcaggcccgtggcatttaggtaaattggaaattgattttggcgaatgtccgggtacaactgtaaaaatacaggaagattgcgaccatcgcggcccgagccttcggacaacaactgcctctgggaagttagtgacccagtggtgttgtcgatcgtgtactatgccacctcttcgatttttaggtgaagacggatgctggtatgggatggaaataagaccgctttcggaaaaagaagaaaacatggtaaaatcacaagtaaccgccggacaagggacttcggagacattttcgatgggtttgctatgccttaccctctttgttgaagaatgcctaagacggcgagttacccgaaagcacatgatactggtagtggtcatcaccttttgtgccatcatactcggaggtttaacctggatggacttgttaagggcgctaattatgctaggagacactatgagtggaagaatcgggggtcaaatacaccttgcaataatgacggtcttcaaaatgtcgcccgggtatgttttaggtgtttttcttcgcaagctgacatcaagggaaaccgcattaatggttatcggcatggcaatgacaaccgtgttttcgatcccccacgaccttatggaattaattgatggaatttcattaggattgatacttctaaaaatagttacacactttgataacacacaagttggaacgcttgctctttctttaacattcatgcgatctactacacctttagttatggcttggcgaacaattatggcagtgttctttgtaataacactaataccgctatgccgcacatcttgcttacagaagcagagccattgggttgaaatgaccgcgttaattctcggagcgcaagccttaccggtatacttaatgacattaatgaaaggtgcctcacgtcgttcatggccactaaatgaaggaataatggctgtgggattagtatcactcctaggctcagcccttctaaagaacgacgttcccttagccggaccgatggtcgccggtgggctactattagcagcatatgtaatgtctggaagctcagcggacttatcactcgaaaaagctgcaaacgtacagtgggacgagatggcagatataacgggatctagtccaataatagaagtaaaacaagatgaagatggatctttttcaataagagatgtagaagagacaaatatgatcacactattagttaaattagcacttataacggtatctggattgtatccgcttgcaatacctgttactatggcattgtggtatatatggcaagtaaaaactcagcgcagcggtgcattgtgggatgtaccgagcccagcagcaacccagaaagcaactttgagcgaaggagtttatagaataatgcaaagaggacttttcggaaaaacacaagtaggagttgggattcatatggaaggagtatttcatacaatgtggcatgtgactagggggagtgttatatgccacgaaactggaaggctagaaccgtcgtgggcagacgtacgctccgacatgatatcgtatggaggtggatggcgcctaggagacaaatgggacaaagaggaagatgtacaagtgttagccatagaacctggaaagaaccctagacatgtacaaacaaagccaggattgtttaaaacattaactggcgaaatcggtgcagtaacgctagactttaaaccaggcacgagcggctcaccgataataaacaagaaaggaaaagtcatcggattatatggaaatggtgtcgtcaccaaatctggtgattatgttagcgcgataacgcaagcggaacgaatcggagaacctgattacgaagtagatgaagacatttttcggaagaaacgtttaactattatggacctgcatcctggcgcaggaaagacaaaaaggatattacctagcatagttagagaagcattaaaacgtaggttgagaacactgattttggctcctacgcgtgtcgttgctgctgaaatggaagaggctttacgaggcctcccgattcgataccagacaccagcggtaaaatcagagcatacaggaagggaaattgtagatttaatgtgccatgcaactttcacaactcgattattgtcatctactagagtacctaattacaatttgatcgtaatggatgaagcccattttaccgatccttgctcggttgcggcccgcggctacatcagcacgagagtagaaatgggagaggcagcggctatattcatgacggcaactccaccaggtagtattgatccctttcctcaatcaaatagcccaatcgaggatatagaacgagaaatcccagagcgaagttggaatacaggattcgactggataactgattatcaaggcaaaactgtatggtttgtaccaagcataaaagcgggcaatgacatcgcaaactgcctgagaaagtccgggaaaagagtgatacaactgtctcggaaaactttcgacacagaatacccaaaaacaaaattaacggattgggatttcgtagtaacgaccgatatatcagaaatgggagccaatttcagggctggacgcgtgatagacccaagacgatgcttaaagccagtaatattaacggatggtcctgaacgggtaatcttggcaggaccaataccagttacgccggctagcgcagctcaacgaagaggccgaataggaagaaatcccgcacaagaagatgaccaatacgtgttttcaggcgatcccctcaaaaatgatgaagatcacgctcactggaccgaagcgaaaatgctgttagacaatatttatacgccagaaggcatcattccaacactctttggacctgaaagagagaaaacccaagcaatagatggggagtttaggttacggggcgaacaacgtaaaaccttcgttgaactaatgaggagaggagatctgcccgtatggctgagctataaagtggctagtgcaggaatctcctataaggacagagaatggtgcttcaccggtgaacgtaacaatcaaattttagaagagaacatggaagtcgagatctggacgcgcgaaggtgagaaaaagaaacttcgtcctaaatggctagatgctcgtgtatatgcggatcccatggctttaaaagattttaaagaatttgcctcgggaagaaaaagcaccacattggacatcctaacggaaattgcgacgctccccacttatttatcctcaaaagcaaaactagcgttagataacattgtcatgttgcatactactgagaaaggagggagagcttatcagcacgcactaaatgaattgccagaaagcctagaaacattaatgctcgtagctttactaggggctatgacagctggtattttcttgtttttcatgcagggaaaagggattggtaaattatccatggggttgatagctatagcagttgcatctggcctactttgggtagccgaaatccagccacaatggatagcggcgagtataattttagaatttttcttgatggtactactcattccagaaccagaaaaacagagaacccctcaggataatcaattaatatacgttatcctcaccatcctaacaataataggactaatcgctgcaaatgaaatgggattaatagagaaaacaaaaacggactttggcttctaccaagtaaaaaccgaaacaacgattttagatgtcgatcttagacccgccagcgcatggacactatacgctgttgcaacaacaattctaacacctatgcttcggcacacaattgaaaacatgagcgcaaacctaagcctggcagcgattgcgaatcaagctgctgttttaatgggattaggtaaaggatggccactccaccgcatggatctaggggtccctctcctagcaatgggctgttatagtcaagtaaacccgacaactctgactgcctctctcgtaatgttattaattcattacgcaattataggcccgggacttcaagcaaaagctacgcgtgaagcccagaaacgtacagcagctggtatcatgaaaaatccaacggttgacgggattacagtgattgatttagaaccaataagctacgacccaaaatttgaaaaacaattaggtcaagtaatgttgctggtactatgtgtaggacagcttttattaatgagaactacttgggcgctgtgcgaggtcttaaccctagctaccggaccgattatgactctctgggagggtaacccaggcagattttggaatacaacaatagccgtcagtacagctaacatattcagggggagctacctagctggtgcaggtctagctttttcactgatcaaaaatgcgcaaacccctagaaggggcactggtacaacaggcgagacattaggcgagaaatggaaacgccaattaaatagtcttgatcgtaaagagtttgaggagtataaacgatctggaatcttagaggtagatcgaactgaagcaaaatcagcactcagggatggaagtaagataaagcacgctgtaagtaggggttcttccaaaattagatggatcgtggaaaggggaatgataaaaccaaaaggcaaggtcgtagatctcggttgtggacgcggcggttggtcttactatatggcaaccctcaagaacgtaacagaagtaaagggttacacgaaagggggtccagggcacgaagaaccgataccaatggccacatatgggtggaatctagtgaaactacactcaggagttgacgtattttacaagcctacagaacaagtagatacgttactgtgtgatatcggagagtcgagtagtaaccccactatagaggaagggagaacactgcggatcttaaagatggtagaaccttggctgtcatccaaaccagaattttgtatcaaggtgttgaacccttatatgccaactgttatcgaagagttagaaaaattacaacgccgtcatgggggatccctcgtgagatgccctttaagtcgaaattccactcatgagatgtactgggtaagcggtgcctcaggcaatatagtttcaagcgtcaacacaatatctaaaatgttactaaacagatttacgacacgtcacaggaagcctacatacgaaaaagacgtcgatttaggtgcaggaactaggtcagtatccacagagaccgaaaaaccagatatgaccataataggacgaagacttcagagattgcaagaagaacataaagaaacctggcattatgatcaagaaaatccctatcgtacctgggcatatcatggatcatacgaagcgcctagcacgggaagtgcatctagcatggtaaatggtgtagttaaattactaaccaaaccatgggatgtgattccaatggtaacccaattagcaatgacggacactacgccttttggacagcaaagagtgtttaaagagaaagtagatactagaacccctcaaccaaaactagggacaaggatgattatgactacgacggcaaattggttatgggcactcctggggaagaagaaaagcccaagattgtgcacaagggaagaatttatctcaaaagtacgatcgaatgcagctatcggagcagtcttccaagaagaacaaggatggacgtctgctattgaagcagttaatgatagcaggttttgggagctagttgacaaagaacgtgcattacatcaagaaggcaaatgtgaaagttgcgtatataacatgatgggaaaaagagaaaagaaactaggtgagtttgggagagcaaaaggaagtagagcaatttggtacatgtggttaggggccagatttttggagttcgaggctttgggctttctcaatgaggatcattggttctctagagaaaattcatggagtggtgtcgaaggggagggtctacaccgactggggtatatactcgaagacatagataaaaaggatggggatttaatttatgctgatgacacagctggctgggatacccgaataactgaagatgacttgttaaatgaggagttaattacagaacagatggcgcctcatcacaaaacattggctaaagcgatattcaaacttacatatcagaacaaagttgttaaagtactgcgtccaactcctaagggagctgtgatggatatcatatctagaaaagatcaacgtggaagcggacaagtaggcacgtacggtctaaatacatttacgaacatggaagtccagttaatcagacagatggaggcggaaggagttatcacacaggatgacatgcaaaacccaaaaggattaaaagaaagggtagaaaaatggctgaaggaatgtggtgtagatagactgaaaagaatggccatctcgggagacgattgcgttgttaaacctctcgacgaaagattctcaacctccctgctatttctcaatgacatggggaaagttaggaaagatgtccctcaatgggaaccatcaaagggatggaagaactggcaagaagtcccattctgctcccaccactttcataaaatctttatgaaagatggcaggtcccttgtagtaccttgccgtaatcaggacgaactaataggacgggctagaatatctcagggagcaggctggagtctccgtgagacggcgtgtctagggaaggcttatgcccaaatgtggtctttaatgtacttccataggcgagacctaagactcgcgtctatggctatctgttcagcggtaccgacagaatggttcccgaccagtcgaaccacatggagtatacatgcacagcaccaatggatgactactgaggacatgttaaaagtctggaaccgggtgtggatagaagataatcccaatatgacagacaaaactccggtccatagttgggaagacattccgtacctaggaaaacgggaggatttgtggtgtggcagtttaattggattgagcagcagagcgacgtgggctaagaatatacataccgcgatcacacaagtaagaaacctgatcggtaaagaagaatatgtagactatatgcctgtaatgaagaggtactcttcaccctcagaatcagaaggagtcttgtaa

SEQ ID NO: 23673 - RNA, 9867 nt, synthetic construct
  misc_feature 1..9867: note = derived and/or modified CDS sequence (opt6) from DENV-4__KJ160504__SS-prME
  source 1..9867: mol_type = other RNA
tctaccataaccctattatgtcttatacccacggtaatggcctttcatctgagcacacgcgatggagaacccctgatgattgtagccaaacatgaaagaggacgaccccttctatttaaaactacagaaggaataaataaatgtactttaattgcgatggacctaggagaaatgtgcgaagatactgttacatataaatgtccgttgttagttaatacagaaccagaagatatagattgctggtgcaacctaacttccacctgggtaatgtatggtacatgtacccaaagtggagaacggaggcgagagaaaaggagcgtagctctcacaccacactcaggaatgggattagaaactcgcgcagagacttggatgagtagcgaaggagcttggaaacacgctcaaagagtggaaagctggattttaagaaatcctggatttgctttattggcagggtttatggcctatatgattggacaaacgggcatacaacgcaccgtattcttcgtattaatgatgctagtagccccgtcatacggtatgagatgtgtgggagtgggtaatcgtgatttcgttgaaggagtatcaggtggtgcttgggtagatttggtattagaacatggaggatgtgtaacgacaatggcccaaggaaaaccgactttagacttcgaacttactaaaaccacagccaaagaagttgcactattgcgcacctattgtatagaagcgtctatatccaatattacaaccgcaacaaggtgtcccacgcaaggcgagccgtatttaaaagaagaacaggaccaacaatatatatgcagacgagatgttgtagaccggggatggggtaatggatgcggtttgtttggcaaaggtggtgtcgtaacatgtgctaaattttcttgttctgggaaaataacagggaatcttgtgcagatagaaaaccttgaatacactgtagtggtgacggtacacaacggcgacacccatgctgtaggaaatgacacttcaaatcatggcgtaacagcaactattactccgcgaagccccagcgttgaagtcaaattacctgattatggagaactaacactagattgtgaacccagatcgggtatagatttcaatgagatgattttaatgaagatgaagaagaaaacatggttagttcataaacaatggtttttagatcttccattaccttggacagctggggccgacacgagtgaggtccactggaactacaaagaaagaatggtcactttcaaagttcctcatgcaaagagacaagacgttaccgttttaggaagtcaggaaggcgcaatgcattcagctttggcgggagcaactgaggtggattcaggtgatggtaaccatatgttcgcagggcatctaaaatgtaaagttcgtatggagaaactcagaattaagggcatgagttatacaatgtgcagcggaaaattttcaatcgacaaggaaatggcggaaactcaacatgggacgaccgtagtcaaagtaaaatatgaaggcgcgggtgctccgtgtaaagtgccgatagagattcgcgatgtgaacaaagaaaaagtagttggacgggtcatatcaagcacaccccttgctgaaaacacaaattcagttacaaatattgaactagaacctccctttggagattcgtatatagtaataggtgtgggtaatagtgcattaacattgcattggttcagaaaaggctcaagtattggaaaaatgtttgaatcaacatatagaggggccaaaagaatggcgattttaggtgaaactgcgtgggatttcggaagtgttggcgggttatttacgtccctgggcaaagcagttcatcaagtgtttggttcggtatacacaacgatgttcggcggagtgtcctggatgatacgtattttaataggttttctagttttatggataggaaccaattccagaaatactagcatggccatgacatgtatagcagttggtggtattacattatttttaggttttacggtacaggctgacatgggatgtgtagtatcatggtctggaagagaattaaagtgtggaagcggaatttttgttgtcgacaacgtccacacttggacggaacaatacaaatttcaaccagaaagcccagcccgattagctagcgctatattaaatgcgcataaagatggagtttgtgggattcgctctacaactagattagaaaacgtaatgtggaaacaaataaccaatgagttaaactacgttctatgggaaggtggacatgacctcacagtcgtagctggtgatgttaagggtgtgcttacgaaaggtaaaagggcacttactcctccagtttccgacttaaagtatagctggaagacgtggggcaaagctaaaattttcacaccagaagcccggaatagcacatttctgattgatggtccagatacaagtgaatgtccaaatgaaagacgagcctggaatagtttagaggttgaagattatggttttggaatgttcacaactaatatatggatgaaatttagagaaggcagcagtgaagtatgcgaccataggctcatgtctgcagctataaaagaccaaaaagcagtgcacgcagacatgggatattggatcgaatcctccaagaatcaaacatggcaaattgaaaaagcgtccctaatcgaggtaaaaacatgcctttggcctaaaacgcatacgttatggagtaacggagtgctagagagccaaatgttgatacctaaatcatatgcaggaccattttcacagcataactacagacagggctatgcgacgcaaacggtggggccatggcatcttggcaaacttgaaatagactttggagaatgtccgggcacaacagtcacaatacaggaggattgtgaccaccgagggccgtcattgcggacaacaacggcttccggtaaactggttactcagtggtgttgcagaagttgtacaatgccacccctgcgttttctaggcgaggatggatgctggtatggtatggagatcagacccctaagtgagaaagaagagaacatggtgaaatcccaagttactgctggacaaggcacgagcgagacattcagtatgggactattatgtctgactttattcgtagaggaatgcctccgacgaagagttacacgaaaacacatgatccttgtagttgtaataactctatgtgcaattattctagggggactcacatggatggatcttttgcgagcactgataatgttgggtgacaccatgtctggccgaatcggtggtcaaattcacttagcgattatggctgtattcaaaatgtctccaggatacgtccttggagtgtttttacgaaaattaacatcacgtgaaaccgcattaatggttatcggaatggcaatgaccacagttctctcgattccacatgacttgatggagctaattgatgggatttcactcggactaatcttactaaaaattgtaacccaatttgataatacgcaagtaggtactcttgcattatcacttacattcatacgttcaacgatgccactcgttatggcgtggagaaccatcatggccgtccttttcgtcgtgactctaatacccctctgccgcacttcatgtttacaaaagcaaagtcactgggtagaaataactgctttaattttgggagcgcaagcgttaccagtgtaccttatgacattgatgaaaggtgcgtcaagaagaagttggccactaaatgaaggcataatggcagtgggattagtaagtctactgggatcggccctactaaagaacgatgttccacttgctggccctatggtagcgggcggattattgttagcagcttacgtgatgtccggcagtagtgcagatttgagtttagagaaagcagcgaacgtacaatgggacgagatggcagatattacaggcagctcgccaatcatcgaggtgaagcaggatgaggacggaagtttctcaattagagatgttgaggaaactaatatgataactctattagtaaaactagcattgattaccgttagcggattataccctctagcaattcctataacaatgacattgtggtatatgtggcaagtaaaaacacaaagaagtggggctttatgggacgttccaagcccagcagcaacacagaaggcagccctaagtgaaggagtctatcgtattatgcagagaggcctgtttgggaaaactcaagttggtgttggcattcacatggagggagtatttcatacaatgtggcatgttacccgaggcagcgtaatctgccacgaaacgggacggttggaaccatcatgggcagacgtaagaaatgatatgatatcttatggcggaggatggaggttaggcgataaatgggacaaggaagaggatgtccaagttctagcaatagaaccaggcaaaaacccaaaacatgtacagacaaaaccaggactatttaagacattaacaggggagattggagcagtaaccctagattttaaaccaggtacaagtggctctcccatcataaaccgaaaaggaaaggtcatcggattatacggaaatggggtggtaacgaaaagcggcgactatgtaagcgcgataacacaagcggaacggataggggagcctgattatgaagttgatgaggatattttccggaagaaacgactcacaataatggatctacaccctggagccggaaaaacaaagcgcatcctacctagcattgtcagagaagcactaaaaagacggctacgaacgcttatacttgcacccaccagggtggttgcggcggaaatggaggaagcattaagagggttgccaattcgttatcaaactcctgcggtcaaaagcgaacacacaggcagggagattgtcgaccttatgtgtcacgccacttttactacgcgactactcagtagtacaagagttcccaactacaatctaatagtgatggacgaagcacatttcaccgatccttcatcagtggcggcaagaggttatatttcgaccagagtagaaatgggcgaagcagcagcaatttttatgacagcaacaccaccaggagccacggatcctttcccccaatcaaattcaccaatagaagatattgaacgtgaaatcccggaaagaagctggaatactggattcgattggataacagattatcaagggaaaactgtatggtttgtaccaagtattaaagcaggaaatgacatagctaattgcttacgaaaaagtggtaagaaagtaattcagctgtctagaaaaactttcgggactgaatacccaaaaacaaaattaacagactgggacttcgtcgtgaccactgacatctccgaaatgggagcaaatttccgcgccggcagagtaatagacccacgtagatgccttaaacccgtcattttaaccgacggacctgaaagagtaattttagctggacctattccagtcacgccagcaagcgcagctcagcgtagaggaagagtaggaaggaatccagctcaagaagatgatcaatacgttttcagtggtgatcctctcaaaaatgatgaagatcatgcgcattggactgaggccaaaatgctactagacaatatttatacaccagagggtataattccaaccttattcggacctgaaagagagaaaacccaagcaatagacggagaatttagattacgaggagagcagagaaaaacgttcgtagaactaatgaggcgcggtgacctaccggtttggctaagctataaagtagcgtcagccgggatctcttataaagacagggaatggtgcttcacgggagaacgaaacaatcagatactagaagagaatatggaagtagaaatttggacaagagagggagagaagaagaaactacggcctcgatggctagatgcccgagtgtatgctgatccaatggctctaaaagatttcaaagagttcgcatcaggtagaaaatcaataacactcgacatcctaacagaaatagcgtcactccctgcgtatctaagcagtcgtgctaaacttgccctagataacatcgtgatgcttcatacgacagaaagaggtgggagagcataccaacacgctctaaatgaattacctgagagtctagaaactctaatgttggtagcacttctaggtgctatgaccgccggtatattcctattctttatgcaggggaaaggaatcgggaaacttagtatgggtctaatcacaatagcagttgcctcaggtttgttgtggatcgctgaaatacagccccaatggatagcggcttccataattctggaatttttcttgatggttcttctaataccagaaccagaaaagcagcgaacacctcaagacaatcagttaatttatgttatacttaccgtacttaccataataggattaatagccgcaaatgaaatgggcctgatagagaaaaccaaaacagactttgggttttatcaggttaaaactgagacaactatcctggacgtcgatttaagaccagcttccgcttggactttatatgcagtggccaccacagtactaaccccaatgttaagacacacaatagagaacacctcagctaacctgtcattggcggcaatagcgaaccaggccgcagtcctaatgggtctgggaaaaggttggccgctacatcggatggacctaggggtacctctactggctatgggttgttattctcaagtaaaccctacgacattgactgcaagccttgtgatgctattcgtacactacgcgattattggaccaggactgcaagctaaagcgacccgagaagctcagaaaaggacagcggcgggaataatgaaaaaccccactgttgacggcattacagttatcgatctcgaacctatatcttatgaccccaaatttgaaaaacaacttgggcaagttatgcttctagttctctgtgccggacaactactattaatgagaacaacttgggctttctgtgaagtattaacgctagcgacgggaccaattttgacactatgggaaggcaatcccggaagattttggaataccacaatagcagtcagtactgccaacatcttccgtggcagctatctggcaggagcaggtttagcgttttccttaataaagaacgcgcagactcccagaagaggtacaggaacaactggggaaactttgggcgaaaaatggaaacgacaattgaactcgttggacaggaaagaatttgaagagtataaaagaagtggtatactagaagtggatagaacagaagcaaagagtgcactcaaggatggatcgaaaataaagcatgccgtctcaagaggatcatcaaaaattcgatggatcgtagaacgaggaatggttaaaccaaaagggaaagtagtagacctcggctgcgggcgaggtggatggtcatactacatggcaaccctgaagaatgtaactgaagttaaaggctacacaaaaggcgggcctggacacgaagaaccgatacctatggccacgtatggctggaacttagttaaactacatagtggagttgacgttttctataagcccacggaacaggttgataccctcttatgcgatataggagagtcctcaagtaacccaaccatagaagaaggaagaacacttagagttttaaagatggttgaaccttggctctcctcaaagcctgaattttgtatcaaagtacttaatccatatatgcctacagtaatagaggaattagaaaaactacaaaggaaacacggcggaaatttagtgagatgtcccttaagtagaaacagcacacatgaaatgtactgggttagcggagcctcgggaaatatagtcagtagtgtgaatacaacaagtaagatgctccttaatcgttttacaacgagacataggaaacccacatatgaaaaagatgttgatctgggtgcagggacacgtagtgtaagtacagaaacagaaaagccggatatgactataataggcaggagactacaacgcctacaagaagaacacaaagaaacatggcactacgatcaagaaaatccgtaccgcacttgggcgtaccatgggagttatgaggcgccctccacagggtcagctagtagcatggtaaacggagtggttaaattactaacaaaaccatgggatgtcatacctatggtcactcaactggcaatgacagatacgacacccttcggccaacaaagagtgtttaaagagaaagtagatacaagaactcctcaaccaaaaccaggaacgaggatggtcatgactaccaccgcgaattggctttgggctctgttgggtaaaaagaagaatccacgattatgtacccgagaagaatttatctcaaaagtgcggtcaaatgctgccatcggtgctgtattccaagaagaacaaggatggacatctgcatcagaagcggtcaatgattcgagattttgggagctggtagataaagagagagcacttcaccaagaaggcaaatgcgaaagctgtgtatataacatgatgggcaaaagagagaagaaattgggagagttcggcagagccaaaggttcccgcgccatatggtacatgtggttgggcgccagatttctggaatttgaagctctaggttttctcaatgaggatcattggtttggtcgcgaaaactcttggtcaggggtcgaaggcgaagggttacataggcttggatacatacttgaagaaatcgataagaaagatggggacctgatgtatgctgacgacacagccggctgggatacaagaatcacggaagatgatttgcaaaatgaagaactaataaccgaacaaatggccccacatcataagatcctcgcaaaagcgatattcaagttaacgtatcaaaataaagtagtaaaagtacttagaccaactccacgaggggccgtaatggacataataagtaggaaggatcagaggggttcaggtcaagtaggtacatacggtttaaatacttttacaaatatggaagtacagctcataaggcaaatggaagccgaaggtgtaataactcaagatgacatgcaaaatccgaaaggtctgaaagaaagagttgaaaagtggctgcgagaatgtggagttgacaggttgaaaagaatggctataagcggtgatgattgtgtagtgaaaccgttagatgaacgatttggcacctcattactctttctcaatgatatgggcaaagtaagaaaagacattccacaatgggagccaagcaagggatggaagaactggcaagaagttcctttctgctcacaccatttccataaaatattcatgaaagatggaagatctttagtggtaccttgccgaaaccaagatgaactaatcggcagagccagaatcagtcagggtgcgggctggagtctgagagaaacagcatgtttaggaaaggcatatgcacaaatgtggtcactaatgtatttccacagacgtgacttacggttagcatcaatggccatatgctccgccgtaccaacggaatggttccctacatctagaactacatggtcaatacacgcacatcatcaatggatgactacggaagatatgttaaaagtatggaacagagtctggattgaagataacccgaatatgaccgataagactccagtccatagttgggaagatataccttatttaggcaagagagaagatttgtggtgtggatccctaataggattaagctcaagagctacgtgggcgaaaaatatacataccgctattacacaagtaagaaatctaataggtaaagaagaatatgttgattatatgccggtaatgaaaagatactccgccccaagcgaatctgaaggagtcttataa

SEQ ID NO: 23674 - RNA, 9867 nt, synthetic construct
  misc_feature 1..9867: note = derived and/or modified CDS sequence (opt6) from DENV-4__GU289913__SS-prME
  source 1..9867: mol_type = other RNA
tcgacgatcacacttttatgcttgatccccacagttatggcatttcatctaagtacaagagacggagaacccttaatgatagtagcgaaacatgaacgcggtcgacctcttctattcaaaactaccgaaggaataaacaaatgcacactaattgcaatggacttgggagaaatgtgtgaagacaccgtaacctacaaatgtccactattggtaaacacagaaccagaagacattgactgttggtgcaatttaacgtcgacctgggtaatgtacggtacttgtacacaatcaggagaacgtagaagagaaaaacgatcggttgcattaacccctcattcagggatgggattagaaactagagcagaaacatggatgagttctgaaggagcatggaaacacgcccagcgcgttgaatcttggattctaagaaatccgggtttcgctttattagcaggcttcatggcttacatgattggtcaaaccggtatacaacgaacagtctttttcgtgctcatgatgttagttgcacctagttacggcatgagatgtgtaggagtaggaaacagggactttgttgaaggagtcagtggtggcgcatgggtggaccttgtattggaacatggcggttgcgtaacaacaatggcacaaggaaaacctacgctcgatttcgaactcacgaaaacaactgccaaagaagttgcattacttaggacatactgcattgaagcatcaatatcgaacattacgacagctacaagatgccccactcagggagagccgtatctcaaagaggaacaagatcaacaatacatttgcagaagagatgtcgtagaccggggatggggaaacggctgtgggctatttggaaaaggaggggtagttacgtgtgctaaatttagctgttcgggtaaaataacagggaatctagtacaaatcgaaaacttggagtataccgttgtggtgacagttcataatggagatactcatgcagttggaaatgatacgtcaaatcatggagtgaccgcaatgattacacctcgatctccaagcgtagaagtaaaactgcccgattacggagaacttacattagattgtgaaccacgatcaggaatagatttcaacgaaatgattttaatgaaaatgaagaagaaaacttggctagtacacaaacaatggttcttagatttaccattaccatggacagcaggagctgacacaagcgaagttcactggaactataaagagcgaatggttactttcaaagtaccacatgcgaaacggcaagatgttacagttctgggaagtcaagaaggagcaatgcattcggcattagcgggtgcgactgaagtggattctggggacggcaatcacatgttcgcgggccatctgaaatgcaaggtgcgtatggaaaagctaagaataaaaggaatgagttatactatgtgctctggcaagttcagtatagacaaagaaatggcagaaactcaacatggaacaacggttgtcaaggtaaaatacgaaggggcaggcgcaccgtgtaaagtacctatcgaaatcagagatgtgaataaagaaaaagtggtcggaagaatcatatcatcaacacccctagcggaaaacactaattctgttaccaacatagaattagaaccaccctttggtgattcctatatcgtaataggtgttggtaactccgcgttgacgctacattggtttagaaaaggctctagcattggtaaaatgtttgaatcaacgtatcgaggagcaaagagaatggcaatcctaggagaaactgcatgggatttcggctcagtcggtggtctattcacttcactaggtaaagcagtgcaccaagtattcggttctgtctatacaaccatgttcggaggcgtctcgtggatgattaggattctaatagggtttctagttctctggataggtacaaattctaggaatacatctatggcaatgacctgtatcgctgtaggtggaattacactgtttctgggatttacagtacaagctgatatgggttgtgtagtctcctggtctggaaaggagctaaagtgcggaagtgggatatttgtagtggataacgtacatacatggaccgaacaatacaaattccaaccagagtctcccgcacgtctggcttcagcaatcttaaatgctcacaaggacggcgtctgcggaatccgatcgactactcgattagaaaatgtaatgtggaaacagatcactaatgaactgaattatgtcctttgggaaggaggtcacgacttaacagtagtcgctggggacgttaaaggcgtactcacgaaagggaaaagggccctgacgccacccgtatcagacctaaaatacagttggaagacgtggggaaaggccaaaatcttcacaccagaagcacgcaattcaacatttttaatagacggtcctgatacaagtgaatgtccaaatgaacgacgggcctggaactcattagaagttgaagactacgggtttgggatgttcacaacgaatatatggatgaaatttagagaaggatcatcagaagtttgtgaccatcggttaatgtccgctgcaattaaagaccaaaaggccgtacacgcggacatgggttactggatagagagctccaaaaatcaaacttggcaaatcgagaaagctagtctaattgaggtgaagacatgtctttggccaaaaactcatactctatggtcaaacggtgtgctagagagtcagatgctaattccaaaaagttacgcaggtccattcagtcaacataactatcgacaaggctatgcaacccaaaccgtagggccatggcatttaggtaaactagaaattgacttcggagaatgcccaggcactactgtaacaatacaagaagactgcgaccacaggggacctagtttaaggacaacaaccgcatctggcaaacttgtaacccaatggtgttgtcgatcttgtacaatgccacccttgcgatttctcggcgaagacggttgttggtacggaatggaaataagaccattaagtgaaaaagaagaaaatatggtaaaaagtcaagtaactgcaggacagggtacctctgaaactttcagtatgggcctactctgtctaacattattcgtagaggagtgtctaaggagaagagtaacgagaaaacacatgattctagttgtagtcataacattatgcgcaatcatattaggaggattaacatggatggatttactaagagcactcataatgctaggcgacaccatgtcaggaagaatcggagggcagatacatcttgcaattatggcggtatttaaaatgtccccgggttatgtcctaggagtctttttacggaaactcacaagcagagaaacagcgcttatggtcataggcatggcaatgacaacagtattatcaataccacatgatttaatggaactcattgatggtataagccttggcctgatactcctgaagatagtcacccaattcgataacacacaagtcggtacactagctttatcgcttacttttattcggagtacaatgcccttagttatggcatggagaacgatcatggctgttcttttcgtagtaactctgatacctctatgcagaacgagctgcctccaaaaacaaagccactgggtagaaatcacagctttaattctaggtgcgcaagcacttccggtttatctaatgacattaatgaaaggagcttcccgacgtagttggcctttaaacgaagggattatggcagttggcctagtttcactactcggttcagcgttattgaaaaatgacgtaccactagcaggcccaatggtagcgggtggtttattactagcagcctacgttatgtctggatcaagtgcagacctttctctagaaaaggctgccaatgtacaatgggatgaaatggcggacataaccgggtcgagccctatcattgaagtgaagcaagatgaagatggctcattttctattagagacgtagaagagacaaacatgataactctgctggttaaattagcgcttatcactgtttccggactctatcctttggctatacccgttacaatgacattatggtatatgtggcaagtaaaaacacaacgaagtggagctctgtgggacgttcctagtcctgccgcaacccaaaaagctgctctctccgaaggcgtttaccgtataatgcagagaggactatttggaaaaacccaggtcggcgtggggattcatatggaaggggtatttcacacaatgtggcatgtaacgagagggtctgttatctgccacgagaccggacgactggaaccctcatgggccgatgttcggaatgatatgatatcatacggaggcggctggcgattgggcgataaatgggacaaggaagaagatgttcaggttctagcaatagaaccagggaaaaaccctaagcatgttcaaaccaaacccgggttattcaagacattaacaggtgaaataggcgcggtaacactagacttcaagccgggtacctcagggtcaccgataataaaccggaaaggtaaagtcattggtttatacggaaatggtgtggtgaccaaatctggagattatgtatcagcgataacgcaggcggaacgtataggagaacctgattatgaagtagatgaagatatatttaggaagaaacgtctaactataatggatttgcacccaggagcaggtaaaacaaaaaggatattaccgtcgattgttcgagaagcacttaaacgacgtctaaggactttaatattagctcccacaagggttgtagcggcagagatggaagaggcacttcgaggtttaccaattcggtaccaaacaccagcagttaaaagcgagcacactggacgcgaaatagtagacttaatgtgccatgcaactttcaccactagattattatcatccactagagtacccaactataatcttatagtaatggatgaagcccacttcacagacccgtcatcagtagctgctcgtgggtacattagcactcgcgtagaaatgggggaggctgcagccatattcatgacagccactccaccgggtgccaccgatccatttcctcagagtaactcaccaatcgaggatatcgaaagggaaatcccagagaggagctggaatacaggatttgactggataactgattaccaaggtaagactgtatggtttgttccttccattaaggctggaaacgatatagcaaattgtttgagaaagtcgggaaagaaagttatacaactaagtagaaaaacatttgacacagagtatccgaaaaccaaactgactgattgggactttgtagtaactacagacatatcagaaatgggggcgaacttcagagcaggaagagtaattgaccccagaaggtgcttaaagccagtaatcttgaccgatggtccggaacgcgttattctagcaggacctattccagtaacacccgcaagtgctgcccaaagacggggtcgtatcgggagaaatccagcccaagaagatgatcagtatgtatttagcggtgacccccttaaaaacgatgaggatcacgcccattggactgaagcaaaaatgcttctagacaacatctatactccagagggaattatcccaacacttttcggaccagagagagagaaaactcaagctatagatggtgaatttaggttaagaggggaacaaagaaagacctttgttgaattaatgaggagaggtgaccttccagtttggctatcctacaaggttgcatcagcaggtatttcatataaggatcgggaatggtgctttacgggtgagaggaataatcaaatcctagaagaaaacatggaagtcgagatttggacgcgagaaggggagaaaaagaaactccgaccccgttggttggacgcacgtgtatacgcagatccaatggcgcttaaagattttaaagagtttgcgagtggtcggaaaagcataactttagacatccttactgaaatagccagcctcccaacatacttatcttctcgagcaaaattagctttagataacattgtcatgctccatacaacagaaaggggcggcagagcatatcagcatgctttaaatgagttacctgaaagcctggaaacattaatgctcgtggcattactaggagcaatgactgccggaatattcctattctttatgcagggaaaaggcataggaaaattatcaatgggattgataacaattgctgtagcgagtggactcctatgggttgcggaaatccagccgcaatggatagctgcatcaataattttagagttctttctcatggtcttactcattccagaaccagagaagcaacgtacgccccaagataatcaactaatatacgtaatcctcacgattttaaccatcataggattaatcgcagctaacgaaatgggtctgattgagaaaactaaaactgattttggcttttatcaagtaaaaaccgaaactacaattttagatgtagacttacgaccggccagtgcatggacactgtatgcagtagccaccacgatcctaactccaatgctccggcatacaatcgaaaacacttccgcaaatctatcactagctgctattgctaatcaagccgctgtacttatgggtcttggcaaaggatggccacttcatcgaatggatcttggagtccctctattagcaatgggctgctatagccaagtaaatcccaccactctaacagctagcctggtgatgctgtcagtacactacgcaataatcggaccgggccttcaagccaaagcaacccgtgaagcacagaaacgaacggctgctggaataatgaaaaatccgactgttgatggcataactgtaatcgatctagaacccatctcatatgatcctaaatttgaaaagcagcttggacaggtaatgctcctagtgttgtgtgcaggtcaattacttttaatgagaactacctgggcattttgtgaagtgctcactcttgcgacaggacctatcttaactttatgggaagggaatccaggacgtttttggaacacgaccatagctgtaagcactgctaacatatttcgggggtcatatctcgcaggagctggccttgcatttagtttgattaagaatgctcaaactccaagaagaggcactggaaccacaggagaaacgttaggcgaaaagtggaaaagacaacttaatagtctcgaccgaaaagagttcgaagaatataaacgaagtggtatattggaagtggatagaactgaagcaaaatctgcgttaaaagatggttcgaagataaaacacgctgtcagcagaggcagtagtaaaatcaggtggatagtcgagaggggaatggtgaaacctaagggcaaggtcgttgatcttggatgtggacgaggtggatggtcttactatatggcgactcttaaaaatgtaacagaagtaaaaggctatacaaaaggaggaccaggacatgaggaacccattccaatggccacatacggatggaatctagtgaaattacattcaggagtagatgtattttacaagccgacagaacaggttgacacactactatgcgacataggcgaatccagttctaatccaacaattgaagaaggcagaacactacgagtgctgaagatggtagaaccctggctttcttccaaacctgaattttgtataaaagtattaaatccatacatgcctacagtaattgaagaactagagaaattacaacgcaagcatggtgggaatctcgtacgttgtcccttaagtcgaaacagtactcacgaaatgtattgggtctcaggagcgtcaggcaacatagtctcttccgtaaatacgaccagcaagatgctactcaatcgatttacaaccagacatcgcaaacccacgtatgagaaagatgtagatctcggggcaggcacgagatcagtaagtactgagactgaaaaacccgacatgaccatcataggtagacgtttgcaacgcttacaggaagaacataaagagacatggcattatgaccaagaaaacccctataggacttgggcctatcatggctcatacgaagccccaagcacaggaagcgctagcagcatggtcaatggagtcgtaaaattattaacaaagccctgggatgtaataccaatggttacgcaattagcaatgacggatacgactccattcggccagcaaagagtatttaaagaaaaagttgatacaaggacgccacaaccgaaaccaggaacgagaatggtaatgacgaccaccgcaaattggctatgggctctcctaggcaagaagaaaaatccacggctatgtacaagggaagaatttatatccaaagtgagatctaatgcggcaatcggagccgtgttccaggaagaacagggatggacctcggctagcgaagccgtcaacgattcaagattctgggagctagttgacaaagagagggcgctacatcaggaaggcaagtgtgaatcctgcgtgtataacatgatgggaaagcgcgagaagaaactaggtgagtttggccgagctaaaggatcccgtgcgatatggtatatgtggctaggcgcaagattcctggaatttgaggcattaggcttcttgaatgaagatcattggtttgggcgtgaaaattcatggtctggcgtagagggggaaggtctccacaggctgggttatatcctagaagaaatagacaagaaagatggcgacttaatgtacgccgacgatacagccggttgggacacgaggataacagaagatgatctacaaaatgaagaattaataacagaacagatggcaccccatcataagatactcgctaaagcgattttcaaactcacgtaccaaaacaaagtggtaaaagtgctgagacctacaccaagaggagcggtcatggacataatctcaagaaaagaccaacgtggttcaggtcaagtcggcacttatggattgaacactttcactaatatggaggtacagttaatacgccagatggaggcggagggcgtcatcacacaggacgacatgcaaaaccctaagggactaaaagagcgagtagaaaaatggctaaaagaatgtggtgtagaccgactaaaacgtatggccatctctggcgatgattgtgtggtaaaacctcttgatgagaggtttgggacatccttacttttccttaatgacatggggaaagtaagaaaagatattccacagtgggaaccgtcaaaaggctggaaaaactggcaagaagtacctttttgcagccatcattttcataaaatattcatgaaagatggacgtagcctagtcgtaccatgcagaaatcaagatgagttaattgggagagcacgtatttctcaaggtgcgggttggtcattacgagagacagcgtgcttaggtaaggcatatgcacaaatgtggtctctcatgtacttccatagacgggatctcagactggcatcgatggcaatctgttcagcggtccccaccgaatggtttcctacgtctcgtacgacctggagtatccatgcgcaccaccaatggatgaccaccgaagatatgctgaaagtatggaatagagtctggatagaagacaatcctaacatgactgataagactccagtgcactcatgggaggacataccatatttaggtaagagagaggatttatggtgcggctcattaattggtctatcatctagagccacttgggctaaaaacattcatactgcaattacacaagttagaaatttaataggtaaggaagagtatgtcgattacatgcctgtaatgaagcgatattcggcacccagcgaatccgaaggagtattgtga

SEQ ID NO: 23675 - RNA, 9867 nt, synthetic construct
  misc_feature 1..9867: note = derived and/or modified CDS sequence (opt6) from DENV-4__KJ579243__SS-prME
  source 1..9867: mol_type = other RNA
tctactattactctcttatgtttaatccccaccgtcatggcttttcacctgagtactagggatggagaacccttaatgatagttgcgaaacatgaaagaggtaggcctttgctatttaaaactactgaaggaattaataaatgtacgctgatagcaatggatttaggagaaatgtgtgaagatactgtgacttataaatgtcccctattagttaatactgaaccggaagatatcgactgttggtgtaatcttacttcaacctgggtaatgtatgggacctgtacccagtctggtgaaagacgaagagaaaaacgatctgttgctttaactccccacagcggaatggggctcgaaacccgagcagaaacctggatgtctagcgagggggcttggaaacatgcccaaagggttgaaagttggattcttagaaatccaggattcgcgttgttagccggatttatggcctacatgataggtcaaactggcattcaacggactgtcttctttgtactaatgatgttggtagctccatcttatgggatgcgttgcgtgggggtaggaaatcgagatttcgtggaaggtgtttcgggaggtgcgtgggtagatctagttttagaacacggaggttgtgtaacaacgatggcacaaggcaaaccaacactagactttgaattgactaaaactaccgcaaaagaggtagcactactaaggacttactgtatcgaagcgttaatatcgaatataacaacggccacgagatgtcctacacaaggtgagccttacttaaaagaagaacaggaccaacaatacatatgccgtagagatgttgttgatagaggatggggtaacggctgtggtttgtttggcaaaggcggagtagtaacctgcgcgaaattttcatgttcaggtaaaattaccggtaatttagtgcaaattgaaaatttagaatacacagtagtagtaactgttcataatggagatactcatgctgtagggaatgatacaagcaaccatggcgtgacagcaactatcactccgagaagtccgtccgttgaagtcaaactgcctgactatggtgagctcactctcgattgcgagcctagaagtgggattgactttaacgaaatgatactaatgaaaatgaagaagaaaacttggttagtacataaacaatggtttttggatttgcccttaccttggactacaggtgcagatacatcggaggtccattggaactacaaagaacgcatggtgacatttaaagtacctcatgcgaaaagacaagacgtaacagttctaggctctcaggaaggcgcgatgcattccgctttagccggcgccacagaggtcgattcgggagatgggaatcacatgtttgcaggccacctaaaatgtaaagttagaatggaaaaactacgtataaaaggcatgagttatacgatgtgcagcgggaagttttctatagataaagaaatggcagaaacacaacacggaaccacggttgtaaaagttaaatacgaaggagctggagcgccgtgcaaagtaccaatagaaatccgagatgttaataaggaaaaagtggttggccgtgtaatcagtgcaacgcccttagcagaaaacaccaactcagtcacgaacattgaattagaacctccctttggagattcctatattgtaataggtgtgggtaattccgcattaacacttcattggtttcgaaaaggatcgtctataggtaaaatgtttgagtctacttacagaggtgctaaacgaatggctattctaggagagacggcgtgggattttggatctgtaggagggctatttacgtctctaggaaaagcggtacatcaagtattcggcagtgtctacactacaatgtttggaggagtctcatggatgatacgtatattaattggatgcttggtcctttggataggtaccaactcgaggaataccagcatggcaatgacatgtattgcagtaggtgggattacattattcctgggatttacagtacaggcggatatgggatgcgtcgtgagttggagcggaagggaactaaaatgcggaagtgggatatttgtcgtagacaatgttcatacatggacggaacaatataagtttcaacccgagagtccagcacgcttagcatcagctatactcaatgcgcataaggacggtgtttgcggcattcgatctaccacaagacttgaaaacgttatgtggaaacagatcaccaacgagctgaattacgtcttatgggaagggggccatgacttaacggtagtagctggtgatgtgaaaggtgttcttacaaaagggaagagagcattaactcccccagcaagcggtcttaaatattcatggaaaacatggggtaaagccaagattttcactcctgaagcacgaaacagcacatttttaatagatgggcctgatacttcagaatgccctaatgagcgcagggcgtggaacagctttgaggtcgaagactacggttttggaatgtttaccaccaatatctggatgaaattccgagaaggttcttccgaagtgtgtgatcacagactgatgagcgccgctataaaagaccaaaaggctgtccacgcagatatgggatattggatagagagttccaaaaaccaaacatggcagatcgaaagagctagtcttatagaagtaaaaacttgtttgtggccaaaaacacacactttatggtcgaacggcgtgttagaatcgcaaatgctaataccaaaaagttatgctggtcccttctcgcagcataactatagacagggctacgctacgcaaacagttggaccatggcatttaggaaagctggaaatagattttggagaatgtccaggaacaacggtaaccatacaagagaactgcgaccatagaggcccgtccttgagaaccacaacagcgtcaggaaagctagtcacccaatggtgctgtagatcttgtactatgcctcctctgcgattcttgggagaagatggatgttggtatggaatggaaattcgacctctttcagaaaaagaggaaaacatggtgaaaagccaagtaacagcaggacaaggaacaagcgagactttttcaatgggattactatgtctcacactttttgtggaagaatgcttacgtcgccgcgtaacaagaaagcatatgatactggcagtcgtcatcaccttgtgcgctataatcctcggaggattaacatggatggacttgttgagagcgctaataattctaggtgatacgatgtctggccgcattggtggacaaacacacctagcaataatggcagttttcaaaatgtcaccgggatatgttctaggcgtatttttgcgaaagctcacctcacgcgagacagctcttatggtgataggaatggccatgacaactacgctaagcataccacatgatctaatggaattaattgatggaatttccttaggacttatattattgaagattgtcacacaatttgataacactcaagtaggcacacttgcactatcgttaacgtttataagaagcacaatgtcactcgttatggcgtggagaacaataatggcagttttgttcgtcgttacgttaattccactttgtcggacaagttgtctacaaaaacaatcccattgggtcgagatcactgcgctgatactaggcgcacaggcgttacctgtatacctaatgacactaatgaagggcgcctcgcgtcgcagctggccattaaacgagggaatcatggcagttggtttagtctcactactaggaagtgccttattgaaaaacgatgtacccttagcaggccccatggtcgcagggggacttctattagcggcctatgttatgtccggttcctcagcagatttaagtctagagaaagctgccaatgtgcagtgggatgaaatggctgacattaccgggtcatctcccatcatagaagtcaaacaagatgaagatgggtcattctcaatacgggatgtagaagaaacaaatatgattacactattggtaaagctagcactaataaccgtatctggactataccctcttgcaatccccatcacaatgactttatggtatatgtggcaagtaaaaacacaaagatcaggtgcgctatgggatgttccctcaccagcagcgacgcaaaaggcggcgctgtcggagggtgtgtacagaataatgcaacgcggcctgtttggcaaaactcaagtaggagtaggtattcacatggagggagtatttcacacaatgtggcacgtaacacgaggaagcgttatttgccatgaaacaggtagattagaacccagctgggctgacgtacgcaatgatatgatttcttacggaggaggatggaggcttggagataaatgggacaaagaagaagatgtgcaagtgctagccatagaacctggcaaaaatccaaaacacgtccaaacgaagcctggattattcaagacgttgacgggagaaattggagcagtaacactcgattttaagcctggtacaagtggatctcctattataaatcgtaaaggaaaagtaataggtttatatggtaatggagtagtaaccaagagcggagattacgtgtcagctattacacaagcagaaagaattggcgagccagattacgaagtcgacgaggatatttttagaaagaagcggttaactataatggaccttcaccctggcgcaggaaaaactaagcggatattaccctccattgtccgagaggcactaaaacgcagacttagaaccctcattctagctccaaccagagtagtagccgctgaaatggaggaagcattacgcggattgccgattagatatcaaacaccagctgtaaagtctgaacacacaggaagggaaatagtggatttaatgtgtcatgcaacctttactacgcgattattgtcatctacacgcgtaccaaattataatctgattgtaatggatgaagcccattttactgaccctagtagcgttgcagctaggggatatattagcacacgtgttgaaatgggcgaagccgccgccatctttatgacggctacacctcctggagccacagacccgtttccacaatcaaattctcccatcgaagatattgaaagagaaataccagaaagaagctggaacacaggcttcgactggatcaccgattatcaaggaaaaacagtgtggtttgtcccctccataaaagccggcaatgatatagctaattgtctaagaaagtccgggaagaaagtaatacaattaagccgtaaaacgtttgataccgagtatcctaaaacaaaattgacagattgggactttgtagttacgaccgacatttcggaaatgggagccaactttcgagcagggagggtaattgatcctaggagatgtttaaaacctgttatcttgaccgatggacctgaaagggtaatcctggccggcccaataccggtaacgccagcaagtgcagcgcagcgtcgtgggcgtattgggagaaacccggcgcaggaggacgatcagtatgtgttttcaggggatcccctgaaaaatgatgaagatcatgcgcactggacggaggcgaagatgttgttggacaacatatatacaccagaaggaattataccgacactattcggaccggaacgagagaaaacgcaagccatagatggagaatttcgccttcgaggagaacaacgaaagacgttcgttgaattaatgagaagaggggatctgccagtttggttatcttataaagtagcgtcagcaggtatttcatataaggatcgcgaatggtgtttcactggcgaaagaaataatcaaatattggaagagaatatggaagttgaaatttggacaagagaaggagagaagaagaaattacgacccaaatggttggatgcgagagtatatgcggatcctatggcactaaaagattttaaggaatttgcatcaggaaggaagtcaataacacttgatattctaacggaaatagcgtctctccccacttatcttagttcccgagctaaattagcacttgataatattgttatgctacatacaacagaacgaggaggaagggcataccaacacgcactgaacgaactaccagaaagtctcgaaactcttatgttagtagcacttctgggagcaatgactgctggaatatttctattctttatgcaaggcaaagggataggaaagttatccatgggcttaattaccatagcagtagcatctggactgctatgggtagcggaaatacagccacaatggatagctgcgagcataatactagagttctttcttatggtcctacttatacctgagccggaaaaacagcggactccccaagataatcaattaatttacgttatccttacaatcctgaccataattggtctaatagcagccaacgaaatgggactaatagagaaaactaagaccgattttggcttctatcaagtcaaaaccgagacaacaatcctcgatgtcgatctccgacccgcttctgcgtggacattatacgcagtagcaacaacaattcttaccccgatgctaagacatacaatagaaaacacttcagcaaatcttagtttagctgcgatagcgaatcaagccgccgtcttaatgggattgggaaaaggctggccattacacaggatggatctcggggtaccattattagctatgggctgctacagtcaagtgaacccgactacgctaacggcaagtttggtaatgctactggttcattatgccataataggaccaggtctgcaagcgaaagctacgcgcgaagcgcaaaaacgtactgcagcgggcattatgaaaaatcccactgtagatggaataacggttatagatttggagcctatctcttatgaccctaagttcgagaagcaactaggacaagtgatgcttttagttctttgcgcaggacaactgcttttgatgcggactacttgggctttttgtgaagtcttaacactagcaactgggccaatactgacattatgggagggaaatccagggcggttttggaatacgactatagcggtttcaaccgcaaatatattcaggggtagttatctagcaggagctggtttagcattctcattaataaagaacgcacagaccccaaggagaggcacaggaaccgctggtgaaacgttaggtgaaaagtggaaaaggcaattaaattccttagacagaaaggaatttgaagagtataaaagaagtggaatattagaagtagatcggactgaggcaaaatcagcattaaaagacgggtcgaaaataaaacatgctgtatcgcgtggttcctctaaaatacgatggatagtagaaagaggaatggttaagccaaaaggaaaagtcgtggacctggggtgtgggaggggtggttggagttattatatggctactctgaagaacgtaacagaagttaagggctatacaaagggaggaccaggtcatgaggaacctatcccgatggccacatacggctggaatttagtaaaattacattctggagttgacgtattttataagccaaccgaacaagttgatacactgttgtgtgatataggcgaaagttcttcgaacccaactattgaagaagggagaactttacgagtgctgaaaatggtagaaccatggctaagttctaagccggagttttgcataaaagtattaaacccatacatgccaacagtgatagaagaattagagaaattgcaaagaaaacacggtggaaatttagtaagatgtccactaagtagaaatagtactcacgaaatgtattgggtgtctggtgctagtggaaacatagtgagtagcgtcaacactacaagcaagatgctcctaaatcgatttaccacaagacaccgtaagcccacctacgagaaagatgtagacctgggagccgggactagatcagtaagtacggaaacagaaaagcctgatatgacaataataggccgaagactacaacggcttcaagaagaacataaagaaacatggcactatgatcaagaaaatccatatagaacatgggcataccatggttcttatgaagcaccgagcacgggatctgctagttccatggtaaatggggttgttaagctcctaaccaaaccttgggacgtaataccaatggtaacgcaattagccatgactgatactactcccttcggtcaacaaagggtatttaaggaaaaggttgacactcgaacgcctcaaccgaagcctggcacgcgaatggttatgaccacaacggcaaattggttgtgggcacttttaggcaagaagaaaaatcctcgtctctgtacaagggaggaatttatatcaaaagtcaggtcaaatgccgctatcggagccgtctttcaggaagaacagggctggacatcagcatcagaggcagtcaatgacagtcgattttgggaattagtggataaagagagggctttacatcaagaagggaaatgcgaatcatgcgtttacaatatgatgggcaaacgtgagaagaaattaggggaatttggtagagccaaaggtagtagggccatctggtacatgtggctcggcgctagatttttggaatttgaagcgttaggtttcttgaatgaagaccattggttcggaagagaaaactcgtggtctggggttgaaggggaaggtttgcacagattggggtatattctggaagaaatagacaaaaaggacggcgatttaatgtatgcggacgatacggcaggatgggatactagaattacagaagacgaccttcaaaatgaagaattaattacggagcaaatggcgccacatcacaaaatcctagccaaagctatttttaaactcacataccaaaacaaagtggtcaaagtgctaagacctacaccacgaggagccgtaatggacataatatctagaaaggaccagcggggctccggacaagtcggaacatatggactaaacacattcacaaacatggaagtacaacttatacgacagatggaagccgaaggagtaattactcaagatgatatgcaaaatccgaagggcttaaaggaacgagtagaaaaatggctcagggaatgcggtgtggataggttaaaaagaatggctatatcaggtgacgattgtgtcgtgaaacctcttgatgaaagatttggtacttcgctactttttcttaatgacatgggtaaggtacggaaagatattccacaatgggagccttctaagggctggaagaactggcaagaagtaccattttgttcccaccattttcataaaatatttatgaaagatggaagatctttagtagtaccgtgtcgcaatcaagacgagttaattggacgggcgcgcatttcgcagggagcaggatggagtctacgggaaactgcgtgtctaggaaaagcatatgctcaaatgtggagtttaatgtacttccatagacgtgatcttcgactagcgtctatggcgatatgcagtgccgttccaaccgagtggttcccaacaagcagaactacctggtccatacatgcacatcatcaatggatgactactgaagacatgctcaaagtatggaatcgagtttggattgaagacaatccaaatatgatcgacaagacacccgtacattcatgggaggacatcccttatctaggtaaaagagaagatttatggtgtggaagcctcattggattgagttcccgagctacgtgggccaaaaacattcatacggcaatcactcaagtcagaaatcttattggaaaagaggaatatgtagactatatgccagtaatgaagaggtactcggcaccttccgagagcgagggcgtattgtga

SEQ ID NO: 23676 - RNA, 9867 nt, synthetic construct
  misc_feature 1..9867: note = derived and/or modified CDS sequence (opt6) from DENV-4__KJ579246__SS-prME
  source 1..9867: mol_type = other RNA
tcgacaataacccttctctgtttaattcccacggttatggcgtttcacttatcaacacgcgacggagaacctttaatgatagtcgcgaaacatgaacgagggagaccactactatttaaaacgacagaagggataaataaatgtacacttatagcgatggatctcggagaaatgtgtgaggatacagtcacgtacaaatgtccactattagtaaatacagaacccgaagacatagactgttggtgcaatttaacttctacgtgggtaatgtatggaacgtgtacacaaagcggcgagaggagaagagagaaaagatcagtagctcttactccccatagtggtatgggattagaaaccagggcggaaacatggatgtcatcagaaggtgcttggaaacatgcacagcgagtcgagagttggatattaagaaatccaggcttcgcgctcttagcaggatttatggcttatatgataggccagaccggtatacaaagaactgtgtttttcgtgcttatgatgctagttgcaccgagttatggtatgagatgcgtcggcgtcggaaacagagactttgttgaaggtgttagcggaggagcgtgggtagatttggttttggaacacggaggttgcgtaactacaatggctcaagggaaaccaacactagatttcgaactaaccaaaacaacagctaaagaagtagctctcttaagaacctactgcatcgaggcgttaatttctaatattactacagccacacggtgcccaacacaaggggagccttatttaaaggaggaacaagaccaacagtacatatgccgtcgagatgtagtagaccgtggatggggtaatggatgcggattatttggaaagggaggtgtagttacctgtgcaaaatttagctgctcaggtaaaataacaggaaatcttgttcaaatagaaaatttagagtatacagtcgtcgtaactgttcataacggagacacccacgcagtgggcaatgacaccagtaatcacggagtaacagctacaatcacacctagatcaccgtcagttgaagtcaaactacctgactatggagaacttacattggactgcgaacctcgcagcggcattgactttaacgaaatgatacttatgaagatgaagaagaaaacatggttggttcacaaacaatggttcctagatctaccgttgccgtggacgacgggcgccgatacatccgaagtccactggaattataaagaaagaatggtaacatttaaagtacctcatgcaaagagacaagatgtgactgttttgggatcacaagaaggtgctatgcactctgccttggccggtgctactgaagtggatagtggtgatgggaatcacatgtttgcaggacatctaaaatgtaaagtcagaatggagaaactcaggataaaaggaatgtcgtacaccatgtgctccggaaaatttagtatagacaaggagatggctgaaacgcagcatggaacgacggtcgtaaaagttaagtacgaaggagcaggagctccctgcaaagtgccaattgaaatacgggatgttaacaaggagaaggttgttggaagagtgataagtgcaacacctctcgccgaaaacacaaattctgttactaatatagagcttgaaccaccttttggggactcttatatcgtgattggtgttgggaatagcgcgttaacattacattggttcagaaaagggtcatccataggtaaaatgtttgaatctacatatcgaggcgctaaacgtatggccatccttggagagacggcatgggattttggaagcgtaggaggtcttttcacaagtctaggtaaagcagtacatcaagtgttcggaagtgtgtacacaacaatgtttggaggcgtatcttggatgatacggattctaattggattcttggtactatggatcggaactaattcaagaaatacatcaatggccatgacctgtattgctgtaggtggtatcacactttttctcgggttcactgtacaggcagatatggggtgcgtagtaagttggagcgggagagaattaaaatgcggcagtggtattttcgttgttgataacgtacatacttggaccgaacaatacaaattccaaccagaatccccagctagattggcttcagcaatacttaatgcacataaagacggggtttgcggtataaggtccacaactagattagaaaatgttatgtggaaacaaatcacaaatgaattgaattatgttctatgggaaggagggcatgatctaacggtagttgcaggggatgtaaaaggtgtgttaactaagggcaaaagagccctaactcctcctgcttcagatctaaagtattcatggaaaacatggggtaaagccaaaatttttacgcccgaagccagaaattccacatttttaatagatggacctgatacctctgaatgccctaatgaacgaagggcttggaactcatttgaggttgaagactacgggttcggaatgtttacaacaaatatatggatgaaatttcgggaaggttcctcagaagtatgtgatcatagattaatgagcgcagccattaaagatcagaaagccgtgcatgcggatatgggttattggatagaatccagcaaaaaccaaacatggcaaatagaacgggcaagtttgatagaagtcaagacctgcttgtggcctaagacacatactctttggagtaacggagtgctggagtcccaaatgctaataccaaagagttatgccgggccatttagtcaacataattacagacaggggtatgcgacacagacggttggaccatggcatctaggaaaactagaaatagacttcggcgaatgccctgggacaacagtgactattcaggaaaattgtgaccatagaggaccaagtctacggacaacaactgcaagtggaaagctggtgacacagtggtgttgtagatcgtgtacaatgccgccgttacgatttctcggagaagacggatgctggtatgggatggaaatcagacccctttcagaaaaggaagaaaatatggtcaaatcacaagttacagctggacaaggtacgtctgaaactttcagcatgggtctactctgcttgacactattcgtggaggaatgcctacgacgtagagtaactaggaaacacatgatattagcagttgtaataacactgtgtgcaattatattaggtggtctaacctggatggacttactccgtgcactgattatccttggggacacaatgtcgggacgtataggaggtcaaacccacctcgcaatcatggccgtgttcaaaatgtcgcctggatatgttttaggagtatttttgaggaaattaacttccagggaaacagcacttatggtaattgggatggccatgacaacgacattgtcaattcctcacgacttaatggaattaatagacggtatcagtttagggttaatccttttaaaaattgtaacacagttcgataatacacaagtaggaaccttggccctgtcattaacattcataaggtccacaatgagcttggtcatggcatggcgaacaattatggcggttctatttgtagttactttaatccctctatgtcgtacaagttgtttgcaaaaacaaagccactgggttgagattacagcgctaatcttaggagctcaagcacttccagtttatttgatgactcttatgaaaggggcatctaggcgatcttggcccctaaacgagggaataatggcggtcgggctagtgagcctactgggatcagcgttgcttaaaaatgatgttccgctagcggggccaatggtggctggaggtctcctcctagctgcatatgtaatgagcgggagtagtgctgatttgagcttagaaaaagctgcaaatgttcaatgggacgagatggcggatataaccggttcctcaccaatcatagaggtaaaacaagacgaggacgggagtttctcaataagggatgttgaagagacaaatatgataacactattagtgaagttagcactgataacagtgtctggtctgtatccactagctatccctattactatgaccttatggtatatgtggcaagttaagacacaaagatctggcgcactttgggatgtcccaagtcctgcggcaacacaaaaggctgcgctcagtgaaggtgtctataggattatgcagagaggactatttggaaagacacaggtcggtgtaggcattcatatggaaggagtgtttcacacaatgtggcatgttaccagaggcagtgtaatatgtcacgaaacgggccgtctggagccaagctgggcagacgtaagaaatgatatgattagctatggagggggttggagactaggagataaatgggataaagaagaggacgtgcaagtcctcgcaatagaaccaggtaaaaacccaaagcacgtccaaacaaaaccaggactttttaagacgttaacgggggaaataggagctgtaactctggatttcaagcccggaacatccggatccccaataataaatcgtaaaggaaaagtaataggactttacggtaacggagttgtaacaaaaagcggggattacgttagtgcaatcacacaagcggaaagaataggagaaccagactacgaagtagatgaagatatttttcgaaagaaacgtttaaccataatggacctgcatcctggagctggaaaaacgaaacgcatactcccttcaatagtccgtgaagcattgaagcgaaggttacgtactctcatccttgcacctacccgtgtggtcgcggctgaaatggaggaggctttacgtggattgccaatacgatatcagactcctgctgtgaagtccgaacatacagggagagagatagtagacttaatgtgccatgcaacattcacaactagactgctatcgtctacgagagtgcctaactacaacttaatagtaatggatgaagcacattttactgatccttccagtgttgctgcacgaggatacatatcaacccgagtagaaatgggagaagctgcggcaattttcatgacagctacaccacccggtgcgacggacccgtttcctcaatcgaactccccgatagaagacatagagagagaaatcccggagcgtagttggaatacagggtttgactggattacagattaccaaggaaagaccgtttggtttgtgccctcgataaaagctggcaatgatattgccaattgcctaagaaaatccgggaagaaagttattcaattaagtcggaaaacattcgatacagagtacccaaaaacaaaactgactgactgggactttgtagtcacgaccgacattagtgaaatgggggcgaacttcagggctgggcgagttatagacccgcggagatgtctaaaacctgtaattctcactgacggaccagaacgtgtaatattagcgggaccaatacctgttactcctgcatctgcggcacaacgtagaggtcgaatcggccgaaatcccgcacaagaggacgaccaatacgtcttctcgggagacccacttaaaaatgatgaagaccacgcccactggactgaagcaaaaatgttgttagataatatatacacaccggaagggattataccaacattatttgggccggaaagggagaaaacgcaagcaatagatggtgagtttcgattacgaggagaacagaggaaaacattcgtagaactaatgaggcgaggagatttacccgtgtggttaagttacaaagtagcatcagcaggtataagctacaaagatcgtgagtggtgtttcaccggagaaaggaacaatcaaatcctcgaagagaatatggaggtcgagatatggacaagagaaggagagaaaaagaaattacgaccaaaatggctagacgctagggtttatgcagacccgatggcattaaaagactttaaagaatttgcaagtggcagaaaatcaatcacgttggatattcttactgaaatagcatccctgccaacttatttgtcctctcgagctaagttagccttagacaacattgttatgctacacactacggaacgtggaggacgcgcgtaccaacacgccttgaacgaactgccagaatctctagaaacattaatgctagtcgcgctgttaggagcaatgactgcaggtatatttttattctttatgcaaggaaaaggaataggtaaactaagtatgggattaataacgatagcagttgcaagcgggcttttatgggtggcggaaattcaaccccaatggatagcggcatcgataattctcgagttctttctaatggtattgctaataccagaacccgaaaaacagagaacaccccaagataatcagctaatatatgttatacttacaattttgaccatcataggactaattgccgcgaacgaaatgggactgatagaaaagacgaaaacagattttggattttaccaagtcaaaacagaaacgactatactagacgtagatttaagaccggcaagcgcatggacattatatgcagttgcaaccacaatacttactccaatgttaaggcatacaatcgaaaatacgtcagcaaatctgtcactagcagccatcgcgaatcaagccgctgtattaatgggtctagggaaaggttggcctctccacaggatggatttgggtgtccctttattagcaatggggtgttactcacaggttaacccaacaactctaacggcgtctctagtaatgctactggtacattatgcaattataggacctggactacaagccaaagcgacaagagaagcccaaaaacgcactgccgctggcataatgaaaaaccccacagtagatggaattaccgtaatagatctagaaccgatctcctacgatccgaaattcgaaaaacaattaggtcaggtaatgctattagtgctatgtgcgggccagttactcttaatgagaactacatgggctttttgcgaagtattaacgttagcaaccggcccaatcctcaccttatgggaagggaaccccggtagattttggaatacaacaattgcagtatccacagcgaacatttttagggggagctatttagccggtgcaggtttggccttcagtctaataaagaatgctcagacaccccgaagagggaccggaacggcaggagagacattgggtgaaaagtggaaacggcaactaaacagcttggatcgtaaggagttcgaagaatataaaagatctggaatactcgaagttgatagaacggaagcaaaaagcgcgttgaaagatgggtcgaaaattaaacacgcagtaagccggggaagctcgaaaattagatggattgtcgaacgtggtatggtcaaaccaaagggtaaggtagtagatctgggttgtggaagaggaggttggtcatattatatggccactctaaagaatgtcactgaagtcaaaggatacaccaagggtgggccaggacacgaagaaccgataccaatggcgacatacggttggaatctagtaaaactgcactcaggggtagacgtcttttacaaacccaccgaacaagtcgatacattactgtgtgacataggtgaaagcagtagcaatcctacaatcgaggaaggaagaacgctacgcgttttgaaaatggttgaaccgtggttatcatctaaaccagagttctgtattaaggtactaaatccatacatgcctaccgtcatagaagaactggaaaagctccagcgaaaacatgggggtaatctagtacgctgtcctttaagtagaaacagcactcatgaaatgtattgggtatcaggcgcatcgggaaatatagtttcttccgtaaacacaacgagcaagatgcttcttaaccgcttcacaacccgtcatagaaaaccaacatacgaaaaagacgtagatttaggagctggcacacgatcagtatctacagaaactgaaaaaccagatatgaccattatagggcgaagactacaaagacttcaagaagaacataaagaaacctggcattacgaccaggaaaacccctacaggacttgggcctatcatggatcttatgaagctccatcaacgggttccgctagttctatggttaatggagtggtgaaactcctcacgaaaccttgggatgtgataccaatggtaacacaattagctatgacggatactacgccttttggacaacaacgtgtcttcaaagaaaaagtagataccaggacaccgcagccaaagccaggaacgcgaatggtcatgactactacagctaactggttgtgggctctcctaggtaagaagaaaaatcctcgtctttgtacgcgcgaagagttcatctcgaaagtgagatcaaacgcagccataggagcagtttttcaagaggaacagggctggacttcagcctcagaagccgtgaatgatagtcgattctgggagctagtcgacaaggaaagagctttacaccaagaaggaaaatgcgaaagttgtgtatataacatgatgggcaaaagagagaagaaattaggcgaatttggcagagcaaaaggtagtcgtgcaatctggtatatgtggctaggcgccagatttttagaatttgaggcattaggtttcctcaatgaagatcactggtttggtagggaaaattcatggagcggagtggagggggaaggactacacagattaggttatattctggaggaaatagacaagaaagacggagatttaatgtatgcagacgataccgctgggtgggatacaagaatcacggaagacgacctacaaaacgaagaacttataacagaacaaatggcaccacatcacaagatactagcaaaagcaatttttaagttgacataccaaaataaagttgtaaaagtgttacgtcccacaccacgcggagcggttatggatatcatcagcagaaaagatcagagaggcagcggccaagttggcacttacggtttaaacacattcacaaatatggaagtacagttaataaggcaaatggaagctgaaggcgttataacacaggatgacatgcaaaacccaaaaggactaaaggaaagggtagaaaaatggttgagagagtgtggtgtcgacagactcaagagaatggctattagcggggacgactgcgtggttaaacccttagatgaaaggtttggtacatccctcttattccttaatgacatgggcaaagtgagaaaagatattccacaatgggagcctagtaaagggtggaagaattggcaagaagtcccgttctgcagccatcattttcataagatctttatgaaagatggtcgctccttggtggtaccctgccgtaatcaagatgaattaataggcagagcaagaatttcccaaggggccgggtggagtcttagagagactgcatgtctgggaaaggcttacgcgcagatgtggtctcttatgtattttcaccgaagagacttgagactcgccagtatggccatttgctcagccgttccaaccgaatggttcccaacatcacgaacgacatggtcaatacacgcccaccatcaatggatgacaacagaagatatgttaaaagtatggaatcgcgtttggatcgaagacaaccctaacatgatagataaaacgccaattcacagttgggaagacattccttacttaggcaaaagagaagatttgtggtgtggatcactaattgggctgtcatcgcgcgcgacatgggccaagaatattcatacagctataacacaagtgcggaacttaataggaaaagaagaatatgttgactacatgccggttatgaaacgttacagtgcaccctcagaaagcgaaggagtactttaa

SEQ ID NO: 23677 - RNA, 9867 nt, synthetic construct
  misc_feature 1..9867: note = derived and/or modified CDS sequence (opt6) from DENV-4__KJ579248__SS-prME
  source 1..9867: mol_type = other RNA
tccactataactctcttgtgtctgataccaacagtaatggcctttcacctgtctacacgggacggggaaccacttatgatcgtagcaaaacacgaaagaggccgacctcttttatttaaaactactgaagggataaataaatgcactctgatagcgatggatttaggggaaatgtgtgaagacacagttacttacaaatgcccactattagtcaatacagagccagaagatatagactgctggtgcaacttaacttctacgtgggttatgtatggcacatgcacccagtccggtgagcgaagacgggaaaaacgtagtgtggcattaacaccacattccggtatggggcttgaaacaagagccgaaacgtggatgagctctgagggcgcatggaaacatgctcagcgagtcgaatcgtggatactaagaaacccaggtttcgcactattggcaggatttatggcatatatgattggccaaacgggtattcaaagaacagtatttttcgtcctaatgatgctagtggctccatcttacgggatgcgatgcgtaggtgtggggaatagggattttgtagaaggcgtctcaggtggagcctgggttgacctagtccttgagcatggtgggtgtgtcacaacaatggctcagggtaaacccaccctagattttgagcttactaaaaccacagctaaagaagtagctttactacggacttactgtattgaagcattaatatccaacattactactgcaacaaggtgtccaacccaaggagagccatatttaaaagaagaacaggatcagcaatatatttgccgtcgggatgtagttgacagaggatggggcaatggttgtggactttttggaaaaggaggagttgttacatgtgctaaattctcatgttctggaaaaataactggaaatctggtacaaattgaaaatcttgagtataccgtagttgtaaccgtacacaatggcgacacccacgcagtaggtaatgacacaagtaatcacggtgttactgcaacgataacaccaagaagtccgtccgtagaagtgaaacttcctgattatggtgaacttaccctggattgtgagccacgaagtggaatagatttcaacgaaatgatactgatgaaaatgaagaagaaaacttggctcgtacataaacaatggtttctcgatttacctctaccctggacaacgggcgctgatacaagcgaagttcattggaactataaagaaagaatggttacattcaaagtgcctcacgctaaaagacaagatgttacagttttaggatcccaggagggtgcaatgcatagtgcactcgccggtgcaaccgaagttgattcaggagacggaaatcacatgtttgcagggcatctcaaatgcaaagtaagaatggagaaattaagaataaaaggcatgagttacaccatgtgtagtggtaaattcagcatagataaagagatggcggaaactcaacacggaacaactgtagtcaaagttaaatacgaaggtgcgggtgcaccttgtaaagttccaattgaaattcgagacgtaaacaaagaaaaagtcgtaggcagagtaatcagtgcaacgcctctagcagaaaacactaactcagttactaatatagaacttgaacctccttttggggattcttatatcgttattggtgttggaaatagtgcactaacgctacattggttcagaaaaggaagttcgattggaaaaatgtttgagagtacgtacagaggagccaaacgtatggccattctcggagaaactgcctgggattttggctcagtaggaggtttattcacttctctaggcaaagctgtacaccaagtattcggatctgtatacactacaatgtttggtggagtcagttggatgatcagaattttaatcggattcttagtattatggataggcaccaattcaaggaacacaagtatggccatgacatgtatcgcggtcggaggaataacactatttctgggattcacggttcaggcagacatgggatgtgtcgtgagctggagcgggagagagctaaaatgtggaagtggaatattcgttgtcgataatgtgcacacatggaccgaacaatacaaatttcagcctgaaagtccggcacgtcttgcttcagccatcctcaatgcacataaagacggagtgtgcggaatacgttccacaacaagactcgaaaatgtaatgtggaagcagataacaaacgagttaaattatgtcctatgggaagggggacacgatcttactgtagttgcaggcgacgtcaaaggagtgttaaccaaagggaagagggccttaactccccctgcgtcagatctgaaatactcatggaaaacatggggaaaggccaaaatcttcaccccagaagcgcgaaactccacgtttctgatcgatggaccagacactagcgaatgtccgaacgagcgacgtgcctggaactcgttcgaagtagaggattacgggttcggcatgtttactactaatatatggatgaagtttagagaaggaagcagtgaagtctgcgaccatcgattaatgagcgcagccataaaagatcagaaggctgtccacgctgatatgggttactggattgaatcgagcaaaaatcagacatggcaaatagagcgtgcaagtcttattgaagtgaaaacatgcctttggcccaaaacacatacgctttggtcaaacggcgtactagaaagccaaatgttgattcctaaatcttatgcaggacccttttctcaacacaattatagacagggttatgcaacacaaacggttggaccttggcacttgggaaagttagaaatagactttggagaatgcccaggtaccacagtaaccatacaagagaattgtgaccataggggaccctcattgcgaacgacgacagctagtggtaaactcgtaactcaatggtgttgccgaagctgcaccatgccgcctttgagatttctgggagaagacggttgttggtatggaatggaaataaggccgcttagcgaaaaagaagaaaatatggtaaaatcacaagtaacagccggccaggggactagcgagacctttagcatggggctactttgccttaccttgttcgttgaggagtgcctgagacgacgtgtcacgaggaaacacatgatacttgccgtcgtaatcaccttatgcgcaattatacttgggggcttaacatggatggacctactaagggccctcataatgttaggtgatacgatgagtggacgcgttggtggacaaacacacctagcgattattgcagtcttcaaaatgagcccagggtacgttttaggtgtatttctgcgaaaactaacttccagagagacggcccttatggttattgggatggcgatgacaactacattatctattcctcatgacctaatggaacttattgatggcataagtcttggtttaatcctattgaaaatcgttacacaatttgataatacacaagtgggaacattagcattgtcactaacatttatacgctctactatgagtctcgtcatggcttggcgcacaataatggcggtattatttgtcgtaacactgataccactatgtagaacgagttgtttacaaaaacaatcacattgggttgaaatcacagcgttaatactcggagctcaagcactaccggtctatctaatgacgttaatgaagggagcttcccggagatcttggccactcaacgagggaataatggcggtcggtctagtttccctattaggatcggctttgttaaagaatgatgtaccactagctggtcccatggttgctggtgggttattattagcggcatacgttatgtctggtagctcagcagatctttccttggaaaaggcagcaaatgtacaatgggatgaaatggccgatataacaggatcttctccaattatagaggtcaagcaagacgaggatggcagctttagtattcgcgatgtcgaagaaacgaatatgatcactcttttggtaaaattagcgctcataacggtgtcaggattatatcctctagcaatacctatcactatgacattatggtatatgtggcaagttaaaacacaaagaagtggtgcactatgggacgtgccaagccccgcagcaacacaaaaggcggctttaagcgagggtgtatacaggataatgcaaagaggcctgttcggtaaaacacaagttggagtgggtatccacatggaaggcgtattccatacgatgtggcacgtaacaaggggttccgtcatttgtcacgaaacaggaaggctggaaccaagttgggctgatgttagaaatgatatgatatcatatggaggtggttggagactcggagacaagtgggacaaagaagaagatgtccaagtcttagcaattgaaccaggtaaaaacccgaaacatgtccaaactaaacctggtctttttaaaaccttaactggcgaaataggtgccgttaccttggatttcaaaccgggaacaagtgggagccctataataaaccgaaaaggtaaagtaattggattatatggtaacggagtagtaacaaaatctggtgattatgtatccgcaataacccaagctgagcgcataggtgagccagactacgaggttgatgaagatatatttcgcaaaaagagacttactataatggatttacatccaggagcaggcaaaactaaacgtatattgccttctatagtacgggaggctctcaagagacgcttaagaactctaatattagcacccactcgcgttgtagctgctgaaatggaggaagcgctccgaggattgcctataagataccaaactccagcagtcaagtccgaacacactggaagggagatagtcgacttaatgtgtcacgctacatttaccacccgcttgttgtcatctacccgtgttcctaactataatctgatagtcatggacgaggctcatttcacagaccccagttcggtagcagctagaggatatatcagtacgcgagtcgagatgggtgaagccgcagcaatatttatgactgccacacccccgggggccacagatccgttccctcaatccaattctccaatagaagatattgaaagagaaatacccgaaagatcatggaatacgggttttgactggattaccgattaccagggtaagacagtctggtttgttccaagtatcaaagccggcaacgatattgctaactgtctgagaaagtccggcaagaaagtaattcaactgagcagaaaaacatttgatacagaatacccaaaaacaaaattaactgattgggacttcgtagtcactacagatataagcgaaatgggtgcaaactttagagctggaagagttatagatccacgaagatgtctgaaacctgttattttaacagatggacccgaaagggtcatattagcaggaccaataccagtgaccccagcatccgcagcgcaacgaagaggtagaatagggcgcaatcctgcacaagaggatgatcagtatgttttcagcggagatcctcttaaaaacgacgaagaccacgcacactggaccgaagccaaaatgcttttagacaacatatatacaccagaaggtatcataccaacattattcggtccagaaagggagaaaacacaagctattgatggagagtttaggttgcgaggagagcaacgaaaaacatttgtagaacttatgagaagaggtgatctaccagtttggttatcatataaggtcgcgagcgccggtattagttacaaagatcgtgaatggtgctttaccggtgaaagaaataatcaaattctggaagaaaacatggaggtagaaatatggacaagggaaggagaaaagaaaaagttgaggccgaagtggcttgacgcaagagtatatgctgatccgatggcattaaaagattttaaagaatttgcttccgggaggaaatcaatcacccttgacatacttaccgaaatagcatcactacctacatacctatcgagtagagcaaaattagctttagataacatcgttatgttacacacgacagaacgcggagggcgagcatatcagcacgcactaaacgaattacccgaatctcttgaaactttaatgctcgtagcattattaggagcaatgactgcaggtatattcctcttctttatgcaaggaaaaggaatagggaagttatcgatggggctaatcactattgcagtcgcctcaggtctcctttgggttgctgaaatacaaccgcaatggatcgccgcatcgattatactagaatttttcttaatggtcttactgatccctgaaccagagaagcaacgaacgccgcaggataaccaattgatctatgttatactaacaattctgacaataataggacttattgcggccaacgaaatgggtttaatagagaaaaccaaaacagactttggattttatcaagtaaaaaccgaaacaacgattctagatgtagatttaagaccagcgtcagcgtggacattatatgcggtagcaacaacaattctcacaccaatgttacgacataccatagaaaacacaagtgcaaatttatcattagctgctatagccaatcaagcagcggttctaatgggattaggtaagggatggccattacatagaatggatttgggagtaccattactggcaatgggctgttactctcaggtaaacccgactaccctaacagcaagcctagttatgctactggtgcattatgcaattataggaccaggtttgcaagccaaagcaaccagggaagcacaaaaacgaactgccgcaggcatcatgaaaaatccaactgtagatggcatcacggtaatagacctagaaccaatcagctatgaccctaaatttgaaaaacagctaggacaagtaatgctattagtgctatgtgctgggcaactgctactcatgagaacaacctgggccttttgcgaagttcttacattagccactggacccattcttactctgtgggagggaaatcccggcagattttggaatacgacaattgcagtgagcaccgctaacatcttcagagggtcttatttggcaggcgcaggactagcctttagtttaattaaaaacgcgcaaaccccgagacgtggtacaggaacggcaggagaaaccctaggagaaaaatggaaacgccagcttaactcactggacagaaaggagttcgaagaatacaagcgcagcggcatactcgaggttgacagaacggaagcaaagagtgccttaaaagatggttcaaaaattaaacacgcggtttcgagagggtcaagtaaaattcggtggattgtggaacgcggaatggtgaagccgaaaggtaaggtagtagatctgggttgcggaagaggaggttggagttactacatggcaacgctaaagaacgtcacagaagtgaaaggatataccaaaggtggacccggacacgaagaacccatcccgatggccacatacggatggaacctagtcaaactacatagcggagtcgatgttttctataaaccaaccgagcaagttgatacattattatgtgatattggtgagtcttcatccaatccgacgattgaagaaggaaggacattacgggttttaaagatggtagaaccctggttatcctcaaaacccgaattttgtattaaggtcttgaatccatatatgcctacagtgatagaggagcttgaaaagttacaaagaaaacacggtggaaatcttgttagatgtccactatcgcgtaacagtactcatgagatgtattgggtttccggtgcatctggcaatattgtctcgagtgtcaacaccaccagtaagatgcttttgaatagattcacgacgcgtcataggaaaccgacgtacgaaaaagatgtagatctaggcgcaggtacccgaagtgtgagtactgaaatagagaaaccagatatgacaataatcgggagacgattacaaaggttacaagaagaacacaaggaaacttggcattatgatcaggaaaatccttacagaacatgggcataccatggatcgtacgaagctccctccacgggcagcgcatcctcaatggtgaatggagtagtaaaattactaacaaagccgtgggacgtaattcctatggtaacacaattagccatgacagatactacaccttttggccagcaaagagttttcaaagaaaaagttgatacaagaacaccccaacctaagccaggaacgagaatggttatgacaacaacggcaaactggttatgggcattactcgggaagaagaaaaacccacgattgtgcacaagagaagaatttatctccaaagtacgatcaaacgcagcaatcggggctgtcttccaggaagaacaaggctggacaagcgcatctgaggcagtgaacgatagtaggttctgggagttagttgataaagaaagagctctgcatcaggaaggaaaatgtgaatcctgtgtctataacatgatgggaaagcgtgagaagaaactaggagagtttgggagagcaaaaggatcacgagccatctggtacatgtggttgggcgcaagatttttggagttcgaagcattgggatttttaaatgaagaccactggtttggcagagagaatagttggtcgggtgtagaaggggaaggactccatcggttaggatacatattagaagagatcgataagaaagatggggatctaatgtacgccgatgacactgcaggctgggatacacggataacagaagatgatttacaaaatgaggagttaattaccgaacaaatggctcctcatcacaaaatattagccaaggccatttttaaactcacatatcaaaacaaagtagtaaaagttttaagacccactcctcgaggcgccgtaatggacataatctctagaaaggatcaaaggggatcgggccaagtaggaacatatggcctcaacacatttaccaatatggaggtacaattaatccggcaaatggaggccgaaggagtaataacacaagacgatatgcaaaacccgaaaggactaaaagagagggtcgagaaatggttaagagaatgtggagtagatagacttaagagaatggcaatatccggagatgattgcgtagtaaaaccactggatgaaaggtttggtacttctttattgtttttaaatgatatggggaaagtcagaaaggacatcccccagtgggaacctagcaaagggtggaagaactggcaagaagtgcctttctgcagtcatcattttcataaaatctttatgaaagatggaaggagcctggtagtaccttgcagaaatcaagatgaattaatagggagggccagaattagtcagggagcagggtggtctttacgtgaaacagcttgcttaggtaaagcgtacgcccaaatgtggtcgttgatgtattttcacaggagagatctgagattagcatcaatggcaatatgttccgcggtaccaactgagtggtttccgacatccagaactacttggtctatccatgcacaccaccaatggatgacgacagaagatatgctgaaagtttggaacagagtctggatagaagacaacccaaatatgattgataaaacccccgtacattcatgggaagatattccgtacctgggaaaacgggaagatttatggtgcggctctcttatcgggttaagctcacgtgctacatgggcgaagaacattcacaccgctataacacaggtacgtaacctaataggaaaggaggaatatgtagactatatgagtgttatgaagcgttatagtgcaccaagtgagagcgaaggagtcttgtag

SEQ ID NO: 23678 - RNA, 9867 nt, synthetic construct
  misc_feature 1..9867: note = derived and/or modified CDS sequence (opt6) from DENV-4__KJ579240__SS-prME
  source 1..9867: mol_type = other RNA
agcacgatcacgttactctgcctcatacctactgtgatggcatttcatttgtcgacccgtgacggagaacctttaatgattgtggcaaaacatgaacgtggacgtcctctattatttaaaaccactgaagggataaacaaatgtacgttgatagctatggaccttggagaaatgtgtgaagataccgttacatacaaatgcccactattagtgaatacagaaccagaagatattgattgctggtgtaacctgacatctacatgggtaatgtacggaacttgtacccagtctggagaaagacgacgagagaaaagaagcgtcgctctaacacctcattcaggaatgggactagaaacaagagcagaaacttggatgagctccgaaggtgcttggaaacatgcgcaaagagtcgaaagctggatactaagaaatccgggtttcgctctacttgcaggattcatggcatacatgattggacaaacagggattcaaagaacggttttcttcgtgctcatgatgttagtagccccaagttacggtatgaggtgcgtaggagttggtaatagagactttgttgaaggagtatcaggtggagcgtgggttgatctggttctagaacatggaggttgcgtgacaacgatggcgcagggaaaacctacattggactttgaactcacaaaaacaactgccaaagaagttgctctattacgaacatattgcatcgaggctttaatatcaaacataacaaccgctactagatgtcccacgcagggagaaccatatctaaaagaagaacaggaccaacaatatatatgtagacgggatgtcgtagatcgtgggtggggaaatggctgcggattattcgggaaaggcggagttgttacgtgtgctaaattcagttgctcaggaaaaatcaccgggaacttggtgcaaatcgagaatttagaatacaccgttgtggtaacagttcacaatggggatacacacgctgtaggaaacgacactagcaatcatggggttacggccactataaccccacgctccccgagtgtagaagtgaagctacccgactatggagaattaacccttgattgcgaaccaagatccgggatcgattttaacgaaatgatacttatgaaaatgaagaagaaaacttggttggtgcacaaacaatggtttctggatcttccattaccttggaccacaggagcagacacttcagaagtgcattggaactacaaggaaaggatggtaacattcaaagtcccacatgcgaaacgtcaagatgtgacagtattgggatctcaagagggagcaatgcattcagcattggcaggcgcaacagaagtcgattctggtgacggaaatcatatgttcgcaggacatctaaaatgtaaggtccgtatggaaaaacttcggataaaaggcatgtcatatactatgtgttctggaaagttcagtatcgataaagaaatggcagaaactcagcatggcacgactgttgtgaaggttaaatacgaaggagcgggggctccttgcaaagtaccaatagaaatccgagatgtaaataaggaaaaagtagtagggagagtaatatccgccactccgcttgcagaaaatacgaacagcgtcacaaatattgaactagaaccaccatttggagatagttatatagttattggagtaggaaatagtgcgttaacattacattggttccggaaagggagcagtatcggaaaaatgttcgaatcaacgtataggggagcaaaacggatggcaatattaggggagacagcctgggattttggatcagtaggaggcctttttacgagcttaggtaaagcagtacaccaagtatttggatctgtatacactacaatgttcggaggcgtatcttggatgatcagaatcctcataggatttttagtattatggataggaacaaattcaagaaacacatctatggcggtcacgtgcatagcggtaggagggataactttatttttaggattcactgtacaagcagatatgggatgtgtcgtgtcatggtcaggcagagaacttaaatgtggatcaggaatatttgtggttgacaatgtccacacgtggacagaacagtataaattccaacctgaatccccggctcgccttgcatccgccattctaaatgcacataaagatggtgtttgcggaataagatcaacaacacgtctagaaaacgtaatgtggaaacagatcactaacgagctgaactacgtattgtgggaaggcggtcatgatttaactgtcgttgccggagatgtaaaaggagtcctaacaaagggaaagagagcattaactccaccagcaagtgatttaaaatactcgtggaaaacatgggggaaagctaagatatttacccccgaagcgagaaatagcacatttcttatagacggtccagatacatctgaatgcccaaatgaaaggcgcgcatggaacagctttgaagtagaggattatggtttcggcatgtttacgactaatatatggatgaaatttagagagggctcatccgaggtgtgcgatcatagactaatgtccgccgctatcaaagatcaaaaagctgtacatgctgacatgggatactggatagaatctagtaaaaatcaaacatggcaaatagaaagagcatcactaattgaggtgaagacatgtctatggcctaagacccacacactctggtctaacggagttcttgaatcccaaatgttaattccaaaaagttatgctggaccattttcacaacataattaccggcagggatatgcaacccagacggtaggtccctggcatcttggcaaattagagatagattttggcgaatgcccaggcactacagtaacaattcaagaaaattgtgaccacagaggtccgtctttacgaacgacaactgcatcaggaaagctagttacacaatggtgttgcagaagttgtactatgccgcccttaaggtttctcggagaagatggatgttggtatggtatggagatcagaccattgagcgaaaaagaagagaacatggtcaaaagtcaggtaacggcaggtcagggcacaagtgaaactttcagtatgggtctattatgtctgacactcttcgtagaggaatgtctcaggcgtagggtaacaagaaaacatatgatattagctgtagtaataacactatgtgctataattcttggaggacttacatggatggacctactacgcgcactcataatgttaggagacacgatgtcaggaagaattggcggtcaaacacatttggctatcatagcggtttttaaaatgtcaccaggttacgtattgggagtgttcctgagaaaacttacatccagagaaaccgcactaatggtgattggaatggcaatgaccactacactcagtattccacacgacttaatggaacttattgacggtataagcctcggtctaatacttcttaagatcgttacgcaatttgacaacacgcaagtcggtacactcgctttgagcttaacgtttattagatctacgatgtccttggtaatggcatggaggacgataatggccgttttgttcgttgtaactttaattcccttatgccgaacttcatgcttacaaaaacaaagccactgggtagaaattaccgcattgatcctaggcgcccaagcattaccagtatatctaatgactttaatgaagggtgcaagtcgtcgatcttggcctctaaacgagggcatcatggctgtagggcttgtcagtttactcggcagtgcacttctgaagaacgacgtcccccttgctgggcccatggttgccggcggacttttactagcagcttatgtaatgtcagggtcttctgccgatctaagtttagagaaagctgctaatgtccaatgggacgagatggctgatataaccggaagttctcccatcattgaagtcaaacaggatgaggatggcagctttagtatacgagacgttgaagagactaatatgataactttgctagttaaactagcgctaatcaccgtatcaggactatatcccctggcaataccgataactatgactctttggtacatgtggcaagtgaagacacaaagatctggcgctctctgggacgtaccatctccggctgcaactcaaaaggcagcgctttcagaaggagtatacagaataatgcaacggggattattcgggaagacgcaagttggggttgggattcatatggaaggtgttttccataccatgtggcatgtaacacgaggctcggttatttgccacgagactggacgattagaaccgtcatgggctgatgttcgaaatgacatgatctcatatggtggtggatggcgacttggagataagtgggataaggaagaagacgtacaggtccttgcaattgaacctggcaaaaatccgaaacatgtacaaacaaagcccggactcttcaaaacgttaacgggagaaataggagcagtcacacttgacttcaaaccaggaactagcgggagtcccatcataaatagaaaggggaaagttataggtttgtatgggaatggcgtggtgaccaaaagcggtgactatgtctctgcgataactcaagcggaaagaattggagaacccgactatgaagtagatgaagatatatttagaaagaaacgattaactataatggacctgcacccaggtgcgggaaaaaccaaacgaatactccccagcatagttcgtgaggcactaaaacgtaggctaaggactctaattttagcacccacccgagtagtagcagccgagatggaggaagccctaaggggcttgccaataagatatcagacgcccgcggtaaaaagcgaacatacaggccgcgaaatagtagacttgatgtgtcatgcgacattcacgacaaggctattatcatcgactagagttcctaactacaatttgattgtcatggacgaagcacatttcaccgatccatccagcgttgcagcacgaggatacatctcaacacgagttgaaatgggtgaggctgccgctatcttcatgactgccaccccaccaggtgcaactgatccattcccacagagcaacagtccaattgaagatatagagcgtgaaataccggaaagatcctggaatactggcttcgattggataactgactaccaagggaagacggtctggtttgtcccgagcattaaagcgggaaatgatatcgcaaattgcttgagaaagtcaggcaagaaagttattcagctgtcgcgaaaaacattcgatactgaatatccaaaaacaaagttaacggattgggattttgtagtaacaacggatatcagtgaaatgggagctaatttccgggcaggccgtgtcatagacccaagacgttgtcttaagcctgttatattaactgacggaccggaacgtgttatccttgctggccctatacctgtcaccccggcgtcagcagcacaaaggagaggcaggattggtagaaatccagcgcaagaggacgatcaatacgttttctccggtgatccattgaagaatgacgaagatcatgcacactggaccgaagctaaaatgttgcttgataatatatatactccagaagggataatacccacactcttcggacctgaaagagagaagacacaagccatcgacggtgaatttaggctacgaggcgaacaacgtaaaacgttcgttgaattgatgcgacgaggagatctaccggtatggctaagttacaaggttgcttctgcgggcatctcttataaagacagagagtggtgcttcacaggtgagaggaataaccaaatactagaagaaaacatggaagtagaaatatggacaagggaaggggaaaagaaaaagctaaggcccaaatggcttgacgcacgagtatatgctgacccaatggcattaaaggatttcaaagaatttgcatccggtcgcaaatcgatcacactcgacattttaactgaaattgccagcttaccaacttatctatcatcaagagcgaaattggcgctagataacatcgtaatgttacatacgacagaacgtggaggacgagcatatcaacatgcactaaacgaactacctgagtctttagaaactcttatgttggtagctttattaggcgctatgactgcggggattttcttattcttcatgcaagggaaaggaatcggcaaattaagtatggggttaataacgattgctgtagcttcaggattgctttgggtggcagaaatacaacctcagtggatagccgcttcaattattttagagttctttttgatggtactgctaatacctgaacccgaaaaacagcgcacgccacaagataatcaactgatatacgttatactgacaatacttacaataattggattaattgctgcaaacgagatgggattaattgagaaaacgaagacagatttcggattctatcaggttaaaacagaaacgactattttagacgtggaccttagacccgcaagtgcctggacattatatgcagttgctactacgatactaactccaatgttaagacacacaatcgaaaatacatcagcaaatttatcgctagcagcgattgccaaccaagctgctgttttgatgggactaggaaagggctggccgcttcaccgaatggatttaggtgtccccttgttagctatggggtgctattcacaagtaaatccaactactttaacggcaagccttgttatgttactggtacactacgcgataattggccccggactccaagctaaggcaacgagagaagctcagaaaagaacagcggccggcataatgaaaaatcctacagttgacgggataacagtaattgatcttgaacctattagctacgatcctaaatttgaaaaacaattaggtcaagtcatgttattagttttatgcgctgggcaactgttattaatgcgtacaacatgggcattttgtgaagtgctgactctcgcaactggtccgattttgacgctctgggaaggtaatccaggaagattttggaacacgactatagccgtctccaccgcaaatatctttcgaggctcctatctcgctggagcaggacttgctttctcattgataaagaacgcccaaaccccaagacgagggactggtacagcaggagaaacgctaggagaaaaatggaaacggcagctcaactctctggacaggaaagaatttgaggagtacaaacggtctgggattctagaagtagaccgaaccgaagcaaaaagtgcccttaaagatgggtcgaagattaaacacgcagtatctaggggaagttcaaaaatacgatggattgtcgaaaggggaatggtgaagcctaaaggcaaagtagtagatttaggatgtggccgcggtgggtggtcatattacatggctacccttaaaaatgtcacagaagtcaaaggctataccaaaggaggtccaggacatgaagaacctataccaatggcgacctacggatggaacctagtaaagctacactcaggagttgatgtattttataaacccacggaacaggtagatacattgttatgtgatataggtgaatcttcatcaaatccgactatcgaggaagggaggacattaagagttctgaaaatggtggagccatggctatcctcaaaaccagagttttgcataaaagttctaaacccatacatgccaactgttattgaagaactagaaaaactgcaaaggaagcatggtggtaacttagtaagatgtccactttctcgaaattcaacgcacgaaatgtattgggtctcaggagctagtggaaatatagtatcgtcggttaatactacatcaaaaatgcttttgaatcgctttaccaccagacataggaaaccgacatacgaaaaagatgtagatctcggggcagggacacgtagcgtatctacagagatcgaaaagcccgacatgacaataatcggtagacgcctccaacgattacaagaagaacataaagaaacgtggcactatgatcaagagaacccttatcggacctgggcgtatcatggctcatatgaagctccatctactgggagcgcgagctccatggtaaatggggtagtaaaacttttaactaaaccatgggacgttatacccatggtaacacaattggcaatgacggacacaacaccatttggacaacagagagtgttcaaggaaaaagttgataccagaacaccccaacccaaacctggaactagaatggtaatgactacgacagcaaattggttatgggcgctattaggcaagaagaaaaatcctcgattatgcacacgggaagagttcatatcgaaagtacgtagcaacgctgcaataggtgcagtatttcaggaagaacagggatggacttcagcttctgaagccgtgaacgatagtagattttgggaattagttgacaaagaacgagcgctgcatcaagaaggaaagtgtgaaagttgcgtatacaatatgatgggcaaacgggaaaagaagctgggagagttcggtagagccaaaggatcacgagcgatatggtacatgtggttgggcgcgcgctttctagagtttgaggccctaggttttctaaatgaagatcactggttcggacgggagaatagttggagtggggtggaaggcgaggggcttcatcgattaggttatattctagaggagatcgacaagaaggatggtgacctgatgtatgcagatgatacggcggggtgggatactagaataacggaagatgacttacagaatgaagaattaataacagagcagatggcacctcatcataagatattagcaaaagctatcttcaaacttacatatcagaataaagtagtaaaagttttaagacctacccctaggggagcagtcatggatattatatcaagaaaagatcaaagaggtagtggacaagttgggacgtacggcttaaatacattcaccaacatggaagtccaactaatccgtcaaatggaagctgaaggtgtaattactcaagacgatatgcaaaacccaaaaggattaaaagaaagagtagaaaaatggctgagagaatgtggcgtagatcgtttgaaacgaatggccataagtggtgacgattgcgtagtcaagccattggacgaaaggttcggaactagcctattatttttgaacgatatggggaaagttagaaaggatattccacagtgggaaccctcaaaaggatggaaaaattggcaagaggtaccgttttgttctcaccattttcacaagatcttcatgaaagacggaagatctttggttgtaccctgtcgcaatcaagacgaacttataggacgcgcaagaattagccaaggtgcaggatggtcattaagagaaacagcttgtttgggtaaagcgtacgcacaaatgtggagcttaatgtatttccaccgccgtgacctacgcttagctagtatggcaatttgtagtgcagtacccacagagtggtttccaacaagtagaacaacatggagcatacacgcccatcaccaatggatgacaactgaagatatgctaaaagtatggaatagggtgtggatcgaagacaatcctaacatgatcgataagacgcctgttcattcgtgggaagacataccgtatttaggaaagcgtgaagatctatggtgcggatcgctaataggattatcatctcgcgcgacctgggcgaagaacatacacactgcaattacacaggttcgaaatcttataggaaaagaagaatatgtagactacatgtcagtaatgaaacgatactcagctccctcagagtcagaaggagtcctatga

SEQ ID NO: 23679 - RNA, 9867 nt, synthetic construct
  misc_feature 1..9867: note = derived and/or modified CDS sequence (opt6) from DENV-4__KJ596658__SS-prME
  source 1..9867: mol_type = other RNA
agcactattacgttattatgtttaattccaaccgtaatggccttccacttatcaacaagggatggtgaacctttaatgatagttgctaaacacgaacgtggaagacctttactatttaaaaccacagaaggaatcaacaaatgcacactaattgccatggacttaggagaaatgtgtgaagataccgttacgtataaatgtcctctcttagttaataccgaacctgaagatatcgattgttggtgtaacctaaccagcacttgggtcatgtatggaacgtgtactcagagcggggaacggagaagggagaaaaggtcggtagcactaactccccattcggggatgggattagaaactcgtgcagaaacctggatgtcttctgaaggagcgtggaaacatgcgcaacgagtggaatcttggatactacgaaatccgggttttgcgctactagcaggattcatggcttacatgattggacagacaggaatccagagaacagtattctttgttttgatgatgttagtagcacctagttatgggatgagatgtgtcggtgttggaaacagagacttcgtagaaggagtatccggaggagcatgggttgacctagtccttgaacacggtggatgcgttaccactatggcccaaggaaaaccaactttggacttcgaactaacaaaaactacagccaaagaagtcgcacttctgcgaacatattgcatcgaggctttgatctctaatataacgacagcaactcgctgtccaactcaaggggaaccatacttaaaagaagaacaggatcaacaatatatatgtaggcgagatgtagtagacagaggctggggcaacggatgtggtttatttggaaaaggcggtgtcgtaacttgtgcaaaatttagttgttctggaaagatcactggaaatttggtacaaatagaaaatttggaatacaccgttgtagtcacagtgcataacggggatactcatgcagtagggaacgatacatcaaaccatggcgttacagcaactattacaccaaggagtcctagtgtagaagtaaaattaccagattacggagagctaactctagattgtgaaccgaggagtggaatagactttaacgaaatgatattaatgaaaatgaagaagaaaacttggcttgtacacaagcaatggtttctagacttaccactaccctggaccaccggtgctgacacatcagaggtccattggaattacaaggagaggatggtaacctttaaagtgccacacgcaaagagacaggacgtaacagtattaggatctcaagaaggcgcaatgcattcagctctagcgggagccacagaagtagattcaggtgacggaaatcacatgtttgcgggtcacctaaaatgcaaagtaagaatggaaaaactacgcataaaaggtatgagttacaccatgtgtagtggaaaattttctattgataaagagatggcggaaacacaacacggtacaacagtggtaaaagtaaaatatgagggtgcgggtgcgccatgcaaagtcccgatcgaaataagagatgtaaataaagaaaaagtggtaggccgtgttatcagtgcgacaccattggcagaaaacaccaattcagtaacaaatattgagcttgagccgccattcggagatagttatatagtaataggggtagggaacagtgctttaacgttacactggtttagaaaagggtcatcaattggtaaaatgtttgagagtacatacagaggagctaaaaggatggccatccttggtgaaactgcatgggacttcggatccgtaggtggtttattcacttcattggggaaagccgttcatcaagtatttggctcagtatacacaactatgtttggaggtgtttcatggatgatacggatcttaattggatttctcgtattatggataggtacaaactcaagaaatacctcaatggccatgacttgtatagcagttggcggaataacattattcttaggttttacggtacaagcggatatgggatgtgtagtctcctggtctggtagagaattaaagtgtggttcagggatatttgtagtcgataatgtgcatacatggacagaacaatataagtttcagcccgaaagtccagctagattagcctctgctatccttaatgcacataaagatggcgtatgcggtatccgctctaccactagactggaaaatgtgatgtggaaacaaatcaccaatgaattaaattatgtattatgggagggcgggcacgatcttacagttgtggcaggcgatgtaaaaggtgtattaaccaaaggtaaaagagcacttacaccgccggcatctgacctgaaatactcttggaagacttggggaaaggcaaaaattttcacacctgaagcaagaaatagtacctttcttatcgacggccccgatacgtccgagtgtccaaatgaaagacgtgcatggaactcatttgaagtagaagactacggttttggaatgtttaccacaaacatatggatgaaattccgcgagggttcatcagaagtatgcgatcacagattaatgagtgcagcaatcaaagatcaaaaagcagtgcatgccgatatgggatactggatagaatcatctaaaaatcaaacgtggcaaattgaacgagcaagtttgatagaagtaaagacatgtttatggcccaagacacatacgttatggagcaacggtgttctggaaagtcaaatgctaatcccaaaatcttacgccggacctttctcacaacataactataggcaaggttatgctacccagacagtaggaccatggcatctaggtaagttagaaatagacttcggtgaatgtccaggaacaacagttacaattcaagaaaactgtgaccatagaggaccatctctgaggaccactactgcaagtggaaaattggttacgcagtggtgttgcagatcctgtaccatgcccccattgcgcttccttggagaagatgggtgctggtacggtatggaaatacgtcctctatcagaaaaagaagaaaatatggtaaaatcgcaggtaacagctggacaaggtacttcagagaccttctccatggggttactgtgcctgacccttttcgtggaggaatgtctaagacgccgtgtgacgaggaaacatatgatacttgccgtagtcattacactttgcgctataatactaggcggtctaacttggatggacttgctaagggctctaataatactaggggatacaatgtctggtagaataggaggccaaacacatctagctattatggcagtctttaagatgtcaccaggttatgtactaggcgttttcttaagaaaacttacctccagggaaacagccctaatggtgataggaatggcaatgacaacaaccttatctatccctcatgacctcatggagctcatcgacggcatatctttaggattaatcttacttaaaattgttacacagttcgataatacccaagtcggtactttagcgctttctcttacctttattagatctacaatgtctcttgtgatggcatggcggacaataatggctgttctatttgttgttactctcataccgctgtgtcgaacaagttgcttgcaaaaacaatcacactgggtagaaataacagcattaatactcggcgctcaggcgctacctgtgtatctcatgacgcttatgaaaggtgcttcgcgcagaagttggccattgaacgaaggtattatggcagtaggtcttgtctcactcctagggagcgccctactcaaaaatgacgttcctctcgctgggcctatggtcgcgggaggacttttactggctgcctatgtgatgtcaggcagctccgccgatctgtcgctagaaaaagcagctaatgtacaatgggatgaaatggcggatataacaggatcttccccgattatcgaagtaaaacaagatgaagacggcagcttttcgattcgtgatgtagaagaaacgaatatgatcacactattagtaaaattggcacttataacagtaagtgggctgtatccattagctataccaattacgatgactctgtggtacatgtggcaagtaaaaacacaaagaagcggtgcattatgggacgtgccaagtcccgcggctactcaaaaggcagcattatcagagggcgtctataggattatgcagcgaggtttatttggaaaaactcaggtaggtgtcggcatacacatggaaggagtatttcacaccatgtggcacgtcacgaggggtagcgtcatctgccacgaaacaggacgactagaaccaagctgggctgatgtgcgcaatgatatgatatcttacggaggtggatggcgactaggagataaatgggataaagaagaagatgttcaagtacttgccatagaaccaggaaagaacccaaaacacgtacaaacaaaacctggactatttaagacactaactggagaaattggtgcagttactcttgattttaaacccggcactagcgggtcgcctatcatcaatcgaaaagggaaagtaatcggactttacggaaatggtgtggttacaaaatcaggcgattatgtaagcgcgatcacacaagcagaacggataggagaaccagactatgaagttgatgaagacatttttagaaagaaacgtttaacaatcatggacctacatcctggagctggcaaaacgaaaagaatacttccttcaattgttcgtgaggccctcaaaagaagactgcggactcttatattagcgccaacgcgtgttgttgcagcagaaatggaagaagcattacggggactccccatcaggtaccaaactccagcggtaaagtcagagcacacaggaagggaaatagtagatttaatgtgccacgcgacattcacgacaagactgttatcatcgactcgagtccccaattataatttgatcgtcatggacgaagcacatttcacagacccttcaagtgttgcggccagaggctatataagtacgcgtgtcgaaatgggtgaagctgcggccatattcatgacggcaaccccaccaggtgctacagacccgttcccccaatcaaattcccctatagaagacatagaacgagaaatcccggagcgtagttggaatactggatttgactggatcacggattatcaaggaaaaaccgtatggttcgtaccaagcatcaaagcaggaaatgatatcgcaaattgtttaagaaaaagtggcaagaaagtgatccaactcagccgcaaaacttttgatactgaataccccaagaccaaattaacagactgggattttgtggtgacaacagacatatcagaaatgggggcaaattttagagctggccgtgtaatcgatcctcggagatgtctaaaaccagtaatccttacggatggcccagaaagggttattttagcgggacctattcctgtaacgcccgcatccgcagcacaacgacgtggtcggataggcaggaatccagcccaagaagatgatcaatatgtattctcaggagatccgttgaaaaatgatgaagaccacgcacattggacggaagcaaaaatgctattggacaatatctatactccagaaggcataataccaaccttattcggccccgaacgagagaaaactcaagccattgacggggaatttcgcttacgaggagaacaacgtaaaacgtttgttgaattaatgagaagaggtgatcttccagtgtggttatcatataaagtagcaagtgcaggtattagctacaaagatcgagaatggtgttttacaggggaaagaaataatcaaattctcgaggaaaatatggaggtcgagatttggacccgcgaaggagagaagaaaaagctaagacccaaatggttggatgctcgcgtctatgccgatcctatggcgctaaaagacttcaaagaatttgcttctggacgaaaaagtataaccctcgatatattaactgaaattgcttccctacctacttacttgagctcgcgagcaaaattagcattagacaacatagtgatgttacataccacagaaaggggtggtcgagcataccaacatgcactgaacgaactacctgagagtcttgagacattaatgttagttgcattgttgggtgcaatgactgccggaatattcttatttttcatgcaaggaaagggtataggtaaactaagcatgggcctaatcacaatcgcagtggcatcaggattactttgggtcgcagaaatacagccacaatggatagctgcatcaatcatactggaatttttcctaatggtattgttaatccccgaacctgagaagcaacgaacgccacaggataaccaacttatttatgttatactaacgattttaaccattataggattaattgcagctaatgaaatgggattaattgaaaagactaagacagattttggattttatcaagtcaagacagagactacaatattagacgtagacttacgcccggcctctgcatggaccctttatgccgtggcaacaaccatattaactccgatgttacgacatacaatagaaaatacaagcgctaatttaagtttagccgctatagcgaaccaagcggcagtcctaatgggcttgggaaaaggctggccactacatcgtatggatttaggcgttcctttgctagcaatgggctgttactcacaagtaaaccccactaccttaaccgcctccttggtaatgctcctagtacactatgcgatcattgggcccggtctacaagccaaggctacacgagaggctcaaaaacgaaccgcagctgggattatgaaaaatcctacagtcgacggaataactgtaatagatctcgagccaatctcttatgatccaaaattcgaaaaacagctaggacaggtaatgttattagtattgtgcgctggtcaactcttactgatgagaacaacgtgggccttttgcgaagtcctcaccctagctactggtcctatactaacactttgggagggaaacccaggacgcttttggaacaccacgattgctgtaagcacggcaaatatatttcgcggttcgtatttagcaggagcgggtttagcattttccttgataaagaacgcacagacgccccgaagaggtaccgggactgctggtgaaacacttggcgaaaaatggaaacggcaactaaattctctcgatcgaaaagagttcgaagaatacaaacgaagtggcattctggaagtagatagaactgaagccaagagtgctttaaaggacggttcaaaaattaagcacgctgtatctcgtggatcatcgaaaatcaggtggattgtcgagagagggatggtaaagcccaaggggaaagttgttgaccttggatgcggacggggaggctggtcctattatatggcgaccctcaaaaacgttactgaagttaaaggatataccaaagggggtccgggacatgaagaaccaatcccgatggcgacatacggatggaatcttgtcaaattacactctggtgttgacgtattttataagcctactgaacaagtagatactttattatgtgatattggagaatctagtagcaatcccacgatcgaggaaggaagaacgctcagggtgctaaagatggtggagccctggctcagttcaaaacctgagttctgtataaaggtcttaaatccttatatgccaactgttattgaagaactagagaaacttcaaagaaagcacggaggcaacctagtaagatgtccgctcagtcgcaattcaacgcatgaaatgtattgggtatcgggggcttctggtaacattgttagctcggtcaacaccacaagcaaaatgttgttgaacaggttcacgacgagacatcgtaaacccacatacgaaaaagacgttgaccttggcgcagggacgagatctgttagtacagaaaccgagaaaccagacatgactataatcggtagacgattacaaagactccaagaagaacacaaagaaacttggcattatgaccaagagaatccatatagaacatgggcttatcatggttcgtacgaggcaccatccaccggaagtgcgagttcgatggtgaatggggtagtcaaactattaactaagccgtgggatgttattcctatggtaacgcagctcgctatgacagatactacaccatttggtcaacaaagagtgtttaaggagaaagttgatacgcgaactccgcaacctaagccaggcacgagaatggttatgaccactacagcgaactggctttgggcgttactaggcaagaagaaaaaccctcgtttatgtactagggaggagttcatatcaaaagtccgtagtaacgcagcaattggagctgtctttcaagaggaacagggatggacaagtgcttcggaagccgtaaacgattccagattctgggaactcgtagataaagaaagagcattgcatcaggaaggtaaatgcgaatcatgtgtttacaatatgatgggtaaaagagagaagaaattaggagagtttggccgagcaaagggctcaagagctatatggtacatgtggttaggggcaagattccttgaatttgaggctttagggtttctaaatgaagaccattggtttggaagagaaaattcctggtccggtgtggagggcgagggcttacatcgcttaggatacattcttgaggaaatagacaagaaagatggtgatctaatgtatgcggatgatactgctggttgggacactaggataacggaagatgatttacaaaatgaggaattgataactgaacagatggcgccccatcacaaaattctagctaaagcaatctttaaactcacctatcaaaataaagtcgtcaaagtccttcgaccaacccctcgtggtgctgttatggatatcataagtcgtaaagatcaaagaggttcaggccaagtaggaacttatggcttgaacacatttacaaacatggaagtacagctcataagacaaatggaagctgaaggcgtcattacgcaggacgatatgcagaacccaaaaggtttaaaagaacgcgtagaaaaatggctaagagaatgtggagttgatagactaaaacgtatggccatttccggggatgactgcgtggtaaaaccattggatgaacgcttcgggacaagccttcttttcttaaacgacatgggcaaagttagaaaagatataccacaatgggaaccgtcaaaaggttggaaaaattggcaagaagtcccattctgctcgcatcactttcataaaatttttatgaaagatggtaggagcctcgtagtaccatgtagaaaccaagatgagttaataggacgagctcgaatttcgcaaggcgccggatggtcattaagagagactgcgtgcctaggaaaagcctatgcacaaatgtggtccctaatgtacttccatcgccgagatttacgattagcctcaatggcaatatgctccgcggtaccaacggaatggtttcccacaagtaggacaacgtggtcaatccatgcgcaccatcaatggatgacaacagaagatatgctcaaggtttggaatcgggtatggatagaagataatcctaacatgatcgataaaacccccgtacatagctgggaagatattccatatctgggaaaaagagaggatctttggtgcgggtcgctgataggattaagctcaagagcaacttgggctaaaaatatccatacagctataacacaggtgagaaacctaataggcaaagaggaatacgttgattacatgccagtcatgaaacggtactcagccccctcagaaagtgagggggtactgtaa

SEQ ID NO: 23680 - RNA, 9867 nt, synthetic construct
  misc_feature 1..9867: note = derived and/or modified CDS sequence (opt6) from DENV-4__KJ596659__SS-prME
  source 1..9867: mol_type = other RNA
tcgacgataaccttactctgtctcattccaacggtcatggcttttcacttgagtactcgggacggtgaacctttgatgatagtagcaaaacacgaaagagggaggccactgctatttaaaacaacggaaggcatcaacaaatgtaccttaatagcaatggatttaggtgaaatgtgtgaagatacagtgacttacaaatgtccgctacttgtgaatactgaaccggaagatatcgactgttggtgcaatctcacctccacttgggtaatgtatggtacttgtacacaatcaggggaaagaagaagagaaaaacggagtgtagcactaacacctcattcgggcatgggcttagaaaccagagcagaaacatggatgtcatctgaaggggcatggaaacacgcccaaagagtagaaagttggatattgcgaaatccaggctttgcacttctggcaggatttatggcgtatatgataggacaaactggcatccaaagaactgtattctttgtcctaatgatgctagtagcgccctcatacggaatgaggtgcgtaggagtcggtaatcgggattttgtagaaggggtttcaggaggcgcctgggtagacctagtactagaacatggaggatgtgtcactaccatggcacaaggcaaaccaacactagattttgaactcaccaaaaccacagccaaagaagtcgcattattacgcacttattgcatagaagctctgatatccaacatcacaactgctacgagatgtcctacacaaggtgaaccctatttgaaagaagaacaagatcaacaatacatatgtcgcagggacgtggtcgatcgcggatggggcaacggatgtggcttattcgggaaaggaggagtcgtaacctgcgcaaaatttagttgttcagggaaaataacaggaaatttagtacagattgaaaacctcgaatatacagtggtagtaacagttcataatggggatacgcacgcagtgggaaatgacacatcgaaccacggcgttacagcaacaataacccctcgttctccaagtgtggaagtaaagctcccggattatggtgaactaacactagactgtgaacccagatcaggcattgactttaatgaaatgatattaatgaaaatgaagaagaaaacgtggttggtccacaaacaatggtttttggacctgcctttaccttggacaactggagcagatacaagtgaagtgcattggaaccataaagaaagaatggtaacattcaaggttccccacgcaaaaaggcaagatgttacagttctggggtcacaggaaggcgcaatgcattcagccctagcgggagctacagaggtggacagtggagacggcaaccacatgtttgctggacacttaaaatgcaaagtcagaatggaaaagctgagaattaaaggaatgtcatacactatgtgttcaggaaaattctcaatagataaggaaatggctgaaacacagcatggaacgacagtagtaaaggtcaagtatgaaggggcaggcgctccatgtaaagttccgatcgaaatacgggatgtaaacaaggaaaaggtagttggcagggttatttcagcaacaccgctagctgaaaatacaaattcagttaccaacatcgaattagagcctccatttggggatagctacatagtaataggcgtgggaaattcagcgctgacattacattggtttagaaagggtagcagtatcggaaagatgtttgaaagtacttataggggagctaagcgaatggccatactcggggaaaccgcctgggattttggatccgttggcggtctatttaccagcctcggaaaagcagttcaccaggtatttggtagcgtatacaccacaatgttcggaggtgttagttggatgataaggattctcataggatttttagtcttgtggatcggcaccaactccaggaacacttcaatggcaatgacttgtatcgcagtaggtgggataactttgttccttggttttacagtacaagcagatatgggctgcgtagtgagttggtctggtagagaactaaaatgcggtagtgggatttttgtagtagacaacgtacacacatggacggaacaatacaaatttcaaccggaaagccctgcaagactagcttcagcaatattaaacgctcataaagatggagtatgcggcatacggagtacaacacggttagagaatgtaatgtggaagcaaataactaatgaactcaactatgtactgtgggaaggtggacatgacctaacagttgttgctggcgatgttaaaggcgtgctcacgaaaggaaaaagagcactaacaccaccagcaagtgaccttaaatattcatggaagacttggggtaaagccaaaattttcactcctgaagcgcgtaatagcacatttctaatagacggaccagatactagcgaatgtccaaacgaacgtcgagcatggaactccttcgaagtagaggactacgggttcggtatgtttacaacaaatatttggatgaaattccgtgaaggaagctcagaagtatgtgatcaccgattaatgagcgcagccatcaaggatcaaaaggcagttcacgcagatatgggatattggatagaatcaagtaaaaaccaaacatggcaaatagaaagagcatcactcatagaagttaaaacatgtctatggcctaaaactcatacactgtggagtaatggtgtactcgaaagccagatgttaataccaaaatcatatgcaggaccttttagtcaacacaattatagacaaggatatgctactcaaacagtaggcccatggcatctagggaaacttgaaattgacttcggtgagtgtcctggaacaactgtcacaatacaggagaactgtgaccatagaggccctagccttagaacgaccacggcttctggcaaacttgttacacaatggtgttgtcgaagctgtaccatgccgcctttacggtttttgggtgaagatggatgctggtacggcatggaaattagaccactttcagaaaaagaggaaaacatggtgaaatcacaggtaaccgctggccaaggtacatctgagaccttctcgatgggcttgttgtgccttacgttatttgtggaggaatgtttaaggaggagagtaactagaaagcacatgatcctcgcagttgtgattaccttatgtgcaatcatattaggtggccttacgtggatggatttactacgggcactaataatattaggtgacacaatgtctggtcgaataggagggcaaacccacttagcaataatggctgtgttcaaaatgagtccaggatatgtattaggtgtatttctaaggaaacttacttcacgcgaaacagcccttatggttattggcatggccatgactacaacgctatcaatcccccacgatttaatggagttaattgatggtataagcctcggtctaattttgctaaaaatcgtgacccaatttgacaacacgcaagttggaactctcgcactgtccttaaccttcataagaagtactatgagtctagtcatggcttggcgaacaatcatggctgtattattcgttgttacgttaattcctctgtgtcgtactagctgtcttcaaaaacaatcacattgggttgaaattactgctttgatactaggtgcgcaagccttaccagtttatctgatgaccctgatgaaaggggcttccagaagatcttggcctttaaacgaaggtataatggccgtgggattagtatcattgttaggaagcgcattattgaagaatgacgttccactagcaggaccaatggtagccggtggattattacttgctgcttatgtgatgagtggaagtagtgccgatctatctttagaaaaggcagctaacgtacaatgggatgaaatggccgacataactggttcatccccgataatagaagtaaaacaagacgaagacggaagtttttcaattagggacgtcgaagaaacaaacatgatcactttactcgtcaaattagcactcataaccgtgtccggactatatcccctagcaataccaatcactatgactctatggtatatgtggcaagtaaaaacacaaagatccggtgcattatgggatgtaccgagtccggcagcgacacaaaaggctgcgttgtctgaaggcgtttacagaattatgcaacgtggtctgtttggtaaaacacaagttggcgttggaatccacatggagggtgttttccacaccatgtggcacgtgacacggggaagcgtcatatgccatgaaacgggaagattagaaccgtcttgggccgacgtgaggaatgatatgatatcctatggcggtggctggcgattaggtgataaatgggacaaagaagaagacgttcaagttcttgctatcgaaccgggcaagaatccgaaacacgttcaaaccaaaccaggtctctttaaaacactaactggcgaaatcggagcagtgaccctcgactttaaaccaggtacgagcgggtcacctataattaatcgtaaaggtaaagtgataggactgtacggcaatggggtcgtcacaaaatccggagactatgtgtctgcaataacacaagctgagcgtataggagaaccagattatgaagttgacgaagatatttttagaaagaaaaggcttactataatggatttacacccgggggccggaaagacaaaaagaatcctgccaagtatagtaagggaggcgcttaagagacgactaagaacgttaatattggcaccaaccagagtggtcgctgctgaaatggaagaagccttacgaggcttacctattagatatcaaacaccagcggtcaagtctgaacacacaggaagagaaatagtagatctcatgtgccatgctacatttactactcgactgctaagcagtacaagagtaccaaactacaatttaatagtgatggacgaagcacattttacagacccaagtagtgttgcggcacggggctatatatcaaccagagtggagatgggtgaagcggcagcaattttcatgactgcgacaccccctggagcaactgacccatttcctcagtcaaactcgccaattgaagacatcgaacgtgaaatcccggaaagaagttggaacacaggctttgactggatcacagattatcaaggcaaaactgtttggtttgtgccatcaataaaggctggaaacgacatagctaattgtttaagaaaaagtggcaagaaagtgatccaactttctagaaaaacctttgatacagaatatcccaaaacaaagttaacagactgggactttgtcgtgacaacggatatatccgagatgggagcgaatttccgagcaggccgcgtaattgaccccaggagatgtttgaaaccagtaatactaactgatggaccagaaagagtaatactggcgggtccgatccccgtgacgcctgccagtgctgcgcaaagaagaggccggataggtagaaaccctgcccaagaagacgatcagtacgtttttagtggagacccattaaagaatgatgaagaccatgctcattggaccgaagccaaaatgctcttggataatatctacaccccggaaggaattataccaactctattcgggcccgaaagagaaaagacgcaagctatagatggagagttccgtttgcgtggagaacaacgtaagaccttcgtcgagctcatgaggcgaggcgaccttccggtttggctgtcatacaaagttgcaagcgcgggtatctcatataaagacagagagtggtgttttactggagaacgcaataaccaaatattagaagaaaatatggaagtcgaaatatggacaagagagggagagaaaaagaaactcagaccgaaatggttagatgctagagtatacgcagatccaatggcacttaaagattttaaagaatttgcttctggacgaaaatcgatcacattagacatactaactgaaatcgcatcactacccacttatctttcttcaagagcaaagctcgcattagacaatattgtcatgctgcacactactgagagaggtgggagagcatatcagcatgcgttaaacgagctacctgaatccctagagacattaatgcttgtcgctttgttaggtgcaatgacagccggtatttttctattctttatgcagggcaaaggtataggaaaactttcgatgggattaataaccattgctgtagcatctgggttattatgggtcgcagagatacaaccccaatggatagccgcttccataatactggagttcttcttgatggttttactgatacccgaacctgaaaaacaaaggacaccacaagataaccaactaatatacgtaatattgacaatcctaacgataattggactcatagctgctaacgaaatgggccttatagagaaaactaaaactgattttggattctatcaagtaaagactgaaaccactattttagatgtggatctccgacctgcatcagcgtggactttatacgctgtcgccacgacaatactaacacctatgctacgccacacaattgagaatacaagtgcgaacctgagcctagcagctattgctaatcaggccgcagtgctcatggggcttggaaagggctggccattacatcgaatggatcttggtgttccattgctagccatgggttgttattcacaggtaaatccgacgactttgaccgcaagcctagttatgttgctagttcattacgctataattggacccggcctgcaagcgaaagccaccagagaagcacagaaaagaacggctgcgggaataatgaaaaatccaacggtagatggaataaccgttattgatttagagccaataagctatgatccgaaatttgagaagcaactaggacaagtaatgttactggtgctctgtgcaggtcaactgctattgatgaggaccacatgggcgttctgcgaggttttaactctcgccacgggcccgatcctcacgctctgggaagggaatcctgggcggttctggaatacaaccatagcagtaagcaccgctaatatcttccgaggtagctacttggcgggcgctggattggcgttttccttaatcaaaaatgcacaaacaccgcgacggggcaccggaacagctggcgaaacactgggagaaaaatggaaaagacaattaaacagtttagataggaaagagttcgaggaatataaaagaagtggaatacttgaagtagatcgaactgaagctaagagtgctttaaaggatggatcaaagattaaacacgcagtgtccaggggttccagcaagattagatggatcgtggaacgaggcatggtaaaacctaaaggcaaagtagtagacctcgggtgcgggcgcggcgggtggtcatattatatggccaccttgaagaacgtaacagaagttaaaggctatactaaaggaggcccggggcatgaagaaccgataccaatggcgacctatggttggaaccttgtaaaacttcattcaggcgtcgatgtattttataaaccaacagaacaagtagatacccttttatgtgatataggtgaatcaagcagtaacccaacaatagaagaaggtcgtacactacgagtcctcaagatggtagagccttggctgagtagtaaaccagagttctgtataaaagtcctaaatccatatatgcccacggttatagaagaactcgaaaaattgcaacgaaagcacggcggaaatcttgttagatgccccttatcgcgtaattcaacgcatgaaatgtactgggtatccggagcttcgggtaatattgttagctcagtgaacactacgtcaaaaatgttactcaataggtttacaactcgacatcgaaagccaacatatgagaaagacgttgatttgggggcgggaactagaagtgtatcgaccgaaaccgaaaagcccgatatgacaataattggacgcagattgcaacgattacaagaagaacacaaagaaacctggcactatgatcaagaaaatccttatcggacatgggcctaccatggaagttatgaagcgccttccaccgggagtgcaagttcaatggtaaacggtgtggtgaaattgttaactaaaccatgggatgtgataccaatggttacgcaactggccatgacagatactacaccctttggtcaacaacgagttttcaaggagaaagtcgataccaggactccacaaccaaaaccagggacgagaatggttatgacgactacagcgaactggttgtgggctcttttgggcaagaagaaaaatccaagattatgcactcgggaagagtttatttctaaggtgcgatccaacgccgcaataggcgcggtttttcaagaagaacagggatggacgagtgcaagcgaagcggtcaacgattctaggttctgggaacttgttgataaagaaagggcactacatcaggagggaaaatgcgagtcttgtgtgtataacatgatggggaagcgagagaagaaattaggcgagttcggtagagctaaaggttcaagagccatttggtacatgtggctgggagcaagatttttagagttcgaagcgttaggatttttaaacgaagaccattggttcggtagagagaacagctggtcaggcgttgaaggtgaaggactacaccgactaggttatattttagaagagatagataaaaaggatggggacctaatgtacgcggacgatacagcaggttgggacactcgaataaccgaggatgatctacaaaatgaagaattgataaccgagcaaatggccccacatcacaaaatactagcaaaagccattttcaaattaacttatcaaaacaaagttgtaaaagtactaagacccacacctagaggcgcagtaatggacattattagcagaaaagaccaaagagggagcggtcaagtgggaacatatggtttaaacacgtttaccaatatggaagtacagctaatcagacaaatggaagctgagggcgtaataactcaagatgatatgcagaacccaaagggactaaaagaaagagttgagaagtggttacgggaatgcggagtcgatcgacttaagagaatggcgatttcgggtgatgactgtgtagttaaaccactagatgaacgtttcgggacttcgctattgtttctgaacgacatgggaaaagtaagaaaagacatacctcaatgggagccaagcaaaggatggaaaaattggcaagaagttcccttctgttcgcatcacttccataaaatcttcatgaaagatggaagaagtctagtagtaccatgtcgtaatcaagacgagttaatagggcgagcacgcatatctcaaggagcggggtggtcattgagagaaacagcttgcctaggaaaggcttacgcgcaaatgtggtctttaatgtatttccatcgaagggatttaaggctagcatcaatggcaatttgctcagcagtaccgactgaatggttcccaacctctcgtacaacatggtcgatacacgcccatcatcagtggatgactacggaagacatgttaaaagtgtggaatagagtctggatagaagataacccgaatatgatagacaaaaccccggttcactcgtgggaagatatcccatatttaggcaaacgagaagacctatggtgcgggagtctgatcggattgtcctcaagagcaacatgggccaagaatattcataccgcaataacgcaagttagaaatttaattggcaaagaagaatatgttgactacatgcccgtcatgaaaaggtatagcgcaccttcggagtcagaaggtgtactgtaa

SEQ ID NO: 23681 - RNA, 9867 nt, synthetic construct
  misc_feature 1..9867: note = derived and/or modified CDS sequence (opt6) from DENV-4__KJ596661__SS-prME
  source 1..9867: mol_type = other RNA
tctacaataacgctgctatgtcttataccgacggtgatggcatttcacttatcaacaagagacggtgaacctctgatgatagtagccaaacatgaacgcggaagacctctgctgttcaaaactacggaaggtataaataaatgcacactaatcgcaatggatctaggtgaaatgtgtgaagatacagtaacatacaaatgtcctctcttagtgaacacagaaccagaagatattgactgctggtgtaacttaacaagtacgtgggtgatgtacggaacatgcactcaatcgggagaacgacgtagagagaaaagatcagtagctttgacaccacattcaggcatgggcttagaaacccgtgccgaaacatggatgtcttccgaaggagcatggaaacatgcccaacgtgtagaaagttggattctacggaatccgggattcgccttattagcgggatttatggcctatatgatcggtcaaacgggtatacaaagaacagtatttttcgtactgatgatgctagttgcaccttcttatggaatgcgttgcgtaggcgttggaaatagagactttgtagaaggagtctcaggaggtgcttgggttgacctagtattagaacacggtggttgtgtgacaacaatggctcaaggcaaacccaccttggattttgaattgacaaaaacgacggctaaagaagtagccctattacgaacctactgcattgaagcactgatttctaatataacaacagcgacacgatgtccaacgcagggggaaccttatctaaaagaagaacaagatcagcaatacatatgtcgaagagatgttgtggatagaggatgggggaatgggtgtggtttattcggaaaaggaggtgtagtaacatgtgccaaattttcctgcagcgggaaaatcacaggaaatcttgtccaaattgaaaatctcgaatatacagtagttgtaaccgtccataatggtgatacgcatgccgtaggcaatgatacttcgaaccatggtgtcaccgctactataacgcctcgatcaccaagcgtagaagtaaaactcccggactatggagaacttactctcgactgtgaaccaagaagcggtatagatttcaatgaaatgatcttaatgaaaatgaagaagaaaacttggttagtacataaacaatggtttctggatcttccattgccttggacaacgggagcggatacttcagaagtccattggaattacaaggaaagaatggtaacctttaaagtcccacatgccaaacgacaagatgtcacagttcttggttcacaagaaggagctatgcactctgcattggcaggagctacagaggtggattcaggagatggaaatcatatgtttgcgggacacctaaaatgtaaagttagaatggagaaactaagaatcaagggcatgagttacactatgtgcagcggaaagttctcgatcgacaaagaaatggctgaaacgcaacatggtacgacagtcgtaaaagtcaaatacgagggggccggagcaccatgcaaagtacctatagaaataagagatgtcaacaaagagaaagtagtaggacgcgtaatatcagccacacccttagctgaaaatacaaattcagttactaatattgaattagagccgccgtttggagattcatatattgtcataggagttggaaattctgcgcttacactacactggttccgaaaaggtagtagtattggtaaaatgttcgaatccacataccgtggagctaaacgaatggcaatactcggagaaaccgcctgggactttgggtctgtaggtgggctatttacttcacttggaaaagctgttcaccaagttttcggctctgtatacactacgatgttcggcggtgtttcatggatgataagaatcttaattggatttttagtattatggataggtactaattctcgcaatacctctatggccatgacatgtatagcagtaggtggcataacattattccttggctttactgtgcaagctgatatgggttgtgtcgttagttggtctggtagagaactaaaatgtggaagtgggatattcgtcgtagacaatgtgcacacttggactgagcagtacaagttccagccagaatcaccagccagactggcctcagccatacttaacgcacataaggacggagtgtgcggtattcgttcaacgaccagacttgaaaacgtaatgtggaaacaaataacaaacgagctaaactacgtgttgtgggagggaggccatgatctcaccgtcgtagcaggagatgtaaaaggggttctaacaaaaggaaagcgtgctctcacgcctccagctagcgacttaaaatacagttggaagacatggggtaaagcaaagatctttacccccgaggctcgaaactcaacatttttaatagatgggccagatacgagcgaatgcccgaatgaaagacgggcatggaactcattcgaagtggaggattacggtttcggaatgtttacgacaaatatttggatgaaattcagagaaggatccagcgaagtatgcgaccatagattgatgagcgcagcaataaaagatcaaaaggcagttcacgcggacatgggatactggatagaatctagcaaaaatcagacttggcagatagaaagagcctctctcatcgaagttaaaacatgcttatggccaaagacccatacactctggtcaaatggtgtgttagaaagccagatgctgattccgaaatcttatgcaggacctttcagccaacataattatcgtcagggatatgctacccaaacggtaggcccctggcatctagggaaactggaaatagacttcggtgagtgtcccggcacgacagtcactatccaagagaactgcgatcatagagggcctagcttacggacaacaacggcgtcgggaaaattggtcacccaatggtgctgtagatcatgtactatgccacctttaagattcctaggagaagatggctgttggtacggaatggaaatacgacctcttagtgaaaaagaagagaatatggtgaaatcccaggtaaccgctggtcaaggaacgagtgagacttttagcatggggcttctgtgtctaaccttatttgtcgaagaatgtctccgtcgaagagtaacacgcaagcacatgatacttgctgtcgttataacactgtgtgcaataatattgggcgggctaacttggatggatctgctaagagcccttatcatgctaggtgatacaatgagtggacggatcggtggtcaaacccatcttgctatcatggcagtattcaagatgtcacctggctacgttttaggagtctttctaagaaaactcacgtcaagagaaaccgccttgatggtcatcggtatggcaatgacaactacactttctataccccacgatcttatggagcttatcgacggtatttcacttggactcatcttactcaaaatcgtcacgcaattcgataatacccaagttggcactctggcactttctctaacttttattagatcaacgatgtctcttgtaatggcttggaggactatcatggccgtattattcgttgtaactctcatcccactttgcaggacttcttgcctacagaaacaaagtcactgggtagaaataaccgcactaatactgggagcccaagctctaccagtatatctaatgaccttaatgaagggcgcaagtagaagaagttggccactcaatgaagggattatggcagtaggtcttgtatcactgctcggttcagcgttgctaaagaatgacgttcctctagcaggacccatggtggccggaggattacttttggcagcatatgtaatgtcgggctcctccgcagatttatcgctagaaaaagcagcaaacgtccaatgggatgagatggcagatataacaggttcgagccctattatagaagttaagcaagatgaagatggatctttttcaatccgtgatgtagaagaaacaaacatgatcaccttattagtcaaattggcattaattaccgtttctggattatatccactagcaattcctataacgatgacactatggtatatgtggcaagtaaaaacacaacgaagtggagctctctgggatgttccctccccagcagccacccaaaaggctgccctcagtgagggcgtttatagaattatgcaaagaggcctatttgggaagacacaagtaggtgttggtatacatatcgaaggggtttttcatacaatgtggcatgtaactcgaggaagtgtaatatgccacgaaacaggtagattagaaccatcatgggcggacgttaggaatgacatgattagttatggcggagggtggagattgggagacaaatgggacaaagaagaagatgttcaggtactcgccattgagcctggaaagaacccaaaacacgtgcaaacaaaacccggtctgtttaagactttgactggggaaatcggagcagttacactggactttaagcctggcaccagtgggagcccaatcatcaataggaaaggaaaagtcataggattatacggtaacggcgttgtaacaaagtcgggagattacgtatccgcaattacacaagcagagcgtattggagaacctgactacgaagtagatgaggacatttttaggaagaaaaggcttacaataatggatttacatccgggagcaggcaaaaccaagcgtatattaccaagtattgtccgtgaggctttaaaaagaagacttcgcacccttatactagcgcccactcgtgttgtagcggcagaaatggaagaggctttaagagggctaccaataagatatcaaactccagctgtaaaatcggagcataccgggcgcgaaatcgttgacttaatgtgccacgcgaccttcacgacacgcttactctccagtacaagagtcccaaattataatttaatagtaatggacgaagcgcacttcactgatccttcttcagtggctgctagaggttatattagcacccgagtagagatgggtgaagcagccgctattttcatgaccgccacacctccaggtgctactgacccattcccgcaaagcaactcgccgatcgaagatattgaacgggaaattcctgaaagaagttggaacacaggcttcgactggataactgattaccaaggaaaaacagtatggtttgtcccatccataaaagcaggaaatgacatagcaaattgccttagaaagtctggaaagaaagtcatacaattgtctagaaagacatttgatacggaataccctaaaactaaactaacagactgggacttcgtagtcactacggatataagtgaaatgggtgcaaattttcgtgcaggacgagttatcgaccctagacgctgtttaaaaccagtaatactaacagacggacctgaacgggtcatactcgctgggccaatcccggtaactccggcaagtgcggcacaacgtagaggtagaatcggtagaaatcccgctcaagaagatgatcaatacgttttcagtggagacccccttaaaaacgacgaggatcacgctcattggacagaggctaaaatgttgcttgacaatatctatactcccgaaggtatcatacctacattatttggtcccgagagagagaaaacccaagctatagatggggaatttagattacgaggagagcaacgcaagaccttcgtagagttaatgcgtaggggagatttaccagtttggttatcttataaggtcgccagtgcaggtatatcttataaggatcgagaatggtgtttcaccggagaacgaaacaatcagatattagaggaaaatatggaagtcgagatctggacgcgtgaaggtgagaaaaagaaattaagaccaaaatggctcgacgctagggtatatgcagacccaatggcattgaaagattttaaggagttcgcaagtggacgaaaaagtatcacacttgacatattaaccgaaatcgcttcgttaccaacttacctatccagccgagccaaacttgcactggacaatatagtcatgctacacactacggaaaggggtgggagggcatatcaacatgcacttaacgagttgcctgagagtttagaaacattaatgttggtagcgttattaggtgcaatgacggcaggcatatttctattctttatgcaagggaaaggaataggaaagctcagtatgggattaataaccatagcagtagcgtcaggcctgctttgggttgctgaaatacaaccacaatggatcgcagcctctattatattagagttctttctaatggttttactaattccagaaccggaaaagcagcgaacaccccaagataatcagttaatctacgtaatccttaccattttaacaattataggattaatagccgcgaacgaaatgggattaatagagaaaaccaagacagactttgggttctaccaagttaaaactgaaacaactatactagacgttgatttaagacctgcttcggcttggactctatacgcagttgcaactacgatactaactcctatgctacgacacacaatcgaaaacacgagcgcaaatctgtctttggcagctatcgcaaatcaagccgctgtgcttatggggttagggaaaggctggccattacatcgtatggatttaggggtgccactcctagctatgggatgctactcccaagttaaccctaccacactaacagcaagtttggtgatgctattagttcattacgctataattggtccgggattgcaagccaaagcaacaagagaggcacaaaaacgtacagcagctggtataatgaaaaacccgactgttgatggtattactgtaattgatttagaacccataagttacgacccaaagtttgaaaaacaactaggccaagtaatgctcctagttttatgtgctggtcaattgctattaatgcgcactacatgggcattctgcgaagtccttaccctcgcaaccggtccaacattaacactctgggaaggtaacccaggacgattttggaacaccacaatagcagtgtcaaccgcaaacatattccgaggcagctaccttgccggcgccggtttggcattcagtttaattaagaatgcacaaacgccacgaagagggacaggaacagctggggagacactgggagaaaaatggaagagacaattgaactcccttgatagaaaggagttcgaagaatacaaaagatcaggaatactcgaagtagatagaactgaagcaaaatcagccttaaaggatggaagtaaaataaagcatgcagtctcacgtggcagctcaaaaatacgatggattgtagaaagaggaatggtgaagccaaaggggaaagtagtagaccttggatgcggacggggcggttggagttactatatggccactctcaaaaacgtaacggaagtaaaaggctacacaaaaggagggcccgggcatgaagaaccgatccccatggccacgtacgggtggaacttagttaaactccattcaggtgtagacgttttctacaaacctaccgaacaagtggataccctcctatgtgacataggggagtcgtcaagtaatcctacgatcgaggaaggtagaactttgagagttttaaaaatggtggaaccctggttaagtagtaaaccagagttctgcataaaggtgttaaacccatacatgcccacagtaatagaagaactcgaaaagttacaaagaaaacacggtggcaatcttgtgaggtgcccattgtcaaggaacagcacgcatgaaatgtactgggtatccggggcgagcggcaacattgtctcaagcgtaaatacaacaagtaaaatgttgttaaaccgtttcacgacaaggcatagaaagccaacctatgaaaaagatgttgacctgggagccggaacaagatcagtttctaccgaaacggagaaacctgatatgacgataatcggacgaagattacaaagattacaagaggagcataaagaaacttggcactatgatcaagaaaacccatatcggacttgggcataccacgggtcctatgaagccccatctacaggttccgcgagctcaatggtaaatggtgtcgttaaattattaacgaagccgtgggacgttataccgatggttactcaattggccatgaccgacacaacgccctttggtcagcaaagagtatttaaagagaaagtcgacactaggacgccccaacctaaaccagggacacgaatggtgatgacgacaactgcgaattggttgtgggcacttctaggcaaaaagaagaatccccgactgtgtaccagagaggaatttatttctaaagttcgtagtaatgccgcaataggcgcagtcttccaggaagaacaaggctggacatctgcttcagaagccgtaaatgattcgcgattttgggaacttgtagacaaagaacgtgcgttacaccaagaaggaaaatgcgaatcatgtgtatataatatgatgggtaagagagagaaaaagctaggagagttcggtagagcaaaaggatctcgcgcaatatggtatatgtggttgggagcacggttcctagaatttgaagcactcggtttcttaaatgaagatcattggtttggtagagaaaatagttggtcaggggtagagggagagggtttacatcgattagggtatattctagaagagatcgacaagaaagacggtgatttaatgtatgcagacgacaccgcaggttgggacactagaataacggaagacgatcttcaaaatgaagaattaattaccgaacaaatggctccccatcataagattttggcaaaagctatatttaaactaacatatcaaaataaagtagtcaaagttctaaggcctactcctagaggtgctgtaatggatatcatatcaaggaaagaccaaagaggaagcggacaggtcggaacatatggattaaatacctttacaaatatggaggtgcagttaatacgccaaatggaagctgaaggggtaataactcaggatgatatgcaaaacccgaagggcttgaaagaacgagtagaaaagtggttaagagaatgtggagtcgaccgattaaagcgtatggctataagtggagatgactgcgtagtaaaacctttggacgagagatttggaacatccttattatttctaaatgacatgggtaaagcaagaaaagatattccgcaatgggaaccttccaaaggttggaagaactggcaagaggtacctttctgctctcaccattttcacaagatatttatgaaagacggaaggtcgctagtcgtcccatgccgtaatcaagatgagctaataggccgtgcccgtatttcacagggcgctggctggagtttaagggaaacggcctgtctaggtaaagcctatgctcaaatgtggtccttaatgtatttccatagacgagatttaaggttggcttctatggctatctgttcggccgtaccaacagaatggttccctacaagtcgaacaacgtggtcaatacatgcacatcatcagtggatgacaacagaagatatgcttaaagtctggaatcgcgtatggattgaagacaacccaaatatgatagataagactccagtacattcctgggaagatataccctatttgggtaaacgagaggatctttggtgcggcagcctaataggcctaagctcaagggcgacatgggcgaaaaatatccacacagcaataactcaagtaaggaatttaattgggaaagaggaatatgtcgactacatgcctgtaatgaaacgctacagcgctccgtcggagagtgaaggagttttataa

SEQ ID NO: 23682 - RNA, 9867 nt, synthetic construct
  misc_feature 1..9867: note = derived and/or modified CDS sequence (opt6) from DENV-4__KJ596663__SS-prME
  source 1..9867: mol_type = other RNA
tctactattacgttattatgcctaatacctaccgtgatggcatttcacctaagcacgagagatggtgaaccattaatgatcgtcgcaaaacatgaaagaggacgacctttactgtttaaaacaacagaaggaataaataaatgtaccttaatagccatggatctaggagaaatgtgtgaagacacggttacatataaatgtcctttacttgttaacaccgaacccgaagatattgattgttggtgcaacctaacgagtacttgggtaatgtacggaacatgtacgcaaagcggagaacgccgccgggagaaaagaagtgtcgcattgacaccacacagtggaatgggactcgaaacaagagctgaaacatggatgtcatctgaaggagcctggaaacacgcacagcgagtagaatcatggatattaagaaatcctggattcgcactccttgcgggattcatggcttatatgatcggtcaaacagggattcaacggacggtgttctttgtattaatgatgctggttgctccttcgtacggtatgagatgtgtgggagttggaaatcgcgactttgtagaaggggtctctgggggagcttgggttgacttagtgttagaacatggtggttgtgtgaccaccatggctcagggaaaacctacacttgatttcgagttgaccaaaacgacggcaaaggaagttgcactgctgaggacctattgcattgaagccttaatatcaaatataacaacagctactcgatgcccaacgcaaggagaaccgtatctaaaagaagaacaggaccaacaatatatctgcagaagagacgtagtcgatagaggatggggaaacggatgtggtttatttgggaaaggcggtgtggttacatgtgcgaaattctcttgttcaggaaaaatcactggaaacctagtgcaaatagaaaatttagaatacacggttgttgtaacagttcacaacggggacacccatgcggtaggcaatgatacaagcaaccatggagtgactgctacaataactccgaggtcaccatcagtcgaagtaaagttgcccgactacggagaacttacactagattgtgaaccgagatcaggcatagacttcaacgaaatgatattaatgaaaatgaagaaaaagacgtggttagttcataaacaatggtttttagatctaccgctaccatggactacgggggctgatacaagtgaggtacactggaattacaaagaaagaatggtaacttttaaggtgcctcacgcaaaacggcaggatgttactgtactcggatcgcaagaaggtgctatgcacagcgcactcgccggtgcaactgaggtagactccggcgacggtaatcatatgtttgcgggacatcttaagtgtaaagtacgaatggaaaagctacgtataaaagggatgtcatacaccatgtgttccggaaagtttagcattgataaggagatggcagaaacccaacatggaacaacagtcgtgaaggtcaaatacgaaggagcgggtgcgccatgcaaagtaccaattgaaatacgagatgtaaataaagagaaggtcgtaggtcgcgtcattagcgcgaccccactggcagaaaacacaaactctgtgactaacatagaattggaacctccattcggggactcgtatatagttatcggggtgggtaatagtgccttaactttacattggtttaggaaaggcagtagcatagggaaaatgtttgaatcaacctataggggagcgaaaagaatggcgattttgggggagacggcgtgggacttcggctctgtaggcggactatttacatcattaggaaaagctgtacatcaggtctttggctcagtatataccactatgtttggcggggtatcttggatgataagaatattaattggtttcctcgtgctctggataggaactaattctcggaacacatcaatggcaatgacatgtattgctgtcggtggcatcacactgttcctcgggtttacagttcaagcagacatgggatgcgttgtcagctggagtggtcgtgagcttaaatgcggatcggggatattcgtagtagacaatgtccatacttggaccgaacaatacaaatttcaaccggaaagcccggccagactcgcttcagctattttgaatgcacataaagatggagtttgtggaatacgttcgacaactcgcctagagaatgtaatgtggaagcagatcactaacgaactaaattacgtattgtgggaaggtggacacgatcttaccgttgttgcgggagatgtaaaaggtgtcttaaccaaggggaaacgtgctctaaccccacccgcatccgacctaaaatactcgtggaaaacgtggggcaaggcaaagatttttacccccgaggcacggaatagtaccttcctgatcgacggccctgacacgtctgaatgtccaaatgaacgtagagcatggaactcgttcgaagtggaggattatggattcggaatgtttacgacaaacatttggatgaagttcagagaaggtagttcggaggtttgcgatcacaggttaatgtcagcagcaatcaaagaccaaaaggccgttcacgcagacatgggatattggatagaatcatcaaagaatcagacatggcagatcgaacgggcatccctcatcgaagtgaaaacatgtctttggccaaaaacacatacattatggtcaaatggagtactagaatcccaaatgcttataccaaagagttatgccggaccattcagtcaacataactacaggcaaggatatgcaacacaaacagtcggaccgtggcacctaggcaagctagaaatcgacttcggagaatgcccgggcacaacagtgacgatccaggagaattgcgatcatcgcggtccgtcattaaggactacgacagcgtctggaaaattagtcacacaatggtgctgtagatcttgtaccatgccacctttaagatttttaggagaagatggctgctggtatggaatggagatcagaccattaagcgaaaaagaagaaaatatggtcaaatcacaagttactgctggacaaggaacaagtgaaacattctctatgggtctattatgcttaactctattcgttgaggaatgtttaagacgaagagtaactagaaagcatatgatcttagcagttgtaataacactgtgcgcaatcattttgggagggcttacgtggatggatttgttacgtgctctgattatattgggcgacacaatgtcaggaagaataggagggcaaacacatttagccataatggcagtgtttaaaatgtcccctggatacgtactaggtgtattcctaaggaaactaacttccagagaaactgctcttatggttatcggtatggctatgactacaacactttcaatcccccatgatctgatggaactgattgatggtataagcctgggtctaattctacttaaaatagtgacccaattcgataatacacaagttggcacattagcattgagcttaacatttataaggagtactatgtcgttagttatggcatggcgtactattatggcagtactgttcgtcgtaacgctaattccattgtgtagaacgagttgcctccaaaagcaatcccattgggtcgagattacagctttaatactaggggctcaggccctccctgtttatctaatgacactaatgaaaggggcatctaggagaagctggccattaaacgagggtataatggcggtaggattagtgtctttacttggaagtgccttgctaaagaatgacgtaccgctagcaggaccaatggtcgcaggagggctacttctagcagcttacgtgatgtctggctcaagcgcggacctatctctagaaaaagcagccaatgtacaatgggatgagatggcagatattaccgggtcatctccaataattgaagtaaaacaggacgaggacggtagcttttcaataagagatgtagaggaaacaaacatgataacactgctggtaaaactggcattaataaccgtaagcggactatatccccttgcaatacccatcacgatgacgctttggtacatgtggcaagtcaagacgcaacggtcaggtgcactatgggacgtaccaagcccggcagcaacccaaaaagccgcattaagcgaaggcgtgtaccgaataatgcaaaggggactctttggaaaaacacaagtcggggtagggattcacatggagggcgtgttccacacaatgtggcacgtaaccagaggatcagtgatttgtcacgaaacaggtaggctagaaccgtcttgggcggatgttcgtaacgatatgatcagttatggaggaggttggaggttaggagataaatgggataaagaagaagatgttcaagtgctagcgatcgagccaggtaagaatcccaagcatgtacaaaccaaacctggtttgtttaagactttaactggtgaaataggcgccgtaacacttgactttaaaccgggcacttcgggttcgccaatcattaataggaaaggaaaagttatcggattgtacggcaacggtgttgtgacaaaaagtggggattacgtatcagcaataacccaagctgagagaattggtgaaccagactacgaagtcgatgaagatatatttaggaagaaaagattaacgattatggacctacacccgggagcaggtaagacgaaacggattttaccatcgatagttcgcgaagcattaaaacgaagactaagaacacttatcctagctcccaccagagtagtagcagctgaaatggaggaggctttaagggggttgcctattaggtaccaaaccccagcagtaaaatcagaacatacaggacgggagatagttgatttaatgtgccatgcgacattcacaactcgattgttgtcctcaacacgagtacctaattataacctcatagtcatggacgaggcacattttacagatcccagtagcgtagcggctaggggctatatcagtacaagggtggaaatgggtgaggccgcagccatatttatgaccgcgactccaccaggggctactgatccatttccacagtcaaactcaccaatcgaagatatagaaagagaaatacctgaaagatcctggaatacgggatttgattggatcacagattatcaaggtaagacggtatggttcgttccaagcataaaggccggcaacgacatagcaaattgtcttagaaagtcaggcaagaaggtaattcaattatcaagaaaaactttcgatacagaatacccaaagacaaaattgacagattgggattttgtagtaacaacagacataagtgagatgggtgcgaattttagggcggggagagtaatagatcctcgtcgatgtttgaaaccagtcatactaactgatggtccggaaagagtcatattagcgggaccaataccagttacaccagcatccgccgcacaaaggcggggcagaataggaagaaatccggctcaagaagatgatcaatacgtattttcgggtgatccactgaaaaatgatgaggatcatgcacactggactgaagccaaaatgttacttgacaatatatatactcctgaaggtattattccaacattatttggacctgagcgggagaaaacgcaagcaatagacggtgaatttagacttagaggggagcagagaaagacctttgtggaacttatgagaagaggagatttgccagtatggttatcatataaggtggcctcagccggcatatcttataaagatagagaatggtgcttcacaggggaacgaaataaccaaattctggaagaaaatatggaagtagaaatctggacaagagaaggggagaagaagaaactaaggccaaagtggttagatgcccgggtatacgcagacccaatggcgctaaaagattttaaggaatttgcgagcggacgcaaaagcatcacactagatatattgactgaaattgcatccttaccaacatatttatcatcgagggccaaattagcgctcgacaatattgttatgcttcacactacagaaaggggtggcagagcataccaacacgccttaaatgagttgcctgaaagtcttgaaaccctaatgttggtggctcttttaggagcaatgactgctgggatatttctcttctttatgcaaggaaaaggaatagggaagttaagtatggggttgatcactatagctgttgctagtgggcttttatgggtagctgaaatacaaccccaatggatagctgcttccatcatacttgagttcttcttaatggtactcttgattccagagcctgaaaagcaaagaactccgcaagacaaccaactaatttacgtgatattgactattctaacgataataggtcttatcgctgcaaatgaaatgggcttaatagagaaaaccaaaacagattttggattctaccaagttaaaacagagacaacaatattagacgtagacctacgaccagctagtgcatggaccttatatgcagtagccacaacaatacttactccaatgttgagacatacgatcgaaaatacttcagcaaacttaagtctagcagctatagcaaaccaggccgctgtgctcatgggattaggtaaaggatggcctctacatcgcatggatttgggcgtacccttattggcaatgggttgctatagccaagtaaaccctacgacattaacggcatcattggtcatgttattagtacactatgcaattataggtcctggcttacaggcgaaagcaacgcgcgaagctcagaaaagaacagcggcgggaattatgaagaatcctactgttgacggtattactgttatagatctggagccaatttcctatgaccctaaatttgagaaacaacttggccaagtcatgctattagttctatgcgctggacagttgcttcttatgcgaacgacatgggcattttgcgaagtgttaactctcgcaacgggaccaattctgactttatgggagggaaatcccggaaggttttggaataccaccatagcagtttccacggcgaacatatttaggggaagctacttggcaggagcagggttagccttctctctaattaaaaatgctcaaactccccgtagaggcaccgggacagcaggggagacattaggagaaaaatggaagagacagctaaacagtcttgataggaaagaatttgaagaatataagaggagtggtatattagaagtggacagaacggaggctaaatcagcccttaaggatggcagtaaaataaaacatgcagtaagtcgaggcagcagtaagataagatggatagtagagagaggtatggtaaagcccaagggtaaagtggttgatttaggatgcggaaggggcggttggagctactacatggctactctaaagaatgtaacagaagttaaaggatatacgaagggcggtccaggtcacgaagaaccaattcccatggctacatatggatggaatttagtaaagctgcacagcggggttgatgtattctataaaccaacagagcaagttgacacattactttgcgatataggggagtcgtcatcaaatccgacaattgaagaaggtcggacacttcgtgtattaaagatggtagagccctggctaagctcaaaaccagagttttgcataaaggttttaaatccctatatgcctacggtcatagaagaactagaaaaacttcaacgaaaacatggtgggaatctagtcagatgcccattatctaggaacagtacgcatgaaatgtactgggtttccggagcaagcggtaacatagtatcttctgtaaatactacctccaaaatgttgttaaatagatttaccacaagacaccgaaaaccgacttatgaaaaggacgtcgaccttggcgctgggacaagaagcgtatcaacggaaacggaaaagccagacatgacaatcatcgggcgaaggttacaaagattacaggaggaacataaagaaacctggcattacgatcaagaaaacccttacagaacatgggcttatcatggcagttatgaggcgcccagcactggctccgcgagctcgatggtaaatggagtcgtaaaattattaaccaaaccatgggatgtaattcctatggtaactcaattggctatgaccgacacgacgccgtttgggcaacaacgagttttcaaagagaaggtagatacaaggacgccacagcccaagccgggtacacggatggtaatgacaacgacagctaattggttatgggcattactaggcaagaagaaaaacccgcgcttatgcacaagggaagagtttatatctaaagttaggtcaaacgcagccataggcgctgtatttcaagaagaacaaggatggacgagtgcatcagaggcagtaaatgacagcagattctgggaacttgtagataaagaaagagcccttcatcaggagggcaaatgtgaatcatgtgtctataatatgatgggaaaacgggagaagaaactcggagaatttgggagagcaaaaggtagcagggcaatatggtatatgtggctaggcgctcgctttcttgagttcgaggctttggggttcttgaacgaagatcactggtttggacgagagaatagctggagtggagtagaaggcgagggattacatagattgggttatattttggaagaaattgataagaaagacggggatctaatgtacgcggacgatactgcaggatgggacacaagaataacggaggacgacctccagaacgaagaactcattaccgagcagatggcacctcatcataaaactttagcaaaggcaattttcaagttgacctatcaaaacaaggtggtaaaagtattaagaccaacgcctcgaggtgcagttatggatataatatctagaaaagaccagcgggggtctggtcaagttgggacgtatggtctaaatacttttacaaatatggaagtacaattaattagacaaatggaagcagagggcgtgattacacaagacgatatgcaaaatcccaaggggctaaaggaacgggtcgaaaaatggctacgtgaatgtggagtggataggttaaaacgcatggctataagtggcgatgattgtgtcgtaaaaccacttgatgaacgatttggcacttcccttttatttttaaacgacatgggtaaagtcagaaaagacattccacagtgggagccatcaaaaggatggaaaaactggcaagaagtacctttttgttctcaccatttccacaaaatatttatgaaagacggtagatccctagtcgtcccttgtcggaatcaagatgagctaattgggcgagcacgaattagtcagggagcaggctggagcctccgcgagacggcttgtctgggaaaagcgtatgcccaaatgtggtcattaatgtattttcaccgtagggacctaagactggcatctatggcgatttgctctgctgtaccgaccgagtggttccctacttctagaactacctggagcatacatgcacatcaccaatggatgactactgaagatatgttaaaagtttggaacagagtatggatcgaggacaatccgaacatgatcgataaaacgccagtacactcatgggaagatattccctatttggggaagagagaagatctttggtgcgggtcattgatcggactctcatcaagagccacctgggccaaaaatattcatacggcaattacccaggttaggaatttaattggcaaagaagaatacgtagattatatgccagtaatgaaaagatacagtgcgccgtctgaaagtgaaggggtcttatga

SEQ ID NO: 23683 - RNA, 9867 nt, synthetic construct
  misc_feature 1..9867: note = derived and/or modified CDS sequence (opt6) from DENV-4__KJ596664__SS-prME
  source 1..9867: mol_type = other RNA
agtactattactcttctttgtttaattccaactgttatggctttccatcttagtacaagagatggagaaccgttaatgatagttgctaaacatgaacgaggtaggcctcttctatttaaaacaacagaaggaataaataaatgtacgttaattgctatggacttgggagaaatgtgcgaagacaccgtaacttacaaatgtcctctcttagttaatacagaaccagaagatatagattgctggtgtaacttaacttctacttgggtaatgtatggaacctgtacccagtcaggagaacgacgaagagagaaaaggagcgtggcattaactccacattccgggatgggtttggaaaccagagcggaaacatggatgtccagtgaaggtgcatggaaacacgcacaacgtgtagaaagttggatactcagaaatccaggctttgcgcttttggcagggtttatggcatatatgatcggacaaacaggtatacagcgaaccgtattctttgtcttgatgatgctagtagcaccaagttatggcatgagatgcgttggagtaggaaatagagattttgttgaaggtgtaagtggaggcgcatgggtcgatttagtactcgaacatggtggatgtgtgaccaccatggcacaaggaaaaccgactctcgactttgaactcacaaaaacgactgcaaaagaagtcgcactactaagaacctattgtatagaggctttgatatcaaatatcacaactgcaacaagatgccccactcagggagagccatacctgaaagaagaacaagatcagcaatatatatgtagacgtgatgtagtggacagagggtgggggaatggctgcgggttgtttggaaaaggaggggttgtcacttgtgctaaattctcttgctctggaaaaataactgggaatttggtccaaatagaaaatctagaatatacagtagtagtaacagttcataacggtgacacccacgcagtaggaaatgatacctcgaatcacggagtaacggcaactataactcccaggtcaccttctgtggaagtgaaattacctgactatggtgaactaacgttagactgcgagcctaggtcagggatcgattttaacgagatgatactcatgaaaatgaaaaagaaaacatggttagtgcataaacaatggttcctcgacttacctctaccttggactacgggcgctgacacaagtgaggttcactggaactataaagagcgaatggttacatttaaagttccacatgcaaaacgacaagacgtaaccgtgttaggtagccaagaaggggccatgcatagcgcattagctggcgctaccgaagtagactctggagacggaaatcacatgtttgcagggcatttaaaatgcaaagtacgaatggaaaaattacgtataaaaggtatgagttatacaatgtgttcaggaaaattcagcatagacaaagagatggcagaaacgcaacatggtacaacagttgtaaaagtaaaatatgaaggggcaggagctccctgcaaggttccgattgagataagggatgttaataaggaaaaagttgtaggccgagtcattagcgctactcccttggccgaaaacacaaatagtgtcacaaacatagaactggaaccaccgttcggcgatagctacatagtaatcggagtaggaaactctgcattaacacttcattggttccgaaaaggctcgagcatcggaaaaatgttcgaaagtacatatcgtggggcaaaacgaatggccatccttggggagaccgcgtgggactttggatcagtcggcggtcttttcacaagtctaggaaaagcagttcatcaagtgtttgggagcgtttatactaccatgtttggaggtgttagctggatgataaggatcctaattgggttcttagttttatggatcggcactaactctcgaaatacaagtatggccatgacgtgcattgcagtcggaggaattacactctttctgggtttcactgtccaggcagacatgggatgcgtggtttcctggtcaggccgtgagctgaaatgtggttccggaatttttgtagtagataatgttcacacttggacagagcaatataagtttcagccagaaagtcctgcgcgcctggcatctgctatcttaaacgcgcacaaagacggtgtatgtgggataagaagcaccacaagactagaaaatgtaatgtggaaacagatcaccaatgaactcaattacgttctatgggagggaggacatgatttaaccgtggtagccggcgatgttaaaggtgtcctaacaaagggtaagcgggctttgacaccgccagctagtgatctcaaatatagttggaaaacgtggggtaaggcaaagattttcacacccgaagccagaaattcaacattcctcatagacggacctgatacctcggaatgccccaatgaaaggagagcttggaactcattcgaagtagaagattacggttttggaatgttcactactaacatctggatgaaattccgagaaggaagctccgaggtatgcgaccatcgattaatgtcagctgcaatcaaagatcaaaaagctgtgcacgcggacatgggctattggattgagagttccaagaatcaaacatggcaaattgaaagagcaagtctcatcgaagtaaagacatgtttatggcccaagacacacaccctctggtcaaatggcgtgttagaaagccaaatgttaattccgaaaagttatgcaggccctttttcgcaacataactatcgacaaggatatgcaactcagaccgtgggcccatggcatctcggaaaattagaaatagactttggcgagtgtcctggcacaacagtaaccatacaggaaaattgcgatcaccgaggtccgtccttaagaacgacaacagccagtggaaaattggttacacaatggtgttgccgatcttgtacgatgcccccgttgcgattcctcggggaagacgggtgttggtatggcatggaaataaggccattaagtgagaaagaagaaaatatggtaaaaagtcaagtcacagcgggtcaaggcacttctgaaactttctcaatgggattgctttgccttacattatttgtagaggaatgcctgagaaggcgagtcacacgtaagcatatgatactagccgtagttataactctatgtgcaataatattaggtggactaacttggatggatctattacgcgccctaataatgttaggggatacaatgtccggtagaatcggtggacagacccacctggcgataatcgccgtattcaaaatgagtcccggatacgtattgggagtatttcttagaaaactcacatcgagagaaacagcactaatggtaataggaatggcaatgacgactactctatctataccccacgaccttatggaactaatcgacgggatttctttgggtttgattcttttaaaaattgttacacaattcgacaatacacaagtgggaacgctggctttaagtttaacatttatacgctcaacaatgagtctggtaatggcatggcgtacaattatggcagtcctgttcgtagtcacccttataccactgtgtagaaccagttgcttacagaaacagtcgcattgggtcgaaataactgcactaattttaggggcccaggcgttaccagtatacttgatgactctcatgaagggcgcaagccgaagatcttggcccttgaacgaaggaataatggcagttggattggtatcgctactaggaagtgccctactgaaaaacgatgtcccgctcgctggccccatggttgcaggcggtttacttctagcagcgtatgtgatgagcggaagctcggccgatctaagtcttgaaaaagctgctaacgttcaatgggacgaaatggcagatattaccggatcaagtccgatcatagaagtaaaacaagatgaggacggctctttctccattagagacgtggaggagactaatatgataacattacttgttaaacttgcattaataacagtaagcggcctttaccccttagctatcccaatcacaatgacattatggtacatgtggcaagttaaaacccaaagatccggagcattatgggacgtaccatcacccgcagcaacacaaaaagcggctttatcagaaggggtctacagaataatgcaaagaggattgttcggtaaaactcaagttggtgtagggatacatatggagggagtattccatacaatgtggcatgtcacgcgagggagtgtaatctgccacgaaacaggccgtttagagcctagttgggcagatgttagaaatgacatgatctcgtacgggggaggatggaggttaggtgataagtgggataaggaagaagatgtccaagtcctcgctatagagcctggaaagaacccaaagcatgtccaaacaaaacctggactctttaagacattaacgggagagataggcgcagtaactttagacttcaaaccaggaacatccggtagtcccataatcaatagaaaagggaaagttatcggactttacggaaacggagtcgtcacaaaatcaggagattacgtaagcgctattacccaggccgagagaataggcgaaccagattacgaagttgatgaagatatcttcaggaagaaacgattaacaataatggatttacaccccggagcaggaaaaacaaaacgaattttgcctagtattgtaagagaagctctgaaaaggagattacgtactttaatcctggcgccaacacgagtcgtggcggcagaaatggaagaagcactaaggggattaccaataagataccaaacaccggcagtaaaatcggaacacacaggacgagaaatcgtagatttaatgtgtcatgcaacctttactaccaggttgctttcatccacccgcgtccctaattataatctcatagtcatggatgaagcgcattttactgatccaagttcagtcgccgcacgtgggtatatcagcactagagtagaaatgggagaggccgcagcaatcttcatgacggcaaccccaccgggtgctaccgatccctttccgcaaagtaattctccaattgaagacattgaaagggagataccggagaggtcatggaacacaggattcgattggataactgattaccaaggtaaaacggtatggttcgttccatctattaaagcaggcaatgacatagcgaactgtctgagaaaaagcgggaaaaaggtaatacaactaagccgtaaaaccttcgacacagagtaccccaagactaagctaaccgattgggattttgtagtcactactgatataagcgaaatgggagcaaactttcgggctggaagagtgatagatccacgaagatgcctgaaacctgtcatcttaacagatggcccggaaagggtgattttggccggaccaatacccgtgacacccgccagtgccgcacaaagaagaggacggattggtcgaaacccggctcaagaagatgatcaatacgtattctcaggtgatcctctaaagaatgatgaagaccacgcacactggactgaagcaaaaatgttattagataacatatacacaccagaaggtatcatccccacactgtttggaccagaacgagaaaagacacaagcaattgatggagaatttcgattgagaggagaacaaaggaaaacgttcgtagagctcatgcggagaggggatttaccagtctggctgtcctataaagtcgcatctgcggggatctcatataaagatcgagaatggtgcttcactggagagcgtaataatcaaattctggaggaaaacatggaagttgaaatatggacaagagagggcgagaaaaagaaattacgccccaaatggctcgatgcaagggtatatgcggacccaatggctttaaaagattttaaagaatttgcatccggtagaaaatcgattacactagacatattaacggaaatcgcttcattgcctacatatctatcatcaagagcaaaactcgctcttgataatatcgtgatgctacacacaacagaacgcggtgggagagcatatcaacacgctttaaatgaattaccagaatccctggaaactctaatgttagttgcactgttaggtgctatgacggcggggatattcttgttctttatgcaaggaaagggtattggaaaactaagtatgggacttattacgattgctgtggcatctggtttactgtgggttgccgagattcaaccacaatggatagcagcgagcattatccttgagtttttcctaatggttctactcataccagaacctgaaaaacagcgtacaccacaagacaatcagttgatatatgtaatactgaccattcttacgataataggactaatcgcggctaatgaaatgggattaatagagaaaactaaaacagattttggcttctaccaggtaaaaacggaaacaactatattagatgtggacttgagaccagcgagcgcctggacactgtacgcggtagcgactaccatcttaacacctatgctccgccatactatagaaaatacttcagcaaacttgtcgctggctgctatagccaaccaagcagctgtcttgatgggtctaggaaaaggttggcccttacatcgtatggatttgggcgtacctctgctagcgatgggatgttacagccaagtcaatccgaccactctaacggctagcttggtaatgttacttgttcattatgcgattataggtccaggattacaagcaaaagctacacgggaagcgcaaaaacgaactgctgcgggaataatgaaaaatcctacagttgacggtattacagtaatagacctagaaccaatatcctacgatccgaaatttgaaaaacaacttgggcaagttatgctgctagtattgtgtgcaggccaacttttactcatgagaactacttgggctttttgcgaagtacttacattagccaccggtccaatactgacactatgggaagggaatcctggaaggttttggaatacgaccatagcagttagtacagctaacatctttagagggtcatacctagcaggcgcaggactagcgttttctttaatcaaaaatgcacaaaccccaagacgaggaacagggacagctggagagaccttaggagaaaaatggaaacgacaactcaactccctcgataggaaggaatttgaagaatataaacgtagcggcatacttgaggtggaccgaactgaagccaaatcagctctaaaggatggatcaaaaatcaaacacgcggtgtcgcgaggaagctcaaaaatccgctggatagtagaaaggggaatggtaaaacccaaggggaaagtggttgacctaggttgtggtagaggtgggtggtcgtactacatggcaacacttaaaaatgtgacagaagttaaggggtataccaaaggaggcccaggacatgaagaacctattccgatggccacttatggttggaatttagtgaaattacattcaggagttgacgtattttataaaccaacagagcaagtcgatactttactttgtgatattggcgaatcgtcgagtaacccaacaatagaagagggaagaaccctacgagtactaaagatggtagaaccatggttgtcatcgaagccggaattttgcattaaagtattaaacccatatatgccgactgttattgaagaattggaaaagttacaaagaaagcatggagggaatctagttaggtgccctctcagccgaaatagtacacatgagatgtactgggtttcaggagcaagtggtaatatagttagtagcgtgaatacaacttcgaaaatgctactgaatcgttttactacaagacatcgcaaacctacatatgaaaaagacgtagatctcggtgccggaacacgctccgtgagtactgaaatagaaaaacctgacatgacgataattggacgtaggctacaaagactacaagaagaacacaaagagacttggcattatgatcaagagaatccctataggacttgggcatatcacggatcctacgaggccccgagcactgggtctgcaagtagtatggtaaacggagtcgttaagctactgactaaaccatgggatgtaataccaatggtaactcaacttgctatgacagatacaacaccatttggacaacagcgggtattcaaggaaaaagtggacactcggacgcctcaacctaaacccggaacaagaatggtgatgaccacgaccgccaattggctgtgggcacttctaggcaagaagaaaaatccgaggttatgtacacgagaagagttcatctcaaaggttcgttcaaatgcggccataggagcggtcttccaagaggaacaaggttggacttccgcgtcagaagccgtcaatgacagtcgtttttgggaattagtcgacaaagaaagagccttgcatcaagaagggaaatgtgagtcatgcgtatataatatgatgggtaaacgcgagaagaaattaggagaatttggacgagcaaagggatcaagggcaatctggtatatgtggctaggagcgagatttctagagttcgaagctctgggctttttaaacgaggaccactggtttgggagggaaaattcttggagcggagtagaaggtgaaggtctacaccgacttgggtatatattagaagaaattgataagaaagatggagatctaatgtatgccgacgacacagctggctgggacacaaggattacggaagacgaccttcagaatgaggaattaatcactgagcaaatggcgccacatcataaaattttggcgaaagcaatatttaaactaacttaccagaataaagttgtgaaagtgctaaggcctacgcctagaggagctgtaatggatataatctcgcgaaaagaccaaagaggaagcgggcaggtaggaacatacggactgaatacattcacgaatatggaagtacagctaatacgacaaatggaagccgagggtgtgattacgcaagatgatatgcaaaatccaaaaggccttaaggaaagggttgaaaaatggctcagagaatgtggagtagacagactcaagaggatggccatatctggagacgactgtgtagtgaaacctctcgacgagcgatttggaacgtccttgctattcctaaacgatatgggaaaagtgagaaaagacatcccacagtgggaaccttcaaagggatggaaaaattggcaagaggtaccattttgctcccatcactttcataaaattttcatgaaggatggcaggagcctcgtagtaccctgcagaaaccaagatgagctaatcggaagggcaagaattagtcaaggagccggctggaatctccgcgagactgcatgcttgggtaaagcatacgcgcaaatgtggtcattaatgtatttccacagaagagacttaaggctagctagtatggctatatgctcagcagttcctacggagtggtttccaacatctagaaccacatggagcatacacgcgcatcatcaatggatgaccacggaagatatgttaaaagtctggaatcgtgtctggattgaagataatccaaacatgatagataaaacgccggttcacagctgggaggacataccctacctgggaaagagggaagatttatggtgtggttccctaattggtctaagttcaagagccacttgggccaaaaatatacataccgcaattactcaggtacggaatttaataggtaaagaagaatatgtggattacatgagtgtcatgaaacgatattcagctccctccgaatcagaaggagtattatga

SEQ ID NO: 23684 - RNA, 9867 nt, synthetic construct
  misc_feature 1..9867: note = derived and/or modified CDS sequence (opt6) from DENV-4__KJ596665__SS-prME
  source 1..9867: mol_type = other RNA
tctacaataactctactatgcctaatacctactgtaatggcgtttcatcttagtaccagagatggagaaccactaatgatagtcgcgaaacacgaaagagggcgcccattattatttaaaaccacggaaggaataaataaatgtactcttattgctatggatttgggggaaatgtgcgaagacacggtcacatacaaatgcccattgctagtaaataccgagccagaagacattgattgctggtgtaatctaaccagtacatgggtaatgtacggaacatgtactcaatctggagaaagacgtagagaaaaacgtagtgtagcgttgaccccacactcaggcatgggacttgagactagagcagagacatggatgtcctcagaaggcgcatggaaacatgcacagcgagtcgagagttggattttaaggaacccaggatttgcattgttagcagggttcatggcttatatgataggtcaaaccggtatccaaagaacggtgttcttcgttttgatgatgttagttgccccgtcatatggaatgagatgcgtgggggtcggaaaccgagactttgtagaaggtgtatcaggtggcgcatgggtcgacctagtccttgaacacggcgggtgcgtcacaaccatggcccaaggaaaacctacgttagactttgaattaactaaaaccactgccaaagaggtggcgctactgaggacgtactgcatagaggcattaatctccaatataactactgcaacacggtgcccaacgcaaggagagccgtatctaaaagaagaacaagaccaacaatatatatgtagaagagacgtagttgataggggttggggtaacggctgtggactatttggtaaaggtggggtggtaacctgcgccaaattcagttgtagtggtaaaattactggaaatttagttcaaattgaaaacctagaatatacagtggttgttacagtacacaacggagatacacacgcggttggaaatgacacatcgaatcatggagttactgccactattaccccgaggtcaccgtctgtggaggtaaaactacccgattatggtgaattaaccctagattgtgagccccgatcgggaatagattttaatgaaatgatcctaatgaaaatgaagaagaaaacttggctggtacataaacaatggttcctggacctgccattaccatggaccaccggagccgacacatctgaagttcattggaattataaggaacgcatggtaacgttcaaagtcccacatgctaaaaggcaggatgtcacagtattaggcagtcaagaaggagccatgcattcagcactagccggtgcaaccgaggttgattcaggagatgggaaccatatgtttgcggggcatctcaaatgtaaagtccgaatggaaaaactacgtataaaagggatgagttatactatgtgtagtggaaaattctcaatcgacaaagaaatggcggaaacacaacatggaacaaccgtcgtaaaggtaaagtacgaaggtgctggtgcaccatgcaaagttccaattgagattagagacgttaacaaagaaaaagtcgttggtcgagtaatctcagcaacccctctcgccgagaatactaactctgttactaatatagaattagaacctccgttcggagattcatatatagttataggtgtaggtaactctgctcttaccctgcactggtttcgcaaaggaagtagtataggaaagatgtttgaaagtacgtaccggggtgcaaagagaatggctatcttaggagaaacagcttgggatttcggttcagttggcgggttgtttacaagtttaggaaaagcagtgcaccaagtttttggcagtgtatacactacaatgtttggcggtgtctcttggatgataaggatacttataggatttttagttttgtggatcggtactaattctagaaatacatcaatggcaatgacgtgtattgcagtagggggaataactctatttttaggatttacagtacaggcagacatgggctgtgttgtttcgtggtctggtagagaacttaagtgtgggtcaggtatctttgtagtagacaatgtacacacatggactgaacaatataaatttcaaccagagagccctgctagattggcttccgcaatacttaacgcccataaagacggggtttgcgggattcgctctacgacacgtttggagaacgtgatgtggaaacagattactaatgaactaaattacgtgctctgggagggcggccatgatttaacagtggtagcaggagacgtaaaaggtgtattaacaaaaggtaaaagagctttaacgccacccgcgagtggtctcaaatattcctggaagacatggggcaaagccaaaatattcacaccagaagccagaaattctacgttcctgatagatggacctgacacctcagagtgtccgaatgaaaggagagcgtggaactcatttgaagtcgaagactatggatttggaatgtttaccacaaatatatggatgaaattcagagagggttctagtgaagtatgcgatcatagactaatgagtgcggcgattaaagatcaaaaggctgtgcatgctgatatgggttattggattgaaagtagcaaaaatcaaacctggcaaattgaacgagcgagtctaatcgaggtaaaaacatgtttatggcctaaaacacatactttgtggtcaaatggagtcttggagagtcaaatgttgataccgaaatcctatgcaggaccattcagccagcataattatagacagggttatgcgacgcaaacagtaggtccgtggcacttgggaaaactcgaaatcgattttggagaatgtcctggaactactgtcacaattcaagaaaactgcgatcacagaggcccctctctaagaacgaccacggcctctggaaaacttgtcacacaatggtgctgcaggtcctgcacaatgccacctcttcgctttcttggagaagacgggtgttggtatgggatggaaataagaccgttaagtgaaaaggaagaaaatatggtaaagagtcaggtaactgcagggcaaggaacttcagaaacattttccatgggtctactatgccttacattatttgtcgaagagtgcttgagacgtagagttactaggaaacatatgatcttagcagtagtgataaccttatgcgcgataatacttgggggattaacgtggatggatctattaagggcgctgataatattaggagatacaatgagtggccggattggaggccaaacacacttagctattatggcggtcttcaagatgagtccaggttatgtattaggtgtatttctccgaaaacttacttcacgtgaaacagccttgatggttataggaatggcaatgaccacaacattatcaattccacatgacttgatggaattgatcgacggaatcagtttgggattgattctattaaaaatagtaacccaatttgataatacacaagtgggcacactagctctcagtttaacttttatacgttccactatgtccctagtgatggcatggcgaacaataatggctgttttatttgtcgtcacactaattcctttatgtcgaacatcttgtttgcagaaacaaagtcactgggttgagataacagcactaatattaggagcgcaagcattaccagtctatttgatgacattaatgaagggggcaagccgacgatcatggccgttaaacgagggcattatggcagttggtttagtttcgctactaggttccgcgcttttgaaaaacgacgtaccattagctggtcccatggtagctggaggtttattactagccgcatatgtcatgtcaggcagctcggctgacttaagcctagagaaggcggcaaacgtgcaatgggatgaaatggcagatataacgggcagctccccaattatagaggttaagcaagatgaagacggtagcttttctatacgcgacgttgaagaaaccaatatgataactttactggtcaaactagccttaattacggtaagcggattatatccattagctatccccataacaatgactctttggtacatgtggcaggttaagacacagcggagtggtgcattatgggatgtaccaagccccgctgcgacccagaaggcagccttaagcgaaggagtctatagaattatgcaaagaggattatttgggaagacgcaggtaggtgtcggtattcatatggaaggcgtttttcacactatgtggcatgttaccagaggatctgttatatgtcacgagactggaagattagaaccttcgtgggcagacgtacgaaatgacatgatctcatacggcggcggatggagactaggtgacaaatgggataaagaagaggatgttcaagttttagcgatagagccaggtaaaaatccgaagcatgttcaaaccaagccgggactatttaagactctcactggcgagattggagcagtaacgttagacttcaaaccaggaacaagtggctccccaatcataaatcgaaaaggtaaggttattggattatacggcaatggtgttgttaccaaaagcggcgattatgtcagcgctataacacaggctgaaaggattggagagccggactacgaagtagacgaggacatatttagaaagaaaagattaaccattatggatttgcatccaggagcgggaaaaacgaaaagaatacttccatcaattgtaagagaagcattaaaaagacggcttcggactctcatattagcccctacaagggttgtagcagcagaaatggaggaggcacttagagggcttcccattcgatatcaaactcctgctgtaaaaagtgagcatactggcagggaaatagttgacctcatgtgtcatgcgacttttacaaccagattattatcttcaacgcgagtacctaattacaatttaattgttatggacgaggcacacttcactgatccaagttcagtggctgccagaggatatatttcaacacgggtggagatgggtgaagccgcagcaattttcatgacagcaacaccaccgggggcaactgatcctttccctcaatcaaactctcctatcgaagatattgagcgagaaattcccgaacgctcttggaacacaggatttgattggataacagattatcaaggtaaaactgtatggtttgtaccgtctataaaagctgggaacgacatagcaaactgtctgcgaaaatcgggcaagaaagtaatccaattatctagaaaaacctttgatacagaatacccaaaaacaaaattaactgattgggacttcgtagtgacaaccgacataagtgaaatgggagcaaatttcagagcaggccgtgtcattgacccacgtcgttgtttgaaacctgtaattttaaccgatggaccagaacgagtgatactagccggccctataccggtgactccagcgtctgcggctcaacgacgagggagaatcggcagaaatcctgctcaagaagatgatcaatatgtcttcagcggagatccacttaaaaatgacgaggatcatgcccactggacagaggctaagatgcttcttgacaatatatacacacccgaaggtataattccaacactctttggaccagagagagagaaaacacaagctattgatggcgaatttagacttagaggagaacaaaggaaaacattcgttgagctgatgcgacgaggagatctgccagtgtggctaagctataaagtcgcatcagcaggtatctcatataaagaccgagaatggtgttttactggtgaacgaaacaaccagattctggaggagaacatggaggttgagatatggacaagagaaggtgagaagaagaaactcagaccaaaatggcttgacgcgcgagtatatgccgacccaatggctctcaaagattttaaggaatttgcttcgggaagaaaatcaataaccttagacatccttacagaaattgcatccttaccaacgtacctttcatccagggcaaaattagctttggacaacattgtaatgctacatacaactgaacgaggcgggcgagcctaccaacatgccttaaatgaattgcctgagtctttagaaactttaatgctggtcgcccttcttggtgctatgacggcaggtatttttctattctttatgcaaggcaaaggaataggtaaactcagtatgggcctaataacgatagctgttgcttctggtctcttatgggttgcagaaatacaaccacaatggattgctgcctcgataatcttagaatttttccttatggtattactaattccagaaccggagaagcaacgaacacctcaagataatcaactcatctacgtgatacttacaatacttactattataggtctaattgcagcgaatgaaatgggattaattgagaaaacaaaaacagattttggcttctatcaagttaaaaccgagacaacaattcttgatgtcgacttgcgtcctgcaagtgcctggactttatacgcagtagcaactacaatacttacacccatgctacgtcataccattgaaaatacttcggcgaatttgagtctagcagcgattgccaatcaagcggcggtactcatgggtttaggcaaaggttggccactacacagaatggatttgggggttcctcttctagcgatgggttgctattctcaagtgaacccaacaacgcttaccgcttccctagtaatgctcctagtacactacgccataatagggcctggtctacaagcaaaggcaacacgcgaagctcaaaaacggactgctgcaggaataatgaaaaatccaacagtggatggcatcacagtcattgacttggaaccgatatcttacgacccaaaattcgaaaaacaattaggacaagtaatgctcctagttctttgtgcgggtcaacttttgcttatgcgtacgacgtgggcattctgcgaagtattaacccttgcaacaggaccaatcttaacactatgggaaggaaaccccggaagattttggaacaccactatcgccgtctccacagcaaacatctttcgcggttcttacttagctggtgcaggtttagcattctcgctgatcaaaaatgcccaaactcctcggagagggactgggaccgcaggagaaacattaggtgaaaaatggaaacgccaattaaatagcttagaccgcaaggagtttgaggaatataaaagaagcggaattttggaagtagacaggactgaagccaaatcagctctgaaagatggatcaaaaataaagcatgctgtatcaagggggagctcaaagattcgatggatcgtagaacgaggtatggttaagcctaaaggaaaagtcgttgacttaggatgtggaagaggaggttggtcttattacatggctaccctgaaaaatgtgacggaagttaaaggatacacaaagggaggtcccggccacgaggagccgataccgatggccacatacgggtggaatttagtcaaattgcatagtggtgtcgacgtattctacaagcctacggaacaagttgatacacttctatgcgacattggagaaagctcaagcaatcccactatcgaggaggggcgaacgttaagagtgttaaagatggtggaaccatggttaagtagcaagccagaattttgcatcaaagttcttaacccgtacatgccgactgttatcgaagaactcgaaaagctacaaaggaaacatggcggcaatttagttaggtgccccctatctagaaatagtactcatgaaatgtattgggtatcgggagcatcaggtaatatcgtatcatccgttaacacaacaagcaaaatgcttttgaatcgcttcacgactcgtcatagaaaaccaacttacgaaaaagatgtggaccttggcgcaggcacacggtcagtgagcacagaaactgagaaacccgacatgaccataataggaagacgcttacaaaggctccaagaggaacataaagagacttggcattacgatcaagagaatccgtatagaacttgggcgtatcatggtagttatgaagctccatcaactgggagtgcgagctcaatggtaaacggagtagttaaactgctaactaaaccttgggacgtaataccaatggtcactcaactagctatgactgacacgactccatttgggcaacaacgtgtcttcaaagaaaaagttgacactcgaacaccccaacctaaacccggcaccagaatggttatgacaacaacggcaaattggctctgggcgctcctaggaaagaagaaaaacccgagactctgcacgagagaagagttcataagtaaagtccgctccaatgcagcaataggagcagttttccaagaggaacaaggatggacttctgcaagcgaggctgtaaatgactcccgattttgggagctagtagataaagaacgtgcactacatcaagaaggaaaatgtgaaagttgtgtatataacatgatgggtaaaagagagaagaaattaggagagtttggccgcgcaaaaggctctcgagcaatatggtatatgtggctgggagccaggtttttagagttcgaagcattaggatttctaaatgaagaccactggtttggtagagaaaattcatggtcaggtgtagaaggtgaaggtttacaccggctcggatatattttggaagaaatagataagaaagatggagatttaatgtatgcagatgatactgcgggatgggatacaagaataaccgaagatgatttacaaaatgaggaactaattaccgagcaaatggctccgcatcataaaatactggcgaaagccatatttaaactaacttatcaaaataaagttgtcaaggtcttgcgtccaacaccgagaggagcagtaatggacattatatcaagaaaagaccaaaggggatcaggacaggtcggaacgtatggtctaaacacatttacaaatatggaggtgcaactaataagacagatggaagcggagggagtaataacccaagacgacatgcagaatccaaagggtctcaaagaaagagttgaaaaatggctaagagagtgtggagtggatcgactcaagagaatggcaatatctggagatgactgcgttgtgaaaccattggatgaaagatttggtacatcactacttttcctaaacgacatgggcaaagtaaggaaggacataccacaatgggaaccctctaaagggtggaagaattggcaagaagtcccattttgttcacaccactttcacaagattttcatgaaagatggaagatcattagtagtaccgtgtagaaaccaagatgagttaattggcagggcgagaatctcacaaggcgcaggctggagcctcagagaaactgcatgcttgggaaaggcttatgctcaaatgtggagcctgatgtatttccacagaagagatctacgattggcctccatggcaatctgttcagctgttcccaccgagtggtttccaacaagcaggacaacttggtcaatacacgctcatcatcaatggatgactacagaaaatatgttaaaggtctggaatcgggtgtggattgaggataacccaaatatgattgacaagacgcctgtccattcttgggaggacatcccctacctaggaaaacgtgaagacctgtggtgtggttcacttattggcttgtccagtagagctacgtgggccaaaaatatacataccgccatcacacaagtaagaaacctcataggtaaggaagaatatgtagactatatgccggtaatgaaaagatatagcgctcctagtgagagtgaaggagtgctttga

SEQ ID NO: 23685 - RNA, 9867 nt, synthetic construct
  misc_feature 1..9867: note = derived and/or modified CDS sequence (opt6) from DENV-4__KJ596668__SS-prME
  source 1..9867: mol_type = other RNA
tcgacaattactcttctttgcttaatacccactgttatggcatttcatctatctactagagatggagaaccattaatgatagttgcaaaacacgaaaggggaaggcccctgctatttaaaacaacagaagggataaataaatgcactctaatagcaatggacttaggcgaaatgtgcgaagatacagtaacttataaatgtcctttactggttaatacagaaccagaagatatagactgttggtgcaatctaacatcaacctgggtgatgtatggtacgtgtactcaaagcggcgaaagaaggcgcgagaaacgtagtgttgcattaacgccacatagtggtatgggattagaaacaagagcagaaacgtggatgtcctctgaaggtgcatggaaacacgcacaacgggtagaatcgtggatattaagaaacccaggcttcgcactattagcaggttttatggcgtacatgattggtcaaacgggcatacaaagaacagttttctttgtcctgatgatgctagtagcaccatcatatggaatgcgttgtgtcggggtaggcaatcgagacttcgtagaaggtgttagcggcggggcttgggtggacttggtgttggaacatggaggctgtgtaactaccatggctcaaggaaaaccgactctagatttcgaactaacaaaaacaaccgctaaagaagtcgctctattgcgcacttactgcatagaagccctaatatcaaatataactacggctacgcggtgtcccacccaaggtgaaccatatttaaaagaagaacaagatcagcagtatatatgtcgaagagatgtggtagataggggatggggtaacggctgtgggttgttcggaaaaggaggtgtagtaacgtgtgccaaattcagctgctctggaaaaataaccggtaatttagtacaaatagagaatttagaatatactgtcgtggtcactgttcataacggtgatactcacgcagttggaaacgatacatcaaatcatggagtaacagctacaataacacccaggagtccgagtgtagaagtaaaattaccggattatggagaattgaccctagactgtgaacctagaagtggaatagatttcaacgaaatgatactcatgaaaatgaagaagaaaacttggttagtacataaacagtggttcctcgacttaccgcttccgtggactacaggtgcggataccagtgaagtgcattggaattataaagagagaatggtgacattcaaagtacctcacgctaaaagacaggacgtaacggttttaggatcacaagagggagctatgcatagtgcgctagcaggcgcaactgaagtagatagtggagatggtaatcacatgtttgcaggtcacttaaaatgtaaggttagaatggaaaagttaagaattaaagggatgagctacactatgtgctcaggaaagttcagcatcgacaaggagatggcagaaacccaacacggaacaactgtagttaaagtgaagtacgaaggtgccggtgcaccatgtaaagtccccatagagatacgagacgtaaataaagaaaaagttgtggggcgagttataagcgctacaccattagcagaaaacaccaacagcgtaaccaatatagaacttgaacccccatttggagattcgtatatagtgatcggagtgggcaactcagccttaactttacactggttccgaaagggatcaagtatcggcaaaatgtttgaaagtacttaccgtggggctaagagaatggccattctcggcgaaacagcatgggatttcggatccgtgggcggtttgtttaccagtctaggaaaagcagtgcatcaagtatttggtagcgtatatacaacaatgtttggaggagtctcatggatgataagaatactaataggatttctagtactatggataggtacaaactctcgtaatacatccatggcaatgacctgtatagccgtaggtggaatcactctatttctgggcttcacagtgcaggctgacatgggatgtgtcgtttcatggagtggtcgggaactaaagtgcggtagtggcattttcgtagtggacaacgtacatacttggaccgaacagtataaatttcaaccagaaagccctgcaagacttgcgtcagcgatacttaatgcgcataaagacggtgtgtgcggcatacggagcactaccagactcgagaatgtcatgtggaaacaaataacaaatgaacttaattacgtgctatgggagggaggacacgatttgacggtagttgccggtgatgtaaagggagttcttactaaaggcaaaagagccctaacaccacccgcgtcggacctcaaatattcatggaaaacatggggaaaagcgaaaatatttacacctgaagctcgtaattcaacatttttaattgatggccctgacaccagcgaatgcccaaatgaacgcagagcttggaatagtttcgaagtagaagattatgggtttggtatgttcacgacaaatatttggatgaagttcagagaaggttctagtgaagtatgcgaccaccgattaatgtctgcagcaataaaagatcaaaaagcagtacacgcagacatgggttactggatcgaatcaagcaaaaatcaaacatggcaaatagaacgagccagcttaatcgaggttaaaacatgtctatggccgaaaacgcacacactatggagtaacggagtattagagtctcaaatgttaatacctaaatcatatgcgggcccattctcccagcataattaccgacaaggttatgctacgcagacagtaggaccatggcatctagggaaattggaaattgattttggtgaatgtcccgggacaacagtcacaatccaagaaaactgcgatcacaggggcccctccctaagaaccaccaccgctagtggtaaattagttactcaatggtgttgtagatcttgcactatgcctccacttagatttttgggcgaggacggttgctggtatggtatggaaatccgaccacttagcgaaaaagaggaaaatatggttaagtcgcaagtcaccgcgggacaaggaacttcagaaactttctcgatgggcttattatgcttaaccctatttgtagaggaatgcctacggaggcgggtaaccagaaaacatatgattttggcggtagtaatcacgctatgcgcaattattttagggggcctaacttggatggacctactcagggcactaattatattgggtgatacaatgagcggtagaataggcgggcaaacacatctcgccattatggcagtatttaaaatgagccctggatatgtattaggagtatttttaagaaaacttacctcaagagaaactgctttaatggtaatagggatggctatgaccacaactttatcaattcctcatgatttaatggaattaatagacggcataagcctaggtctaatactcctaaagatagtcacacagttcgataacacacaagtaggcacactggcgctatcactaacctttataaggtcgacgatgagcttagtcatggcttggagaactatcatggcagttcttttcgtagtaacgctcatccctctatgcagaacttcatgtcttcaaaagcagtcacactgggttgaaataacagcacttatcctgggcgctcaagcattgccggtatatctaatgactctgatgaagggagcgagcagaaggagttggcctctaaacgaaggaattatggcagtaggattagtatcactccttgggtccgcactgttgaaaaatgatgtccctctagcaggacctatggttgccgggggattactgttggcagcatatgttatgtcaggatcttcagcagatctctcactagaaaaagcagcgaatgttcagtgggacgagatggctgacattaccggatcttcgcccatcatagaagttaagcaagatgaagatggcagtttctcaatcagggatgttgaagaaacaaacatgataacactgcttgttaaacttgcactaataacggtcagcgggctatatccattagcgattcccgtcacaatgaccctctggtacatgtggcaagttaaaacccaacgaagcggcgctttatgggacgtaccaagtcccgctgcaacacaaaaagctgctttgtcagaaggtgtctatagaataatgcaacggggtttgtttggaaaaactcaagttggagttgggatacatatggagggagtttttcacacaatgtggcacgttactagaggtagcgtaatctgtcatgagacaggccgactcgagccctcatgggctgacgttagaaacgatatgattagttatggaggaggttggcggcttggagacaaatgggataaggaagaagacgtacaagttctagcaatagaacccggcaaaaatccaaaacatgtgcaaactaaaccagggttatttaaaacactaactggtgaaattggtgcagtaacattagatttcaagccgggtacatctggcagtccaattattaataggaaagggaaagtgattggtttgtacggaaacggggtggttacaaagtccggcgactatgtcagtgccattacacaagcggaaagaatcggggaaccggattacgaagtagatgaagatatcttccgcaaaaagagattgactattatggacttacacccaggggcaggtaaaacgaaacgaatacttccgagtattgtaagagaagcattaaaaagaagactgaggacgctcatattagcaccgacgagggtggttgctgcagagatggaggaagcgttgcgaggcctacccatcaggtatcaaacaccagcagttaaaagtgaacacacgggaagagaaatagtggatttaatgtgtcacgcgacattcacaactagacttctcagtagcacaagagtacccaattataatctaattgtcatggacgaagctcattttacagacccaagtagcgttgccgcgcgcggatatatttcaacgcgggtagagatgggggaggcagccgcaatttttatgacggctacgccaccgggtgccactgatccattcccacagtccaatagccctatagaggatattgagagagaaatccccgaaagatcatggaacactggtttcgattggataacagactatcagggtaagactgtatggtttgtgccatccattaaggctggtaatgacatagcgaactgtttgagaaaatcaggtaagaaagtaattcagcttagtcggaaaacattcgatactgaatatccaaaaacaaaactcaccgactgggactttgttgtaacgacagacatatcagaaatgggtgcgaacttccgtgcaggccgggtaatagacccaagacgatgcttaaaacccgtgatccttaccgacggccccgaacgagtgattctagccggaccgattcccgtaacccctgcatctgccgctcagcgaagaggacgaatcggaagaaatccggcccaagaggacgaccaatacgtatttagcggggatccactcaaaaacgatgaagaccatgcacattggaccgaagcaaagatgctcttagataacatatatacaccggagggcataattcctacattatttggcccagaaagagagaaaactcaagcaattgacggagagttcagattacgaggcgaacaacgcaaaacattcgtcgagttaatgagaagaggagatcttcctgtatggttgtcatacaaggtagcctcggccggtatatcatacaaggaccgggaatggtgcttcaccggggaacgaaataaccagatactagaggaaaatatggaagtggaaatttggactagagaaggcgaaaagaagaaattgaggcctaaatggcttgatgctagagtctatgcagatccaatggcactcaaggattttaaagagttcgcatctggccgaaaaagtataacgcttgatatacttactgaaatagcctccttacccacttatttaagttcgcgggctaaattagccttggacaacatagtaatgctacatacaacagaacgaggcggacgagcctatcaacacgctttaaatgaattacctgagagccttgaaacactaatgttagtagccttattaggggctatgactgcagggatattcctattcttcatgcaaggaaaaggcattgggaaacttagcatgggtctaataactatcgcagtagcatcaggattactatgggttgccgagatacaacctcaatggattgcggcatcaattatattagagttctttctgatggtgcttctgataccggaaccagaaaaacagagaacaccacaagacaaccaattaatttatgtaatcctaacaatattgacaataataggacttattgcagcaaatgagatggggttaatcgagaaaacaaaaacagactttgggttctaccaggtaaagactgaaactacgatacttgacgttgatttgcgtccagcgagtgcatggacattatacgctgtagcgacaacaatattgacaccaatgcttcgacatactatagaaaatacatcagcgaacctatctcttgcggccatagcaaaccaggctgctgtactcatgggtctcggaaaaggctggccccttcatagaatggacttaggtgttcccctattagccatgggatgttactctcaagttaatccgacgacacttactgcctcactcgtcatgctcttagtgcactacgccataattggacccggtttgcaagcgaaggcaactcgagaagcacagaaaagaacagctgccggtatcatgaaaaacccaacagtagatgggataaccgttatcgatctagaacctatttcctacgatccgaaatttgaaaaacaacttgggcaagtaatgctgctagtactttgtgctggacaattactacttatgagaacaacatgggcattctgcgaggtgttgacgttggcaacaggccctattcttaccctatgggaaggcaatcctggtcgattttggaatacgactatagcagtgtcaacagcaaatattttccgagggagttatcttgctggagctggactggctttttcgctaattaaaaacgcacaaaccccacgtagaggaaccgggacagctggggaaacgttgggagaaaagtggaaacgacaattaaatagtctagatcgaaaggagttcgaggagtataaacgctctggcatcttagaagttgatcgaaccgaagccaagagtgcattaaaagatggttctaaaataaaacatgcagtaagtcgaggctcgtcaaaaattcgctggattgtagaaaggggaatggtcaagcctaagggaaaggtggtggacctaggttgtggtcgtgggggctggagctattacatggctacactgaagaatgtcacggaagttaagggctacacaaaaggtggcccaggacatgaagaaccaatacccatggcaacatatggatggaatttagttaaactacattcaggcgtcgacgtgttctacaagcctacagaacaagtggacacattactctgcgatataggcgaaagcagcagtaatccaacaatagaagaaggccgcaccttaagggtacttaaaatggtggaaccttggttaagcagcaaacccgaattttgtatcaaagtactaaacccatatatgccaacagtcattgaagaattggaaaaattacaacgcaagcacgggggaaacttggtaagatgtcctctatctcgaaacagtacacatgaaatgtactgggtaagtggtgcgagtggaaatattgtatcctcggtaaacaccacaagtaaaatgctattgaatagattcaccactaggcacagaaagccaacatacgaaaaagatgtagacttgggagccgggacgaggtctgtaagcacagagactgagaaacctgatatgactatcataggaagacggttacagcgactacaggaggaacataaggagacctggcattatgatcaagaaaacccttatagaacttgggcgtaccatgggtcatacgaagcaccgtctacaggctcggcatcctccatggtgaatggagtagtgaagctgctcacaaaaccatgggacgttataccgatggttactcaattagcaatgacggacactacacctttcggccagcaacgagtatttaaagaaaaagtagatactagaacccctcaacctaaaccaggaactcgtatggtaatgacaactacagctaactggttgtgggctttgcttggcaagaagaaaaacccaaggctttgtactcgtgaagagttcataagtaaagtaaggtcaaatgcggcaataggtgctgttttccaagaagaacaaggatggacgagtgcaagtgaagcagtgaatgacagtagattttgggaacttgttgataaagagagagctctacatcaagaaggaaaatgtgaatcatgcgtatataatatgatggggaagcgagagaagaaactaggcgagttcgggagagcaaaaggttcaagagcgatatggtatatgtggcttggggcaagatttctagagttcgaagcattaggatttctaaatgaagatcattggtttggccgtgaaaactcttggagtggagtagagggtgaaggcttgcacagattaggatatatattagaagaaatcgataagaaagatggagacttaatgtacgcagatgataccgcagggtgggatacacgtataacagaagatgatctacaaaatgaagagttaataacagaacagatggccccgcatcataaaattttggcgaaagcaatttttaaacttacctatcaaaataaagtggtcaaagtcctacgtcccacgcctagaggcgcagttatggacattatttcacgtaaggaccagcgtggttctggccaagttgggacttacggtctgaacacattcaccaacatggaagttcagttaattagacaaatggaagccgaaggggtaattacacaggatgatatgcaaaatccaaaaggtctgaaagaaagagtcgaaaaatggttaagagaatacggtgtagatagactaaaacgaatggcaatctcaggggatgactgtgtggtaaaaccattagacgagcgattcggcacatctcttttgtttctcaacgatatggggaaagtgagaaaagatatcccccagtgggagccatccaaagggtggaagaactggcaagaagtaccgttttgctctcatcattttcataagatatttatgaaagatggtaggagtctcgtagtaccgtgcagaaatcaagacgaactaataggtcgtgctcgcatctctcaaggggcagggtggagcctaagagaaactgcctgcctaggtaaagcctacgcacagatgtggagtttaatgtattttcacagacgagacctacgacttgcttcaatggccatttgttccgcagtgccaacagaatggtttccgacgtcgcgcacaacatggagtatccacgcgcaccatcagtggatgacgactgaagacatgctaaaagtctggaatcgtgtttggatcgaagataatcctaatatgatagacaagacgccagttcattcctgggaagatataccctatctcgggaagagagaagacctctggtgcggatcacttatcggtttaagctctagagctacttgggccaaaaatatacacactgcgataacgcaagtgagaaaccttattggaaaagaagaatatgtggattacatgcccgtaatgaagagatatagtgccccaagtgagtccgaaggtgtactgtaa

SEQ ID NO: 23686 - RNA, 9867 nt, synthetic construct
  misc_feature 1..9867: note = derived and/or modified CDS sequence (opt6) from DENV-4__KJ596670__SS-prME
  source 1..9867: mol_type = other RNA
agtactataactttactatgtctaataccaactgtgatggcttttcacctatctacgagagatggagaacctttaatgattgtggcaaaacatgaaagagggagaccgttgttattcaaaacgactgagggtattaacaaatgtactctaattgctatggacttgggagaaatgtgcgaagatacagttacatataaatgtccccttttggtaaataccgaacctgaggatatcgactgctggtgcaatcttacaagtacttgggtaatgtatggaacttgcactcaaagtggcgaaaggagacgggagaaacgaagcgttgctttaaccccgcactcaggtatgggattagaaacacgagcggagacatggatgtctagtgaaggtgcttggaaacatgctcaaagggttgaaagttggattcttagaaatccgggattcgcgctattagctggttttatggcatatatgattggacaaacaggtattcaaaggactgtgttctttgtcttgatgatgcttgtagcacccagctacggtatgagatgcgtgggagtaggcaatcgcgattttgttgagggagtttctggtggagcttgggttgaccttgttctcgaacacggaggatgtgtcactactatggcgcagggcaaaccgaccctagattttgaattaacaaaaaccacggctaaggaagtagcactattaagaacatattgcatagaagccttaattagcaacataacaacagctactagatgtccaactcaaggggagccttatcttaaagaagaacaagaccaacaatacatttgtagacgggatgtagttgatcgaggctggggaaatggttgcggtttgtttggaaaaggaggtgtagtgacgtgcgccaaattttcatgttccggcaagatcacgggaaacttagtccagattgaaaacctcgaatatacggtagttgtcacagtacataatggagacacccatgcagtgggtaatgatacctctaatcatggtgtaaccgccactattacccctagatcgccatcagtagaagtgaaactgccagactatggtgaactaacgctcgactgcgaaccaagatcaggaatagatttcaatgaaatgatcttgatgaaaatgaagaagaaaacttggttagtccataagcaatggttcttagatttgccattgccttggacaactggagctgacacatccgaagtacactggaactataaagaacgcatggtcacttttaaagtgccccacgcgaaaaggcaagacgtgactgtgctgggttcacaggaaggtgcaatgcatagtgcattagcgggcgcaaccgaagtagactccggtgacggaaatcacatgtttgctggccacctaaaatgtaaggttaggatggaaaagttgaggataaagggaatgtcttatactatgtgttcaggaaagttctcaattgataaggaaatggctgaaacacagcatggaacaacagtggtaaaagtgaaatatgagggcgctggggcgccatgtaaagttccaatcgaaattagggatgtgaataaggagaaagtcgttggcagagtaatatcagctactccattagcagagaatacaaatagtgtaacaaatattgaactagaacctccttttggggatagttacatagttataggagtggggaactcagcattaactttacactggttcaggaagggatcttctataggtaagatgttcgaatcaacgtataggggtgccaaacgaatggctatattaggtgaaactgcttgggatttcggaagtgtagggggattgttcacatcgttaggtaaagctgtacatcaagtgtttggatctgtatacacaacaatgtttggaggcgtatcgtggatgatacgaatccttatcggattcctggtactgtggattgggacaaactcaaggaatacctcaatggcaatgacctgcatagccgttggtgggattacccttttcttaggattcacggtgcaagccgacatggggtgtgttgttagctggtcaggtagagaattaaaatgcggttccggaatattcgtagtagacaatgtacacacttggaccgaacagtataaatttcagcctgaaagccccgccaggcttgctagtgcgatactaaatgcgcacaaggatggcgtatgtggtattagaagcactactcgtctagaaaatgtcatgtggaaacaaataacaaatgaattaaattatgttttatgggagggtggacacgacttgacagtagtagccggtgatgtaaaaggagttcttactaaaggtaaaagagcactaacgcctcctgctagtgatttaaagtactcatggaagacatggggtaaggcaaaaatattcacacctgaagcaagaaacagcactttcttaatcgacggaccggatacatctgaatgcccaaatgagagaagggcttggaactcctttgaggtggaggactatggattcggaatgtttacaaccaacatttggatgaagtttagggaagggagtagtgaggtttgtgaccatagattaatgagtgctgcaataaaagatcaaaaagcagtccatgccgatatgggatactggatcgaatcgtctaaaaatcaaacatggcaaatcgaaagagcatctctaatagaagtgaaaacttgcctttggcccaaaacacatacattatggtccaatggcgtcttagaatctcagatgctcatcccaaaatcgtatgcaggaccattctcgcaacacaactatagacagggttacgcaacgcagacagtcggtccctggcatttaggaaaattagaaatcgattttggcgaatgccctggtacaactgtaaccattcaagaaaactgtgaccacagaggaccgtccttgcgtacgactacagcatccggtaaactggtaacacaatggtgttgcaggtcatgcacgatgcctccactgcgttttctaggagaagatggctgttggtatggaatggagattcgtccgctctccgaaaaagaagaaaacatggttaaaagccaagtaaccgcaggacaaggtaccagcgagacattctcgatgggtttactatgtttaacgttatttgtcgaagagtgtttgcgacggagggttacgagaaaacatatgatactagctgtagttataacactatgcgcgatagtgctaggaggactcacatggatggatttattgcgagccctcattatgcttggagacaccatgagtgggagaatcggagggcagacgcatctagctataattgccgtgtttaaaatgtcgccagggtatgtactaggtgtatttttacgtaaattaacatcgcgagaaactgccttaatggtcatcggaatggccatgacaaccactttaagcataccgcacgatctcatggagctaatagacggtataagcctaggacttatactactaaagatagttacgcaatttgacaatacacaggtaggaactctcgctttatcgctaacatttatacgtagcacaatgagtctggtcatggcatggagaacgataatggccgtactatttgtagtaacacttatccccttgtgcaggacatcatgcttgcaaaaacaaagccattgggtagaaattacggccctcattcttggagctcaagcgctaccagtatacttgatgacactgatgaagggtgcttctcggcgctcatggccacttaacgaaggaatcatggcggttggattagtaagtttactcggaagcgcactattaaagaacgacgtaccactagccggtcctatggtggcaggaggacttttattggcggcatatgttatgagcggtagttcggcagacctaagtcttgaaaaagcagccaatgttcaatgggacgagatggctgacatcaccggttcaagccccattatagaagttaaacaagacgaggacggatcattcagtattcgtgatgtagaagaaaccaacatgataaccctcttggtgaaattagcactaataactgtctcaggtctataccctttagccataccaataacgatgacgttatggtacatgtggcaagtaaaaacgcaaagaagcggagcgttatgggacgttccaagccctgcagctacgcagaaagccgccctatccgaaggtgtgtatcgaatcatgcaaaggggtctatttggaaaaactcaaattggcgtgggtattcacatggagggcgtgtttcatacaatgtggcatgttacacggggatccgtaatctgccacgagactggaagactagagccatcttgggcagatgttagaaatgacatgatttcttatggcggagggtggagattaggggataagtgggacaaagaagaggacgttcaagtactagcaatagaacctggcaaaaacccgaaacatgtacaaaccaaaccggggttatttaaaacactaacaggagaaatcggagcagtgactctggattttaaaccggggacatccggcagcccgataataaacagaaaaggcaaagtaatcgggttatatgggaatggagtagtcactaaaagtggagattatgtatcagctattacgcaagcggaaaggattggggagcctgattacgaagtagatgaggacatctttagaaagaaaaggctgaccataatggacctacaccccggggcaggtaaaacaaagaggattcttccatcaatagtgcgtgaagcattaaaacggaggttaagaacacttattctcgctcctacccgcgtagtagctgcggaaatggaggaagcattaagagggctacctattaggtaccagactccggcagttaagtcagagcatacagggagagagattgttgaccttatgtgtcatgctacatttacaacgcgattgttaagcagcacccgcgtgcccaattataatttaatcgttatggacgaagcacatttcactgatccttccagcgtagcagcgcgaggatacattagcactcgcgtcgaaatgggagaagcagcagcgatatttatgacagcgacgcctcccggtgctactgatcctttcccccaatcaaactctccaatagaagatatagaaagagagatacctgagagatcttggaatacgggatttgattggatcaccgattatcagggcaaaactgtctggttcgtcccgtcaattaaggcaggaaatgatatcgccaactgtctgagaaaatctggcaagaaagtcatacaacttagtagaaaaacctttgatacggaatatccgaagacaaaacttaccgactgggactttgtcgtcactacagatatatctgaaatgggagccaattttagagcgggaagagtcattgatccacgacgctgtctaaagccagtcattttaactgatggacccgagcgagtaatattagctggaccaatacccgttacccctgccagtgcagcacaaaggcgcgggagaataggaaggaaccctgcccaagaagatgaccaatatgtattctcaggcgatccattaaagaatgacgaagaccatgctcactggacagaagctaagatgcttttggacaatatttatacgccggaaggtatcatccctacattatttggaccagaacgggagaaaacccaggctatagacggagaatttcgactcagaggcgaacagagaaaaacctttgtagaacttatgagaagaggggatttacctgtctggctatcatataaagttgcatctgctggcataagttataaagatagagagtggtgttttacaggcgagcgaaacaaccaaatccttgaagagaatatggaggtggaaatatggacccgtgagggcgagaagaagaaattacgcccgaaatggttggatgctagggtttatgctgaccccatggcactaaaagactttaaagaatttgcaagcggccgtaaaagcattacattagacattcttactgaaattgcctcactaccgacctacctatctagccgagcaaaactagctctggataacatcgtaatgctacacacaacggagagaggtggtagagcctatcagcacgccctgaatgaattacccgaatccctagaaaccttaatgcttgtggcattattaggtgctatgactgcgggaatctttctattctttatgcaaggcaaaggcataggtaaactctctatgggcttaataaccatagcagtggccagtggattactttgggtggctgagattcaacctcagtggattgccgcatccataattttggagttctttttgatggtattactaattcctgaacctgaaaaacaacggacacctcaagataaccaattaatttatgttatacttacaatactcacaataataggtcttatagctgctaatgaaatgggactaatcgagaaaactaaaactgactttggattctaccaagtaaaaacagaaactacaatattagatgtggatcttagacccgcaagcgcctggacattatacgcagtagctacaaccatattgaccccaatgttaaggcatactatagaaaatacttctgcgaatctttcactagccgcgatagctaaccaagcagcagttttgatgggtctgggaaaaggatggccactacatcgtatggatttaggcgtacccctattagcaatgggatgttatagtcaggtgaatcccacaacactaacagccagcttagtgatgctactcgtacactacgcgataataggaccaggcctccaagcaaaagcaacacgagaagcccagaaaaggacagcagcgggcatcatgaaaaatcctacagtagatggcattaccgtaatagacctagaaccaatatcatatgacccgaagttcgaaaaacaattgggacaggttatgctgctggtactctgtgctggccagttactcttaatgaggactacatgggcattttgtgaagtccttacattagcgacgggtcctattctgaccctatgggagggcaacccaggacgattttggaatactacaattgcagtgagtacagccaatatattcaggggttcttacctcgcaggcgctggtctagctttcagcttaatcaaaaatgcacagacgcctagaaggggtactggaacagccggggaaacactaggagaaaaatggaaacggcaattaaactcactagaccgaaaagagtttgaagaatacaaaaggtcgggcattttagaagtagacagaaccgaagctaaatcagcgcttaaagacggaagtaaaattaaacatgcagtttcgagagggagctcaaaaataagatggatagtggagaggggtatggtgaaaccaaagggaaaagtagttgacttgggctgcggcagaggagggtggagttactacatggccacgttaaagaacgtaacagaagtgaaagggtacactaaaggcggtccaggccatgaggaacctatacctatggctacatatggatggaatctagtaaaactgcacagtggagtggatgtattctacaaaccgacagagcaagttgatacactattatgcgacataggcgaatcaagtagcaatcctaccatagaagaaggccgtactttacgtgtccttaagatggttgaaccttggttgagttccaagccagaattttgcattaaagtattgaacccatacatgcccacagtgattgaggagctggaaaaactacaaagaaaacatggcggtaatctagtacgttgtccattatccagaaattcaactcatgaaatgtactgggtatcaggagcatcagggaatatagtttcgagtgttaacacgacgtcaaaaatgttattgaatagatttactacgcggcatagaaaaccgacgtatgaaaaagacgtcgatcttggagcaggtacgcgaagcgtaagtacagaaatagaaaagccagatatgacaataattggacgtaggttacaacgtcttcaagaagaacataaagaaacttggcattacgatcaagagaacccataccggacctgggcgtaccacggctcatacgaagcgccttcaactgggtcggcaagttcgatggtgaacggcgttgtgaaattactaactaagccgtgggatgtgattccgatggtaacgcaactagcaatgaccgatacaacaccgtttggtcaacaaagagtttttaaagagaaagtagacacgcgtactcctcagcctaaaccagggacaagaatggtaatgactaccactgcaaattggctttgggcccttcttggaaagaagaaaaatcctagactatgcacacgtgaagagttcatatctaaagttaggagtaacgctgcaattggagcagtgttccaagaagaacaaggatggacaagtgcatccgaagctgtgaatgatagtaggttctgggaattggtcgataaagagcgagcactacaccaagaaggaaaatgcgaatcatgtgtgtataacatgatgggaaaaagggagaagaaactcggagaatttggcagagctaaagggtcaagagcaatatggtacatgtggctaggcgcaagatttttggaatttgaagcactaggctttctaaacgaagatcactggtttggaagagaaaactcttggagcggagtcgaaggagaaggactgcacaggttgggttacatcttagaagaaattgataaaaaggatggtgatttaatgtatgcggacgatactgcaggatgggacacacgtataacggaagatgatttacaaaatgaagagttaataacagaacaaatggccccgcaccacaaaatactagcaaaagctatttttaaactaacataccagaataaagtagtaaaagttttacgaccaacaccccgaggagcagttatggacataatctcgagaaaagatcaacgaggttctggccaagtagggacctacggattaaatactttcacaaacatggaagtacaattgatacggcagatggaagcagaaggtgttataactcaagacgacatgcagaacccaaaaggtctgaaagaacgtgttgaaaagtggcttagggagtgtggtgtagacagattaaaaagaatggcaataagtggcgacgattgcgttgtcaaaccgttggatgaacgattcggtacctctctcttatttctaaatgatatgggaaaagtaagaaaagatatacctcaatgggagccgagcaagggctggaaaaactggcaggaagtaccgttttgttcgcatcacttccacaaaatatttatgaaagacggacggtccttggtagttccgtgtcgcaaccaggatgaattaatcggccgtgctcgaattagtcaaggtgcgggttggagcctccgtgaaaccgcttgtctaggtaaggcttacgcacagatgtggtcactaatgtattttcatagaagagacttaagactcgctagcatggcgatatgcagcgctgtccctactgaatggttccctacaagtcgtacaacttggagtatccatgcgcaccaccaatggatgacgactgaagacatgctaaaagtatggaatagagtgtggatagaagataacccaaatatgatcgataagaccccagtgcattcttgggaagatataccttacctaggaaagagagaagacttatggtgtgggtcactaataggattgagtagtcgggctacgtgggctaaaaatattcacactgcaattacgcaagtccggaatctgataggaaaagaagaatatgttgactacatgtcggtaatgaagcgatactcggcaccctccgagagcgaaggagttttataa

SEQ ID NO: 23687 - RNA, 9867 nt, synthetic construct
  misc_feature 1..9867: note = derived and/or modified CDS sequence (opt6) from DENV-4__KJ596671__SS-prME
  source 1..9867: mol_type = other RNA
tcaacgatcacattactttgtctaattccaactgttatggcatttcatctgagcacccgagacggagaaccattaatgatagtagcgaaacacgaaagaggaagaccactactatttaaaacaactgaaggtataaataagtgcaccctaattgcaatggatttaggtgaaatgtgtgaagatacagtcacatacaaatgccccctactcgtaaatacggaacccgaagatatagattgttggtgcaaccttacctccacatgggttatgtatggaacgtgtacccaaagcggcgaacgcagacgagagaaaaggagtgtggcgttaacgccacattccggtatggggctagaaacaagagccgaaacctggatgtccagtgaaggtgcatggaaacatgcacaaagagtcgaatcatggatactacgaaatcccggcttcgcactacttgcagggtttatggcatatatgatcggacaaaccggaatacaacgaactgtcttctttgtactaatgatgttggtcgcgccaagttatggaatgcgatgtgtaggagtaggtaacagagatttcgtggaaggagtgtctggcggtgcatgggtcgatttagttttagaacatggcggatgtgttaccacaatggcacaaggtaagcctacgcttgattttgaattgactaaaaccacagccaaagaagtcgctctactaaggacatactgtatagaagcactaataagtaacatcacaaccgccacgcgttgtccaacacagggtgaaccttatctgaaagaagaacaagatcaacaatatatttgtcgtcgagatgtcgtggatcgaggatgggggaacggttgcggactgtttggtaaagggggcgtagtcacatgcgcaaagttctcttgtagtggtaaaataacgggaaatttggtccaaattgagaatttagaatatactgttgtagttacagtccataatggtgacactcatgccgtaggaaacgacacaagcaatcacggagtaacggcgacaataacaccccgatcgccaagtgttgaagttaagctgccagattacggtgaactcacattagattgcgaacccagatcaggaatcgattttaacgaaatgatactaatgaaaatgaagaaaaagacttggctagttcataaacaatggtttctcgacttaccactcccgtggactacaggggcagacacgtcagaagtccattggaactataaagaacgtatggtgacattcaaagtaccacacgccaagcgtcaagacgttacagtcctaggatcacaagaaggagcgatgcactccgcactagccggagctactgaagtagactcaggtgatggaaaccatatgttcgcaggacatttaaaatgtaaagtccggatggaaaaacttaggattaaaggaatgagctacactatgtgttctgggaaattctcgattgacaaggaaatggcagaaacgcagcacggcactacagtagttaaggtcaaatacgaaggagccggagctccttgcaaggtacctatcgaaatacgagatgtaaataaagaaaaggtcgtagggcgggtcataagtgcaacgccattagctgaaaacactaatagtgttacgaacatagaattagaacctccctttggagacagctacatagtaattggagttgggaatagtgcattaactttgcattggttcagaaaaggatcgtccattggaaagatgttcgaatcaacctacagaggtgctaaaaggatggcaatattaggtgaaactgcatgggattttggtagtgtcggaggtttattcacatctttaggcaaggctgtacatcaggtcttcggtagcgtatacacgacgatgttcggaggagtctcttggatgatacgaatattaataggatttttagttctctggataggaacaaacagtcgaaatacgagcatggcaatgacttgtattgcagttggtggcattacattatttttaggctttaccgtccaagccgacatgggatgcgttgttagctggagtggacgtgaattaaaatgtggatctggaatcttcgttgtagacaacgttcatacatggactgaacaatataaattccagccagaaagcccagcgcgccttgcaagcgcaatactaaatgcacataaagatggtgtatgtggaatccgaagtacaacaagattagaaaacgttatgtggaaacagattaccaatgaattgaattacgtactctgggaaggaggtcatgatctaacagttgttgcgggagacgtaaaaggagtattgacgaagggtaagagggccttaacaccaccggcaagcgacttaaaatacagttggaagacatgggggaaagcaaagatttttactcctgaagcgagaaacagcactttcctgattgacggacctgatacttcagaatgcccaaatgaaaggagagcttggaactcattcgaagttgaagactatgggtttggaatgtttacaacaaatatttggatgaaatttagggaaggatccagcgaagtttgtgaccatcgtctaatgagtgcggccattaaagaccagaaagctgtacatgcggatatgggatactggattgaaagctctaaaaaccagacatggcagatagaaagagctagcttaattgaagtaaaaacgtgcctatggccaaagactcatactttatggtctaatggcgttttagaatcgcaaatgttaatacctaagtcatacgcgggaccattctcccagcataactataggcaaggttatgcaacacaaactgtaggaccgtggcacctcggaaaacttgagatcgactttggtgaatgccccggcacaacggttacaattcaggaaaactgcgaccatcgcggaccttcacttcggaccactacagcatccggcaagttagttacacaatggtgctgcagatcatgcactatgcctcctctgagatttttaggagaagatggatgctggtacgggatggaaatcagaccattatctgaaaaagaagaaaatatggtcaaaagccaagtaacggctggacaaggaacctcagagacgttctcgatgggattgctctgtttaaccttattcgtagaagaatgtttacgcagaagagttacaagaaaacatatgatactggcagtagtcataaccctttgtgctataatcttagggggattgacctggatggatctgcttagagctttgataatgttaggagatactatgagtggtaggatcggtggacagactcatctggcaatcatagctgtatttaaaatgagtccgggatatgttctaggtgtattcctacgcaaattaacgtctagagaaacagctctcatggtgataggaatggctatgacgacaacacttagtataccacatgaccttatggagttaatagacggaataagtctgggtcttatactacttaagatcgtgacacagttcgacaatacgcaggtcgggacactagccctatcactcacattcatacgatcaactatgtcacttgtaatggcttggagaaccataatggctgtactgtttgtcgttactctcataccactttgccgaacatcctgcttacaaaaacaatcacattgggttgaaattacagcattaatcctgggtgcccaagcattaccagtgtacttaatgaccctcatgaaaggtgcatcaagacgatcttggccactgaacgagggaatcatggcagtcgggcttgtaagtctcctagggtccgctctactcaaaaatgatgtaccactagcaggtccaatggtagcaggcgggctgcttctggcggcctatgtaatgtcaggatcctcagcagacctgagcttagaaaaagcagccaatgttcaatgggatgaaatggccgatataacgggttcatcaccgattattgaagtcaaacaagatgaagatggctcattctctattagagacgtcgaagaaacgaatatgataacgctattagtgaaattagcattgattacagtatccggattatacccattagcaattccaataacaatgacgctgtggtacatgtggcaagtgaaaactcaaagatcaggagctctttgggatgtcccaagtccagctgctacccaaaaagcagcactgagtgaaggagtctacagaattatgcaaagaggacttttcggcaaaactcaagtgggtgttggaatccacatggaaggtgtctttcacacgatgtggcacgttaccagaggatcggtaatttgtcatgaaacaggaaggttagaaccaagctgggcagacgtgagaaatgacatgatctcctacgggggaggatggagactgggtgacaaatgggacaaagaggaagacgtgcaagtactagctattgaaccaggtaaaaatcccaaacacgtacaaaccaaacctggcctctttaaaacactcactggggagataggtgccgtgacgctagattttaaaccaggaacaagtggaagtcctattatcaaccgaaaaggaaaagtaattgggctatatggcaatggagtagtgacgaagagtggagattatgtttctgctattacacaagctgaacgaataggagagcccgactacgaggtcgacgaagacatatttcgtaagaaacggctcacaataatggatctacatcctggggctggtaaaactaagaggatcctaccatccattgtgagagaggctttaaaaagacggctaaggactttaatactagctcccacgcgtgttgtagcagctgaaatggaagaggcactaaggggtttacctatacgttatcagaccccagcagttaaatccgaacacaccggtagggagatagtggatctcatgtgtcatgcaactttcaccacacgcctattaagttcaacccgagtaccaaattataatttaattgtaatggatgaagcccactttacggacccttcctcagtagcggcacgaggatacattagcacacgagtggaaatgggtgaagccgccgctatattcatgacggcaacgcctccaggcgcgacggacccgtttccacaatccaactctccaattgaagacatagaacgagagattcctgaacggagttggaatacagggtttgactggataacggactatcaagggaaaacagtgtggtttgtgccctcaatcaaagctggtaatgacattgcaaattgccttcgcaaatcggggaaaaaggtgatccaattatctcgaaaaacgtttgatactgagtatccaaagacgaagctaactgattgggactttgtcgttacaactgatatatcggaaatgggagcaaatttcagggcaggtagagtaatagatccccgcagatgcttgaaacccgtcattctaaccgatggacctgaacgcgtcatcctagccggacctattccagtgacaccagcaagtgccgcgcaaaggcgtggacgaataggacgtaatcccgctcaggaagatgatcagtacgtatttagtggcgatccgttaaagaatgacgaagatcatgcacactggacagaggcaaaaatgttactagacaatatttacacgcctgaaggtataataccaacactcttcggccctgagagagagaaaacgcaagccattgatggtgaatttaggttgagaggggaacaacggaaaacgttcgttgagttgatgagaagaggcgatctgccagtatggttatcttataaagtagcctcagctgggattagttacaaagaccgtgagtggtgcttcacaggagaacgcaataatcaaattctagaagaaaacatggaagtagaaatctggacaagagaaggagagaagaagaaattaagaccaaaatggttggatgcccgagtatacgctgacccaatggcgttaaaagactttaaagagttcgcaagcggaagaaagtcaataacattggatattctaacagaaatagcatcattacccacatacctatcatcacgcgcaaaactagcactcgacaacatagtgatgctacatacaacggagaggggtggaagggcataccaacatgcgttaaacgaattgccggaatcattagaaacactaatgctggtcgcacttttaggagccatgacggctggtatattcttattcttcatgcaaggaaaaggcattggaaaactaagtatggggctaattactatagcagtagcttctgggttactatgggtcgctgaaattcaaccgcagtggatagccgccagtatcatattagagttcttcttaatggtacttcttataccggaaccagagaaacaaaggacacctcaagataaccaacttatatacgtcatattaactatacttacaataataggattaatcgcagcaaacgaaatgggactcattgagaagacaaaaacggacttcggattctatcaagttaaaacagagactactatattagatgtagatctgcgtcctgcatcagcctggacactatacgccgttgccacgaccattttaactccaatgttaaggcatacaattgaaaatacttcggctaatttaagcctagcagccatagccaatcaagcagcagtcttgatggggctgggaaaagggtggcctctacacaggatggacctaggagtacccctgttggcgatgggatgttattcgcaggtaaaccccacgacactgacagcatcgttagttatgctccttgtccattatgcgataatagggccgggactacaggcgaaagccactagggaagctcagaaaagaacagctgctggtatcatgaagaacccgacggtagacggaataacagtaatagatctcgaacctatttcttatgaccccaaatttgaaaaacaactgggacaggttatgttattggtactttgcgcgggacaattactactcatgagaactacctgggccttttgtgaagtgctcacattggccactggcccgatattaacactatgggaagggaaccccggacgcttttggaatactactatcgccgtctctaccgctaacattttccgaggatcctatcttgctggagccggtttagcgttttcattaattaaaaatgcacagactccaagaagaggtacaggcacagcgggagagactttaggggaaaaatggaaacgacaattaaattcactagaccgtaaagagttcgaagaatataagagaagtggaatattagaagtggaccgtacagaagcgaaaagcgctttaaaagatgggtcaaaaataaagcacgctgtctctaggggatcgagcaaaatacgatggatagtggaaagagggatggttaaaccgaaaggtaaagtcgttgatcttggttgtggccggggtgggtggagctattatatggcgactctcaagaatgtaacagaggtaaagggatatacaaaaggtgggcctggacatgaggaacctataccgatggcaacatatggctggaacctagtgaagctacatagcggagtggatgtcttttataaaccaacggaacaagtggacacacttctatgtgatataggagagtccagctcaaatccaactattgaagaaggacgaacattaagggtgttgaaaatggtagaaccgtggctatcaagcaagcccgaattttgtataaaagtattaaacccatatatgccaaccgttatcgaagaattagaaaagttacaaagaaagcatggtggaaacctcgtaagatgtcctctaagtagaaatagtacacatgagatgtattgggtatctggtgcctcaggaaatatagtctctagtgtcaatacgacgtcaaagatgcttctgaatcggtttacgactcggcaccggaaaccaacctatgagaaggatgtagatttaggtgctgggaccagatctgtaagtacggaaatagaaaaacccgatatgactataatcggtaggcgtttacagcgattacaggaagaacataaagaaacctggcactatgaccaagaaaacccatatcgaacatgggcctatcatggtagttacgaggcgccatctactggtagcgcatcttcaatggttaatggagtggtaaaacttctcacaaaaccgtgggatgttatcccaatggtaacacaattagccatgactgacaccactccattcgggcagcaaagggtatttaaagaaaaggttgacacgagaactcctcaaccaaaaccaggaaccaggatggtcatgacaacgactgcgaattggctatgggcactacttggcaagaagaaaaacccacgactttgcacgcgagaagaatttatctcaaaagtacgttcaaatgcagcaataggagctgtatttcaagaagaacagggctggaccagtgcgtctgaagcagtgaatgatagcagattttgggaactggtagataaagaaagagccctccatcaagaggggaaatgcgaatcgtgcgtttataacatgatgggaaaacgagagaagaaacttggtgagttcgggagagcaaagggatcaagagcaatttggtatatgtggctcggagctaggtttctcgagtttgaggctttaggcttcttgaacgaggatcactggttcggcagggaaaatagttggagcggtgtagaaggtgaaggcctgcatcgcctcgggtatatcttagaagaaattgacaagaaagatggggatttaatgtatgcagacgacacagctgggtgggatactaggattaccgaagacgatctacaaaacgaagaactaattacggaacaaatggctccccaccataaaattctagcgaaagctatattcaaactgacataccaaaataaggtagttaaagtgcttcgcccaacaccccgtggtgcggttatggatataataagtagaaaagatcaaaggggttcagggcaagtcggaacctatggactaaacacttttacaaatatggaagtacaactgataaggcaaatggaagccgaaggggtaatcacccaagacgacatgcaaaatccaaagggattaaaagaaagagttgaaaaatggctaagagaatgtggtgtcgaccgcttaaaaaggatggccattagcggtgatgattgtgtcgttaagccgttggacgagagatttggtacatccctcctatttttgaacgatatgggcaaagttcgaaaagatataccacaatgggaacccagtaaaggttggaagaactggcaggaagtacctttttgctcacaccatttccataagatatttatgaaagatggacgcagcctagtagttccctgccgtaatcaagacgaattaatcggcagagcgagaatttcacaaggagcaggttggtcgttacgcgaaactgcttgcctgggaaaggcatacgcacaaatgtggtcgttaatgtacttccatagaagagatctacgtctagctagtatggcaatatgcagtgccgtcccgacagaatggttccccacatcccgcacaacatggagtatccacgcccatcaccaatggatgacgacagaagatatgctaaaggtatggaatcgagtatggatagaagataaccccaatatgattgataagacacccgtccattcctgggaggatataccatatttaggaaagagagaagatttatggtgcggatctttaataggacttagtagccgtgcgacatgggccaaaaatatacatactgcgataactcaagtgcgaaacctcattggaaaagaagagtatgtagactatatgtctgtcatgaagcgctactcagcgccatcagaaagtgaaggagtactctga

SEQ ID NO: 23688 - RNA, 9867 nt, synthetic construct
  misc_feature 1..9867: note = derived and/or modified CDS sequence (opt6) from DENV-4__KJ579241__SS-prME
  source 1..9867: mol_type = other RNA
tcgacaattactttactatgtttgatacccacggttatggcttttcacttgagcacacgagacggtgaacctctgatgattgtcgcaaaacatgaaaggggtcgaccactgctatttaaaactacagaagggataaacaaatgtacattaatagcaatggatcttggggaaatgtgtgaagacacagtaacgtataaatgcccattattagtaaatacagaaccagaagacatagattgctggtgtaacttgacttcaacatgggttatgtacggaacatgtacacaatctggtgaacgtagaagagaaaaacgttccgtagcgctgacaccccactctggaatgggtcttgaaaccagggcggaaacatggatgtcatcagaaggcgcttggaaacatgcgcaaagagtagagagctggatattacgtaacccaggattcgccctcctagcaggtttcatggcgtacatgatagggcaaacgggcatacaacggacagtcttctttgtccttatgatgctggtcgcaccgtcttatggcatgaggtgtgttggagtgggtaatagagacttcgtcgagggcgtgtcaggaggagcatgggttgacttagtgctggaacatggaggttgtgttactacaatggcacaaggtaagcctacattggactttgaactaacgaaaaccacagcgaaagaggtggcgcttcttcgtacttactgcattgaggctttaattagcaatataacaactgcaacaagatgccctactcagggggagccatacctgaaggaggaacaagatcagcaatacatatgtcgtcgcgacgttgttgatagaggttgggggaatggatgtggacttttcggaaaagggggcgttgtaacgtgtgcaaaattctcttgcagtgggaaaataacaggaaatctagtacagatagagaacttagaatataccgttgtcgttacagtccataatggagatacacacgcggttggcaatgatacctcaaatcatggcgtaacagcaacaataacaccacggagcccttcggtggaagtaaagctcccagattatggagaactgacattggattgtgaaccgcgttccggaatagattttaacgaaatgatattgatgaaaatgaagaagaaaacctggcttgttcacaaacagtggtttctagatctgccactcccatggactaccggggcggatacttcggaagtgcattggaactataaagaaagaatggtgacttttaaaattccacacgctaaaaggcaagatgttactgttctagggagtcaggagggagctatgcactctgcactagcgggagccactgaagtggattctggagatgggaatcacatgttcgcaggacatttaaaatgtaaagtacgaatggaaaaacttaggattaaaggtatgagctataccatgtgttcgggaaagttctcaattgataaagaaatggcagaaactcagcacggaaccacagtagtaaaagtaaagtacgagggagccggcgctccatgtaaagtgcctatagaaattagagatgttaataaagaaaaagtagtaggacgtgttataagcgccacgcccctcgcagaaaacaccaattccgttaccaacatagaattagagccacccttcggtgatagttacattgttataggagttggaaattccgcgctaacacttcattggttcagaaaaggttctagtataggtaaaatgttcgaatcaacttataggggcgcaaagcgaatggccatcctcggcgaaactgcatgggacttcggctccgtaggaggtttattcacttccttaggaaaagcggtacatcaagtgtttggctctgtgtatacaactatgttcggaggggtgtcctggatgatacgtatattaatcggatttttggttctatggataggcaccaatagtcggaacacgtcaatggcgatgacatgcattgcagtgggtggaataacactcttcttaggttttacggtccaggcagatatgggatgcgtggtaagttggtccggacgagaattaaaatgcggtagtggaatatttgtagtcgataacgtgcacacgtggacggaacagtataaattccaacccgagtctcccgccagattggcgtcagctatccttaatgcacacaaggatggagtgtgtggaataagatccacaacgcggctcgaaaacgtaatgtggaaacagataacaaatgagcttaactacgtattatgggaagggggacacgatcttacggtcgtggccggtgatgtgaaaggagtacttaccaagggtaaaagagctttaacgccgccagcgagcgacttaaaatactcatggaagacatggggaaaagctaaaatttttacacccgaagcacgaaacagcaccttcctaatagatggacccgacacatcagaatgtccaaatgaacggcgagcgtggaactcgtttgaagtggaagattacggattcggcatgttcacgaccaatatctggatgaaattccgtgaggggtcgtctgaagtatgtgatcatagattaatgtccgccgctataaaagatcaaaaagcagtacatgccgacatgggctactggatcgagtcaagtaaaaaccagacatggcaaatagaaagagctagcctaatagaagtaaaaacctgtctttggccgaaaactcacactttatggagcaacggtgtcctcgaaagccaaatgttaataccaaaatcatatgcaggtccattttctcaacacaattatagacaaggttacgcaacacaaacggtcggtccatggcaccttggcaaactcgaaatagactttggagaatgcccaggcactacagtaacaattcaagaaaattgcgatcaccgaggtccatcgttgcgtacaaccacagcaagtggtaaattagtaacccaatggtgctgcagatcctgcactatgcccccattaaggtttttgggtgaagatgggtgttggtatggtatggaaattagaccgctctcagaaaaagaagaaaatatggtgaaaagtcaggtcacggccgggcagggtacaagcgaaactttctcaatgggattactatgtcttacgcttttcgtagaggagtgcctaagacgtagggtgaccagaaaacacatgattctagcagtcgtcataacgctctgtgcaataatacttggcgggttaacctggatggatctgttaagggctctaataatactgggagatactatgtccggtagaataggtgggcagacacacctagctataatggcagtcttcaaaatgtcacccggctacgtgctaggcgtgtttttacgtaaattgacctcacgagaaacagcccttatggtgataggcatggcaatgactacgactctaagtatccctcatgacttaatggaacttattgatggcatctcacttgggctgatattactaaaaattgtcactcaatttgataatacccaagtgggaactcttgctttatctctaactttcatacgtagtacgatgagcctggtaatggcatggcgcaccattatggcagtgctgtttgtagtgacattgattcctttgtgtcgtacttcctgtctccaaaaacaatcgcattgggtggaaattaccgctctaatattaggtgcccaagcattacctgtatatttaatgactctcatgaagggagcaagtagacggagttggccattaaatgaaggaatcatggcagtaggattagtttctctattgggttccgccctactgaaaaacgacgtcccattagcaggaccaatggtcgccggtggtttattactagccgcgtacgtcatgtctggatcatctgcagatctcagcttagaaaaagcagctaatgttcaatgggatgaaatggcagatataacaggatcttccccaattatcgaggttaaacaagatgaagatggtagcttcagtatacgagatgtagaagaaacgaatatgattacattattagtaaaactcgcacttataacagtgtcgggtctttacccactggcaatcccaattacgatgaccttgtggtatatgtggcaagtcaaaacacaacgatccggtgcactatgggatgtcccttcaccagcagctacacaaaaggcagctctaagcgaaggtgtttataggataatgcagagggggttattcggtaaaacacaagtaggagttggtatacatatggaaggtgtgtttcatactatgtggcatgtaactcgcgggtcggtaatatgccacgaaactggtcgactcgagccaagctgggctgatgtaagaaatgacatgattagctatggaggaggctggcgcttaggcgacaagtgggacaaagaagaagatgtgcaagtattagcgatagaacctggcaaaaatccgaagcacgtacaaaccaaacccggcttattcaaaacattaactggggaaataggagcagttactcttgacttcaaacctggcactagcgggtctccaataattaatagaaaagggaaggtaattggattgtatggtaacggagtagtaactaaaagcggggattatgtatccgcaattactcaagctgaaagaattggtgaacctgattacgaggtagacgaagatatatttagaaagaaacgactaacaatcatggatcttcaccctggagctggtaaaacaaaacgaatacttccaagcattgtgcgggaggctttaaaacgtagattacgaacgctcattttagcacctaccagagttgtagcagctgagatggaagaagctctacgtggactaccaataagataccaaacaccggccgtaaaaagcgagcacacgggacgggagatagtagatctaatgtgccacgcaacattcaccactagactattatcatctactagagtgccgaattacaacttgattgtcatggacgaagctcattttacagatcccagtagtgtggcagcccgcggctacatatcaacgagagtagaaatgggggaagcagcagcgatcttcatgacagctacaccaccaggcgcaaccgatccctttccacaaagcaactcaccgatcgaggacatagaaagagagatacctgagcgctcatggaacactggttttgactggataactgattatcaaggaaaaactgtgtggttcgttccgagcattaaggctggtaacgacatcgcaaattgtcttcggaaatctggcaagaaagtaatacaacttagtagaaaaacgtttgacacagaatatccaaaaacaaaacttactgattgggattttgtagtaactacagatatcagtgaaatgggcgccaacttcagggccgggagagttatcgaccccaggcggtgtctaaaaccagtaatactaactgatggaccagaaagggtcatactagcaggtccaatacccgtaacacccgcatcagcagctcagcgcaggggcagaatagggagaaatcctgctcaagaagacgaccaatacgttttcagcggagacccactaaagaatgacgaagaccatgcgcactggacagaggcaaaaatgttattggacaacatatatactccggaagggatcataccaacacttttcggacctgaaagggagaaaacgcaagcaattgatggcgaatttcgtctacgtggggaacaaagaaaaaccttcgttgaacttatgagacgaggagatttacccgtttggttaagttataaagtagcatcagcaggaatttcatataaagatcgtgagtggtgtttcaccggtgaaagaaataatcaaatactggaagaaaatatggaggtagaaatatggacaagagagggcgagaaaaagaaactgcgtcccaaatggcttgatgctagagtttatgcggatccaatggcgctcaaagacttcaaagaatttgccagcggaagaaaatctataacattggatatcctgacagaaatcgctagcttgccaacttatctaagtagcagagcgaaactcgcgttagacaacatagtgatgttacataccacagaacgaggtggtagggcctaccagcacgctttaaatgagttgcccgaatccttagaaactctcatgttagtggcgttacttggagcaatgacagcagggattttcttgttcttcatgcagggaaaaggaataggaaaattaagcatgggcttaattacgatagctgtagcgtcaggattattatgggttgctgaaatacaacctcagtggatagcggcatcgataatactagagttctttcttatggttctgttaatccctgaaccagaaaagcagaggacacctcaagataaccaattaatctatgttatattaacaattctgactataattggcctgatagcagcaaatgaaatgggtcttatagagaaaacgaagacagatttcggtttctaccaagtcaaaacggaaacgaccattctagacgtggacctaagaccggcaagtgcgtggacactgtatgccgtcgcgacaacaatactcacaccaatgcttcgccatacgatcgaaaatacatcagccaatttgagtttagcagctatagccaatcaggcagctgtacttatgggcttaggcaaagggtggcctcttcaccgaatggatcttggcgtccccctattggcgatgggatgttacagtcaagtgaatccaactacattaacggcctcacttgttatgctactcgtacattacgcaattattggtcccggtttacaagctaaagctactcgggaagcacagaaaaggactgctgctgggataatgaaaaatcccaccgtagatggtataactgtcatcgatcttgaaccaatatcgtatgatccgaaattcgaaaaacaacttggtcaagtgatgctcttagtcctatgtgctggtcaattactgcttatgagaactacgtgggctttttgtgaagtactaacgctggcaacgggaccgatattaacgctatgggaaggcaatccaggtcgattctggaatacgacaattgcagttagtacagcaaatatattccgaggttcatacctagctggtgctggtctagcgttttctttaatcaaaaatgcccaaacaccgaggaggggaacaggtacagcgggggaaacactaggcgaaaaatggaaacgacagttaaattcattggatcgaaaggagtttgaagagtacaagagatcaggaatactagaagtcgatagaacagaagcgaagtcagctttaaaagatggctcaaagataaaacatgcagtctcccgaggcagttcaaaaatccgatggatagtagaacgcgggatggtaaaaccaaaaggcaaagttgttgacttaggctgcggccgcggaggatggtcgtattatatggcaacgctaaagaatgtgacagaagtaaaaggttacactaaaggaggaccaggacacgaagaaccaattccaatggcgacctatggatggaatttagtcaagctacattcgggcgtagacgtattttacaaaccaacagaacaggtagatacactactctgtgatataggcgagagttcatctaacccaaccatagaggaaggacgcacaatgagggtattgaaaatggtggaaccctggctttcatctaaaccagagttctgtattaaagtattaaacccatatatgccaaccgttattgaagaactagaaaaattacaacggaaacatggtgggaacctagttagatgcccattgagcagaaattcaacacatgaaatgtactgggtcagtggagctagtgggaatatcgtaagtagtgtaaataccacatcaaagatgctactaaacaggttcacaacaaggcatcggaagcccacctatgaaaaagatgttgatttaggggcaggaacccgaagcgtctcaacagagacagagaaaccagatatgacaatcatcggtcgtagattgcaaagattacaggaggaacacaaagagacttggcattacgaccaagagaatccgtaccgaacttgggcgtaccacggatcatacgaagctcctagtactggttcagcttcttccatggttaacggcgttgttaaactgctgacaaaaccatgggacgtcattcccatggtaacccaattagcgatgaccgatacaacaccattcggacaacaaagagtattcaaagaaaaagtagatacacgcacaccacaaccaaagcccggtactcgaatggtcatgacgacgacagcgaactggttatgggctttactaggtaaaaagaaaaacccgcgcttatgtactagagaagaatttatcagtaaagtacgaagtaatgccgcgataggtgcagtcttccaagaagaacaagggtggacatcagcctccgaagcagtcaatgatagcagattctgggagctagtcgataaagagagggcacttcatcaagaaggaaaatgtgaaagttgcgtttataatatgatgggaaaacgagagaagaaactcggagaatttggccgggcaaaaggatccagagctatttggtatatgtggttaggggcaaggtttctggaatttgaagcactcggatttctaaatgaggatcactggtttggaagggagaactcatggagcggagtggagggagaggggctacataggttaggatatatactagaagaaatcgataagaaagatggagatcttatgtatgctgatgacactgccggatgggatacaagaatcactgaagacgatttacaaaacgaagaactaatcactgaacaaatggcaccacatcataagatacttgcaaaagcaatttttaagttgacataccagaataaagtagtgaaggtcctcagacctacgccaagaggagctgttatggatataatatcacgaaaagaccagaggggctcgggacaggtcggcacatacggcctcaatactttcacgaacatggaagtacaattaatacgacaaatggaagctgaaggagtaattacacaagacgatatgcaaaatcctaaagggcttaaggaaagagtcgagaaatggctaagagagtgcggagtagacagactcaaaagaatggctataagcggcgatgattgtgtcgttaaacctcttgatgaaagattcggaacatctctattgttcttaaacgatatgggtaaagtgcgaaaagacataccccagtgggaaccgtcaaaaggttggaaaaactggcaagaagtgcctttttgttcacaccattttcataaaatattcatgaaagatgggcgaagtctggtggtgccatgtcgaaaccaagacgagctaataggccgtgcccggataagtcaaggcgcaggctggagtttacgagagactgcttgcttgggaaaggcatacgctcaaatgtggtcattgatgtattttcaccgcagggacctgcgcttagcaagtatggcaatatgttcggcagtaccgactgagtggtttccaacaagccgtacaacatggtcaattcatgcacatcatcaatggatgacaacggaagatatgcttaaagtatggaaccgagtctggatcgaagacaacccaaatatgatcgacaaaactcccgtccacagctgggaagacataccttacctaggtaaaagagaagatctatggtgcggaagccttataggtctgagcagtagggctacatgggccaaaaatattcataccgcaataactcaagtaaggaatttaataggaaaagaagaatacgttgactacatgccagtaatgaaaagatatagtgccccatccgaaagtgagggggtcctatga

SEQ ID NO: 23689 - RNA, 9867 nt, synthetic construct
  misc_feature 1..9867: note = derived and/or modified CDS sequence (opt6) from DENV-4__KJ596672__SS-prME
  source 1..9867: mol_type = other RNA
tctactataactttactttgtcttattccgacagtaatggcgtttcacctatcaaccagagacggagaacctcttatgatagtagccaaacatgaaagaggacgaccattgttatttaaaacgacagaaggaatcaataaatgtactctcattgctatggatttaggggaaatgtgtgaagacactgtaacttacaaatgtccgttgctggttaatacagaaccagaagatattgattgctggtgtaatctcactagcacttgggtcatgtatggaacttgtacacaatctggagaaagaaggagagaaaaacgttccgtggccctaacgccgcactcaggaatgggtttggaaaccagggcagaaacttggatgagttctgaaggagcttggaaacacgcccagagagtagaatcttggattctacgaaatcctggatttgcgcttttagctggatttatggcttatatgatcggacaaactggaatccaaagaacagtattctttgtacttatgatgttagttgctccatcctacggaatgcgttgtgtaggagttgggaatagagacttcgtagaaggggtaagtggaggagcatgggtagatttagtcttagaacacggtggttgcgtaaccacaatggctcaaggaaaaccaacattagactttgaattaacgaaaacaacagcgaaagaagtagcattacttcggacatactgtatagaagccctaattagcaatataaccaccgctacacgctgcccaactcaaggagaaccctatttaaaagaagaacaagatcagcagtacatatgtaggcgcgacgtagtggacagaggctggggaaacgggtgtggcttatttgggaaaggtggtgtggtaacctgtgccaaattttcctgttcaggaaaaataactggaaatttagttcagatagagaatctcgaatatacagtagtcgtaaccgtccacaacggggatactcatgcagtaggtaatgacacatccaaccacggagtaacggcgacaatcaccccaagatcgccgtctgtggaagtgaaattgccagactatggagaattaacgttggattgcgaaccaaggtctggaatagactttaacgaaatgatattaatgaaaatgaaaaagaaaacgtggttggttcataaacagtggtttttagacttacctttaccttggactacgggcgcagacacgtcagaggtccattggaattataaagagcggatggtcactttcaaagtgccccacgccaaacgacaagacgtgacagtactagggtctcaagagggagcaatgcactcagcattagcgggagctacggaagtagattcaggcgatggcaatcatatgtttgcagggcatctaaaatgcaaagtaagaatggaaaaattgaggatcaaaggtatgagctatacgatgtgtagtggaaaattcagcatcgataaagagatggcggagacccaacatggcactacggtagtcaaagtaaaatacgaaggagcaggggccccgtgcaaagtacctatagaaattcgggacgtaaataaagagaaagtcgtaggaagggtaattagcgcaacacctctagctgagaacacaaattctgtaactaatattgaattagagcctccttttggagattcctatattgtgataggggtaggaaattccgcactgacattgcattggtttcgcaaaggttcatcaattgggaaaatgttcgagtccacttatagaggtgccaaaagaatggcaatcttaggggaaacagcatgggactttggaagtgtaggtggactatttacttcgcttggtaaagcagttcaccaagtattcggctcagtatatacaacaatgttcggtggagtttcgtggatgatacgaatcttaataggatttttagttctgtggatcgggacaaatagtagaaacacttcaatggcaatgacatgtatagctgtagggggaataactttatttttaggttttacagtgcaagccgacatgggatgtgtagtaagctggagcggtcgcgaattaaaatgcgggagcggtatatttgtagtagataatgtccacacttggaccgagcagtataaattccagccagagtcacccgcacggttagcgagtgctattctaaatgcacataaagatggtgtatgtggaatccgttcaacaactagattagaaaacgtcatgtggaaacaaattacgaatgaattaaattatgtcctttgggaagggggacacgatctaacagtggtggccggtgacgtcaagggtgttttaacaaaaggcaaacgcgcactaacaccccctgcctctgatttaaaatactcttggaaaacatggggaaaggccaaaatcttcacaccggaagcacgaaatagcactttcttaatagacggcccagacacttcagaatgcccgaatgaacggagagcatggaactcgttcgaagtcgaagactatggctttggaatgtttactacgaacatctggatgaaattccgggagggtagctcagaagtttgcgatcatagactaatgtcggccgccataaaagatcaaaaagctgtgcacgcagacatgggatattggattgagtcgtctaaaaatcaaacctggcaaatagagagagcatccttaatcgaagtaaagacctgtttatggccaaagactcataccttatggagtaatggagtacttgaaagccaaatgttgattcctaaatcctacgcaggaccattctcccaacataattataggcagggatatgcgacacaaaccgttggaccgtggcatttgggtaaattagaaatcgatttcggagaatgtccagggactacagtcacaatacaagagaactgcgatcatagagggccaagcctacggacaacaacagcgtctggtaagttagttactcagtggtgttgcagaagttgtactatgcctccattaaggtttttaggagaagacggctgctggtacgggatggaaataagacccttatctgaaaaagaggaaaatatggtaaaaagccaagtgacggcaggtcagggtacatcagaaacatttagcatgggcttgctatgcctgacactgttcgtagaagagtgtctaagacgacgagttactcggaaacatatgatactagcagttgtaattacattatgcgctatcattttgggaggactcacatggatggacttactaagggccttgatcatgcttggggatacgatgtcaggcagaataggtggtcaaactcatttagcaataatcgccgtatttaaaatgtcacctggctatgtattaggagtctttcttagaaaactgactagcagagaaaccgcgctcatggtaattggaatggctatgactactacactatcaatacctcacgacttaatggaattaattgacggcatctcactaggattaatattattaaagatagtaacgcaattcgataatacccaagtaggtaccttagccctgagcctgacattcataagaagcacgatgtctctagtaatggcctggcgtactataatggcagtcttatttgtagtaacactaatccccctatgtagaaccagctgcttacaaaaacagagtcactgggtagaaattactgctttgatcttaggggcgcaggctctacccgtctacttgatgaccctaatgaaaggcgcatcacgtcgttcatggcctttaaatgaaggaattatggcggtcggcctagtatcgctattgggatccgcccttcttaagaatgacgtgcctctagctggaccaatggtcgcaggcggtctattattagctgcatatgtaatgtcaggatcatctgcagatttgtcacttgaaaaagccgcaaacgtgcagtgggatgaaatggccgatataacgggtagttccccgataatagaggtaaaacaagatgaggatggttcttttagtataagagatgtagaagaaactaatatgatcacattattggtaaaactggcattaatcacagtgtctggattatatcctctagcaattccaattactatgacattgtggtatatgtggcaagttaagacacaaagatctggagcgctctgggacgttccgtcccccgcagcgactcaaaaggcagccttatcagaaggtgtttacagaataatgcagagagggttatttggaaaaacgcaagtgggagtagggattcatatggagggcgtcttccacaccatgtggcacgtgacaagaggctccgtaatctgccatgaaactggcagacttgagccatcctgggccgatgtccggaacgatatgatatcgtacggaggtggttggagattgggagataaatgggacaaagaagaggatgtccaagttttagcaattgaacccggcaaaaatccaaaacatgttcaaacaaaaccaggactctttaagactctgacgggagaaattggtgccgtgactttagattttaaaccaggcacgtcagggagcccaattatcaatcggaaggggaaagtcatcgggctatatgggaacggagtagttacaaaatctggtgattacgtcagcgcaataacacaagccgaaagaataggtgaaccagattacgaagtcgacgaggacatctttaggaagaaaaggctcaccataatggatctacatcccggcgcaggaaaaactaagaggatattacctagcattgtccgggaggcactgaagagacgtctccggactctcatattagcacctactagagtagttgctgcagaaatggaagaagcgttacgagggctaccgattaggtatcaaactccagctgtaaagtccgaacacacgggcagagagattgtagacttgatgtgccatgcaacgttcacgaccagactacttagtagcacaagagttccgaattacaatttaattgtaatggatgaagctcatttcacggatcctagttcgattgctgcacgaggctatatctcgacaagggtagaaatgggggaagcggcggcaatcttcatgacagccaccccaccaggggctacagatcctttcccccaatcaaatagtcctatcgaagatatagaaagggaaatcccagaaagaagctggaatacagggtttgattggattacagattatcaggggaaaacagtatggtttgtgccttcgattaaggcaggtaacgatattgctaattgcttacgcaaatcgggcaagaaagtaatacagcttagccgtaaaacctttgatacagagtacccgaagacgaaattaactgactgggattttgttgtaacaactgatatatcggaaatgggcgccaactttagagcagggcgggtaatagaccctcggagatgcctaaagcccgtaatattaacagacggccctgaaagggtaattctagctggccctataccggtaactccagcttcagcggcgcaaagacgggggcgcataggcaggaacccagcacaggaagacgaccaatacgtattctcaggtgaccctctcaaaaatgatgaggatcacgcacattggacagaagcaaaaatgctcttagataatatctatacaccggaagggattataccaactctattcggtcctgaaagagagaaaacgcaagcaattgacggagaatttcgactcagaggtgagcaaagaaaaacgtttgtagaactgatgcgaagaggtgatttaccagtatggttatcttataaagttgcgagcgcaggtatctcttacaaagacagagaatggtgttttacaggggagcgcaataaccaaattcttgaggaaaacatggaagtggaaatctggactagggaaggagagaagaagaaacttaggcctaaatggctagatgcgagggtatacgccgaccctatggcactaaaggattttaaagaatttgcaagcggacgaaaaagtattacactagatattttgactgaaatagcgtcgttaccaacttacctcagttctcgcgcaaaattagcgttggacaatatagtcatgcttcatacgacggaaagagggggacgggcataccaacatgctttaaacgaactaccagaatccttagaaaccctaatgctggtggctcttttaggtgcaatgacagcaggtatattcctattctttatgcaaggaaaaggtattggcaaacttagtatgggactgataacaatcgccgtcgcatcaggattattatgggtcgcagaaattcagccacaatggatagcagctagtataatcctggaatttttcttaatggtcctattaattccagaaccggaaaaacaaagaaccccacaagacaaccaactaatttacgttatcctcacaattttaactataataggcttaatagcagcaaacgaaatgggactgatagagaaaacaaagacagacttcggtttttaccaagtgaaaacagaaacaacgatactagatgttgatcttcgaccagcgtcagcatggaccctgtatgccgttgccactaccattttaacacctatgcttagacatacaattgaaaatacctctgccaacctatccttagctgcaatagcaaaccaggctgcagttcttatgggattaggtaaaggctggccactgcatcgaatggacctcggagttcctcttttagctatgggctgttactcacaagtaaacccgacaacattaacagcgtcgttagtaatgctacttgttcactacgcaataataggcccaggcttacaagcaaaagccactcgtgaggctcaaaagagaactgcagcaggaataatgaaaaacccgacagttgacggaataacagtaatcgatttggaaccaataagctacgaccccaaattcgaaaagcaactgggacaagtaatgctattagtcttgtgtgctggtcagttgttattaatgcgaacgacctgggctttttgtgaggtactaacactagcaacaggacctatactcacgttatgggagggaaacccagggaggttttggaacacgacaatcgctgtaagtaccgccaatatcttcagaggaagctatctggcgggagctggacttgctttcagcttaatcaaaaacgctcagacccctcgacgaggaacagggacagccggtgaaactttaggagaaaagtggaaaaggcaactgaacagccttgatcgcaaggagtttgaagagtacaagcggtcaggaatcctcgaagttgatagaacagaagcgaaaagtgcgcttaaagatggaagtaaaatcaagcatgcggtaagtcgaggaagctcaaaaataaggtggatagtcgaaagggggatggttaaacctaaaggaaaagttgttgacctcggatgcggccgaggcggatggagttattatatggccaccctaaagaatgtcacagaagtaaaagggtataccaaaggaggacctggacatgaagaaccaatccctatggcgacctacggttggaatttagttaagctgcactcaggtgtagatgtattttataaacctacagaacaagtagacacgcttttgtgcgatatcggtgaatcatcatcaaatcctacaatagaggagggaagaacattacgtgtactaaaaatggttgaaccttggttaagctcaaaaccagagttttgtataaaagtcttaaacccatatatgccgacggttatagaagagttagagaagttacagaggaagcacggaggaaacctagtccgttgcccattatcgagaaactcgacccatgaaatgtattgggtatcaggggctagcggtaatatcgtgtcaagcgtaaatactacatcaaaaatgctactaaatagattcacgactcgacatagaaagccaacttatgaaaaggatgttgaccttggagccggaactagatccgtttctactgagatcgaaaaacctgatatgacaataatcggccgtaggctacaacgattgcaggaggaacacaaggaaacatggcattacgaccaagaaaacccctatagaacatgggcataccatggtagttacgaagctccaagtacaggttcagcatcgtccatggtgaacggagtagtcaagctacttacgaagccatgggatgtaataccaatggtgactcagctcgctatgacggatacgacacctttcggacaacaacgcgtatttaaggaaaaagtagacacaagaacaccgcagccgaaacctggcacaagaatggtaatgacgacgaccgcaaattggttatgggcgttattaggaaagaagaaaaatcctagactttgcacccgggaagaatttatttcaaaagtacgttctaatgcggccataggagcagttttccaagaagaacaaggatggacatcagcctcggaagcagtaaatgatagtagattttgggagctagtagataaagaacgtgccttgcaccaagaagggaaatgcgaatcttgtgtatacaacatgatgggtaaaagggaaaagaaattgggtgagttcggcagagctaaaggttctagagcaatttggtatatgtggttaggcgcaaggtttctagaatttgaggcacttggattcctaaatgaagaccattggttcggaagggaaaacagctggagcggagtcgaaggggaaggactacatcgcttgggatatatattagaagaaatagataagaaagatggagatctaatgtatgcagacgacaccgccggttgggacacaagaattacagaggacgatttgcaaaatgaagaactcataacagaacaaatggcgccacaccataaaattcttgcaaaagctatctttaaactgacatatcaaaataaggtagtgaaagtattacggccgacgcccaggggagcagtaatggatattataagtcgtaaagatcaacgaggaagtggacaagtagggacctatggattaaacacattcacaaacatggaagttcaactgatccgccaaatggaagcagaaggagtaataacccaagacgacatgcaaaaccccaaggggcttaaagaaagggtagagaaatggttaagagaatgcggcgttgatagattgaagaggatggccatatccggagatgattgtgtggtcaaacctcttgatgaacgctttggaacatctctactgttcttaaacgacatgggtaaagttagaaaggatattccacagtgggaaccatctaaaggctggaagaactggcaagaagtacccttttgttcccatcatttccacaagattttcatgaaggatggacggagcttagtcgttccctgtcgtaaccaagatgagctaattggtcgtgcaagaattagccaaggagcgggttggtccttgcgagaaacagcctgccttggaaaagcatatgctcaaatgtggtcattaatgtatttccataggcgcgatttacgattagcatctatggccatttgtagcgcagtccccacagagtggttcccgacgagtagaacgacatggtcaatacacgcacaccatcaatggatgacaacggaagacatgcttaaagtgtggaacagagtctggattgaagacaaccctaacatgatagataaaactccagtgcattcatgggaagacattccttacttggggaaacgagaagatctttggtgcggatcccttattgggctgagctcacgtgctacgtgggccaaaaacatccatactgccataacgcaggttcgtaacctcataggtaaagaagaatatgtggactatatgtcagtgatgaagcgatattctgcaccgagtgaatccgagggtgtattataa

SEQ ID NO: 23690 - RNA, 9867 nt, synthetic construct
  misc_feature 1..9867: note = derived and/or modified CDS sequence (opt6) from DENV-4__KJ579242__SS-prME
  source 1..9867: mol_type = other RNA
tcaacaataacattactatgtttaattccaactgttatggcatttcacttatcaacacgagacggtgaacctctgatgatagtggcaaaacatgaacgtgggagaccacttttattcaagacgacagaaggaataaacaaatgtactctcattgcgatggacctgggagaaatgtgcgaagacaccgtgacatacaaatgtccactccttgtaaacactgaaccagaagatatagactgctggtgcaaccttacatcaacgtgggtgatgtatggtacatgcacgcaaagcggtgaaaggcgacgtgagaaaagatcagtagcacttacccctcactccggaatgggtttggaaactcgtgcagaaacgtggatgagctcagaaggtgcatggaaacatgcgcagcgtgtagaaagttggatacttaggaatccaggctttgctctactcgccggttttatggcgtacatgatcggacaaacaggcatacagagaaccgtctttttcgttctaatgatgctggtcgcccctagttatggaatgagatgtgtaggggtcggaaatcgagattttgtagaaggagtgagcgggggagcgtgggtcgatttggtacttgaacacggaggttgcgtcacaacaatggcacaaggtaaacccacactagatttcgaattgacaaaaacaactgcgaaagaagttgcgttactaaggacctattgcatcgaagcattgatcagcaacattactaccgctaccagatgcccaacacagggggagccctatctgaaggaagaacaagatcaacaatacatatgccggagagatgtagttgaccgaggctggggaaatggctgtggtctatttggaaagggcggtgtagtcacgtgtgcaaagttcagttgcagtggaaaaataacagggaacttagtacaaatagaaaacctagagtatactgtagtagtaacagtacacaacggagacactcatgcagtaggaaatgacacatcgaaccatggagtaacagctaccatcactccaaggtcgccgtctgtagaggtaaaactaccggattatggggaacttacgttagactgcgagccaagatctggaatcgactttaacgaaatgatattgatgaaaatgaaaaagaaaacttggctagtacacaaacagtggtttttggacctcccgttgccatggacgacgggtgcagatacgtctgaagttcattggaattataaagaaagaatggtaacgtttaaagtaccccatgctaagagacaagacgtgaccgtactgggatcccaagagggagctatgcactcagctctagcaggcgcaacagaggtagacagtggtgacgggaatcatatgtttgcaggacatctgaagtgcaaagtacgaatggaaaaattgagaataaaaggtatgagttatacaatgtgttcaggtaaattcagtatagataaggaaatggcagaaacccaacacggcacaacagtggtaaaagttaaatacgaaggtgcaggggccccctgtaaggtgcccatagaaatacgcgatgtaaataaggaaaaagttgtaggtcgagtaataagtgctactccgctagccgaaaatacaaacagtgtaaccaacatcgaactagagccaccgtttggagattcgtacatagtcataggtgtaggaaacagtgctttgacactacattggttcagaaaaggatcttcaatagggaagatgttcgagagtacatacaggggagccaaaagaatggcaatactaggagaaacagcatgggactttggatcagtaggcggcttatttacatcactcggtaaagcagtacatcaagtatttgggtcggtatatacaacaatgtttgggggagtctcttggatgatacgcatacttattggattcttggtgttatggataggcactaattctcgaaatacttctatggccatgacatgtatcgctgtcggcggaataacattattccttggtttcacagtccaagctgacatgggttgtgtagtatcatggtcaggccgagaactaaagtgtgggagcggtatatttgtggttgataatgtgcatacatggaccgagcagtataaattccaaccagaaagcccagcacgcctagccagtgctattctaaatgcacataaggatggagtatgcggaatccgtagtacaacgcgattggagaatgtaatgtggaagcaaataacaaatgaattaaattacgtgttgtgggaagggggccatgatctgacggttgtggctggtgatgttaaaggagttctaactaagggtaagcgtgcgctaacacccccggcgtcagatctcaaatactcttggaaaacttggggtaaggcaaaaattttcacacctgaggctcggaacagtacgtttttaatcgatggtccagatacatcagaatgtccaaatgagcgacgggcatggaactcttttgaagttgaagattatggttttggaatgtttaccacaaacatatggatgaaatttagggagggatcatcggaagtatgcgaccacagacttatgagcgccgcgataaaagatcaaaaagcggtacatgcagacatgggatactggatagagtcatctaagaaccaaacttggcaaattgaaagggcgtcattaatcgaggtaaaaacttgtttatggccaaaaacccatacactatggagcaacggtgtattagagagccaaatgctaataccaaagagctatgcaggtccattttcacaacataattacagacaaggatacgcgacccaaactgtagggccctggcatttagggaagttggaaattgattttggagaatgtccagggaccacagtaactatacaagaaaactgcgatcaccggggaccgtcgttacgaacaaccaccgctagcggtaaattagttacacaatggtgttgtcgtagctgcaccatgcctccactgcgatttctgggtgaggatggatgttggtatgggatggaaatacgacctttatcggaaaaggaggaaaacatggtgaaatctcaagtcaccgcaggccaaggtaccagcgagacatttagtatgggattactgtgcctaacattattcgtagaagagtgtcttaggcgaagagttacgaggaaacacatgatactcgcagtggtaataactctctgcgctataatacttggaggactcacttggatggatctacttcgcgccctaatcattttaggggatacaatgtccggtagaataggtgggcaaactcatctagcaataatggctgttttcaaaatgagtcccggctacgtactcggtgtatttcttcgaaagctcacgagcagggagaccgcccttatggtaataggaatggctatgactactactttatccataccacatgacctcatggaattgatcgacggtataagtcttggtttgatattgcttaaaatagtaacgcaattcgataatacacaggtaggtaccttggctttgtcattaacgttcattagaagtacgatgtccctagtgatggcctggcgtaccattatggcggttttatttgtagttacccttattcctctatgcaggacaagctgtctgcaaaaacagtcacactgggttgagataacagccctaattcttggggctcaagcattacccgtgtatctgatgacactgatgaaaggagcctctcgaaggagttggccactgaatgaaggtattatggcggtcggtcttgtatcattattaggctccgctttactaaagaatgacgttcctctcgccggaccgatggtagcgggaggcctcttacttgctgcctatgtaatgtcaggaagtagcgcagacttatcattggaaaaagcagctaacgtccaatgggacgagatggcagatataacaggtagttctccaataatagaagtaaaacaagacgaggacggcagcttttcaattcgcgacgtggaagaaactaacatgataacgctattagttaaattggctttaattacagtttctggtctttacccacttgcaatcccaataactatgacactttggtacatgtggcaagtaaaaacacaaagatctggagcgctgtgggatgtcccctcacccgccgcaacgcaaaaagcagccttatccgagggagtatacagaataatgcaacgtgggttattcggaaaaactcaagtcggcgttggaatacacatggaaggagtattccatactatgtggcacgttacccgtggatccgttatctgtcatgaaactggcaggttagaaccatcgtgggctgacgtccgtaatgacatgataagctatggcggaggctggcgattaggagacaaatgggataaggaagaagatgtccaagttttagcgatagaacctggcaaaaacccaaagcatgtccaaacaaaaccaggactgttcaaaacacttacgggagagatcggcgctgttactcttgattttaaacctggcacaagtggatccccaatcataaatagaaaagggaaggtaataggcctctacggaaacggcgtagtaaccaaaagtggggattacgtgtcagcaattacacaagctgaaaggatcggtgaacctgactatgaagtggatgaagatattttcaggaagaaacgcctaactattatggatttacaccccggagctggtaaaacaaaacgcattttgccttctattgtaagagaggcacttaaacgaaggcttaggacattgatattagcaccaacgagagtcgttgctgcagagatggaagaagcattacgaggcttgccaatacgttaccaaacgcctgctgtaaagtcagagcacaccgggagagaaatagtagacctaatgtgtcacgctacctttacaacccgtttacttagtagtactagagtaccgaactacaatttaatcgtaatggacgaagcacatttcacggatccttctagtgtcgctgcacgaggctacatttcaacaagagttgaaatgggagaagccgctgcaatctttatgacagcaacacctccgggagcaacagaccctttcccacagagtaattcacctattgaagacattgaaagggaaatccctgaaagatcatggaatactgggtttgattggataacggattatcaaggcaaaacagtctggtttgttccatcgataaaagctggaaacgatattgctaattgtctaaggaaaagcggcaagaaggtcatacaactgtctaggaaaacctttgatacagaatacccaaaaacgaaactcacagattgggactttgttgtaacaactgacatatccgagatgggagctaattttcgagcaggtcgagtaatcgacccacgacggtgtcttaaacctgtgatcctcacagacggccctgaacgtgttattcttgctgggccaataccagtcacaccagcatctgcggcacaaagaaggggtagaattggtagaaatccagcgcaagaagatgaccagtatgttttctcaggggatcctcttaaaaatgacgaagaccatgcacattggacagaagcgaaaatgttattagacaatatatacacccctgaaggcattataccgactctattcggacccgaaagagagaagacacaggcaatagatggagaatttagattacgaggtgaacaaagaaaaacattcgtagaactaatgagaaggggtgatttgccagtatggttatcttacaaagtagcaagtgctggcatctcctacaaagacagagaatggtgtttcacaggagagcgcaataaccaaatacttgaggaaaacatggaagtagaaatatggacccgagagggtgagaagaagaaactgagacctaaatggttagatgcaagagtctatgctgatccaatggcactaaaggatttcaaggaatttgcttcaggaagaaagagcatcactttagatattttaactgaaatcgcatcgctgccaacctacctttcgagtcgagcaaaattagcattggacaatattgtaatgttgcacacaaccgaacgtggaggcagagcatatcaacacgcgctgaatgaactacctgaatcattggaaactttaatgttggttgcccttttaggggctatgacggccggaatattcctattctttatgcagggaaaaggaataggaaaattaagcatggggttaattacaatcgcggtggcctctggcctattatgggtggcagaaatccaacctcaatggattgccgcgtccattatccttgagttcttcttaatggtattgttaatccctgaacctgaaaaacagagaacaccgcaagacaaccaattgatatacgtgatactaacgattctaacaattataggattaatcgcagcgaacgaaatgggtttgatagagaagacaaaaactgatttcggcttttaccaagttaagacagaaaccaccatactcgatgttgacttgcgtcctgcatccgcctggacgttatacgccgttgcaacgaccatactaactccaatgctacggcacacaatcgaaaacacaagcgcaaatctgagcctggcagcgatcgctaaccaagctgctgtgcttatgggactgggcaaaggatggcctctccatcgtatggacttaggcgttccattactggcaatggggtgttattcacaagtaaatcctactacacttacggcttctcttgtaatgctcttagtacattatgctatcataggacctggattgcaagcaaaagctactagagaagcacaaaaacgaactgctgcagggatcatgaagaaccccactgttgatggaataacggtaattgatttggaaccgatcagctacgatcctaaattcgaaaagcaactgggccaagtgatgttattggttttatgcgcgggccaattattactcatgagaacgacctgggcattttgcgaagtactcacactcgctacaggcccaatccttactctctgggaagggaatccaggtaggttttggaatacaaccatcgcggtcagtacagcaaatatatttagaggcagttatttagcaggagccggcttagtcttctccctgattaaaaatgcacaaaccccacgaaggggtacaggaactgcaggagagacgttgggcgagaaatggaagcgccagcttaatagccttgatagaaaggagttcgaggagtataagcgtagtggcatcttagaagtggataggactgaggcaaagtcagcgttaaaagacggttcaaagattaaacatgcagtttccagaggctctagcaagatacggtggattgttgaaagaggaatggttaaaccaaaaggaaaagtcgtcgatctaggatgtggtcgaggcggttggagctactatatggcgacccttaaaaatgttactgaagttaaaggatacacaaaaggaggaccgggtcatgaagaaccaattccaatggcgacatatggatggaatctagtaaaattgcactctggagtggatgtattttataagcctactgaacaagttgacacgttattgtgtgatattggagaatcttcatcgaatccaacaatagaagaaggtcgtacaatgagggttttaaaaatggtcgagccatggttatcgagtaaaccagagttctgtattaaagtattaaatccctatatgccgacagtcatagaagaattagagaaattacaacggaagcacggcggaaacttagttcgttgtccactctctagaaactcaactcatgaaatgtactgggtaagtggagcctctggaaatattgtatcgagtgtgaatacaacaagtaaaatgttattaaatagatttactacaagacatagaaaacccacgtacgaaaaggatgtagacctaggcgcaggtacaagaagcgtgagcacagaaaccgaaaaacccgatatgacaataataggcagaagattgcagcgcctccaagaagaacataaggaaacctggcactacgaccaagaaaatccataccgaacgtgggcctatcatggctcatacgaagctccatccactggttcagcatcaagtatggtaaacggtgtcgtaaaacttctaacgaaaccttgggacgtgattccaatggtcactcagcttgccatgaccgatacaactccttttggacagcagcgagtctttaaagaaaaggtagatacgagaacaccgcaaccaaagcccggaactagaatggtaatgaccacgacggctaattggttatgggcacttcttggaaagaagaaaaatccaaggctatgtactagagaagagtttatttcgaaagtaagaagcaatgctgctattggcgctgtatttcaggaagaacaaggatggacctctgcttcagaagccgtaaatgattcaagattttgggagctagtagacaaagaacgagcattacatcaagaaggtaaatgtgaatcatgtgtttataatatgatgggtaaaagggagaagaaacttggagaatttggacgagcgaaagggagtagagctatctggtatatgtggttaggtgcacgatttctcgaatttgaagctctgggattcctcaatgaagaccactggttcggaagagaaaatagctggtccggagtggaaggcgagggtcttcatagactgggttacatattagaggaaattgataagaaagatggtgacctaatgtacgctgatgacaccgctggctgggacacaagaattactgaggatgatttacagaatgaggaattgataacagaacagatggccccacaccacaaaatactagccaaagcgattttcaagctaacttatcaaaacaaagtagttaaagtccttaggccaacaccgagaggagccgtaatggatataatatcaaggaaagaccaaagaggcagcggtcaagtcggaacgtacggcttgaacacgttcacaaatatggaagtgcaacttatacgacaaatggaagcagaaggtgttataactcaagacgatatgcaaaaccctaaaggattaaaagaaagagtggaaaaatggttgcgagagtgcggtgtagatcgattaaagcggatggctatttcaggggacgattgcgtggtaaaaccgcttgacgaaagattcggaacaagcctattgtttctaaatgatatgggtaaagtaaggaaagatataccgcaatgggaacctagtaaaggttggaaaaattggcaggaagtcccattttgttcgcaccactttcataaaatctttatgaaagacggaagatcattagttgtgccctgcagaaatcaagatgagttaattggccgggccagaatatcccaaggcgctggttggagtctacgggagacagcatgcttgggaaaggcgtatgcacaaatgtggagtttaatgtactttcatcgtcgagatttgcgattggcatcgatggcgatatgtagcgcggttccgactgagtggtttccaacttcacgaacgacatggtcgattcacgcccatcatcaatggatgacaacagaagatatgctaaaggtctggaatagggtctggattgaggacaacccaaacatgattgacaaaactccagtgcatagttgggaagatattccctatttaggaaaacgggaggacctttggtgcggatccttaatcggtctgagtagtagagctacatgggccaaaaatatacataccgcgataactcaagtaagaaacctgatcggaaaagaagaatacgtggattatatgccggtcatgaagcgttattcggcaccatcagaatctgagggtgtgctatag

SEQ ID NO: 23691 - RNA, 9867 nt, synthetic construct
  misc_feature 1..9867: note = derived and/or modified CDS sequence (opt6) from DENV-4__GQ398256__SS-prME
  source 1..9867: mol_type = other RNA
tcaacaatgacgcttttatgccttatccccacagttatggcatttcatttatccacaagagacggagaacccttaatgattgttgctaaacatgaaagaggaaggccattattgttcaaaactaccgaaggaatcaacaaatgtacattaatcgctatggatttaggagaaatgtgcgaagacactgtgacttacaaatgcccactgttagtaaatacagaaccagaggatatagattgctggtgtaacttgacaagcacttgggttatgtatggaacttgtactcaaaacggtgaaagacggcgtgaaaagaggagtgttgcactgacaccacattcaggaatgggacttgagacacgagctgaaacgtggatgtcctcagaaggcgcatggaaacatgcacagcgtgtcgaatcatggattctaagaaatccaggttttgctttattggctggctttatggcatacatgattggtcaaacagggatccaaagaacagtatttttcgtattaatgatgctggttgccccaagctatggtatgcgatgcgtaggtgtaggcaatagagattttgttgagggagtaagcgggggagcatgggttgatttggtactagaacatgggggttgtgttaccacgatggctcagggaaaacccacacttgacttcgaactaacaaaaacaaccgccaaagaagttgcactattgaggacctattgcattgaagctagcatttccaatataacgacagcaacgaggtgtcctactcaaggagaaccatatttgaaagaagaacaggaccagcaatatatttgtcgtagagatgtagttgatagaggatggggtaacggttgtggtctgttcggtaaaggaggcgttgtcacgtgtgcaaaattcctttgctcaggcaaaataactggaaacttagtacagatcgaaaatttagaatacacagtcgcagtgacggtacataacggagacacacatgcagttggaaatgatacaagttcacatggtgtaacagcaaccatcacgccacgcagtccgtccgtagaggttaagctacctgattacggggagttaacactcgattgcgaaccccgtagtgggattgatttcaatgaaatgattctcatgaaaatgaagaagaaaacatggcttgtgcataaacaatggttcctcgatttacctttgccatggacagccggagccgatacatccgaggtccattggaatcataaggagagaatggtaacatttaaagttccccacgcaaaaagacaagacgtaacagtcctagggtcccaagaaggagcaatgcattcagccctagcaggcgccactgaagttgattcaggagacggtaaccatatgtttgcgggtcacttaaaatgtaaagtgagaatggaaaagctgcgaataaaaggaatgagttatactatgtgttccggcaaattcagtatagataaggaaatggctgaaactcagcatgggactactgttgtgaaagttaaatacgagggggctggtgcaccttgtaaggtcccgatcgaaattagggacgttaataaggaaaaagttgtaggaagaatcatttcttctacaccattcgcggaaaacacgaactctgttacgaatatagagttagaaccaccatttggagactcatacatagttatcggagtaggagaatctgcgttgacgttacactggttcagaaaaggatcttctattggtaagatgttcgagagcacgtatagaggtgcaaaaagaatggctatactaggagagactgcttgggacttcggcagtgtgggaggactgttcacttcattaggcaaagctgtacatcaagtatttggctcagtttacactaccatgttcggaggggtaagctggatggtacgaatactcatcggctttctagttctgtggataggtacaaatagtcgaaatacgtcgatggcaatgacatgtatagcagtaggtgggatcacgttatttttaggttttacggtacaagcagatatgggatgcgtagtgagttggaatgggaaggagctaaaatgtggtagtggaatctttgtagtagataacgtccatacctggaccgaacaatataaattccagcctgaatctccagcacgattagcgagcgcaattctcaatgctcataaagatggagtctgtggtatccgctctacaacaaggttagaaaatgtaatgtggaaacaaataacgaatgaattaaactacgttttatgggagggtggacacgatcttacggttgtagccggcgatgtaaaaggcgtccttaccaaaggtaaaagggcgctaacgcctccggttaacgatctaaaatacagttggaagacctggggtaaagccaaaatatttactcctgaggctcgtaacagtacgttcttaatagacggaccagatacatcagaatgtccgaacgaacggagagcatggaacttctttgaagttgaagattatggctttggtatgtttacaacaaatatatggatgaaatttcgtgaaggaagctcagaagtttgcgatcatagattgatgagtgcagcaattaaagatcaaaaagcagttcatgccgacatgggatattggattgagtcatctaaaaaccaaacttggcaaatagagaaagcatctctaatagaagttaaaacatgcctatggcccaagactcacacactgtggtcaaacggagttttggaatcacaaatgcttattccaagatcatatgctggtccattcagccaacataattacagacaaggatacgccacgcaaaccgttggtccgtggcatttaggaaaattggagatagactttggtgaatgcccaggtacaacagtcgccatacgtgaagattgtgaccacagaggaccctcgttacgaaccacaacagcaagtgggaaattagtgacgcagtggtgctgtcgaagctgcactatgccgcctttgagattcttaggggaagatggttgttggtatggaatggaaatcagaccactaagcgaaaaagaggagaatatggtgaaatctcaagttacagctgggcaaggaacttctgaaacattctcgatgggcctattatgcctaacgctatttgtagaagaatgtctacgtcgtcgtgtaacaagaaaacatatgatactggttgtggtaataacattttgtgcaattattctcggtgggttaacatggatggatctactgcgggcccttataatgctcggagatactatgtccggcaggattggtgggcaaatacacttagccatcatggcggtatttaagatgtcccctggatacgttttgggagtatttttaagaaaacttacaagtcgagaaacagctttaatggtaatagggatggcaatgacaacagtattttccattccacacgacctaatggaacttatagatgggataagcctaggcttaatacttctcaaaatagttactcactttgacaatacacaagtcggaacattagccttgtcattaacgtttctacgttctacaatcccattagtaatggcatggcgaacaattatggcagtattctttgttgtaaccctaataccattatgcagaacctcatgtctacaaaaacaatcacactgggttgaaataacagcattgattctgggtgcccaggcgttgccagtttatctcatgacgttaatgaaaggtgcaagccgacgtagttggccattaaacgaaggaataatggccgttggcctagtaagcctacttggaagtgccctgttgaaaaatgatgtaccactagcaggacctatggtggccggtggattattactagcagcttatgtaatgtctggaagttctgcagatctttctttagaaaaggcagctaacgtccaatgggacgagatggccgatattacaggttcatcgccaataatagaagtaaaacaagatgaagatggtagttttagcataagagatgtagaagaaaccaacatgataactttactcgtaaaactagcgctcataacagtatctggattgtatccacttgctattccagttacaatggcactttggtacatttggcaggtaaaaacgcagagatctggggcattatgggatgtcccgagcccagccgcgacacaaaaagcaactctgagtgaaggagtttacagaataatgcaaagagggctgtttggcaaaacgcaagtgggggtaggcattcacatggaaggtgtattccatacaatgtggcacgtaacaagaggtagtgtaatatgtcacgagacaggaagattggagcccagctgggcagacgtccgtaatgatatgataagttacggaggtggttggagattgggagacaagtgggataaagaagaagatgttcaagttttagcaattgaaccagggaaaaaccccaaacatgttcagacaaaaccaggtctctttaagacgttaacaggcgaaataggagccgttacgctggatttcaagcccggtacgtcggggagtccaattatcaataagaaaggaaaagtgattggactatatggaaatggagtagtgacgaagagtggagattacgtgtcagctataacgcaagcggaaagaatcggagaacccgattatgaggtcgacgaagatatctttcggaagaaaagacttactataatggatctccaccctggagccggtaaaacaaaacgcatattaccatctatagttcgtgaggccctgaaacgaagacttcgaactctcattctagcaccaacacgcgtagttgcagcagaaatggaagaggctttacgaggattgccgatcagataccaaacgcctgcagtaaaaagtgagcatacaggacgggagattgtagaccttatgtgccatgccacattcacaacaagacttttgagtagcaccagagtgccaaattataatcttatagtaatggacgaggcacattttacagacccatgctcagtagcggcacgtggatatatatccacgagagtggagatgggtgaagcggcagcaatttttatgaccgctactccgccaggagcgacagatccgtttccacaatcaaacagcccgattgaagacatcgaacgagagatacccgaaaggagctggaacacaggttttgattggattactgattatcaagggaagaccgtttggtttgtacccagtataaaagcaggaaatgatatagcaaattgtttaagaaagagtggtaaaagagtcattcaactgtcacgaaaaacttttgacacagaatacccaaaaaccaaactgacagactgggatttcgttgtaaccacagacatatcagaaatgggagcgaactttagggcaggtcgcgtaattgaccctaggagatgtcttaaacccgtaatattaactgatggccccgaacgagtaatattggcgggtcccattcctgtcactccagcaagcgcagcacaacgtagaggacggattggacgaaaccctgctcaagaggatgaccaatacgtgttttcaggggacccactaaagaacgacgaagaccacgctcactggacggaagcaaagatgttattagataacatctatacgccggaaggaataatcccgaccctgttcggaccggaaagagagaaaacacaagcaatcgacggcgaatttagattaagaggtgaacaaaggaaaacgttcgtagaactcatgaaacgaggagacttaccagtttggctctcatataaagttgccagtgccggaatctcttataaagatagggagtggtgtttcaccggcgaacgaaacaaccagatacttgaagaaaacatggaagtagagatatggacgaaagaaggagagaagaagaaattacggcctaaatggctcgacgcccgtgtttatgcggatcccatggccttaaaagatttcaaagagttcgcaagtggacggaaatcaataactctagatatcttaacagagatagcctcactaccgacttatttatcttcaaaggctaaactagctttggataacatagtcatgttacacacaaccgaaaaaggcggcagagcctatcaacacgctcttaacgaattaccagaaagtttggaaacattaatgctggtggcgctactcggggcgatgactgcaggaatatttttattctttatgcagggcaaaggcattgggaaattgtcaatgggtctcatcgctatagcagtagcatcaggactgctctgggtggcagagattcaaccccagtggattgcagccagcataattttagagttctttctgatggttctactaattccggaaccggaaaaacaaagaacacctcaagacaaccaactaatttacgttatcttaacgatactcacaataataggattaatagctgcaaatgaaatgggccttattgagaaaacaaagacggactttggattttaccaagtgaagactgaaacaaccattttggatgtcgatctaagaccggcctctgcatggactttatacgccgttgcaactactatattgacaccaatgttaagacacaccatagagaacaccagcgcaaatctgtctttagcggcaattgcaaatcaggcggcggttttgatgggattaggaaaaggatggccattgcatcgaatggacctaggcgtaccattgttggcgatcggctgttacagtcaagtaaacccgacaacattgacggcgtcgttagtaatgcttcttgtacactatgcaattattggacccgggcttcaagccaaagcaacaagagaagcccaaaaacgcactgcggcaggaataatgaaaaatcctacagtagatggaatcacggtgatcgacttggaacctatcagctatgatccgaaatttgaaaaacagctagggcaggttatgctattggttttgtgcgttggtcaattattattaatgcgaactacatgggcgttgtgtgaagtgttaacgctagctaccggtccggcaatgaccttatgggaaggaaatcctgggagattttggaacacaactatagcagtatcaacagctaatatattccgaggaagctacttggcaggagccggcctcgcttttagtctaattaagaatgcccaaacgccacgacgcggaacaggcacaacgggagagacgcttggagaaaaatggaaaagacaactaaatagtctagacagaaaagagttcgaagaatacaaaagaagtggcatcctagaagtagatcgaacggaagcaaagagcgctcttaaagatggaagcaagattaagcacgcagtttcgcgcggaagcagcaagatccgctggatagtcgaacgtggaatggtcaagcccaaaggaaaggtagtagatttgggatgcggccgtggaggttggtcatattatatggctacgctgaagaatgtaactgaagtcaaaggttatacgaagggcggacctggacatgaagaacctattccaatggcaacttacgggtggaacctagtgaaacttcactctggggtggatgtgttctataaaccaaccgaacaagtagacacgttgctgtgtgatatcggcgaaagctcgagtaaccctacaatagaagagggaagaacattaagggttctaaaaatggttgaaccgtggctatcttcgaaaccagagttctgtatcaaagtattgaacccgtatatgcctacagtcatcgaagagttagaaaaactgcaaaggagatacgggggttcattagtacgttgtccgcttagcagaaattcgacccacgaaatgtactgggtatcaggtgcatcaggcaacatagtatcatcagttaatacgatatccaagatgttattaaaccgctttactacacgtcacaggaaacccacatacgaaaaagatgttgatcttggggccggaacaagatcagtctcaacagaaaccgaaaaacccgacatgacagtgataggtcgtagattacagaggctgcaagaagaacataaagaaacttggcactatgaccaagaaaacccctaccgaacatgggcttaccatggctcttatgaagcaccatctaccggcagcgcatcctcaatggtcaatggcatagttaagttactcacaaaaccgtgggatgtaatcccgatggtaacgcagctagcaatgacggatacaactcccttcggtcaacaacgtgttttcaaagaaaaagttgatacacgaaccccgcaacctaagccaggaacacgaatgataatgactacgactgctaactggttgtgggcattattgggcaagaagaaaagccctcgtctttgcacacgcgaagagttcatatccaaagtgagatctaatgccgcaataggagccgtatttcaagaagaacaaggttggacaagtgcaagtgaagcagtaaatgatagcagattttgggagcttgttaacaaagaaagggcattacatcaagaaggaaaatgcgagtcatgtgtatataacatgatgggaaaacgtgagaagaagttaggagaatttggtagagcaaagggtagtagagctatatggtatatgtggttaggggcgcgatttttggaatttgaggcgttaggatttctaaacgaagatcactggttttcgcgcgaaaattcgtggagcggcgtcgagggagagggactacatagactaggatatatattggaagacatagataagcaagatggcgaccttatttacgccgacgatacagctggatgggataccagaattaccgaagatgacctattaaacgaggaattaattactgaacaaatggcacctcaccacaaaacattggccaaagcaatattcaagctaacataccaaaacaaagtcgtcaaagttctacgtccaacgcctaaaggtgcagtgatggatattatctcaagaaaagaccaaagaggcagcggacaagttggtacttatggactaaacacttttacaaacatggaagttcagttaattaggcaaatggaagccgagggagtaataacacaggacgatatgcaaaatcctaagggactcaaagaacgtgttgaaaaatggttaacagagtgcggtgtagatagactcaaaaggatggccatttcaggtgatgactgtgtggtcaagccgttggatgaacggttctccgcaagtttactattcttaaatgacatgggaaaggtacgtaaggacataccacaatgggaaccttcaaagggctggaaaaattggcaagaagtaccattctgcagtcaccacttccacaaaatatttatgaaagatggacgcagcttagtcgtgccctgccgaaaccaagatgagttgataggcagagcgagaatatcccaaggtgctggctggtcattgcgtgaaactgcctgtcttggaaaggcttacgcgcaaatgtggtctttgatgtattttcaccgaagggacctgagattggcctcaatggctatctgttccgcagttcctacagaatggtttcctacctcaaggacaacttggagtatacatgcacaccatcaatggatgactaccgaagatatgttaaaagtatggaatcgcgtatggatagaggataacccgaacatgactgacaaaacgccagttcattcgtgggaagacattccctatttggggaaacgagaagacttgtggtgtggcagccttataggtctatcgtcccgagcgacatgggccaaaaatatacatacggcaataacccaagtgagaaacctcatcggaaaagaggagtatgtcgattatatgcctgtaatgaaacggtatagtgcaccctcagaatctgaaggagtactataa

SEQ ID NO: 23692 - RNA, 9867 nt, synthetic construct
  misc_feature 1..9867: note = derived and/or modified CDS sequence (opt6) from DENV-4__KC333651__SS-prME
  source 1..9867: mol_type = other RNA
tcaaccatgacactcttgtgtttaatcccgacagtaatggcatttcatctatcaactagggatggggaacccttaatgatagttgctaaacacgaaagaggcaggccccttttattcaaaacgacagaaggaataaataaatgtacactaatagcaatggatctaggagaaatgtgtgaagatacagtaacatataaatgccctttattagtcaacacagagcctgaagacatagactgctggtgcaatctaacgtcgacatgggtaatgtatgggacttgtacacagaatggagaacgtcgaagggagaaaagatcggtggctctaacaccccattctggtatgggattagaaaccagagcagaaacttggatgagttcggagggtgcgtggaaacatgctcaaagagtagagagttggatattgaggaatcccggatttgcgttgttagcgggatttatggcctacatgataggacaaacaggtatacaaaggattgtattctttgttctaatgatgctcgtagcgccatcgtatggtatgcgatgtgtaggagtcggtaatagagactttgtcgaaggagtatccgggggagcatgggttgatctagtgttagaacacggaggctgcgtaactaccatggcacaaggtaaacctactctagactttgaattaacaaaaacaacagctaaagaggtggcacttttacgaacgtactgcattgaagcaagcatctccaatattacaacagccacccgatgccccactcaaggagaaccatacttgaaagaagaacaagatcaacaatatatatgcagacgagatgtagtagataggggatggggaaacggatgcggactgttcgggaaaggtggagtcgttacatgtgctaaattcctatgttcggggaagattactggcaatctggttcaaatagaaaaccttgaatatacagtagtagtaacagtacataatggagacacacatgccgtgggtaacgatacttcaaatcatggagtcactgcaactataacgcccagaagtccatcagtagaagttaaactaccagattacggggagttaactctagactgtgagccaagatccggaatagattttaacgaaatgatattaatgaaaatgaaaaagaaaacttggctagtacacaagcaatggtttttagatctgccccttccttggacagcgggtgcggatacatcagaagtacattggaatcataaggaacggatggtgacgtttaaagtccctcacgctaaaagacaggatgtaacagtcctaggcagtcaagagggagccatgcattcagccttagcaggcgcgacggaggtagatagtggcgacggtaaccacatgtttgccgggcatcttaagtgtaaagtaaggatggaaaaattgcgtataaaaggcatgtcttatactatgtgctcggggaaattttctattgataaggaaatggcagaaacacaacatggtacaacagtagtcaaagtcaaatatgaaggagccggtgcaccttgtaaagttccgatagaaatcagagacgtaaataaagaaaaggttgtagggagaattatatccagtacaccatttgccgagaacaccaactccgttacaaatatagagctagaaccaccctttggggattcttatattgttataggtgtaggtgagagcgcacttaccttacattggttccgtaagggttcgtcaattggtaaaatgttcgaaagtacttatagaggagccaaaagaatggccatactgggagagacagcatgggactttggttcagtaggcggcctcttcacttctctaggaaaagctgtacatcaagtatttggctctgtttatacaacaatgtttggcggggtctcatggatggtacgaatcttgataggatttcttgtactctggatcggtacgaactcgcgaaacacatcaatggcgatgacctgcatcgcggtgggtggcattaccttatttttaggcttcacagtccaggccgacatgggttgtgtggttagctggaatgggaaagaactaaagtgtggaagcggtattttcgtagtcgacaacgtgcatacctggacggaacaatataaattccaaccggaatccccagcacgtcttgcttcagccatacttaatgcccataaagatggagtctgtgggatcagatccacaactagacttgaaaatgtaatgtggaagcaaataaccaatgaattaaattatgtattatgggaaggagggcatgatctaactgtggttgctggggatgtaaaaggagttttaacgaaaggcaagcgggcgttaactcctccagtgaatgacctaaaatactcatggaagacatggggaaaagccaagatattcacccccgaggcaagaaattcgacattcttaatcgacggtccagatacttctgaatgtcccaacgagcgaagggcatggaatttcttcgaagtcgaagactacggatttgggatgttcactacaaacatatggatgaagtttagagagggcagttctgaagtatgcgatcatcgacttatgtcagccgctatcaaggaccagaaagcggttcacgccgatatgggctattggatagaaagcagtaagaatcaaacttggcaaatagagaaggcctctttaatagaagttaaaacctgtctgtggccaaaaactcacacactatggagcaatggtgttcttgagtcgcaaatgctaataccaagatcatatgccggacccttttctcaacataactaccgacaaggttacgctactcaaactgttggaccatggcatctaggaaaactcgagattgactttggtgaatgccctggaactaccgttgcaatacgtgaagactgtgaccatcggggtccatctctaagaactactactgcatcaggaaagctcgtaactcaatggtgttgtagatcatgtacgatgccacccttgaggttcctcggagaagacgggtgttggtacggaatggaaatacgaccattatcagaaaaagaggagaacatggtaaagtcacaagtgacggcaggtcagggcaccagtgagacattttcaatgggattattatgtttgacactgtttgtagaggagtgtctacgacggagagtcacgagaaaacatatgatactcgtggtggtaataaccttctgtgcaatcattttgggcggattaacatggatggacctcttacgcgcgttaattatgctcggcgacacgatgtctggcagaataggcggtcaaatccacctggctattatggctgtctttaaaatgtcaccaggctacgtgcttggtgttttcctaagaaaattaacttcgcgagaaacggcactaatggtaataggaatggcaatgacaacagtgttctctatcccgcatgacttaatggagttaattgatggaatatcgttagggcttattttgcttaaaatagttactcattttgacaacacacaagtcggcactcttgctttaagcctaacgtttctaagatcaacaatacctttagtcatggcgtggagaacgattatggcagtattctttgttgttacattgattcctctatgcagaacatcctgcctacagaaacatagtcattgggtggaaataactgcactaatcctcggcgctcaagcacttccggtttatttaatgacactaatgaaaggcgcaagtaggcggagttggccgttaaacgagggaataatggcagtgggtttagtgtcactacttggaagtgctttattaaagaatgacgtcccccttgccggtccgatggtcgccgggggactattgttagccgcttacgtaatgagtgggtcgtcagccgacttactgctggagaaggcggctaacgtacaatgggatgaaatggctgatatcactggatcatcacccataatagaggtcaagcaggacgaggatggcagtttctcgattagagacgtggaggaaacaaatatgatgactctgcttgttaagttggctctaatcacagtatcaggactctaccctttagccattcctgtaacgatggctctttggtatatttggcaggtaaagacccaaaggtcaggagctctatgggacgtaccgagtccggcagcgacacaaaaggcaaccttaagcgaaggagtatatcgaataatgcagcgcgggctctttggtaaaacccaagtcggcgtaggaatacatatggaaggggtctttcatacaatgtggcatgtgacacgaggcagcgtgatatgtcacgaaaccggcagattggaaccaagttgggctgacgtacgaaatgacatgatatcatacggtgggggatggcgactcggggataaatgggacaaagaagaggatgttcaagttctagctatagaaccaggtaagaacccaaaacatgttcaaacgaagccagggctatttaaaacgcttacaggtgaaataggagccgtaacattagactttaaaccgggtacgtcaggatctccgattataaataagaaaggaaaagtgattgggttatatgggaacggtgtcgtaacaaagagtggagattacgtatcggcgataacccaggcagaaagaattggtgaacctgactatgaggtagacgaggatatcttcagaaagaaacgattgactatcatggatctccaccctggcgcgggtaaaactaagcgcatactaccgtcaattgttcgtgaagcacttaaaagacgtcttaggacattgatattagcgccaacacgcgtcgtggcggcagaaatggaagaagcgttaagaggattacctataagataccaaacgcctgccgtaaaaagcgaacacacaggacgtgagattgtagatctgatgtgccacgctacttttactacacgactattgtctagcacacgcgtaccaaattataatttaatcgttatggacgaagcacacttcactgatccctgctcagttgcagcccggggatacatatcgacacgagtcgaaatgggagaagctgcagcaatattcatgacagcaactccccctggagccaccgacccgtttccacaatcaaattcacccatagaagatatagaacgagaaatcccagaacgctcatggaatacaggatttgactggattactgattatcaagggaaaacagtatggtttgtcccgagcattaaggctgggaatgatattgcaaactgtttgcgtaagtcgggcaaacgtgttatccagctatcgagaaaaacgtttgacaccgaatatcccaaaactaaactcacagattgggattttgtagtcactactgacatttcggaaatgggtgcaaattttcgagccggacgtgttattgatccacgaagatgcttaaaaccagttatattaacggacggaccagaaagagttattctagctgggccgattccggtaactcccgcttctgctgcacaaagaagaggacgtatcgggcgaaaccctgctcaagaagatgaccaatatgtcttctcaggggaccctctcaagaatgatgaagatcacgcacactggaccgaagctaaaatgttacttgacaatatatacacgccagaaggcataataccaactttattcggaccagagagagaaaagactcaagcaatagatggagagttcagattgagaggtgaacaaaggaaaacattcgtagagctgatgaaaaggggtgaccttccagtctggttatcatataaagttgcatcagctggaatatcgtacaaagacagggaatggtgttttacgggagaacgaaataaccaaatactagaggaaaatatggaagtggaaatatggacgaaagaaggagaaaagaagaaattaagaccaaaatggctcgatgcacgagtgtatgcagacccaatggcactaaaagattttaaagagtttgcaagcgggcgaaaaagtatcaccttagatatcttaacagagatcgcatcccttccaacatacctgagtagcaaagcgaaactagcacttgacaatatagtcatgcttcacacgacagaaaaaggcggtcgcgcataccaacatgcgttaaatgaactacccgaatcattagagacattaatgctagtagcactgcttggagctatgacggcaggaatatttttatttttcatgcaaggtaaaggaattggtaaactatccatgggcctcatcgcaatagcagttgcttccggtttgttatgggtggcggagatccaacctcagtggatagcggcatctatcattctcgaatttttcctcatggttctcctcatccccgaaccagagaagcaacgcacaccacaagacaaccaacttatctacgtcatcttaacaatcctgactattattgggctgattgcagcgaacgagatgggacttatcgagaaaacaaaaacggacttcggtttttatcaagttaaaacggaaacaaccattttagatgtcgatcttcgacctgcatctgcatggactttgtacgctgtagcaacaacaatactaacgcctatgttgaggcacacaatagaaaatacaagtgccaatttaagtttagcagctatagcgaatcaagccgcagttctaatggggttggggaaaggttggcccctccatcggatggacttaggcgtaccattattagcgattgggtgttattcacaagtaaacccaaccacactaaccgcatctctagttatgctattggtgcactacgctattataggcccaggtctacaggctaaagctaccagagaagcccaaaagagaacagccgctggaattatgaaaaatcctacagtagatggcattaccgtgatagatttagaacccatatcatacgacccaaaattcgaaaagcagcttggtcaggtaatgctattggtattatgcgctggtcaattactacttatgagaactacttgggcattgtgtgaggtactaacactagcgaccggccctgcaatgacactgtgggagggtaaccccggaagattctggaacacgactattgctgtctcgacagcaaacattttccgaggatcttatctagcgggagctggattagcgttctctctcattaaaaatgcacagactcctcggcgcgggacgggaacaacaggggagacactgggtgagaaatggaaaaggcagctaaactcattagaccgaaaagaatttgaagagtacaaaagatctggaattttagaagttgatcgtacagaagcaaaaagcgctttgaaggatggatcgaaaataaaacacgccgtctcccgaggatcctcaaaaatacgatggatcgttgagcgtggaatggtgaagcccaaaggaaaagtcgtagaccttgggtgtgggcgaggagggtggagctactatatggcaacactaaagaatgtaaccgaagtcaaaggttatacaaaaggcggtccagggcacgaagaaccaataccgatggcaacatatggctggaatttagtgaaactccattccggtgtcgacgtcttttacaaacctaccgaacaggttgacacactattatgtgacataggggagtcatctagtaatcccactatagaggaaggaaggaccttacgcgtattaaaaatggtagaaccatggctgagtagcaaaccagaattttgcattaaagtactcaatccctacatgccaacagttatagaagaactggagaaactacaacgcagatacgggggatcgctagtacgttgtccactatctcgtaattcaacccatgaaatgtattgggtatccggtgctagtggaaacattgtttctagtgtgaatacaatatcaaaaatgcttctaaataggttcaccacaaggcataggaaaccaacatacgaaaaagatgtagacctcggagcaggcacaaggagcgtatcgactgaaacagagaaacccgacatgacagtcatcgggaggcgattacagcgattgcaggaagaacacaaagaaacttggcattacgatcaagaaaatccttacagaacttgggcctatcatgggtcatatgaggcaccaagcacgggttcagcatccagtatggtgaacggcgttgtaaaactattaactaaaccatgggatgttataccgatggtgacccagcttgcgatgactgacacaactcctttcggacaacaaagagttttcaaggaaaaagttgatacaagaacgcctcagccgaagccggggactcgtatgattatgactacaaccgcaaactggctatgggcattactaggtaagaagaaaagccctcgcttatgtacccgggaagaatttatttctaaagtcaggtcaaatgcagcaataggcgcggtgtttcaggaggagcaaggatggaccagtgcttcggaagcagtgaacgactctagattttgggagttagtggacaaagagcgtgcactacatcaagaagggaaatgtgagtcatgcgtatacaatatgatgggtaaaagggagaagaaattgggtgaatttggtagggctaaaggcagtagagcaatatggtatatgtggttaggagcgagattcttagaatttgaagctctaggttttctaaatgaagaccattggttcagcagggagaactcatggtccggagtagaaggggaggggttacacagattaggatatattttagaagacatcgacaaacaagaaggtgatctcatttatgctgatgatacagcaggttgggataccagaataactgaagatgatcttctaaacgaagaattgatcactgagcaaatggccccacatcacaaaacactcgcaaaggcaatctttaaacttacttaccaaaacaaagtcgtaaaggttctgcgtcctacgccaaaaggagctgtgatggatataatttccaggaaagaccaaaggggtagtggtcaagtaggaacatacggactcaacacttttacgaacatggaagttcagcttatacggcaaatggaagcagagggggttatcactcaggatgatatgcaaaatcccaaaggactaaaagaaagggtagaaaaatggttaacagaatgcggtgttgatagattaaaaagaatggcaatctcgggagacgattgtgttgtgaagcctttagatgaaagattctctacttcattactatttttaaacgacatgggtaaagttcgaaaggacataccacaatgggagccttctaagggttggaaaaattggcaagaggtaccgttttgttcacatcattttcataaaatctttatgaaagacggtagatcgttggttgtcccctgtagaaatcaagatgaattaattggtagagcaagaatttcacaaggtgctggctggtctctcagagaaactgcatgcctcggcaaggcttatgcccaaatgtggtccctcatgtatttccaccgacgggatttaagactagcaagtatggcaatttgtagtgcagtccctactgaatggtttccaaccagccgcacaacatggagtatccatgcccaccaccaatggatgactacagaggatatgctaaaagtatggaacagagtatggatagaagataatccaaatatgaccgacaaaacccctgtacacagctgggaagacattccttaccttggaaaacgtgaagacttgtggtgcggctccttaataggcttgtcatctcgtgcaacttgggccaagaatatacacacggcgattacacaagtacgtaaccttataggaaaagaagattatgttgattacatgcccgttatgaagcgatattcagctccatccgaatcggaaggcgtactatga

SEQ ID NO: 23693 - RNA, 9867 nt, synthetic construct
  misc_feature 1..9867: note = derived and/or modified CDS sequence (opt6) from DENV-4__JN559740__SS-prME
  source 1..9867: mol_type = other RNA
agtacaattacccttctttgcttaatcccgacagtcatggcatttcatctgtccacccgggatggagaaccattaatgatagtagcgaaacatgaacgcggaagacccctacttttcaaaactacagaaggaataaacaaatgtacacttattgcaatggacttgggagaaatgtgcgaagatacggtaacatataaatgcccattgttggtgaatacagaacccgaagacattgattgctggtgcaacctaacatcaacatgggtaatgtatgggacatgcacacaatctggagaacgtagacgagaaaaacgaagcgttgcattaacccctcatagcggaatgggacttgaaacacgggcagaaacgtggatgtccagtgaaggggcatggaaacatgcacaacgtgtcgaatcgtggattctgcggaaccccggatttgcactgctcgcaggattcatggcctacatgattggacaaacaggtattcagagaacggttttctttgtattgatgatgttggtagcacctagttatgggatgcgctgtgtaggtgtgggaaatagggattttgtggaaggagtctcaggaggagcatgggtagatctcgttttagaacatgggggttgcgtaaccacaatggcgcaaggtaaacctacattagacttcgaactaaccaaaacaaccgcaaaagaagtcgcgctactaagaacttactgtatcgaagcatcgataagcaatataacaactgcaacaagatgtccaacacaaggggaaccgtatttgaaagaagaacaagatcaacaatacatttgtaggagagacgttgtagatcggggatggggaaacgggtgcggattgtttggaaaaggtggcgtagttacatgtgccaaattcagttgctctggaaaaataacggggaatctggttcaaatagaaaatctagaatacactgtcgtagtcacggtacataatggggatacccgagcagtcggaaacgatataagtaatcatggtgttactgcaatgatcacccctaggagcccctcagtcgaagtaaaattacctgactatggtgaactcacactggattgtgaaccgagatcaggcatagatttcaacgaaatgattctaatgaaaatgaaaaagaaaacgtggttggttcacaaacaatggtttttagatctaccattaccgtggacagccggagcagatacgagcgaagtccactggaactataaagaaagaatggtaacatttaaagtgccgcacgctaaaagacaggatgtaactgtgctaggtagtcaagaaggtgctatgcattcagctctagccggtgcgacggaagttgattccggtgatggaaaccatatgtttgcaggacatttaaaatgcaaagtccgaatggagaaactgcggatcaaagggatgtcttacacgatgtgctccggaaagttttcaattgacaaagaaatggcagaaactcagcacggcacaaccgtcgtcaaagtaaaatatgaaggagccggagctccatgtaaagtgcctattgaaataagggatgtaaataaagaaaaagtagtaggtcgaattatcagcagcacacctttagccgagaatactaatagcgtcacaaacatagagctagaacccccgtttggtgatagctatatagtaataggcgtaggaaacagtgctcttaccttacactggtttagaaaaggatcaagcatcgggaaaatgtttgaatcaacatatagaggcgccaaaagaatggcaattctaggagaaacggcgtgggactttggaagcgtcggtggtcttttcacgtcgttaggtaaagcagtccaccaagtatttggaagcgtgtacacgacaatgtttggaggggtctcatggatgataagaatattaatcggtttcttagttctatggattggaactaactcacggaacacgtctatggccatgacctgtattgcagtcggaggaataactctattcttagggtttacggtccaagcagacatggggtgtgtagtatcatggagtggaaaagaactaaaatgtggctctggaatatttgtagtagacaatgtacacacgtggactgaacaatataaattccaaccagaaagcccggcaaggttagcaagtgcgatcttaaatgctcataaagatggagtttgtggcattcgctcaactacaagactagaaaacgttatgtggaaacaaataactaacgagttaaattatgtcttgtgggaaggaggacatgatctcacggttgtagccggtgacgttaaaggagtgctcacaaaaggaaaaagggcactcactccaccagtctctgacttaaaatattcgtggaagacatggggcaaagcgaagatattcactccagaagcaagaaattccacgtttcttattgacggtcctgacacttcagaatgtcctaatgaaaggagagcgtggaacagcttagaagtggaagactacgggtttggtatgtttactactaatatatggatgaaatttagagaaggatcctctgaggtttgcgaccaccgtctaatgagtgctgcaatcaaggaccaaaaggcagttcatgcagacatgggttactggatcgagtcatcgaaaaatcaaacatggcagatagaaaaagcatctcttattgaagtcaaaacatgtctctggcctaaaacccataccttatggagcaatggagtattagagtcacaaatgttaataccgaaaagttatgcaggacccttctcccagcacaattaccgtcaaggttatgctactcaaacagtagggccttggcacttaggaaaattggaaatagattttggtgagtgtccaggtactactgttactattcaagaagattgtgaccatagaggcccatcgttgagaactactactgcatcaggtaaattagtaacacaatggtgttgtaggtcatgcactatgccacctctgcggtttttaggtgaagatggctgttggtatggaatggaaattagaccattaagtgagaaagaagagaacatggttaagagtcaagtcactgcagggcaaggaacgagtgaaacattctcgatggggttgttatgtctaactctctttgtcgaggaatgtctcagaagaagagtaacaagaaagcatatgatattagtagttgtaataaccctgtgcgcaataatcctcggtggcttgacatggatggatcttctaagagcactcataatgctaggcgacacgatgtcagggcgaatagggggccagatacatctcgcgattatggctgtatttaaaatgtcaccaggttacgtactaggggttttcctccgaaaactaacatcaagagaaacggcattaatggtaataggaatggctatgacgacagtcttatcaatcccacatgatctcatggaactaatagatggaatatcactaggtttaatattactgaaaattgtaactcagttcgacaacacccaagtaggtacattggcgctttctctaacgttcattagaagtacaatgcccctagtaatggcttggagaacgatcatggctgtcctctttgtcgtaacattgatcccgctatgcagaacgtcgtgtctgcaaaagcaatcacattgggttgaaattacagcattaattttaggagcgcaagcattacccgtgtatttgatgacactgatgaaaggagccagtcggagaagttggccactgaacgaaggaataatggcggttggcttagtaagtttactcggaagcgcacttttgaaaaacgacgtaccgctagctggtccaatggtagccggtgggttattgctcgctgcttacgtaatgtcaggatcttccgcagacctatccttagagaaagcggctaacgtacaatgggatgaaatggctgatataacaggctctagcccaataatagaagtcaaacaagatgaagatggtagctttagcatacgtgatgtagaggagaccaatatgattacattgttagtaaaactagcactaatcacagttagtggactttatccactagcaatcccggtaaccatgacactatggtacatgtggcaagttaaaacacagcgttcaggagcattatgggatgtccctagcccggcagctacacaaaaagctgctcttagtgaaggtgtttataggataatgcagagaggattgttcgggaagacccaagttggggtcgggattcatatggagggagtttttcacacaatgtggcacgtaactcgaggcagcgtcatttgccatgaaacaggacgtcttgaaccctcttgggctgatgtacgcaacgacatgatatcatacggcgggggttggagattaggtgacaaatgggataaagaagaagacgtacaagtgctagcaatagagcccggcaagaatccgaaacatgtccaaaccaaacctggtctatttaaaacattaacaggcgaaatcggagcagtgaccttggattttaaaccaggaacaagcggtagtccaataattaacagaaaaggaaaagtaatagggctatacggaaatggtgttgtgacaaaatcaggagactatgtatcagccataacacaagccgaacgaataggagagcccgactacgaggtggacgaagacatatttaggaaaaagcgcttaactataatggacttgcaccctggagccggtaagacaaagaggattttaccctccatagttagggaagctcttaaacgacgactcaggacactaattttggctccaacaagggtagtggcggccgaaatggaagaagctctgcgtggactccctattagataccaaacgcctgctgtcaaatcggaacacacaggtagagaaattgtagatttaatgtgccacgcaacattcacaacgcgtttactaagcagtactcgggtaccaaattataacttaatagtcatggacgaagctcacttcacggacccatcgagtgttgcggcacgtggatatatttcaacgcgagttgaaatgggagaagctgcagcaatattcatgaccgcgactccacccggagcaacagacccattcccacaaagtaactcaccgatagaagatatagaaagagaaataccagaacgctcatggaatacaggatttgactggatcactgattaccaaggaaaaacggtatggtttgtgcctagtatcaaagccggtaatgacattgcgaactgtctgagaaaaagtggcaagaaagtgattcagctatcacgaaaaacattcgatacagaatatccgaaaacgaagctcacggactgggattttgtagtcacgacggacatatcagaaatgggagctaactttagagccgggagagttatcgatcctaggagatgtttaaaacccgtaatattaaccgacggtccagagagagttattctcgcaggaccaataccagtaacacccgcgtcagcagcccagagacgtggtcgaataggtcggaatcccgcacaagaagatgaccaatatgtatttagtggggacccacttaaaaacgatgaagatcacgcacattggactgaagcaaagatgctattggataacatttatactcccgaaggtataataccaacgctatttggccccgaacgagagaaaacccaagcgattgacggggaatttcgtttgcgcggagaacaacgcaaaaccttcgtggaactgatgcgccgaggagacttacctgtttggctgagctacaaagtagccagtgcaggtatatcttataaagatcgtgaatggtgttttactggagagaggaataatcagatattagaggagaacatggaagttgaaatatggacaagagagggggagaagaagaaacttagacctagatggctagatgcgcgagtctatgcagaccctatggcccttaaagatttcaaagaatttgcctcggggaggaaatcgataaccctagatatcttaaccgaaatagcaagcctgccgacttatttatccagtcgtgccaaacttgcattagataatattgtaatgttacacactacagagagagggggaagggcataccaacacgccttgaatgaattacccgaatcattggaaacgctgatgttagtggcactactaggagcgatgacagcgggaatatttctgttctttatgcaaggtaaaggcataggaaaactatcaatgggacttataaccatagctgtggctagtggattgttatgggtcgcagaaatccaaccgcaatggatcgcagcatcgataatactagagttctttctaatggtgctacttattcccgaaccagaaaaacaaagaactccacaagacaatcaactcatctatgttatattaacaattctcactataataggacttatcgcggccaacgaaatgggtttgatagagaaaactaagacagactttggattttaccaagtcaagacagaaacaacaatactagacgtagatctgaagccggcgtccgcctggactttgtatgctgtagctaccacaatattaacacccatgttacgacacactatagaaaatacatctgccaacctatcattagcggcaattgctaatcaagccgcagtactaatgggcttaggtaaaggctggccattacatagaatggatttaggggtacctctcttggcaatggggtgttatagccaggttaaccctattacattaaccgcatcactcgtaatgttgcttgtacattatgcaattattggcccaggacttcaggctaaagctacacgagaggcgcaaaagagaactgctgccggcataatgaaaaatcctacagtagatggaatcacggtaattgatcttgagccaatcagctatgatccaaaatttgaaaaacagttgggacaagtaatgctattggtattatgtgccggacaactcctgctgatgaggacaacgtgggcgttctgtgaggtcttaacgttagcaaccggcccaattttaactttgtgggagggaaatccggggcgtttttggaatacaactattgcagtttctacagccaacatatttaggggaagttatttagcaggcgcaggactggcattctcattaataaagaacgttcaaactccgagacgaggaactggtaccaccggtgagaccctaggagagaaatggaagcgtcaattaaactcactagatcgaaaagaatttgaagaatacaaacgatcgggaattttagaagttgatcgaactgaggcgaaatccgcacttaaggatggttcaaaaatcaaacacgctgttagccgtggcagcagtaaaattagatggatagtagaacgcggaatggttaagcctaagggaaaagtagttgatctaggatgcgggaggggcggatggtcctattacatggccacattgaagaacgttacagaggttaaagggtacaccaaaggcgggcccggtcacgaagaacccatacctatggctacatacggatggaatttagtgaaattacattccggagtagacgtattctataagccaactgaacaagtggacacactactctgtgatatcggggagagcagctcaaatccgactatagaagaaggaagaactctaagagttctaaagatggtcgaaccttggctaagcagtaaacccgagttctgtataaaagtcctaaatccatacatgcctacagttattgaagaattagaaaaactacaaaggaaacacggaggaaatctcgttcgttgtccattaagcagaaactcgactcacgagatgtattgggtatccggagcaagtggtaatatagtcagctcagtaaacacgacctcgaaaatgctgctcaaccgatttacaaccagacatcgcaagccaacttacgaaaaagacgttgatttgggggcgggcactaggtccgttagtacagaaacagaaaaaccggacatgaccataattggacgcaggttacaacgcctacaagaggagcacaaagaaacgtggcactatgatcaagagaacccatatcgaacttgggcatatcacggttcatatgaggctcctagtaccgggtctgcatcttcgatggtcaacggggttgtgaaattacttacaaaaccatgggatgtcattccgatggtaacacaacttgcaatgacagacactactccgtttggtcagcagagagtttttaaagaaaaagtggacacacgtacaccacagccaaaacctggaacgcgaatggtgatgactacaactgccaattggctgtgggcattactaggcaagaagaaaaatcctagattatgcacaagagaagagtttataagcaaagtaagaagcaacgccgcgattggagcagtattccaagaggaacaaggctggacatccgcatcggaagcggtcaatgatagcaggttttgggagcttgttgataaagaaagagcgttacatcaagagggaaaatgtgaatcgtgtgtatataacatgatgggaaagagagagaagaaattaggtgagttcggcagagcaaaaggtagtagagctatttggtatatgtggttgggagcacgctttctggagttcgaggctttgggatttttaaacgaagatcattggtttggccgcgaaaatagttggtctggtgttgaaggtgaaggcctgcaccgtctaggctacattttggaggaaatagataagaaagacggagatcttatgtatgctgacgacacagccgggtgggacacaagaatcacagaagatgatctacagaatgaagaattaataacggaacaaatggcaccccaccataaaattctggcaaaagcaatattcaagttaacttatcagaacaaagttgtcaaggtcttacgaccaacacctcgaggagccgtcatggacataatatcaagaaaggatcaacgtggctccggacaagtggggacgtatggtttaaacactttcactaatatggaagtgcaacttattaggcaaatggaggcggagggtgtcattacccaggatgatatgcaaaatcccaaaggactaaaagaaagagtggaaaaatggttgaaagagtgtggagtagacaggctcaaacgaatggccataagcggtgatgattgcgtcgtaaagccattggacgaaaggttcggcacttcactactatttcttaacgatatggggaaggtccgaaaagatatcccacaatgggaaccatcgaaaggatggaagaactggcaggaagtacccttttgctctcaccacttccataaaatattcatgaaagatggcagatcattagtagttccttgtaggaatcaagatgaactaattggcagagcacgtatttctcaaggcgcaggatggtcattaagagaaactgcttgtttaggtaaggcttacgcacagatgtggtctttaatgtacttccatcgcagagatctacggttagcgagtatggcaatatgctctgccgtcccgacagaatggttccccacaagtcgaaccacatggtcaatccatgctcatcatcaatggatgacaactgaagatatgctaaaagtatggaaccgtgtatggattgaagacaatcctaatatgaccgacaaaaccccagtccactcctgggaggacattccctacttgggaaagagggaagatctttggtgcgggagcctcataggcctaagttcaagagcaacgtgggcaaagaacattcatacggccatcacacaagtacggaacttgataggcaaagaggaatatgtagactacatgccagtcatgaaacgatactcggctccctccgaatccgaaggtgtactatga

SEQ ID NO: 23694 - RNA, 9867 nt, synthetic construct
  misc_feature 1..9867: note = derived and/or modified CDS sequence (opt6) from DENV-4__JN559741__SS-prME
  source 1..9867: mol_type = other RNA
tctactataactttactctgtcttataccgactgtgatggcatttcatctatcaacccgcgacggagaaccgctcatgatcgttgcaaaacacgaacgtggtagacctctattattcaaaacgacggaaggaattaacaaatgtacattgatagcaatggacttaggggagatgtgtgaagatacggtaacttacaaatgtcccctacttgttaacacggaacccgaagatatagattgttggtgcaatctaacgtcaacctgggttatgtacggtacttgcacgcaatcaggtgagaggcggcgagagaaaagatccgtcgcgttaacaccacattccggtatgggattggagacgagagccgaaacgtggatgagtagcgagggtgcatggaaacacgcgcaaagggttgaatcctggatattgaggaatccagggtttgctttacttgccgggtttatggcttacatgataggacagacaggcattcagagaactgtcttctttgtcctgatgatgttagtagcaccctcttatggtatgagatgtgtaggggttggtaaccgagattttgtagagggagttagtggcggagcttgggttgacctcgtgttagaacacggaggctgtgtaacaacaatggcccaagggaaaccaacactagattttgagctaacaaaaacaacagcaaaagaagtggccttactcagaacctactgtatcgaagcattaatatctaatattacaactgcaacacgttgcccgacccaaggagaaccctatcttaaagaagaacaggatcaacaatatatttgccgtcgggatgtagtagacagaggatggggaaacggttgcgggttattcggaaaaggcggtgtagtaacttgtgctaaattttcttgctcagggaaaattacaggaaacctcgtacaaattgaaaatctagaatatactgtagttgtgaccgttcacaatggagacactcacgcagtcggaaatgatacatccaaccatggagttacggcaaccattacaccgcggtcaccatcagtggaggtcaaactaccggattacggtgaattaaccctggattgcgaacctaggtcaggaatagactttaacgagatgatattaatgaaaatgaaaaagaaaacttggctagtacataaacagtggtttctagatttacctcttccttggactacaggtgctgatacgtcagaagttcattggaattacaaagagcgcatggtaacatttaaggttccccacgcaaaacgccaagatgtcacagtattaggtagtcaagaaggtgccatgcattctgcattggcaggagctacggaagtggatagtggagacggaaaccatatgtttgccggacatttaaagtgtaaagtccggatggaaaaactacgtattaagggaatgtcctacacaatgtgtagtggcaaattttcaatagacaaagagatggcagagacacagcatggaacaactgttgtcaaggttaaatacgaaggagccggagcgccctgtaaagtacccattgaaattcgagatgttaacaaagaaaaagttgtcggaagggtaatttcagcgacaccccttgcagagaatacgaacagtgtaacaaacatcgagctagaaccaccgttcggagattcatatattgtaataggggtgggaaattctgccttaaccctacactggtttagaaaaggttcaagtataggcaaaatgttcgaatccacgtatagaggggcgaaacggatggctatactaggagaaacagcatgggacttcggcagcgtagggggcctatttacctctttaggaaaagccgtccaccaagtatttggaagtgtttatacaaccatgtttgggggagtaagttggatgatccgaatacttattggatttctcgtattatggataggtacaaactccagaaacacaagcatggctatgacttgtatcgctgtcggagggattaccctctttctggggtttactgtacaagcagacatgggctgcgtagtctcatggtctggtagagaattaaagtgcggctcaggaatttttgtagtagataacgtgcatacatggacagaacaatacaaatttcaacctgagtcaccagcacgccttgcttctgctatcttaaatgctcataaggatggagtttgcggtatccggtcgacaacacgtttagaaaatgtcatgtggaaacagataactaacgagctaaactacgtcttatgggaaggaggacacgatttaactgtcgtagctggggatgtaaaaggtgtacttacaaaaggaaagagagctctcacccctccagcatctgaccttaagtattcgtggaagacttggggcaaagctaaaatatttactcctgaagcgcgaaatagcacgtttctaattgatgggcctgacacaagtgaatgcccaaatgaaagacgagcatggaatagcttcgaagtcgaagattatggtttcggaatgtttaccacaaacatttggatgaagtttagggaaggaagtagcgaagtgtgcgatcacaggttaatgagcgccgcgatcaaagatcaaaaggccgttcatgccgatatgggatactggatagaatcgagcaagaaccaaacatggcaaatagaacgcgccagtttaatagaagttaagacctgtttatggcctaaaacgcacacactctggtccaatggtgttttagaaagccaaatgttaattcctaaaagttacgctggcccatttagtcaacacaattaccggcagggctatgcgactcagacggtaggcccatggcatttaggaaaactggaaatagacttcggagaatgtcctgggacaacagttacaattcaagaaaattgtgatcatcgaggtcccagcttaagaacaacaactgcttccgggaagttggtgacgcaatggtgttgcagaagctgtacaatgccaccattgaggtttttaggggaagatggctgttggtatgggatggaaatccgtcctctatcagagaaagaagagaacatggtgaaatcacaagtaacagcaggacaagggacgtctgagactttttccatgggtctattatgtcttacgctgtttgtagaagaatgtcttagacgcagagtcaccagaaaacacatgattctagcggtcgtcataacgttgtgtgcaatcatcctaggaggattaacatggatggatttacttagggccctcattatgctgggagatacaatgagtggacgcatagggggacaaacacacttggctataatggctgtcttcaaaatgtctccaggatacgtattgggcgtatttttaagaaagttaacgagccgagaaaccgctctaatggtcattggaatggccatgacaacaacattgtctatacctcacgatctcatggagctgatagatggtatatccttgggacttatactgcttaagatagtaacacaattcgataatacgcaagtaggcacactggccctttcattgacgtttattcgatctaccatgtctctggtaatggcgtggcgaactataatggctgtgttattcgttgttacactaataccattatgtcgtacatcgtgtcttcagaaacaaagtcactgggtggaaataaccgcattgatattaggtgcgcaagccctaccagtgtatcttatgacactaatgaaaggagcatctcgaagatcatggccattgaatgaaggaataatggctgtaggattggtaagcctattaggaagcgcactattgaaaaatgatgtacccctagcaggcccgatggtagcaggaggacttctgcttgcagcatacgttatgagcggatcatccgcggatttgtcccttgaaaaagctgcaaacgtacaatgggatgaaatggctgacatcacgggtagtagcccaattatcgaagtgaaacaagacgaggatgggagcttttctatacgtgatgttgaagaaactaacatgataacattgctcgttaaacttgctttgataacagtcagtgggctatatccattagctataccaataacgatgactttatggtatatgtggcaagttaagacacaaaggtcaggtgccctttgggatgttcctagtccggctgccacccagaaggcagcattatccgaaggagtttacaggataatgcaaagaggcctgtttgggaaaacccaagtaggggtaggaatccacatggaaggcgtttttcatacgatgtggcatgtcacacgaggttctgtaatttgtcatgaaacagggcgcctagagccaagttgggcagatgtacgaaatgacatgattagctacggtggcggatggcgtctaggcgataaatgggataaagaagaagatgtccaggtactggctatagagccggggaaaaacccaaaacacgtacaaacaaagccaggattgtttaagaccctaactggagaaataggagcagtaacgctcgacttcaaacccgggaccagcggatcaccaattattaaccgcaaaggtaaagtcattggtctttatggaaatggagttgttacaaaaagtggagactacgtgtctgcaataacacaagcagagaggataggagaacctgactacgaagtagacgaggatatattcaggaagaaacgactaacaataatggacttgcatcctggtgcaggtaaaacgaagcgtattctaccttcaatcgtccgagaagccttaaagcgaaggcttcgtacgttgattctggcgccgactagggttgtagcggcagaaatggaagaggctttacgaggattgccgatcaggtaccaaacgcccgcagtgaagtcagaacataccggtcgtgaaattgttgatttaatgtgccacgcgacgttcactacgaggttacttagctctactcgagtgcctaactacaatcttattgtgatggacgaagcacactttacagacccttcatcagtagctgcaagaggctatataagcacgcgagtagaaatgggagaagcagcggcgatatttatgacagccacaccgccgggtgccactgatccatttccacagagtaattcgccgatagaagacatagagcgcgaaatacccgaaaggagttggaatacaggttttgactggattacagactaccaaggtaaaacagtatggttcgtaccaagcataaaagcaggaaacgatatcgcgaattgcttaagaaagtccggcaagaaagttatacaactaagtagaaaaacgttcgatacagaatatcctaaaaccaaactaactgactgggatttcgtagtaactacagacatatctgaaatgggggcaaattttcgagctggtagagttattgatccgcgacgatgtctaaaacctgtgattctgactgacggccccgaacgagtgattttagcaggtccgatcccagtaacaccagcctcagcagcacaacgcagaggcaggatcggtcgtaacccagcacaagaagatgaccaatacgtcttttcgggcgatccgttaaagaatgatgaggatcatgcccactggactgaagctaaaatgttgctagataacatctacaccccagaaggaataatacctacgttgtttggacccgaaagggagaaaacgcaagcgatagatggcgaatttagattaagaggcgaacaacgtaaaacgtttgtagaactcatgaggcgtggcgacctgccagtgtggctcagttacaaagttgcatcagctggaatcagctacaaagacagggaatggtgttttacgggagaacgtaacaatcaaattttagaggagaacatggaggtagaaatctggacgcgcgaaggtgagaaaaagaaactaagaccaaaatggcttgatgcgagagtgtacgccgatcccatggcattaaaagactttaaagaatttgcaagcgggagaaaaagtattacattagatatactcaccgaaatagcatcgttacctacctatttaagtagtcgtgcgaaactcgcgttagataatatagtaatgttacatactacagagcgtggtggtcgtgcttatcaacatgcacttaatgaacttccagagtcacttgaaactctgatgctggttgctttattaggagcaatgacggcgggcatatttttattctttatgcagggaaaaggaataggcaagctgtcgatggggttaataaccattgctgtggcgagtggcttattgtgggtcgccgagattcaacctcaatggatagctgcctcaattatcttagagttctttttaatggtactgcttataccagaaccggaaaaacaaagaacaccacaggataatcagcttatatatgtaatactcactatactcactataattggtttaattgctgctaacgaaatgggtttaatagagaaaacaaaaacagacttcggcttctatcaagtaaaaaccgagacgaccatcctagacgtagatttgcgaccggcatctgcatggactttatacgccgtagccacaacaatattaacaccgatgttaagacataccatcgagaatacatcagccaatctcagtttagcagcaattgcaaaccaagcggctgtgctaatgggattagggaaaggctggcctcttcataggatggatttaggtgtgccattgctcgcaatgggctgctattcacaggtaaatccaaccacccttacagcttcattggtcatgttattagtacattatgcaattataggtccaggtttacaagcgaaagcaacgagagaagcacaaaaacgaacagctgccggaataatgaaaaatcctacagtcgacggtatcacagttatagacctagaaccaattagttacgaccctaaatttgaaaaacagttaggacaagttatgctactcgtcctatgtgctggccagttattattaatgcgcacgacttgggcattctgtgaagtactgacactcgcgacaggacccatcctaacattatgggaaggcaatccaggaagattttggaatacaactatagcagtatcgacagcaaatatattcagagggtcctacttagcgggagcaggcctagcgtttagtcttatcaagaacgcccagaccccgcgtaggggaacgggtacagccggcgaaaccttaggagaaaaatggaagagacaattaaactcattggacagaaaggaatttgaagaatataaaagatccgggatattagaagtagatagaacggaagcaaagagtgctctaaaggacggttcaaagataaaacatgcggttagtagggggtcgagcaagatacgatggatcgtagaaagggggatggtaaaacctaaaggtaaggtcgtagacctagggtgtgggcgcggagggtggagttattatatggcgactctaaagaatgttactgaagttaagggttacaccaaaggagggccaggacatgaggaaccaattccaatggcgacgtacggatggaatcttgttaagctccatagtggagtagatgttttctataaaccaaccgaacaggtcgatacactactctgcgatataggggaaagctcatcaaatccgacaatagaagaaggcagaacactgagggtactcaagatggttgaaccatggttatctagtaagccagaattttgtatcaaagtacttaacccctatatgccaaccgtcattgaagaattggagaaacttcaaagaaaacacggagggaatttagtgaggtgtccattgtcacgtaacagtacacacgagatgtattgggtttcaggcgcctcagggaacattgttagttcagtaaataccacatcaaagatgctattaaatcgcttcactacccgacatagaaagccgacatatgaaaaagatgtagatctgggggcaggaacccgatcggtgagcactgagactgaaaagccagatatgaccataataggaagacgcctacaaagacttcaagaagaacataaggaaacatggcattatgatcaagaaaatccatatcgtacctgggcatatcatggatcctatgaagcacctagtacggggtccgcgagctcaatggtgaatggtgtagtcaaattactaacaaagccgtgggatgtgataccaatggttacacaacttgccatgacggatacaactccgttcggacaacaacgtgtgttcaaagaaaaggtcgacactcgaacgcctcagcctaagcctggtactaggatggtgatgacaaccacggcaaactggctatgggctcttttaggtaaaaagaaaaatccccggttatgtacgagagaggaatttataagcaaagtgagaagtaatgcggcgataggggcagtgttccaggaggaacaaggctggacaagtgcatcagaagcagttaatgattcccgcttttgggagctggtggataaggaaagggctctacatcaagaaggcaaatgtgaaagttgtgtatacaacatgatgggcaaaagagaaaagaagttgggagaatttgggcgagccaaggggagtagagctatatggtacatgtggcttggtgccagattcctagaatttgaggctttaggattcctaaacgaagaccactggttcggacgagaaaactcttggtctggagtagaaggagagggcttacatagattaggctatatactagaggagatagataagaaagacggggatttaatgtatgcagatgatacagcaggatgggatacaagaattacagaagatgacttgcaaaatgaagaactaatcacagaacaaatggcaccccatcacaaaatattggcaaaagccatcttcaaattgacctatcaaaataaggtagtcaaagttttacgaccaacacccagaggggcagttatggatataatctctcgaaaagatcagagaggtagtggtcaagttggcacgtacggcctaaacacatttaccaatatggaggtgcaactgatcagacagatggaagcagaaggagtaattacccaagatgatatgcagaatccaaaaggactcaaagaaagagttgagaaatggttacgtgaatgtggggttgatcgtttaaagcgaatggccatctctggagacgattgtgtagttaaaccattggatgagcggtttggaacgagtctcttattcttaaatgatatgggcaaagtccgaaaagacatcccacaatgggaaccttcgaaaggttggaagaattggcaagaagtccctttttgtagtcaccatttccacaaaatattcatgaaggatgggagaagcctagtagtcccttgtaggaaccaagatgagcttataggacgagctcgtattagccaaggagcaggctggtcgctaagggaaacggcatgtcttggtaaagcatatgcccaaatgtggagcttaatgtatttccatagaagggatctaagattagcaagtatggcaatatgctccgcagtcccaactgagtggtttccgacgagtcgaacaacatggtcaatccatgcgcaccatcaatggatgacgacagaagatatgttaaaagtatggaatcgagtctggattgaggataatcccaatatgatagataagacaccagtgcatagttgggaggatataccatatcttggaaagagagaggatctatggtgcggatcactaataggtttgagttctagagctacttgggccaaaaatattcatacagcgataacccaagttagaaatttaatagggaaggaagaatacgtcgactatatgccagtcatgaaacggtactctgccccaagcgaatcggaaggcgtactataa

SEQ ID NO: 23695 - RNA, 9867 nt, synthetic construct
  misc_feature 1..9867: note = derived and/or modified CDS sequence (opt6) from DENV-4__JQ513334__SS-prME
  source 1..9867: mol_type = other RNA
tctacaataacattgttgtgtctcatacccacggtaatggctttccatttaagtacaagagacggagaacctttaatgatagttgcgaaacatgaaaggggacgtccattactatttaaaactactgagggtataaacaaatgtaccttgattgcgatggatctaggtgagatgtgcgaagatactgtaacttacaaatgtcctctattagtgaacactgaaccagaagatatagattgctggtgtaatttaacaagcacgtgggtaatgtatggaacctgtacccaaagtggcgagcgccgaagagagaaaagaagtgtggctctcactcctcactctggtatgggattagaaacgcgagcagaaacatggatgtctagcgaaggtgcatggaaacatgcacaaagggtagagagttggatattacgaaatcccggattcgcactacttgcggggtttatggcttatatgatcgggcaaacagggattcaacgtactgttttcttcgtattaatgatgcttgttgctccaagctacggtatgagatgtgtcggcgtagggaatagagactttgtggaaggagtaagcgggggagcatgggtagacttggttttggaacatggaggatgtgtaactacaatggctcaaggaaaaccgactctcgatttcgaactcacaaaaacgacagccatggaagttgcacttttacgaacttattgtatagaggctagcataagcaatataacgacagcaaccaggtgccccacccaaggtgagccatatttgaaagaagaacaggaccaacaatacatctgcaggagagatgtagtcgaccgagggtggggtaacggctgcggactatttggcaaaggtggagtggtcacttgcgctaaattttcctgcagcgagaaaattaccgggaacctcgtccaaatagaaaatctagaatacaccgtcgtcgttaccgtccataacggagacacacacgcggtaggtaacgacacatcaaatcatggcgtaacggcaaccattactccgcgttcacctagtgtagaagtagaattaccggattatggagagcttacattagactgcgagccaaggtcgggaatcgattttaatgaaatgattctgatgaaaatgaaaaagaaaacttggttagtgcacaaacagtggttcctggacttacccctaccttgggcagcgggagctgatacctccgaagtacattggaactataaagagaggatggtaacattcaaggtgccccacgcgaaacgtcaagacgtgacagtcttgggaagtcaagaaggcgcaatgcattcggctctcgccggtgcaacagaagtggatagcggggacggaaaccatatgtttgcaggacacctaaagtgtaaagtcaggatggaaaaattacggatcaagggaatgagctacaccatgtgtagtggaaagttctctatcgataaagagatggcagaaactcaacatggcacaacagttgttaaagttaaatacgaaggagcgggtgctccttgtaaagtacctatagaaataagagacgtgaataaagaaaaagtagttggacgagtcatatcatctataccattagcagaaaatactaactcagtaacaaacattgaactagaaccgccgttcggagattcctatatagtgataggtgtaggaaacagtgcactcacgctacattggtttcggaaagggtcgtccataggtaaaatgttcgaatcgacatatcgaggggcaaaacgagttgccatactaggcgaaaccgcatgggatttcggtagcgtagggggactcttcacgtcgttgggcaaagcagttcatcaagtatttggtagtgtgtatactacaatgttcggcggcgtatcatggatggtgaggattttaatcggactgctcgtcttgtggattggaacaaattcacggaatacaagtatggccatgacttgtattgcggttggtggcatcactttatttctaggatttactgtacaagctgacatgggatgcgtagtatcatggtccggtagggagcttaaatgcggatctgggatattcgtcgtagataatgtacatacgtggacggaacaatataagtttcaaccggaatcccccgcaagactagcctctgctatactaaatgctcataaagacggagtatgcggcattcgcagtacgacgagactcgaaaatgtcatgtggaaacagataaccaatgaactaaattacgtgctttgggaaggcggccatgacttaacagtagtggccggtgatgtgaagggagttttaactaaaggtaaacgagctttgacgccacccgtatcagatctaaaatatagttggaaaacatggggtaaggcaaaaatattcacaccagaagctagaaattctactttcttaatagacggtccagatacaagtgaatgtccaaacgaaagacgtgcgtggaactctttagaagtagaagactacggattcggcatgttcacaacgaatatatggatgaagtttcgagagggatcatctgaagtatgcgaccatagacttatgtcggcagcaattaaagatcaaaaagccgttcacgcagatatgggctactggattgaatcctccaaaaaccaaacctggcaaatagaaaaagcatcattaatagaggttaaaacatgtttatggccaaaaacccatacactttggtcgaatggggtattagaatcacagatgttgatacctaaaagctacgccggacctttctcacaacataactatagacaaggctacgcgacacaaacggtaggaccatggcatcttgggaaattagaaatagactttggtgaatgtcctgggacaactgtcacaatacaagaagattgtgatcatagaggaccgtccttaagaacgacaacggcttcaggaaagttggtgacccagtggtgttgtcgctcatgcacaatgcccccactacggtttctaggagaagatggttgctggtacggcatggaaattagacccttgagcgaaaaagaagagaatatggtaaaaagtcaggtcgctgccggacaaggcacatctgagacattctcaatgggtctcttatgcctaaccttattcgttgaagagtgcctaagacggcgagtaacgagaaaacatatgatcctcgctgtggtcatcacactatgcgcaattatactaggcggtttaacatggatggacctcctaagagcattaataatgttaggtgacacgatgtcaggaagaattggaggacagacgcacttagctataatggcagtttttaaaatgtctccgggatacgtattaggtgtatttttacgcaaactcacatcgcgagaaacagcattaatggttataggtatggcaatgacaacgaccctaagtattcctcacgaccttatggaattaatagatggtatatccctagggttaatacttttgaagatagtcacgcaatttgacaatacccaagtaggcactctcgcattatcacttacatttattaggagtacaatgagcttagtaatggcatggagaacgataatggctgtattgttcgtagtcacgctcattccgctctgcagaaccagttgtctacaaaagcagagtcactgggttgaaataaccgccttaattcttggagcacaagctctgcctgtatacttaatgacactaatgaaaggcgcaagtagaagatcttggccacttaacgagggcattatggcagtcggtcttgtgagtttacttggatcagctctactaaagaatgacgtgccccttgcaggaccaatggtagcgggaggtcttttgcttgcggcttatgtaatgagcggcagctccgcggatttgagcctggaaaaagctgcgaatgttcagtgggatgagatggccgatataacaggatcaagtcccataatagaagtaaaacaggatgaagatggaagtttcagtattcgagacgtcgaagaaacaaacatgataactttattggtcaaactcgcactcattaccgttagtggtttgtatccgctcgccatcccggtaaccatgacgttatggtatatgtggcaggtcaagacgcagcgatcaggcgcattatgggatgtacctagcccggctgccacacagaaggccgcactgtctgaaggcgtatataggattatgcagagggggttatttggaaagacacaggtaggcgtaggcatacacatggagggtgtatttcacactatgtggcatgtcactaggggaagtgtaatttgtcacgaaactggaagactagaaccttcatgggcagatgtaagaaacgatatgatatcgtatgggggcggttggagacttggtgacaaatgggataaagaagaagacgtacaagtacttgctatagagcctggtaaaaatccaaaacatgtacaaacaaagcctgggctttttaagacgcttacgggtgaaataggagcagtcacattggacttcaaaccaggcacgtcgggttcgccaattattaacagaaaaggaaaggttataggattatacgggaatggcgtagttacaaaatcgggcgactatgtatctgcgataacgcaggctgaaaggatcggggaacctgattatgaagtcgatgaggatattttcaggaagaaaagattgacaattatggatctgcaccctggagctggcaaaacaaaaagaatattaccttcaatcgtccgtgaagcattaaaaaggagattaaggactctgattctagctccaacacgagtagtagctgctgaaatggaggaagcactccgtgggctcccaatccgctatcagactccggcagttaaaagtgaacacacagggcgtgagattgtagatttgatgtgtcatgccacatttactactcgattgctgagtagtactagagtacctaattacaacttaatagtaatggacgaggcacacttcacagatccttcaagcgtagccgcgagggggtatatttcaacacgggtcgaaatgggcgaggcagcagcaatatttatgactgcgacccctcccggggcaacagacccatttccacaatcaaattcaccgatagaagatatcgaaagggagattccagaaagaagttggaatacaggttttgattggataaccgactaccaaggaaaaacagtatggtttgtgccttcgatcaaagcgggaaatgatattgctaattgtctacgaaaatccggcaagaaagtaattcagctttcacgaaaaacattcgatactgaatatcctaagacaaaactaaccgattgggattttgtagtcacgactgacattagcgagatgggagcgaattttagagcgggtagggtgatagatccaagacggtgcctcaaaccagtaatactaacagacgggcccgagagagttatattagctggacccataccagtaactcctgcatccgcagcccagagaagaggtaggataggaaggaatccagctcaagaagacgatcaatatgtatttagcggcgatcctcttaaaaatgatgaagaccacgctcactggaccgaggctaaaatgctattagataatatatatactcccgaagggataataccaacccttttcggacccgaacgcgagaaaacacaagcaatagatggagaatttcgattaaggggagaacaacgcaaaacatttgtggaattaatgaggcgcggtgatctaccagtttggctctcatataaggttgccagcgctgggatcagctataaggaccgtgagtggtgttttacgggtgaaaggaataaccaaatactagaagaaaatatggaagtggagatatggacgagagaaggtgagaaaaagaaattacgtccccgctggcttgacgcccgagtgtatgccgaccccatggcccttaaagacttcaaagagttcgcctctggaaggaaaagtataacactagatatccttacagaaattgccagcctaccgacatatctgtctagtagagctaaattagcgcttgataacatagtcatgctacatacaacagaacgaggtggccgagcatatcaacatgctcttaatgaacttccagaaagccttgagacgctaatgttagtagcattattgggggccatgacggcaggcatattcttgttcttcatgcaaggaaagggcattggcaagctcagtatgggattgataacaatcgcagtggcaagtggattattgtgggtagcggaaatacaacctcagtggatcgcagcgtcgataatcctggaatttttcctaatggtactattaatcccggaacccgaaaaacaacgaactccacaagataaccaattaatatatgttatcttagctattttaaccatcatcgggttaattgcagcaaacgagatgggactgatcgagaaaacaaaaactgacttcggtttctatcaagtcaagacagaaacaacgatattagacgttgatttacgtccagcttctgcgtggacgctctatgccgtagcaacgacaattcttacacctatgctacggcatacaatagaaaacacctcggcaaatttatctctcgcggctatcgccaaccaagccgctgtactaatgggactaggtaaaggatggcccctacatagaatggacctgggagtgccattactggcaatggggtgttactcgcaagtaaacccaactacattgaccgcatcgctcgtgatgttattggtacactatgcgatcataggtccaggactccaagctaaggcaacaagggaagcgcagaaaagaacagcagctgggataatgaaaaatcctacagtagatggaattacggtaatcgatttggagcctatatcgtatgacccaaaatttgaaaaacaattaggccaggtaatgctattagttttatgtgcaggacaattactattaatgcggactacctgggccttttgtgaagtactaacactagcaacaggcccgatacttacattgtgggaaggcaacccaggacgcttctggaacactacaatagcagtatccacagctaatatatttaggggaagttacctcgcgggggctggattagcattttccttaattaagaatgctcaaactccacggcggggaactggcacgaccggcgaaacactgggagagaaatggaaacgacaattaaacagtttagataggaaagagtttgaagagtacaaaagatcaggtattcttgaggtagatcgaacagaggcgaagtctgcactaaaagatggaagcaaaataaagcatgccgtctcacgagggagttccaaaatacgatggattgttgagcgaggcatggtcaagcctaaaggtaaagtagtagatttaggatgcggaagaggtgggtggtcttattatatggctactcttaaaaacgtcacggaagtaaagggatatactaaaggagggcctggtcacgaagaacctattcccatggctacatatggatggaacctagtaaaattacatagcggtgttgatgtgttttacaaaccaactgaacaggtggatacacttctatgcgatattggtgagtcatcttcaaacccaaccattgaagagggtcggacgctgagagtactaaaaatggtggaaccctggctaagctctaaacccgagttctgtatcaaggtgctgaatccttacatgcctactgtaatagaagaacttgaaaaacttcaaagaaaacacgggggtaacctcgtcagatgtccgctaagtcgcaatagcacgcatgagatgtactgggttagtggtgcctctgggaatatcgtgtcctccgttaacacaacgtcgaaaatgcttcttaatagatttacaacaagacataggaaacccacgtacgaaaaagacgtcgatctaggtgccggaacgcgaagcgtaagcacagaaaccgaaaaaccagacatgacaataattgggcggagactacaacgtcttcaagaggagcacaaagaaacgtggcattatgatcaagaaaacccataccgaacgtgggcgtaccatggatcttacgaggcacctagtacaggtagcgctagtagtatggtaaacggggtagtgaaactactaactaaaccgtgggatgttattcctatggttacacagttagctatgacagatacaactcctttcggtcagcaaagagttttcaaggaaaaagttgacacacgaactccccaaccaaagcctggcaccagaatggtgatgacgacaaccgccaattggctatgggctctactgggcaagaagaaaaatcctagactttgtaccagggaagagttcatctcaaaagtacgttcaaatgcagcaataggagcagtctttcaagaggaacaaggctggacgtccgcctccgaagcagtaaatgattcgcgattttgggagctagttgataaagaacgcgcactgcatcaagaaggaaaatgcgaatcatgcgtttataatatgatgggaaagcgtgaaaagaaattaggtgaatttggtcgcgcaaaaggttcccgcgcaatatggtatatgtggttgggtgcgcgttttctcgaatttgaagcattgggctttctcaacgaagatcactggttcggtcgagaaaattcgtggagtggtgtagaaggagagggcttacatagactcgggtacatcttggaagagatagacaagaaagatggtgatcttatgtatgctgatgatacggcaggatgggacacaaggataactgaagatgatttacaaaacgaagaactgataacagagcaaatggctcctcatcacaagattctagcaaaggcaatatttaaactaacctaccaaaataaagttgtgaaagtactaagaccgaccccaagaggagcagttatggatatcatttctcgtaaggatcagcgtggatcgggacaagtagggacttatggattaaacactttcactaatatggaagtacaattaataagacagatggaagcagaaggagtaatcactcaagatgacatgcaaaacccaaaaggtctcaaagagcgggtggaaaaatggcttcgagaatgcggtgttgatagattaaaacgaatggcaattagtggagatgattgtgtagtaaaaccactagatgagagattcggaacttcgctactatttttaaacgatatgggtaaagtcagaaaggatataccacaatgggaacctagcaagggttggaaaaattggcaggaagtcccgttttgcagtcatcattttcataagatatttatgaaagatgggaggagtctagtcgtgccatgtaggaatcaggatgagttaatagggagagctcgaatatctcaaggcgctggatggtcacttagggaaactgcatgcctaggtaaagcatacgcacaaatgtggtcattgatgtattttcaccgaagagatttgagactagcttcaatggccatctgtagcgctgttcctactgaatggttccccacctcaagaaccacttggtcgatacacgcacatcaccaatggatgacaaccgaagacatgcttaaagtatggaacagggtatggattgaagacaatcctaatatgattgacaaaacacccgtacactcatgggaagacataccctaccttggtaaacgggaagatctgtggtgcggatctttgataggcctgagttcacgcgccacatgggcaaagaatatacataccgctattacacaggtccgcaatctaataggtaaagaagagtacgtagattatatgccagtcatgaaaagatactccgcgccttcggaaagtgaaggagtattataa

SEQ ID NO: 23696 - RNA, 9867 nt, synthetic construct
  misc_feature 1..9867: note = derived and/or modified CDS sequence (opt6) from DENV-4__JQ513336__SS-prME
  source 1..9867: mol_type = other RNA
agtactataactttactttgtctaataccgacggtaatggcttttcatttaagcactagagatggtgaaccactaatgattgttgcaaaacacgaaagagggaggccgctgttgttcaaaaccacagaaggtataaataaatgtactctaattgcaatggaccttggggaaatgtgtgaagatacagtcacatacaaatgtccattgctcgtaaatacggaacccgaagatattgactgttggtgcaacctcacctcgacttgggttatgtatgggacttgtacacaatcaggagaacgacgtagggaaaaacgtagcgtcgctcttaccccacattcaggaatgggtctcgaaacaagagcagaaacatggatgtcatccgaaggagcctggaaacacgctcaaagggtcgaaagttggatactgagaaatcccggattcgcacttctcgcaggatttatggcatatatgataggacaaacagggatacagagaactgtattctttgtactaatgatgttagtcgccccatcgtacggtatgagatgtgtaggagtgggaaatagagattttgtagaaggagtttcaggcggagcttgggtagacttagtacttgaacatggaggctgtgttacgacgatggctcaaggtaaaccaacattagattttgaactgactaaaactactgcaaaagaagtcgcgttactacggacgtactgcattgaggcttctatatctaatataacaactgcgactcgatgtcccacgcaaggcgagccgtatttgaaagaggagcaagatcaacagtatatttgtagacgtgatgttgttgaccgtggatggggaaatggatgcgggttattcggaaaaggcggggttgttacctgtgctaaattcagttgttcagagaaaataacggggaatctagtacagatcgaaaatctggaatacactgttgtagtaaccgtacataatggagatacacatgcagttggtaatgatacatcgaatcacggcgtgacagctactattacaccgagatctcctagtgtggaggtcgaactaccagattatggagaattgactttggattgcgaaccccgatcaggaatcgactttaatgaaatgattttgatgaaaatgaagaagaaaacgtggcttgttcataaacagtggtttctcgatttaccattaccgtgggctgcgggtgccgacacgtccgaagtacattggaactacaaagaaagaatggtaacgttcaaagtccctcatgctaaacgtcaagacgtcacagttctcggaagtcaagaaggggctatgcactccgcattggctggagcaacagaagttgacagtggagatggcaaccatatgtttgcgggtcatttaaaatgtaaagttagaatggaaaaacttcgaataaaaggtatgtcttatactatgtgctccggtaaattcagcatagataaagaaatggcagaaacacaacatgggactactgtggtcaaagttaaatacgaaggtgctggagccccatgtaaagtccctattgaaattcgtgatgttaataaagagaaagtggtcggtagagtaatttcatccataccgctggcagaaaatacaaacagtgtgactaacattgaattagaaccacctttcggtgactcgtacattgtaataggagttggtaattccgccttaactctacactggtttcggaaaggaagcagcatcggaaaaatgttcgaatccacctaccgtggcgctaaaagaatggcaattttaggtgaaacagcatgggattttgggagcgtaggtggattatttacaagtcttggaaaagctgtacatcaagtatttggtagcgtatacacgactatgttcgggggagttagttggatggtaaggattcttattgggctcctagtcttatggattggtacaaatagtcgaaatacctccatggccatgacttgcattgcggtaggaggaatcactctcttcttaggatttactgtgcaggcggatatgggatgtgttgtgtcatggtcaggaagagaactaaaatgcggtagcggaatttttgtcgtagataatgtccacacctggacagaacaatacaaatttcagcccgaatcgcctgcacgattagcatctgctattctaaacgcgcacaaggatggagtgtgcggaataagaagcactacgagacttgaaaacgttatgtggaaacaaataacaaatgagctcaattacgtactatgggaaggtgggcatgacctaactgttgttgcaggggatgtaaagggggtattgactaaagggaaacgggcacttaccccaccagtttcggatttaaaatattcctggaaaacatggggtaaagcgaaaatttttactccagaggcaagaaattcaacattcctaattgacggaccagatacgtcagaatgtccgaacgaaagaagggcatggaacagtttagaagtggaggactacggatttggtatgttcaccactaatatatggatgaagttccgtgaagggagcagtgaagtctgtgatcataggttaatgtccgccgcgataaaggatcaaaaagcggtacacgcggatatgggatattggatcgaatcgagcaaaaaccaaacttggcagatagaaaaagctagcctaatcgaagtgaaaacgtgtttgtggcctaaaacacacacgctatggtcaaacggagtgctcgagtcacagatgttgattccgaaaagttatgccggtccgttttcacaacacaactatagacagggatatgccacccaaacagtcggcccgtggcacttaggaaagctagaaatagattttggggaatgtccagggacaacagttacaatacaggaggattgcgaccatagaggtcctagtcttcgcaccacaaccgctagtggaaagctggtaacccagtggtgttgccgaagttgtacaatgccgcctctgcggttcctaggtgaggatggctgctggtatggaatggaaatacgccctttgtctgagaaagaagaaaatatggtaaaatcacaggttgccgccggacaaggcacttctgaaactttctcaatgggactactatgtcttacgctatttgtggaagaatgtctaagaaggcgggttactagaaaacacatgatcctagcggtggtaataactttatgtgctataatactcggcggattaacatggatggatttactacgggcattaataatgctaggagacactatgagcggtagaataggaggacagacgcacctcgcaataatggctgttttcaaaatgagtccagggtatgtgttaggagtctttttaagaaaattaacaagtcgagaaacagcacttatggtaatcggaatggcaatgacaactaccttaagcatcccacatgatctcatggaactaatcgacggcatatcattaggacttatactattaaaaatcgtaacacaattcgataatactcaagtcggaaccttagcactcagtttaacttttatacggtcgacaatgtcattagttatggcttggcgtactataatggcagtactttttgttgtaacattaattccactgtgtagaacgagctgcttacaaaaacagagccattgggtcgaaattacagctttaatcttgggcgctcaggccttaccagtatacctgatgaccttaatgaaaggcgcctctaggagatcctggcctttaaacgaagggataatggcagtaggtcttgtgtcgttgttagggtcggccctccttaaaaacgacgtcccgttagcaggccccatggttgccggaggactcctattagcagcgtacgttatgtccgggtcatcagccgatctgtcccttgaaaaagcagccaatgtacaatgggacgaaatggctgacattacgggaagtagcccaattattgaggttaaacaagacgaagacggctctttctccatacgtgatgtcgaagagaccaatatgattaccctattggttaagttagcattaatcacagtatccggcctctaccctctcgcaattccggtcacaatgacgttatggtatatgtggcaagtaaaaacacaacgatcaggggctctatgggacgtaccttcccctgcagcgacacagaaagcagcgctgtcagagggagtgtatagaataatgcaaagggggcttttcggaaagacgcaagtgggtgtcggaatacatatggaaggagtatttcacacaatgtggcatgtgacgagaggatccgttatttgccatgaaacaggcagattggagccatcttgggcggatgtgaggaatgatatgataagttatggtggaggatggagactaggagataagtgggataaagaggaagacgtacaggtgcttgctatcgaacccggcaaaaatccgaaacacgttcaaactaagcccgggttattcaaaacactaactggagaaattggagccgtaaccctagatttcaaaccgggaacatctggttctccaatcataaataggaaaggtaaagtaataggtctgtacggcaacggagtcgtcaccaagagtggcgattacgtaagtgctataactcaagctgagagaataggagaaccagactatgaagttgatgaggatatatttcgtaagaaacgcttgactatcatggatctacaccctggagcgggaaaaacaaaaaggatcttaccaagcatcgtgcgtgaagcattgaaacgacgtctaagaacattaatattggcgcccacaagggtagtcgccgcagaaatggaagaagccctaagaggacttccaatacgctaccagactccagccgttaaaagtgaacacacggggcgtgaaatcgttgaccttatgtgtcacgcgaccttcactaccagattgctatcatcgacacgagtccctaactataaccttattgtaatggatgaagcacattttactgatccatcgtccgttgcagcacgaggatatatatcaactagagttgaaatgggagaagctgcagcaattttcatgactgccacgccgcccggagcgacagatccttttccacaatcaaatagtccaattgaggatattgaaagggaaattccagagcggagttggaacacaggctttgactggataactgattatcaaggaaaaactgtgtggtttgttccctctattaaagccgggaatgacatagcaaattgtcttaggaaatctgggaagaaagttatccaactttctcggaaaacatttgacacagaatatccaaaaaccaaactgactgactgggactttgtagttactacagatatttcagaaatgggagccaattttagagctggaagggttattgatccacgaaggtgcctaaaacctgtcatattgaccgatggacctgaacgtgtaatattggctggtccgattccagtaacgcctgcgagtgctgcacaaagacgtggccgtatcggtcgtaatcctgctcaagaggatgatcaatacgtattttctggcgaccccctcaagaacgacgaagaccatgcacactggacggaagccaaaatgttattggataatatttatacaccagagggaataataccaacgctgtttggaccggaacgagagaaaactcaggctatagacggtgaatttcgattaagaggagaacaacggaaaacattcgtggaactaatgcggaggggagatctaccggtttggctgtcatacaaggtcgccagtgctggaataagttataaagatcgggagtggtgtttcactggagaacggaataatcagatcttagaagaaaacatggaagtagagatatggaccagagaaggtgagaagaaaaagttgagaccgcggtggttggacgcgcgtgtgtatgcagatccaatggctttaaaggattttaaagagttcgcaagtggaaggaaatcaattactctagatatacttactgagatagcatcgcttccaacatacctaagctctagagccaaattggcactggacaacatagtaatgctgcacacgacagagaggggaggaagggcttatcagcatgcgctgaatgaattgccagaatctttagaaacgctaatgttagttgcacttctaggggcaatgacagcagggatatttttatttttcatgcaaggtaaaggtataggtaaactgtccatgggtttaataacgatcgccgtagcgtcaggattactatgggtcgccgaaatccaaccacaatggattgccgccagcataatactagagttcttcttaatggttcttctcataccagaaccagaaaaacaaagaactccacaagacaatcaattgatttacgtcatccttgcaatattaaccattataggacttattgcagctaatgaaatggggttgattgagaaaaccaaaacagactttggattttatcaagtaaaaacagagactactatattggatgtagacttaagaccagccagtgcgtggaccctatacgccgttgcaacaacaatactaactcctatgcttagacacacaatagagaatacttcagcaaacctatcattagcagcaatagcgaatcaagctgcagtattaatgggacttggaaaaggttggcctttgcatagaatggacttgggagttccattattagctatgggttgttattcacaagtaaacccaacgacactaactgcatcgttggtaatgttattggttcattatgccataataggacccggactacaggcgaaagctacacgcgaagcacaaaagagaacagctgcgggaataatgaagaaccctactgtcgatggtataaccgtaatagatctggaacccataagttatgacccaaagtttgaaaaacagctaggacaggttatgttattagttctatgtgcgggtcaactcctattaatgcgaacaacgtgggctttctgtgaagtacttacacttgcaactggcccaatattaaccttgtgggaaggcaacccagggcgattttggaatacaacaatagcagtaagtacagctaatatattcagagggagttacttggctggcgccggattggcattcagtctaatcaaaaatgcccagactccgcgtagaggcactgggacgacaggcgaaactttaggagaaaaatggaaaagacagcttaactcactcgatagaaaagaatttgaagagtataaacggagtggaatactggaagtcgatagaactgaagcaaaatcagcattaaaagacggaagtaaaattaaacatgccgtaagccgtggctctagcaaaataaggtggatagtagaaagaggtatggtaaaacctaaagggaaggtagtggatttaggctgcggtagaggtggttggtcctactacatggcaacattaaagaatgtaactgaagtaaaaggatatactaaaggaggtcctggtcatgaagaacccataccaatggctacatatggatggaacctagttaaattgcattctggagttgacgtattttataaacctactgaacaggttgacacactactgtgtgatattggagagagctcatcgaatccaactatcgaagaaggccgaacactacgagttctaaagatggtagagccgtggttaagtagtaaacccgagttctgcataaaagtacttaacccctatatgccgacagtgatcgaagaattagaaaaactccaacgaaaacatggcggaaacttagtgcgctgtcctcttagtcgtaactccacacacgaaatgtattgggtaagtggggcttccggaaatatcgtttcatctgtaaacaccacgagtaaaatgttgttgaatagatttacaacgagacatcgcaaacccacgtatgaaaaagacgtagaccttggggcaggcactaggtcagtctcaacagaaactgagaaaccagacatgacgattatagggcggaggctccagagattacaagaagaacataaagagacatggcactatgaccaagaaaatccataccggacttgggcatatcatggaagttatgaagcgccaagcaccggcagtgcgagttcaatggtaaacggtgtcgtcaaattgttaaccaaaccttgggatgtcataccaatggtaacacagttagctatgacagatacgacgccattcggccaacaaagagtattcaaggagaaagtagatacacggacgccacagccaaaacctggcaccagaatggttatgacgacaacagctaactggttgtgggcccttttgggcaagaagaaaaatccaaggttatgtacgagggaagaatttataagtaaagttcgttctaacgctgcgataggagccgttttccaggaagaacaaggctggacatccgcatcggaggcagtaaacgacagccgattttgggaattggtagacaaagaaagagctttacatcaagaagggaagtgcgaaagttgtgtatataatatgatgggaaagagagagaagaaacttggagagttcggacgtgcgaaaggtagtcgagcaatatggtacatgtggctaggagcccggtttctcgagttcgaagccttaggatttttaaacgaagaccattggtttggccgggaaaattcttggtcaggagttgaaggtgagggacttcacaggcttggatatatattagaagaaatagacaaaaaggatggggatctgatgtatgcagacgatactgccggatgggacacacgtataaccgaagacgatttgcaaaatgaagaactaataaccgagcagatggcaccacaccataaaattttggcaaaggcaatcttcaaattaacttaccaaaataaagtagtaaaagtcttaaggcctacgccacgaggagccgtaatggatataattagcagaaaggatcaaaggggtagtggacaagttggaacatacggattaaatacatttacgaatatggaagtacagctcatccgccaaatggaggcagaaggagtgataactcaagatgacatgcaaaatcctaagggcctaaaagaacgagtcgagaagtggttaagggagtgcggtgtagacaggctcaagcgtatggcaattagcggagacgattgtgtagtaaaaccactggatgagcggtttggcacttcccttctttttctgaatgatatggggaaagtacgtaaagacataccgcaatgggaaccatcaaagggatggaaaaattggcaggaagttccattctgctctcatcatttccataaaatattcatgaaagatgggaggagcctagtagtaccttgtcggaatcaagacgaacttatagggagggccagaataagccaaggagcaggatggagccttagagaaacagcttgtctaggaaaagcatatgcacaaatgtggtcattaatgtacttccaccgcagagacctacgactggcatcaatggccatttgcagcgcggtaccaaccgaatggttccccacaagtagaaccacttggtcgattcacgcacatcaccagtggatgactaccgaggatatgctaaaagtatggaaccgagtgtggatagaagataacccaaatatgatagataaaacaccggttcatagctgggaagatattccctatctcggaaaaagagaagacctatggtgcgggagtctaattggattgtcaagtcgagccacatgggctaaaaacatacatacggcaataactcaagtacgtaacttaattggcaaagaagagtacgtagactacatgccagtaatgaaacgctacagtgcaccgtctgagtcagagggcgtactatag

SEQ ID NO: 23697 - RNA, 9867 nt, synthetic construct
  misc_feature 1..9867: note = derived and/or modified CDS sequence (opt6) from DENV-4__JQ513338__SS-prME
  source 1..9867: mol_type = other RNA
tcaactataacattgctatgcctaatccccaccgtaatggctttccatttatctacacgtgatggagaacccctaatgatcgtagcaaaacacgaacgaggacgtcctcttttatttaaaacaaccgaaggaattaacaaatgtacactaattgctatggatctcggagaaatgtgtgaagacacagtgacatataaatgtccactgttggttaacacagaacccgaggacatagattgctggtgcaatcttacctcgacctgggtgatgtacggaacttgtacgcaatcaggcgaacgacgaagggagaaaagatcagtcgccctgacccctcattcaggtatgggtcttgaaacaagagctgaaacgtggatgtcgtcagaaggagcatggaaacacgctcagcgggtggagtcatggatcttacgtaaccccggattcgccctcctagcgggtttcatggcatacatgatcggtcaaaccggaatacaaagaactgtattctttgtactaatgatgctagtggcgccgtcatatggtatgcgttgtgtcggcgttggaaatagagattttgttgaaggcgtatcaggtggcgcatgggtagacctagtattagaacatggcggctgtgttaccacgatggcacaaggaaaacctacattagatttcgaattaacgaaaaccacagccaaagaagttgcgctactaaggacatactgtatcgaggcgctaatatcaaacattacgaccgcaacaaggtgtcccactcaaggagaaccatacttaaaagaagaacaagaacaacagtacatctgtcggagagatgtcgtggacagaggatggggaaacggatgtggtttatttggtaaagggggtgtagttacttgtgcaaagttttcttgctctggaaaaataacaggtaacttagtacaaatcgaaaatttggaatacaccgtagtagttacagtacataatgggaacactcctgcagtaggcaatgatacctctaaccatggcgtaacagcaccaataactccgcgttcacctagtgtcgaagtaaaactcccggattacggcgaattaacactggattgcgaaccaagatcaggaatcgattttaatgagatgattttaatgaagatgaagaagaaaacatggttagtacacaaacaatggttcttagatcttcctttgccatggactaccggagcagatacctccgaagtacactggaactataaagaacgaatggttactttcaaagtgccacatgcaaaacgtcaagatgttacagtactaggcagtcaagagggtgcaatgcattctgctctagctggagctaccgaggttgactctggcgacgaaaaccatatgtttgcgggacacttaaaatgcaaagttaggatgggcaaattgagaattaaaggcatgtcatacacaatgtgttcaggcaaattcagtatagacaaagaaatggcagaaacacaacatgggactactgtagtgaaagtaaaatatgagggtgcaggggctccatgcaaggtacctattgagataagagacgtcaataaagaaaaagtagtgggaagggttataagtgcaactccactcgccgaaaatacaaattcagtgacaaacatagaattagaacccccttttggagatcgctatatcgtaatcggagtaggaaactcggcacttactctacattggttccggaaaggctcaagtattggtaagatgtttgagtccacctatagaggtgcgaagagaatggccatattgggagagacagcgtgggactttgggtccgtaggaggactatttacttccctcggaaaagcggtccatcaagtcttcggatctgtctatactaccatgtttggaggagtgtcatggatgataagaatattaattggattcctagtactctggataggcacgaacagcaggaacacgtcaatggcaatgacgtgtatagcagtcggaggaataaccctattcttaggttttacagttcaagcagatatgggctgtgtcgttagttggagtgggagggaattaaaatgtggatcagggatatttgtagtagataacgtgcacacttggaccgagcaatataagtttcaaccagaaagccctgctagacttgccagcgccattcttaacgcacataaagacggtgtttgcggcatcagatcaactaccaggttggagaatgttatgtggaaacaaattacgaatgagcttaactacgtactatgggagggaggtcacgatcttacagttgttgcgggtgatgttaagggagttctaacaaaagggaagagagccttaacaccccctgccagtgatttaaagtactcgtggaaaacttggggaaaagctaagattttcacaccagaagcaagaaactctacatttttaatagacggacccgatactagcgaatgccctaacgaaagacgagcgtggaatagcttcgaagtggaggactacggattcggcatgtttactacaaatatctggatgaaatttcgcgaagggagtagtgaggtgtgcgatcataggctaatgtctgctgctatcaaagaccaaaaggcggtacacgcggatatgggctattggatagaatcaagcaagaaccaaacttggcaaatagaaagggcgtctcttatagaagtcaaaacttgtttatggccgaaaacacatacactatggtctaatggcgttttagaatcgcagatgttgattcctaaatcatacgcaggcccattttcgcaacataattatcgccaggggtatgcaactcaaacagttggtccatggcaccttgggaaactcgaaatcgattttggcgaatgccccggcacaactgttacaattcaagaaaattgcgatcacagaggcccatccttacgcacgaccactgcaagtggaaaattagttacacaatggtgttgtcgctcctgcactatgccgccattaagatttctaggagaagatggctgttggtacggcatggaaataaggcccttatcagaaaaagaagagaatatggtaaagagccaagtcactgcaggacagggtacaagtgagacttttagtatgggactattatgcctaacacttttcgttgaagaatgtttaaggagaagagttaccaggaagcacatgatactagcagtcgttataacattatgtgccataattttaggaggcttaacttggatggatttattgcgagcactgataatgctaggggatacaatgagtggtagaataggaggtcaaacacatctcgctattatggctgtctttaaaatgagcccgggatacgttttgggagtatttcttcgtaaattgacaagtcgtgagacagcattgatggtaataggcatggcgatgactacgacactgtccatcccacacgacctcatggaactaatagatgggatcagcctaggtttgattctattaaaaatagtgactcaatttgataatacccaagttggaactctagccctttcgctaacatttatacgatcaaccatgtcacttgttatggcatggagaactattatggccgtcctatttgtagtgacgttaataccgctatgtaggacatcatgcttacagaaacagtctcattgggttgaaataaccgctctaatattgggtgctcaagcactacccgtttatttaatgacgttaatgaagggtgcgtcacggaggtcatggccacttaatgaaggtattatggcagtcggtcttgttagtctactaggatcagctcttttgaagaatgacgttccactagcggggccaatggttgccggaggattattgttagcagcatacgttatgtcaggttcctctgcggatcttagtttagagaaagcagccaacgtgcaatgggatgaaatggcagatataacaggaagcagtcctatcatagaggtaaagcaagatgaagacgggtcattttctatcagagatgtagaagagaccaatatgataaccttacttgttaaattagcccttattactgtttccggtctgtaccctttggcgatacctataactatgacactctggtatatgtggcaagttaagactcagcgtagcggggcactgtgggatgtcccaagccccgcagctacacaaaaggcggccttatcagagggggtatatagaataatgcaaagaggattattcggaaaaacgcaggttggagttggaatacacatggaaggagtattccatactatgtggcatgttacacgaggttcggttatttgtcatgaaacaggacgccttgaaccttcctgggcggatgttcgtaacgacatgatatcgtatggaggcggctggcgtttaggtgataagtgggataaggaagaagatgtacaggttctagccatagaaccgggtaaaaaccctaaacatgtacaaacaaaaccaggattgttcaaaactttgacgggtgagataggagccgtgacattagacttcaagccaggcacatccggttctcccatcataaaccgaaaaggtaaagtgataggactttatggcaatggtgtagtaacgaagtctggcgattatgtatctgctatcacacaagcagaacgaataggagagcccgactatgaagtagatgaggatatatttaggaagaaaagattaacaataatggatttgcatcccggagcaggaaagaccaaacgtattttaccatctatagtgcgagaggcgctaaagagaagacttagaacacttatactcgcccctacacgcgtagtagcagctgaaatggaggaagcactccgtgggctaccaataaggtaccagacaccagccgttaagagtgaacacactggacgagaaattgtagacctgatgtgtcatgctacttttacgacaaggctcctatcatctactagggttcctaattacaatcttatagtcatggacgaagctcactttacagatccttcatctgtagcagcgcgtggttacattagcactagggtcgaaatgggagaagcagcagctatattcatgacagcaacaccacccggagccacagatcctttcccacaaagtaactctccaatagaagatatcgaacgcgaaatccccgaacgaagctggaatacaggatttgattggatcacagattaccaaggtaagacagtgtggtttgtaccttcaatcaaggctggtaatgacatcgctaattgtctaagaaaatcaggcaagaaagtaatacaactttcaagaaaaacattcgacactgagtatccaaagacaaagttaaccgattgggattttgtcgttacaacggatatttctgaaatgggagccaactttagagcaggacgagtgatcgatccgcgacggtgtcttaaacccgtaatcctaactgacggacctgaaagagttatacttgctggcccaatcccggtcactcctgcgtccgcggcacaacgaagaggccgtataggtcgtaatcccgcccaggaagacgatcagtacgtttttagtggcgatccactcaaaaatgatgaggatcacgcgcactggacggaagcaaagatgttacttgataacatatacactccggaagggatcattcccacactttttggtccggaaagagaaaagacccaagctatcgatggagaatttcgactacgaggcgaacagaggaaaacattcgtagagttaatgagaagaggagacttaccagtatggctaagctacaaagtagcaagcgcaggcatatcatacaaagatagagagtggtgctttactggagaaagaaataaccaaatcctagaagaaaatatggaagtagaaatatggactcgcgaaggggagaagaagaaactaagaccaaaatggctagatgcaagagtatatgccgatccaatggcgttaaaagattttaaagaatttgcgtcaggaagaaaaagtataactttagatatactaactgaaatcgcatcactcccaacctatctaagctcaagagcaaaattggctctagacaacatagtaatgctacacactacggaaaggggtggtagagcataccaacatgctttaaacgaactacccgaatcgcttgaaaccttaatgcttgtagccttgttaggtgcgatgaccgcaggaatatttttattcttcatgcaagggaagggtattggtaaattaagcatgggcctcataacgatagcagtggcttcaggcttattatgggtcgctgaaatccaacctcaatggatagcagcgagtattatattggagttctttctaatggtattattgataccggaacccgaaaagcaaagaacaccccaagacaatcaattaatatacgtaatcctcaccatcttaacaataataggattaatcgcagccaatgaaatgggcttaatagaaaagacaaaaacagactttggcttttaccaagtcaaaacagaaacaacaattctagatgtggaccttaggccagccagtgcatggacgctgtatgcagtagctacaactatactaactccgatgctgagacatacaatagagaatacaagcgcaaatttgagtttagctgccatcgcaaatcaggctgctgtgttaatgggcctgggaaaaggttggccacttcatagaatggaccttggagttccccttctagcaatgggatgctactctcaagtaaatccaacaacgttaacagcaagcctagtaatgttattagttcactacgctattataggacctggtttacaagctaaagcaacacgtgaggcacaaaaacgaacagctgcaggaataatgaagaatccgactgtagacggaataacggtcatagacctagaaccaattagttatgatccaaaattcgaaaaacagctcggccaggtaatgctattagtactctgtgcaggacagctactgctgatgcgcacaacctgggccttttgcgaagtattaacacttgcaactggtccgatactaacactgtgggaaggcaacccgggacgcttctggaacacaaccatagcagtatcaactgccaacatatttcggggctcatatctcgcaggagcaggtcttgctttttcactaatcaaaaatgcccaaaccccgcggcgcggaacaggaacgaccggagaaacgcttggtgagaaatggaaaaggcaactcaactcgctcgatcggaaagagttcgaagaatataaacgatcaggcattctagaggtggatcgaactgaggccaaaagcgcactcaaagatgggtcgaaaataaaacatgccgtatcaagaggtagtagtaagattagatggattgtagaaagaggaatggtaaaacctaaaggtaaagttatcgatctaggctgcggacgagggggctggtcctattatatggcgaccctcaaaaatgtaacagaagttaaaggatatacaaaagggggaccaggtcatgaagaaccgataccgatggctacatatggttggaatctggtaaaactgcattccggagttgacgtcttttacaaaccaaccgaacaagtagacacgttattatgtgatataggtgaatcgtctagcaaccctaccattgaagaaggcaggactttaagggtattgaaaatggttgaaccatggttaagctccaaacctgaattttgcatcaaagtactaaatccatacatgcctacggtgatagaagaacttgaaaaactgcaaagaaaacatggaggtaatctggtacgttgccctttgtcacgaaattctacacatgagatgtattgggttagtggcgcctcagggaacattgtttcatcagttaacactacatcaaagatgcttctaaatagattcactacacgtcatcgtaagccaacttatgaaaaggacgtggatttaggagctggtacacgttcagtgagtacagaaacagagaagccagatatgacgataatagggaggaggttacagaggttacaggaagaacacaaggaaacttggcactacgaccaggaaaacccatatagaacatgggcatatcacggtagctatgaagcaccctcgacaggaagtgcgagttcaatggtcaatggagtcgtaaagctactcactaagccatgggacgtcatccccatggtaacacagctagcaatgacagatactactccttttggccaacaacgggtatttaaagagaaagtggacactcgaacgccacagcctaaaccgggaacacgtatggtgatgactactacggccaattggctatgggctctcctagggaagaagaaaaacccacgactatgcacgcgagaagaatttatatcaaaggtcaggagtaacgcggcaattggggcagtattccaggaggagcaaggctggacgtcagcaagtgaagcggttaacgatagtagattttgggaactcgtcgacaaggagcgtgcactacatcaagaaggaaaatgcgaaagctgcgtgtataatatgatggggaaacgagagaagaaactaggggagttcggcagagccaaaggatctcgtgcgatatggtatatgtggttaggcgcacgatttttagagtttgaagcactaggattcctaaacgaagatcattggttcggaagggaaaatagttggtcaggcgtagaaggagaaggactgcacaggctgggatacatactcgaagaaattgataagaaagatggtgatttgatgtatgcggatgacacagccggctgggatacacgcattactgaggatgatcttcaaaacgaagaactaattacagaacaaatggctccgcaccacaaaatcctagctaaagcaatcttcaaacttacgtaccaaaataaagtagtcaaagttctgagaccaactcctcgaggggctgttatggatattattagtaggaaggatcaacgtggatccgggcaagtggggacctatgggttaaacacatttactaacatggaagtacaattaataaggcaaatggaggcagaaggtgtaataacacaagacgatatgcaaaatccaaaaggtctaaaagaacgagtagagaaatggttgagggaatgtggggttgataggctaaagcgaatggcaatatctggagacgattgtgttgtgaaacctcttgacgaaagatttggaacttcattactttttctaaacgacatgggcaaagttagaaaagatataccgcaatgggaaccaagtaaaggctggaaaaactggcaagaagtacctttttgtagtcatcatttccataaaatattcatgaaagacggcagaagcctagtcgttccatgcagaaatcaggatgaattaattgggagagcacgtatcagtcaaggtgcgggatggtccttacgagagacagcttgcttaggaaaagcatacgctcaaatgtggtcacttatgtatttccaccgacgtgaccttagattagcatctatggcgatttgtagtgcagttcccacagagtggtttccaacgagcagaacaacatggtcaattcatgcacatcatcaatggatgacgacagaagatatgctgaaggtctggaatcgtgtttggatagaagataatcctaatatgattgacaaaactccagttcactcatgggaagatataccatacctaggaaaaagagaagatttgtggtgcggaagtttaattggattatcgagcagggctacctgggcgaaaaacatacatacagctataacacaagtacgaaatcttatcggcaaagaagaatacgttgattacatgcctgttatgaaaagatatagcgcccctagtgaatcagaaggagtcctgtga

SEQ ID NO: 23698 - RNA, 9867 nt, synthetic construct
  misc_feature 1..9867: note = derived and/or modified CDS sequence (opt6) from DENV-4__JQ513339__SS-prME
  source 1..9867: mol_type = other RNA
tcaactatcactcttctgtgtttgatccccactgtaatggcattccatttaagcaccagggacggagaaccgttaatgatcgtggcaaaacatgaaagaggacgcccactgctttttaaaacgacagaaggaataaataaatgtaccttgattgctatggatctaggagaaatgtgtgaagacactgtgacgtacaaatgccccctattagtcaacacagaaccagaagatatcgattgttggtgcaatctcacctctacctgggtgatgtatggaacctgcacacaatctggagaaagaaggcgcgaaaaacgctcagttgcactgactccccattcaggaatgggactagaaacgagagcggaaacgtggatgtcgtctgaaggtgcttggaaacacgcacaaagggtggaaagttggatccttagaaatccgggatttgcccttctagctggatttatggcctatatgattggacaaacgggcattcagcgcacggtattctttgtattaatgatgttagttgccccaagttatggcatgcgctgcgtcggcgtaggaaatcgtgattttgtcgaaggggtctctggtggagcgtgggtggacttagtcctagaacacggagggtgtgttactacgatggctcaaggaaaaccaaccctagactttgaattgacgaaaacaacagccaaagaagtagccttgttgagaacatattgcatagaagctctaattagtaacataacaactgctactcgatgtcccacacaaggagaaccatacttaaaagaagaacaagaccaacaatacatttgcagacgggacgtagtagacagaggatggggaaatggctgcggactatttggtaaaggaggggtagtaacgtgtgccaaattctcatgcagtggaaaaatcacaggtaatctcgttcaaattgaaaatctagaatataccgtggtagttacggttcacaatggtgatacgcacgcagttggaaacgatacaagtaaccatggagtaacagcaactataacacccaggagcccttccgttgaagttaaactacctgattatggcgagctaactttggattgtgaaccaagaagtggcatagatttcaatgaaatgattttaatgaaaatgaaaaagaaaacttggctggtacataaacagtggttcctagatttgccactaccctggactaccggggctgacacatctgaagtccactggaattacaaagagagaatggctacatttaaagtgcctcatgcaaaacgacaggacgtgactttgttggggtcacaagaaggagcgatgcactccgcattggctggagctacagaggtagattcaggagatgaaaatcacatgttcgctggtcacctaaaatgtaaggttagaatgggaaaattgaggataaaaggtatgagttatacgatgtgcagtggaaaattttcaattgataaagagatggcagaaacgcaacatggcacaacggtagtgaaagtaaaatatgaaggcgcgggagcaccatgtaaagttccaatagagatacgggatgtaaacaaagaaaaagttgtaggccgcgttctttcagcgacaccattagcggaaaatacaaattccgtaacaaatatagaactagaaccgccattcggtgacagttatatcgtcataggagtggggaactccgcactaaccttacactggttcacaaaagggtcatctatcgggaaaatgttcgaaagtacctataggggagctaaaaggatggcaatactaggagaaacagcatgggactttggatcagtaggcggattatttactagccttggaaaagcagtacatcaagtcttcgggtcggtatacactactatgtttggcggggtatcttggatgataagaatactaattgggttcttagtattatggataggcacaaattcccgcaacacctcaatggctatgacatgcattgccgtgggcggaattacattatttttggggtttacggtacaagcagatatgggatgcgtagtgagttggagcggtcgtgaactaaaatgtggttcagggattttcgtagtagataacgtacacacttggacagagcaatataagtttcaaccggaatctcccgcacgcttagcgagcgctattttaaatgcccataaagacggagtatgtggtattaggtctacaacgagattggaaaacgttatgtggaagcaaataacaaatgaattaaactatgtgttgtgggagggaggacatgatttgacagtagtagcaggagacgtaaaaggagtgcttactaaggggaaaagagcattgacaccaccagcttcagaccttaaatatagctggaagacttggggcaaagcgaaaatttttacaccagaagccagaaattcaactttcctcattgatgggcctgacacatccgaatgtcctaacgagcgccgagcgtggaactcattcgaggttgaagactacggcttcggtatgtttacaacgaatatatggatgaagtttagagagggatctagcgaggtatgcgaccaccgattgatgtcggctgcaataaaagatcaaaaagcggttcacgctgatatgggatactggattgaatcgtctaaaaaccaaacttggcagatagagcgcgcatcgttaatagaggtgaaaacttgcctgtggccaaagactcatacactatggtcgaatggtgtgttagaaagtcaaatgctgataccaaaatcatatgcagggccgttctcgcagcataactaccggcaagggtatgcgactcaaacagtcggtccttggcacctcggcaaacttgaaatagactttggcgaatgtccaggtacaactgtaacaattcaagaaaattgcgaccatagagggcccagccttagaaccactacagcttcgggtaaactcgtgactcaatggtgttgtaggtcgtgtacaatgcctcctctgagatttttaggtgaagacggctgttggtacggcatggaaattcgaccattaagcgaaaaagaagaaaacatggtcaaatcacaggtcacggcaggtcaaggtacaagtgaaaccttctccatgggtttgctatgtctcactctattcgtggaagaatgtcttaggagacgcgttacgcgaaaacacatgatattagcagtagtaattacactatgtgccataatactaggcgggctaacatggatggatttacttagggcattaattatgctcggcgacacaatgagtggacggattgggggacaaactcatttagctataatggctgtattcaagatgagcccgggttatgttctcggagtattcctaagaaaactgacttcaagagaaaccgccttaatggtgatagggatggcaatgacaactacactaagtatcccacacgatctcatggaacttatagatggtatctccctaggcctaatactgttaaaaatagtaactcaattcgataatacgcaggtcggtactcttgcattatcactcacatttatccggagtacaatgtctttggtaatggcttggaggacaataatggcggttttgttcgtggttactttaatcccactgtgccggacgtcatgcctccagaaacaaagccattgggttgaaatcacagccctaatattaggtgctcaagcattaccagtctacctaatgacgttaatgaagggagcatcccggcgatcgtggccactaaatgaaggaattatggctgtaggattagtttcactcttggggagcgcattattaaagaatgatgttccactagcaggtcctatggttgccggtggactattgctggctgcatatgttatgtcaggatccagtgcagatttaagtctagaaaaagcagcaaatgtccaatgggacgagatggcagatataacaggaagttcaccaataatcgaagtaaaacaggacgaagacggatcgttttcgatacgtgacgtcgaagaaacgaacatgataacactattagtgaaattagccttaataacagtatcaggtctatatccattggcaattcctatcaccatgactttatggtacatgtggcaagttaaaacacaacgttcgggagctctctgggatgtgccatctcccgcggcaacacaaaaagcagctctttcagagggtgtgtatagaataatgcaacgagggttattcggaaaaacacaagtaggagtcggcattcatatggaaggagtatttcatacgatgtggcacgtcactcgtgggtcagtaatatgtcatgaaaccggccgcttagagcccagttgggctgatgtaagaaacgatatgatttcttacggaggtggttggaggcttggggataagtgggataaagaagaagatgtacaggttcttgctatagaacctggtaaaaaccccaaacatgtacagaccaaaccaggcttgtttaagacactcacaggggaaatcggagctgttactttagattttaagccaggtacatctggttctccgataataaacagaaaaggaaaggtaataggcctttatggaaacggagtagtaacaaagagtggtgactatgtatcagctattacacaggctgaaagaataggcgaaccggattatgaagtagatgaggacattttcagaaagaaacgactaactattatggatttacatcccggagctggtaaaaccaagcgtattctgccaagtatcgtcagagaggcattaaaacgaaggctaagaactttaatattagcaccaacacgagtagtggcagcagaaatggaagaagcacttagaggcctcccaatccgctatcaaactcctgcagtaaaatcagagcatactggacgcgaaatagtggacctgatgtgtcatgccacgttcacaacgagactcctaagttctacaagagttccaaattataatttaatagttatggacgaagcacatttcactgatccaagttcagttgctgcaaggggatatatatcaactcgtgtagaaatgggtgaagcagcggctatattcatgacagcaactccgccgggcgctaccgatccgtttccgcagagtaactctcctatagaggatatagaacgggaaatacctgagagatcgtggaatacaggattcgactggattacagattatcaagggaaaaccgtctggttcgttccatcaataaaagcagggaacgatattgcgaactgtttacgaaaatcgggtaagaaagtgattcagttatcccgaaaaacatttgatacggaatatcctaaaacaaagttgacagactgggacttcgttgtcaccacagatatttcagaaatgggcgctaacttccgagccgggcgagttattgacccgagaagatgtctaaaacctgtaatcctaacagatggaccggagagagttattcttgcaggcccaataccggtgactcctgcctcagcagcacaaagacgcggtcgaataggaagaaatccagcgcaagaagatgatcaatatgttttctctggagacccactgaaaaacgatgaggatcatgcgcattggacggaggcaaaaatgctcttagacaatatatacacgcccgaagggatcatccctaccttgtttggtccagaacgggagaaaacccaagctattgatggtgaatttcggctacgtggcgagcaacgaaaaacctttgtagaactcatgagaagaggtgatctgccagtttggttaagttacaaagtagcttcagccggaatctcatataaagacagagaatggtgctttactggagaaagaaataaccaaatactagaagagaacatggaagtcgaaatttggacgagagaaggtgagaagaagaaattaagaccaaagtggctggacgcgcgtgtctatgcggatccaatggctctaaaagatttcaaagagttcgcttcaggcagaaaatcaattacattagatatcttaacagaaatagcttcattaccaacatacctctcctcacgagcaaaactagcgctggataatattgtaatgctacatactactgaaagaggagggcgggcataccaacatgcacttaatgaactacccgaaagtttggaaacactcatgcttgtcgctttgttaggcgcaatgaccgcgggtattttcctgtttttcatgcaaggtaaaggaattgggaaactaagtatgggattaataacaatagcagttgcatctggcctactttgggtcgctgaaattcagccgcaatggatagctgccagtattatattagagttcttcttaatggttttattaataccagaaccagagaagcaaaggacacctcaagataatcaactcatatacgtaatattaaccatcctaacaataataggcctcatcgccgcaaatgaaatgggcttaattgaaaagacgaaaaccgacttcgggttctaccaggtcaagactgaaactacaattctagatgttgatttgagaccagcgtcggcgtggacgttgtatgcagttgctacaactatacttactccaatgcttagacacaccatcgagaacacatctgccaatctctctctcgcagctatagctaaccaagcagcagtcttaatgggtctgggtaaagggtggcctttgcatcgtatggatttaggagttccactactcgcaatgggctgttattctcaggtaaatccgacaacattaacagcctcgctcgttatgctactcgtacactatgcgatcataggaccaggtctacaagctaaagcaacccgtgaagcgcaaaaacgtacggcagcaggaataatgaaaaaccctactgttgacggtataacagtaatcgatcttgagccgatcagttacgacccgaaattcgaaaaacaattaggacaggtaatgctgttagtactgtgcgcaggccaattattgttaatgaggacaacctgggcattttgcgaggtcctaactctcgctaccggcccaatccttacactgtgggaaggtaatccgggccgattttggaacaccaccattgctgtaagtaccgcaaatatatttagaggaagttatctagctggtgctggattagcattttcgcttattaagaacgcacaaaccccaaggagaggtactggaacaacaggcgaaacattgggagaaaaatggaaacgacaactaaatagtttagatcgtaaagaatttgaagagtacaaacgttctggaatactagaagttgaccgcacagaagcaaaaagtgcactaaaagatggatcaaagataaaacatgcggtatctagaggatcgagtaaaatacgttggatagtagaacgaggtatggtcaaaccaaaaggaaaggtcatagaccttggatgtggtcgtggagggtggagttactatatggccactcttaagaatgttacagaagtgaaaggatatacaaaaggtggacctggacatgaagaacctattcctatggcaacatacggatggaatttggtcaaactacattcaggtgtcgatgtcttctataagcctaccgaacaagtagacaccttactatgcgatataggtgaatcttccagtaatccaacaattgaagaaggtcgtaccctaagggtacttaaaatggtagaaccatggctgtcatccaagccagagttctgtataaaagtgcttaatccgtatatgcctacagtgatagaagaactagaaaagctccaacgaaaacacggaggtaacttagtgagatgcccgttaagccgtaacagcacacatgaaatgtattgggtatcaggcgcaagcggaaacatagtgtcttcagtcaacacaacatctaagatgctacttaaccgctttacaactagacacaggaagccgacatatgaaaaagatgttgacttgggtgctggaacgagaagtgtgtcaacggaaaccgaaaaaccagatatgacaattattggcagacgactacaacgactccaagaagaacataaagaaacgtggcactatgatcaagagaacccttatcgaacatgggcttatcatggaagttacgaagccccatcaactggaagcgcatcaagtatggtgaatggcgtcgtaaaactactaactaagccctgggacgttattccaatggttacacaattggcgatgacggacacaaccccattcggacaacaaagagtatttaaagaaaaggtcgatacgagaacacctcagccaaagccgggaactcggatggtaatgactacaactgcaaattggctatgggcacttctaggcaagaagaaaaacccaaggctatgtaccagagaagagttcatatcaaaagtgagaagtaacgcggccataggagcggtatttcaagaggaacaagggtggacaagtgcatccgaggctgttaatgattctagattttgggagctagtagacaaagaacgtgcacttcaccaagaagggaaatgcgagtcgtgcgtatataatatgatgggaaaacgggagaagaaattgggtgagttcggccgagcaaaaggatcccgcgccatctggtatatgtggcttggggcgaggtttttggaatttgaagcattaggctttttaaatgaagatcattggtttggaagagaaaatagctggtcaggtgtggagggtgaaggattacaccgtttaggttacatcttagaagagatcgacaagaaagatggcgacttaatgtacgctgacgataccgctggctgggacacaagaataacagaagatgatcttcaaaatgaggaattaatcacagaacaaatggctccccatcacaaaattctcgcaaaagcaatctttaaattaacctatcaaaacaaagttgtaaaagtactccgaccaactccacgtggggctgtaatggacataataagtcggaaggatcaacgcggaagtggacaagttggaacgtacggactaaacacttttaccaacatggaagtacaattaattagacaaatggaagccgagggagtgatcactcaagatgatatgcagaatccgaaaggtctgaaagaaagggttgaaaagtggttaagagaatgtggagtcgatagacttaagagaatggcgatttctggcgatgattgtgttgtcaaaccccttgacgaacgattcggcacatcattgttattcctgaacgatatgggtaaagtaagaaaggatataccccaatgggaaccttcaaaagggtggaagaactggcaagaggttcccttttgtagtcatcactttcataaaattttcatgaaagatggaagatcattagtagtgccttgtcggaatcaggacgaattaataggaagggctagaatatctcaaggggccggatggagcttaagagagactgcatgccttggtaaagcgtatgcacaaatgtggtcgctgatgtacttccaccgaagagatctacgcctagcaagtatggctatctgctccgcagtcccgaccgagtggtttccaacttcacgaaccacatggtccattcatgcacatcatcagtggatgacaaccgaggacatgctaaaagtatggaatcgtgtctggatagaagacaatccaaatatgatagataaaacacctgtacactcctgggaagacataccctatctaggtaaacgcgaggacctctggtgcggttcattaataggactatcaagccgtgctacgtgggccaaaaatatacatactgcgattacacaagtgagaaatttaataggtaaagaagaatatgtagattatatgccagtaatgaaaagatactcagcaccgtctgagtctgaaggagtgttgtga

SEQ ID NO: 23699 - RNA, 9867 nt, synthetic construct
  misc_feature 1..9867: note = derived and/or modified CDS sequence (opt6) from DENV-4__JQ513343__SS-prME
  source 1..9867: mol_type = other RNA
agtacgataaccttactttgcttaatacctacagttatggctttccatctcagtactagggatggtgaacctctgatgatagtggccaaacatgaaagaggtagaccacttttgttcaaaacaacagaaggaatcaataaatgcacattaatcgcaatggatttgggggagatgtgcgaagatacagttacatataaatgcccattattggtcaatactgagcccgaagacattgactgttggtgtaatttaacgagcacatgggttatgtatggaacttgtactcagtcgggtgaaagaagaagagagaaaagatctgtagctttgactccgcactccgggatggggttagaaacaagagcggaaacatggatgagcagtgaaggagcgtggaaacatgcacaacgggtggaatcatggattttaaggaaccctggatttgcacttctagctggttttatggcgtatatgataggtcaaaccggtatacaacgaaccgtcttctttgtattaatgatgcttgtagctccctcatatggtatgagatgtgttggagttggaaatagagattttgtagagggagtatccggaggcgcttgggttgacttagtactggaacatggcggttgcgtaacaacgatggcccagggtaaacctactctagatttcgaactgacgaaaacaactgcaaaagaggttgcgctgttaagaacatattgtattgaggcgttaatcagcaacataactactgctactaggtgcccaactcaaggtgaaccttacctaaaagaagaacaagatcaacagtatatttgtagacgtgatgtagtggatagggggtggggaaatggttgtggtttatttggaaaaggaggggtagtgacatgtgcgaaattctcatgttctggaaaaataacaggcaatcttgtacaaatagaaaacttagaatacacagtagtagtcactgtgcacaatggagatacccacgctgttggcaacgatacatctaaccatggggttacagctaccatcacacctagatctccaagcgttgaagttaaattacccgattacggagaattaacactagactgtgagccacgaagcgggatagatttcaacgaaatgatacttatgaaaatgaagaagaaaacttggttagtacataaacaatggtttcttgacctacctttaccctggacgacaggtgctgatacaagtgaggtacactggaattataaagagcggatggaaactttcaaagtaccacatgccaaacgccaggatgtaactttgctgggcagccaagaaggagccatgcacagtgcactcgcgggagctacggaagtagattccggtgacgaaaaccatatgttcgctggtcatttaaaatgtaaagtccgaatggaaaaactaagaataaaaggaatgtcctatacaatgtgttcaggcaaattcagtatagacaaagaaatggccgaaactcaacatgggactacagtagttaaggttaaatacgaaggtgctggagctccatgcaaagtgcctatcgagattagagacgtgaataaagagaaagtggtgggaagagtaataagtgctactcctctcgctgaaaatacaaattctgtaacaaatatagagttggagccacccttcggtgattcttatatagtaataggagttggaaattctgctctcacactccactggtttagaaaagggagcagtataggcaaaatgttcgaatcaacatatagaggcgccaaacgaatggcaatactaggagaaacagcatgggacttcggctctgtaggaggactgttcacatctttagggaaagcagttcaccaagtttttggtagcgtatacacaactatgtttggtggagtttcatggatgatacgaattttaattggatttttggtgttatggattggtacgaatagtaggaatacatcaatggctatgacttgcattgcagtaggcggcattactctatttctgggatttacagttcaggcagatatgggatgtgttgtaagttggagtggaagagaattaaaatgtgggtctggaatttttgtagtcgataacgttcacacctggacggagcagtacaaattccaaccagagtctccggcccgactggcatctgcaatattaaacgcacataaagacggagtatgcgggatacggtcaacaacacgactggagaatgtaatgtggaagcagataacaaatgagctcaattatgtactctgggaaggcggacacgacttgacggttgttgccggagatgttaaaggagtattgaccaaaggtaagagagctttaacgccaccagcaagcgacttaaaatattcgtggaaaacttggggaaaggcgaagatttttactcccgaggcgcgaaatagtacttttctaattgacggacctgacacttcggaatgccccaacgagagacgagcatggaactcattcgaggtcgaagattatggatttggaatgttcaccacaaacatctggatgaagttcagagaaggaagttccgaagtttgtgatcatagactaatgagtgcggcgattaaagatcagaaggcagtacacgcagatatgggctattggattgaaagcagcaaaaatcaaacatggcaaatagaaagggcatctttgattgaagtaaagacgtgcttatggcccaagacacatacattgtggagcaacggagtgcttgagtcacagatgttaattcctaaaagttacgcggggccgttcagccaacacaattaccgccaaggatatgctacacaaacagtgggaccctggcatcttggcaaattggaaatcgatttcggtgagtgccccggtaccacggtcacaatccaggaaaactgcgatcataggggtcctagtttacgtacaactaccgctagcggaaaactcgttacacaatggtgttgcagaagctgcacaatgcctcccttaagatttctcggcgaagatgggtgttggtatggtatggaaatcagacctttgtcagaaaaggaagagaatatggtgaaatcacaggtaacagctggacagggaacgagtgaaacgttcagcatgggattgttatgcctgacactatttgttgaggaatgtttacgtaggagggtgacaagaaaacacatgatattagcagtcgtcataactttatgcgcaattatattgggtggacttacatggatggatctattaagagcattaatcatgctaggtgacacgatgagtggcaggattggaggacaaacacacctcgcgattatggcagtatttaaaatgagtcccggttatgtactcggtgtgtttctcagaaagctgacctcgagagaaacagctcttatggtcataggcatggctatgacgaccacgttgtcaattccacatgatctcatggaattaatagatggaatcagtttaggtctaatactacttaaaattgtaacacaattcgataatactcaagtgggaacactcgcattgagtctaacatttatcaggtcaactatgagtttagtcatggcatggagaacgataatggcagtgctatttgtggtcacactgatacctctttgccgcacctcctgcttacaaaaacaaagtcattgggtggaaataacagctctaatacttggggctcaagctctcccagtttatttaatgactcttatgaagggcgctagtaggcgctcatggcctctcaatgagggaataatggcggtaggcttagtgtctttacttggttccgctttattaaagaatgatgtgccacttgctggccccatggtcgcgggcggtttattactggccgcatatgttatgagcgggtctagcgccgatttatctctcgaaaaagcggcaaacgtccaatgggacgaaatggctgacattacgggaagttctcctattatcgaggtcaaacaggatgaagatggctcattttccatccgcgatgtcgaggaaactaatatgataactctacttgttaaattagctcttataaccgtatctgggttatatccacttgccattccgataaccatgacactctggtatatgtggcaagtaaagacacaacggagcggcgctctttgggacgtcccaagccccgctgccactcaaaaagctgctctttctgaaggagtataccgcatcatgcaaagaggacttttcggtaaaacacaagtaggtgtcggtattcatatggaaggagtattccacacgatgtggcatgtaacaagagggagtgtcatatgtcatgaaacgggcaggttagaaccatcatgggcagacgtgagaaatgatatgatatcatatggcggcggttggagattaggagacaaatgggacaaagaagaagacgttcaagtacttgctatagagccgggtaaaaatcctaaacacgtacagactaaaccgggtctatttaaaaccctcacaggagaaataggagcagtaaccctagatttcaaacctggaactagcggcagtcctattataaataggaaaggtaaagtaatcggactgtatggtaacggtgtcgtaacaaaaagtggggattatgtctcagccatcacacaggccgagcgcatcggagagcctgactatgaagtggatgaggacattttcaggaagaaacggttgacgataatggatttacacccgggagctgggaaaacaaaaagaatattaccatctatagtccgagaagcactgaaacgccgcctcagaacacttattctggcgcctacaagagtggtcgcagcagaaatggaggaggcactacgtggactgccaatcagatatcaaacgcccgctgtaaaatcagagcacacaggtcgagaaattgtcgacttaatgtgtcatgccaccttcacaactcgcttactgagttctacaagggtgcctaattataatttaatagtgatggacgaagcgcattttaccgatccctcaagtgtagcggcacgaggttacataagtacacgtgtagagatgggcgaagctgcagccatattcatgacagctacacctccaggagcgacagacccatttccccaatcaaactctcctatagaagatatagagcgagaaatcccagagaggtcatggaatactggttttgactggataacagattatcaaggaaaaacagtctggttcgttccttcaattaaagccggtaatgacattgctaattgcttacgaaagtcaggcaagaaagtaatacagctatcacgcaaaacattcgataccgaataccctaaaactaaactaactgactgggactttgtggttacaaccgatatatccgagatgggtgcgaattttcgagctggacgagttatagatccacgaaggtgtctgaaaccggtgatacttaccgatggaccagagagagtcatacttgcgggacctatacctgttacgccagcgagcgcggctcaaaggagaggtaggataggtcgaaatccagcacaagaagacgatcaatatgtcttcagcggtgatccattgaagaatgatgaagaccatgcacattggacagaagcaaagatgttactagataatatatatacgcctgaagggataataccgactctttttgggccagaacgagagaaaactcaagctattgatggagaatttcgactcagaggggaacaacgcaagacgttcgtagaactcatgagaagaggagatcttcctgtttggttgagctataaggttgcttcagcaggaatttcatataaagatcgggaatggtgttttacaggagagagaaataatcagattttagaagagaatatggaagtagaaatatggacacgcgagggggagaaaaagaaactgcgcccaaaatggctagatgcgagagtatacgctgaccccatggcacttaaagactttaaggaatttgcttccggtcgaaagagtataacactggatatattgacagaaatcgcgtcattacctacatacctttctagtagagctaagttagcgctagacaatatagtgatgttacacacaacggaaagaggaggcagagcctatcaacacgcacttaatgaattaccagaaagcctagaaactttaatgctagttgcgcttttgggagcaatgacggcagggatatttttattctttatgcagggtaaaggaataggaaaattaagcatgggactaataaccatagctgtagcaagcggtttactatgggtagctgaaatacaaccacaatggattgcagcatctattatactagaatttttcctcatggtgttgttaattcctgaaccggaaaaacagcgaacaccgcaagacaaccaattaatatatgtaatattaacaatcttaaccataatcggcttgatcgctgctaacgaaatgggcctgatagaaaagacaaaaacagattttggtttctaccaggtcaaaacagaaacgacaatactcgatgtcgatttaagacccgctagcgcctggacgctttatgctgttgcaacaacaatcctgacaccaatgttaagacataccatcgagaacacaagcgcaaatcttagcctagcagcgatcgcaaatcaggcagcggtactcatggggctagggaaaggatggcccctccatagaatggaccttggagttccactgctagcaatgggatgctattctcaggtaaatccaaccactcttacagcctcgttggttatgctcttagtacattacgccataatagggcctggattacaagcaaaagctacgagagaagcacagaagcgcacagcagcaggtatcatgaaaaacccgacagtcgacggtattacagtcatcgacctagaaccaatttcatatgatccgaagtttgaaaaacaattgggccaagtgatgttacttgttctctgcgctggacagttattacttatgaggaccacctgggccttttgtgaggtcttaacccttgcaacaggaccaatactaacactgtgggaaggaaacccaggacggttctggaacacgacgatcgcagtgtcgaccgcaaacatatttcgcgggagctatctggcaggagctggtctggcctttagtcttattaaaaatgcgcaaacacctcgaagaggcactggaaccacaggagagacactaggagagaaatggaaaagacaattaaactcgctggatagaaaagagttcgaagagtataagaggtcaggaatattagaagtagatcggactgaagcaaaatcagcacttaaggacggaagcaaaataaaacatgcggtttcacggggttcatcaaaaattcgctggatagtggaacgaggcatggtaaaaccaaaaggtaaagtaatagatctaggatgtgggagaggtggttggagttattatatggcgacactcaaaaatgttacggaagtaaaaggatacaccaaaggaggtcctggacacgaggaaccaattccaatggcgacatatggttggaacctagtaaaattacacagcggtgtagatgtattttataagccgacagaacaggtagatacgcttctctgtgacatcggggagagcagttctaatccaactatagaggaaggacgaaccttacgagtacttaagatggtagaaccttggttaagttcaaaacctgaattttgtatcaaagtccttaacccgtatatgcctacagtgattgaggagttagaaaaattacagaggaaacatggcgggaaccttgtgagatgcccactctcccgtaatagtacacacgaaatgtattgggtaagcggtgcgagtgggaatatcgttagctcagttaacaccacaagcaaaatgttactcaacagatttacaacaagacacaggaaacccacatatgaaaaggatgtggatttaggggcggggactaggtcagtctccacagaaaccgaaaaacctgacatgactattataggaagacgattacaaagacttcaggaagaacacaaagagacatggcattatgatcaagaaaacccatacagaacttgggcatatcatggaagttatgaagctccgtcaacgggatcagcgagttcgatggttaatggagttgtgaaactgctaactaaaccgtgggacgttattcctatggttacgcaactagcaatgactgatacaacgccttttggtcaacaaagagtattcaaagaaaaagtcgatactcgcacaccacagccaaagccaggcacacgaatggtaatgacaactacggccaactggctttgggcgcttctaggtaagaagaaaaatcctcgactttgtacaagagaggaatttatcagcaaagtacgctcaaatgcagccataggcgccgtcttccaagaagaacaaggttggacatcagctagtgaagcagtgaacgactcaagattttgggaattggtagacaaggaaagagcactgcatcaagaaggaaagtgcgaaagttgtgtgtataacatgatggggaagagagagaagaaattaggagaatttggacgtgctaaaggatcgagggcaatttggtacatgtggctaggtgcaaggtttctagaatttgaggcgttggggttccttaacgaggatcattggtttgggagagaaaatagttggagtggagttgaaggagagggtttacatagattagggtatattttggaagaaatagataaaaaggatggagacttaatgtatgccgatgatacagctggatgggatacaagaattaccgaagacgatttacaaaatgaagaattaattacggaacagatggcaccccaccataaaatattggcaaaagccatcttcaaattaacataccaaaacaaagtagtaaaggtactacgaccaaccccacgaggagcggtcatggatattataagtaggaaggaccagcggggttcaggccaagtaggaacttacggactgaacacatttaccaacatggaggtacaactaatacgtcagatggaggcggagggcgtaataacacaagatgatatgcaaaaccctaagggactaaaggaaagagtcgaaaaatggctacgtgaatgcggagtagataggttaaaaagaatggcaataagtggagacgactgtgtagttaaaccactagatgaaagatttggaacatctttattgtttctaaatgacatggggaaagtccgcaaggacataccacagtgggaaccatctaaaggctggaagaactggcaagaagtccccttttgcagccaccattttcataagatcttcatgaaggacggcaggagtttagtggtaccgtgcaggaatcaggatgaattgatcggccgagcaagaatatcacaaggcgctggctggtctctgagagaaactgcctgcctcggtaaagcctatgcccagatgtggagcctaatgtactttcacagacgtgatttaagactggcttctatggcaatctgttcagctgtaccaacagaatggtttccaacctcccggactacctggtcaattcatgcccatcaccaatggatgacaacagaggatatgctaaaagtatggaatagagtttggatagaagataatccaaatatgatagataaaactcctgtccactcctgggaggatattccatacctaggaaaaagagaggacttatggtgcgggagcttgataggtttatcttccagggctacttgggccaaaaatatacacaccgccatcacccaagtgcgcaacttaatagggaaagaagaatacgtagactatatgccagtgatgaaacggtacagcgcaccttcagaatctgaaggtgtgctctaa

SEQ ID NO: 23700 - RNA, 9867 nt, synthetic construct
  misc_feature 1..9867: note = derived and/or modified CDS sequence (opt6) from DENV-4__KT276273__SS-prME
  source 1..9867: mol_type = other RNA
tcgactataactttattatgccttataccaaccgtcatggcatttcacttgagcactagagacggtgaaccattaatgatagtggcaaaacatgaaagaggtagaccattactatttaaaaccacagaaggtataaataaatgcaccctaatagctatggacttaggagaaatgtgtgaagataccgtcacatacaaatgtccacttctggttaatactgagccagaagacatagattgttggtgtaatctaacaagtacgtgggttatgtatggaacctgcacacagtcaggagagcgaaggcgcgagaaaagaagtgtagcactcacgcctcattccggaatgggattggaaacgagagcggaaacatggatgagtagtgaaggagcttggaaacacgcgcagagagtcgagtcatggatattacgaaatcctggtttcgctttactcgcaggtttcatggcatacatgataggacagacaggtatacagcggacagtattctttgtgttaatgatgcttgttgctcctagttacggaatgcgttgtgttggagtcgggaatagagattttgtagaaggtgttagtggtggagcctgggttgatctagttttagaacatggaggatgcgtaactacaatggcccaaggaaggcctaccctagatttcgagttaactaaaacgactgccaaagaggttgctttactaagaacgtactgcatagaagcaagtataagcaatataacgaccgccacccgatgtcccactcaaggtgaaccctatttaaaagaagaacaagatcaacaatacatttgtagaagagacgtagttgacagaggatggggaaacggatgtggtctgttcggtaaaggaggtgtagttacatgtgcaaaattttcatgtagtggtaaaataactggaaacttagtacaaattgaaaatctagaatatacagtagtggtcaccgtacacaatggggacacccatgccgtaggtaacgatacatccaatcacggagtaactgcaaccataacgccaagaagcccaagtgtagaggttgaactcccagattatggagaattaacactcgattgtgaacctcgatcaggtatagacttcaatgaaatgatattgatgaaaatgaataagaaaacatggttagttcacaagcagtggtttcttgatttaccgctaccatggacagccggagctgatacctcagaagtacattggaataataaagaacggatggttacttttaaggtaccccatgctaaaagacaagatgttacggtgttgggctcgcaagagggggcaatgcacagtgctctagcaggagcaacagaagttgactctggagatggtaatcatatgttcgctggacatcttaaatgtaaagtgagaatggagaaactacggataaaaggaatgtcttacactatgtgctcaggtaagttcagcatagataaagaaatggcagaaacacaacacgggacaaccgtcgtaaaagttaagtacgaaggagctggtgcgccctgcaaagtaccgattgaaattagggatgtaaataaagaaaaagtaatagggagagttatatcgagtatacctctagctgaaaatactaactcagttaccaacatagaactcgaaccgcctttcggagattcatatatagtaattggagtgggaaatagcgcacttacactacactggtttagaaaaggaagtagtataggaaagatgtttgaatcaacctaccgaggtgcaaaacggatggctatattgggtgaaacagcttgggactttggttcagtaggaggactttttacaagtctaggaaaggcagtgcaccaggtatttggatcagtatatacgactatgtttggcggagtgtcctggatgataaggattctaataggctttttggtcctatggataggcactaattcacgaaacacaagtatggctatgacatgcattgcggtaggcgggattacactgttcctggggtttacggtacaggccgacatgggttgcgttgtaagttggtccggtagggaattaaaatgcggatcggggatttttgtaatagacaatgtacacacatggactgaacaatataaattccaacctgaatcgcccgcaagattagcatccgctattctaaacgcacataaagacggagtttgcggtataagatcaacgacgagattggaaaatgtaatgtggaaacaaatcacaaatgaattaaattatgttctttgggaagggggacacgatctaacagtggtagccggcgacgttaagggcgtcctcaccaaaggcaaaagagcattaacacctccagcaagtgatcttaaatatagctggaaaacgtggggaaaagccaaaatattcacaccagaagcacgtaattcgacgtttctaattgacggtccagatacgtcagagtgtcccaatgaacggcgtgcatggaactctttggaagttgaagactatgggttcggcatgttcactaccaatatatggatgaagtttagagaaggatcgtcggagatgtgcgatcacaggttaatgtctgcagctataaaagatcagaaagccgtacatgcggacatgggatactggatcgaatctagtaaaaaccaaacatggcaaattgaaaaagcatccctaattgaggtaaaaacatgtctgtggcctaaaacacatacactttggagcaatggagtacttgaatcacaaatgctaataccaaaatcttatgccgggcccttcagtcaacacaactatcgtcaggggtatgcaacacaaatcgcaggtccatggcatcttggaaaattagaaatcgattttggagaatgtcctggtacaacggttactatccaggaggattgtgaccaccgtggaccatcactgagaacaactacggcgagcggcaagctagtaacccaatggtgttgtagatcatgtacgatgccaccattaaggtttttaggtgaagacgggtgttggtatgggatggagatcaggccattaagtgaaaaggaagaaaacatggttaagagtcaagttgctgcaggacaaggaacctcagagactttttcaatgggattactttgcctaacattgttcgtagaggaatgcttacgtcgtcgagtaactcgtaagcatatgatattagttgtggtcataacattctgtgctatcattctgggaggactaacctggatggatctcttaagagctctcatcatgctgggagataccatgtccggacgtataggaggacaaatacatctcgcaataatggccgtatttaagatgtctcctggttatgttcttggagtatttttacggaaacttacaagcagggaaaccgcacttatggtcattggaatggcaatgaccaccgttttgagtataccttacgatctcatggaactcattgacggtatcagcttaggtctaatattgcttaagatagtgactcaatttgacaacactcaggttggaacattagcgttatcattgacttttattcgctccactatgccattggtaatggcctggcgtacgattatggccgtactctttgtagtaaccctaataccattgtgtagaacttcatgcctgcaaaaacaatctcactgggtagaaataacagctttaatcctcggcgctcaggctttgcccgtctaccttatgactttaatgaaaggagccagcagacgaagctggcctttaaatgaaggaattatggcggtaggactcgtttcgcttcttggatcagccttattgaaaaacgacgtaccgctagcaggacccatggttgccggtggcctgttattggcggcatacgttatgtctggatcctcggcagatttgtcgttagaaaaagcagctaatgtgcagtgggatgagatggccgacataactggatcctcgccaattatagaagtaaaacaagatgaagacggcagcttttctatacgtgacgtagaagagactaatatgatcacgttgcttgtaaaactagcgctcataacagttagcggtctctacccgctagcaattccggttaccatgaccttatggtatatgtggcaagttaaaacacagcgcagtggtgcactatgggacgtaccgtcgccagcagccacacaaaaagcagcactatctgaaggtgtttatcgtataatgcaaagggggctatttggaaaaacacaagtaggagtggggatacacatggaaggcgttttccacaccatgtggcacgtcaccagaggttcggtaatctgccatgaaactggaagactcgaaccgtcctgggcggatgttaggaatgatatgatttcttatggaggtggttggaggttaggagataaatgggataaagaagaagacgtgcaagtcttagctatagaacccggcaaaaaccctaaacatgtacagactaaaccaggactctttaaaacgctaacaggtgagattggagcagtaacactcgatttcaaaccgggaacgagcggctcgcctattattaatagaaaaggtaaagtcataggattatacgggaacggagtagtaacgaaatcaggcgattacgtaagtgcaataacgcaagcggaaaggatcggagagccggattacgaggtggacgaagatatatttagaaagaaacgtttgacaataatggacttgcatcctggagcagggaagacaaaaaggattctaccctcaattgtgagagaagcgctaaaaagacggttacgtaccctcattttggcaccgacacgcgtagttgcggcggaaatggaagaggcgttaagaggattaccaataaggtaccagactccagcagtaaaatccgaacatactggaagagagatcgtagatctcatgtgccatgcaacctttaccactcgactattgtctagcacaagagtgccaaattacaacctaattgtaatggatgaggcccatttcacagatcctagctctgtagccgctagaggatatatcagtacacgagtagaaatgggagaagcagctgcgatctttatgacggctactcccccaggtgctaccgatcctttcccgcagtctaactcacccatagaagatattgagcgtgagatacctgaacggagctggaacactggctttgactggatcacagactatcaaggaaagactgtgtggtttgtcccatccattaaggctgggaatgatattgcaaattgtctgagaaaaagtggcaagaaagtaatacaactaagcaggaaaacattcgacacagaatacccaaaaacaaaactcacggactgggatttcgtggttacaactgacatatcggaaatgggagcaaattttagagcaggaagggtcattgatcctcggaggtgcttaaagccagtaatattgacagatggacctgagcgagtcattctggcgggacccatccctgtaacaccagcatccgccgcacaacgaagagggcgaatcggcagaaatcctgcacaggaggatgaccaatatgtattttccggagaccctctcaaaaatgatgaagatcacgcccattggacagaagcaaaaatgctactagataatatatatacacctgagggtataattcctacactgtttggaccggaaagagagaaaacccaagcgattgacggagagtttagattgagaggggaacaaagaaaaacctttgtagaattgatgagacgaggggacctgcccgtctggttatcatacaaagtagcaagcgcaggcatatcatataaggaccgagagtggtgcttcacaggggaaaggaacaaccaaatacttgaggagaatatggaagtagaaatttggaccagagagggagagaaaaagaaattgagaccccgatggttggacgcacgagtatatgcggacccaatggcccttaaagactttaaagaatttgctagtgggcgaaaatctattactttagatatattgacagagatagccagcttacctacttatttgagctcaagagcgaaacttgccctggacaacatagtgatgttacatactacggaacgcggaggccgtgcatatcaacatgctttaaacgaattacctgaatcgcttgaaacattaatgttggtagctttgcttggggctatgacagccggaatatttctattctttatgcaaggaaaaggaattggcaaactatctatgggacttataactattgcggtagcatcaggactgctatgggttgcagaaatacagccccaatggatcgccgccagcataattttggaatttttccttatggttcttttgataccggagccagaaaaacaacgaacaccccaggataaccagctaatctatgtgatcctcacaatcctgacaataatcggtctaatagcagcaaacgaaatggggttaatcgaaaagacaaaaacagacttcggattctatcaagtcaaaacagaaacaacgatactagacgtcgacttacgaccagcttctgcgtggactctatatgccgtggccaccaccatattaacgcccatgttaagacatacaatagaaaacacttctgcaaatttgagcttagctgcaatcgccaaccaagctgcagtgttgatggggctcggaaagggttggccattacacagaatggacctaggagttcccttacttgcgatgggctgctactcacaagtgaatccgacgacgttgactgcatccttagtaatgttactcgtccattacgcaatcataggtccgggacttcaagcaaaagcaactagagaggcacaaaaacgtacggctgctggaataatgaaaaatcctactgtggacgggattacggttatcgacctggaaccaatatcatatgatccaaaatttgagaaacaattaggtcaggtaatgctactggtcctttgcgctggacaactgctattaatgcgaactacgtgggcattctgtgaagttttaacattagccacaggacctatactcacactatgggagggtaacccgggaagattttggaatacaacaatcgccgtgtcaactgcaaacatttttagaggaagttacttagcaggggcaggtctggcgttttcactcatcaaaaatgcacaaacaccaagacgagggacaggcacaacaggggagacactaggagaaaaatggaaaagacaactaaactctttagacagaaaagaatttgaagaatataaaagatcaggcattctcgaggtcgacagaacagaagccaagtccgcattaaaagacggaagcaagataaaacatgcagtctccaggggtagttcaaaaattcgttggatcgtcgaaagaggaatggttaaaccgaaaggcaaagtagtagatctaggatgcggaagaggagggtggagttattatatggcgactttgaaaaacgttacagaagttaaggggtacactaagggtggcccaggccacgaagaaccgattcccatggcaacatacggctggaacctcgtaaaacttcacagcggagttgacgtgttttataagccaactgaacaagtagacacactcctatgcgacataggcgaatccagtagtaacccaactattgaagaaggacgtactcttcgagtacttaaaatggtagaaccttggctatcgtcaaaaccagaattttgtattaaggtactaaacccttacatgccaaccgtaattgaagaattagagaagttacaacggaaacatggtggtaatttagttcgatgcccgttatcgagaaactcaacccacgaaatgtattgggtatctggagcttcaggaaatatcgtctcatctgtaaacactacatcaaaaatgttgctgaacagattcacaactagacatagaaaaccgacctatgaaaaagacgtcgatttaggggcaggcacaaggtccgtaagtacggagaccgaaaagccagatatgaccataatcggcagaagacttcagagattacaagaggaacacaaggaaacctggcattatgaccaagaaaatccgtatcgaacctgggcttaccacggtagctacgaagcaccaagcaccggaagcgcctcgtccatggtaaatggagtcgttaaattattaaccaagccgtgggatgtaataccgatggttacccaattggcaatgacggatacgactccgttcggacaacagagagtgttcaaagaaaaggtagatactcgaactccgcaaccgaaacctggaacacgaatggtaatgacaaccacagcaaactggttgtgggcattgttaggcaagaagaaaaacccccgattatgcacaaaggaagagtttatatcgaaagtgcgagccaatgcagcgattggagcagtctttcaagaagaacaagggtggaccagtgcatcagaagcagttaatgattctcgattctgggaacttgtagataaggaacgagccttgcatcaagagggaaagtgcgagtcgtgcgtgtataatatgatgggaaagagagagaagaaattgggtgaatttggtagagcaaaggggtccagagcgatctggtatatgtggctaggtgcaagatttttagagtttgaggctttgggatttctgaatgaagatcactggttcggccgtgaaaattcttggtctggggtcgaaggggaggggctgcacagacttggatacattctagaggagattgataaaaaggatggagatttaatgtacgcagatgatactgctggatgggatactaggataacagaagatgatttacagaatgaggaactgataacggaacaaatggctccccatcataagatcctggcaaaagcaatatttaaactaacatatcaaaataaggtcgtaaaggtactccgtcccacaccccgaggcgcggttatggacattatttcaagaaaggatcaaagaggcagcggccaagtcggaacctatgggcttaatacttttacgaatatggaagtgcaactcattagacaaatggaagcagagggagtaataacacaggacgacatgcagaatcccaaaggtttaaaagagcgagtagaaaaatggctgcgagaatgtggtgtcgatagacttaaacgtatggcgattagtggagatgattgcgtagttaaacccctagacgaaagatttgccacgtcattattatttttaaatgatatgggtaaagtcagaaaagatatacctcaatgggaaccctcaaaaggatggaaaaactggcaggaagtccctttttgttctcaccattttcacaaaatctttatgaaagatggacgaagcctagtcgtcccatgccgtaaccaagatgaattaataggaagggcaagaattagccaaggagcaggatggagcctgaaagagacagcatgtttagcaaaagcatacgctcagatgtggtcccttatgtactttcataggcgcgacctaagactcgcgtcaatggcaatttgcagcgctgtccctacagaatggtttccaaccagtcgaactacatggtctatacacgcacaccatcaatggatgacaactgaagatatgttaaaagtatggaaccgagtatggatagaggataatccgaatatgatagataaaacaccggttcactcatgggaagacatcccatatttgggtaaacgagaagatctatggtgtggcagcttgattggcctctcctccagagcaacatgggccaaaaatattcataccgctataactcaggtgcgcaatctcattgggaaagaagagtacatggattacatgcccgttatgaggagatattcagcaccaagtgaatctgaaggggttctttaa

SEQ ID NO: 23701 - RNA, 9867 nt, synthetic construct
  misc_feature 1..9867: note = derived and/or modified CDS sequence (opt6) from DENV-4__KU523872__SS-prME
  source 1..9867: mol_type = other RNA
agtacgatgactttactttgtctaatacccactgtcatggcatttcatttatcaactagagacggagaacctttaatgattgtcgcgaaacacgaacgaggcagaccactactatttaaaaccacagaaggtataaacaaatgtacattaatagcgatggatcttggcgaaatgtgtgaagatacagtaacttataaatgccccctattagtaaacacagaaccagaagatatagattgctggtgcaaccttacatcaacatgggtaatgtatggcacttgcactcaaagtggagagagaagaagagaaaaacgatccgtagcactaacccctcattccggaatgggactcgaaacgcgcgctgaaacctggatgtcttccgaaggagcatggaagcatgcgcagagagtagagtcgtggattttaagaaacccaggatttgcactcttagccggttttatggctcatatgatcggccaaactgggattcaacgaacggtcttctttgtccttatgatgctggttgcaccatcatacgggatgagatgtgtaggtgtcgggaacagagattttgtggaaggtgtgtcaggaggagcttgggtcgacctagtacttgagcatggtgggtgcgttactaccatggcacaagggaaacctacgttagattttgaattaacgaaaacgacggccaaagaagtagcacttcttagaacatactgtatcgaggcttcgattagtaacataacaaccgcaacccgctgtcctacacagggtgagccttacttaaaagaagaacaggatcaacaatacatatgcagacgagatgtcgttgacaggggctggggtaacggttgcggtctatttggtaagggcggagtagtaacttgtgcaaaattttcatgttcgggaaaaatcactgggaaccttgttcaaatagaaaacctagaatatacagtcgtggtcacggtgcacaatggagatacgcatgccgtaggaaatgatacaagtaatcacggagtgacagcaacaataacgccaagaagcccatcagtagaagtgaagttaccagactacggagaacttactttagattgcgaaccgaggagtggcatagattttaatgaaatgatattaatgaaaatgaaaaagaaaacgtggctcgtacacaaacaatggttccttgatctacctctaccatggacggcgggtgcagatacaagtgaagtacattggaattacaaggagagaatggtgacattcaaagtcccccacgctaaaagacaagatgtgacggtcctgggctcacaagaaggtgcaatgcacagcgcattagctggtgcaacagaggtcgactccggagacggtaaccatatgttcgctggtcacttgaaatgcaaagtaagaatggaaaaacttcgaataaaaggaatgtcctatactatgtgtagcggcaagtttagtatcgacaaagaaatggctgaaactcaacacgggactacggttgttaaggtaaagtatgaaggagctggcgccccttgtaaggtgccgattgagatacgggatgtaaataaagagaaagtggtcggaagaattatatcatctactccttttgccgagaacacaaattcagtaacgaatatagaattagaaccgccatttggagattcatatatagtcataggggttggagactcggctttaacacttcactggtttagaaaaggaagttctatcggaaaaatgtttgagagtacctatcgaggtgcaaaacgaatggctattcttggggaaacagcatgggatttcggttcggtaggaggcctctttacaagtttaggaaaggcagttcatcaagtattcggttcggtctatactaccatgtttggaggagtatcatggatgatcagaatattaatcggattcttggtactctggatcgggacaaattcgcgcaatacttcaatggcaatgacatgtatagcagtaggaggaatcaccctattccttggttttactgtgcaagctgacatgggatgtgttgttagttggaatggaaaagagctgaaatgtggaaacggtatatttgttgttgataatgtgcatacatggaccgaacagtataaatttcaacctgagagtccagcacgattagcatctgctattttaaacgcacacaaggacggtgtatgtggcataaggtctacgactagactagaaaacgttatgtggaagcaaataacaaatgagttgaactatgtcctctgggaaggcggtcatgacttaacagttgtcgcaggagacgtcaaaggtgtgttaacaaaaggaaaaagagcattgacaccgccagttaatgacctaaaatattcttggaaaacttggggtaaggccaaaatatttaccccagaagcccgaaattcaactttcttaattgatggtcccgatacatccgagtgccctaacgagagacgagcttggaactttttcgaggtggaagattatgggtttggtatgtttactaccaatatctggatgaaatttagagaaggtagcagcgaagtctgcgatcataggttaatgtctgcagccatcaaagatcaaaaagcagtacacgccgatatgggttattggatagaatcaagcaaaaatcaaacttggcagattgaaaaggcctcgttgatagaagttaaaacttgtctatggcccaaaacacatacattatggagtaatggcgttttagagtcccaaatgttaatcccaagaagctacgccggcccattttcacaacataattacagacaaggctacgcgacgcaaactgcgggaccatggcatcttggaaaattagaaatagattttggcgaatgtcctggcacaacagtaacaattcaagaagattgcgatcacaggggcccaagtttacgaacgaccacagcatcaggcaaactcgttacacaatggtgttgcagaagctgcacgatgccacccttaagatttttaggtgaagatggatgctggtatggcatggaaataagacccctaagcgaaaaggaagaaaatatggtaaaaagtcaagtaacagcaggccaaggcaccagtgaaacctttagtatgggactactgtgcctcacgctatttgtagaggaatgcctgagaagaagggttacacggaaacatatgatcttagtagtagtgattacgttctgtgcaataatactcgggggtcttacatgggttgacctgttacgtgctctaatcatgctaggagatactatgagtgggcgaataggaggtcagatccacctagcaataatggctgtatttaaaatgtcaccagggtacgtgttaggagtatttttaaggaagctaacgtcacgggaaacggcattgatggtgatcggtatggctatgacaacagtcttctcaataccacatgatttaatggaactgattgatggtatctcacttggtctcatacttctcaaaatagtgactcattttgataacactcaagtgggaacgctggccctaagcctaacatttataagaagtacgacgcctctggtaatggcctggcggaccataatggcagtattctttgtggtcacattaatccctctatgccgaacttcgtgcctacagaaacaatctcactgggttgaaataactgctttaatactcggagcccaggcacttcctgtatatttaatgacactgatgaaaggagcaagtaggcgaagttggcctttaaatgaagggataatggccgtaggtctggtttctttattaggatccgcattgcttaaaaacgatgtaccgctagcaggaccgatggttgccggtggtttattacttgcggcttatgtcatgagcggaagtagcgcagatctctcattagagaaagcggcaaacgtgcagtgggatgaaatggctgatattacaggttcctcaccggtaatagaagtaaaacaagatgaagatggtagcttctcaatacgcgacgtcgaggaaactaatatgatcacacttttggttaagttggcgctaataaccgtaagcggactataccctctggctataccggtaacaatggcaatctggtatatttggcaagtgaaaacacaaagaagcggagctctatgggacgttcccagccccgcagctacacagaaagcaacactaagtgagggagtctacagaatcatgcaaagaggactctttgggaaaacacaagttggagtaggaatacacatggaaggggttttccataccatgtggcatgtcacccgaggatccgtaatctgtcatgaaaccgggcggctagaaccttcgtgggcagatgtccgtaatgatatgataagttacgggggaggatggaaactaggagataaatgggacaaggaagaagacgtacaggtactggcaatcgagcctggcaagaatccgaaacacgtccaaacgaaacctgggttgtttaaaactttaacaggagaaataggtgccgtcacactagacttcaaacctggaacatccgggtcacctatcataaataagaaaggaaaagtaataggtctttatggtaacggagtagttacaaaaagtggggattacgtgagtgctattactcaggcagagagaataggtgaacccgactacgaagtagacgaagacatatttaggaagaaacgactaacaattatggatttacatccaggagcaggcaaaactaaacgcatacttccaagtatcgtaagagaggccctgaagcgtagattaaggacattgatacttgcacccacgagagtcgtcgctgccgaaatggaagaagcacttcgcggactcccaatccgttaccaaacgccagcggttaaatcggagcatacgggcagagagatagtcgatttgatgtgccatgccacttttacaacgcgattattatcttctacccgcgttcccaactacaacctaatagtgatggatgaagcgcactttactgacccgtgttcagttgcagctcgaggatatatatctaccagagtagagatgggagaggcagcagctatctttatgactgccacgcctccagggtctattgatccatttcctcaaagcaattcgcccatagaggatattgagcgtgagatccccgaaaggtcatggaatacagggtttgattggataacagattaccaaggaaaaacagtctggtttgtaccgagtattaaagctggcaacgatatagcgaactgcttgagaaagtctggaaagagggtcatccaattatcacgtaaaacctttgatacggaatatccaaaaaccaaacttacagactgggatttcgtagttacaaccgatatttctgaaatgggagctaattttagagcaggacgggttattgaccctaggcgatgtctgaaacctgttatactgaccgatggacccgaaagggtaatcttagctggtcccatacctgttactcccgccagcgcagctcaacgtaggggccgaataggacggaatccagctcaagaagatgatcaatatgtttttagtggcgatcctctcagaaatgacgaggatcatgcgcattggaccgaggcgaaaatgctgctagataatatatatacccctgaaggaataatccccacactatttggccccgaacgggaaaagacccaagcaatagacggtgagtttaggcttaggggcgagcagaggaaaacctttgtcgagttgatgagacgcggtgacttacctgtatggttatcttataaggtagcctccgctggtatatcttacaaagacagagaatggtgttttacgggcgagagaaacaaccaaatacttgaagaaaatatggaggttgaaatatggactagagaaggcgagaagaagaaattgcgtccaaaatggttagatgccagagtctatgccgacccaatggcattgaaagactttaaagagttcgcatcgggaagaaaaagtataactctcgatatactaaccgaaatagcaacacttcccacatatctgagctcaaaagccaaattagcgttagataatatagtgatgctccatactaccgaaaaaggagggcgcgcatatcaacacgccttaaacgaattgccagagagtctggaaaccctaatgttggttgccctacttggagcgatgacagcaggaatatttttattctttatgcaaggcaagggaataggtaaactttcaatggggctcattgctatagcagtagcctctggattgttatgggtagctgaaatacaacctcagtggatagcagcatcaattatattggagtttttccttatggttctactgatacctgaacctgaaaaacagagaacaccacaagataatcagcttatatatgtgatcctgactatcttgacaatcataggattagtagcagcgaatgaaatgggattgatagagaaaacgaagacggactttgggttctatcaggtgaagacggaaaccactatactcgacgtagatctaagacctgccagcgcctggacgttatatgctgtcgctacaacaattctaacccctatgttaagacacaccatagagaacacgagtgctaatttatcgctcgcagcaatcgcgaatcaagcagcagtactaatgggacttggaaaaggctggccactgcataggatggatcttggtgtacctctacttgctataggatgctattcgcaagtaaatccgaccacgttaacagccagcttagtcatgttattagttcattatgcaataatagggcccggattacaggccaaagcgacgcgagaagcacagaaaagaacagctgcaggtataatgaaaaatccgacggttgacggaataacagttatagacttagaaccgataagttatgatccgaaatttgaaaaacaactaggacaggtaatgctattggttttatgtgtggggcaattgctcctaatgaggacaacctgggcattgtgtgaagttcttacattggcgacggggccaattatgactctctgggaaggtaacccaggaagattctggaatacgactatagctgtatctacagcgaatatatttagaggctcatatctagccggtgcaggattagcatttagtctaatcaaaaatgcacagaccccgcgcaggggaacaggaacgacaggtgaaacattaggagaaaaatggaagaggcaactaaattcattagatagaaaggaatttgaggagtataaacgaagtgggatcctagaagtggatagaactgaagccaaatccgccttaagagatggaagcaagaccaaacatgcagtatcaagaggatcgtctaagataagatggatagttgagagaggtatgattaaaccgaagggtaaagtagtggacttgggatgcggacgcggagggtggagctactatatggctacgctcaaaaacgtaacagaggtaaagggttatactaaaggcggacccgggcatgaagaaccaatcccaatggctacttacggatggaacctagttaaattgcactcaggagtcgacgtattttacaaaccaaccgaacaagtagataccctactatgtgacattggagagagttcgtcaaacccaacgatagaagaggggaaaacattacgagttttaaaaatggttgagccttggttaagcagcaagccggaattttgtataaaggtgttaaacccatacatgcccactgttatagaagaactagaaaaattgcagcgtcgacatggcggaagtttagttcgatgccctttgagtcgtaattcaactcatgagatgtattgggtttcaggagcatcgggcaatatcgtttccagtgtaaataccatatcaaaaatgctccttaatagattcactacacgttataggaaacccacttatgaaaaggatgtagacctaggtgccggaactagatcagtaagtacagaaactgaaaaaccggatatgacaataattggtcgcagactacagaggttacgagaagaacataaagagacgtggcattacgaccaggaaaatccataccgtacatgggcataccacggttcatatgaggccccaagcacaggaagcgcatcaagtatggttaacggcgttgtcaaattactaactaaaccctgggatgtcgtcccaatggtaacacaattagcgatgacagatacgacaccatttggtcagcagagagttttcaaagaaaaagtcgacacacggacaccacagcccaaacctggaacaagaaaaataatgacaactactgcaaattggctatgggcattacttggaaagaagaaaagtcctagattatgcacccgtgaggaatttattagtaaggtccggagtaacgcggcaattggtgcggtttttcaagaggaacaaggatggacgtccgctagcgaagctgtcaatgattctcgtttctgggagttagtagataaagaaagagctttacaccaagaagggcgttgcgaatcctgcgtctataacatgatggggaaaagagagaagaaattgggagagttcggtagggcaaaaggaagtcgcgctatctggtatatgtggctcggagcgcgatttttagaatttgaagcattgggtttcttaaacgaggaccattggtttagtagggagaactcgtggtctggagtagaaggagaaggactccaccgattgggatatatactagaagatatcgacaagaaagatggtgacctaatatacgccgatgacactgcgggttgggatactcgaatcactgaggatgatcttctcaatgaagaactcataacagaacagatggcgccacaccacaaaacgctagctaaagcaatttttaaacttacgtatcaaaataaggtcgtgaaagttctaaggccgacgcccaagggggcagtaatggacatcatcagccgaaaagaccaaagaggctccggacaggtaggaacatatggattaaatacgttcacaaatatggaagtgcaattaattagacagatggaggctgaaggcgtcataactcaagacgacatgcaaaatccagaaggcttgaaagagagagttgagaagtggttaaaagaatgtggtgtggacagactaaaaagaatggcgatatcgggtgacgattgcgtggtgaaacccttagacgaacgattcagtacttcactgttatttctaaacgatatggggaaagtacgtaaggatattccacaatgggaaccaagtaaaggatggaaaaactggcaagaagtccctttctgcagtcaccattttcacaaaatcttcatgaaagacgggcgatcattagtagtgccctgtcgaaatcaggacgaactaattggccgagcgcggataagtcaaggtgcaggctggtctttaagagaaactgcttgcctgggtaaagcatatgcgcaaatgtggtccctgatgtactttcatcgcagagatctcagacttgcttctatggcgatatgttctgcggtaccgacagaatggtttcctacaagtcgaactacatggtcaatacatgctcatcaccaatggatgacaactgaagatatgttaaaagtatggaatcgggtctggatcgaggacaacccaaatatgacagacaagacacctgttcactcatgggaggacataccttatttaggaaaacgtgaagatttatggtgtgggagtttaattggacttagttcccgagcaacctgggccaaaaatatacatacagcaattacgcaagttagaaatctaataggtaaagaagagtatgtagattatatgcccgctatgaagaggtactctgcacctttcgaatccgagggagtcttgtga

SEQ ID NO: 23702 - RNA, 9867 nt, synthetic construct
  misc_feature 1..9867: note = derived and/or modified CDS sequence (opt6) from DENV-4__KP140942__SS-prME
  source 1..9867: mol_type = other RNA
tccacaattacattgttatgtcttattccaacagtgatggcatttcacctttcaaccagagatggggaacctctaatgattgttgctaaacatgaacgaggcagaccccttctattcaaaacaacagaaggaataaataaatgtacacttatagcaatggatttgggcgaaatgtgtgaagataccgtgacgtataaatgccccctcttagtcaatacggaaccagaagatatagactgctggtgtaatctaacgagtacatgggtaatgtacggtacatgcactcaatcaggagaaagaagaagagaaaaacgaagcgtagcacttacacctcattcagggatggggttggaaacaagagctgaaacttggatgagcagtgaaggagcgtggaaacacgcgcaacgagtcgaatcatggatactgcgtaatccaggctttgcacttcttgcgggctttatggcttatatgatcggacaaacaggtatccaaagaactgtcttcttcgtattaatgatgttagtagccccttcgtatggaatgaggtgcgttggtgttggaaacagagactttgtagaaggagttagcggtggggcatgggtcgatcttgtccttgaacatggaggatgtgttacaacaatggcccaaggacgacccaccttagactttgaactaacaaaaactacagctaaagaagttgcacttttgcgaacatattgcattgaagcatctatttctaacataaccacggctactagatgtccaacccaaggagaaccatacttaaaagaagaacaagatcaacaatatatttgtagaagagatgttgtagaccggggctgggggaatggttgtggacttttcggaaaaggtggagtggtaacatgtgctaaattctcttgttctggtaaaattacaggaaatctagtacaaatagaaaatttagaatacacagtagtagtcacagtacacaacggtgatactcacgctgtcggaaatgatacgagtaatcacggcgtaacagcaacaatcacaccaagaagccctagtgttgaagtcgaattacccgactatggcgaattaactctggactgtgaaccacgaagtggaatagattttaatgaaatgatattaatgaaaatgaacaagaaaacatggctagttcacaaacagtggttcttagacctaccacttccttggacagccggagcagatacttctgaagtacattggaataacaaagaacgaatggtgacattcaaagttccccacgctaaaaggcaggacgtcactgtgctcggatcccaagaaggggctatgcactcagccctggccggtgctaccgaagtcgattcaggggatggaaaccatatgttcgcaggtcacttgaaatgcaaagtcagaatggagaagttacgaataaagggtatgagttacacgatgtgttcgggcaaattctcaatcgacaaggaaatggcagaaacccaacatggcacaactgtagtcaaagtaaagtatgaaggggctggagccccttgcaaagtacctatagaaataagagatgttaataaggaaaaagttattgggagagtaatttcatcaattccgctagctgaaaacacaaattcagtaactaatatcgagctagaaccaccgtttggcgatagttatatagttataggcgtaggtaatagcgccctgactctacattggttccgcaaagggagtagcataggaaaaatgttcgaatcaacgtaccgcggagcaaagcgtatggcaattttgggggaaacagcatgggactttggatccgtgggaggtctattcacctcgttaggtaaagctgtccatcaagtgtttggtagtgtatatacaacaatgttcgggggagtctcatggatgatacggattctaatcggattcttagtcttatggattggaaccaattcgagaaacacatccatggcgatgacatgtattgcagttggtggaataacgttatttttaggttttacagtgcaagcggatatgggttgtgtagtttcctggagtggcagagagctaaaatgcggatcaggaatatttgtaattgataacgtacatacatggacagaacaatacaagtttcagccagaaagccccgcgagattggcaagcgctatactcaatgctcacaaggatggggtatgcggtatacgatcgacaacaagattggaaaatgtcatgtggaaacagataacaaatgagttaaactacgtgctgtgggaaggaggtcacgatttaactgtcgtcgccggagacgttaaaggtgtcttaacaaaagggaagagagccttaacaccccctgcatctgatttaaaatacagttggaaaacgtggggtaaagccaagatttttacacccgaagcaagaaactctactttcttaatagacggacctgacacatcagaatgtcctaatgagcgtcgagcctggaactcgttagaagttgaggattacggctttggtatgttcaccacaaatatatggatgaagtttagagaggggagcagtgaaatgtgcgatcatagattaatgagtgcagcgataaaagatcagaaggcggtacatgcggacatgggatattggattgagagttcaaagaatcaaacttggcaaatagaaaaggcttctttgatcgaggtaaaaacgtgtctctggccgaaaacgcacacattatggtccaatggggtgctagagagtcagatgttgatacctaaatcttatgcaggcccattctcgcaacataactatagacaaggttatgcaacacagatagctggaccgtggcatcttgggaaattggagatagatttcggagaatgccccggtacaaccgtaactatccaagaggattgtgaccatagaggtccctccctacgaacaactactgcctctggaaaactcgtaacacaatggtgttgtagatcctgtaccatgcctcccttgcgctttttaggagaagacgggtgttggtacggaatggaaataaggcctctttccgagaaagaagagaatatggtaaaaagtcaggtggcagccggtcaaggcacatcagaaaccttctcgatgggcttactatgtctcactctcttcgttgaggaatgccttcgcaggcgtgtgacacgaaaacacatgatactggccgtggttataacgctctgtgcaattattctaggtggcttgacttggatggatttgttacgcgcgctaattatgctgggtgatacaatgtcaggtagaatgggaggtcagactcatctagctataatggcggttttcaaaatgagtcctggatatgttctaggtgtattccttcgaaaacttacttcccgagagacagccctcatggtaataggcatggcaatgacaactacattgagtataccgcacgacttaatggaattaattgatggtatcagcttaggtttgatactacttaaaatcgttacccagttcgacaatacgcaggtaggaactttagcattgagccttacattcattaggtctaccatgtctttagtaatggcgtggcgcacaattatggccgttttattcgtagtgaccttaattcccctatgtagaacatcttgtttacaaaaacaatctcattgggttgaaataacagcactaatactcggagctcaagcactacccgtatatttaatgaccctaatgaagggtgcttcaaaaagaagttggcccctcaacgaggggataatggctgtcggtctcgtttcgctgctagggtcagcactactgaaaaacgacgtccccttagcggggccaatggttgctggtggattattgctagctgcttatgtgatgtcggggtcgtctgccgatcttagtctagagaaagcagcgaacgttcaatgggatgaaatggctgatataactggttctagcccaataatagaagtgaaacaggatgaagatgggagcttttcaattagggatgtagaagaaacaaatatgattacactattagttaaactggcgttaattacggtaagtgggctgtatccgttagctataccagtgacgatgacactatggtatatgtggcaagtaaagacacagcgcagtggtgcactgtgggatgtaccctcaccagctgctacacaaaaggcagccctgagcgaaggagtatacaggattatgcaaagaggattatttggaaaaactcaagtaggggtaggaatacacatggaaggagtattccacaccatgtggcatgttacgcgcggttctgttatatgtcatgaaacaggaaggttggaaccatcatgggctgatgtcagaaatgatatgattagttatggtggtggttggagactcggggataagtgggacaaagaagaagatgtccaggttctggctatagagccgggtaaaaatccaaagcacgtacagacaaagccagggctatttaaaacgctaacgggagaaatcggagcagtaacccttgatttcaaacctggcacttctggatcgcccattattaatcggaaaggtaaagtaataggcctctatggaaacggtgtagtaaccaaaagtggtgactatgtatcagcaataacccaagctgagcgaataggcgaaccagactatgaagtagacgaagacatttttaggaagaaacgtcttaccataatggatcttcacccaggggcaggaaagacaaaacgtatattgccgagtatagtaagggaagcccttaaacgcagattacgcactttaattcttgctcctacacgtgttgtagcagcagagatggaagaggctttacgaggactaccgatccgataccaaacaccagccgtaaaaagtgaacatacgggacgagaaatcgttgatctaatgtgtcatgctacatttacgacaagattattaagcagtactcgggtccctaattataatttaatcgtgatggatgaagcacatttcaccgatcctagtagtgtagcagcaagaggatatataagcacacgtgtagaaatgggagaagctgctgctatctttatgacagcaaccccgcccggcgcaactgatccatttccccaatcaaattctcccatcgaggacatagaaagagaaatacctgaaaggtcatggaacacgggatttgactggataactgattatcaaggtaaaaccgtttggtttgttccatctataaaggctggtaacgatatagcaaattgtcttagaaagtccggcaagaaagtgattcaactttcacgaaaaactttcgatacagaatatcctaaaaccaaacttaccgattgggatttcgtcgttacaactgatatctccgaaatgggagccaatttcagagcggggcgtgtcatagatcccaggaggtgtctgaaacccgttatactaaccgacggacccgaaagagtcattttagcaggaccgattccagtgacgcccgcttcagcagcccagcggagagggagaatcgggaggaatcccgcacaggaagatgatcaatacgtattttcaggagaccccctaaagaatgatgaggatcatgcccattggacagaagctaagatgctattggacaatatatatacaccagaaggaataatcccaactttattcgggcccgaaagagaaaagacgcaagcaatagatggagagttcaggctaagaggggaacaaagaaagacatttgtcgaattaatgagaagaggagacttacctgtatggttaagctataaagtcgcaagtgctggaatttcgtacaaagacagggaatggtgttttactggggaacgaaacaatcaaattttggaagagaacatggaagtcgagatatggacaagagaaggggagaagaagaaactaagaccacgttggctagatgccagggtttacgccgacccaatggcacttaaggacttcaaagagtttgcttcaggacgtaaatctcttaccctagacattctgactgaaattgcaagtctccctacctacttatcctcccgagcaaaattagcgttagataatattgtaatgttacacactaccgaaagaggagggcgagcataccagcatgctctaaacgaattaccggagtcattagagacactcatgttggtggcattactaggagcaatgacggctggtatatttctatttttcatgcaaggaaaaggtataggaaaactatctatgggtttgataacaatagctgtggcttcaggtttattatgggtagccgaaattcaacctcaatggatagctgcctctataatattagagttctttctaatggtattactgatccccgaacctgaaaaacaaagaactccacaggataaccagctaatatacgttattctaacaatattaactatcataggactcattgcggcaaatgaaatgggcttgatagagaaaaccaaaacagattttgggttctatcaagtaaaaactgaaacaacaattctggatgtggacttgagacccgcttctgcttggaccctatatgccgttgccactacgattttaactcccatgctccggcacacaatcgagaatacgtctgccaatttgtcgttggcagccatcgcaaaccaagctgctgtgctgatgggtctaggcaaaggttggcccctacatcgaatggatcttggggttccgctattggctatgggttgttattcacaagtgaatcctaccacactaacagccagtctagttatgttattagtacactacgcaattattggtccaggacttcaagcgaaagcaactagggaagctcagaaaaggacggcagctgggatcatgaaaaatccgactgtagacggaataacagtgattgacttagaacctatttcatatgacccaaagtttgagaaacaactaggacaagtaatgctcctagttttgtgcgcaggccaactactactgatgagaacgacgtgggcattttgcgaagttttaacccttgcaactggacccattcttacattatgggaaggaaatccagggcgtttttggaatacaactatcgcagtctctacagcgaatatcttccgcggctcatatttggctggagctggtctagcgttctccttaataaagaatgcccaaacaccacgtagaggaacagggaccaccggagagacactaggagaaaaatggaagagacaactgaacagcttagacagaaaagaatttgaagaatacaagaggtccggaatcctagaggtagacagaacagaagcaaaatccgcattgaaagacggctcaaagattaaacatgctgttagcagaggttcctcaaaaataaggtggattgtagaaagaggtatggttaagccgaaaggtaaagtagttgatctaggatgtggtcgaggcggctggtcatattatatggccactcttaaaaacgtcacggaggtgaaaggatatacaaaaggtggaccaggacatgaagaaccgatccctatggcgacctatggatggaacttggttaaactgcattcaggcgtagatgtgttctacaaacccactgaacaagtcgatactctactctgtgacataggagaaagctcctctaatccgacaatagaagaaggaagaaccttacgagtccttaaaatggtagaaccttggctctctagtaaacctgaattttgtattaaggtactaaacccatatatgccaaccgtaatcgaagaactagagaaactacaacgcaaacacggtggaaacctagtgagatgtccactatctagaaattcaacgcacgaaatgtattgggtctctggagcaagtggtaacatagtatcaagtgttaatacaacaagtaaaatgctactaaatagatttactactcgacataggaaaccgacatatgaaaaagacgtggatttaggagccgggacaagatctgtaagcactgaaacggagaaacccgatatgactattatcggacgaaggttacaaagattgcaggaggaacataaagaaacatggcattacgaccaagaaaatccataccgcacctgggcttatcacggatcatacgaggcgcccagtactggcagtgcctccagtatggttaatggagtcgttaaactactaacgaagccttgggatgttattcctatggtcactcaactcgcaatgacggacacgacaccattcggtcaacagcgagtatttaaagaaaaagtagatactcgtacaccgcagcctaaacccggaactcggatggtaatgactacaactgccaactggctctgggctctactaggaaagaagaaaaatccacgattatgtacaaaggaagaatttatttcaaaagtcagggcaaatgcagccataggagcggtatttcaggaagaacaaggatggacatcagcaagtgaagccgttaatgattcaagattttgggaacttgtcgataaagagagagctttacaccaagaaggaaaatgcgaatcttgcgtctacaacatgatgggaaaacgagagaagaaactgggcgagtttggacgagccaagggatcaagagccatttggtacatgtggctaggagcacgatttctcgagttcgaggccctcggattcttgaacgaagatcactggttcggacgtgaaaattcttggtcaggtgtagaaggtgaagggcttcaccgactaggatatatattggaagaaatagataagaaagatggcgacttaatgtacgcggatgacacagctgggtgggatacacgaattacagaagatgatttacaaaatgaggaattgattacggagcagatggcccctcaccataaaatattagctaaagcaatctttaagctaacctaccaaaataaagtcgtgaaagttcttaggccaactccgaggggagccgtaatggatataatatccagaaaggaccaacggggatctggtcaggtgggcacgtatggtttaaatacgtttaccaacatggaagttcaacttatacgtcaaatggaagccgaaggagtaataacacaggacgatatgcaaaacccaaaaggcctcaaagagcgtgtagaaaaatggctgcgggaatgcggcgttgaccgacttaaaaggatggcaataagcggagatgattgcgtagttaaacctcttgatgaaagatttgctacgtctctcctgttcttaaacgatatgggaaaagtccgaaaagatatccctcagtgggaaccctctaaaggatggaagaattggcaagaggtaccattttgtagtcaccattttcacaaaatattcatgaaagatgggagaagtctcgttgttccgtgtcggaatcaggatgagttaatagggcgtgcgcgaattagtcagggtgccggctggtcactaaaagaaacagcctgtttagcaaaagcatacgctcaaatgtggtcactaatgtatttccaccgtcgcgatctccgacttgcatctatggcaatctgctcggcagtaccaacagaatggttccccacatctcgcacgacctggtcgatccatgcacaccatcagtggatgaccactgaagacatgttaaaagtatggaacagggtatggatcgaagataaccccaatatgatagataaaacccctgtccactcgtgggaagacattccttacttaggtaagagagaagatctatggtgtgggagcctaattggcttgagttcacgagccacatgggccaaaaatattcataccgctatcacacaagtacgtaacctcatcggtaaagaagagtatatggattacatgcccgtaatgagaaggtattccgcacctagcgaaagcgagggtgtactatga

SEQ ID NO: 23703 - RNA, 9867 nt, synthetic construct
  misc_feature 1..9867: note = derived and/or modified CDS sequence (opt6) from DENV-4__KU523871__SS-prME
  source 1..9867: mol_type = other RNA
tccacaatgacactactatgtctgataccaacagtcatggcattccatcttagtacgagagatggggaaccattgatgattgtagcaaaacatgaaagaggacgcccattacttttcaaaaccactgaaggcatcaataaatgtacactaattgcaatggatctaggggaaatgtgcgaggatacagtaacatataaatgcccactattagttaatacagaaccagaagatatagactgttggtgtaacctgacctcaacttgggtcatgtatgggacatgtacgcaaaatggagaaagacggcgagagaaaagaagtgtggcacttactccacattcgggcatgggtctagaaacacgggcggaaacatggatgtcaagtgagggagcctggaaacacgcacaacgcgtcgaaagttggattttaagaaaccctggatttgcacttttagcggggttcatggcttatatgatcgggcaaacaggaatacaacgaatagtctttttcgtcctaatgatgttagtagccccctcctacggcatgcgttgtgtaggtgtgggaaatagggattttgtggaaggagtaagcgggggcgcatgggttgatttagtacttgaacacggaggatgcgtaaccacaatggcacagggaaaacccacactcgactttgaacttacgaaaactaccgcaaaagaagttgctcttttaagaacttattgtatagaagcgagtataagtaacataaccaccgcaacaagatgtccaacgcagggagaaccctatcttaaagaagaacaagaccagcaatatatatgccgcagagatgtagtagatcgaggttggggtaatggatgcggattatttggaaaaggaggagtagtcacatgcgctaaattctcctgtagtgggaaaataacaggaaacctcgtccagatagaaaatttagaatacacggtagtcgtaacagtgcataacggagacacacacgcagtaggaaatgacacctcaaaccacggtgttactgcaactataacgccacgatcaccatcggtcgaagtaaaactacccgattatggcgagttaacacttgactgtgagccacgctccggaatcgacttcaacgagatgatactcatgaaaatgaagaagaaaacttggctcgtacataaacagtggtttctcgatctaccgttaccttggacagctggtgctgatacgagcgaagtacattggaatcataaagaaagaatggtaacattcaaagtcccgcacgccaaaaggcaagatgtcactgtccttggctctcaggaaggagctatgcatagtgccttagctggagccactgaggtggacagtggtgacggcaatcatatgttcgcagggcatttaaaatgtaaagtaagaatggaaaaactacgaataaaaggtatgtcatataccatgtgctctggaaaatttagtatcgataaagaaatggcggaaacacaacatggtactactgtcgtcaaggttaagtacgaaggcgccggtgcaccttgcaaagtgcctatcgaaataagagatgttaataaggaaaaagttgtgggtagaatcatatcaagcacgccatttgcagaaaacacaaactcggtcaccaacatagagttagaaccacctttcggtgattcgtatatcgtaataggagttggggagtctgctttaacgttgcattggtttcgaaaaggatcatcaataggcaaaatgtttgagagtacatatagaggtgccaaacgaatggcaatcttaggagaaaccgcatgggactttggctcagtgggtggattatttacatccctaggaaaggcagtgcaccaagtcttcggttcagtctacacgacaatgttcggaggggtcagctggatggtacgaatattaattggctttctcgtactatggataggcactaatagtcgcaatacgagtatggctatgacatgcattgcagtgggaggcatcacactctttctaggcttcaccgtgcaagctgatatgggatgtgtagtaagctggagtggtaaagaactaaaatgcggctcaggcatcttcgttgtagataatgttcacacttggacagaacagtataagtttcaacctgaatctccagcccgactcgcaagtgctatattgaacgctcataaagatggggtgtgcggaatacggagcacaactcgacttgaaaatgttatgtggaaacaaataacgaatgagttgaattatgtactatgggaagggggtcatgacttaactgtagtcgccggtgatgtaaagggagttcttacgcgtggaaaaagagctctcactccaccggtaaatgatttaaaatactcttggaaaacatggggaaaggcaaaaatattcacacctgaagctagaaactctacatttctaattgatggtccagatacatccgaatgcccaaatgaacgaagggcctggaacttctttgaagtcgaagactatggctttgggatgttcactacgaatatctggatgaaatttagagaaggaagtagtgaagtgtgcgatcaccgcctaatgtcagccgcaataaaagatcaaaaagcagttcatgccgacatggggtactggatagaatctagtaagaatcaaacatggcaaattgaaaaggcgtctcttattgaagtaaaaacctgcctctggcctaaaacccacactctatggtccaacggcgtcctagaaagccaaatgttgattccgcgaagttacgcgggaccgttttcacaacataattaccgtcaaggatatgcaactcaaacagtgggaccgtggcatctaggcaaactcgagatagacttcggggaatgtcccggcactactgttgcaataagagaagattgtgatcataggggacctagtttaagaacaactactgcatcagggaagctggttacccaatggtgttgcaggtcctgtacaatgccacctttaagattcttgggtgaagacggttgttggtacggcatggaaatcaggcccctaagtgaaaaagaagaaaacatggttaaatcacaagcaacggcgggacaaggaacgagtgaaacattcagtatgggattactatgtcttacactatttgttgaggagtgccttagaagacgagttacaagaaagcacatgatattggtggtcgtgatcactttttgcgcaataatattaggtggacttacatggatggatcttcttagggctttgatcatgttgggcgacactatgtccggtcggattggcgggcagatacacctagctattatggctgtattcaaaatgtcgccagggtatgtactcggtgtctttctgaggaaactaacgtctagggagacagcattaatggttataggaatggccatgacaacggtgttttctatcccacatgaccttatggaactcatagatggtataagtctaggcctaattttactaaaaattgttacccactttgataatacacaagttggcactttagcattatcacttacctttcttagaagcacgaccccactggtcatggcttggcgaaccataatggccgtcttctttgtcgtcacactgattcctttgtgccgaacctcatgcctacagaaacaaagccattgggttgaaattacggctctgatcttaggcgcacaggctttacccgtgtacctaatgactttaatgaaaggtgcctcgagacgttcctggccattaaatgaagggattatggcagttggtctggttagtctgctaggcagtgctctcctgaagaacgatgtgcccctcgctggacctatggtggcaggagggttattactagcagcttatgtaatgtcagggagttctgcggatctatccctggaaaaagccgctaatgttcaatgggacgaaatggccgatattaccggatcatctcctatcattgaagtgaaacaagatgaagacggctcattctctatcagggacgtagaagagactaatatgatgacccttcttgtaaaactcgcattaattacagttagcggtctatatcccttagcaataccagtaacaatggcattatggtatatttggcaagtaaaaacgcaacggtcaggcgccttatgggatgttccttcaccagccgcgacacaaaaagctacactttcagaaggtgtgtatagaatcatgcagcgggggttattcggtaagacacaagttggcgtcggcatacacatggagggcgtattccatactatgtggcacgtcactaggggttctgttatttgtcatgaaacgggtcgcttagaaccatcgtgggcagatgtaagaaatgacatgattagctacggagggggttggagattaggagacaagtgggacaaagaagaggatgttcaagtacttgctatagaacccggtaaaaatccaaaacatgtacagacaaagccaggcttatttaaaacattaacgggagagataggagctgttacattagattttaaacctggaacttccggatcacccataatcaacaagaaaggaaaggtcataggactgtacgggaacggtgtggtaaccaaaagcggcgattatgtgagtgctataacacaagcagaaagaattggagagccggattatgaagtcgatgaggatattttcaggaagaaacgattaacgataatggatctgcatcctggtgcgggtaaaaccaaaaggatacttccgtcaatcgtccgagaggcgctaaaaagaagacttagaacactgatactagctccaactagagttgtagccgctgaaatggaagaggcattgagaggactacctattagatatcaaacgcccgcagtcaaaagtgaacacactggacgggagatcgtagatttaatgtgtcatgccacattcacgacaagattactttcatcaacaagagtgcccaattacaacttgattgtaatggatgaagcacactttacggatccctgtagtgtggcggcaagaggatatataagtaccagagttgaaatgggagaagctgcagcaatattcatgactgccactccgcccggagccactgatccctttccccagtcaaacagtcccattgaagatatcgagagagaaatacctgagcgttcgtggaacactggatttgactggatcactgattatcaaggcaagacggtttggttcgtcccatcgataaaagcaggcaacgatatcgccaactgtttaagaaaatcgggtaaaagagtaatccagctatcaagaaaaacgtttgacacagagtatcctaaaaccaaattgactgactgggatttcgttgtaacgacagacattagtgagatgggcgcaaattttcgcgctggtcgagttatagatccgagacgatgccttaaaccagtcatattgaccgatggcccagagagagtaattctagccggccctatacccgttacaccagcctcagcggcgcagcgccgtggtagaattggacggaatccagcacaggaagatgatcaatacgtcttttcaggagacccccttaaaaatgatgaagatcatgcacattggaccgaagccaaaatgctattagataacatttatacgcccgagggtataataccaactctattcggcccagaaagagagaaaacacaagcaattgacggtgaatttagactacgaggagaacagcgaaaaacttttgtagaactaatgaagagaggggacctccccgtttggctatcatacaaagtcgctagtgctggaataagttataaagaccgagaatggtgtttcaccggtgaaagaaataaccaaatcctagaagaaaacatggaagtcgagatatggacaaaagaaggtgagaagaagaaactccgacctaagtggttggacgctagagtgtatgctgacccaatggccttaaaagatttcaaagaatttgcatccggtagaaaaagtataacattagatatactaacagagatcgcatcgttgccaacatatttgtcatccaaagcaaaacttgcgcttgataacataatcatgttacatacgaccgaaaaaggagggagagcttaccaacacgcattaaatgaactaccagaatccttagaaacactaatgttagttgccttactaggcgcgatgacagcagggatttttctgttctttatgcaaggtaaaggaatcggtaaattatcaatgggtcttatagctattgctgtagcgtccggattgctatgggtagccgaaatccaaccccaatggattgcagcgtctataattcttgagttctttttaatggttcttctcattcctgaacctgaaaaacaacgcactcctcaagacaaccaattgatatatgtaattttaactattctaacaataataggcttgattgctgccaacgaaatgggacttattgaaaagactaagactgatttcggtttttaccaagtaaaaacagaaacgaccatattagacgttgacctaagacctgcatcagcatggactctctacgcagtggctacgaccatattaacaccgatgcttcgtcatacaattgaaaatacaagtgcaaacttgtcattggcagcaattgcgaaccaagctgctgtgttgatgggactaggaaaaggatggccattacaccgcatggatctaggtgtgccacttctcgcgatcggttgctactcccaagtaaacccaacgactttaacggcgtcgcttgttatgctgttagtccactacgctataatagggcccggacttcaagcaaaagccactagagaagcgcaaaaacgaacagcagcaggtatcatgaaaaaccctacggtggatggaataacagtaatagatctagaaccaatatcatacgaccccaaattcgaaaaacaactcggtcaagtaatgctcttagtgttatgtgctggacagctgctactgatgcgaacgacatgggcactctgtgaagtcttgacactcgcaactggacctgccatgacattatgggaaggtaaccctggcagattttggaacacaacaatcgctgtctctacagcaaatatatttagaggatcttatcttgcaggcgctggactagcattttccttaattaaaaacgcccaaactcctagaagaggaacgggaactacaggtgaaacgttaggcgaaaaatggaagagacagctaaattcattagataggaaagagttcgaagagtataaacgcagtggcattctcgaggtcgatagaacggaagctaagagtgctcttaaagacggctcaaagataaaacacgctgtatctaggggatcatcaaaaatccggtggatcgttgagagaggcatggtaaagccaaaaggaaaagtggtggatttaggatgtggaagaggtgggtggtcttattacatggctacactaaagaatgtcactgaagtcaaagggtacacaaagggtgggcccggtcatgaagaacctataccaatggctacttacggttggaatcttgtgaaacttcatagcggggtagatgtcttttataaaccaacggaacaagttgatactcttttatgtgatattggagagagtagctcaaaccccacgatcgaagaaggacgtactttacgagtgttaaaaatggtggaaccatggttaagctcaaaacctgaattttgcataaaagtactgaacccatatatgccaacggtaatagaagagttagaaaaattgcagcgtcgacacggcggatcgttagttagatgtcccttgtccaggaacagtactcacgaaatgtactgggttagtggagcctcaggtaatatcgtatcttcggtaaatactataagtaaaatgcttttaaacagattcacaacgagacatagaaaacctacatatgaaaaagatgtagatttaggggcaggcacaaggtccgtaagtacagaaaccgaaaaacccgacatgacgattattggaagaagacttcagagactcagagaagaacataaagagacctggcattatgatcaagaaaatccgtatcgaacctgggcatatcacggaagctatgaagcccctagcaccgggtcagcttcgtccatggtaaatggtgttgtaaaactactgaccaagccatgggacgtagtacctatggtaacacagttagcaatgacagatacgacaccatttggacaacaaagagtttttaaagaaaaggtagatacaagaacaccacaacctaaacctggcactagaatgattatgactacaactgccaactggctctggactttactcgggaagaagaaatcccctagattatgcactagagaagagttcatcagcaaagtaaggagcaatgctgcaataggcgcagtatttcaagaagaacaagggtggacctctgcatcagaagccgttaacgattcccgtttttgggaattagtagataaagaacgtgcattacatcaggaaggcaaatgcgaaagttgtgtatataacatgatgggaaagagagagaagaaacttggagagtttggtagagcaaaaggaagcagagcaatgtggtacatgtggctcggtgccagatttttagaatttgaagcacttggatttttaaatgaagatcactggttctcacgagaaaattcttggtccggagtcgaaggagagggccttcaccgcctggggtatatactagaagatattgacaagaaagatggcgatctaatatatgctgatgatacagccgggtgggatacgcgaataacggaagatgacctattaaatgaagaacttataactgagcaaatggcaccccatcataaaactctcgccaaagccatcttcaagctgacataccaaaataaagttgtaaaggtactcaggcccacgcctaaaggagcggttatggatattatatcacggaaagatcagcgaggctcaggtcaagtcggaacttatggtcttaacacttttaccaatatggaggttcaacttattcgacaaatggaagcggaaggggtaataactcaagatgatatgcaaaatccgaagggactgaaagaacgcgttgaaaagtggttaacggaatgcggagttgatcgtttaaaaagaatggccatatccggtgacgattgtgtagttaaaccactggatgaacgattcagcacaagtttattattcctaaacgacatgggcaaagtcagaaaggacattcctcagtgggaaccatcaaaaggatggaaaaactggcaagaagtgccattttgctcccatcatttccataaaatattcatgaaagatggaaggtccttagtcgttccatgccgtaaccaagacgagctaataggcagggcacgcatcagccaaggagctggttggagtttacgagagacggcgtgtttggggaaggcttacgcacaaatgtggtccttaatgtactttcataggcgagatctacgcttagcgtcgatggctatctgttctgcagtaccgacagaatggttcccaacgtcaagaacaacatggtctatacatgcacatcatcaatggatgacgactgaggatatgctgaaggtttggaaccgcgtctggattgaagataaccccaatatgacagataaaacaccagtatattcttgggaagacataccatatctaggaaaaagggaagatctatggtgtggcagtcttatcggattgagttccagagcaacctgggctaagaatatccataccgcgatcacacaagtaagaaacttaatcggaaaagaagattacgtagactatatgccgataatgaaaagatattcagcccctagtgagtctgaaggcgtactttaa

SEQ ID NO: 23704 - RNA, 9867 nt, synthetic construct
  misc_feature 1..9867: note = derived and/or modified CDS sequence (opt6) from DENV-4__HQ332175__SS-prME
  source 1..9867: mol_type = other RNA
tcaacgatcacacttttgtgtcttatacccacggtcatggcattccacttgagcacaagagacggtgaaccattgatgatagtcgcaaaacacgaacgcggacgacccttgttatttaaaacaactgaaggaatcaataaatgcacgctcatagcaatggatttaggtgaaatgtgcgaagatactgtcacatataaatgtccgctgttggtgaatacagaacctgaagatatcgactgttggtgcaatcttacatcgacttgggtaatgtatggtacatgtacccagtctggagaacgacgacgagagaaaaggtcagtcgcgttgacacctcactctggaatgggtctggaaacgagagcagaaacgtggatgagctccgaaggtgcttggaaacacgcacaacgcgtggaatcctggatattacgtaaccccggttttgcgctgcttgctgggtttatggcttatatgattggacaaacagggatacaacggactgtattctttgttctaatgatgttagtagcaccttcttacggtatgagatgtgtgggagtgggtaacagagatttcgtagaaggagtttcgggtggagcatgggtagacttagttttagaacatggaggttgtgttaccaccatggcccaaggaaaaccaaccttagactttgaacttacaaaaacgactgcaaaagaagttgccctacttaggacgtactgtattgaagcacttatcagtaacataacaaccgctactaggtgtccaacacagggagaaccgtatttaaaagaggaacaagatcaacagtatatctgtcgaagggatgtcgttgaccgaggatggggaaatggatgtggtctcttcggaaaaggtggagtagtaacgtgtgctaaatttagctgcagcggtaaaattaccggaaacctggtccagatcgagaacttggagtacacggtcgtagtaaccgttcataacggtgatacccatgcagtaggcaacgatacatctaaccacggagtcacagcaacaataacacctagaagtccaagtgtcgaggtgaaattgccagattatggcgaacttacattggactgtgagcccaggtctggcatagactttaacgaaatgatcttgatgaaaatgaagaagaaaacttggctagttcataaacaatggtttttagatctaccactaccgtggactaccggagcagatacgagtgaagtacattggaattataaagaaagaatggtcacatttaaagtaccacatgcgaaaagacaagacgtcaccgtcttaggatcacaggaaggtgcaatgcatagcgcgttagctggtgcgacagaggtggatagtggagatggaaaccatatgttcgcggggcatctaaaatgcaaagtaaggatggaaaaattaagaattaaaggcatgtcatatacaatgtgctcaggaaaattttcaatagataaagaaatggcagaaacacaacatgggaccacagtagtgaaagtaaaatacgaaggtgctggcgccccatgcaaagtacctattgagatccgcgacgtaaataaagaaaaagtagtggggcgtgtgattagtgctacaccgttggctgaaaatacaaattccgtaacaaacattgaattagagcctccgtttggagattcatatatagtaataggagtgggaaattcggcactaacattgcactggttcagaaaaggatcttcaataggaaaaatgtttgaatcgacttatagaggggcgaaacggatggccatactcggtgagactgcatgggattttggatcagtagggggtttattcacgtctctaggcaaagctgttcatcaagtttttggcagtgtctatactacgatgttcggaggggtaagctggatgataagaatattaattggatttctggttctatggattggcacgaacagtagaaatacctccatggcaatgacatgtatagccgttggtggaatcacgcttttcttaggtttcacagtgcaagctgacatgggttgtgtagtatcgtggagtggacgagaactaaaatgcggcagtggcatattcgtcgtagacaacgttcatacttggacagaacaatataaatttcaaccagagtcacccgctagactagcctccgcaatactaaacgctcataaagatggtgtttgtggaataaggtcaaccacccgattagaaaatgtaatgtggaaacaaataacaaatgaactcaattatgtgttatgggaagggggccacgatcttactgtggtagcaggagacgtgaagggtgttctcactaaagggaaacgagcgttgacacccccagcgtcggatttaaaatattcttggaaaacatggggaaaagccaaaattttcactccggaagcgcgaaatagtacgttcctaattgacgggcctgatacaagtgaatgtcctaatgaaagacgcgcctggaactctttcgaggtagaggattatggtttcgggatgtttacaacaaacatttggatgaagtttagggagggaagtagtgaagtatgcgatcaccgactaatgtcggcagccatcaaagaccaaaaagcagtacatgctgacatgggctattggatcgaaagcagcaaaaatcaaacgtggcagattgaaagagctagcctaatcgaggttaagacttgtttatggccgaagacacataccttatggagcaatggtgtacttgaaagtcagatgctaattccaaaatcgtacgccggaccatttagtcaacataactacagacaaggttatgcaacacaaactgtagggccatggcatctagggaaacttgagatagactttggagaatgcccaggtacaacagttactatacaggaaaattgcgaccatagggggccaagtttacgtacaaccacggcttccggcaaattggtaacgcaatggtgctgcagatcctgcacaatgcctccactcagatttctgggagaagacggatgttggtatggtatggaaatacggcctctgagcgaaaaggaagaaaatatggtcaaatcacaagtaacggcaggacaaggtacctctgagactttctctatgggcctgctatgcctcacattatttgttgaagaatgtttgcgtagacgtgttactagaaaacacatgattcttgcagtcgttataacattgtgcgcgataatactcggaggtctcacatggatggatcttttaagagcattgattatgttaggagacactatgtcaggtcgtataggagggcaaacacatcttgcgataatggctgtattcaaaatgagcccaggatatgttctaggcgtcttcttaagaaaactcacttcgcgggaaactgcgctaatggtgataggtatggcgatgacaaccacgttatcgattccgcatgacttgatggaactcatcgacggtatatctctggggttaatcttgttgaaaatcgtaactcagttcgataatactcaggtgggtacactagcgctctcacttacttttataaggtcaacaatgtcgctagttatggcatggcgtacaatcatggcagtactatttgtagttacactaattcccctatgcaggacaagttgtctccaaaaacaaagccattgggtagaaatcactgcacttattttaggagcacaggctttacctgtatacttaatgaccttaatgaaaggagctagcagaaggagctggcctcttaacgaaggaatcatggcggtaggtttggtgtcactactaggatctgcgcttcttaaaaatgatgttccattagccggacccatggtagccgggggtcttttgcttgcagcctatgtaatgagtgggagtagtgtagatcttagtcttgaaaaggctgctaacgtccaatgggacgaaatggccgacattaccggatccagtccgatcatagaagtaaaacaagatgaggacggtagcttttcaatcagggatgtcgaagagacaaatatgataaccttacttgtaaagttagcccttattacagtatcaggcttatatccattagcaatacccataaccatgacgttatggtacatgtggcaagtaaaaacgcaacgctcaggtgcgctgtgggatgtaccttcgccggctgcgacacagaaagcagcgttgagtgaaggtgtgtacagaatcatgcagagagggcttttcggtaaaacacaggtgggcgtaggtatccatatggaaggagtatttcatacaatgtggcatgttacacgaggttcagtaatctgtcatgaaacaggacgtcttgaacctagctgggctgatgtccgaaacgatatgatatcttatggtggaggatggaggctcggtgacaaatgggataaagaagaagacgttcaggttctggcgatagaaccgggtaaaaaccctaaacacgtacagactaaacctggactgttcaaaacactaactggggagataggagctgttacactagacttcaaaccgggtaccagcggttcccctattattaatagaaagggaaaagttattgggttgtatgggaacggggttgtaacgaaatccggtgattatgtttctgcaataactcaagctgaaagaataggtgaacccgactacgaagtagatgaagacatatttcggaagaaaaggttaacaattatggatttgcacccgggagccggaaagacgaaaagaatacttccctcaattgtaagagaagcattgaaaagaaggctacgtactctaattttagcccccacaagggttgttgccgccgagatggaggaagcacttcgtgggcttccaatccgttatcaaactccggcagtcaaatctgagcacacgggaagagaaatagtggatttaatgtgtcacgccacattcacgacacggttattgagtagtacaagagttccaaactacaatttgattgtgatggacgaagcacatttcacggacccaagctctgtagcagctcgtggctacatcagtacgcgtgttgaaatgggtgaagctgcagctatattcatgacagctactccgcccggcgccactgatccatttccccaaagtaactcccctatagaagacatagaacgcgagataccggagagatcatggaatacagggttcgattggataacggactatcaggggaagacagtatggtttgtcccatcgatcaaggcaggtaatgatatagctaactgtctaagaaaatcaggtaagaaagtaattcagttatctagaaaaacgtttgataccgaatatccgaaaacaaaattaactgactgggacttcgttgttacaactgatataagtgaaatgggggccaattttcgggctggccgagtcattgatccacgtcgctgcctcaaaccagtcattttgaccgatggacctgaacgtgttatcctcgctggacctatacctgtaaccccggcatcagccgctcaaagaagagggagaattggacgtaatccagcacaggaggatgatcaatacgttttctccggcgatccattgaaaaatgatgaagaccacgctcattggactgaagcgaagatgctactagacaatatatatacacctgaaggaataataccaacactatttggaccagaaagggagaaaactcaagcgatcgatggcgaatttcgcctaagaggtgaacaaagaaaaactttcgtagaattgatgagaagaggcgacctcccagtttggttatcctataaagtcgccagcgctggcatttcctacaaggatagagaatggtgctttacaggtgaaaggaataaccaaattctagaggaaaatatggaagtggagatatggacgagggagggagagaagaagaaactgaggccaaaatggctcgatgcgagagtgtacgcagacccaatggctctgaaggattttaaggagttcgcatcgggcagaaagagtataaccttagatatattgacggaaatagcttcattaccaacttatctttcatcaagagcgaaattagcactcgataacattgtaatgttgcatacaactgaaagaggcggcagagcataccaacatgcgcttaatgagttacctgagtcattagagacgttgatgttggtagccctactaggggcaatgacggcaggcatatttctcttctttatgcagggtaagggaattggaaaattatctatgggtttaattacaattgccgtggcctcgggactattatgggtggcagaaatacagcctcaatggatagccgccagtataattttagagttcttcttaatggtacttttaattccagaaccagaaaaacaaagaacaccacaagataaccaattaatatacgtaatcctaactattttaacgataattgggttaatcgctgcaaacgaaatgggattaattgagaaaactaaaactgatttcggtttttatcaggtaaaaacagaaaccaccatactggatgtagatctgagacccgcgtccgcatggacattatatgctgttgccacaacaatattaacacctatgttaaggcatactatcgagaacacgtctgcaaatctgtcacttgctgcaatagcaaaccaagcggccgtcctaatgggcctcgggaagggatggcccttgcacaggatggacttaggtgtccctttattagcaatgggatgttactcgcaagtgaatcccacgacccttacagcgtccttggtcatgttattagttcattatgcaataataggcccgggtttacaagcgaaagcaactagggaggcacagaaacgaactgctgccggaataatgaagaatccgactgttgatgggataacagtaatagatctagaaccaatatcttacgacccaaagtttgaaaaacaattgggccaagtcatgctcttagttctatgcgccggacaattactattaatgagaacaacatgggcattttgtgaagtattaactcttgcgacaggtcccatattaaccctgtgggaaggaaatcccggaaggttctggaatacgacaatagcagtatctacagccaacatatttagagggtcctatctagccggtgcgggtttggcttttagtctaattaagaatgcccaaactccaagaaggggcacgggcactacgggggaaacgctaggtgaaaaatggaagagacaactaaattcgctcgatagaaaagagttcgaagagtataaacgttctggtattttagaagtagaccgaactgaagctaaaagtgcattaaaagatggatcgaagattaagcatgccgtatctagaggatcaagtaagatccggtggatagtagaacgagggatggtaaagccgaaaggaaaagtggtggaccttggctgtggacggggaggatggagttactatatggccacactaaagaacgttacggaagtaaaaggatatactaaaggaggaccgggtcatgaagaacctatacccatggccacatatggttggaatttagtaaaactacacagtggagttgacgttttctataaaccgacagaacaagtagatactttattatgtgatattggtgaatctagcagtaacccaactatagaggagggtagaactttgcgagtattaaaaatggtagaaccctggttaagctcaaaacctgaattttgtatcaaagtactaaatccgtacatgcccacagtaatcgaagaactggaaaaacttcaacgaaaacatggtggcaatttagtcaggtgcccgttgtcacgaaacagtacacacgaaatgtattgggtgtcaggggctagtggaaacatagtaagcagtgtaaacacaacctcaaaaatgttgttaaatcgatttactacgagacatagaaaacctacatatgaaaaggacgttgatctcggagcaggtacaagatccgtaagcacggaaacagagaaacccgatatgacaataataggacgaaggctgcagaggcttcaagaagaacataaagaaacatggcactacgatcaagaaaacccatatcgaacttgggcgtatcatggcagttacgaagcgccatcaacaggaagtgcatcttccatggtgaatggagtagtaaaactacttactaaaccctgggatgtaataccgatggtaacacaactggcgatgacagacacgacaccatttggacaacaacgcgtgtttaaagaaaaagtggacacacgaacaccgcaacccaaaccagggacaagaatggttatgacaaccacagcaaattggctttgggcattactaggtaagaagaaaaatccgaggctatgtacacgagaagagtttatcagcaaagtccgatctaatgccgcaataggtgcagttttccaagaagaacaaggatggaccagtgcgagtgaggctgtgaatgactccagattttgggagttagttgataaagaaagagcactgcaccaggaaggaaaatgcgagagttgtgtttacaacatgatgggtaaacgcgaaaagaagctcggagagtttgggagagctaaaggaagtagggcaatctggtatatgtggctgggagctcgatttcttgagttcgaggctttaggctttctaaatgaggatcactggtttggtagagaaaattcatggtccggtgtagagggggaaggattacatagacttggatatattttggaagagatcgataagaaagatggagatctgatgtatgcggatgatacagcaggatgggacactaggattactgaagacgatctacaaaatgaagaactaataaccgaacaaatggctccccaccacaagatattagcgaaagccatctttaaattaacataccaaaataaagtcgttaaagtcttaagacctacaccacgtggggcagtcatggacattataagtcgtaaagatcaaagaggatcaggtcaagttgggacatacggcctaaatacttttactaatatggaagtccagttgataagacaaatggaagccgaaggagttattacgcaggatgatatgcaaaatccaaagggtttgaaagaaagagtagagaaatggctcagagaatgcggcgttgatcggttaaaacgcatggctatatcaggggacgactgtgtagtaaagcccttggacgaaagatttgggacttcattgctatttttgaatgatatggggaaggtccgcaaagatattccccagtgggaaccaagcaaagggtggaaaaactggcaagaggtacctttctgtagtcaccattttcataaaatattcatgaaagacgggcgttctttagtagttccctgcagaaatcaagatgaattaataggcagagcaagaattagccagggggcagggtggagtcttcgagaaaccgcatgtctaggcaaagcatatgcacaaatgtggtcgttaatgtatttccacagacgggatctgaggttggcctctatggccatttgtagtgcagttccgacagagtggttccctacatcgcggactacatggagtatacatgcacatcatcaatggatgaccacagaggatatgctaaaagtatggaatagagtgtggatcgaggacaatccaaatatgatcgataaaacaccggtccactcgtgggaagacataccatatttagggaaaagagaagatctgtggtgtggttctttaatcggtttatccagccgggcaacttgggcgaagaacattcatacagcaattgcccaagtacgaaatctaataggtaaagaggaatacgtcgactatatgccagttatgaaaaggtactccgcaccatccgagagcgagggagtattataa

SEQ ID NO: 23705 - RNA, 9867 nt, synthetic construct
  misc_feature 1..9867: note = derived and/or modified CDS sequence (opt6) from DENV-4__HQ332172__SS-prME
  source 1..9867: mol_type = other RNA
tcaactatcacgttactttgtttaatccccactgtgatggcttttcatttatctacgcgtgatggggagccattaatgatcgttgctaagcatgaaagggggcggccattgttattcaagacgactgaaggcataaataaatgtactttgatagcgatggatctgggggaaatgtgtgaggataccgtgacttataaatgccccttgctagttaatacggaacctgaagatattgattgctggtgcaatttaacgtctgcatgggttatgtacggaacttgtacacaaagcggggagagaagaagagaaaagcgtagcgtggcattgacgccgcatagtgggatgggtctagagacaagagcagaaacgtggatgtccagcgaaggcgcttggaaacatgcacaaagagttgagtcatggatcctcaggaatccgggttttgcattactcgcaggatttatggcatacatgatagggcagacaggcatccaacgaaccgtatttttcgtactaatgatgctagtcgctccttcatatggaatgcgatgcgtaggggttggaaatcgggatttcgtagaaggggtatcaggtggagcatgggtagatctcgtattagaacatggaggttgtgtaactacgatggcacaaggcaaacctaccttagactttgaactcactaagacaaccgctaaagaggtagcactgcttcgcacttattgtatagaagcattaatttccaacattacaacagctacaaggtgcccaacgcaaggcgaaccctatcttaaagaggagcaagatcagcaatacatttgtagaagagacgtcgttgatcgaggctggggaaatggatgtggtctatttgggaaaggaggggttgtcacgtgtgcaaagtttagctgcagtggaaagataacagggaacttagtacaaatagaaaacttagaatacacggtggtcgttactgtacacaatggcgacacacacgccgttggtaatgatacaagtaatcatggagtaacagcaaccatcacccctcgtagtccctcagttgaagtcaagctcccagattacggagaattaacattagattgtgaaccacgctcaggcatagactttaatgagatgatcctgatgaaaatgaaaaagaaaacttggctagttcataaacaatggtttttagatctccctttaccatggacaacaggagccgacacctctgaagttcattggaattataaagaaagaatggtcacattcaaagtaccacatgctaagagacaagatgtaacagtattaggatcacaggaaggagctatgcatagtgccctcgccggtgctacagaagtagattcaggcgatggcaaccacatgtttgctggccacctaaagtgcaaagtgagaatggaaaagttaagaattaaaggcatgtcctatacaatgtgtagtgggaaattcagcatagataaagagatggcggaaactcaacatggtacaacagtcgtgaaagttaaatacgaaggcgcaggagccccatgcaaagtgcccattgagattcgagatgtgaacaaagagaaagtcgtaggacgtgtgataagcgctacacccctagcagagaacaccaatagtgtgacgaatattgaactagaaccacctttcggggattcatatatcgtgatcggagttggtaactcagcgttaaccctgcactggttcagaaaaggatcgagcatagggaaaatgttcgaatctacatatagaggggcaaagagaatggctatcctgggggaaacagcttgggattttggaagtgttgggggactattcacaagtctaggaaaagcagtacatcaagtattcggaagtgtttataccacaatgtttgggggagtttcttggatgataagaatcctaattggatttctagtattatggataggaacaaattctagaaatacgagcatggcgatgacctgtatcgcagtaggagggatcacattatttttaggatttacagtccaagcagatatgggatgtgtagtatcctggtcaggaagagaattgaaatgtggctcgggtatctttgtagttgacaatgtacatacctggacagagcaatataaatttcagcccgaatctccagcccgtctcgcgtcggcaatacttaacgctcacaaagatggagtgtgcggcattcggagcacaacacgtcttgaaaacgttatgtggaaacaaattacgaacgaattaaattatgtactctgggagggtggtcatgatttgactgttgtcgccggtgacgtcaagggcgtacttacaaaagggaagagagctctgacaccaccagcttccgatctcaagtatagctggaagacatggggaaaagcaaagatcttcacgccggaagcacgcaatagtacatttttaattgacggaccagatacatcagaatgcccgaatgagcgacgagcttggaatagcttcgaagtggaagattatgggtttggaatgtttacgactaatatatggatgaaattcagagagggaagttctgaggtgtgcgaccacagattaatgtcagcagccataaaggatcagaaagcggtacatgccgatatgggctattggatcgaatccagcaaaaaccaaacatggcaaattgaaagagcctctttaatcgaagtaaagacgtgcctgtggcccaagacccatacactgtggtctaatggagtactggagtcccagatgctaatcccaaaatcctatgctggacccttcagtcaacataattatagacagggttacgcgacacaaaccgtggggccttggcatttgggtaaactcgaaatcgatttcggggaatgtcctggaactacagtgacaatacaagaaaattgcgatcatagaggaccatcattacgtactacaacagcctcaggcaagctcgttactcaatggtgttgtcggagttgtactatgccacccttaagattcctcggtgaagatggatgttggtacggtatggaaattaggcctttatcagaaaaagaagaaaacatggtcaaatcccaagtaacagcaggacaagggacctccgagacattcagcatgggcttactatgcttgactctattcgtcgaagaatgcctgcgaagacgagtcaccagaaagcacatgattttggcagtagtaataactttatgtgctataatattaggaggcttaacctggatggatttactcagggctctaatcatgctgggagacacgatgagcggtcgaataggagggcagacacatttggctattatggcggtttttaaaatgtcgccaggctatgtactcggagtctttttacgcaaactaacaagccgagaaaccgcactaatggttataggaatggcaatgactaccaccctttccatcccccacgatctaatggagttaatagatggcatatccttgggccttattcttttaaaaattgtcacacaattcgataacactcaagtaggaaccctagcgttatctctaacatttatccgctcgacaatgagtctagtaatggcttggaggactataatggctgttttatttgtagtgacattaataccattatgtcgtacaagctgtttacaaaaacagtcccattgggtcgaaataacagcactaatactaggtgcgcaagcgctcccagtatatctgatgacattgatgaaaggtgcctcaagaagaagttggcctctgaacgagggaataatggcagtgggtctagtttcactgctgggatcagctcttttaaagaatgacgttccgcttgctggccctatggtagcgggtggacttttactagcagcatatgtgatgtccggatcttctgcagatttaagtcttgaaaaagcagcaaatgtccaatgggacgaaatggcagatataacaggatcctcaccgattatcgaagttaaacaagatgaggatgggagttttagtattagagatgtcgaggagacaaacatgataacgttgttagttaaactcgcactgataactgtttcaggattgtacccccttgcaattccaataacaatgacactatggtatatgtggcaagtaaaaacacaacgaagcggagcactatgggatgttcctagcccaacagctactcaaaaagccgctctcagtgaaggggtatatcgcattatgcagagaggattatttggtaaaacgcaagtgggtgtagggatacatatggagggtgtattccatacgatgtggcatgtaaccagagggagcgtcatatgtcatgaaaccggccgattggaaccgagttgggctgatgtaagaaatgatatgatcagctatgggggtggctggcgactaggtgataaatgggataaagaagaggacgtacaagtcctagcgatcgagcctgggaagaatccaaaacacgtacaaaccaagccaggcctatttaagacgctcacgggtgagattggtgctgtaacgctagatttcaaacctggaactagcggatcaccaattataaacagaaaaggaaaggtgattggattatacggaaacggtgttgtaacaaagagtggtgattatgtaagtgctataacgcaggctgaacgtataggcgaaccagactacgaagtcgatgaagacatatttagaaagaaacgactaacgataatggatctgcaccctggagcaggcaaaacgaaaagaattttaccttcaatagtcagggaagctctaaaacgcagattacgcacgctcattcttgcgcctactagggttgttgcggcagaaatggaagaagccttacgtggactaccgatccgataccaaacccccgccgtgaaatctgagcatacaggacgagaaatagtcgatttaatgtgccatgctacgttcacgacgagacttttaagtagtacaagggtcccaaactacaacctgatcgtcatggatgaagcccatttcactgaccccagctcggtcgctgcacgtggatacatctcaacacgagtcgaaatgggcgaggcagcagctatctttatgactgctaccccgcccggggcaacagatccattcccccaatcaaattctccgattgaagatatagagcgggagatacccgagaggtcgtggaatacgggattcgattggataacagactatcagggaaaaacagtttggtttgttccctccataaaagctggcaacgacatagctaattgtctgaggaaatctggaaagaaagttatccaactaagtagaaaaacctttgataccgaatacccgaaaactaaattgacagattgggattttgttgtgacaacagacatcagtgaaatgggagctaattttcgtgcaggacgtgtaattgatcctcgcagatgtctcaaaccagtaatcctaactgacggtccggagagagtaatactagccggcccgataccggtaacaccagcatcagcagcgcaaaggagagggcggataggtcggaacccagcacaggaagatgatcaatatgtctttagtggtgacccacttaaaaacgatgaagatcacgcacattggacagaagctaagatgctactagacaatatatacacacctgagggtataataccaaccctttttgggcccgaacgcgaaaagacacaagcaattgatggagaatttcgattacgaggagaacaaagaaaaacttttgttgaattaatgagaagaggagacctccccgtatggctgagttataaagtcgcgagtgcgggtatctcatataaagatagagaatggtgcttcacgggggaacgtaacaaccaaatactagaggaaaatatggaagtagaaatatggacaagggaaggagagaaaaagaaattaagacccaaatggctagatgcacgcgtatacgcagacccgatggcattaaaggatttcaaagaatttgcgtcgggcaggaaatcaataacattagatatattaactgaaatagcatccctacccacctacttgtcctcgagagcaaagttggcactagacaacatagtaatgcttcatacgacagaaagaggtgggcgggcgtaccaacacgcgctaaacgagctgccggagtctttggaaaccttgatgcttgttgctctcttgggtgcaatgacagctggcatctttctgttctttatgcaagggaaaggcataggcaaattgtcgatgggactaataactatagcagttgcatcaggactgttatgggttgcagagatacaaccacaatggattgcagcgtctatcatcctagaatttttcctcatggtattattaataccggaaccagaaaagcaacgaacgcctcaagataatcagctaatctacgtcatactaacgatcttaacaataataggattgatagcagcaaatgaaatgggattaatcgagaaaaccaagacagacttcggattctatcaagttaaaacagaaactactattctggatgttgatttaagaccggcttccgcgtggacactctacgcagtagcgacaacaatacttacacctatgttgagacatacaatagaaaacacttcagctaatctcagcctagctgcgattgccaaccaagcagcaatacttatgggactaggtaagggttggcccctacataggatggatctaggagtcccacttttagccatgggatgctactcacaagtaaatccaacaacactaactgcgtctcttgtaatgcttctggtgcactacgcaataataggaccgggtctgcaagccaaagcgacacgagaagctcaaaaacgaacagcagcgggaattatgaaaaacccaacagtggacggtatcacagtaatagacctagaaccgatttcgtatgatccgaaatttgaaaagcaacttggccaggtaatgttactagcattgtgcgcgggacaactgctcctgatgcgaacgacatgggcgttttgtgaggttcttaccctagcaactggcccaatacttacactatgggaaggaaacccaggaaggttttggaacactacaattgcggttagtaccgctaacatctttcgaggttcatatttagcgggagctggattagcatttagcctgattaagaacgctcagacacccagaaggggcactggaactaccggcgaaacgttaggtgagaaatggaaacgacaacttaattctttagaccgcaaggagtttgaagaatacaagcgcagtggtattttggaagttgatagaaccgaagcaaaatcggctctaaaggatggctctaaaattaaacacgcggtttctcgtggctcaagtaagataagatggatagttgaacgaggtatggtgaagcctaagggtaaagtcgtggacctgggatgcggtagaggtggatggtcatattacatggctactttgaagaacgtgacagaagtaaaaggatatacgaaaggaggtcctggacacgaggaacctattccaatggctacttatggttggaatttggtaaagctacattcaggcgtagacgtattttataagcctactgaacaagtggataccctactatgtgacattggggagagttcttcaaacccaactattgaagaaggtagaactttacgagtcttgaaaatggtggaaccatggctatcaagcaaaccagaattttgtattaaagtcctgaatccgtatatgcccacagtaattgaagagttagaaaagctacaaagaaaacatgggggcaatttagtacgttgtcctttgtctagaaatagcactcacgaaatgtattgggtttccggagcatcaggaaatattgtgagttcagtaaatacaacatcgaaaatgctccttaatagatttaccaccagacacaggaaacctacgtatgaaaaagatgttgacttaggtgctggaactagatctgtatcgacggaaacagagaagccagacatgaccatcattggtagacgactacagcgtctgcaagaagaacataaagaaacctggcactatgaccaagaaaatccttacaggacatgggcgtatcatggtagctatgaggcaccgtctacgggcagcgcatcgtctatggtgaacggagtggtcaaacttctcactaaaccatgggatgtaattccaatggttacacaactagctatgacagatactaccccattcgggcagcaacgggtatttaaagaaaaggtagatactaggacaccacaacctaaaccaggcactagaatggtgatgacaactacggcaaactggttatgggccctcttaggcaagaaaaagaatcctagattatgcacaagagaagagttcataagtaaagtaagaagcaacgctgcaattggtgccgtgttccaagaagaacaaggatggacaagtgcttcggaagcagtaaacgatagcagattttgggagctcgtggacaaggaacgagcgctgcaccaagaaggtaaatgtgaaagctgtgtctataatatgatgggaaagagggagaagaaactaggagagttcgggcgcgcaaaaggttcaagggctatttggtatatgtggctaggagcaagatttctagaatttgaggcgcttgggttccttaatgaagatcattggttcgggagagaaaattcttggagcggcgttgaaggagaaggtcttcatagactagggtatatacttgaagagatagataagaaagatggagatttaatgtatgcggacgacacagctggttgggacactaggataacagaagacgacctacaaaacgaggaattgataacggaacaaatggctccgcatcataaaatattagcaaaagcgatctttaaattgacttatcagaataaagtagttaaggttttaagaccaacaccccgcggcgcagtaatggacataatctcaaggaaggatcaaagaggaagtggtcaagttggtacttatggattgaacacatttacgaatatggaggttcagctgattaggcaaatggaagccgagggcgtaatcactcaggatgacatgcaaaatcctaaaggactcaaagagcgagtcgaaaaatggcttagggaatgtggcgtagaccgactgaaaagaatggcaataagcggagatgattgcgttgtaaaacccttagatgaaagatttggaacctctctactttttctaaatgacatgggtaaagtccgaaaagatatacctcaatgggaaccaagtaaaggctggaaaaattggcaggaagttccattttgttctcatcactttcataaaatatttatgaaagatgggagaagtttagtcgttccttgccgtaaccaggacgaactgataggtagagcacgaataagtcaaggagccggttggtcattaagagaaactgcttgcctgggtaaagcatatgcacaaatgtggagtttaatgtattttcatagacgggacttaaggctagcgagtatggcaatatgttcagcagttccaacagaatggttcccaacatcgagaacaacttggtctatacacgcacatcatcaatggatgaccaccgaagatatgctaaaagtctggaatagagtttggatagaagataacccaaatatgatagataaaacacctgtacattcatgggaggatattccctacttaggtaaaagagaggacctgtggtgcggaagtttaatcgggttgagctcgagagcaacatgggcgaaaaatatacatacggcaataacacaggtgagaaatctaataggaaaagaggaatacgtagattatatgccagtaatgaaacgttattctgctccaagtgaaagcgaaggtgtattataa

SEQ ID NO: 23706 - RNA, 9867 nt, synthetic construct
  misc_feature 1..9867: note = derived and/or modified CDS sequence (opt6) from DENV-4__HQ332176__SS-prME
  source 1..9867: mol_type = other RNA
tctacaataacattattatgcttaatccccacagttatggcatttcacttaagtactcgtgatggggaacccctaatgattgtcgcaagacacgaacgaggtaggcccctacttttcaaaacaaccgagggtattaataaatgtacattaatagcaatggatcttggtgagatgtgtgaagatactgttacatacaaatgtccgttactcgttaatacagaacctgaagacatagattgctggtgcaatcttacatcaacatgggtaatgtatgggacttgtacgcaaagtggagagcgtaggagagaaaaacgcagcgtggcactaacaccacattcaggaatgggactggagactagagctgaaacttggatgagttctgaaggagcgtggaaacatgcacagagagtcgaaagttggatacttaggaatcctgggttcgcattattagcaggattcatggcttatatgataggacagacggggattcaacgaaccgtatttttcgtcttaatgatgctagtggctccatcctatggaatgcgctgtgttggagtcggaaatagagattttgtagagggagtaagtggaggagcatgggtggacctggtgctagagcatggcggctgcgttacaacgatggcacaaggcaaaccgactctagactttgaactaaccaaaaccactgcaaaagaagtggctttactaagaacatattgcatagaggcattgattagtaatataacaacagcaacacgttgtccaacccaaggcgaaccttatttaaaagaggaacaagaccaacagtacatttgtagacgagatgttgtcgataggggttggggaaacggatgtggtcttttcggaaaagggggagttgtcacatgcgcaaaattttcttgttctggtaaaataactggaaatttagtgcagattgagaacctggaatataccgtggttgtaacagtacacaacggtgatacacatgcggtgggaaatgatacatcaaatcacggtgttacagcaacgattacccctagatcacctagcgtggaagttaaactaccagactatggcgagttaaccttagactgtgaaccccgatcagggatagacttcaacgaaatgatactaatgaaaatgaagaagaaaacatggctcgttcacaaacaatggttccttgatctaccattgccttggacaacaggcgcggacacttccgaggttcattggaattataaagagcggatggtaacctttaaagttcctcatgcaaagagacaagatgtaacagtcctaggatctcaagaaggtgccatgcattctgcgctcgcgggggcaaccgaggtggacagcggggatggtaaccatatgttcgcgggccatttgaagtgcaaagtcagaatggaaaagctaagaataaaaggtatgtcatatacaatgtgttctggcaagttctcaatagacaaagaaatggcagaaacccaacacggaaccactgttgtaaaagtcaaatatgagggcgctggcgcgccatgtaaagtaccgattgaaattagggatgtaaacaaagaaaaagtagtgggacgagttatatctgcaactcccttggcagaaaatacaaattcagtaacaaacatagagcttgaaccgcccttcggggattcatatattgtaataggagtaggtaattctgctttaacgctgcactggtttcgaaaaggcagctcaattggtaaaatgtttgaaagtacatatcgaggagctaagcggatggcaatattgggagaaactgcatgggattttggaagcgtcggaggtctatttacctcgttaggcaaggcggttcatcaagtttttggatcagtttatacgacgatgtttgggggcgtatcctggatgataagaatccttattggtttccttgtattatggataggaacaaattcgcgtaataccagcatggctatgacgtgtattgccgttggagggattacattgtttcttggttttaccgttcaagccgatatgggatgcgtcgtttcttggagcggaagagaactaaagtgtggatcaggtatatttgtagtagataacgttcatacatggacagagcagtacaaatttcagccagaaagtcccgctaggctggcgagcgcaatactaaatgcacacaaagatggtgtatgtgggattagatcgacaaccaggcttgagaacgtcatgtggaagcaaattaccaatgaacttaattatgtactatgggaaggtggacatgatttaacggtagttgcaggggatgtaaagggagtgctcactaaaggcaagagggccctaacgccacccgcatccgatcttaaatatagttggaaaacatggggcaaagctaaaattttcacgccagaagcgcgaaactccacctttctcatagacgggcccgacacatcagaatgccccaacgaacgcagggcttggaatagttttgaagtagaagactacggatttggaatgtttacaaccaatatttggatgaaattccgagaaggctcctcagaagtgtgtgatcacagactgatgagcgcagctattaaggatcaaaaagcggtgcatgccgatatgggttattggatcgaaagcagtaaaaatcaaacatggcagatagagcgcgcttcattaatagaagttaaaacttgtctttggccaaaaacacataccttatggtctaacggagtattagagtcacagatgcttataccaaaatcatatgcgggtcctttttcacaacataactaccgtcagggatatgctacacaaactgtaggcccatggcacttaggcaaattagagatagattttggagaatgtcccggtacgacggtaaccattcaagaaaactgcgaccatcgtggtccaagtctgagaaccactacggcatcagggaaattggttacccaatggtgttgcagatcctgtactatgcctcctctcaggttccttggtgaagatgggtgttggtacggaatggaaatccgccctctgtcagaaaaagaagagaacatggtaaaatcacaagtcaccgcaggtcaggggaccagtgagacattttcaatgggccttttgtgtttgactttattcgttgaggaatgtttaagaaggagagtcacgcgaaaacatatgatactagccgttgtaattactttgtgtgccataatactaggtggacttacgtggatggacctattacgcgcgcttatcatgctaggggatactatgtcaggacgcataggaggacaaacccacctagccataatggcggtttttaagatgtctccaggctatgtactcggtgtattcctacgaaagctaacaagtagggagactgccctaatggttattggaatggcaatgactacaacactaagcattccacacgatttgatggaattaatcgacggaatttcgttaggattgatattgttaaaaatagtcacacaattcgacaatacacaagtaggaacccttgcgttatctcttacattcatacgatcaacaatgtcactcgtaatggcgtggaggaccataatggcagtgctgttcgttgttacattaataccattatgtcgaacctcgtgcctacaaaaacagtcgcattgggtcgagataactgcactaatattaggagcgcaagcgcttcctgtttatctgatgacccttatgaagggagctagcagaagaagctggcctctcaatgaaggcattatggcagtaggcttagtatctctccttgggagtgctctattgaaaaatgacgtaccgctagcaggcccaatggtagctggaggactactactagcagcttacgtaatgtccggaagttcggctgacttaagtttagaaaaagcagccaacgtgcaatgggatgaaatggctgatataactggcagctctccaataattgaagtgaagcaggatgaagacggatcatttagtatacgtgacgtagaagaaactaacatgattacactcctagttaagttggcattaataacagtatcaggcctatatcctctcgcaataccgatcaccatgaccttgtggtatatgtggcaagtaaagacacagaggtcgggagccttatgggatgtacctagtccagctgctactcaaaaagcagcgctatcagagggagtgtaccggataatgcaaagggggttatttggaaaaactcaggttggtgttggcatacatatggagggtgtgtttcatacaatgtggcatgttactcgtggctcagtaatatgtcatgaaacaggccggctagaacccagttgggcagatgtaagaaacgacatgattagctatggtggtggatggagacttggtgataagtgggacaaggaagaggatgtacaggtgcttgctatagaaccgggcaaaaatccgaaacatgtgcaaacgaaaccaggtctattcaaaactctcactggggagattggagcagtaacgcttgactttaagccagggacttcaggttcgccgataattaacagaaaaggaaaggttattggcttgtacggtaatggtgtggtgaccaaatccggtgactatgtttccgctatcactcaagctgaaagaatcggcgaaccagactacgaagttgatgaggatatcttcaggaagaaacgattaaccataatggatctacatcccggggcgggaaaaactaagagaattttaccatcaatagtaagggaagcacttaaaaggcggctgagaacactaatacttgcaccaacacgtgtagtggcagccgaaatggaagaagcacttagaggcttacctataagataccaaaccccagctgtaaaatcagagcatacaggacgagagattgtagatctaatgtgtcatgcaacttttaccacccgattgctgtcaagcacacgtgtaccaaattataatttaattgtaatggatgaagcgcactttacggatccaagttctgtagctgcgcgaggatatatatctacaagggtagaaatgggagaagcagccgcaatttttatgacggcaacgcctccaggggcaacagacccattccctcaaagtaactcccccattgaggacatcgaaagggagatacccgaacgctcatggaatacgggttttgattggataacagattatcaaggtaaaacagtgtggttcgtgccctctataaaggctggaaacgatattgcaaattgtctccgtaaatcaggcaagaaagtaatacaactaagtcgaaaaacttttgatactgaataccctaaaacaaaattaacagattgggatttcgtagtaaccacagacataagtgaaatgggagctaacttcagagctggacgggttatagaccctagacgatgccttaaacctgtaatactgactgatggacctgagagagtaatacttgcaggccctatacccgttactccggctagtgccgctcaaagacgtggccgaatcggccgaaacccggctcaagaggacgaccaatatgtattcagtggagatccgttgaaaaacgatgaggatcacgcgcattggactgaggcaaagatgctactcgataatatttatacccctgaaggtataattcccacactatttggtccggagagagagaaaacacaagccatagatggcgagttccggctgagaggggaacaacgaaaaacatttgtcgaattaatgagaagaggggatctacctgtctggctctcgtacaaggtagctagcgccggcatatcatacaaagatcgggaatggtgctttacaggggaaagaaacaatcaaatattagaagagaacatggaagtagaaatatggacaagggaaggagagaagaagaaacttcgaccgaagtggctggatgcgagagtatacgctgatccaatggctttaaaagatttcaaagagtttgcctctggtagaaagagcataactctggacattctgacagaaatagcaagtttacctacgtatttatcatcgagagcaaagttggcactggacaatatcgtcatgctccatacaacagagagaggcgggagggcatatcaacatgctctaaatgaactacctgagtcattagagacattaatgttagtggcattgctcggcgcaatgacagccggcatatttttatttttcatgcagggaaaaggcattgggaaactaagtatgggtttaataactatagcggtagcatccggcttattatgggtagcagaaattcaacctcaatggatagccgcgtcgataatacttgaatttttcttaatggtcctgttaattccggagccggaaaaacaaagaacgccccaggacaaccaactcatatatgttatattgactatattaaccatcatcggcttgatagctgcaaatgagatggggttgatagagaaaacaaagaccgattttggattttatcaagttaaaacagaaactaccatactagatgtggacctgaggccagcttcagcttggactctgtacgcggtcgcgacaactatactaactcctatgttacgacatacgatcgagaatacatcagcaaacttatcactagctgcaatagcgaatcaagctgcagtacttatgggactagggaaagggtggcctttacacagaatggacttaggggttccgttattagcaatggggtgttactctcaagttaacccaactacgctcactgccagtcttgttatgttgcttgtccattatgcaattatagggccaggtttacaagcaaaagctacgagagaggcacagaaaagaactgcagcaggcataatgaaaaatcctacagtcgacggcattaccgtaatagatctggaaccaatcagctacgaccccaaatttgaaaagcaactaggacaggttatgcttctagttttatgtgcaggacaattactattaatgaggacaacatgggccttttgtgaagtactaactctagcaactggtccgatacttactttatgggaaggaaacccgggtagattctggaacactaccatagcagttagtacagctaacatatttcgtggaagttatcttgccggtgctggactagcattctcattaattaaaaacgcacaaacaccaaggagaggcacaggcacaactggtgaaacgttaggagaaaagtggaagcgacaactgaacagcctggatcgaaaagagttcgaagaatataaacgctcaggtatattagaagtagacagaacagaagcgaaaagcgcacttaaagacggtagcaaaataaaacatgcggtaagtcgaggttcttcaaaaataagatggattgttgaacgagggatggtaaagccgaaaggaaaagtagttgacctggggtgtggaagaggagggtggtcatactacatggccaccttaaagaacgtcacagaagttaagggatacacgaagggaggaccgggccatgaagaaccgatcccaatggcaacatatggatggaatcttgtgaagctgcatagtggagtagatgttttctacaagccgacagagcaggtagacacactactatgcgatatcggggaatcgagttcgaatcccacaatagaagagggtaggacattgagggttctaaaaatggtagaaccgtggttatctagcaaacctgagttctgtataaaagtactcaacccttatatgcctaccgtaattgaagaattagaaaaactccaacgaaaacacggtggtaatctagttagatgtcctctctcacggaactctacacatgagatgtattgggtgtctggggcttcggggaatatcgtgagttcagttaataccacgtcgaaaatgttgctaaatagatttacaacaagacatcgaaaaccgagttatgaaaaagatgtagacttaggggctggaacacgaagtgtgagtaccgaaacagaaaaaccagatatgacaataataggccgacgattacaacgtttacaagaagaacacaaagaaacttggcattacgaccaagaaaacccatatagaacgtgggcttatcatggatcttatgaagctccttcaacgggctccgcttcctcaatggtaaatggggtcgttaaactcctgactaaaccttgggacgtaattcctatggtaacgcaattagcaatgactgacactacccccttcggtcagcagagagtcttcaaagaaaaagtggacacccgcacgccacaaccaaagcctggtacgaggatggttatgacgaccacagcaaattggctatgggcacttctaggcaagaagaaaaatccaagattatgtacacgagaagaatttatatccaaagtgagatccaacgcggcaatcggagcggtttttcaagaagaacaggggtggacaagcgcgtcggaagcagtaaatgattccagattttgggaacttgttgacaaagagcgcgcattacatcaagaaggaaagtgtgaatcatgcgtctacaatatgatgggaaaacgagagaagaaactcggagaatttggtagagccaagggttccagagcaatatggtatatgtggttaggtgcacgatttctcgaatttgaagcgttaggtttcctaaatgaggatcactggtttggtagagaaaattcttggagtggagtcgagggcgagggcttacatagattgggatatatcctggaagagattgacaagaaggacggagatttaatgtacgccgatgatacagccggatgggatacacgcataactgaagacgatcttcaaaatgaagaactaataacagaacaaatggcacctcaccataaaatcttagcaaaagcgatttttaagttaacataccagaacaaagtagtgaaagtacttagacctacgccaagaggagctgttatggacatcataagccgaaaggaccaacgtggtagtggacaggtaggtacttatggacttaatacttttaccaatatggaagtccagcttatacgacagatggaagccgaaggtgttattacacaagatgacatgcaaaatcctaaaggtctaaaagaacgtgtggaaaagtggttgagagaatgcggtgttgacaggttaaaaagaatggccataagtggagatgactgtgttgttaaaccactagacgaacgtttcggaacttccttactcttcctaaacgacatggggaaagtacggaaagacatcccacaatgggaaccaagtaaaggatggaaaaactggcaagaggtccctttttgctcacatcactttcataaaattttcatgaaagatggtcgctctctagtagtcccatgtaggaatcaggatgagttaattggtagggctcggatatcacaaggagcaggatggtctctaagagaaactgcctgtctaggaaaagcctatgcccaaatgtggtcattaatgtactttcataggagggacttacgattagcaagtatggctatctgttcagcagtacctacggaatggtttcctactagcaggacaacatggagtatccatgctcatcatcaatggatgacaacagaagatatgttaaaagtgtggaatagagtatggatagaagataatccaaatatgatcgacaaaaccccagtacattcctgggaggacataccatatctcggcaagagagaagacttatggtgcggatcgttgattggactcagttcacgagctacatgggccaaaaatatacataccgccataacacaagtgagaaatttaatcggtaaagaagaatacgtagattatatgcctgtaatgaagagatattcggcgccatcagagtcggaaggtgtcctttga

SEQ ID NO: 23707 - RNA, 9867 nt, synthetic construct
  misc_feature 1..9867: note = derived and/or modified CDS sequence (opt6) from DENV-4__HQ332174__SS-prME
  source 1..9867: mol_type = other RNA
agtacgataactttactttgtttgataccgaccgctatggcgtttcatttatccacgagagacggggaaccacttatgatagtggcaaagcacgaaagaggaagacctttactctttaaaactacagaaggtataaacaagtgtaccctcatcgctatggacctaggagaaatgtgcgaggatactgtaacatataaatgccccttgttagtcaatacggaacctgaggacatcgattgttggtgcaacttgacaagtacatgggtgatgtatgggacctgcactcaaagtggagaacggaggcgagaaaagagatcagtagcactaacaccacattcaggaatgggactcgaaacacgtgcagaaacgtggatgtcgagtgaaggcgcatggaagcatgcacaaagggtggaatcatggattttaaggaaccccggtttcgctttattagcaggttttatggcatacatgattggacaaacgggcattcagagaacggtgtttttcgtattaatgatgctcgtcgccccgtcgtatggtatgagatgcgttggagtaggaaacagagattttgtggaaggtgtctcagggggagcttgggtagatctcgttctagagcatggcgggtgcgtgacaacaatggcccaaggtaagcctacgcttgattttgaactaaccaaaaccacagctaaagaagttgccttattacgaacttattgtatcgaagccttaatcagtaatataactacggcgacacgatgcccaacacaaggggaaccatatcttaaagaagaacaagaccaacaatacatatgtaggcgcgatgtggtggatagaggatgggggaacgggtgtggcttatttggaaagggcggtgttgtgacctgcgcaaaattttcttgtagtgggaagatcacaggaaacctagtccaaatagaaaacctagaatatacagttgtcgtaacggtccataatggcgatactcatgcagtagggaatgatacatccaatcacggagtaacagcgaccattacaccgaggtctccatcagtagaagtaaagttgccagattacggagagttaactctggattgtgagccacgttcaggcatagactttaatgaaatgatattaatgaaaatgaaaaagaaaacttggctcgtccataaacaatggtttttggatttgccactaccctggactacaggagctgacacctccgaggttcactggaattataaggaacgaatggttaccttcaaggtaccacatgctaaacgacaagacgtcacggtattagggagtcaagagggcgcaatgcactcggcgctcgccggtgccacggaggtagatagcggtgatgggaaccatatgttcgcaggtcatctgaaatgtaaagtccgaatggagaaactaagaattaagggtatgagttataccatgtgctcaggtaaattcagtatcgataaagaaatggcagagacacaacatggaacaacagtcgttaaggtgaaatacgagggagctggggcaccatgcaaagtaccaatagaaattagagatgttaacaaggagaaagtggtgggccgagtaataagcgctacacctttagcagagaatactaacagcgttacaaatatcgaactagaaccaccttttggtgactcatatatcgtgataggagtaggaaattctgccttgacacttcattggttcagaaaaggatcttctattgggaaaatgttcgaaagtacctacagaggtgccaaaagaatggcaatacttggggaaacagcttgggactttggatcagtagggggattgttcacttccttaggtaaagctgtacatcaagtttttgggtcagtctatacaacaatgttcggaggtgtgagttggatgattaggattctaattggatttttagtattatggataggtacaaacagtcgtaatacgagcatggcaatgacatgtatagccgtgggagggattactttatttctaggttttacggtccaggctgacatgggatgcgtagtcagttggagcggcagggaactaaaatgtggatccggaatttttgttgtggataacgtacatacatggacagagcaatacaaattccaaccagaatcgccagcaagattagcttctgctatccttaacgcacacaaagacggagtttgtggaattaggtcaacaacgcgactagaaaacgtgatgtggaaacaaatcacaaatgaattaaactacgtactttgggaaggtggccatgatcttacagttgtagctggggatgtgaagggcgtgttaacgaagggtaagcgtgcgttaacaccaccagcatccgacctcaaatactcatggaaaacctggggcaaagcgaagatttttactcccgaggcgcggaatagtacctttttaatagatggacctgacacatcagaatgtccaaatgaacgacgtgcttggaacagctttgaagtagaagactacggattcggtatgttcactaccaatatatggatgaagttccgagaaggaagtagcgaagtgtgcgaccatagactaatgagtgctgcaataaaagaccaaaaggctgtacatgctgatatgggttactggatagaaagttcaaagaatcaaacctggcaaatagaacgagcgagtttaatagaggttaaaacatgcctttggcctaagacccatactctatggtcgaacggagtactagaatcacaaatgcttataccaaaatcatatgcgggaccttttagtcagcataattacagacaaggatatgccacacaaacgatgggaccatggcatctaggcaagctcgaaatagatttcggggaatgcccaggcactactgttacaatacaagagaactgcgatcatagaggccctagtttaagaacaacgacagcctccggtaagctagtcactcaatggtgctgtcgttcctgcacaatgccaccgttaagatttctaggagaagatggttgctggtatggaatggaaatccgaccattaagtgagaaagaagaaaatatggtcaaatcgcaagtaacggccggacaaggagcttcagaaacttttagtatgggattactatgcctgacattatttgtagaagaatgtctaaggagacgagttacgcggaagcatatgattctagcagtagtgataaccttgtgtgccataattctcggcggccttacctggatggatttattaagggcgttaataatgttgggagatactatgtcaggaagaataggaggccagactcatctggcgattatggcggtatttaagatgtcgccaggttatgtactaggcgtatttttaaggaaattaacatcaagagaaactgcacttatggtaattgggatggctatgacaaccactttaagcataccgcatgatctcatggaattaattgatggaatatccttgggcttgatactccttaaaattgtaacgcaattcgataatacacaagtaggtactttagcattatcattgacatttattagaagtactatgagtctagttatggcgtggcgcacgataatggctgtcctcttcgttgtaactttaatcccactgtgccgcacaagttgtctccaaaaacaatcgcactgggttgaaatcacagctttaattcttggagcacaggcactcccagtatacttaatgacactaatgaagggagcgagcagacgtagttggcctttgaatgaaggtatcatggccgttggcttagtgtccttgcttggtagtgctttacttaaaaatgacgttcctttagccgggccaatggtcgcgggcggcttactattggcagcttacgtaatgtcaggatcctcagccgatttatcgctagaaaaggcggcgaatgtacaatgggatgaaatggctgacataacgggatccagccccattatagaggttaaacaggatgaagacggttctttctctataagagatgtcgaagaaacgaatatgatcactttattagtcaaactggcattaataacagtttctggattgtatccacttgccattcccataacaatgacactatggtatatgtggcaggtaaaaacgcagagatctggagccctatgggatgtcccaagccctgcagctacccaaaaagctgcactatcagaaggagtatatagaataatgcaaagaggattgtttggaaaaacgcaagtaggtgttggaatacacatggaaggggtttttcatacgatgtggcatgtgaccagaggctcggttatttgccatgaaactggtaggttagagccaagctgggccgatgtacgtaatgacatgataagttatggaggtggctggcggttaggtgacaaatgggacaaggaagaagatgtccaagttttagcaattgaacctggcaaaaatcctaaacatgtacaaacgaaaccaggactctttaaaactctaactggtgaaattggcgccgtcacactagattttaaaccaggtaccagcggcagtccaattataaatcgcaaaggaaaagttattggcttatatggaaatggtgtagttactaaatcaggggactatgttagtgcaattactcaagcggaacggataggtgaaccagattatgaagtggatgaagatatattccgtaaaaagcggttaactatcatggatctccatcccggcgcaggtaaaactaaaagaatactacctagtattgttagagaagctcttaaacgacggcttagaactttaatcctagctccaacaagagtcgtcgccgcggaaatggaagaggctttacggggtcttccgataagatatcaaacgcccgcagttaaaagtgaacacacaggacgagagatagttgacctaatgtgccatgctacgtttactacccgtttgttatccagtactagagtaccaaactataaccttattgttatggatgaggcgcattttactgacccgtcaagcgtagcggcgagaggttatataagtacgcgagtggaaatgggtgaagctgcggccatattcatgacagctacgcccccaggagcaaccgacccatttccccaatccaatagtccaatagaagatatagaacgggaaatcccagaacgctcctggaacacaggctttgattggataaccgattaccagggaaaaactgtgtggttcgtacctagcatcaaagcgggtaatgatattgcaaattgcttaagaaaaagtggcaaaaaggtgatccaattaagcaggaaaaccttcgatacggagtatccgaagacaaagttgacagattgggactttgtggtaactactgacatatccgagatgggagcaaattttagagcgggtagagtgattgatccgaggagatgtctcaaacctgtaatcttgacagacggtccggaaagggtcatactagccggaccaatacctgtaactcccgcatcagcagcacaaagacgaggtcgtattggcaggaatcccgcacaagaagatgatcaatatgtgtttagcggagatccactgaaaaacgatgaggaccacgcccattggacagaagcaaaaatgctactagataatatatatacacccgagggtattatacctacactcttcggcccagaaagggagaaaacgcaagcaattgatggggaatttcgccttcggggagaacaaagaaaaacgtttgtagaattaatgcgtagaggcgatttacctgtatggttaagttacaaggtcgcatctgccgggatatcttataaggatagagaatggtgtttcactggcgagagaaacaaccaaatactcgaggagaatatggaagtagaaatttggactagagagggagaaaagaaaaagttaagacccaagtggcttgacgcgagagtatatgcggaccctatggctttaaaagacttcaaagagtttgcaagcggcagaaaatcaataacactagacattctaacagagatagcatccctacccacgtatctctcatcacgcgcgaaattagcattggacaatatagttatgttacatacgacagagcgcggtggtagggcttatcagcatgcccttaacgagctcccagaatcactagaaactcttatgcttgtcgcactgctgggagcaatgacagcgggaatctttctattctttatgcaaggcaaggggatcggtaagctgagtatggggctgatcacgattgccgtagcatcaggattgctctgggtagcggaaattcagccacaatggatagcagcatcgataatactcgaatttttccttatggtcctactaattccggaaccagagaaacaaagaaccccacaagataatcagctaatctacgtgatcttgacgattctcacgatcataggattaatagcagcgaacgaaatgggactaatcgagaaaaccaagacagacttcggtttctaccaagcaaaaacagaaactaccatattagacgtagatttacgaccagcatcggcatggacactatatgctgtagcgactaccatactaacaccaatgctcaggcatacaatagaaaatacttccgcgaacctcagcttggctgcaatcgcgaaccaagcggctgttttgatggggctaggaaaaggatggccactacatcgcatggaccttggagttccgctattggcgatgggatgctattcgcaagtgaacccgacgacattaacagcaagcctagtgatgctcttggtgcattatgcgataattggtccaggcctgcaagcaaaagcaactagagaggcacaaaagcgtacagctgcgggaataatgaagaacccgaccgtggatgggataacggttatagatctcgagcccattagctacgacccaaaattcgaaaaacaattgggacaagtcatgttattagtcttatgcgctggacaattattattgatgcggacaacctgggctttctgcgaagtactaacactcgctactggcccaattttgacactttgggagggaaacccaggccgtttttggaatactaccatagctgtatcgactgccaacatatttagagggagctatctagcaggagcagggctggcattctcactgattaagaatgcacagacccctagacgaggcacaggtaccacaggggaaaccctcggagaaaaatggaagagacagctaaattctctggacagaaaggaatttgaggaatataaacgctcaggaattttggaagttgatagaacagaagcaaaaagtgcgctaaaagatggaagcaaaataaaacacgctgttagccgaggatcttcgaagataagatggatagtagagcgcggaatggttaaaccgaaaggcaaagttgttgatttggggtgcggcagaggcggatggagctattacatggcaactctgaaaaacgtaacggaagtcaaagggtacacaaagggaggacctggtcatgaagaaccgattcccatggcaacttacggctggaatctggtaaaattacatagtggagtggacgtattctacaaaccgacagagcaagttgatacactgttatgtgatataggagaaagctcatccaacccaacaattgaagaaggcagaaccttaagagttttaaagatggttgagccttggctaagctcaaaacctgagttctgcataaaagttctgaatccttatatgccgactgtgattgaagaattagagaaattacagcgaaaacacggtgggaacttagtaaggtgcccgctttcacgaaactcaacacacgaaatgtattgggtctccggtgcaagcggaaatatagtatcttcagtcaataccacttcaaaaatgcttttgaaccggtttacaacaaggcataggaaaccgacgtatgaaaaagatgttgatctgggagcaggtacacggtcggtatccacagaaacggaaaaaccagacatgacaattattggacgaagacttcaaagactacaggaagaacataaagagacttggcattacgatcaggaaaatccgtaccgtacatgggcgtatcacggttcctatgaagcccctagtacgggaagcgcaagttcaatggtgaatggagtggttaaattattaacaaaaccttgggatgttatcccaatggttactcagctagccatgactgacacaaccccatttggacaacaacgagtattcaaagaaaaagtagatactcgaacacctcagccaaagccaggaacacgaacagtaatgacaacgactgccaattggttatgggcactcttaggcaaaaagaaaaatcctagactgtgtactcgggaagagtttatttcgaaagtaagatcgaatgctgcaataggcgcggtcttccaagaggagcaaggatggacatccgcatccgaagcagtaaatgatagtaggttttgggagttagtggataaggaacgagctttacatcaagaaggtaaatgtgagtcctgcgtatacaatatgatgggcaaaagagagaaaaagctaggtgagtttgggcgagcaaagggaagtagagccatatggtatatgtggctcggggccagatttctagaatttgaggcgttagggtttctaaacgaagatcattggttcggtagagaaaactcatggtcaggagtggaaggagaaggattgcatcgattaggatacatattagaagaaatagacaagaaagacggagacctcatgtatgcggacgacacggcaggttgggatacgagaataacagaagacgacttacagaatgaagaactaattactgaacagatggctccacatcacaaaatattagcaaaagccatatttaaactcacctaccaaaacaaagtcgtaaaggtcttacgacccactccccgtggagcggttatggatattattagtcgaaaggaccaacggggatcgggtcaggtgggcacctatggattgaatacatttaccaacatggaagtgcaattaatacggcaaatggaggcagaaggagtaataacacaagacgacatgcaaaaccccaaggggctaaaggaaagagtagagaaatggttacgtgaatgtggggtagatcgacttaagagaatggcgatttccggagacgattgtgtagtaaaacctttagatgaacgattcggaacaagtttattattcttgaatgacatgggaaaggtacgcaaagacataccacaatgggaaccttctaaaggatggaagaattggcaagaagttcctttttgttcacatcacttccataaaatatttatgaaagacggtcgaagtctggtagtaccgtgcagaaatcaagacgaactcattggtagggcgagaatctcacaaggagctggctggtcattgagggagacggcgtgtcttggcaaagcatacgcccaaatgtggtcattaatgtatttccacagaagagacctaaggctggcctccatggcaatctgcagcgctgtgcccactgaatggttcccaacttctcgcactacttggtccatacacgctcaccatcaatggatgactacagaggatatgcttaaagtgtggaatcgcgtatggatagaagataatcctaacatgatagacaaaacaccggtccattcttgggaagatataccctacttaggaaaaagagaagatctttggtgtggttctttgattggcttatcctcgcgtgccacatgggccaaaaatatacatacggccatcacacaagtacgtaatttaatcggaaaagaagaatatgttgattacatgccagtaatgaaacgctactctgccccttcggaatcagaaggagtactataa

SEQ ID NO: 23708 - RNA, 9867 nt, synthetic construct
  misc_feature 1..9867: note = derived and/or modified CDS sequence (opt6) from DENV-4__KT026308__SS-prME
  source 1..9867: mol_type = other RNA
agtactataacattgctttgtttaataccaacggttatggcgttccatttatcaacgagagacggagaaccactaatgattgtggcaaaacacgaacgaggacgtcctttattatttaaaactactgaaggtataaataaatgcacgctaattgcgatggacctaggagaaatgtgcgaagatacagtcacatacaaatgtcccctgttagtcaatactgaacctgaagacattgattgctggtgtaatctgacttccacttgggtaatgtatggcacatgtacgcaatctggggaaagacgccgtgaaaaacgctcagtagcgttaacaccacatagcggcatgggactagaaacaagagcagagacctggatgagtagtgaaggggcgtggaaacacgcgcaacgtgtagaatcgtggatattgcgaaatcccggtttcgctttacttgcaggttttatggcatacatgataggccagacaggcattcagagaaccgtattcttcatactgatgatgttggtcgctccttcttatggtatgagatgtgtaggcgtaggtaacagagactttgtagaaggagttagtggaggagcatgggtggacctagtactcgagcacggaggatgcgtaactactatggctcaaggcaaacctacgttagattttgaattaataaaaacaacggcaaaagaagtagcccttctccgtacttactgcatagaagccagcatttcaaacatcactacagctacaagatgtcccacacaaggcgagccatacttaaaagaagaacaggatcaacaatacatatgccgaagagatatggtcgatcgggggtggggtaacggctgtggactatttgggaaaggaggtgtagtaacgtgtgctaaattttcatgtctcgggaaaataacaggtaatttagtacaaatcgaaaatcttgaatatactgtcgtcgtaactgttcacaacggtgacactcacgcagttggaaatgatacatctaatcatggagtgacagccaccataacaccgagatcaccatcggtagaagttcagctaccagattatggtgaactaaccttagactgtgaaccccgtagtggaatagatttcaacgaaatgatattgatgaaaatgaaaacaaaaacttggctagtacacaaacagtggttcttagacctaccacttccttggacaaccggagcagataccctagaggtgcattggaaccataaagaaagaatggtcacattcaaggtaccccacgcaaaaagacaggatgtaacggtattaggatcccaagaaggtgcgatgcactcagcattagcgggcgctaccgaagtagattcaggtgacggtaatcatatgtttgcaggacatttaaagtgtaaagtacgtatggagaaactaagaattaagggtatgagttatacaatgtgctctggcaaattttcaatcgacaaggagatggcagaaacacaacatggtactacagttgtcaaagtcaagtatgagggtacaggagcaccatgtaaagtacctatagaaattcgcgatgttaacaaggagaaggtagttggcaggattatttccagtacaccttttgctgagaacacaaactcggtgacgaatattgaactagaaccaccattcggagattcatacattgtaattggagtcggtgactcagccctaaccttacactggttccgaaaaggcagctccataggaaagatgttcgagtcaacatacagaggtgccaaacgaatggcaatactgggagagacagcatgggatttcggttccgtagggggtcttttaacaagcctcggaaaggcagtacatcaagtattcggaagcgtatacacgacgatgttcggaggggtttcttggatggtaagaattttaatcggattattggttttatggattggcacaaactctaggaatacttcaatggcgatgtcttgtatcgccgtaggcggcattactttatttctggggttcacagtacatgcagatatgggatgtgtcgttagctggtccggcaaagagcttaaatgcgggtctgggatctttgtaatagacaatgttcatacttggacagaacaatacaaatttcaaccagaatctccagcacgattagcatcagcaatactaaatgcacacaaagagggagtatgtggaatacgatcgactacacggctcgaaaacgtgatgtggaagcagatcacgaacgaattaaattatgtactctgggaagggggacatgatttgacagtagtagccggtgacgtcaaaggcgtgttaagcaaaggtaagagggcactggcaccccctgttaacgatttaaagtatagttggaaaacatggggaaaggcaaaaatcttcacacccgagaccagaaatagcaccttcttggtagatggtccagatacttcagaatgccccaacgagaggagagcatggaatttcttagaagtagaagattatggattcggaatgtttacaacgaatatctggatgaagttcagagaaggttcctctgaagtctgcgatcatcgattgatgagtgccgcaattaaagaccagaaggcggtacatgcagacatgggctattggatagaatcatcgaaaaaccagacatggcaaatagagaaagccagtttaatagaagttaaaacttgcctatggccgaaaacgcatacgctttggtcaaacggagtactagaatcacaaatgctaattccgaaagcatacgcaggaccaatttcgcagcataattaccgacagggttacgcaacgcaaactgcaggtccttggcatctgggtaaactagagatcgattttggagagtgcccaggtacaacagttacagtacaggaagattgcgatcacagaggacccagcctacgcaccactacagcaagtgggaaattagtaacacagtggtgctgtagatcctgtactatgcctcccttgcggtttctaggtgaagacggatgctggtatggaatggaaattcgccccttgaatgagaaagaagaaaatatggttaagtctcaagtctcagcgggtcacggcacaagtgagacattttccatgggtctgctctgcttgaccttgttcgtagaggaatgtttgagaagaagagttacaagaaagcatatgatattagttgttgtgactaccctatgcgcgataatcttaggaggcttaacatggatggatttacttagggcactaataatgcttggagatacaatgagtggacgaatgggaggtcaaatacatttagctattatggcagtttttaaaatgagtcctggatatgtgttaggaatattcctaagaaaacttacatcacgggaaacagcacttatggtcataggaatggcaatgaccacagtgctcagcattcctcatgatctaatggaatttatagatggtataagtcttggtcttatacttctaaaaatggtcacacattttgacaacacacaggttggaacgctagcactagcactgacctttattaaatcgacaatgccattagttatggcttggagaactatcatggctgtgctatttgtggtaaccttgattccgctatgtcggacgtcctgcctacaaaagcagtcacactgggttgagataactgcattgatattaggagctcaagcgctaccagtatatttaatgacactcatgaaaggagcttctaaaagaagttggcccttaaatgaaggtattatggccgtaggccttgtatcactattaggatctgcccttttgaagaacgatgttccgctagcaggacccatggtggcaggagggttacttttagctgcttacgtaatgagtggatcttcagcagatctgagtttagagaaagctgcaaatgtgcaatgggacgaaatggccgatataacaggatcttcaccgataatagaagtcaagcaagacgaagacggtagctttagcataagagatgtagaggagaccaacatgataacactcctcgtcaagctagcgttaataacagtcagcggactatacccactagctattccagtaaccatgaccctctggtacatgtggcaagtgaaaacacaaaggtcaggagcattgtgggatgttccatcacccgcagcggctcagaaagcaacacttacagagggtgtctatagaataatgcaaagaggattgttcggcaaaactcaagtcggtgtaggaatacatacagaaggagtatttcacactatgtggcatgtaacgcgaggttccgtaatttgccacgaatcagggcgattggaaccaagttgggccgatgtaaggaacgacatgatctcatatggtggtgggtggaggttaggtgacaagtgggacaaagaagaagatgtacaagtcctagcaatagaaccaggtaaaaaccccaaacatgtccaaaccaaaccagggctttttaaaaccctaactggtgaaattggtgctgtcaccttagatttcaaaccaggcacatcgggatcaccgataataaataggaaaggcaaagttatcggattgtacggtaatggcgtggttacaaaatcaggtgactatgtctcagcgataactcaggctgaaagaataggcgaaccagattacgaagtagacgaagatatattcaggaagaaacggcttacgatcatggatctccaccccggcgcaggtaaaacaaaaagaatattgccatccatagtaagagaagctcttaagcgacgattgagaacgcttatattagcaccgactagagtagtagcagccgaaatggaagaggcgttaagagggcttccaataaggtatcagactcctgcagtgaaaagtgaacacacaggcagagaaatagtggaccttatgtgtcacgctacatttactaccagattattatccagcactagagtgccgaattataaccttatcgtgatggatgaagctcatttcacagacccgtcatcagtcgccgcacgtggatatatctctacccgcgtagaaatgggtgaggcagccgctgtatttatgacagcaacacccccaggaactacagatccgtttccccaatccaattcgccgatagaagacatcgaaagggagataccagagagatcttggaataccggtttcgattggattactgattatcaaggcaagacggtttggttcgtaccatccataaaagcgggaaacgatattgccaattgcttgagaaaatctggcaagaaagtgattcaattatcaagaaaaacgtttgacacagagtaccctaaaactaagctaacagattgggacttcgttattactacagacatatcagagatgggtgcaaactttcgcgcaggtagggtaatagaccccagaagatgtctgaagccggtgatactaacagatggtccagaacgcgtaatcctggctggaccaatacctgtaacccctgcatcagcagcacagaggagaggtcgcattgggagaaatccggcacaagaagacgatcaatatgtcttttctggggatccacttagaaacgacgaagaccatgcgcattggaccgaggccaaaatgttactagacaatatatatactcccgaaggtataataccaacattgtttggtccagaacgtgagaaaacccaagcaatagatggagagtttcgtttacgaggagaacaacggaaaacattcgtagagctaatgcgtagaggcgaccttccagtatggttatctcacaaagttgctagtgcaggtatctcatacaaagatcgcgagtggtgctttacaggagaaaggaataaccagattctagaagaaaatatggaagtagaaatatggactagagaaggcgagaagaagaaactacgacccaaatggttagatgcgcgcgtatatgccgatccaatggcattaaaagactttaaagaatttgcatccggccgtaaatctattacactggacatattaactgaaatagcctcacttccaacatatttatcctccagagctaaactggcgttagataacatagtcatgctccacactacagaaagaggtgggaaagcatatcagcatgccttaaatgaactgccagagagcttagaaacattaatgttagttgcgttactaggagctatgaccgctggaatatttctattctttatgcaaggaaagggtatgggtaaattatccatgggcctaatcgctatagctgtagctagtgggctcttatgggttgcggaaatacaacctcaatggatagcagcatccataatactagagtttttccttatggtactgttagtgcctgagccggaaaagcaaagaacaccccaggataatcaactcatttatgtaatattgacaatactaacgataatagcactcgtagcagcaaatgaaatgggactgatagagaaaactaaaactgatttcggattttaccaagtaaaagcagaaacaactatactggacgttgatctaagaccagcaagcgcctggactttatatgctgtagcaactacaatattaacgcctatgttacgccacacgattgagaatacgagtgcaaatttaagtttagctgctatagcaaaccaagctgctgttctgatgggtcttgggaaaggttggcccctgcacagaatggacttaggcgtgccacttctagcgatgggatgttattcccaagttaatccaacaacattaacagcctctttagtcatgttgctggtccattatgctataattggtcctggactacaagctaaagccactagagaggctcagaagagaactgcggcaggcatcatgaaaaacccgaccgtagatggaataactgtgatcgacctagaacctatctcctacgatcctaaatttgaaaaacagttagggcaggtaatgttgctcgtactatgtgtcgggcaactgttattaatgagaactacgtgggcattctgtgaggttctaactctcgcaaccgggccaatccttacattatgggaaggcaatccaggtcggttttggaatactacaattgcggtaagcacagctaacatatttagaggcagttaccttgctggtgcaggattagctttttcattgatcaaaaacgcacaaacaccacgacgaggtaccggaacaatgggagagactctgggagagaaatggaaacgacaactcaattcacttgaccgcaaggagtttgaagagtacaaacgcagcgggatattggaagtcgatcgaacagaagctcgatctgcattaaaagacgggtcgaaaattaaatatgcggtatctagaggcacaagcaaaattaggtggattgttgagcgagggatggttaaacccaaaggaaaggtagtagacttaggctgcggacgaggaggatggtcctattacatggccaccctcaaaaatgttactgaagtgaaaggctatacaaagggaggaccgggtcatgaagaacctatacctatggcgacatacggatggaatctagttaaactccattctggggttgacgtgttttataaacccactgaacaagtggatacactcttatgtgacatcggtgagtctagtagtaaccccacgatagaggagggacgtacattaagagttctaaaaatggtggagccttggttatcatcgaaacctgaattttgcattaaagtgttgaatccgtacatgcctactgtcatcgaggaattagaaaaattacaacgtagacacggagggagcttagtacgatgtcctttaagcagaaactccactcacgaaatgtattgggtgagtggggtgtctggaaacatagtaagcagtgttaacacaacaagtaagatgctactaaatagattcaccacgaggcatcgtaagccgacttacgaaaaagatgctgacttaggggctggtacgaggagtgtcagcaccgagacggaaaaaccagatatgacaattataggccgccgtttacagagactacaagaggaacacaaagaaacatggcattacgaccatgaaaacccatatcgaacttgggcataccacggaagttatgaggccccaagtactggttcagcgtccagcatggtgaacggggtagtaaaacttctaactaaaccatgggatgttgttccgatggtgacgcagctggcaatgaccgacaccacaccattcggtcaacaacgtgtgttcaaggagaaggttgatactagaacaccccaacccaaaccaggaacacaagtcgtaatgaccacgacggctaactggctatggactctacttgggcgtaagaaaaacccaaggctatgtactcgtgaagaatttatttctaaagtgagaagcaatgccgcaataggagcggtattccaggaagaacaaggctggacatcagcgtcagaagcggttaatgactcacgattttgggagctagttgacaaagagagagctttacatcaagaaggaaagtgcgagagctgtgtgtacaacatgatggggaaacgagagaagaaactcggtgagtttggtcgcgcaaaaggatccagagccatttggtacatgtggttgggagctcgctttctagagttcgaagcactaggctttttaaacgaagatcactggtttggaagggaaaattcctggtccggcgttgaaggtgaaggactacatagacttggttatatcttagaagacatcgataaaaaggacggcgacttgatatacgctgacgataccgctgggtgggatacccgtataactgaagacgatttgctaaatgaggagttgattaccgaacagatgacaccgcatcacaagatactcgctaaagctatattcaaactaacataccaaaataaagtcgtaaaagtgctacggccaacaccaaagggagcagtaatggatatcatatctagaaaagatcaaagaggaagtgggcaagtaggaacatatggattaaatacattcacaaacatggaagtacaattaataagacaaatggaagccgagggggtgataacgcgagatgacatgcacaatccgaaaggacttaaagaaagggtcgaaaaatggctgaaagagtgcggagtcgatagactaaaaagaatggcaatctctggggatgattgcgtcgttaaaccactagacgaaagattcagcacatcgttactctttctaaatgatatgggtaaagtgcgaaaagatattccacaatgggaacctagcaaagggtggaaaaattggcaggaagttccattctgttctcatcatttccataaaatttttatgaaagatggcagatccttagtcgtgccttgtcgaaaccaggacgaacttataggacgggctaggatatcgcaaggtgctggatggtcattgagagaaacagcatgcctaggaaaggcttatgcacagatgtggagtcttatgtattttcaccggagagatcttcgcttagcgtctatggcaatctgttcagccgtacctacagaatggttccccacgtccagaacgacatggtctattcatgcacaccaccagtggatgacaacagaagacatgcttaaagtctggaaccgggtctggatagaagacaatcctaatatgattgacaagacaccagttcatagctgggaagatataccgtatctaggaaaacgcgaagatctgtggtgtggttcattgataggactcagcagtagagctacctgggccaaaaacatacataccgcaattacccaggtacgtaatctaataggtaaggaagaatatgttgactacatgccggctatgagacgctactctgcacattttgagtcagagggggtactctag

SEQ ID NO: 23709 - RNA, 9867 nt, synthetic construct
  misc_feature 1..9867: note = derived and/or modified CDS sequence (opt6) from DENV-4__KT026309__SS-prME
  source 1..9867: mol_type = other RNA
agtactattacactgctctgccttatacctacggtcatggcattccacttaagcactcgcgatggagaaccgttaatgattgttgcaaaacacgaaaggggaagacctcttttgttcaaaacaactgagggaataaacaaatgtacactaattgcaatggatctaggagaaatgtgtgaagatacggttacttacaaatgtcctctactcgttaacactgaacctgaagacatagattgctggtgtaatctaacgtctacatgggtgatgtacggtacttgtactcaatctggtgaaaggagacgggagaaacggagcgtcgctttgactccgcatagtgggatggggttagaaacacgtgcggaaacgtggatgtcatcagaaggagcgtggaagcacgctcaacgcgtagaaagttggatattaagaaacccgggattcgcactattagcaggattcatggcctatatgataggacagaccggaatccaaaggactgtattctttatcctaatgatgttagtggctccctcgtacggaatgagatgtgtcggagtaggaaatagagattttgttgagggagtctctgggggagcctgggttgacttagtcttggagcatggcggttgtgtaacgacaatggcgcaagggaagccaacactggattttgaactaatcaaaaccacagctaaagaggtcgcgttactaaggacatactgtatcgaagcgtccatcagcaatataacaacggcaactaggtgccctacccaaggtgaaccgtacttgaaagaggaacaagaccaacaatacatatgcagaagggatatggtggaccgaggatggggaaacgggtgcggcttgttcggtaagggtggcgtagtgacatgtgctaaattctcatgcttaggtaaaatcacaggaaatctagtccagatagaaaatttggaatacacagttgtggttactgtccacaatggagatactcacgcagtaggtaatgatacgtcgaaccacggcgttacagcaactataacgcctaggagtccttccgtagaagtacagctcccagattatggcgaattgacattagattgtgaaccaagatcaggtatagacttcaacgaaatgatactcatgaaaatgaaaaccaaaacatggcttgtacataagcaatggtttttggacctacctttaccctggacaacaggagcagatactctcgaggtccactggaatcataaagaacgtatggtaacattcaaagtacctcacgccaaaaggcaagatgttacagtactagggtctcaagagggggcaatgcactccgcgcttgctggtgcaacagaggtcgattcaggtgatggaaatcatatgtttgcaggccatcttaaatgtaaagtgcgcatggaaaaactaaggatcaaggggatgtcatatacaatgtgttctggtaagttttctattgacaaagaaatggcagagacgcagcacggtacgacggttgtgaaggtaaagtatgagggaactggagcaccctgcaaagtacctattgagattagagatgtaaacaaggagaaggtggtcggtcgaattatctcatctacacctttcgctgagaatactaattccgtaacgaatatagagttagagccacccttcggcgacagctacatagtgataggtgtcggggactcagcattaactctacattggttcagaaaaggaagctctataggaaaaatgttcgagagtacttataggggcgcaaaacgaatggctatcttaggtgaaacagcatgggatttcggatcagtaggtggcctgttaacgagtttgggaaaagcagttcaccaagtatttggctctgtatataccacaatgttcggaggtgtttcatggatggtaaggatcctgataggtcttctagtgttatggataggtacaaactcgcggaacacgagcatggctatgtcttgtattgcagttggaggaattacactattcctaggatttacagtacacgctgacatgggttgtgtcgttagttggagtggtaaagaattaaaatgcggatcaggtatattcgtgatagataacgtccatacatggactgaacagtataaattccaaccagagagtcctgctcgactagcaagtgcaatcttaaacgcacacaaagagggagtatgcggaatcagaagtacaactagattggagaacgtaatgtggaaacaaattaccaacgaattaaattacgtcctttgggagggaggtcacgaccttactgtagtagctggagatgttaagggcgttctttccaaaggtaaaagggcactagcacctcctgtgaacgatctcaaatattcttggaagacatggggcaaagccaaaattttcaccccagaaacccgaaactctacatttttagtagacggcccagatacctcagaatgtccaaatgagcggcgagcctggaacttcttagaagtagaagattatggttttggtatgtttacgacgaacatttggatgaaattcagggaaggatcttctgaagtatgtgatcataggttaatgagcgcagcaatcaaagatcaaaaggcagtccatgctgatatgggttattggatagaaagtagcaaaaaccaaacatggcaaattgaaaaagcatcattaattgaggtaaaaacgtgtttgtggcccaaaacacatacgttgtggagcaatggagtactagaaagccagatgttaataccaaaagcatacgccggaccaatatctcaacataattacagacaaggttacgcgacccagacagcaggcccctggcatcttggaaaattagaaattgatttcggagaatgccccggaaccactgtaactgtacaagaggattgtgaccatagaggtccaagtctgagaacaacaactgcctctggtaaacttgtcacacaatggtgttgccgttcatgcaccatgcctccactaagattcctgggtgaagacgggtgctggtatggtatggaaattcgaccgttaaatgaaaaagaagagaatatggtgaagtcgcaagtcagtgccggacacggtaccagcgaaacatttagtatgggattattgtgtttaacgttgttcgtagaggaatgcctgagaagaagggttacgaggaaacatatgatcctagtagtagtcactacattatgtgcgatcattttaggaggactaacttggatggacttactgcgtgcactgattatgttaggtgacaccatgtcaggtagaatgggaggacaaatacatttggcgattatggcggttttcaaaatgagccctggatacgtcttaggaatattcctccgaaaactaacatctagagaaacagcactgatggtgatcggtatggccatgactactgttttaagcataccacatgatctcatggaatttatagacggaataagtttaggattgatactactcaagatggtcacgcatttcgataatacacaagtggggacattagcacttgcgctcaccttcatcaagtccaccatgccactggtaatggcttggcgaacgattatggcggttttattcgtggtcacgctaattcctttatgtcgtacctcttgcttacaaaagcaatcgcactgggttgaaattacagcattgatactcggcgcgcaagcattaccagtctaccttatgacactgatgaaaggagcttctaaaagaagctggccattaaatgaaggcataatggccgttggcctagtttcactacttggttcagcattactaaagaatgacgtccctttagcggggcccatggttgccgggggtctcctcctagctgcatacgttatgtcagggagtagtgcagatctctctctagagaaagcggcaaacgtacaatgggatgaaatggcagacattactgggtcgtctcccattatcgaagtcaaacaagacgaagatggatcatttagcatcagagacgtagaggaaacaaacatgataactctattagtaaaattggcacttataacagtgtcaggattataccccctagccatcccagtaactatgacgctatggtacatgtggcaggttaagacccagcgctctggggcgctctgggatgtaccctcgccagctgcggcacagaaagcgactctaacagaaggagtatatcgtatcatgcaaaggggtttgttcggaaaaacacaagtaggtgtaggtatccatacggagggtgttttccacactatgtggcatgtaacaagaggatcagtcatctgccatgaaagcgggagactcgaaccaagctgggccgatgtaagaaatgatatgataagctacggcggaggatggcggttaggtgacaagtgggataaagaggaagatgttcaagttttagccatagaaccgggcaaaaatccaaaacacgtacaaaccaaaccgggactctttaagacactaaccggagaaattggtgctgtaaccttagacttcaaaccgggaacaagtggttcacctataataaatcgcaaaggaaaagtcattggtctttacggaaacggagttgtcacaaaaagtggagattacgtgtctgccataacacaagcagaacgaatcggggagccagactatgaagtcgacgaggatatctttagaaagaaaaggttaaccattatggatctacatccaggtgcgggtaaaacaaaacgtatcctaccttcaatagttcgggaagcgttaaaacgtaggcttagaacacttattcttgcacccacgcgagtagtggccgcagagatggaagaggcattaagaggtttacctatacgatatcaaacacccgcggttaaaagcgagcatacaggcagggagatagttgacctgatgtgccatgctacctttaccactcgacttctatcatcaacaagggttcctaattacaacctaatagtaatggatgaagctcattttaccgatccatccagcgtagcggcaagaggctatataagtactcgagtcgaaatgggtgaagctgcagccgtattcatgactgcaacaccacctggaaccaccgatcccttcccacaaagtaattcacctatagaggatatcgaaagagaaatccctgagagaagctggaataccgggttcgattggatcaccgattatcagggtaaaacagtatggtttgtcccatcaatcaaagctggtaatgatattgcaaactgtttgaggaaaagcggcaagaaagttatacaactttcccgtaagacatttgacacggaatatcccaaaaccaaactaacagactgggactttgtaataacaactgatatttcagaaatgggcgcgaattttcgtgcgggacgagtgatagatcctcgcagatgcctaaaaccagttatattaacagacgggccagaaagagtaatattagctggcccaatcccagttactcctgccagcgctgctcaaagaagaggtagaattgggcggaatccagcacaagaagatgatcaatacgtattttcaggtgacccattaagaaacgatgaagaccatgctcattggaccgaagcaaagatgttattggacaacatttatacccctgaaggcatcatccctactctttttgggccggaaagagagaaaactcaggcgatagatggagagttccgactccgtggtgaacaacgaaaaacttttgtggaacttatgcgccgtggtgacctgcctgtgtggctatctcacaaagtagcaagcgccggaattagttacaaagacagggaatggtgctttactggagaacgaaataaccaaatacttgaagaaaatattgaagtcgagatctggactcgagaaggagagaaaaagaaactcagaccaaaatggttagacgcgcgtgtgtatgctgacccgatggccttaaaagacttcaaagagttcgcgagcggccgtaaatcaataacgctagatatactaaccgaaattgcatccttaccaacgtacctttcaagtcgcgccaaactagcgttagacaatatagtcatgcttcatacaacagaaagaggcggaaaagcatatcaacacgcattaaatgagttaccagaatccctcgagacactgatgcttgtggctttattaggcgcgatgaccgccggaatatttctattctttatgcaaggcaagggtatgggtaaattatctatgggtcttatagcaatcgctgttgccagtggcctgttatgggtagcagaaatacagccgcaatggatagctgcatcaataatactagagttctttttaatggttttattggttccggagcctgagaaacagagaacacctcaagataatcaactaatctatgtaatcctaacgattttaaccattatagctttagtagcagcaaacgaaatgggattgatcgaaaagacaaaaaccgactttggcttttaccaagttaaagcagagactaccattttagatgtggatttaagaccagcatccgcctggacactgtacgcagttgccacaacgattttaacacctatgctaagacatactatcgagaacacatcagcgaacttatcactagccgcaatcgcaaaccaagctgcagtactaatgggattaggaaaaggctggcccttgcatcgaatggatctaggagttccccttttagctatgggatgttatagccaggttaatccaaccacgctcacagcatccttggtcatgctgctcgtgcactacgctataataggccctggtctacaagctaaagccacccgcgaagcccaaaagcgcacggcggcaggaatcatgaaaaatcctacggtagacggtattaccgtaatagacctagaacccatatcatatgaccctaaattcgaaaaacaacttgggcaggttatgctactggttctctgcgttggacaactacttcttatgagaacaacatgggctttttgcgaagtgctaactttagcgacaggaccgattttaaccctatgggagggaaatccgggacgattttggaatacaaccatagccgtctcaacggcgaacatatttcgtggttcttatctggcaggagcaggactggcctttagtttaatcaagaacgcgcagacccctcgaaggggcacaggtacgatgggagagacattaggagaaaagtggaaacgtcagctaaattcccttgatagaaaggaatttgaagaatacaaacggagtggcattttagaagtagaccgaactgaggcgagatccgcgctaaaagacggttcaaaaataaaatatgcagtttcaaggggtacatcaaaaattcgctggatagtagaacgaggaatggtaaaacctaaaggaaaagtagtagatttaggatgtggtcgtggaggctggagctattatatggcgactctgaaaaacgtaacagaggttaaaggctatactaagggcggaccaggtcatgaggaacccattcctatggcaacttatggatggaatttagtaaaattgcacagcggggtcgacgtattctataaaccaaccgaacaggtagacactctgctatgcgacatcggtgaatcttcatccaaccctacaattgaagaaggtagaacactcagagttttaaaaatggttgagccgtggttaagtagcaagcctgagttctgtatcaaagtattaaatccatatatgcctacggtgatagaagaattagaaaaacttcaaagacgtcacggaggctctcttgtacgttgtccattatcaagaaactccacccacgagatgtattgggtatccggcgtcagtggtaacatagtatccagtgtaaatacaacctcaaaaatgctgttgaatagatttaccacgcgccataggaagcctacatatgagaaggatgcagacctaggagcagggacacgatctgtctccacagagacagagaagccagatatgactataattgggcgaagactacaaagattgcaggaagaacataaagaaacatggcactatgaccatgaaaacccatatcgtacatgggcatatcacggaagctatgaagctccctcgacaggatcggcatcaagtatggtcaacggtgtggtaaagttattaactaaaccttgggatgtagtaccgatggtaacacagctagctatgacagacactaccccctttggacaacaaagagtattcaaagaaaaagtagacactcgaaccccacagccaaagccaggaacccaggtagtaatgactactacggccaactggttatggactctattgggacgcaagaaaaatcccagactatgcacgcgtgaggaatttattagtaaggtaagatccaatgcagcaattggtgcagtattccaagaagaacaaggatggacttcggcttcggaagctgttaatgatagtcgattttgggaattggttgataaagaacgggcactacaccaggaagggaaatgtgaatcttgtgtatataatatgatggggaaaagggaaaagaaactcggtgaatttggacgagctaaaggctcacgagcgatttggtatatgtggctaggtgcgcgatttttggagttcgaagcattaggctttttaaacgaagaccactggtttgggagggaaaactcttggagtggagtggaaggcgaagggctccatcgcttgggttatatcttagaagacatcgacaagaaagacggtgatctaatatacgccgatgacacagctggatgggacactcggataacagaagacgatctactcaatgaagaattaattaccgaacaaatgactccgcaccataaaatattagcgaaagccatatttaaactaacttaccaaaacaaggtagttaaagtactacgtccaacaccaaaaggggcagttatggatattataagtaggaaggaccaacgaggatccggacaagttggcacttatggcctgaatacatttactaatatggaggttcaacttattagacaaatggaagcagaaggggtaataactagagatgatatgcataatcctaaaggcctgaaggaacgcgttgaaaagtggttaaaagaatgcggagtcgacagattaaaaagaatggcaatatctggagacgattgtgttgtgaagccgttagatgagcgtttctctacctccctactctttctgaatgatatgggcaaagtccgcaaggacatacctcaatgggagccatctaaaggctggaaaaattggcaagaagttcctttctgctctcaccactttcataaaatatttatgaaagatggtcgaagtctggttgtaccttgtagaaaccaagatgaattaataggaagggcgcgtatatcacaaggggcgggatggtcgttaagagaaacagcctgtttaggcaaggcatatgcacaaatgtggagtctcatgtatttccatagaagagaccttcggctagcctctatggcgatatgctccgcggtaccgactgaatggtttcctacatcacgaaccacttggagtatacatgcccatcatcagtggatgaccacggaagatatgctaaaagtttggaaccgagtatggatagaagataacccaaacatgatcgataagacgccagtgcactcatgggaagacattccttacctaggaaagagagaagacctttggtgtggatcactaatagggttgtcttcaagagcaacttgggctaaaaacattcacacggcaattacgcaggtaagaaatttgataggtaaagaagaatatgttgattacatgcctgcaatgagacgttacagtgcacatttcgagtcagagggagtattgtaa

SEQ ID NO: 23710 - RNA, 9867 nt, synthetic construct
  misc_feature 1..9867: note = derived and/or modified CDS sequence (opt6) from DENV-4__KF907503__SS-prME
  source 1..9867: mol_type = other RNA
agcaccatcacattgttatgcctgataccaacggtaatggcgttccacctatcgacccgtgacggagaaccattgatgattgtcgctaaacatgaaagagggcgtccactattattcaaaacaacagaaggcatcaataaatgtacacttattgcgatggatcttggggaaatgtgcgaagacaccgtgacttataaatgtccattattagtaaacactgaacctgaagatatcgattgctggtgcaatctaacgtctacttgggtaatgtacggtacgtgcactcagagtggagaaagacggcgtgagaaaagatcagttgcattaacaccacactcagggatgggtctggaaactagagcagaaacttggatgtcgtcggaaggggcatggaaacatgcgcagcgtgtggaaagttggattttgcgaaaccctggttttgcactattagctggattcatggcttacatgataggtcaaactggtatccaaagaaccgtcttctttgtactaatgatgttagtagctccctcttatggaatgcgttgcgtcggagtcggtaacagagacttcgttgaaggagtgagtggaggagcgtgggtcgatctagtattagaacatggtggctgcgtcactacaatggcacaaggcaaaccaaccctagatttcgaattaacaaaaacaactgcgaaagaagtggctttattaagaacgtattgcatcgaggcaagcataagcaacataactacagcgacccgatgcccgactcagggagaaccttatctaaaagaagaacaagatcaacaatacatatgccgcagagacgtggttgaccgtggatggggaaatggatgtggtctattcggtaaaggaggggtagtaacctgcgcaaaattttcctgtagtggtaaaataactgggaacctagttcaaattgaaaaccttgagtacaccgtagtggttactgtacacaatggagacacgcatgcggtagggaacgatacatcaaatcacggcgtaacagcaatgataaccccgcgctccccaagtgtagaagttaaattaccggattacggagaattaacacttgattgtgaacccagaagtggaattgactttaacgaaatgattttgatgaaaatgaagaagaaaacgtggttagtgcataaacagtggtttttagatttacctctcccctggacagcaggggctgacacctctgaagtacattggaactataaagagcgaatggtaaccttcaaagtaccacacgccaaaagacaagatgtcaccgtacttggttcacaggaaggcgccatgcactcagcattagcaggagcaacagaagttgattcgggcgacggtaatcacatgtttgcagggcacctaaaatgtaaagttagaatggaaaaattaagaatcaaagggatgtcatatacaatgtgtagtggcaaattctcaattgataaagaaatggcggaaacgcaacatggaacaacagtcgtaaaggtgaaatacgaaggtgcaggagctccttgtaaagtaccaatagagataagagacgttaataaagaaaaagttgtaggacgaattatctcttccacaccattggctgagaataccaattcagtaacaaatattgagctcgaaccaccattcggggatagctatatagtaatcggagtagggaacagcgcattaacgttgcattggtttagaaaaggaagtagcataggaaaaatgtttgagagtacttacagaggagcaaaacgaatggcgatattgggagaaacggcttgggactttggatctgtgggaggactattcacaagcctggggaaagccgtacaccaggtattcggctcagtgtatacaacgatgttcgggggcgtaagctggatgatcaggatactaattggatttttagtactctggatagggactaactcaaggaatacttctatggctatgacttgtatagcagtaggagggattaccctcttcttaggtttcacagtacaagcagatatgggatgcgtagtttcatggtcaggaaaagagctaaaatgcggttcagggatcttcgtagtagacaacgtacacacttggacagagcagtataaattccaacccgaaagtccagcgagattggcatctgcgattctgaatgcacacaaagacggcgtttgcgggataagaagtacaactcgacttgaaaatgtgatgtggaagcagatcacgaacgagctgaattatgtcctgtgggaaggtggacacgatcttacggttgttgcaggcgatgttaaaggagtcttgactaaaggaaaacgtgctttaaccccaccagtgtcagatcttaaatactcatggaaaacatggggtaaagcaaagatattcacgccagaagcaagaaatagtacgtttttaatagacggaccagatacatcggagtgccctaatgaaaggagagcatggaactccctggaagttgaagactacggctttggtatgtttaccacaaatatctggatgaaattccgtgaaggcagttccgaagtttgcgatcatagactaatgagtgcggctataaaagatcaaaaggcagtacacgcagatatgggatattggatcgagtcaagtaagaaccaaacatggcaaatagagaaagcatctcttattgaggtaaagacctgtttgtggccaaagacgcatactctatggtctaacggagttctagaatcgcaaatgctaataccaaaatcatatgcgggcccttttagtcaacacaattatagacagggctatgcaactcaaacggtcggaccgtggcacttgggaaaactcgaaatcgattttggtgaatgccctggcacgactgtgactatccaagaagactgtgatcatcgtggaccctcgcttagaacatccacagccagcggcaaattagtaacacaatggtgctgccgttcatgtacaatgccaccacttaggtttttaggtgaagatggttgctggtacggcatggaaatacgcccactatccgaaaaagaagaaaatatggtcaaatctcaggtaactgccgggcaaggtacaagtgaaacattttccatgggactgttatgcctaacactatttgttgaagaatgcttgcgtcggcgcgtaacccgtaaacatatgattctcgtcgttgtcataacactttgcgcaataatattagggggtcttacatggatggacttactaagggcactaattatgcttggcgacacaatgtccggaagaatcggaggtcagatccaccttgcaattatggctgtcttcaaaatgtcacccggttatgtattaggagtgtttttaaggaagctgacatcacgagaaaccgctttgatggtgataggcatggcaatgaccacggtattatcgataccacacgatctgatggaactaatagatgggatcagtttgggattaatacttctaaaaatcgtgacacaattcgataacacacaggtaggaacattggcactctcgttaacgtttatacgatcaacaatgccccttattatggcctggcgaaccattatggccgtattatttgtagttacattaatcccactttgcagaacttcttgcttacagaaacaaagtcactgggtggaaataactgcactcatactaggagcacaagccctgccagtttacttaatgacgttaatgaaaggagcatcacggcgaagttggcctttaaacgaggggataatggccgtgggcttggtatcgctcttgggttcagcattacttaagaatgacgttccactggcagggccaatggtcgcgggaggtttgttgttagcggcgtatgtcatgtcaggcagctctgcggacctgtctctagaaaaagccgctaacgttcagtgggatgaaatggcagatattacgggtagttcaccaataatcgaagtaaaacaggatgaagatgggtcctttagtattagagacgtggaagaaacgaatatgataaccctcctagtcaaacttgcactcatcactgtcagtggcctgtaccccttagcaatccccgttactatgacactatggtatatgtggcaggtcaaaactcaaagaagcggcgctctttgggatgtgccctcaccggccgctactcaaaaggcagcattgtcagaaggagtctatcgaatcatgcaacggggtctattcggcaagactcaagtcggagttggtatccatatggagggtgtctttcatacaatgtggcacgtaaccagagggtctgtcatctgtcacgaaacagggcgacttgaaccatcatgggcagatgtgagaaatgacatgatttcatacggaggaggctggagactcggagataaatgggataaagaggaagacgtgcaagttttagcgatcgaacccggcaaaaatccaaagcacgtacaaacaaaaccggggttatttaaaaccttgacaggagaaataggagcagtaaccttagactttaagcccggaacctctggaagccccattataaacagaaaagggaaagtaatcggtctttacggcaatggagttgtcacaaaatctggagactatgtaagtgccataacgcaagcagaacggattggagaacctgactacgaagtagatgaagatattttcaggaagaaaagattgactataatggacctgcatccaggagctgggaaaactaaaagaattttaccctcaattgtaagagaagccttgaaaagaaggcttcgtacgctcatattagcaccaactcgagtagtcgcagcagaaatggaggaagccttgcgaggcttaccaatacgataccaaacaccagccgtaaagagtgaacataccggaagagaaatagtagatcttatgtgccacgcaacgagtacaacacgtcttctttcaagcactagagtacctaactataacttgatagtcatggatgaagctcattttacagatccatcaagtgtagcagctagaggatacatatctaccagagtagagatgggagaggctgcagccatcttcatgacggccacaccaccaggagctacagatccttttccacaatccaactcccctatagaggatatcgaacgagaaataccagaaagaagctggaacacaggattcgattggattaccgattatcaaggaaaaaccgtctggtttgtaccttcaattaaagcgggaaacgacatcgcgaactgtttaagaaaatctggcaagaaagttattcagctatccagaaagacatttgacacagaatatcccaagacaaaattgacagactgggattttgtcgtaactacagatataagtgagatgggagctaactttagggcagggagggttatagatcctcgacggtgtttaaaacctgtcattttaacggacgggccagagcgcgtcatcttagcgggaccgataccagtgactccggcatcagctgcacaacgccggggtagaattgggaggaacccagcccaagaagacgatcaatacgtattttcaggagatcccttgaagaatgatgaagaccacgcccattggacggaagcaaaaatgctactcgataatatatacacacccgagggcataattcctactttattcggccctgagagagaaaagactcaggcaattgatggtgaatttcgactaagaggagaacaaagaaaaacatttgtagagctaatgagaagaggggacttgcctgtatggctgagttacaaagtcgcttctgctggaatatcgtataaagatagagaatggtgctttacaggggaacgcaataaccaaattcttgaagaaaatatggaagtggagatttggacaagggaaggggagaagaagaaattacgtcccagatggcttgacgcacgagtctatgcagatccaatggctttaaaagactttaaagagttcgcatccgggaggaaatcaataaccttagatatattgacagaaatagcatctctaccgacctatttatcaagcagagctaagctcgctctcgataatatagtcatgctacacaccacagaacgaggaggtagggcatatcaacatgccctcaatgaactacctgaatcactggaaacattaatgcttgtggcgctcctaggagccatgacggctgggatctttttgtttttcatgcagggaaaggggataggcaaactaagcatgggtctgattattattgcagttgcatctggactactatgggtggccgaaatacagccacaatggattgcagcaagtattattctagagttctttttaatggtattgttgatcccagaacctgaaaagcaacggacaccacaggataatcaactcatatacgtcatattaacaattttgaccatcataggcttaatcgccgccaacgagatgggattaattgagaaaactaaaacagattttgggttttatcaagtgaaaacggaaaccactatacttgacgttgacctaagaccagcgtcggcatggacattatacgctgttgccaccaccatactaactccaatgcttcggcacacaattgaaaataccagtgccaatttatcgttagcagcgatcgcaaatcaggcggccgtactcatggggctaggcaaaggatggccattgcacagaatggaccttggtgttccattgttggctatgggctgttattcacaagtaaacccgacaacactaaccgctagtttagtcatgttgtctgtccattatgcaatcattggaccggggttacaagcaaaagcgacaagggaagctcaaaaacgtacagctgctggcatcatgaaaaacccgacagtggacggaatcactgtaatagatctagaaccaatatcatatgacccaaagtttgaaaaacaacttggtcaggtcatgttacttgtcttatgcgctggtcagctactattaatgcgaaccacttgggctttttgtgaagtacttactttagctactggaccaattttaactctatgggaaggcaatccaggaagattctggaatacaacaatagctgtttcgaccgcaaatatcttcagagggtcatacctggccggtgctggactagcattttccttaatcaaaaatgcacagacaccgcggaggggcaccgggacaacgggagaaacactaggcgagaagtggaaaagacaattaaacagcctcgacagaaaagaatttgaagaatataaacgctcaggtattttggaggtcgacagaactgaagcaaaatcggcgttaaaagatggcagtaaaataaagcacgctgtaagtcgcggaagttcaaagatacgttggattgtagagcgcggcatggtgaagccaaaaggaaaagtcgtagatctggggtgtggaagagggggctggtcatattatatggcaaccttgaaaaacgtaacagaagtcaaaggctatactaaaggaggtccgggacatgaggaacccattccaatggctacatacggatggaatttagttaaactacattcaggtgtagacgtattttataagcctacagaacaggtagacacgctactctgcgatattggagaatcaagctcaaatccgaccatagaggaaggtaggaccttaagggtactaaaaatggtagaaccctggttaagcagtaagccagaattttgcataaaagtacttaacccatatatgccaactgtcatagaagaacttgaaaaactccagcgaaaacatgggggaaacttagtcagatgtcctttgtcaagaaatagtacacatgaaatgtattgggttagcggcgcgtcaggaaatatagtgagtagcgtaaacactacatcaaaaatgttactaaacaggtttactacacgccatagaaaaccaacatacgaaaaagatgtagatctaggagcagggacacgaagcgtctcgactgagacagaaaagccagacatgacgattatagggcgaaggttacagcgtcttcaggaagaacacaaggagacatggcattatgatcaagagaatccataccgtacttgggcataccatggatcatacgaagcaccaagcacaggatcagcaagttctatggtcaatggagttgtaaaactcttaaccaagccatgggatgtaataccaatggtcacacagcttgccatgaccgacactaccccttttggtcagcagagagtgttcaaagaaaaagtggacactagaacaccacaaccaaaacccggaacacgaatggtaatgacgaccacagcaaattggctatgggcccttctaggtaagaaaaagaacccaagattatgcacaagagaagagttcataagtaaggttagatcaaacgcagcaatcggcgctgtctttcaggaggaacaggggtggaccagtgcctctgaggccgtgaatgatagtcgattttgggagctagttgacaaagagagagctttacatcaagaaggaaagtgtgaaagttgtgtctacaatatgatgggtaagcgggagaagaaacttggtgaatttggtcgagcaaaaggcagtagggcaatctggtacatgtggttaggtgcaagatttttagagttcgaagcgttgggtttcttgaacgaagatcattggtttggcagagagaacagttggtcaggagtagagggagaaggattacatagactcggctacattttagaagaaatagataagaaagacggagacctgatgtatgcagatgatacggcaggctgggatacaagaataacggaagatgacttacaaaatgaagaactaataacagagcaaatggcacctcatcacaaaatactagccaaagctatatttaaactaacataccaaaataaagtagttaaagtgcttcggccaacgcccagaggagcggtgatggatataatatcccggaaagaccaacgcggttcaggacaagtcggcacttacggattaaacaccttcacaaatatggaggtacagctaataagacagatggaagcagagggagtaataactcaagatgatatgcaaaatcccaaaggactgaaggagcgcgtagaaaaatggcttaaggaatgcggtgtagacaggctaaagaggatggcgatcagtggggacgattgtgttgttaaacccttggacgagaggttcgggacttccttattatttcttaatgacatgggaaaagtacgtaaggatataccacaatgggagccttctaagggatggaaaaactggcaagaagtccctttctgctctcatcattttcataagatttttatgaaagatggtcggagcctagtcgttccttgtagaaatcaagatgaactgataggcagagcacgtatctctcaaggagctggatggtctctaagagaaactgcatgtctaggaaaagcatatgcgcaaatgtggtctctgatgtatttccatcgcagagacttaagattggcgtcgatggccatatgcagcgcggtgcctactgaatggtttcctacaagtagaactacatggtcaatccacgctcaccaccaatggatgacaacagaagatatgttaaaagtgtggaatcgggtatggattgaagataatcccaacatgacagacaaaacaccagtacacagctgggaggacattccctatctgggaaagagagaagatttatggtgtggatcgttaattggtctctcatcaagagcaacttgggccaaaaacatacacacagcaataacacaggtacgtaatttaataggtaaggaagaatacgtcgactacatgcctgtaatgaaacgctatagtgcaccaagtgaaagcgagggagttttatga

SEQ ID NO: 23711 - RNA, 9867 nt, synthetic construct
  misc_feature 1..9867: note = derived and/or modified CDS sequence (opt6) from DENV-4__AY947539__SS-prME
  source 1..9867: mol_type = other RNA
tcaaccatgacgctcctatgcctgatcccgactgcaatggcgtttcatctatcaacaagagatggagaaccactaatgattgtcgcacggcatgaaaggggacgacccttactttttaaaacgacggaaggaataaataaatgcaccctcatagcaatggatcttggagaaatgtgtgaagacacagtaacatacgaatgtcctttattggtaaacactgaaccggaagacattgactgttggtgcaacttgacgagcgcatgggttatgtatggtacttgtacgcagagcggtgaacgtaggcgtgagaaacgatctgtggcattgactccgcactctggaatgggccttgaaactagagctgaaacatggatgagcagcgaaggagcgtggaaacatgcacaacgagtagaatcatggatcctgaggaaccccggtttcgcgcttcttgccggctttatggcgtatatgatcgggcaaacgggcatacaaagaacagtgttctttgttttgatgatgttggtagcaccatcttatgggatgagatgcgtgggagtgggaaatagagactttgttgaaggagtaagtggaggtgcatgggtggacttagttttggaacatggtggatgtgttacgactatggcccaaggtaaacctacactggattttgaactaatcaaaacaactgccaaagaagttgcacttcttcgcacatattgtatagaggcttcaatcagtaacatcacaactgcaacgagatgtccaactcaaggagaaccttatttaaaagaagaacaagatcaacaatatatatgcagaagagatgttgttgacagaggctgggggaatggttgtgggctattcggtaaaggaggagtggttacttgcgccaaatttagttgttccggaaaaatcacaggcaacctagtacagattgagaacttggaatacacagtagttgtaacagtacataatggcgacacgcatgccgttggtaacgatatcccaaatcacggtgtgacagcaacgataaccccgaggtctccatcagttgaagtgaaacttcctgattacggtgaattaacactagattgtgaacctagatcaggaattgattttaatgaaatgatattgatgaaaatgaagaagaaaacctggttggtacataaacaatggtttctagatttaccgctaccatgggccgccggagcagacacctccgaagttcactggaactataaagaacgaatggtaacattcaaagtcccccatgcaaaacgacaagacgtgacagtactgggatctcaggagggcgcaatgcacagcgctctaacaggggccacagaagtagactctggggatggtaaccatatgttcgctggtcatcttaaatgtaaagtacgaatggaaaaattgcggattaaaggaatgtcatacactatgtgcagcggaaaattttcgatagataaagaaatggcagaaactcaacatggaacaaccgtcgtaaaagttaaatatgaaggcgcaggcgcaccatgtaaagttccaatcgagataagagatgtgaacaaagagaaagtagttggtcgaataatctcctccacaccattcgcagagtacacgaatagtgtaacaaatatagaactagagccccctttcggagactcatatatcgttataggagtaggagatagtgctttaacactacactggtttagaaaaggaagttcaattggaaaaatgttagaaagcacataccgaggagcaaaacgtatggccatactaggtgagacggcctgggacttcggatcagtgggtggactattgacttcgttaggtaaagccgtccatcaagtatttggatctgtatataccacgatgtttggtggagtaagttggatggtccgaatcctaattggattcctcgtattatggattgggactaatagccgtaatacttcgatggctatgacatgtatcgcagtaggtggcattacgctattcctgggatttaccgtacatgctgatactggatgtgcagtatcttggtcaggcaaagaactaaaatgcggcagtggaatatttgtaattgataacgtacatacatggacagaacaatataaatttcaaccagagagtcccgccagactggcctctgcaattctcaatgcacacgaagatggcgtttgtggtatacgcagcacgactcgacttgaaaatattatgtggaaacaaatcacgaacgaactaaattacgtcctgtgggaaggtggacacgacctaacagtagtcgcgggggatgtaaaaggtgtgctatccaaaggtaagagggcactagcccctccagtaaatgatttaaaatatagttggaagacatgggggaaagcaaaaatattcacaccggaggcaaagaactcaacattcctgattgacggtcccgatacttccgagtgtccaaatgagagacgcgcatggaactttttggaagtcgaggactacggattcggtatgttcaccactaatatatggatgaagttcagggagggatcgagcgaagtttgtgatcatagactaatgagtgcagccattaaagatcaaaaagcagtgcatgctgacatgggatattggatcgagtcaagcaaaaatcagacatggcaaatagaaaaggcaagtcttatagaagttaaaacatgcctatggcctaaaacccacactctgtggagtaacggtgtattagaaagtcagatgcttattccaaaagcgtatgctggaccattttcacaacacaattatcgacagggttatgcaacgcagactgttggaccctggcacctaggaaagctcgaaatcgactttggtgaatgtccaggcacaacagttactatacaggaggattgtgaccacagggggccttcattacggacaacaactgcatctgggaagttagttactcaatggtgttgcaggtcttgcacaatgcctccgttacgatttcttggtgaagacggatgttggtacggtatggagattaggcctttaagcgagaaggaagaaaatatggtaaagtcccaggtatcagcgggacaaggtacaagtgaaaccttctcaatgggactattatgtctaacgttatttgttgaggaatgtttaagacgacgcgtaacaaggaaacacatgatcttggttgtagttacaactctatgtgctattatattaggcggattaacatggatggatcttcttagggcattgatcatgctgggagacacgatgagcggacgcatgggtggacaaattcatctggcaattatggccgttttcaaaatgagccccggttacgtattaggaattttcctccgcaagttgacatctcgagaaactgcactcatggtgataggtatggcaatgacgacggtactatcaatacctcatgatctaatggagttcatagatggtatatcactagggctcattcttttgaaaatggtcacgcattttgataatacgcaagtaggaacactcgcactaagtttaacattcatacgatctacaatgccacttgttatggcctggcgtacgataatggcagtactgtttgtagtgacacttatcccattatgcagaacgtcatgtctccaaaaacaaagtcactgggtagaaatcacagcattgattctaggagcacaagcactaccagtatacttaatgactctaatgaaaggcgcttctaaaagaagttggcccctgaacgaaggtataatggcagttggcctagtttcgctattaggaagcgcgttattgaaaaatgacgtcccactagcgggaccgatggttgcaggcggactactactggcagcatatgttatgtcaggcagtagtgcagatttaagtctggaaaaagctgctaatgtgcaatgggatgaaatggcagacatcactgggagctctccgatcatagaagtaaagcaggatgaagatggcagtttttcaatcagagacatagaagaaaccaacatgattacacttctagtaaaactagcgctaatcacggtatcaggtctttacccactagctattccagtgacaatgacactttggtatatgtggcaagtaaaaacgcaacgaagtggagcattatgggatgtcccctcgccagctgccgcacagaaggcaacactcaccgaaggcgtctatagaatcatgcagagaggacttttcggtaaaactcaagttggtgtagggatacacatggaaggcgtatttcatactatgtggcacgtaacccgcggtagtgtaatatgtcacgaaactgggagactagaacccagctgggcagatgtaagaaacgatatgatttcctatggtggtggttggaggttaggtgataaatgggataaggaggaagacgtacaggtattggcaatagaaccgggtaagaaccccaaacatgtccaaacaaaacccggattatttaaaacattgaccggagaaatcggtgctgttacattagactttaaaccagggaccagcggatcaccaataattaatcggaaaggaaaggtaattggactatatggtaatggggttgtcacaaaaagtggggattatgtctcagctatcacccaagcagagcggacaggagaaccagattatgaagtagatgaagatatattcagaaagaaacggttaacaatcatggacttacacccaggcgctggtaaaacaaaaagaatcttaccatcgatcgtgcgggaagcattaaagaggagattgaggacacttatacttgctccgacgcgagtagtagcagcggagatggaagaagcattgagagggctaccaattagatatcagacccctgcggtgaaaagtgaacatacaggccgagaaatagtagacttaatgtgtcatgctaccttcaccacaaggcttctctcatctacccgagttcctaattataatttaatagttatggacgaagcccactttacagacccttcctccgttgccgcgcgcggctatatctcaacccgagtagaaatgggcgaagcagctgcgattttcatgaccgcaacacctccaggcgctacagatcctttccctcaaagtaactctccgatcgaagacatagaacgggaaattcccgaacgatcctggaacacaggattcgactggattacagactatcaaggaaaaacagtgtggttcgtgccatcaattaaagcgggcaatgatatagcaaactgcttaaggaaatctggtaagaaagtgatacaactaagtcgcaaaactttcgatacagaatatcccaaaacaaaacttacggattgggattttgttgtaacaacagatataagcgaaatgggagcaaattttagggcaggtcgggtaatagacccacggcgctgtttaaaacccgtaatttcaacagatggtcccgaacgagttatactagctggccctattccagtaacgccggcaagtgcagcacagcgtaggggcagaattgggagaaatcctgctcaagaagacgatcaatatgtctttagcggtgaccccttgaaaaacgatgaggatcacgctcactggacagaagctaagatgctactagataacatctacacaccagagggaataattccaacactgttcggccccgaacgtgagaaaaaccaagcaatcgacggggaatttcgactaagaggagaacagcgaaagacatttgtagaacttatgaggagaggtgatcttccagtatggttatcttacaaagtagctagtgctggcatcagctataaggatagggagtggtgttttactggtgaaagaaataatcagattttagaagagaatatggaggtagaaatttggacgcgtgaaggtgagaagaagaaattgagacctaagtggctagatgccagggtatacgccgaccccatggccctaaaggatttcaaagagttcgcatcaggtagaaaatcgatcacgcttgacattctaacagaaatagcgtccctgcctacttacctgagtagcagagccaaattggcccttgacaacattgttatgttacacacaaccgagcgaggtggaaaagcatatcaacacgcactgaatgaactcccagaaagcctggagactttgatgttagttgcactattaggtgctatgactgccggaatatttttattcttcatgcaaggcaaaggaatcggaaagttgtcaatgggtttaatagccatcgcagtcgcgtctggccttctttgggtggccgaaatacaaccacaatggattgccgccagtataatattagaatttttcctaatggtgttgcttataccggaaccagaaaaacaaagaacaccgcaagataatcagttaatatatgttatactcacaatactaacaataataggcttaatagcggcaaatgaaatggggcttatagagaaaacgaagacagatttcggtttctaccaagtaaaaactgaaacaaccatattggatgttgatctacgccctgcatcagcatggacactttatgccgtcgccacaacaattttaaccccgatgctacgccatacaatagagaatacatcagccaacttaagtttggcagcaatagcaaatcaagcagccgtgctgatgggattaggcaaaggttggccccttcataggatggatttgggagttccactattagcaatgggttgttatagccaagttaatccgacaacattgatagcaagccttgttatgttattagtacattacgctatcataggaccaggattacaagccaaagcaaccagagaagctcaaaaacgtacagcagctggcattatgaaaaatcccaccgtagacggaattacagtcatcgacctcgaacctatttcatatgatccaaaatttgaaaaacaattaggacaagtaatgctattagttttatgcgctggacaactattacttatgagaactacatgggcattctgcgaagtgctgactctggcaacaggtccggtactcacactatgggagggaaacccagggagattctggaacacaactatagctgtatctaccgcgaatattttcaggggatcatacctagctggggcaggactggcgttttccctgataaagaatgctcaaacaccacgacggggcacagggaccacgggtgagactttaggggaaaaatggaaaagacagttaaactcgcttgatcgaaaggaatttgaagagtataaaagatcgggaatattagaagttgacaggacggaagcaaaaagcgctttaaaagatggaagtaagataaaacacgcagtctctagaggctcaagcaaaatacgatggatagtggaacgaggtatggtaaagccgaaaggaaaagtcgtagatcttggttgcggacgtggaggatggagttactatatggcaacgctgaaaaatgttacggaagtgaagggttataccaaagggggaccaggccacgaggaaccaatcccgatggcaacatatggctggaatctagtgaaattacacagtggagtcgatgtcttttataaaccaacagagcaagttgacacgttactttgcgacattggtgaatcaagcagtaacccaacaatcgaagagggtaggacactaagggttctgaaaatggttgaaccttggttaagttccaaacctgagttctgtataaaggtactaaatccttatatgccaacagtcattgaagaattagaaaagctccaaaggaaacacggaggctctttagtaagatgtccactgagtagaaacagtacccatgaaatgtattgggtatcaggagtaagtggcaacattgtatcatcagtaaacacgaccagtaaaatgcttcttaatagattcactaccaggcacaggaaacccacatatgagaaggatgtggatttaggagcaggtactagaagcgtttcaactgaaacagaaaaaccagacatgactataattgggcgtagacttcaaagactacaggaagaacacaaagagacgtggcactacgatcaagagaatccatacaggacatgggcatatcatggaagctatgaggcaccttcaaccgggagcgcatcatcaatggtgaatggagttgtgaaactcttaactaaaccttgggacgtaattcctatggtcacacaattagccatgactgatacaacaccgtttggtcagcagcgagtgttcaaggagaaagtagacactcggacaccacaacctaaacctgggaccaggatggtaatgacaacaaccgctaattggctgtgggctttgctcggcaagaagaaaaatccaagactatgtactcgagaggaatttatatctaaagtaagatcaaatgcagccataggagcagtatttcaagaagaacaaggttggacttcagcctccgaagctgtgaatgactccagattctgggagcttgtagacaaagaaagagccttacaccaagaaggaaaatgtgagagttgtgtttataacatgatgggaaagagggagaagaaattaggagagttcgggagggcaaaagggtctcgtgctatctggtacatgtggctcggtgccaggttcttagaatttgaggctttaggatttttaaacgaagatcattggttcggtcgggaaaattcatggtcaggtgtcgaaggtgaaggcttacaccgcctaggatacatattagaagatatagacaagaaggacggagacttgatatacgcagacgatactgctggctgggatacccggataacagaagatgacttgcttaacgaagaattaattaccgagcaaatggcaccacatcacaaaatactggcaaaggcaatattcaaattaacataccagaacaaagtagtaaaagtacttagacctacgccaaaaggggctgtaatggatataatctccagaaaagaccaaagaggcagtggacaagttggaacatatggcttgaacacttttacgaacatggaagtacaactcataaggcaaatggaggccgaaggcgtaataacccaagatgacatgcataacccgaaaggcttgaaagagagagttgaaaaatggctcaaagaatgtggtgtggaccgattaaaaagaatggccataagtggggatgattgcgtcgtaaagcccttagacgaaagattttctacttcgttactatttttaaacgacatggggaaagtacgtaaagatataccacagtgggaaccatcaaaagggtggaaaaactggcaggaagtaccattttgctcgcatcattttcacaaaatattcatgaaagatggtcgaagtctcgtagtcccgtgtagaaatcaagatgagcttataggccgggcgcgtatctcgcagggcgcggggtggtctctaagggaaacagcgtgcttgggaaaggcttatgcgcaaatgtggtcacttatgtacttccatcggcgtgatttaagactcgcgagtatggcaatttgctctgcagttcctactgaatggttcccaacatccagaaccacttggtcaatacacgcccatcaccagtggatgacaacggaggacatgctcaaagtatggaaccgcgtttggatagaagataacccaaatatgaccgataaaacgcctgtgcatagctgggaagatatcccttacctcggcaaacgcgaagatctttggtgtggatcactaatcggtttaagttcgcgcgcaacttgggcgaaaaatatacatacagcaatcacacaagtgagaaatcttatagggaaagaagagtatgtcgactatatgccagttatgaaaagatattcagcaccttttgaatctgaaggggtcctctaa

SEQ ID NO: 23712 - RNA, 9879 nt, synthetic construct
  misc_feature 1..9879: note = derived and/or modified CDS sequence (opt11) from DENV-1__AB608789__SS-prME
  source 1..9879: mol_type = other RNA
tcagtcaccatgttgctaatgttaatgcccacagcattggcgtttcacctgaccacacgcggaggggaaccacacatgatagtaacgaaacaggaaaggggaaaaagcctcctattcaagacatcagcaggggtcaatatgtgcaccctaatagcgatggatcttggggagctatgcgaggacactatgacctataaatgcccgaggattaccgaagcggagcccgacgacatcgactgttggtgcaacgcaacagacacctgggtcacttacggtacctgctctcagacgggggagcaccggcgagacaaaaggtcggtagcactagccccgcacgtgggactcggcttagagacccgtacagagacatggatgagctccgaaggggcatggaaacaaattcagagggtggaaacctgggcgctacgccatccaggattcacagtgattgcattattcctggcacacgcaattgggacaagtatcacccaaaaggggattatattcatactactgatgctcgtaacgccctccatggcgatgcgatgcgtgggaattggtagcagggacttcgtggaaggtctttcaggagcaacatgggtagacgttgtactcgaacacggaagttgcgtcaccacaatggccaaagacaagcccacactagacatcgagcttctaaagacagaggtcacaaatccagcggtactacgaaaactgtgtatcgaggcaaaaatatccaacacgacgacagactcgagatgcccaacacagggggaggcgacgctcgtcgaagaacaagacgcgaactttgtatgtcgacgaacgttcgttgaccgcggctgggggaacgggtgcggactattcggaaaaggttcactcataacgtgcgctaaattcaaatgcgtgactaaactggaagggaaaatagtccagtacgaaaatctaaagtatagcgtcatcgtcacagtacacacaggcgaccaacaccaagtcggcaacgagagtaccgagcacggaaccacagccacgatcacaccccaggcccccaccagcgaaatacagctcacagactacggagcactaaccctggactgctcgccccgcactggcttggactttaatgagatggtcctgctgacaatgaaagaaaaatcgtggctagtgcacaaacagtggttcctagacctgccactcccatggacatccggagcaagcacgtcccaggagacatggaaccggcaagacctcttagtgacctttaagaccgcccacgccaagaaacaggaggtagtggtcctaggtagtcaagagggagcaatgcacacggccctgaccggggcgacggaaatacagacaagtggcaccacaacaatcttcgccggtcacctcaagtgcagactcaagatggacaaactaacattgaagggaatgagctacgtgatgtgtactgggtcattcaagctggagaaggaggtggccgaaacccagcacgggaccgtgctcgtccagatcaaatacgaagggactgatgcaccctgcaaaataccgttcagtactcaagatgaaaaaggagtcacacaaaacggacgtcttataacagccaatcccatagtgacggacaaggaaaaacccgtcaacattgaagcagagcccccgttcggcgagtcctatattgtaataggtgctggggagaaggcattgaaactcagctggtttaaaagaggatccagcatcggaaagatgttcgaagcaacagccagaggggcacgccggatggcaatcctaggcgataccgcctgggacttcgggtccatcgggggcgtattcaccagcgtcggtaaacttgtccatcaaatcttcggcacggcatacggcgtactattctcaggggtaagttggacaatgaagatcggcatcggcgtcctcctaacctggttgggactgaactcacgctcgaccagcctttccatgacttgcatagctgtcggacttgtcactctatatctcggcgtgatggtgcaagccgactccgggtgcgtcatcaactggaaaggccgtgaactaaaatgcggaagtgggattttcgtaaccaacgaagtccacacctggacagaacaatataaattccaggcagactccccaaaacggctcagtgccgcaataggcaaggcttgggaggagggggtctgcggaatcaggtcggccacgagactggaaaacatcatgtggaaacaaatatccaacgagttaaaccacattctgctagagaatgacatgaagttcacagtcgtggtgggggacgtcgtagggattctcgcccaaggcaagaaaatgatacgtccccaacctatggaatataaatactcatggaaaagctggggcaaggctaaaataatcggcgccgacgtgcagaacacaaccttcataatagatggaccaaacacgcccgagtgtccagacgaccaaagagcatggaacatatgggaagtcgaagactatggcttcgggattttcacgacaaacatatggctaaaacttagagatagctacacgcaagtgtgcgatcacagactaatgagcgctgcgataaaggactccaaagctgtacacgcggatatggggtactggattgaaagcgagaaaaacgaaacatggaaacttgcgagggcttcattcatagaagtaaaaacgtgtatctggcctaagagccacacactatggtcaaacggggttctcgaatcagaaatgataatacctaagatttacggcgggcctataagccagcacaactacagaccaggatattttacacagacagccgggccatggcacctcggcaagctagaattagatttcgatctgtgtgagggaacaacggtagtcgtggatgaacactgtggtaatcgcggtcctagcctccggacaaccaccgtaacaggcaagatcatccacgaatggtgctgccgaagttgcaccctgcccccgctacgttttaaaggggaagacggatgctggtatggcatggaaattcgcccagttaaagagaaagaggaaaaccttgtcaaatctatggtgagcgccgggtccggcgaagtcgactcatttagcctgggactcctctgcatgagcatcatgatagaggaagtgatgcgctctcgctggtcccgaaaaatgctaatgaccggaaccctggcggtgtttctgctacttatcatggggcaactaacatggaacgacctaatacgcctttgcataatggttggcgccaatgcatcggacaggatgggaatgggcacaacttacctggccctaatggccacatttaaaatgcggcccatgttcgccgtagggctgctatttcgacgactcacgagccgagaggtgcttctcctcacgatagggctaagcctagtcgcaagcgtggagttgcccaattcacttgaagaactaggagacggactcgccatggggatcatgatactaaaattactcacagactttcaatctcaccaactatgggcgaccctcctgtccctcacctttattaagaccactgtgagtttgcactacgcctggaaaacgatggccatggtactcagcatcgtcagcctcttcccactatgtttgtccacaaccagccaaaagaccacatggttgcctgtgctattggggtctctcggatgcaagcccctgaccatgttcctaatagccgaaaataaaatctggggcaggaaaagctggcccttaaatgaagggataatggccgtcggaattgtctcaattttattatctagcctcctaaagaatgacgtcccgctggcaggaccactcattgcgggaggaatgcttatcgcctgctatgtaatttcaggaagcagtgcagacctatccctcgaaaaagcggctgaagtttcttgggaagaggaagcagagcacagtggtgccagccacaacatcctagtagaagtgcaagatgacgggaccatgaagatcaaggacgaagaaagagatgatacactcacgatcctattaaaggcaaccctcttagcagtatccggagtgtacccactaagtatcccggcaaccctattcgtgtggtacttttggcagaagaaaaagcaaaggagcggcgtcctgtgggacaccccatctcctcccgaagttgaaagggcggtgttagacgaaggaatctataggatcatgcaacgcggactactcggaagatcgcaagtgggggtcggcgtcttccaagaaaacgtctttcacactatgtggcacgtgacccgaggagcggtactgatgtaccagggcaagcgtctggaaccaagctgggcatccgttaaaaaggatctgatctcatatgggggcggatggcggctccaaggaagttggaacacaggcgaggaagtccaagttatcgcagtagagcccggcaaaaatccgaagaatgtacaaacagcacccggcacgtttaagacaccagaaggtgaagtaggggccatcgcgttagattttaaaccaggaacgtcgggatcacctatagtgaacagagaaggcaaaatcgttggcttatacggcaacggggtcgtcaccacctcgggcacctatgtatctgctatagcgcaggcgaaagcatcgcaggaaggcccacttcccgagatcgaagatgaagtattccgtaagcgtaacctcaccatcatggacctgcatcccgggtcagggaaaacacgccgctacctacccgcaatcgtccgcgaagcgatcaagcgaaaactacgaaccctgatcctggcgccgacaagagttgtcgcatccgaaatggccgaagctcttaaaggtatgccaatcagataccagacaacggcagtgaaatctgagcatacaggcaaagagattgtagatctcatgtgtcatgctacgttcaccatgcggctccttagccctgtcagagtacccaactacaacatgatcattatggacgaggcacatttcactgacccgagcagcattgcagcgcgcggatacataagcacacgggtcggaatgggcgaagcggcggctatcttcatgacagcgaccccgccgggaagtgtcgaagcatttccccaatcaaacgccgtaatccaagacgaggaacgtgacatccccgagcgatcctggaactccggatatgaatggattacagacttcccggggaaaacggtgtggttcgtcccaagtatcaagtccggtaatgacatcgcaaactgtctgaggaagaacggaaaacgtgtcatacaactgagcagaaagacgtttgacacggagtaccagaaaactaagaacaatgactgggactatgttgtcaccacagacatatcagagatgggcgccaatttcagagcggacagagttatagacccccgacgttgcttgaaaccggtaatcctgaaggacggacctgagcgagtgatcttggccggaccgatgccagtcaccgttgcatccgcagcacaaagacgaggaagaataggccgaaaccacaacaaagaaggcgaccaatacatatatatgggccagccgcttaacaatgacgaagaccacgcccactggaccgaagccaaaatgcttcttgataacatcaataccccagaagggataatccctgcgctatttgagccagagcgggagaaatcggcggcaatcgacggggagtacagactaagaggggaagcccggaaaacttttgtagaactcatgagacgaggagacctgccggtgtggctctcgtataaagtcgcatccgaggggttccagtattcggaccggcgatggtgtttcgacggagaacggaacaatcaggtgctagaggagaacatggacgtcgaaatatggacaaaagaaggggaacggaagaaacttcggccgcgatggctagacgcacgcacatatagcgacccgctcgccttgcgtgagttcaaagagttcgcagccggacgacgatcagtgagcggtgatctaatactcgagatcgggaagctaccacaacatctaacccagagggctcagaatgcgttggataatctagtcatgctccacaattccgagcaaggcgggcgcgcctaccggcatgccatggaggaactccccgacactatcgagacgctgatgcttttggcgcttatcgccgttctgacgggtggagttacactattcttcctctccggtcgaggcttgggcaagacctccatagggctactgtgtgtcatggcctcctcagtattactgtggatggcctcggtagagccgcactggatagctgcgtcaataatactcgaatttttcttgatggtactcctgataccggaacccgatagacagcgaacaccccaggacaatcagctcgcatatgtcgtcatcggcctcctgttcatgatcctcacggttgctgcaaacgagatgggcttactcgagacgacaaagaaagacctgggaatcggtcacgtagcggtcgaaaatcaccaccacgcaaccatgcttgacgttgatctacacccagccagcgcgtggacattgtacgcagtcgcgacgaccataataaccccgatgatgcgccacaccatcgagaatacgaccgcaaatatatccttaaccgccatagccaatcaagcagctattttaatggggctggacaagggatggccaatcagcaagatggacatcggggtcccactattggccctggggtgctactcccaagtaaatccattgacactcacagcggcggtcctaatgcttgtagcgcactacgccatcataggccctgggttgcaagcaaaagccactcgcgaagcacagaaaaggacggcggctggtatcatgaagaacccgacagtagacggaatagtcgcgatcgacctcgaccccgtcgtttacgatgccaaattcgaaaagcaactggggcagatcatgctactaatcttatgcacgagccagatattactgatgcgcaccacatgggctctgtgcgaaagcatcaccctagctaccggaccattaacgaccttatgggaaggaagcccagggaaattctggaacacgaccatcgcggtctcaatggcaaatatcttccgggggagctacctagcaggagcaggattagcgttctcgctcatgaaatcactagggggaggtcggagagggacaggagcacaaggggaaaccctgggcgaaaagtggaaaaggcagctaaaccaattatcaaagtctgaatttaatacttataagaggagcggaataatggaggtggacaggagcgaagccaaggagggagtgaagcggggcgaaacgacaaagcacgcagtatcacgagggaccgccaaactccggtggttcgtggagaggaacttggtgaaaccggaagggaaagtgatagacctaggatgcggaagagggggctggtcgtactactgtgcaggccttaagaaagtgaccgaggtgaaagggtacacgaaaggcggcccgggacacgaagaacctataccaatggcaacatacggatggaacctagtgaaactgcacagcggcaaagacgtattcttcacgcccccagaaaaatgcgacaccctgctctgtgatataggagagagcagccccaacccgacgatcgaggaaggcagaacgctacgggtgcttaaaatggtagagccctggcttcgcggaaaccagttctgtataaagatcctaaacccctacatgccctccgtagtagagacacttgagcaaatgcaacgtaagcacggcggaatgttagtcaggaaccccctctcccgcaactcgacacacgaaatgtattgggtcagttgcggaacaggaaacatagtttcagccgtgaacatgaccagtaggatgctactgaacagatttaccatggcccatcgcaaaccgacatatgagcgcgacgttgaccttggcgcagggacacggcacgtcgcggtcgaaccggaagtagcaaacctagacatcatcggccagcgaatagaaaacattaaacacgaacacaaatcgacatggcattacgacgaagataacccctacaagacctgggcctaccacggaagctacgaagtcaaaccctcagggtccgcaagcagcatggtaaacggggtagtcaaactccttactaaaccatgggatgttatcccgatggtgacacagattgcaatgacagacacaacacccttcgggcagcaacgggtattcaaggaaaaagtagacacacgcacacccaaagcaaaaagaggtacggcacagatcatggaagtgacagccagatggttatggggcttcctaagtcgcaacaagaagccacggatatgtacacgggaagaatttaccagaaaggtgcgctcaaatgccgccatcggagcggtattcgtcgacgagaaccaatggaacagcgcaaaagaggcggtcgaggacgaaagattctgggatctggtccaccgcgagcgtgagcttcacaagcaaggaaaatgtgccacatgcgtctacaacatgatggggaaaagagagaagaagttgggagagttcggtaaagccccggagtcccgagccatctggtacatgtggttaggcgccagattcttagagttcgaagcattgggcttcatgaacgaagaccactggttttcccgagaaaattccctgtcgggcgtggagggagaaggactccacaaacttggatatatcctgagagacatcagcaagattcccggaggtaacatgtacgccgacgacacggcgggctgggacacaaggatcaccgaggacgacctgcaaaacgaagcgaaaataactgatataatggaaccggaacacgcgttattagccacgagcatctttaaactaacgtaccagaataaggtagtccgtgtccaacgtccagccaaaaacgggacggtaatggacgtaatcagcagacgcgatcagagaggatcaggacaagtcggcacctatggccttaacacattcactaatatggaggcccaactaatccggcaaatggaatcagaaggcatcttctccagctccgaactcgagaccccaaacttagccgaacgggtgctagactggctgggaaaatacggagtggaacgacttaagagaatggcaatctcaggcgatgactgtgttgtgaagcccatcgacgacaggtttgctaccgcgcttaccgccctgaatgacgttgggaaagtacggaaagacatcccccaatgggaaccttctaagggctggaacgattggcagcaggtaccattctgtagccaccactttcaccaacttataatgaaagatggcagggaaatcgtggtcccgtgccgtaaccaggatgaattggttggacgtgcaagggtaagtcagggcgccggatggagtctgagggagacggcatgcctcggaaagagctacgcacaaatgtggcaacttatgtacttccaccgcagagacctaagactcgcggccaacgcgatctgctccgctgtcccggtggactgggttcccaccagccggactacgtggtcgatccacgcacatcaccagtggatgaccacggaggacatgctcagtgtgtggaacagagtatggatcgaagaaaacccgtggatggaggataaaacacatgtatcaagttggggcgacgtaccctacctcggaaaacgggaagaccaatggtgcggcagcttaataggactaacggccagagcgacgtgggcaacaaatatccaagtggccattaaccaggtccgacgcctcatcgggaatgagaactacctcgactatatgacgtcaatgaaacgcttcaagaacgaaagcgacccagaaggagccttatggtaa

SEQ ID NO: 23713 - RNA, 9879 nt, synthetic construct
  misc_feature 1..9879: note = derived and/or modified CDS sequence (opt11) from DENV-1__AB608788__SS-prME
  source 1..9879: mol_type = other RNA
agcgtaacaatgcttctaatgctgctccccaccgtactagcattccatctaaccacgcgcggaggagaacctcatatgattgtaaccaaacaagaaaggggcaaatcacttctattcaaaactagcgcgggtgtgaacatgtgcacactcatcgccatggacttaggcgaattatgcgaagacacaatgacctacaaatgcccccgaataaccgaagccgagccggacgacgtagactgctggtgtaacgcaacagacacttgggtcacgtacggaacgtgcagccaaacaggagaacatagacgcgacaaacgtagtgttgcactggcgccccacgtgggcctaggactagagacacgcacagagacgtggatgtcaagtgaaggagcctggaaacaaattcagagggttgagacttgggcactacgccatcccggtttcacggttatagcactctttttggcgcatgcaatcggaacaagcatcacccaaaaaggaatcattttcattctgttgatgcttgtcacgccctccatggcaatgcggtgcgtcggcatcggcaaccgcgatttcgtagaaggcctcagcggcgccacttgggttgatgttgtactagagcatgggagctgtgtaacaaccatggcaaaggataaaccgaccttggacatcgaactgctaaaaacagaggtgaccaacccggctgtgctgaggaagctgtgtatagaggcgaaaataagcaacacgaccaccgacagtcgatgtcccactcaaggagaggcaacgctagtagaagaacaggacgcgaatttcgtgtgtcgccgcacattcgtcgaccgaggttggggcaatggttgcggcctctttggcaagggctccctaattacatgcgctaagtttaaatgcgtaacaaagctggaaggaaaaattgtacagtacgagaacctcaagtacagcgtcattgtgacggtccatacgggggatcagcaccaggtcggcaacgagtcaactgaacacgggacaacggcaacaataacgccacaagcaccgacttcggaaatacagctaacagactacggcgccctcacactggactgctcgccacgaacaggattggattttaacgaaatggtcctcctcacaatgaaggagaaaagctggctcgtacataaacaatggttcctggacctaccactgccctggacaagtggagctacgacaagccaagaaacatggaaccggcaagacctattagtcactttcaaaaccgcccacgccaagaagcaagaggttgtagtgcttggcagtcaagaaggggcaatgcatactgcgctcacaggagcgacggaaattcaaacgagcggaacaacgacaatctttgcaggccacttgaaatgccgattgaaaatggacaaactcaccttgaaaggcatgagctacgtcatgtgcacgggcagcttcaaactagaaaaggaagtagcagaaacgcagcacggaacagtcttagtacaagtcaagtacgaaggcaccgatgcgccgtgcaagatccccttctctacgcaagacgagaaaggcgtaacgcaaaacggacgcgtgataaccgccaaccccatcgtcacggataaggagaaaccagtgaacatagaggcagaaccaccattcggagaatcctacattgtggttggagcgggcgaaaaagcgctcaaactgtcgtggttcaaaaaggggtcaacaattggcaaaatgttcgaggctaccgcaagaggggcccgtcgaatggccatactgggggataccgcctgggatttcggttcgatcggcggcgtctttacatcggtgggcaagctcgtccaccagatattcggcacggcgtacggcgtacttttctccggagtgtcgtggacaatgaagataggcattggagtgctactcacatggcttggcctaaactctcgctcaaccagcctatctatgacgtgcatcgcagtcggactcgtaacattatacctaggagtgatggtacaagcggattccgggtatgtaataaactggaaagggagagagctaaagtgtggaagcggaatatttgttaccaacgaagtccacacatggactgaacaatacaaattccaagcggatagcccgaagagactttccgcagcaataggaaaagcctgggaagaaggagtttgcggaatccgaagtgccactcggctggagaatatcatgtggaagcaaatcagcaacgagctgaaccacatattactggaaaacgatatgaagtttacagtagtcgtgggagacgtgtccggcatactagcacagggaaagaaaatgatcagaccccaaccgatggagcacaaatacagctggaaaagctggggtaaagccaaaatcataggggccgacgtgcagaactccacgttcataatcgatggacccaacacaccggaatgccccgacgaccagcgagcatggaatatttgggaagtcgaggactatggattcgggatattcacaaccaatatctggctcaagctacgagactcgtacacgcaagtgtgcgaccaccggctcatgtccgcagccataaaagactcgaaggctgtgcacgccgacatggggtattggatagaaagcgagaagaacgagacgtggaagctagcgcgggcgagtttcatcgaggttaagacatgcgtctggcctaaaagtcacacactatggtccaatggagtactagaaagcgaaatgattatacctaaaatttacgggggaccaatatcgcaacacaactacaggccaggctacttcacacaaactagcggtccgtggcacttaggcaaacttgagctagacttcgacctgtgtgaagggacgacagtcgtcgtggacgagcattgcgggaaccggggaccaagtctgcgcacaaccaccgtaacgggaaagataatacacgagtggtgttgccgcagctgcactctaccacccttacgattcaagggggaagacgggtgttggtacggtatggaaatccgccccgtgaaggaaaaagaggaaaacttagtcaaaagcatggtttcggccggctcgggagaagtcgattccttctcgttgggactcctatgcattagtattatgatcgaagaggtaatgcgctcgaggtggtccagaaaaatgctaatgacaggcacactagccgtgttcctcctcttaatcatggggcaactcacatggaatgacctgataagactatgtattatggtaggagcgaacgccagtgatagaatgggcatggggaccacgtacctggcgctcatggccacgttcaagatgcgcccaatgttcgccgtggggctcctcttccgcagactcaccagccgcgaggtccttttgttaacgataggactgagtttagtcgcaagcgtagagctaccgaactccctggaggaactcggagacggacttgctatggggataatgatattaaaactcctcacagatttccagagccatcagctatgggcggcactcttaagcctaacgtttatcaaaacaacgttcagtcttcactacgcgtggaaaacgatggccatggttctatcaatcgtcagcctcttcccgctatgcctatcaacgacaagtcagaaaacgacatggctcccggtgctcttgggaagtctcggttgcaagccgctaaccatgtttctaatagccgaaaacaaaatctgggggcgcaagtcatggccattgaacgaagggatcatggcagtagggatcgtcagcatcttgctgagcagtctcctcaagaatgatgttccattagcaggacctctgatcgcaggcgggatgttgatagcgtgctacgtcataagtgggtcaagcgcagacctctcacttgagaaggccgctgaagtgagctgggaggaagaagcagagcacagcggcgcgtcgcataacatcttggtagaagtccaagacgacggaacaatgaaaatcaaagacgaagaaagggacgatactctgacgatcctacttaaggctacattactagcagtcagcggggtttacccactaagcatcccggctacgctattcgtatggtacttctggcagaagaagaaacagagaagtggagttctatgggacaccccatcaccacccgaagtcgaacgcgcagtcctcgacgacgggatctatcgaatcatgcagagaggtctactcggtcggagtcaggtcggggtcggggtcttccaagagaacgtgttccacaccatgtggcacgtaacacgaggcgccgtactcatgtaccaaggaaagcggttggaaccgtcatgggccagtgtcaagaaagacctaataagttacggcggcggctggcgtctacaggggtcctggaacacgggagaagaagtacaggtaatagcggtggagcccgggaaaaaccccaaaaatgtacaaaccgcccctggaacgttcaagacaccagagggcgaggtaggagcaatagcgctagactttaaacccgggacatcagggtcacccatagtaaatcgtgagggaaaaatcgtggggctatacggcaacggcgtagtaaccacctcgggaacgtacgtatctgcgatcgcacaagcgaaagccagtcaagaggggccgctaccagaaatagaagacgaggtcttcagaaagcggaaccttaccattatggacctccacccaggatcaggaaaaacacggcgatatctaccagcgatagttagagaagcaataaagcgcaaactgcgtacattgattcttgccccaacacgcgttgtagccagcgagatggcagaagcactgaaggggatgcccataagataccaaacaactgcggtaaaaagtgaacacaccgggaaggaaatcgtggatcttatgtgtcatgccaccttcacaatgaggttgctcagccctgtccgggtgccgaattataacatgataataatggacgaagcccatttcacagacccctcctccatagcggcaagaggatacatctcaacccgcgttggaatgggagaggctgcagcaatcttcatgaccgcaacaccgccaggtagtgtcgaggcgttcccacaatcgaacgcggtcatacaggacgaggagcgagatatccccgaaagaagctggaacagcggctacgactggataacggacttccccgggaaaacggtgtggttcgtacccagcattaagtctggcaacgacatagcgaattgcctacgcaaaaacgggaaacgagtcatacaactaagtagaaaaaccttcgacaccgagtaccaaaagactaaaaataatgattgggactacgtcgtgactacagatatatccgaaatgggcgcaaacttcagggcagaccgagtgatcgatccaaggcgatgcttaaagcccgtgattttaaaggacggcccagaacgtgtaatcctggccggaccaatgccagtaactgtggcctcggctgcacaacggcgaggccggatcggacgaaatcaaaacaaagaaggcgatcagtatatctacatgggtcaaccgctaaacaacgatgaggaccacgcgcactggaccgaagcgaaaatgctgctagacaatattaacaccccagaggggataataccagcgctatttgaaccagaaagagaaaagagcgccgcgatagacggagagtaccggctgcgaggtgaggcgagaaagacgtttgtggagctgatgaggcggggcgacctcccggtttggctaagctacaaagtagctagtgaaggtttccaatacagcgaccggaggtggtgtttcgacggcgagcgtaacaaccaggtccttgaagagaacatggacgtcgaaatttggacgaaggaaggggaaaggaagaagctccggcctcggtggctcgacgccaggacatatagtgacccactcgcgctaagagaatttaaagaatttgccgcaggcagaaggtccgtcagcggtgacttgatactagaaatagggaaactcccacaacatttaacgcaacgagctcagaacgccctcgacaatctggtcatgttacacaacagcgagcaaggaggcagagcctaccgccacgcaatggaggagctgcccgatacaatagagactctaatgctactcgctctgatagccgtgctaacgggaggcgtgactctcttcttcctgtctggacgcggattaggtaagacctcgataggattgctctgtgtaatggccagttccgtcctcctgtggatggccagtgttgagccacactggatagcagccagcataatacttgaatttttcctgatggtgctactcatccctgagcccgaccgccaaaggactccgcaagacaaccagcttgcttacgtagtcataggtttattattcatgatcttaacggtcgccgcaaacgaaatgggtctcttggagaccaccaagaaagacctaggaattggacacgttgccgtagagaaccaccaccacgccaccatgctcgatgtagacctccatccggcgtccgcatggacgttatacgcagtcgccacgacgataattacacccatgatgcgacacaccatagagaacactaccgcaaacataagcctaacggcaatagctaaccaggcggcaatcctgatggggctagacaaggggtggccgatatccaaaatggacatcggtgtgccgttgttggccttgggatgctactctcaagtcaacccactaaccttgacagcggccgttttgatgctagtagcccactacgcaatcatcgggcctggactccaagcgaaagccacaagagaggcccagaagcgaacagcagccggcataatgaaaaacccgaccgtcgacggaattgtagcgatagacctagaccctgtagtctacgacgccaaattcgaaaagcaacttgggcagataatgctgttgatcttgtgtacgagtcagatcctcctgatgcgaacaacctgggcactgtgcgaatccataaccctggcaacaggaccattaaccactctttgggaagggagccccgggaagttctggaacacaacaatagccgtaagcatggcgaacatattcagagggagctacctggccggcgcaggcctcgcattttcgctaatgaaatccctaggtggaggacgacggggaacgggggcacaaggcgagacactgggagaaaaatggaaaagacagctgaaccagctcagcaaaagcgaatttaacacatataaacgcagcggaatcattgaagtagataggagcgaagcaaaagaaggcttgaagagaggcgagaccacgaagcacgcagtgtcgaggggtacggccaagctgagatggttcgttgaaagaaacctggtgaaaccggaaggaaaggtgatcgaccttggatgcggaagaggagggtggagctactactgtgccggactgaagaaagtaacggaggtcaaaggttatacaaaaggaggagcgggtcatgaagaaccaatcccaatggcaacgtacggatggaatctcgtcaaactttactccggcaaggacgtcttctttactccacccgaaaagtgcgacacactcctctgcgacataggagaaagttcaccgaacccaaccatcgaggaaggacggacgctcagagtattaaaaatggtcgaaccatggctgaggggaaaccagttttgcatcaagatactaaacccatacatgcctagcgtagtagagacactcgaacaaatgcaaagaaagcatggcggcatgttggtcaggaaccccctatcccggaactctactcacgaaatgtactgggtgagttgtggaacgggtaacatcgtaagtgcggtcaacatgacaagcagaatgctcctgaacagatttacaatggcgcatcgaaaaccaacatacgaaagagatgtagatcttggggcggggacacggcatgtcgccgtagagcccgaagtcgcgaacctcgacatcatagggcaaaggatagaaaatataaaacacgagcataaaagcacctggcactacgacgaagataacccatataaaacatgggcttatcatggaagctacgaagtcaaaccgtcagggtcggcttcatccatggtgaacggcgtcgtccgactcctaaccaagccttgggacgtgataccgatggtaacacagatcgcaatgacggacacgacacccttcgggcaacagagagtgttcaaggaaaaagtcgataccagaacgccaaaagcaaaacagggcactgcacaagtgatggaagtcaccgcaagatggctatggggattccttagcagaaataagaaaccacgaatctgtactcgagaggagttcactcgaaaagtaagaagcaacgcagcaataggcgctgtcttcgtggatgagaaccaatggaactccgccaaggaagctgtcgaggatgaacgcttctgggacctagtccaccgagagagggagctacacaaacagggcaaatgcgcaacgtgtgtgtataacatgatgggcaagagagagaagaaactaggagagttcgggaaggccaaggggtcgagggccatttggtacatgtggcttggggcacgattcctagagtttgaggctttgggatttatgaacgaggaccactggttctctcgggagaacagcttgtcaggagtcgaaggagagggattacacagactcgggtacatcttgcgagacatatcgaaaataccaggcgggaacatgtacgccgacgacacagcaggatgggacacaagaatcaccgaagacgacctgcagaacgaggccaagatcaccgacataatggaaccggaacacgcccttctagccacctcaatattcaaacttacctatcaaaacaaggttgtccgtgtacagaggccagccaaaaacggtacagtcatggacgtgatcagtcgaagagaccaacgagggtcaggacaggtaggtacatacggcttgaacacattcactaatatggaggcacagcttataagacagatggaatcggaaggaattttctcaccctcagaactggaaacaccaaatctcgcagagcgggtcctggactggcttgaaaagtacggcgtagaaagattaaaacgcatggccatatcaggcgacgattgcgtagtaaaaccaatagacgaccgcttcgctacagccctcacggccctgaacgatatgggaaaggtaagaaaggacataccacagtgggaacccagtaagggatggaacgactggcaacaagtacccttctgttcgcaccacttccaccagctgataatgaaggacgggcgggagatcgtcgttccatgtaggaatcaggacgaattagtggggagagccagagtatcacaaggtgctgggtggtccctacgagagacagcatgcctgggaaagtcgtacgcgcaaatgtggcaactcatgtacttccatcgaagagacctccggcttgcagcaaacgcgatttgcagcgccgtgccagtggactgggtgccaacgtcaagaacaacctggagtattcacgcacaccatcagtggatgaccaccgaaaacatgctgtcagtctggaaccgggtctggatcgaggaaaacccatggatggaagacaagacccacgtaagcagctgggaggacgtaccctacctggggaagcgggaggatcagtggtgcggcagcttaataggccttaccgctcgcgcaacttgggcgactaacatacaagtcgcgataaatcaagttcgcagattgatcggcaacgaaaactatttagactacatgacgtctatgaagagatttaaaaacgatagcgacccagaaggggcgctttggtag

SEQ ID NO: 23714 - RNA, 9879 nt, synthetic construct
  misc_feature 1..9879: note = derived and/or modified CDS sequence (opt11) from DENV-1__AB608786__SS-prME
  source 1..9879: mol_type = other RNA
agtgtgactatgctgctcatgctgatgcccaccgccctggccttccacctcaccactcggggcggcgagccgcatatgatcgtgtccaagcaggagcggggcaagagcctgttgttcaagacaagcgccggggtgaacatgtgcaccctcatagccatggatctgggcgagctgtgcgaggataccatgacctacaagtgcccccgcataacagagaccgagcccgacgacgttgactgctggtgcaacgccactgatacctgggtgacctatgggacgtgttcgcaaacgggcgaacaccgcagggacaaacggtccgtggccctcgcaccacacgttggccttgggttagagacccgaaccgagacgtggatgtcgtccgaaggcgcctggaagcagatccagcgggttgagacgtgggccctccgccaccccgggttcacagtaatcgccctgttcctcgcccatgtgatcgggaccagcatcacccagaaagggattatcttcatcctcctgatgctggtaacgccttcccttgccatgcggtgcgtgggcatcggctcccgggacttcgtggaggggctgtccggcgcgacctgggtcgacgtggtgctcgaacacgggtcatgtgtcactacgatggccaaagacaaacccacgttggacatcgagctgctgaagaccgaggttaccaaccccgctgtgctccggaagctgtgtatcgaagccaagatctccaacaccactaccgacagccgttgtcctacccagggcgaggcgaccctggtagaggagcaggacgccaacttcgtgtgccgccgcaccttcgtggatagaggttggggcaacggctgtgggctgttcgggaaagggtccctgattacgtgtgccaagttcaagtgcgtaaccaagctggagggcaagattgtgcaatacgagaatctcaagtactccgtgatagtcaccgtgcacacgggggaccaacatcaggtcggcaacgagtctaccgagcacggcaccacagccaccatcactccccaagcccccaccaccgagatccagctgaccgactatggggcgctgacgctcgactgcagcccccgaacaggcctagacttcaatgagatggtcctgcttaccatgaaggagaagtcctggctggttcacaagcagtggttcctggatctccccttgccctggactagtggggctagcacgtcccaagagacgtggaaccggcaggacctgctcgtcacctttaagaccgcccacgcaaagaagcaggaggtggtggtcctgggatcacaggagggcgcgatgcacacggcgttaacgggggccaccgaaatccaaacctccggcacgacgaccatattcgccgggcacctaaagtgccgcctgaagatggacaagctaaccctcaaggggatgagctacgtgatgtgcacgggatctttcaagcttgagaaggaagtggccgagacccagcacggcacggtcctcgtgcagatcaaatacgagggcaccgacgccccctgcaaaatacccttcagcacgcaagacgagaagggagtgacgcagaatggcaggctgataacagcgaacccgatcgtcaccgacaaggaaaagcccgtcaacattgaggccgagcccccctttggggagtcctacattattatcggcgctggcgagaaggctctcaaattgagctggttcaagaaggggtcctctataggcaagatgttcgaggcgacggcccgcggggcccgacgcatggccatcctgggcgacacagcctgggacttcgggagcattggcggcgtgtttacgtcggtcgggaaattggtgcaccaaatcttcggaacggcgtatggggtcctgttctccggcgtctcttggacgatgaagatcggaatcggcgtgctgctcacctggctgggactgaactcccgcagcaccagtcttagcatgacctgcatcgccgtagggctggtcacgttatacctcggcgtgatggtgcaggccgactcggggtgcgtcatcaactggaagggcagggaactgaaatgcgggagcggcatcttcgtgaccaacgaagttcatacctggaccgagcaatacaagttccaggctgacagcccgaagcgcctgtccgcggcaatcggcaaagcctgggaagagggggtctgcggcattcggagcgctacccgccttgagaacatcatgtggaagcagatcagcaacgaactaaaccacatactactggagaacgacatgaagttcacggtggtggtcggcgatgtggccggcatcctggcccagggaaaaaagatgatccggccccagcccatggagtacaagtacagctggaagtcctggggtaaggcgaagatcatcggcgccgatgtgcagaacaccaccttcatcatcgacgggcccaacaccccagagtgccccgatgaccagcgggcctggaacatctgggaggttgaggattacggatttgggatcttcacgactaacatctggctgaaactccgcgatagctacacccaggtgtgtgaccaccgcctgatgagcgccgcgatcaaggactccaaggctgtgcacgccgatatgggctactggatcgagtccgaaaaaaacgagacctggaagttagcgcgggccagctttatcgaggtcaagacatgcatctggccaaaaagtcacactctatggagcaatggagtgctggagtccgagatgatcatccccaagatttacgggggcccaatctcacagcacaactacaggcctgggtacttcacccaaacggctggcccctggcacctgggaaagctcgagctggacttcgacctatgcgagggcactacggtagttgtagacgagcactgcggaaaccgggggccatccctcagaaccacgaccgtgaccgggaagatcatccacgaatggtgctgtcggagctgcaccctgccgcccctgcgcttccgaggcgaagacggctgctggtacgggatggagatccgccccgttaaagagaaagaggagaatctggtgaagtccatggtgtccgccggaagcggcgaagtcgactccttctcgctggggctgctctgcatatccataatgatcgaggaggtaatgcggagccgctggtcccggaagatgctgatgaccgggacgctggctgttttcttcctcctgatcatggggcaactgacctggaacgacctcatccgtctgtgtatcatggtcggcgccaacgccagcgaccgtatggggatgggcaccacctacctggcgctgatggccacgttcaagatgcgacccatgttcgctgtgggcctgttattccgcaggctcacctcccgagaggtgctgctactcacaatcgggctctctctcgtcgcctccgtcgaactccccaactcactggaggagctgggcgacgggctcgccatgggcatcatgatactcaagttgttaaccgacttccagagccaccagctgtgggcgactctacttagcttaactttcattaagaccaccttcagtctgcactacgcctggaagacgatggccatggtcttaagcatcgtatccttattccccctgtgcctaagcacaacctcccagaagaccacgtggctgcctgtcctcctcgggagcctggggtgcaagccgctgacaatgttcctcatcgccgagaataaaatatggggtcgtaagtcctggccattaaacgaggggatcatggcggtcggcatagtgtcaatcctgctgtcgtccctgctgaagaacgatgtgccactcgccgggccgcttattgccggcggaatgctgattgcctgctacgtaatcagcgggtccagcgccgacctctccctggagaaggcggccgaggtgagctgggaagaggaagccgaacactccggcgcttcacataacattctggtggaagttcaagacgacgggacaatgaagatcaaggatgaggagcgcgacgacaccctcaccatcctgctgaaagccacgttgctcgcggtgtctggagtttacccgctaagcatcccagccaccctgttcgtctggtatttttggcagaagaaaaagcaaaggtccggtgtactgtgggacacccccagtccacccgaggtggagcgcgccgtcctggacgacggcatctatcgaatcatgcaacgtggcctactcgggcggtcccaggtgggcgtgggggtcttccaggagaatgtgttccacaccatgtggcatgttacacgcggcgctgtccttatgtaccaggggaagcggctggaaccgtcgtgggcgtccgtcaagaaggacttaatcagctacggcggcgggtggcgcctgcagggttcctggaacacgggtgaggaggtgcaggtcatcgcagtggagcccggaaaaaatcccaaaaacgtgcagactgcgcccgggaccttcaaaacgcccgagggggaggtcggcgctatcgccctggacttcaagcccgggacgtcgggatcccctatagttaaccgggaggggaagatagtgggcctgtacggcaacggagtcgtgaccactagtggcacgtacgtcagcgccatcgcgcaagccaaggcatcccaggaaggccccctgcccgagatcgaggacgaggtctttcgcaaacggaacctgaccattatggacctccaccccggctccgggaaaacccgccgctacctgccagccatagtgcgcgaggcgatcaagcggaaactgcgcaccctaatcctggcacccacacgtgtggtcgccagtgagatggccgaggccctgaagggcatgcccatccggtaccagaccaccgcggtcaagagcgagcacaccggcaaggagatcgtggacctcatgtgccacgccacgtttaccatgcgccttctgagtccggtccgggtcccgaactacaacatgatcatcatggacgaggcccacttcactgacccctcctccatcgctgcccgcgggtacatcagcacccgggtgggcatgggggaggctgccgccatcttcatgacggccacgccgcctggctccgtcgaggccttcccgcagagcaacgcggtgatccaggacgaggagcgcgatatccccgagcggtcctggaatagcgggtacgagtggatcaccgatttcccgggcaagacggtctggttcgtcccctccatcaagagcggcaatgatatcgccaactgcctccgcaagaacgggaagcgggtgatccagctgtcgcgcaagacgttcgacaccgagtaccagaagaccaagaacaacgactgggactacgtggtcaccacggacatcagtgagatgggcgccaacttccgggcagatagagtgatagatcctcgacgctgcctgaagccagtgatactcaaggacggaccagagagggtaattctggcggggcctatgccggtaaccgtcgcctccgccgctcagcgccgggggcgcatcggccggaaccacaacaaagaaggcgaccagtatatatacatggggcaacccctgaacaacgatgaagatcacgcccactggaccgaggctaagatgctcttagataacataaacacaccagaaggcatcatccccgccctgttcgagccggagcgcgagaagtctgccgccatcgacggagaataccgcctccggggagaggcccgcaagacgttcgtggagctcatgcggaggggggacctgcctgtttggctctcctacaaagtggcgagcgagggcttccagtacagcgaccgacgctggtgcttcgacggagaacggaacaaccaggtgttggaggagaacatggacgtggagatctggaccaaggagggggagcgcaaaaagctgcgaccgcgctggctcgatgcccggacgtactccgatcccctggctcttcgcgagttcaaagagtttgccgccggcaggcgcagcgtctccggggatctcatcctggaaatcggcaagctaccgcagcacctgacccagcgggctcagaacgcccttgacaacctggtgatgttgcataacagcgagcagggcgggcgcgcctaccggcatgccatggaagagctgccagacacgatcgaaaccttgatgctcttggcgctgattgcggtcttaacgggcggggtcaccctgtttttcctgtccggccgagggctcggtaagacgagcatcggcctgctgtgcgtcatggcctccagcgtgttactgtggatggccagtgtcgagccccattggatcgccgcgagcatcatcctggagttcttcctcatggtgcttctgatcccagagccggatcgccagcgcacgccgcaggataaccagctcgcttacgtggttatcggactgctgttcatgatcctcacggtggccgcaaacgagatgggcctgctggaaaccacgaagaaggacctcggcatcggacatgtggcagtcgagaaccaccaccacgcagccatgctggacgtcgacttacaccctgcatccgcctggacgttgtacgccgtggcgacaaccattatcacacccatgatgcggcatactatcgaaaataccaccgccaatatcagcctgaccgccatcgccaaccaagccgcgatcctgatggggctcgacaagggctggcccatctcaaagatggatatcggcgtccccctgctagccctcggctgctacagccaggtgaaccccctgacgctgaccgccgccgtgctcatgctggtagcgcactacgccatcataggcccggggctgcaggccaaggcgacccgcgaggcccagaagcgtaccgcggccggcataatgaaaaaccccacggtggacgggatcgttgcgatagatctggacccggtcgtgtacgatgcaaagttcgagaagcagctcggccagatcatgctgctcatactgtgcacgtcccaaatcctgctcatgcggacaacgtgggccctatgcgagtcgatcaccctggcgaccggacctttgacgaccctgtgggagggttccccaggcaagttctggaacacgaccatcgccgtcagcatggccaacatcttcagggggtcctacctagccggtgctggcctcgcctttagcctgatgaagtccctcggtggcggacggcgcggcacaggagcccagggtgaaaccctcggcgagaagtggaagcggcagctgaaccaactgagcaagagcgagttcaacacgtacaaggggtccggcatcatggaggtcgacaggtcggaggccaaggaagggctcaagcggggcgagaccaccaaacacgccgtctcccgcgggacagcgaagctgcggtggttcgtggaacgcaacttggtcaagccggagggcaaagtaatcgacctgggctgcgggcggggcggctggagttactactgcgccggtctcaagaaagtgaccgaggtcaaggggtacaccaagggcggccccgggcacgaggagccgatccccatggccacctacggctggaacctggtgaagctgcactccgggaaggacgttttcttcatcccccccgagaagtgcgacaccctcctgtgcgacatcggcgagagcagtcccaaccctacgatcgaggaggggcgcaccttacgggtcctcaagatggtggagccatggctgcgtggcaaccagttttgcataaagatactgaacccttacatgcctagcgtcgtcgagaccctcgaacagatgcaacggaaacacggcgggatgctggtgcgcaacccgctgagtcggaacagcacccacgagatgtactgggtgtcgtgcggcactgggaatatcgtttcggccgtgaacatgacgtcccgcatgctcctaaaccggttcaccatggcccaccgcaagcccacctacgagcgcgacgtagacctgggcgcgggcacccggcacgtcgcggtcgaacccgaggtggccaacctagacattatcgggcagcgcatcgagaacatcaaacacgagcacaagagcacgtggcactacgatgaggacaatccctacaagacctgggcctaccacggttcatacgaggtcaagcctagcgggtccgcctctagcatggtaaacggcgtcgtgaaactgctgaccaagccctgggacgtgatccccatggtcacccagatagcaatgaccgacaccacgccgttcgggcagcagcgggtatttaaggaaaaggtggatactcgcacgccgaaggccaagaggggcacagcccaaatcatggaggtcaccgccaagtggctctggggattcctgtcccgtaacaagaagcccagaatctgcacccgggaagaattcacgcggaaggtgcgctctaacgccgccatcggggccgtgttcgttgacgagaaccagtggaactccgcgaaggaggccgtggaggacgagcggttctgggacctggtgcaccgcgagcgggagttacacaagcaaggtaaatgcgcgacctgtgtctacaacatgatggggaagcgcgaaaagaaactgggggagttcgggaaggccaagggcagtagagccatctggtacatgtggctgggcgcccgcttcctcgagtttgaggccctggggtttatgaacgaagaccactggttctcccgcgagaacagcctgtcgggcgtcgagggggaaggcctccataagctggggtacatactgcgcgacatcagcaagatccccggtgggaacatgtacgcggacgacaccgcgggctgggacaccagaatcacggaagacgatctccagaacgaggccaaaatcacggatataatggagccggagcacgcattacttgccaagtccattttcaagctcacgtaccagaacaaagtggtgcgggtgcagcggccagcgaagaacggcaccgtgatggacgtcatcagccgccgcgaccagcgggggtctggccaggtgggcacgtacgggctgaacaccttcaccaacatggaggcccagctgatccgccagatggaaagcgagggtatcttcagcccctctgagttggagacgcccaacttagccgagcgggtgctagactggctcgagaagtacggagtcgagcgccttaaacggatggccatatcaggcgacgactgtgtggtgaagccgatcgatgatcggtttgcgacggcgctcaccgcgctcaacgacatggggaaggtccggaaggacatcccgcagtgggaaccctcaaaaggctggaatgattggcagcaggttcccttctgctctcaccactttcaccagctgatcatgaaggacggcagggagatcgtggtcccgtgccggaaccaagacgagctggtggggcgcgcgcgggtaagtcagggcgccggttggtccctcagagagaccgcatgcctcggcaaatcctacgcgcagatgtggcaactgatgtacttccacagacgcgacctccggctggccgcaaacgccatctgtagcgcggtccccgtggactgggtgccaaccagtcggacgacctggagcatccacgcgcatcaccagtggatgaccacggaggacatgctgtcggtatggaaccgggtgtggatcgaggagaacccttggatggaggataagacgcatataagctcctggggtgacgtgccgtatctcggcaagcgcgaggaccagtggtgcggaagcctgatcgggctaaccgcccgggcaacctgggccaccaacatccaggtcgcgatcaatcaggtgcgccgcctcatcggcaacgagaactacttagactacatgacttccatgaagcggttcaagaacgagagcgaccctgaaggagccctgtggtga

SEQ ID NO: 23715 - RNA, 9879 nt, synthetic construct
  misc_feature 1..9879: note = derived and/or modified CDS sequence (opt11) from DENV-1__AB608787__SS-prME
  source 1..9879: mol_type = other RNA
tccgtcaccatgctgttgatgctgatgccgaccgccctagcgttccacctaaccacgcgagggggtgaacctcatatgattgtatcgaaacaagaacgcggaaaaagtctactatttaaaacctcagctggtgttaacatgtgcaccctaattgcaatggatctaggcgaactctgtgaagatactatgacgtacaaatgcccaaggatcacagaggcagagccagacgacgttgactgttggtgcaatgcgacagatacctgggtcacatatgggacgtgctcccaaacaggtgaacatcgtcgagacaaaaggtccgtagccctcgctccccatgtggggttagggctcgaaaccaggacagaaacgtggatgtcctccgagggggcgtggaaacaaatccagagagtagagacctgggccctgcgtcacccgggcttcacggtaatagccctattcctagcccacgcaataggcaccagcattacacaaaaaggcatcatattcattcttctaatgctcgtaacaccgagcatggccatgcgttgtgtcggtatcgggtcgcgcgacttcgttgaagggttaagcggggccacctgggtagacgtagtactagaacacggctcgtgtgtgaccactatggccaaagataaaccgacgctcgacatagaattactgaagaccgaagtgaccaatccggctgtactgcgcaaactctgtatcgaagcaaaaatctccaacaccacgaccgacagccgctgtcccacacaaggggaggctacactggttgaagaacaagacgcaaacttcgtgtgccggcgaacattcgtagatcgtggatggggaaatggatgcggccttttcggtaagggatcgctactaacctgcgcaaagttcaagtgtgtcacaaagttagaaggcaaaatagtccagtacgaaaatttgaaatacagtgtgatcgtcacagtacacacaggagaccaacaccaagtaggcaacgaatccacggaacacgggaccacagctacgataaccccgcaagctcccacaacagaaatccaactcactgattacggagcactaactcttgattgtagcccgagaaccgggcttgacttcaacgagatggtcttactaaccatgaaggaaaagagctggctggtgcacaaacagtggttcctggacctaccactcccgtggacttcgggagcatcaacaagccaagagacatggaacaggcaagacctccttgttacattcaaaacagcacacgccaagaagcaggaagtagtcgtattaggttcgcaggaaggcgctatgcataccgccctcacaggagcaaccgaaatccagaccagcggaaccaccaccatattcgcaggacacctgaaatgcaggctcaaaatggacaaactgacgttgaaaggaatgtcatatgtcatgtgtactggtagtttcaaactcgaaaaagaggtggccgaaactcaacacgggacagtcctagtacagatcaaatacgaaggcactgacgcaccatgcaaaatacccttcagcacccaagacgagaaaggggtcacgcagaatggccgactgattaccgcaaacccgattgttaccgacaaggaaaaaccagtgaacatcgaagccgagccgcccttcggagagtcatacatcgtaataggagctggtgagaaggccctgaagctctcgtggttcaagaaaggtagcagcatcggaaaaatgttcgaagcaacagcccgcggtgccaggaggatggccatcctaggggacacagcttgggattttggaagcataggaggcgttttcacgtccgtggggaagctagtccaccagatattcggcaccgcctacggggtgttattcagcggggttagctggaccatgaaaataggaatcggagtgctcctcacctggttaggactaaattcacgaagcaccagcctatcaatgacttgcatcgcagtaggactcgttaccttgtacctaggggtaatggtccaagcggactcaggatgtgtcattaactggaagggccgagaactgaagtgcggctccggaatctttgtgaccaacgaagtgcatacctggacggagcaatacaagttccaagcagactcccctaagcgtctgagcgctgcaataggtaaagcgtgggaagagggggtctgcgggatccgctccgcaacccgcctagaaaatatcatgtggaagcaaatttccaacgaactgaaccatatactgctggaaaacgacatgaaatttactgtagtagtgggagacgtcgccgggatactcgcacaaggcaagaaaatgataagaccccagccgatggaacacaagtacagctggaagtcctggggtaaggcaaagataataggagcagatgtacaaaattcaacgttcatcatcgacgggccgaacaccccagagtgtccggatgaccaaagagcctggaatatatgggaggtagaggactatggatttggaatttttacgacaaacatatggctaaagctccgagacagttacacacaggtttgcgaccaccggttaatgagtgccgcgatcaaggactcaaaggccgtgcacgcagatatgggatactggatcgaatccgagaaaaacgaaacttggaagctagcccgtgcctcgttcatagaggttaaaacatgtatctggccaaaatctcacacgctatggtctaacggagtcctcgagagcgagatgatcataccgaaaatctacgggggaccgatctcccaacacaattaccgccccggatactttacacagacagcagggccgtggcacctcgggaagctagaactcgacttcgacctatgcgaaggaaccacggtcgtagtagacgagcattgcggaaacagaggaccctcgctccgcactacaacagtcacggggaagatcgtccatgagtggtgctgcagaagctgcacattgccacccctacggttcagaggggaagacggctgctggtacggtatggaaatccggccagtgaaagagaaggaggaaaacctagtcaagagtatggtcagcgcagggagcggcgaggtggactccttcagcctcgggctactctgtatctccatcatcatagaagaagtgatgcgctccaggtggatccggaaaatgttaatgactggaaccctgggtgtcttcttcctgctcatcatgggtcagctaacatggaacgaccttatccgtctctgcataatggtcggcgccaacgcaagcgaccgaatgggaatgggcacaacgtatctagcactgatggctaccttcaagatgcgacccatgttcgcagttgggcttctctttcgccgcctaactagcagggaggtactcctcctcacgataggcctaagcctagttgcctcagtagagctacccaacagtctagaggagcttggcgacggcctcgcgatggggatcatgatacttaaattactcacggatttccaatcgcaccagctatgggccaccctactatcgctaacctttataaagacaacctttagcctgcactacgcgtggaagaccatggcaatggtcctttccattgtgtcattgttccccttatgcctaagcacgacttcgcagaaaactacgtggcttcccgttttgctgggctctctcggctgcaaacctctaacgatgtttctcatagccgaaaacaagatatggggtcgcaaatcgtggcccctaaacgaaggcatcatggcagtcggaatagtgtcgatcctgttgtcgagcctactgaaaaacgatgtaccattagcgggccccctcatagcgggaggcatgctcattgcctgctatgttataagcggaagttccgcagacctgtcactagagaaggccgcagaagtgagttgggaggaagaggcggaacactcaggggcctcgcacaacatcctagtagaggttcaagacgatggaaccatgaagatcaaagacgaagaacgagacgatacactaaccatattattgaaggcgacgctgttggcagtatccggcgtctacccgctaagtataccggcaacactcttcgtgtggtacttttggcagaagaagaaacaacggagcggtgtcttgtgggatacaccaagcccacccgaggtggagcgagcagtgcttgacgacggaatatatagaataatgcagcgggggctcctgggacgaagccaagtgggcgtcggagtattccaagagaacgtattccacaccatgtggcacgtgacccggggtgcggtcctcatgtaccagggcaagcggctagaaccgtcctgggcgtccgtcaaaaaggatttaattagctacggcggagggtggcggttacagggaagctggaatacaggcgaagaagtgcaggtcatagcagtagagccaggcaagaatcccaaaaacgtccaaaccgcacccgggacgttcaaaacgccagaaggcgaggtcggggcgatcgccctagacttcaaacccgggacgtcgggcagcccgatcgtaaaccgagaaggaaaaatcgtggggctgtacggaaacggagtagtgacgaccagtggaacctacgtatcggcaatagcccaggccaaggcctcccaagaggggcctctcccggaaatcgaagacgaagtcttcaggaaacggaatctaacaattatggatctacatcccggctcaggaaaaacgagacgatacctccccgcaatcgtcagagaggccataaaacgcaaactgcggacgcttatcttagcaccgaccagagttgtcgcatcagagatggcagaggccttaaaaggaatgccaattaggtaccaaacgacagcagtgaaatctgaacacacaggaaaggagatagtagatctgatgtgtcacgccactttcacgatgcgactgctaagcccagtccgcgtacctaactacaacatgattattatggatgaagcgcactttacggacccgtccagcatagcagccagagggtatataagcaccagagtgggcatgggcgaagccgcggctatatttatgaccgccacgccacccggcagcgtagaagcctttccccaatcaaatgcggtaattcaggacgaagaacgcgacataccagaacgatcatggaactctggttatgaatggatcacagatttcccgggcaagactgtatggttcgtccccagcataaaggcgggaaacgatatagccaactgcctacgcaaaaatggtaaaagggtaatacaattatcccggaagacgttcgatacggaatatcagaaaacgaaaaacaacgattgggactacgtggtaacgacggacatcagcgaaatgggcgcaaacttccgagcggaccgcgtaatagacccaaggcgttgcctaaaacccgtgatcctgaaagacggacccgaacgtgtgatactagccgggccaatgccggtgacagttgcttcggcagcacaaagacgaggaagaatcggacgaaatcacaacaaagaaggtgatcaatacatctacatgggacaaccccttaacaacgacgaggaccacgcacactggaccgaggcaaaaatgctgttggacaacatcaatacccccgaggggatcatcccggctttatttgaacccgaaagagagaagtcggcggccatagacggggaatacagattgcgtggggaagcacgcaaaaccttcgtggaactgatgcgccgaggcgacttaccagtctggctctcatataaagttgcatcagagggattccaatactcagaccgtcgatggtgttttgacggcgaacgaaacaaccaagtactagaggagaacatggacgtcgaaatttggacaaaagagggggagcggaaaaagctccgcccccgatggttagatgcccgaacatacagcgatcctctagcattgagggagttcaaagaatttgccgccggtaggagaagtgtgagtggagacttgatattagaaatcggcaaactaccacagcaccttacacagcgcgctcagaacgcactggataacttggttatgctacacaacagcgaacagggaggcagggcttatagacacgccatggaagaactccctgacaccatcgaaacgctcatgcttctcgccctcatagccgtgctgaccggaggcgtgacgctgttcttcctctcaggcaaaggcctagggaaaacctccataggactactatgtgttatggcatcatctgtcctgctctggatggcctctgtcgaaccccactggatagcagccagcatcatactagagttctttctcatggtcctgttaataccagaaccagataggcaaaggacaccacaggacaaccagctggcatacgtggtgataggcctgctgttcatgatcttgactgtggcagccaacgaaatgggactgctggaaactaccaagaaagacttaggaataggacacgttgccgtcgaaaaccaccatcacgcagcgatgctcgacgtggaccttcacccagcctcagcatggaccctttacgcggtcgccacaacaataataactccgatgatgcgacatacgatcgagaataccacagcgaacataagcctaacagcaattgcgaatcaggccgcaatactgatgggtctggacaaagggtggcccatcagcaagatggacataggagtcccactcctggcgttaggatgctactcgcaagtgaacccactaacattaacagcggccgtactcatgcttgtggcccattacgcgataatcggcccaggcctccaagcgaaggcgaccagagaggcccaaaagaggactgccgccggaattatgaaaaaccctacagtcgacggcattgtagccatagacctcgaccctgtggtatacgacgcaaagttcgagaaacaactcggccagataatgcttctaatattatgcacatctcagatattgttaatgcggacaacgtgggcactctgcgagtccataaccctagccacgggtccgctcacaaccctttgggagggatcgccaggaaagttctggaataccacaatagcagtttcgatggctaacatattcaggggatcatacttagcgggcgccggtctggcctttagcctgatgaaatcactcggcggcggccgaagaggcacaggagcgcagggtgaaacactcggagaaaagtggaaacgtcaattaaaccagttatcgaaaagtgagtttaacacatacaaagggtctggcataatggaagtagaccgaagcgaagcaaaagagggcttaaaacgaggagaaacaacgaagcacgctgtcagccgagggacagcaaaacttaggtggtttgtggagagaaatttagtaaagccggaggggaaagtcatcgacttaggatgcggacgtggaggctggtcatactactgcgccggactcaagaaagtgaccgaagtcaagggctacacaaaaggcggccctggccatgaggaacccataccgatggcaacttacgggtggaacttggtcaaactgcactctggtaaggacgtattctttatcccacccgagaaatgcgataccctgctatgcgacataggagagagtagccccaatcctacaatcgaagaagggaggacattacgtgtactgaaaatggtggaaccatggctcaaagggaaccagttctgtataaagatattgaacccatatatgccaagcgtcgtagaaacgctcgaacagatgcagcgcaagcatggaggcatgctagtaagaaatccgttgtctcggaactccacccacgaaatgtattgggtctcatgcggaaccgggaacatagtcagtgctgtcaacatgacaagccgaatgctactgaatcgattcacgatggctcaccgcaagcccacatacgaacgcgacgtagacctgggggccgggacccgccatgtcgcagtcgagccagaagtagctaacttagacatcatagggcagcgaatagaaaatataaaacacgaacacaaaagtacttggcactacgacgaagacaacccctacaaaacatgggcataccatggaagttacgaagttaaaccctcgggcagcgcaagtagcatggtcaatggcgtcgtaaaactgctgacgaaaccgtgggacgtgatccccatggtcacgcagatagctatgaccgacacaacaccctttgggcaacagcgagtttttaaggagaaagtcgatacgcgcacaccaaaagcgaaaaggggcaccgcgcaaatcatggaagtcaccgcccgctggctatggagctttctgtccagaaataaaaagccacggatttgtacacgagaagaatttacccgcaaagtaaggtctaacgccgcaataggcgccgtattcgtagatgagaatcaatggaactcggccaaggaggctgtcgaagacgagcgattctgggacctggtccaccgcgaacgggagcttcacaagcaaggaaaatgtgccacatgcgtctacaacatgatgggcaaacgggagaagaaactcggagagttcggaaaggccaagggtagtcgagcaatctggtatatgtggctgggggcaagatttttggagttcgaggctctcggattcatgaacgaagaccattggttctcaagagaaaactccctgagtggagtagagggggagggcctacacaaactaggatacatactaagggacattagcaaaatcccagggggcaacatgtacgccgatgacaccgcaggatgggataccagaataacggaagacgacctccaaaacgaggctaaaataactgacataatggagcctgaacacgcactattagcgaaaagcatattcaagctgacctaccagaacaaggtggttagggtgcaacgcccagcgaaaaacggaaccgtgatggatgtgattagtcgcagggaccagaggggctccggacaagtcggcacatacggtttgaataccttcaccaacatggaggcacagctcattagacagatggaatcagaagggatatttagtccgagcgaactggaaacccccaacctggcagaacgagtcctagactggttggagaaatacggtgtagaacgactcaaacgtatggcaataagcggagacgactgcgtagtaaaacccatagatgaccgatttgccacggcgctcacagccttaaacgacatgggaaaagtcagaaaagatataccgcagtgggagccgagcaagggctggaacgactggcaacaagttcctttctgctcccaccactttcatcaacttataatgaaggacggaagagaaatagtagtaccgtgccggaatcaggacgagctagtcgggcgagcgcgagtcagccaaggcgctgggtggagtctaagagagacggcatgcctcggaaaaagctacgcacaaatgtggcaattaatgtactttcaccgacgcgaccttagactagccgccaacgcgatctgcagcgcggtgcccgttgattgggtgccaacttcgcgaacgacttggtcaatacatgcgcaccaccaatggatgacgactgaagacatgctatcggtttggaaccgggtgtggattgaggaaaacccctggatggaggacaaaacacatatctcaagctgggaggacgtcccatatctgggaaaacgtgaagaccaatggtgcggatcactaataggcctcacggcacgcccaacatgggcaaccaacatccaagtagcgattaaccaagtcagaaggctaataggtaacgagaactaccttgactacatgacgagcatgaaacgtttcaaaaatgaatcagagccggaaggggcactatggtaa

SEQ ID NO: 23716 - RNA, 9879 nt, synthetic construct
  misc_feature 1..9879: note = derived and/or modified CDS sequence (opt11) from DENV-1__HE795086__SS-prME
  source 1..9879: mol_type = other RNA
agcgtgaccatgctactcatgctgatgcccacagccctggccttccacctcacgacccgggggggggagccccacatgatcgtgagtaagcaagagcgcggcaaaagtctgttgttcaaaacgagcgccggggtgaacatgtgcaccctcatcgccatggacctgggtgagttctgcgaggacactatgacctacaaatgcccccgcatcaccgaggccgagcccgacgacgtggactgctggtgcaacgccacggacacgtgggtaacctatgggacctgcagccagacaggcgagcaccggcgggacaagcgaagcgtggccctggcgccccacgtgggacttgggctagagacgcgaaccgagacctggatgagcagcgagggcgcctggaagcagatccagcgggtggagacctgggctttgcgccatcccgggttcacggtgatcgccctcttcttagcacacgccatcggcaccagcatcacccagaaggggatcatcttcatcctgctaatgctagtgacaccctccatggccatgcggtgcgtcggaatcggcagccgcgacttcgtagaggggttgtccggcgcgacgtgggtggacgtcgtgctcgagcacgggagctgcgtgaccaccatggccaaggacaagccaactttggacatcgagctgctcaagacggaggtcaccaaccccgcggtgctgcggaagctgtgtattgaagccaaaatctcaaacaccaccacggacagccgctgccctactcaaggcgaggcaaccctcgtggaagagcaggacgccaacttcgtctgccggcgcaccttcgtggaccggggctgggggaacggatgcgggctattcggcaaaggatccctgatcacgtgtgccaagtttaaatgcgtgaccaagctcgagggcaagatagtccaatacgagaacctgaagtatagcgtgatagtgaccgtccataccggagaccagcatcaggtgggaaacgagtcgacagagcacggcaccaccgcgacaatcacgccccaagcccccagcacggagatacagctgaccgactatggggccctgaccctggactgcagcccccggaccggcctggatttcaacgaaatggtcctcctgacgatgaaggaaaagtcctggctggtgcacaagcaatggttcctggacttaccgctgccatggactagcggggcatccaccagccaggaaacctggaaccggaaggacctcctggtaacgttcaagacggcccatgctaagaagcaggaggtcgtggtgctggggtcccaggagggtgccatgcacaccgccctcaccggggctacggagatacagaccagcggcacaaccacgatcttcgccgggcacctgaagtgccgcctgaagatggacaaactcaccttgaagggcatgagctacgtcatgtgcaccgggagcttcaagctggagaaggaggtggcggagacccagcatggaactgtgctcgtgcagatcaagtacgagggcaccgacgcgccctgcaagattcctttctccactcaagacgaaaaaggggtgacccagaacggccggctgatcactgccaacccgatcgtgaccgacaaggagaagccagtcaacattgaagccgagccgccgttcggggagtcttacatcgtgatcggcgctggcgagaaggctttaaaactgtcctggttcaagaaggggagctccattggcaagatgttcgaagccaccgcgcgcggtgcccggcggatggcgatcctcggcgacacagcctgggacttcgggagcatcggcggagtgtttacgtccgttgggaagttagtgcaccagatcttcggcaccgcctacggggtgctgttcagcggggtctcctggaccatgaagatcgggatcggcgttctcctgacttggctgggcctcaatagccggtccacgagtctgtccatgacctgcatcgctgtcgggttggtcaccctctatctaggcgtgatggtgcaggccgacagtggctgcgtcatcaattggaagggcagggaattaaagtgcggaagcggcatcttcgttaccaacgaggtgcacacatggacagagcagtacaagttccaggcggactccccgaagcgcctcagcgctgcgatcggtaaggcctgggaagagggggtctgcggtgtgcggtccgccacccgcttggagaacataatgtggaagcagattagcaatgagctgaaccacatccttctggaaaacgacatgaagttcaccgtggtcgtgggggatgtggcgggcatcctggcccagggaaagaagatgatacgtccccagcccatggagtacaagtactcctggaagtcctggggcaaggccaagatcatcggcgccgacgtccagaatacaacgtttatcatcgacgggcctaacaccccggagtgccccgacgaccaacgcgcgtggaacatctgggaagttgaagactatggttttgggatcttcaccaccaacatttggctcaagttgcgggacagttacacccaggtgtgtgaccaccgcctcatgtcggcggccatcaaggattccaaggccgtccacgcagacatgggctactggatagagagcgaaaagaacgagacctggaagctcgcgcgcgcctcgttcatcgaggtgaagacctgtatttggcccaagagccacaccctgtggtctaacggcgtgctggagagcgaaatgatcatccccaagatatatgggggccccatctcccagcacaactatcggcccgggtatttcacgcagaccgccggaccttggcacctcgggaagctggagctggacttcgacctctgcgagggcaccaccgtcgtggtcgacgaacactgtggcaaccgagggccaagcctacgaactaccactgtcaccggcaagataatccacgagtggtgctgccggtcatgcacgctgccgcccctgcgatttaaaggggaggatggctgctggtacggaatggagatccgcccagtgaaggagaaggaggagaatctggtcaagagcatggtcagcgccggctccggtgaggtggactccttctccctggggcttctgtgcatctctatcatgatagaggaggtgatgcgctcgcggtggtcacgcaagatgctgatgaccggcaccctcgccgtattcttcctgctgatcatggggcagctcacctggaacgacctcatccggctgtgtatcatggtgggcgcgaacgcctccgaccgcatggggatgggcacgacttacctcgctctgatggccacctttaagatgcgccccatgttcgcggttggcctcctgtttcggcgcttaaccagccgggaggtcctactactgacgatcgggctgagtctcgttgcaagcgtcgagctgcccaacagtctggaggagttgggagacggacttgccatgggcatcatgatcctgaagctcttaacggatttccagtcgcaccagctgtgggccaccctcctgtcgctgaccttcatcaagactaccttcagcctccactacgcttggaagaccatggctatggtgctgtccattgtgagccttttccccctctgcctgtccaccacttcccagaagaccacctggctacccgttctcctgggttccctggggtgtaagccgctcaccatgttcctcatcgcagagaataagatctggggccgaaagagctggccactaaacgaggggatcatggcagtggggatcgtgagtatcttactgtccagcctgctcaagaacgacgtccccttggccgggccgctgatcgccggcggcatgctcatcgcctgctacgtgatttccggaagctccgccgacctgtctcttgagaaggccgccgaggtgagctgggaggaggaggccgagcattcaggcgcgtcccacaacatcctcgtggaagtgcaggacgacgggacgatgaagatcaaggacgaggaacgggacgacaccctaaccattctactcaaggccacgctgttggcggtgagcggcgtctaccccctatccatccccgccaccctgttcgtgtggtacttctggcagaagaagaagcaacggagcggggtgctctgggacacgcccagcccgcccgaggtcgagcgagcagtgctcgacgacggcatttaccgcatcatgcagcgcggcttgctggggcgcagccaggtgggcgtcggggtgtttcaggaaaacgtcttccacacgatgtggcacgtcactcggggcgcggtgttaatgtaccaaggtaagcgactcgaaccctcctgggccagcgtgaagaaggacctgatctcctacggcggggggtggcggttgcaggggagctggaacaccggtgaggaggtccaagtgattgctgtggagcccggcaagaaccccaaaaacgtccagacggcccccgggaccttcaagacctcagaaggagaggtgggcgccattgcgctcgatttcaagccggggaccagcggcagccccatcgtaaaccgagagggcaagatagtcggtctgtacggcaacggggttgtgaccacttccggcacctacgtctcagcgatcgcccaggccaaggcgagtcaggacgggcccctcccggagatcgaggacgaagtgttccgaaagcgcaacctcactatcatggacctgcaccccggctcagggaagactcggcgctacctgcccgccatcgtgcgggaggcgatcaagcgcaagctccggacccttattctggccccaacgcgcgtcgtggcatctgagatggcggaggccttgaaaggcatgcccatcaggtaccagaccacagccgtcaagagcgaacacaccggcaaggaaatcgtcgacttgatgtgccatgccactttcaccatgcggctgctctcccccgtgcgcgtgcccaactacaacatgatcatcatggacgaagcccacttcacggacccgagctccattgcggcacgggggtatatcagcacccgcgtcggcatgggggaagccgctgctatcttcatgacagcgaccccacccggctccgtggaggccttcccccagtcaaatgcagtaatccaggacgaggagcgggacatcccggagcgcagttggaacagcgggtacgagtggatcaccgactttcccggcaaaaccgtctggttcgtgccctcgatcaagagcggcaacgacatcgcaaactgcctacgtaagaacggtaagcgcgttatccagctctcccggaaaaccttcgacaccgagtaccagaagacgaagaacaatgactgggactacgtcgtgacgaccgatatcagcgagatgggcgcaaacttccgcgccgaccgggtgatcgatcctcggcggtgtctcaagccggtcatcctgaaggacggtcctgagcgcgtgatcttggccggccccatgcccgtcacggtggcctccgccgcgcagcggcgcgggcgaatcggcagaaaccacaataaggagggcgatcagtacatctatatggggcagcccctcaacaacgacgaggaccatgcccactggactgaggccaagatgctgctggacaacattaacacgcccgaggggatcatcccagccctcttcgaacccgagcgcgagaagtcagccgcgatcgacggcgagtaccgcctgcgcggcgaagcccggaagaccttcgtggagctgatgcgccgcggggacttgccggtctggctaagttacaaggtcgcgtcggagggcttccagtacagcgaccgccggtggtgcttcgacggcgaacgcaacaatcaggtactggaggagaacatggacgtcgagatctggaccaaagagggggaacggaagaaactccgcccccgctggcttgacgcccgcacgtactccgaccccctggccctcagggaattcaaggagttcgcggcgggacgacgcagcgtgtccggggacctgatcctggaaatcggtaagctcccccaacaccttacccagcgcgcacagaacgcccttgataacctcgtgatgctgcataacagcgagcagggcggtcgggcttatcgccatgcaatggaagagctgcccgacaccatcgagaccctcatgctgttagccctcatcgccgttctgacgggaggggtgaccctcttcttcctctccggccgggggctgggcaagacaagcatcggactgctatgcgtgatggcgtcgtccgtcctgctgtggatggcatccgtggagccacactggatcgccgccagtatcatcctcgagttcttcctgatggttctgctcatccctgagcccgatcgacagagaactccgcaggacaaccagttagcctacgtcgtcatcgggcttctcttcatgatcctgactgtggccgcgaacgagatgggcttgttagagacgaccaagaaggacctggggatcggccacgtagccgtggagaatcatcaccacgccgcaatgctggacgtggacctccaccccgccagtgcctggaccctatacgcagtcgccaccacgatcatcacccccatgatgcgccacaccatcgagaacaccacggccaatatcagcctgaccgccatcgcgaatcaggccgccatcctcatggggctggacaagggctggccgatttccaagatggacattggcgtgccccttctcgccctggggtgctactcacaggtgaacccgctgaccctcaccgcggccgtcctgatgctagtggcgcattacgcgatcatcggcccagggctccaggccaaagcgacgcgggaggcccagaagcgcaccgccgccggcataatgaagaaccctaccgttgacgggatcgtggccatcgacctggaccccgtggtttacgacgctaagttcgagaagcagctgggccagatcatgcttctgatcctgtgcacctcccagatcctcctgatgcgcaccacctgggccctctgcgagagcatcaccctcgccaccggccccctgacgaccctgtgggaggggagccccgggaagttctggaatactaccatcgccgtgtctatggctaacatcttccgggggagctacctcgcgggcgccggccttgccttctccctgatgaagtccctcgggggcgggcgccggggcactggcgcccaaggcgagacgctgggcgagaagtggaagcgccagctgaaccaattatccaagtcagagttcaacacgtacaagcggtccgggatcatggaggtggaccgcagcgaggcgaaggaaggcttgaagcgcggggagaccacgaagcacgccgtctcccgcggcaccgccaagctgcgctggttcgtcgagcgcaacctcgtgaagccggaagggaaggtgatcgacctgggctgcggacgcggcgggtggagctactactgcgccgggctgaaaaaggtcaccgaggtaaagggttacaccaagggcgggcccggccacgaggagcccatacctatggccacatacggttggaaccttgtgaagctccactccggcaaggacgtttttttcataccgccggaaaaatgcgacaccctgctgtgcgacataggtgaaagctccccaaaccccacaattgaggaaggcagaaccctccgggtgctgaagatggtggagccgtggctgcgcgggaatcagttctgcattaaaatcctcaatccctacatgcccagcgtcgtggagacgctggagcaaatgcagcggaagcacggcggcatgctggtgcgcaacccacttagcagaaactccacccacgagatgtactgggtctcctgcgggaccggcaacatcgtgagcgcagtgaacatgaccagtcgcatgctattgaaccgtttcaccatggctcaccgaaagccgacatacgaacgcgacgtcgacctgggggccggcacacggcacgtggccgtggagcccgaggtcgccaaccttgatatcatcggccagcgcatcgagaacatcaagtacgagcacaagagcacttggcactacgatgaggacaacccctacaagacctgggcgtaccacgggtcttacgaggtaaaacctagcggtagcgcctcctctatggtaaacggtgtggtgaagctgctcacaaagccctgggacgtcatccccatggtcacccagatagccatgaccgacaccacgcccttcggccagcagcgggtgttcaaagagaaggtcgacacccgcacgcccaaggcaaagcgggggaccgcccagatcatggaggtgacggcgaagtggctgtggggattcttgtcccgcaacaagaagccgcggatctgcacccgggaggagttcacccggaaggtgcggagcaatgccgctatcggcgccgtcttcgtggacgagaaccagtggaactctgcaaaggaggcggtggaggacgagcggttctgggacctcgtccaccgcgaacgggagctacataagcaggggaagtgtgcaacctgcgtgtacaacatgatgggcaaacgcgaaaagaaactgggtgagttcggcaaagccaagggcagccgggccatctggtacatgtggctcggcgcgcgcttcctagaatttgaggcactgggattcatgaacgaggatcattggttctcccgggagaactctctctctggggtggagggcgaggggttacacaagctgggctacatcctccgcgacatctccaagatccctgggggcaacatgtacgctgacgacacggccggctgggacacccggatcacagaagacgacctacaaaacgaggccaagatcaccgacatcatggagcccgaacacgcgctgctcgcgaaatccatcttcaagctgacgtaccagaacaaggtcgtgcgggtgcagagaccggccaagaacgggacggtcatggacgtcatcagccgccgcgaccagcggggcagcggccaagtggggacctacggcctgaacacctttacgaacatggaggcccagctcatccgccagatggagagcgaaggtatcttctcccccagcgagctggagacccctaacctggccggccgggtactcgactggctggagaagcacggcgtggagcgcctgaagcgaatggcgatttccggcgacgactgcgtcgtcaagcccatcgatgaccgcttcgccacagcactcaccgccttaaacgacatggggaaggtgcggaaggatatcccgcagtgggaacccagcaaggggtggaacgactggcaacaggtccccttctgtagccaccactttcaccagctgatcatgaaggacgggcgcgagatcgtagttccctgccggaaccaggacgagctcgtgggtcgcgcaagagtgtcgcagggcgcggggtggagcctgcgcgagaccgcctgtctcggcaagtcctatgcccagatgtggcaactcatgtacttccaccggcgcgacctgcggctggccgcgaacgccatttgcagcgccgtgccggtggactgggtccccacctcccgcaccacctggagtatccacgcccaccaccaatggatgacgacagaggacatgctcagcgtgtggaaccgggtgtggatcgaggagaacccctggatggaagacaagacccacataagctcatgggaggacgtcccctatctggggaagagagaagaccagtggtgcggcagcctgatcggcctcaccgcccgagcgacgtgggccaccaatatccaagtggccatcaaccaggttcgccgcctgattggcaacgagaattatctggactacatgacgtccatgaaacgattcaagaacgagagcgatccggagggcgccctctggtag

SEQ ID NO: 23717 - RNA, 9879 nt, synthetic construct
  misc_feature 1..9879: note = derived and/or modified CDS sequence (opt11) from DENV-1__AB189120__SS-prME
  source 1..9879: mol_type = other RNA
agcgtgaccatgttgctcatgctgctaccaacagtgctaacctttcatctgacgacccgcggcggtgagccccacatgatcgtcagcaagcaggagcggggcaagagcctcctgttcaaaaccagtgccggagtgaacatgtgcactcttattgccatggacctgggcgagctctgcgatgataccatgacctacaagtgccccagaatcaccgaaaccgagcccgacgacgtggactgttggtgcaatgccacagaaacctgggtgacctacgggacgtgctcgcagaccggcgagcatcggcgcgacaagcggtccgtggccctggcgccccacgtgggcctggggttagagacccgtaccgaaacgtggatgagctcagagggcgcgtggcggcaaatccagaaggtggagacatgggcgctgcgccaccccgggttcacagtcatcgcactgttcttagctcatgcgatcggcacctcgatcacgcagaaaggcatcatcttcatactgctgatgctcgtcacgcccagcatggccatgcgttgcgttggcatcggcaacagagattttgtggaggggctcagcggggccacctgggtcgacgttgtgctggagcatggttcgtgcgtgaccactatggccaaggacaaacccacactagacatcgaactgctgaagaccgaagtgaccaaccccgccgttctccgtaagctgtgcatcgaagccaaaatcagcaacacgaccaccgatagccgttgcccgacccaaggcgaggccaccctggttgaggagcaggacgcgaatttcgtatgccggaggaccttcgtcgataggggctgggggaacggctgcgggttattcggcaaggggagcctgatcacgtgcgctaagttcaagtgcgtcacgaagctggaagggaaaatcgtccagtacgagaacctcaagtactcggttatcgttactgtacacaccggagaccagcatcaggttgggaacgagactaccgagcacggaaccatcgccacgattacgccccaggctcctacttctgagatccagttgaccgactatggggccctgacgttagactgcagcccccggaccggcctggacttcaacgagatggtgttgctcaccatgaaggaaaagtcctggctggtgcacaagcagtggttcctggacctcccgctgccttggactagcggcgcgagcacgagccaggagacctggaaccgacaagacctgctcgtcaccttcaaaaccgcccacgccaaaaagcaggaggccgtggtgctgggctctcaggagggcgcaatgcacacggctctgaccggggccaccgagatccagacctccggcacgaccaccatattcgcgggacacctaaagtgccgcttgaaaatggacaagctgaccctcaagggaatatcctatgtcatgtgcacagggagcttcaagctggagaaggaggtggcggaaacccagcacggcactgtgttagttcaggtgaagtacgagggcaccgacgctccctgcaagatccccttctccagccaagacgagaaaggggtgacccagaacggccggctggtcaccgccaacccgattgtcaccgacaaagagaagccagtcaacattgaagccgagccgcccttcggggaaagttacatcgtcgtgggagccggtgaaaaggccttaaagctttcctggtttaagaaggggagcagcatcggcaagatgtttgaggcgaccgcccggggcgctagacgcatggccatactgggtgacacggcttgggacttcgggtccatcggcggcgtgttcaccagcgtcgggaagctcgtccaccagatcttcggcaccgcgtacggggtgctgttctccggcgtctcttggactatgaaaatcgggatcggcatccttctcacatggctgggcctgaactcgcgcagcacttccctctctatgacctgcatcgccgtgggtatggtgaccctgtacctcggagtcatggtgcaggcagactctgggtgcgtgatcaactggaagggcagggagttgaaatgcgggtcgggcatcttcgtaacgaacgaagttcacacctggaccgagcaatataagtttcaggctgacagtcccaagcgtctttccgctgcgattggcaaggcctgggaggagggtgtctgcggcatcaggagtgccaccaggcttgagaacatcatgtggaagcaaatctccaacgaactcaaccacatcctgttggagaacgacatgaagttcaccgttgtagtgggggacgtcagcggcatcctcgctcaaggaaagaagacgatcagaccacagcccatggaacacaagtactcctggaagagctggggcaaggccaaaatcattggcgctgacgttcagaacaccacctttataattgatgggcccaacaccccggagtgccctgacgaccaacgcgcctggaatatatgggaggttgaggactacggcttcgggatcttcacgaccaatatctggctgaagctgcgggacagttacacccaggtctgcgaccaccggctcatgagcgccgccatcaaagattccaaggccgtgcacgcagacatgggctactggattgagagcgagaagaacgagacctggaagctggcccgcgcttccttcattgaggtgaagacgtgcgtctggcccaaaagccacacactttggtccaacggcgtgttagaaagcgagatgatcatccccaagatatacgggggcccgatctcccagcacaattacaggcccgggtacttcacccagacggctggcccatggcaccttgggaagctggagctcgacttcgacttatgcgaaggcacgaccgtggtggtggacgagcactgtggcaaccgggggccgtctctacgaaccaccacggtaaccggcaagatcattcatgaatggtgctgccggtcctgcaccctgccgccactgcgcttcaagggcgaggatggctgctggtacggaatggagatccgcccggtaaaagaaaaagaagagaatctggtaaagagcatggtgtccgcggggtccggcgaggtcgactctttctccctggggctgctgtgcatcagcatcatgatcgaggaagtgatgcggtcccggtggagccgcaagatgctcatgaccggcacgttggtggtcttcctgctcctgaccctggggcagctgacctggaacgacctgataaggttgtgcattatggtgggcgccaacgcctccgacaacatggggatgggcaccacctacctggccctgatggccaccttcagaatgcgcccgatgttcgcagtcggactcttattcagacgcctgacaagccgggaggtgcttttgctgaccgtggggctgtccctcgtcgcaagcgtggagctgccgaactccctggaggagctcggtgacggtctggccatgggtatcatgatactgaagctcctgaccgacttccagagccaccagctttgggccaccctcctatcgctgaccttcgtcaaaaccacgctcagcctgcattatgcctggaagaccatggcgatgatactttccatcgtttcgctcctccccctgtgcttatccaccacgagtcagaagacgacatggctaccggttctgctcggctcactggggtgtaagccgctcacgatgttcctcatcaccgagaataaaatctggggccgcaagagctggcccctgaatgaggggatcatggctgtgggcatcgtcagtatcctactctccagcctgctgaaaaacgacgtgcccctcgccgggcccctgatcgcaggcggcatgttgatcgcatgttacgtgatctccggatcttccgccgacttgagcctggagaaggccgccaaggtctcctgggaggaggaagccgagcactctggtgcatcccacaacatcctggtggagatacaagacgacgggaccatgaagatcaaagacgaggagcgggacgacaccatcaccattctcttgaaggccaccctgctcgccattagcggcgtctacccgatgtcaatccctgcaacactgttcgtgtggtacttctggcagaagaagaagcagcgcagcggagtgctgtgggacacgcctagcccgcccgaggtggaaaaggctgtcctggacgacggcatatatcggatcctccagcgcggcctgctggggcggagccaggtaggcgtgggggttttccaggagggcgtattccacaccatgtggcatgtaacccgcggggcggtcctcatgtaccaggggaaacggctggagccttcctgggcaagtgtgaagaaggacctgatctcttacggcggtggctggcgcttccaggggagttggaacaccggagaggaggtgcaggtcatcgccgtggagcccgggaaaaaccccaagaacgtgcagacggccccaggcaccttcaagacatcggagggcgaggttggggcgatagccctcgactttaagcccggcaccagcgggagccccatcgtgaaccgggagggcaagatagtgggcctgtacgggaacggcgtcgtcacgacctccggaacctacgttagcgccatcgcccaggccaaggcttcccaagagggccccctgccggagatagaagacgaggtcttccgcaagcggaacctcaccatcatggacctgcaccccggtagcggcaagacgcgccggtacctgccagcgatcgtgcgtgaggcaattaagagaaaactccgcaccctggtgctggcccctacccgggtcgtggcctccgagatggcggaggcccttaagggcatgcccatccgctaccagaccacggccgtcaaaagcgaacataccggtaaggaaatcgtcgacctaatgtgccacgccaccttcaccatgcgcctgctaagccccgttcgggtacccaactacaacatgatcatcatggatgaggcccacttcacggaccccgcgagcatcgccgcccgcggctacatctccacccgggtcgggatgggcgaagccgccgcgatcttcatgaccgccacgccgcccgggagtgtcgaggccttcccccagtccaacgccgtgatccaagacgaggagaaggacatcccggagcggagctggaactccggctatgactggatcacggacttccccggtaaaacagtatggtttgtaccgagcataaagtccgggaacgacatcgcaaactgcctgcgcaaaaacggcaagcgcgtgatccaactgagccggaagacctttgacaccgagtatcagaagacgaagaataatgactgggactacgtagtcaccaccgacatcagtgagatgggggcgaacttccgcgccgaccgggtcatagacccccgccggtgtctgaaaccagtgatactgaaggacggccccgagcgcgtgatcctggctgggcccatgcccgtcacagtggccagcgcagcccagcggcggggtaggatcggccgaaatcaaaacaaggagggggatcagtacatctatatgggccagccactaaacaatgacgaggatcacgcccactggacggaggccaagatgctgctggacaacattaacacccccgaggggatcatccccgccctcttcgagcccgagcgagagaagagcgcggccatcgacggggagtaccgcttacgcggggaggcacgcaagaccttcgtcgagctgatgcgccggggagacctcccggtctggctgagctacaaggtggccagcgaaggtttccaatactccgaccgccgctggtgcttcgacggggagcgcaacaaccaggtgctggaggagaatatggatgttgagatctggaccaaggaaggagagcggaaaaagctccgcccccgctggctcgatgcccgcacgtactcggaccccctggcgcttcgggagttcaaggagttcgcggccgggcgcagatccgtgtctggcgacctgatactggagatcggcaagctcccccaacacctgacccagcgcgcccagaacgccctggacaacctcgtaatgctgcacaactccgagcagggcggcaaggcgtacaggcacgccatggaggaactgccggataccatagagaccattatgcttttggcgttaatcgccgttctcaccgggggcgtgacgttgttcttcttgtccgggcgcggtctcggcaagacgtccataggactactgtgcgttatgagctcatctgcgctcctgtggatggcctccgtggagccacactggatcgccgcgagcatcatcctggagttcttcctcatggtgctgctgatccccgagcccgaccggcagcgcacgccgcaggacaaccagttagcctacgtggtcatcggcctgctgttcatgatcttgacggtggcggccaatgagatgggccttctggaaacgaccaaaaaggacttgggcatcgggcacgccgcagccgaaaaccaccaccacgcggcaatgctggacgtggacttgcaccccgcctccgcctggaccctctatgccgtagcgaccacgataatcacccccatgatgcggcacaccatcgagaacaccacggccaacattagcctgaccgccattgccaatcaggctgcgatcctgatgggccttgacaagggctggccgatctccaagatggacatcggggtccccctgctggcgcttggctgctatagtcaagtgaaccccctgaccctgactgcggccgtattgatgctggtggcgcactacgccatcattggccccggcttgcaggccaaagctacgcgcgaagcccagaaacggaccgcggccgggatcatgaagaacccaacggtggacggcatagtcgccattgacctcgaccctgtggtctacgatgccaagtttgagaaacagttagggcagatcatgctgctcatcctgtgcacctcccagatcttactcatgcgcacgacgtgggcgctatgcgagagcataacgctggcgaccggtcccctcacgaccctgtgggaaggctcccccgggaagttctggaataccaccatcgctgtcagcatggcgaacatcttccggggctcctacctggccggcgctgggctcgcgttttccttaatgaagtccctgggcgggggccgccgcgggacgggcgcccagggcgagacgctcggggagaagtggaagcggcaactgaaccagctctccaagagtgaattcaacacctacaagcgctccggcatcatcgaagttgaccggagcgaagccaaggaggggctcaagcgcggcgagaccacgaagcacgccgtatcccgggggaccgcgaagctgaggtggttcgtcgagcggaacctggtgaaaccggaggggaaagttatcgacctaggctgtggacgcgggggatggagctattactgcgccggcctcaagaaggtgactgaagttaaggggtacaccaagggcgggcccggccacgaggagcccatacccatggccacgtacggctggaacctagtcaagcttcattccgggaaggacgtcttcttcatcccgcccgaaaaatgcgacactctactctgcgacataggcgagagctcccccaaccccaccatagaggaggggcggactttacgcgtgctcaagatggtggaaccgtggctgcggggaaaccagttctgcatcaaaatcttgaatccatacatgcccagcgtcgtggagaccttagaacagatgcagcgcaagcacggcggcatgctggtgaggaaccccctgagcagaaacagcacgcacgagatgtactgggtttcctgcggcactggaaacatcgtgagcgcagtgaacatgacctcccggatgttgttaaacagattcactatggcccaccggaagccgacgtacgagcgcgatgtcgacttgggcgcgggcacccggcacgtggccgtggagcccgaagtcgccaatctagacatcatcgggcagcgcatcgaaaatatcaagaacgagcacaagtcgacctggcactacgacgaggacaacccttacaaaacgtgggcttaccacggctcatacgaggtgaagccgagtgggagcgcctcctcgatggtcaacggcgtggtgcgcctgctaacgaagccctgggacgtcatccccatggtgacacaaatcgcgatgaccgacaccaccccctttggccagcagagggtattcaaagagaaggtcgacacccgcacccccaaagccaagcggggaaccgcccagatcatggaggtgacggccaagtggctctggggcttcctgtcccgtaataagaagccgcggatctgcacccgcgaggaattcactcggaaggtacgcagcaacgccgcgatcggggccgtcttcgtggacgaaaaccagtggaactccgccaaggaggccgtggaagacgagcggttctgggacctggtacgccgggaacgcgagctccacaaacagggcaagtgcgccacgtgcgtgtataacatgatggggaaacgggagaagaagctgggcgagtttgggaaggccaaggggagcagggctatctggtacatgtggctgggcgcccggttcctcgagttcgaggccctgggcttcatgaatgaggaccattggttctcccgcgagaacagcctgtccggcgtggagggggaggggctccacaagctggggtatatcttacgggacatcagcaaaatccccggcgggaacatgtacgcggacgacacggccgggtgggacacccgcattaccgaggacgacctccagaacgaggccaagatcaccgacatcatggagccggagcatgccctgctcgctacgtccatcttcaagctcacctaccagaacaaggtagtccgggtgcagcgcccggcgaagaacggcaccgtgatggatgtgataagtcggcgcgatcagcgcgggtcgggccaggtgggcacgtatgggctgaacacgttcaccaacatggaggcccagctgatccggcaaatggaaagcgaaggcatcttctcgcccagtgaacttgagacccccaacctggccgggagggtactggactggctcgaaaagcatggcaccgagcggctgcgaaggatggccatatcaggggacgattgcgtagttaagccaatcgacgacagattcgccacggcgctgaccgccctcaacgatatgggcaagatcaggaaagacatcccgcagtgggagcccagcaagggctggaacgactggcagcaggtgcccttctgcagccaccacttccaccagctgatcatgaaggacgggagggaaatagtggtaccctgcagaaaccaggacgagctggtcgggcgcgcccgggtgtcccaaggggccggctggagcctccgcgagaccgcctgtttagggaagtcctacgcgcagatgtggcagttaatgtactttcaccgaagagatttgcgcctggccgccaacgccatttgcagcgcggttcctgtcgattgggtacctacctcccgcacgacctggagcatccacgcgcaccaccagtggatgaccaccgaggacatgctgagtgtgtggaaccgcgtctggatcgaggagaacccttggatggaggacaagacccacgtgagctcctgggaggacgtgccgtacctcggaaaacgcgaggatcagtggtgcggcagcctgatcgggctgacggcccgggccacctgggcaaccaacatccaggtcgctatcaaccaggtgcgccgcctcatcgggaacgagaactacctggactacatgacctctatgaagcggttcaaaaatgagagtgacccggagggggccttatggtga

SEQ ID NO: 23718 - RNA, 9879 nt, synthetic construct
  misc_feature 1..9879: note = derived and/or modified CDS sequence (opt11) from DENV-1__AB189121__SS-prME
  source 1..9879: mol_type = other RNA
tcggtcaccatgctgttcatgctcctgcccaccgccctggcattccacctcaccacccgaggcggggaacctcacatgattgtgagcaagcaggaacgagggaaaagcctactcttcaaaacctcggccggggttaacatgtgcaccctgatcgccatggaccttggcgaactgtgcgaggacacaatgacctacaagtgcccccgcattaccgagaccgagcctgacgacgtggattgctggtgcaatgccaccgagacctgggtgacctacgggacgtgtagccaaactggcgaacaccgaagagataagcgatccgtggcactagcgccccacgtgggcctcgggctggagacccgcaccgaaacttggatgtcctcggagggcgcctggcgacagattcagaaggtggagacctgggctctccgccacccagggttcacagtgatggctctgttcctggcccacgcaatcgggaccagcatcacccaaaagggcatcatctttatcctcctgatgctggtgacgccatccatggccatgcgctgcgtcggcattggcaaccgggatttcgtggaagggctcagcggagccacgtgggtggacgtagtgctggagcacgggtcctgcgtgaccaccatggccaaagataagcccacgctggacatcgagctcctgaaaactgaggtcactaaccccgcagtgctgcggaagctctgcatcgaggcgaagattagcaacaccacgaccgactcgcgatgcccgacccagggcgaggctaccctggtagaggaacaggacactaacttcgtctgcaggcgcacctttgtggaccgggggtgggggaacggctgcgggctgttcggcaaggggtcgctcatcacgtgcgccaagttcaagtgcgtgacgaagctggagggtaagatcgtccagtacgaaaatctgaaatattccgtaattgtcacagtccatacaggagaccaacaccaggtgggcaacgagacgaccgagcatggtaccacggctatcatcacgccccaagcgcccacgagcgagatccagctcaccgactatggggctttgacgctggactgtagcccccgcaccggcttagatttcaacgagatggttttactgactatgaaggagaagtcctggctcgtccacaagcagtggtttctggacctcccgctcccctggacctccggtgcgagcacgagccaagagacctggaaccggcaggacttactggtaaccttcaagaccgctcacgccaagaagcaagaagtcgtggtgctcggctcccaagagggcgccatgcacacggccctgaccggcgcgaccgagattcagactagcggtacgacgacgatcttcgccgggcacctgaagtgccggctcaagatggacaagctgaccctgaagggcgtctcctatgtgatgtgcacagggtccttcaaactcgagaaggaggtggccgagacccagcacgggactgtcctggtccaagtgaaatacgagggcacagacgccccctgcaaaatccccttcagcagccaggacgaaaagggggtcattcagaacgggcggttgatcacggcgaaccctatcgtaacggacaaggagaagcccgtgaatatcgaggcggagcctcccttcggagagtcctacatcgtagtgggcgccggcgagaaggccctgaagctcagctggttcaagaaagggagcagcatcggtaagatgttcgaggctaccgcccgaggggcccggagaatggccatcctgggcgacaccgcctgggacttcggatccattggaggcgtgtttacgtctgtcgggaagctggtgcaccaaatcttcggcaccgcatacggggtactattctccggcgtcagctggaccatgaagatcggaatcgggattctgcttacctggctcggcttgaactcccgaagcacatccttatccatgacgtgcatcgcagtggggatggtaaccctctacctgggcgttatggtgcaggcagactcagggtgcgtgatcaattggaagggacgggagttgaagtgcgggtctggaattttcgtcaccaacgaggtgcatacgtggaccgagcagtacaagttccaggcggacagcccaaagcgtctctccgcagcgatcggcaaggcctgggaggagggtgtatgcggcatacggagcgctacccggctggaaaacatcatgtggaagcagatcagtaacgagctgaaccacattctcctggaaaatgacatgaagttcacggtcgtggtaggtgacgtcagcggcatcctagcgcagggtaagaagatgatccgtccccagccaatggagcacaagtattcgtggaagtcctggggcaaggccaaaataatcggcgctgacgtacagaacatcacgttcatcatcgatgggccgaacacgtcggagtgccccgacaaccagcgagcctggaatatatgggaggtggaggactacggcttcgggatattcactaccaacatctggctcaaacttcgggacagctacacccaggtatgcgatcacagactaatgtctgccgcaattaaggacagcaaggcagtgcacgcggacatgggttactggattgagtccgagaagaacgagacatggaagctcgctcgagcgagcttcatcgaggtgaagacatgtatctggcccaaatcgcacacactgtggagcaacggcgtcctcgagtcagaaatgatcatccccaaaatctatggaggccccgtatcccagcataactaccgcccggggtacttcacccagacggccggcccttggcaccttgggaagctggagctggacttcgacctctgcgagggcacgaccgtggtcgttgacgagaactgcggtaaccggggtccctccctgcgcaccacgaccgtgaccggaaagaccatccacgagtggtgctgccggagctgtacgctgccgcccctccgcttcaaaggtgaggatgggtgctggtacgggatggagatcaggcctgtcaaagagaaggaggagaatctggtcaaatctatggtgtccgcgggctccggcgaagtcgactccttcagcctggggctcttatgcatctccatcatgatcgaggaagttatgcgcagccggtggagccgcaagatgctgatgacgggaacattggccgtgttcctgttgctcactatggggcagttaacgtggaacgatttgatccgtctctgcatcatggtcggcgccaacgcgtccgacatgatggggatgggcaccacctacctggctctgatggcgacctttcgcatgcggcccatgttcgcagtaggcctcctgttccggcgcctaacgtcccgagaggtcctcttactgaccgtggggctctctctggtggcctcggttgagctgccgaacagcctcgaggagttaggggacggattggccatgggcatcatgatgctcaaacttctgacggatttccagccccaccagctctgggcgacattgctgtccctcacgtttgtgaagaccacgttcagtctgcattacgcatggaagaccatggccatgatcctgtcaatcgtgagcctactgcccttatgcttaagtacgacaagccagaaaaccacctggctgcccgtcctgctcggctccctgggttgcaagccgctgacgatgctcctgattaccgagaacaaaatctggggacgccggagctggccgctgaatgaggggatcatggccattggcatcgtgtctatactcctgtccagccttcttaagaacgacgtgcccttggctgggccacttatagcgggaggaatgttgatcgcctgctatgttatatcgggcagctccgccgacttgtccttagagaaggctgccgaggtctcctgggaagacgaggccgagcactcaggcgcgtcccacaatatcctcgtggaggtccaggacgacgggaccatgaagatcaaagacgaggagcgagatgacaccctgaccatcctgctcaaggccacgctgctggcgatcagcggagtgtatcctatgtccatcccggccaccttattcgtgtggtacttctggcagaaaaagaagcagcggagcggggtcctttgggacaccccaagtccgcctgaggtggagcgcgcggtgttggacaacggaatctaccggattctgcagagaggcctgctgggtcgaagccaggtcggtgtgggggtgttccaggaaggagtcttccacacgatgtggcacgtgacccgcggagccgtgctcatgtaccagggtaagcgcctggaaccgtcctgggcatccgtcaagcgggacctaatcagctacggcggagggtggcggttccaggggtcatggaacactggcgaggaggtccaggttatcgcagtagagccagggaaaaacccgaaaaacgtgcaaaccactccggggacgtttaagacgcccgagggcgaggtgggggccatcgcgctcgacttcaagcctggcacctctggcagccccatcgtcaaccgcgagggtaagatcgtgggcctatatgggaacggcgtggtcaccacgtcggggacctacgtgtccgccatcgcccaggccaaggcgagccaggagggtccgttgcccgaaatcgaggacgaggtgttccgtaagcggaacctgaccatcatggacctacaccccgggtccggcaagacccgtcgctacctcccggcgatcgtccgggaagccataaaacgcaagctgcgaaccctcgtactggcccccacgcgagttgtagcctcggaaatggcggaagccttaaaaggcatgcccatacgctatcagactaccgccgttaagtccgagcacactggtaaagagatagtggacctcatgtgccacgcaacgttcaccatgcggctcctgtctccagtgcgcgttccgaactacaacatgatcatcatggacgaagcccattttaccgaccccgcgtccatcgcggcccggggttacattagcacgcgcgtggggatgggcgaggccgcagccatttttatgacagccacgcctcctgggtcggtagaggcctttccgcagtccaatgccgtcatccaggacgaagagagagacatccccgaacgctcctggaacagcggttatgagtggattaccgacttccccggcaagacagtatggttcgtacccagtatcaagagcgggaatgacatcgccaactgcctccggaagaacggcaagcgcgtggtgcagttatccaggaagacctttgacactgagtaccaaaagaccaagaataacgactgggactatgtcgttacgaccgacatcagcgagatgggggcgaacttccgcgccgatcgggtaatcgacccgcgccggtgccttaaaccagtgatcctcaaggacggccccgaacgcgtgatccttgccggacccatgccggtcaccgtggcgagcgcggcccagcggcgcggacggatcggacgcaaccccaacaaggagggtgaccagtacgtgtacatgggccagcccttaaacaacgacgaagaccacgcccactggaccgaggccaagatgctcctggacaacatcaatacgcccgaggggatcatcccggccctgtttgaacctgagcgcgagaagtcggccgcgattgacggggagtaccggctccgcggggaggctcggaagactttcgtcgagctgatgcgcagaggcgacttgccggtgtggttgtcctacaaggtggcgagcgagggcttccagtactcagaccgccggtggtgcttcgacggggagcgcaacaaccaagtcctggaagagaacatggacgtggagatctggaccaaggaaggagagcggaagaaacttcgcccccggtggttggacgctcgcacctactccgacccgttagcgctgcgggaatttaaggagtttgccgccgggcgtcggagcgtgtccggtgacctcatcctggagattggaaagctgccccagcatctcacgcaaaaggcccagaacgccctggacaacctggtcatgctccacaacagcgagcagggaggcaaagcgtacagacacgccatggaggagctgccagataccatagagaccctgatgctcctggcgcttatagccgtgctgaccggaggcgtgaccctgttcttcctgtccgggagaggactcggcaagacgtctatcgggctgctctgtgtgatggcatccagcgccctgttgtggatggcaagtgtggagccccactggatcgccgcctcaatcatattggagttcttcctcatggtgctgctgatcccggagcccgaccgacagcgcacgccccaggacaaccaactcgcgtacgttgttatcggcctgcttttcatgattctcaccgtagccgccaatgagatggggctgctcgagaccacgaagaaggacctcggcattgggcacgccgccgcggagaaccaccaccacgctgccatgctagatgtcgatctccaccctgcctccgcctggaccctctacgcggtggccaccaccataatcacgcccatgatgcgacatacgatcgagaacaccaccgccaacatcagtctgacggctatcgcgaaccaggcggccatcctgatgggcctcgacaagggctggccaatttccaagatggatatcggggttcccctgctagccctcggctgctactcgcaggtcaatccgctgaccttgaccgccgcggtactaatgctggtggcgcattatgcgatcatcggccccggcctgcaggccaaggcgacacgggaggcgcaaaagcgaacggccgccgggattatgaaaaaccccaccgtcgacggcatcgtggccattgacctcgaccccgtggtctatgacgccaagttcgagaagcaactgggccagataatgctgctcatcttatgtacctctcaaatcctgctcatgcgcaccacgtgggcgctctgcgagtccatcaccctggccaccggaccgctcaccactctgtgggagggcagcccgggaaagttctggaacaccaccatcgcggtaagcatggccaatatcttccgggggtcctacctcgccggcgcggggctggccttcagcctgatgaaatcgctagggggtggccgcaggggcaccggcgcccaaggcgagaccctcggggagaaatggaagagacagctgaatcagttatctaagtccgagtttaatatctataagcggtccggcatcatcgaagtggaccgcagcgaggccaaagaggggttaaagcgtggcgagaccaccaagcacgcggtatcgcgcgggaccgcaaagctccgttggtttgtcgaacgcaacctggtgaagccggagggcaaggtcatcgacctgggctgcgggcggggcgggtggtcatactactgcgccggcctgaagaaggtgacggaagtgaagggatatacgaagggcggacccgggcacgaggaacccatccccatggccacctatgggtggaacctggtgaagttacactccggtaaagacgtgtttttcacgccacccgagaaatgcgatacgctgctgtgcgacattggcgagtcgtcccccaaccctaccatagaagaaggaaggaccctgcgggtacttaagatggtcgaaccctggctgcggggcaaccaattctgcatcaagatcctgaacccctacatgccgtctgtggtggaaacactcgagaaaatgcagcgcaagcatggaggaatgttagtcagaaaccccctgtcccggaacagcacccacgagatgtactgggtgtcctgcggcacgggaaatattgtatctgccgtcaacatgacctcacgtatgctcttaaataggttcaccatggcccaccgtaaacccacctatgagcgcgacgtagacctgggtgccggcacgcgtcacgtggccgtggagcccgaagtggccaacctcgacatcatcggccagagaatcgagaacatcaagaacgagcataagagcacgtggcactatgacgaggataatccgtacaagacctgggcctatcacggctcctacgaggtcaaacccagtggctccgcaagcagtatggtcaacggggtggtccggctcctaaccaagccctgggacgtgatccccatggtgacgcagattgccatgacagacacgacaccgttcgggcagcaacgtgtgttcaaagagaaggtggacacgcgtaccccgaaggccaaacgcggcaccgcccagatcatggaggtgaccgcccggtggctctggggctttctgtcccgcaacaagaagccccggatctgcacgcgcgaagagttcacccggaaggtccgcagcaacgctgctattggggccgtgttcgtggacgagaaccaatggaactccgccaaggaggcggtcgaggatgagcggttctgggacctggtgcaccgcgagcgggaactccacaagcagggcaagtgcgctacctgtgtttacaacatgatggggaagagagaaaagaagctgggcgagttcgggaaagctaaaggcagccgggcaatctggtacatgtggctgggagctcggtttctcgagtttgaggcgttaggcttcatgaacgaagaccactggttctccagggagaacagcctgtccggcgtcgagggagagggcctgcacaagctagggtacattctgcgtgatatatcgaagataccgggaggcaacatgtacgccgacgacaccgcagggtgggacacgagaatcacagaggacgacctccaaaacgaagccaagatcaccgacatcatggagccagaacacgccctgctggcgacctccatcttcaagctcacctatcagaataaggtagtgagggtccaacgcccagccaagaacggcaccgtgatggacgtgatcagccggagggatcagcggggatccggccaggtaggtacctacgggcttaataccttcacaaacatggaggcccaactgatccgccagatggaaagcgaaggcatattcagtcccagcgagcttgagacccctaatttagccgagcgtgtctttgactggctggagaaacatgggatcgagcgcctcaagcggatggccatctccggcgacgactgcgtggtaaagcccatagacgaccgcttcgcgaccgctctgacagcccttaacgacatggggaaggtgcggaaggacatcccccagtgggaacccagcaagggctggaacgactggcaacaggtcccgttctgctcacaccacttccaccagctcatcatgaaagacggccgtgagattgtcgttccctgccgaaatcaggacgagttagtgggccgcgcccgggtcagccaaggcgccgggtggagtttacgcgagacggcgtgtctcggcaagtcctacgcccagatgtggcagctcatgtattttcaccgtcgcgacctgcggttagcggccaatgcgatctgcagcgcagtgccggtggactgggtccccacctcccgtaccacatggtcaattcatgcccaccatcagtggatgaccacagaggacatgctctcggtgtggaatcgggtgtggatagaggagaacccgtggatggaagacaagacccacgtttcgtcctgggaggacgtgccataccttggcaagcgcgaggaccagtggtgcggcagcttaattggccttaccgctcgcgccacttgggcgacgaatatccaggtggcaatcaaccaggtccggcgcctgatcgggaacgagaactacttagactacatgacctcaatgaagcgcttcaagaatgagagcgaccccgagggggcgctgtggtga

SEQ ID NO: 23719 - RNA, 9879 nt, synthetic construct
  misc_feature 1..9879: note = derived and/or modified CDS sequence (opt11) from DENV-1__AB195673__SS-prME
  source 1..9879: mol_type = other RNA
agcgtgaccatgctgttgatgctgcttcccaccgcccttactttccacctgaccaccaggggcggcgaaccccacatgatcgtgggcaagcaggagcggggaaagagcctgttattcaaaaccagcgccggggtgaacatgtgcaccctgatcgccatggacctgggggagttgtgcgacgacactatgacctacaagtgcccccgcatcaccgagacggagcccgacgacgtggattgctggtgcaacgcaaccgagacctgggtcacctacggcacgtgcagccagaccggcgagcatagacgcgacaagcggagcgtggcactggcgccccacgtgggactgggcctagagacccgcaccgagacgtggatgtcgagcgaaggggcctggcggcaaatccagaaggttgagacctgggcactccgccacccgggattcacggtgatcgccctcttcctagcccacgtgatcgggacctcgatcacgcagaagggcataattttcatactgctgatgctcgtcacccccagcatggccatgaggtgcgtgggcatcgggaaccgcgacttcgtggagggcctgtccggggcaacatgggtcgacgtggtgctggagcacggcagctgcgtcaccacgatggcgaaggacaagcccacgctcgacatcgagctgctcaagaccgaggtgaccaaccccgcagtgctccgaaagttgtgcatcgaagccaagatatccaacacgaccaccgacagcaggtgcccgactcagggcgaagccacgctcgtggaggagcaggataccaacttcgtgtgccggcgcacgttcgtggaccgggggtggggcaacgggtgcggcctcttcgggaagggctcccttataacgtgcgcgaaattcaagtgtgtcacgaagctggaggggaaaatcgtgcagtacgagaacctcaagtacagcgtgattgtgaccgtgcacaccggggaccagcaccaagtcggcaacgaaaccaccgaacacgggacgatcgccaccatcacaccccaggcccccacctccgagatccagctgacggactacggcgccctaaccctcgactgcagcccccgaaccggcctggacttcaacgagatggtgctgttgaccatgaaagagaagtcctggctggtgcataagcaatggttcctggacctccctctgccctggacttcgggggcctccacctcccaggagacctggaaccggcaggacttactcgtgaccttcaagacggctcacgccaagaagcaagaggtagtggttctgggaagccaggagggggccatgcacaccgccctgaccggcgccaccgaaattcagacgtcagggaccaccaccatcttcgccggccatctcaagtgcaggctgaaaatggacaagttgacgctcaaggggattagctacgtgatgtgcaccggctcatttaaactggagaaagaggtggcagagacccagcacggcaccgtcctcgtccaagtgaagtatgaggggacagacgccccctgcaagatccccttctcgtcccaggacgagaagggcgtcacccagaacgggcggctggtgacggcaaacccgatcgtgaccgacaaggagaagcccgtcaatatcgaggccgagcctcccttcggcgagagctacatcgttgtgggcgcgggggaaaaggccctcaagctgagctggttcaaaaagggcagtagtatcgggaagatgttcgaggcgacagcccgcggcgcgcggcgcatggcaatactgggggataccgcctgggacttcggcagcatcggcggggttttcaccagcgtgggcaaattagtgcaccagatcttcggaaccgcctacggcgttctgttcagtggggtgagctggacgatgaaaatcgggatcggcatcctgctcacctggctagggcttaactctcgctccaccagcctctccatgacctgcattgccgtgggcctcattacgctgtatctcggggtcatggtgcaggcggacagcggatgcgttatcaattggaaggggcgggagctcaagtgcggttccggcatcttcgtcaccaacgaggtgcacacctggacagagcagtacaagtttcaggcagacagcccgaagcgcctgagcgccgccatcggaaaggcctgggaagagggcgtgtgcgggatccgaagtgcgacccgcctcgagaatatcatgtggaagcagatcagtaatgagctgaaccacattctgcttgagaacgacatgaagttcacggtcgtagtgggtgacgtctccggaatcctggcccaaggcaaaaagtcgatccggccccagcccatggagcacaagtactcatggaagtcgtggggaaaggcaaagatcatcggagccgacgtgcagaacaccaccttcatcatcgacggacccaacaccccggagtgccccgacgaccagcgcgcctggaatatctgggaggtggaggactatggattcggcatcttcacgaccaacatctggctgaagctccgggactcctacacccaggtctgcgaccaccgccttatgtcggcggccatcaaggactccaaggccgtgcatgccgacatgggctactggatcgagagcgagaagaatgagacctggaaactggcccgggcctccttcatcgaggtgaagacgtgcatctggcccaagagccacaccctttggtctaacggggtcctcgagagcgagatgatcatccccaaaatctacggtgggccaatctcccaacacaactaccgccccggttacttcacccagaccgctgggccctggcacctgggcaaactcgaactggacttcgacctttgcgagggcacgaccgtggtagtcgacgagcactgcgggaaccggggcccgagcttaaggaccaccaccgtaacagggaagatcatccacgagtggtgctgccgcagttgcaccctgcctcccctgcgctttaagggggaggacgggtgctggtacggcatggagatccggcccgtgaaggagaaggaggagaaccttgtgaagagcatggtgtctgccggctccggggaggtagacagcttctctctggggctgttatgcatcagcattatgatcgaagaggtaatgcgctcacggtggtcacgcaagatgctgatgaccgggacgctagctgtgttcctcctgctgaccatgggtcagttgacctggaatgacctcatacggttgtgcatcatggtaggtgcgaacgcctccgataacatgggcatggggaccacgtacctagccttgatggcgaccttccgcatgcgtccgatgttcgccgttgggttgctgttccggcgcctgaccagccgggaggtgctgctcctgaccgtcggcctgtccctcgtggcgagcgtggagctgccaaactccctggaggagctcggggacggattggccatgggaatcatgatcctgaagctcttgacggacttccagagccaccagctgtgggcgaccctcctgtcactgaccttcgtcaaaaccacgttcagcctccactacgcctggaagaccatggcaatgatcctttccatcgttagcctgttccccctgtgtctcagtaccactagccaaaagacgacttggctgcccgtgctcctggggtccctgggctgcaagccgctcacgatgttcctgattacggagaacaagatctgggggcgcaaaagctggcccctgaacgagggcatcatggcggtcggcatcgtgagcatactcctatccagcctgctcaagaacgacgtgcccctggccggacctctgatcgccggcgggatgttaattgcttgctatgtcatatccgggagctctgcggacctcagcctagagaaggccgcagaggtgagttgggaggaggaggccgaacacagcggggcgtcacacaacatcttggtggagatccaggacgacggcaccatgaaaattaaggatgaggagcgggacgacacgatcaccatcctgctgaaggcgaccctcctagccatcagcggggtctacccgatgtcaatccccgccaccctcttcgtgtggtatttctggcaaaagaagaaacagcgcagcggcgtgttatgggatacccccagcccacccgaggtagagcgggccgtgctagatgacggcatctaccgcattctgcagcgggggctgctcggacgcagccaggtgggggtcggcgtgttccaggaaggggtgttccatactatgtggcacgttacgcggggcgccgtgctgatgtaccagggaaagcgtctggagccctcctgggcgagcgtcaagaaggacctcatcagctacgggggcgggtggcggttccagggtagctggaataccggggaggaagtccaggtgatcgcagtcgagcccgggaagaaccccaagaacgtccaaacagcccccggcaccttcaagacctctgagggggaagtgggggccatcgccctggacttcaagcccgggaccagcggcagtcccatcgtaaaccgcgagggcaaaatcgtcgggctatatggcaacggggtagttacgacctcgggcacgtacgtcagcgcgatcgctcaggcaaaggcctcccaagaggggccgctcccagagatcgaggacgaggtcttccggaagcgcaacctgactatcatggacctgcaccccggcagcggcaagacgcggcgctacttgcccgccatcgtgcgtgaggcgatcaaacgcaagctgcggaccctggtcttagccccgacccgcgtggtcgcctccgagatggccgaggcactgaaggggatgcctatccgctaccagaccacggcagtcaagagcgagcatacaggacgggagatcgtggacctgatgtgccacgctaccttcaccatgcgcctcctgtcccccgtacgggtccccaactacaacatgatcatcatggacgaggcccacttcacggatccggccagcatcgcggcacgcgggtatatctcaacccgggtaggcatgggggaggccgccgccatctttatgaccgcgacgccgcccggcagcgtggaagctttcccccaatcgaatgccgtcatccaggacgaagagaaggacattccggaacgcagctggaattccggttacgactggatcacggactttccggggaagaccgtctggttcgtgccctctatcaagtccggcaacgacattgcaaactgcctgcggaagaacgggaagagagtcatccagctctcacggaagaccttcgacaccgagtatcagaagacgaagaacaacgactgggactacgttgtgaccactgacatatccgaaatgggcgccaacttccgcgcggaccgcgtgatcgacccccgccggtgcctgaaaccggtgatcctgaaggatgggcccgagcgtgtcatcctcgccggcccgatgccggtcaccgtggccagcgccgcgcagcgaagaggccggatcggccgcaaccagaacaaggagggcgaccagtacatctatatggggcagcccctgaacaacgacgaggaccacgcccattggacggaggccaaaatgctgctcgataacatcaacacccccgagggcatcattcccgccctgttcgagcccgagcgggaaaagtcggccgcgatcgacggggagtacagactgaggggcgaggcccggaagactttcgtcgagctcatgcgccgcggcgacctgccggtgtggctgagttacaaggtcgccagcgaggggttccagtacagcgacaggcggtggtgcttcgacggcgagcgcaacaaccaggtcctcgaggagaacatggacgtggagatctggaccaaggagggggagcggaagaaactgcgcccccggtggctggacgcccgcacgtacagcgatcccctcgccctgcgggagtttaaggagttcgcggccggccgccgatccgtgagcggcgacctgatcctcgagatcggcaagctgccccagcacctgacccagcgggcccagaacgccctcgacaacctggttatgctgcacaactccgagcaaggcgggaaggcctatcggcacgcgatggaggagcttccggacactatcgagaccctgatgctgcttgccctgatcgcggtgttaaccggcggagtgaccttattcttcctgagcggccgcggcctgggaaagacgtcgatcggcctcctgtgcgtaatgagctccagcgcgttgttatggatggcgtccgtggagccccactggatcgccgccagcatcatcctggagttctttctgatggtgctcctgatccccgagccggatcggcagcgcaccccacaggataaccagttggcctatgtggtcattgggctactgttcatgatcctgaccgtggctgcgaacgaaatgggcctcctggagacgactaagaaggacctggggatcggccacgctgctgccgaaaatcaccatcatgccgcgatgctcgacgtagacctgcaccccgcctctgcctggaccctgtacgccgtggccacaacgattatcacaccgatgatgcggcacacaattgagaacaccacggcgaatatctcacttaccgccatcgctaatcaggcagccatcttaatgggactggacaaaggttggccgatctcaaagatggacataggtgttcccctcctggcactggggtgctacagccaggtaaacccccttaccctgaccgcggccgtgctaatgctcgtggcccattacgcgataatcggccccgggctgcaggccaaggccacgcgcgaggcccagaagcggaccgcagcgggcatcatgaagaaccctaccgtcgacggcatagtggccatcgacctagaccccgtagtctacgacgctaagttcgagaagcagctcgggcaaatcatgctgctgatcctctgcacctcccagatacttctgatgaggacgacctgggccctctgcgaaagcattaccctggccacaggacccctgacgacattatgggaggggtccccaggcaagttttggaacactacaatcgctgtgagcatggccaacatcttccgcggctcctatctggcgggggcaggccttgccttttccctcatgaagagcctcgggggaggacggcgcggaacgggcgcgcagggggagaccctgggcgagaagtggaagcggcagctcaaccagctgtccaaaagcgagtttaacatatacaagcgctccgggattgtagaggtcgatcggagcgaggctaaggaaggcctcaagcgaggggagaccatcaagcacgccgtgtccaggggcactgccaagctacgctggttcgtggagcggaacctggtcaagcctgagggcaaggtcatcgatctagggtgcggccgcggaggctggagctactactgcgcgggactaaagaaggtgacggaggtcaaaggttacaccaagggcgggcccggccacgaggaacccatccccatggccacctacgggtggaacctcgtgaagctgtactccggcaaggacgtgttctttatcccgcccgagaagtgcgataccctactctgcgacatcggggagagctccccgaacccgacgatcgaggagggacggaccctgcgcgtcttaaaaatggttgagccgtggctccgtggcaaccagttctgcatcaaaatcctgaacccctacatgccatcagtggtcgaaaccctggagcagatgcagcgcaagcacgggggcatgctcgtccggaaccccctgtcccgcaactctacccacgaaatgtactgggtgagctgcgggaccggcaacattgtaagcgccgtcaatatgacgtcccggatgctgctcaaccgcttcaccatggcccaccggaagcctacatacgagcgcgacgtagatctgggtgccgggacccgccacgtcgcagtggagcccgaggtagccaatctggacatcatcggccagaggatcgagaacatcaagaatgagcataagagcacctggcactacgacgaagacaacccctacaagacctgggcctaccacgggtcctacgaggtcaaacccagcggcagcgcctcctcaatggtgaacggggttgtccgcctcctgaccaagccgtgggatgtgatccctatggtcacacagattgccatgacggacaccacccccttcggccagcagcgggtcttcaaggaaaaggtggatacccgcacgcccaaggcgaagagagggacagctcagataatggaggttaccgccaagtggctgtgggggttcttatcgcgcaataagaaaccgcgtatctgcacccgagaggagttcactcggaaggtgcgaagcaacgccgccataggcgcggtgttcgtcgacgagaaccagtggaactccgccaaggaggccgttgaagacgagcggttttgggacctggttcgccgagagagagaactacacaagcaggggaagtgcgcaacttgcgtatacaatatgatgggcaagcgagagaagaagctcggcgagttcggcaaggcgaaaggctcccgcgccatctggtacatgtggttaggggcccggttcctggaattcgaggcactcggcttcatgaacgaagaccactggttctcccgcgagaacagcctgtccggggtggagggggaggggctgcataagctcgggtacatcctgcgggacattagcaagatccccggcggtaacatgtacgcggacgacactgcgggctgggacacccggattactgaggacgatctgcaaaacgaggccaagattaccgacatcatggaacccgagcacgccttgctggccacctccatcttcaaactgacgtaccagaacaaggtggtccgggtgcagcgaccggcgaagaacgggactgtgatggacgtgatctctcgccgggaccaacggggctccggccaggtggggacctacggcttgaacacgttcaccaacatgggggcccagctgatccggcagatggagtcggagggcattttctctcccagcgagctggagacgcccaacttggccgggcgcgtgctggactggctcgagaagcacggcatcgaacggctccgccggatggctatctcaggcgacgactgcgtcgtgaagcccattgatgaccgcttcgccaccgccctgaccgcactgaacgacatggggaaagtgcggaaagacatcccgcagtgggagccctctaagggctggaacgactggcaacaggttcccttctgcagccaccactttcaccaactcatcatgaaagacgggcgcgagatcgttgtgccctgccggaatcaggacgagctggttggtcgagcccgggtgtcgcaaggggccggctggagcctgcgcgagaccgcctgcctcggcaagtcctacgcccagatgtggcagctgatgtacttccaccggcgcgacctcagactagcggccaacgccatctgctctgccgtgccggtcgactgggttcccacgtcccgcaccacctggtccattcacgcccaccaccagtggatgaccacggaggacatgctgagtgtctggaatcgagtctggatcgaggagaacccctggatggaggacaagacccacgtgagcagctgggaggacgttccttacctggggaagcgggaggaccaatggtgcggcagcctcatcgggctgaccgcccgcgccacctgggccacaaacatacaagtcgccatcaaccaggtgcggcgcctaataggcaacgagaactacctcgactatatgacgtccatgaagcggtttaagaacgagagcgacccggagggggcactgtggtga

SEQ ID NO: 23720 - RNA, 9879 nt, synthetic construct
  misc_feature 1..9879: note = derived and/or modified CDS sequence (opt11) from DENV-1__AB204803__SS-prME
  source 1..9879: mol_type = other RNA
agcgtgaccatgctgctaatgctgctgccgaccgtgctgacattccacctcaccaccagggggggggagccccatatgattgtgagcaagcaggagcggggcaagagcctccttttcaagacctccgccggtgttaacatgtgcaccctgatcgccatggatctgggcgagttatgtgaggacaccatgacgtacaagtgcccccggatcactgaaaccgagccagatgacgtggactgctggtgcaacgcgaccgagacatgggtaacctacggaacatgcagccagaccggagagcaccggcgcgacaaacggtccgtcgccttggcgccccacgtcgggctggggctggagacaaggaccgagacttggatgagctccgaaggcgcatggaagcagatccagaaggttgaaacctgggcgctccggcacccggggttcaccgtgatagctttattcctcgcacacgccatcggcacgtccatcacgcagaaggggattatcttcatcctgctgatgctcgtcaccccctccatggcaatgcgctgcgtaggaatcggcaacagagactttgtggagggtctgagcggggcgacttgggttgatgtggtgctggagcatgggtcgtgcgtcaccactatggctaaagacaagcccaccctcgacattgaactcctaaagacggaggtgactaaccccgccgtcctccgcaagctctgcatcgaggcgaagatatccaacacaacaaccgactcccgctgtccgacgcaaggcgaagcaacgctggtcgaagagcaggacaccaatttcgtatgtcgccggacctttgtggaccgcggatgggggaacggctgtggcctcttcgggaaggggagcctgatcacgtgcgtcaagtttaagtgcgtgaccaagctggagggcaagatcgtacaatacgagaacttgaagtactccgttatcgtgactgtccacaccggcgatcagcatcaggttgggaacgagactacagagcatggcacgatcgcaaccatcacgccccaggcgccaacaagtgaaatccagttaacggactacggagctctgaccctggactgcagcccccggacaggcttagattttaacgagatggtgctgctgaccatgaaggagaaatcctggctggtccacaagcagtggttccttgatctacctctcccctggacatccggcgccagcaccagccaggaaacttggaaccgccaagacttactcgttaccttcaagactgcacacgcgaagaagcaggaagtggtcgtgctgggctcccaagagggcgcaatgcatacggccctgaccggcgccaccgagatccagacaagcggaaccaccaccatcttcgccgggcacctcaagtgccggctcaaaatggacaagctgacgctcaagggcacgtcctacgtgatgtgcacagggccctttaaattagaaaaggaggtcgcggagacccaacatgggactgtgctggtgcaggtcaagtacgagggaacagacgcaccttgtaagatcccgttcagcagccaggatgagaagggggtgacccagaacggtagattgattaccgccaaccccattgttacagataaagaaaaacccatcaacatcgaggccgagccgccgttcggggagagctacatcgttgtgggcgtgggagaaaaggccttgaaactcagttggttcaagaagggaagctccatcggcaagatgttcgaggcgacagcccgcggtgctcgtcggatggccatcctgggcgacaccgcctgggacttcggtagcatcggcggagtcttcacctccatggggaagctcgtgcatcagatcttcggcacggcctatggggttcttttcagcggcgtctcctggaccatgaagatagggatcggaatcctgctcacctggctgggcttaaacagtcgctccactagcctgtccatgacttgcatcgccgttgggatggtgaccctctaccttggagtgatggtgcaggcagacagcgggtgcgtgatcaattggaaggggcgggaacttaagtgtgggtccggcatattcgtaaccaacgaggtgcacacatggaccgagcagtacaagttccaggccgattcccctaagagactgtctgcggccatcggcaaggcctgggaagagggggtctgtggaatccgttctgcgacgcggctggagaacataatgtggaagcaaattagcaacgagctgaaccatatcctgctggagaacgacatgaagttcaccgttgtagtaggagacgtatctggaatcctcgcccaaggcaagaagatgataagaccccagccgatggagcataaatacagttggaagtcgtggggcaaagcgaaaatcatcggcgccgacgtgcaaaacaccaccttcatcatcgacgggcctaatacacctgagtgctctgatgaccaacgggcatggaacatttgggaggtggaggactacggcttcggaatcttcactaccaacatctggctaaagctgcgcgactcctatacccaggtttgcgaccaccggctcatgagcgcggccattaaggactcccgcgccgtacacgcagatatgggctactggatagagagcgaaaaaaacgagacgtggaagttagcccgggcctcctttattgaggttaagacgtgtatctggcccaagagccacacactgtggtccaacggcgtcctcgagagtgagatgatcatccccaagatctatggtggaccgatctcccagcacaactaccgccccgggtacttcacccagacagcgggcccttggcacctgggtaagttagaattggacttcgacctgtgcgagggtaccactgtagtagtcgacgagcagtgcgggaaccgcgggcccagcctgcgcaccacgaccgttaccggtaaaatcatccacgagtggtgctgccggtcctgcacccttcctccactgcgctttaaaggggaggacggctgctggtacgggatggagatccgccccgtaaaggagaaggaggaaaatctggtcaaaagcatggtgagcgccggatctggcgaagttgacagcttctccctcgggctgctgtgcatcagcatcatgattgaagaagtcatgcgatcacggtggagccgtaagatgctaatgactggcacgcttgccgttttcctgctcctgaccatgggccagctgacctggaacgatctaatacggttgtgcatcatggtaggcgccaacgccagcgacaagatggggatgggaacgacctacctggccctcatggccacctttcgcatgagaccgatgttcgcggtcggcctgctcttcagagggctcaccagccgggaagtgctgcttctcacggtcggcctttcgttggtggcatcggttgagctccccaactccctcgaggaactgggtgacggcttagccatgggtatcatgatgttaaagctgctgaccgacttccagagccatcagctgtgggcgaccctgctttcgctgaccttcgtcaagacgaccttcagcctgcactacgcctggaaaaccatggcaatgactttatcgatcgtgagcctgttcccactttgcctcagcacgaccagccagaaaaccacctggctgcccgtgttactagggtccctcggctgcaagccgctcaccatgttcctcataacggaaaacaagatctggggtcggaagtcctggccgctgaacgaggggatcatggccgtcgggatcgtgtctatactactttccagtctgttaaagaacgatgttccactcgctggccctctgatcgccggcgggatgctgatcgcctgctacgtcatctccggctcctcggccgacttgtctctcgagaaagccgcggaggtctcctgggaggaggaggccgaacacagtggggcctctcacaacatcttggtggaagtacaggacgacggaacaatgaagataaaggacgaggagcgggacgacaccatcactatcctgctgaaagccacgttgctcgccattagcggggtgtacccgatgtctatccctgccaccctgtttgtgtggtatttctggcagaagaagaagcaaaggagtggagtcctgtgggacacccccagcccacccgaggtggaaagggccgtgctggacgacggcatctaccgtatcctgcagcgcggcctgctgggccgtagccaggtcggcgtgggcgtgtttcaggagggggtattccacaccatgtggcacgtgacccgcggggccgtgctcatgtaccaaggaaaacggttagagccctcctgggcctccgtcaagaaggacctgatctcttacggtggggggtggcgcttccagggcagctggaacaccggcgaggaggtccaggtgattgccgtcgagcctgggaagaaccccaagaatgttcagacggctcccggcaccttcaagacatccgagggagaggtgggcgcgatcgcactagacttcaagcccgggacctcgggtagcccgattgtaaaccgggagggcaagatcgtcgggctgtacggcaacggggtggtcaccaccagtgggacatacgtgagcgccattgcccaggcgaaagccagtcaggaggggcccctgccggaaatagaggacgaagtgttccgcaagcggaatctcacaataatggacctgcaccccggcagcggcaagaccagacggtacctgcccgccatagtccgcgaggccataaagcggaaactgagaacccttgtactggccccgacccgggtggtggcgtccgagatggcagaggccctcaaaggaatgccaatccgctatcagaccaccgcagtcaagagcgagcacaccggaaaggagattgtggacctgatgtgccacgcaacgttcaccatgcggctactgtcccccgttcgggtgccaaattacaatatgataatcatggatgaagcccatttcacggaccccgccagtatcgccgcccgcgggtatatctctacccgggttggtatgggggaagcggccgctatcttcatgaccgccacgcctcccggttcggtcgaagccttcccccagtccaacgctgtgatccaggacgaggagaaggacattccggagcgctcatggaactccgggtacgactggattacggatttccccgggaagacggtatggttcgtcccttcaatcaagtccggcaatgacatcgctaattgtctgcggaagaacgggaaacgcgtgatccagctgagtaggaagacgttcgacacggagtatcagaaaaccaagaacaacgactgggattatgtggtaacgacggacatctcggaaatgggggccaacttcagggctgaccgggtgatcgacccccgccggtgcctcaagccggtaatcctgaaggacgggcctgaacgcgtgatcctggccggtcccatgcccgtgaccgtcgcgtcagccgcccagcggcgcggacgaatcggaagaaaccagaacaaggagggagaccagtacatctacatggggcagccgctcaataatgatgaggatcatgctcattggaccgaggcgaagatgctgctggacaatatcaacacccctgaaggaatcattcccgccctctttgagccagagcgagaaaagtcggcggccatcgacggcgagtacaggttgcggggagaagcccgtaagacgttcgttgagttaatgcgccgcggggacctcccggtctggctgagctacaaggtcgccagcgaagggtttcaatattccgatcgcagatggtgctttgacggggagcggaacaatcaagtcctggaggaaaacatggacgtggagatctggaccaaagagggggaacgaaagaagctccggccccggtggcttgacgcccgcacgtacagtgacccgctggcgctacgggagttcaaggaattcgccgctggccgccgctcggttagcggcgacctgatccttgaaatcgggaaattgccgcaacacctgacccagaaggcgcaaaccgcgctggacaacctcgtgatgcttcacaactcagagcagggcgggaaggcctaccgtcatgcgatggaagagctgccggacactattgagaccctcatgttactcgcgctcatcgcagtgctaacgggcggggtcactttgttcttcctctcgggcaagggcctgggcaagacgtccatcggcctgctctgtgtcatgagctccagcgcactgctgtggatggcctccgtggagccccactggatcgccgcatcaatcatactcgaattcttccttatggttttgctaatacccgagccggacagacagcgtaccccgcaggacaatcagctcgcctacgtggtgattgggctgttgtttatgatcctaaccgtcgccgccaacgagatggggctgctcgaaaccactaaaaaggacctgggtattggccacgcagcagccgaaaaccaccaccacgccgcgatgctggatgtggaccttcacccagcctccgcgtggaccttatacgccgtagcaaccactatcatcacccccatgatgcggcacaccatcgagaacaccaccgccaatatctccttaacggccatcgcgaaccaggcagcaatcctaatgggcctggacaaggggtggccgatttcaaagatggacatcggcgtcccactcctcgctctggggtgttacagccaagtgaaccccctgacgcttacagccgcggtgttaatgctggtcgcacattacgccattattgggcccgggttgcaggcaaaagccacccgcgaggcacagaagcgtaccgcggccgggatcatgaaaaatccgacggtggacggcattgttgctatcgacctggaccctgtcgtgtacgacgcgaaattcgaaaagcagctcgggcagatcatgctcttaatcctttgcaccagccagatccttctcatgcgcactacgtgggctctgtgcgaatcaatcacgctcgccaccggaccgctgaccacgctgtgggaggggagccccggaaagttctggaacaccaccatcgccgtgagcatggccaacatctttcgtggcagctacctcgcaggggccggcctcgccttctccctgatgaaaagcctcgggggggggcgtcgaggcacgggcgcccagggggagacgctgggcgagaagtggaagcgacagttgaaccaactgagcaaatccgaattcaatacctacaagcgctccgggatcatggaggtcgaccgttctgaggccaaggagggccttaagcgcggcgagacaacgaagcacgcggtgagtcggggcacggccaagctgcgctggtttgtggagcggaacttagtcaaaccggaggggaaagtaatcgatctggggtgcggccgcgggggctggtcctactactgcgccgggttaaagaaggtgaccgaggtgaagggatacaccaaaggagggccgggccacgaggagcccatccccatggccacgtacgggtggaatctggtcaagctccactcaggcaaggacgtgttcttcatcccccccgagaagtgcgacaccttactgtgcgacattggggagtcctcccccaaccccacgatcgaggaaggccgaaccctcagggtcttaaagatggtcgaaccgtggctgcgtggcaatcagttttgcatcaaaatcctcaacccctacatgcccagcgtggtcgagactctggaacagatgcaacgcaagcacggggggatgctggtgcgtaaccccctctcccggaacagcactcatgaaatgtactgggtctcgtgcgggaccggcaacatcgtctctgcggtgaacatgacatcccgaatgttgctgaaccgcttcacaatggctcacagaaagccgacctacgagagggacgtggatctgggcgcgggaactcggcatgtcgccgtggagccagaagtggccaatctggacatcatcggtcaacgaatcgagaacattaaaaacgagcataagagcacatggcactacgacgaggacaacccctacaagacctgggcgtatcacggctcctacgaggtccggccgagcggaagcgcttcttcgatggtgaatggggtcgtcaggttactcacgaagccgtgggacgtgattcccatggtcacacaaatcgcaatgaccgacaccacccccttcggtcagcaacgggtattcaaggagaaggtggacacccggactcccaaggcgaagcgcggcaccgcccagattatggaggtaaccgctaagtggctgtggggtttcctctcgcggaataaaaagccgcgcatctgcactcgggaggagttcacccgcaaagtgcgttccaatgcagcaatcggcgccgtgttcgtcgacgagaaccagtggaactccgcaaaggaggcggttgaggatgagcgcttctgggacctcgtgcaccgggagagagagcttcacaaacagggaaagtgcgcgacctgcgtttacaacatgatgggaaagcgggagaagaagctcggggaattcggcaaggccaaggggagtagagctatatggtacatgtggctcggggctaggttcctggagtttgaggccctcgggttcatgaacgaggaccactggttctcccgcgagaactccctatccggggtggaaggagaagggttgcacaagctgggttacatcctgagagacatcagcaagattcccggtgggaatatgtacgctgatgacacggccggctgggacactaggatcaccgaggacgacttacagaacgaggccaagattactgatatcatggagccggagcacgcgctgcttgccacctccatcttcaagctcacgtaccagaacaaggtagtccgagtgcaacgacccgccaaatccgggactgtgatggacgtcatctcgcggcgcgaccaaagggggagcggccaggtgggaacctatggcctgaataccttcacgaacatggaggcccaacttatccgccagatggagtccgaagggatattctcgccctccgagttagagacgcctaatctggccggacgcgttctcgactggctggagaagcatgggattgagaggctgaagcggatggcgattagtggcgatgactgcgtcgtgaagcccattgacgaccggttcgccacagctctcaccgccctgaacgacatgggcaaagttaggaaggacatcccgcaatgggaacccagcaaaggatggaacgattggcagcaagtccctttttgttcccaccactttcaccaactgatcatgaaggacggcagagagatcgtagtgccatgcaggtcccaggacgaactcgtcggacgggcccgtgtttcccagggcgctgggtggagccttcgggagacggcttgcctgggcaaatcctatgcccagatgtggcagctcatgtacttccataggcgggacctgcgccttgcagcaaatgcgatctgttcagccgttccggtcgactgggtgcccacgtcccggaccacttggagcatccacgcccaccaccagtggatgaccactgaggatatgctctccgtttggaatagagtctggatcgaggagaacccatggatggaagacaagacccacgtgagctcatgggaggacgtgccttacctggggaagcgggaggaccagtggtgcgggtctctgataggcctcaccgctcgcgcaacctgggcgaccaacatccaggtcgcgatcaaccaggttcgtcgcttgatcggaaacgagaattacctggactacatgacctccatgaagcggttcaagaacgaatccgacccggagggcgccctttggtga

SEQ ID NO: 23721 - RNA, 9879 nt, synthetic construct
  misc_feature 1..9879: note = derived and/or modified CDS sequence (opt11) from DENV-1__LC016760__SS-prME
  source 1..9879: mol_type = other RNA
tctgtaactatgttgctcatgctgatgcccacagctctcgccttccacctcactacccgcggcggggagccgcacatgatcgtgagcaagcaagagcggggcaagagcctgctattcaagactagcgcgggggtgaacatgtgcacccttatagccatggacctgggcgagctgtgcgaggacacaatgacctataagtgcccccgtataacagaggccgagccagacgacgtggattgctggtgcaatgccaccgacacatgggttacctacgggacatgcagccagaccggggagcaccggcgggataagcggtccgtggccctcgcgccccatgtcggactcggtcttgagaccagaacagagacttggatgagctctgagggcgcctggaagcagatccagcgggtagagacctgggccctcaggcaccccggcttcacggtcatagctctcttcctagcgcatgccataggcacgtcaatcacccaaaaggggattatctttatcttgcttatgctggtgaccccctccatggccatgagatgcgtgggaataggcagccgcgacttcgtggaggggctctccggcgccacgtgggtggacgtcgtgctggagcatgggagctgcgtgaccaccatggccaaggataagcccactctggacatagagttgcttaagactgaggtcaccaacccagcagtgctgcggaagctctgtattgaggccaagatttctaacaccaccacagacagccgttgccctacccagggtgaggccactctggtcgaggaacaggatgccaacttcgtctgtcggcgcacgttcgtggaccgaggctgggggaacgggtgtgggctgtttggtaaggggtccctcatcacgtgtgcaaagtttaagtgcgtgactaagctggagggcaagatagtccagtacgagaacctgaagtacagcgtgattgtgacagtacacaccggcgaccagcatcaggtggggaacgaatccacagaacacggcaccacagcgacaatcacgcctcaagcccccacgactgagatccagctcaccgactacggcgcgttgacactggattgtagcccccgaactggccttgatttcaacgagatggtccttctcactatgaaggagaagtcctggctcgttcacaagcagtggttcctggacctaccgctcccctggaccagcggggcctccaccagtcaagagacgtggaaccggcaagacctactcgtaaccttcaagaccgctcatgccaagaaacaagaggtagtggtgctcggctcccaagagggcgccatgcataccgccctgactggcgccaccgagatccagacctcaggaaccacgaccatctttgctggacacctgaagtgccggctcaagatggacaagctaacccttaaaggcatgagctacgtcatgtgcaccgggtcgttcaagcttgagaaggaggtagcggagacgcagcacggcaccgtgctggtacaaattaagtatgaaggcactgacgccccctgcaagatcccctttagtacccaggacgaaaaaggtgtgacgcagaacggccggttgattaccgcgaacccgatcgtgaccgataaggaaaagcccgtcaacattgaggccgagccgccatttggagagtcctacatcgtgatcggtgcgggggagaaggcgctgaagttgagctggttcaagaaagggtcatctatcggcaagatgttcgaggccactgcccgcggagcccggagaatggcgatactgggcgacacggcctgggacttcgggtccattggtggcgtgttcaccagcgttggcaaactggtgcaccagatattcgggaccgcgtacggtgtgctcttctccggcgtcagctggactatgaagattgggatcggcgtgctgctgacgtggctaggactcaactcccgctcgacctccctgagcatgacctgtatcgcagtgggacttgtcaccttatacctgggcgttatggtccaggccgactccgggtgcgttattaactggaaaggtcgggagctcaaatgcggtagtggcatctttgtgacaaacgaggtgcacacctggaccgaacagtataaattccaggcggacagtccgaagcgactgtccgctgccatcggcaaggcctgggaagagggagtctgcggcatccggtcggccacccgcttagagaacatcatgtggaagcaaatctccaacgagctgaaccacatcttactggagaacgacatgaaattcaccgtcgtggtcggtgatgtggcgggcatcctcgcgcagggtaagaagatgatcagaccgcagccgatggagcacaagtacagctggaagtcctggggcaaggccaagatcatcggcgccgacgtgcagaataccaccttcatcatcgacgggccaaacaccccggagtgccccgacgatcaacgagcgtggaacatctgggaggtcgaagattatgggttcgggatcttcaccacgaacatctggttgaagctaagggactcctacacccaggtgtgcgaccaccgcctcatgtccgccgccattaaggatagtaaagctgttcacgcggacatgggctattggatcgagtccgagaagaacgaaacctggaagctggcacgggccagctttatcgaagtcaagacatgcatctggcccaagtcccacacgctctggagcaacggcgtgttagaatcagagatgatcatacccaagatctacgggggacctataagtcagcataactaccgacccgggtacttcacgcagaccgccgggccctggcacctgggaaaactggagctcgacttcgacctatgcgagggcaccaccgtagtagttgacgagcactgcggaaaccgggggccttcattgagaaccaccacggtgacgggcaagatcatccacgagtggtgctgtcggagctgcaccctgccgcccctccgctatcgcggagaggatgggtgctggtacgggatggagatccgccccgtcaaggagaaagaggagaacctcgtgaaatccatggtaagcgcaggctcaggagaggtcgactccttcagtctcgggctgctttgtatctccatcatgatagaggaggtaatgcgctcacgttggtctcggaaaatgctcatgaccggcaccctggccgtcttctttctgctaatcatggggcaattaacgtggaacgacctgatacgcctctgcatcatggtaggcgcgaacgccagcgacaggatggggatgggtaccacctacctggcactgatggcgaccttcaagatgcgaccgatgttcgccgtaggcctcctgttccgcagactgacgtcccgagaggtgctcctcctcaccattggactcagcctggtggcgtccgtggagttgcccaacagtttagaagagctgggcgatgggctggccatggggatcatgatcctaaagctccttaccgacttccaatcccaccagttatgggccaccttactgagcctaaccttcatcaaaaccactttctcgctgcattatgcatggaagaccatcgcgatggtcttgagtatcgtttccttgtttcccctatgcctgagcacgacgtcccagaagaccacctggctccccgtgctgttggggagcttggggtgcaagccgctgacaatgttcctaatagccgagaacaaaatctgggggaggaagtcctggcctctcaacgagggcatcatggctgtaggaatcgtgtcaatcctgctgagctccctcttaaagaacgacgtcccccttgcagggcccctcatcgccggcggcatgcttatcgcatgctacgtaatctcagggtcctccgcagacctgtccctcgagaaggccgcagaggtcagctgggaagaagaggccgagcactccggagcaagccacaacatcctggtggaagtgcaggacgatgggaccatgaaaatcaaggacgaagagcgcgacgacacccttaccatcttactgaaggctaccttactcgccgtgtccggagtgtatccgctgagcatcccagccacgctgttcgtctggtacttctggcagaaaaaaaagcagcggtccggggtgctgtgggacacccccagccctcctgaggtcgagcgcgctgtcctggatgatggtatctatcggataatgcagcgaggcctcctggggcggtctcaggtgggcgtcggagtcttccaagaaaacgtgttccacaccatgtggcacgtgacacggggagccgtcctcatgtaccaagggaagcggctggagcccagctgggcctccgttaagaaggacctgatcagctacggcggcgggtggcgcctccagggctcctggaatacgggagaggaggtgcaggtcatcgccgttgagcccggcaagaacccgaagaatgtccagaccgcacccggtaccttcaaaactcccgaaggcgaagtcggagctatcgcgctggacttcaagcccgggacgtcgggcagtcccattgttaacagagaaggcaagattgtgggcctgtacggcaacggggtcgtgacgacctctggcacctatgtgagtgctatcgcccaggccaaggcgtcccaggagggcccgctccccgagatcgaggatgaggtcttccgcaagcgtaacctgacgatcatggacctccaccccggaagcgggaagacaagacggtacctgccggccattgtgcgcgaggccatcaagcgtaagctgcgcacactaatcctcgcccccacccgcgtcgtcgcctccgagatggcggaggccctgaagggcatgcccatacggtaccaaacgacagccgtcaagagcgagcacaccggcaaggagatcgtggacttaatgtgccacgctacattcacaatgcgcctcctgagccccgtacgggtgccgaactataacatgatcatcatggatgaggcccacttcaccgatcccagctctatcgcggcccgcggttacatctcgacccgggtgggcatgggagaggccgccgcgatcttcatgactgcgacgcctcccggatcagtcgaggctttcccgcagagcaacgctgtgatccaggacgaggagcgcgacatccccgagcggtcctggaacagcgggtacgagtggataacagacttcccaggcaagacggtgtggttcgtcccctcgatcaaatccggtaacgacatcgccaactgcctgcgcaagaatgggaagcgggtgattcagttgtccaggaaaaccttcgacactgagtaccagaagaccaaaaacaacgactgggactacgtggtcacaaccgacatttcagaaatgggcgcgaacttccgagccgaccgcgtcatcgacccgaggcgctgcctgaagccagtgatcctaaaggacgggcccgagcgagtcattctcgccggaccaatgccggttacggtcgcgtccgccgcgcaacgccgggggcgcatcgggcggaaccacaacaaggagggggaccagtacatctatatgggacagccactgaacaacgacgaggatcatgcgcactggaccgaggccaagatgttattggacaacattaacacccccgagggaatcattccggccctgttcgagccggagcgggagaaaagtgccgcgatcgatggggaataccgtttacggggtgaagcccgcaagacattcgttgagctcatgcggcggggggacctgcctgtgtggctctcctacaaagtcgccagcgagggctttcagtacagcgatcggcgctggtgtttcgacggcgaacggaataatcaagtactcgaggagaatatggatgtagagatctggacgaaggagggggagcgcaagaaactgcgtccccgctggctagatgcacgcacgtactccgaccccctcgccctgcgcgagttcaaggagttcgcggcaggccggcgcagcgtctccggtgacctgatcttggagatcggaaagctgccacagcacctgacccagcgggcccagaacgccctagataatctggttatgctccacaacagtgagcagggcggccgcgcgtatagacacgccatggaggagctccccgacacgatcgagacactgatgctgctcgcgctgatcgcagtgctgactggcggggtcaccctctttttcctgtccggcaaggggttaggcaagaccagcatcgggctcctgtgcgtgatggcctccagcgtactgctctggatggcgtctgttgaaccccattggatcgccgcctcgatcatcctagagttcttcctgatggtcttgctcatccccgagccagaccgccagagaacgccccaagacaatcagctcgcctacgtggtcatcgggcttttgtttatgatcctgacggtagccgcgaacgagatgggcctcctcgagaccacgaagaaggacctggggatcggacacgtggccgtcgagaatcaccaccacgccgccatgctagacgtcgacctgcaccccgcgtccgcgtggaccttgtacgccgtggccactaccataatcacaccgatgatgcgccacaccatagagaatacgacagcaaatatcagcctcacagccatcgctaatcaggcggctatcctgatgggactggacaagggatggcccatatccaaaatggacatcggagtccccctcctggccctcgggtgctacagccaagttaaccccctaactcttaccgcggccgtccttatgctggtcgcccactacgccataattggaccggggctacaggccaaggcgacccgggaggcacagaagcgcaccgccgcgggaataatgaagaatccgaccgttgacgggatcgtggccatcgatctggacccagtcgtttacgatgccaaatttgaaaaacagcttgggcagatcatgctgctgatcttatgcacatcccagatcttgctgatgcgtaccacgtgggccctctgtgagagcatcactctggccacgggccccctaaccactttgtgggaggggtccccaggcaagttctggaacacaacgatagccgtgagcatggccaacatttttcgggggtcctacttagcaggggcgggcttggcattttccctcatgaagtctctagggggcgggaggcggggcactggggcccagggcgagactcttggggaaaagtggaagcgacagctgaaccagttatccaaaagcgagttcaacacctacaagcgttccgggatcatggaggtcgatagaagcgaagcgaaggagggcctgaagcgcggggagacgaccaagcacgccgtctcccgcggcacggcgaaactccggtggttcgtcgagcgtaatcttgtgaagcccgaagggaaggtgatcgacctgggctgtggccggggtggctggagctactactgtgcggggcttaagaaagtaactgaagtcaaaggctacaccaagggcggcccaggccacgaggagccggtgccgatggccacgtacgggtggaacctcgtgaagttacactccggcaaggacgtattcttcatcccgccggagaaatgtgacaccctgctctgcgacatcggggagagctcccccaacccgaccatagaggagggccgcacgcttcgggtgctgaagatggtggagccctggctgcgcggaaaccagttctgtataaagattctgaatccctacatgccatctgtcgtggagaccctggagcagatgcagcggaaacacggcggcatgctcgtgcggaatccgctatcccggaattctactcatgagatgtactgggtaagttgcgggaccggcaatatagttagcgcgatcaacatgacttcccgtatgctgctcaaccggttcacgatggcccacagaaagcctacctacgaacgcgacgtcgatctgggggccggcacccggcacgtcgccgttgagcctgaggtagccaacctggacatcatcggacagcgcatcgaaaatatcaagtgcgagcacaagagcacttggcactacgacgaggacaacccctacaaaacgtgggcgtaccacggttcctacgaggttaagccgagcggctccgccagcagcatggttaacggggtagtgaaactcctgaccaagccatgggacgtgattcccatggtcacccagatcgccatgaccgatacgacccccttcggtcagcagcgtgtcttcaaggagaaggtggatacccgcaccccgaaggccaaacgggggacggcccagatcatggaggtcactgcgcgctggctgtggggcttcctctcccgcaacaagaaaccgcgcatctgcacccgggaggagttcacccgcaaggtgcgctccaacgccgccatcggggccgtattcgtggacgagaatcagtggaactcagcgaaagaggcagtcgaggatgagcgcttctgggacctggtccaccgggagagggagctgcataagcaggggaagtgcgccacgtgcgtgtataacatgatgggcaagagggagaagaagctcggtgagttcggtaaggccaaggggagccgggctatatggtacatgtggctgggcgcgcggttcctggaattcgaagctttgggcttcatgaacgaggaccactggttttcccgagagaacagcctgtccggcgtggagggtgaggggttacacaagctcggctacattctgcgagacatatcgaagatctccgggggcaacatgtacgcggacgacaccgccggatgggacacccgcatcaccgaggatgacctgcagaacgaggcgaaaattaccgagatcatggagccagagcacgcacagctcgccaaggcgatcttcaagttgacgtaccaaaacaaggtggtacgggtccaacgcccggccaagaacggtactgtgatggatgtcatcagccgccgggaccaaagaggctctggccaggtgggaacctacggtctgaacacgttcaccaacatggaggcccagctgatccggcagatggagtcggagggcatctttagtcccagcgagctggagacccccaacctggctgagcgcgtgctcgattggctggagaagtacggtgtagagcggctaaaacgtatggcaatctccggggacgattgcgtggtgaagcccatcgacgacagatttgctacggcactaacggcgctgaacgacatgggcaaggtacgcaaagacatcccgcaatgggagcccagcaaggggtggaacgattggcagcaggtcccgttctgctcccatcacttccaccagctgatcatgaaggacggccgtgagatagtggtcccctgtagaaaccaagacgagctcgtgggccgggcccgcgttagccaaggggccggctggagcctgcgggaaaccgcatgcctaggcaaaagctatgcccagatgtggcaactcatgtactttcaccggcgagacctgcggctggcggccaacgctatctgctccgctgtcccggtcgactgggtgccgacctcccggaccacttggagcatccatgctcaccaccagtggatgaccaccgaagacatgctctccgtctggaaccgcgtatggatcgaggaaaatccctggatgaaagacaaaacacacattagctcatgggaagacgtgccatacctaggcaagcgggaagaccagtggtgtggcagtctaatcgggctcacggctcgcgccacgtgggccaccaacatccaggtcgccatcaaccaagtgcggcgtctgatcggcaacgagaattatctggactacatgacctccatgaaacgcttcaagaatgagagtgacccggagggggccctctggtga

SEQ ID NO: 23722 - RNA, 9879 nt, synthetic construct
  misc_feature 1..9879: note = derived and/or modified CDS sequence (opt11) from DENV-1__LC128301__SS-prME
  source 1..9879: mol_type = other RNA
agcgttaccatgctgctcatgctgctgcccaccgccctcgcgttccacctgacgaccagaggcggggaaccgcacatgatcgtgagcaagcaggagcggggcaagagcttgctgtttaagacctcggccggggtgaatatgtgcaccctgattgccatggacctgggggaactatgtgaggacaccatgacatacaaatgcccccgcataactgaaaccgaacccgatgacgtagactgctggtgcaacgccaccgagacctgggtcacttacgggacctgcagccaaaccggcgagcaccgcagagacaagcggtctgtcgccctggcgccccatgtgggcctgggccttgagacacgcaccgagacctggatgagctccgagggcgcgtggagacagatacaaaaggttgagacgtgggccttgaggcacccaggtttcaccgtgatcgccctgttcttagcccacgcgatcggcacgagcatcacccagaaggggataatcttcatcctgctgatgttggttacgccatccatggcaatgagatgcgtcggaatcggtaaccgcgactttgtggaggggctgtcaggagccacctgggtcgacgtcgtcctcgagcacgggagttgcgtaacaaccatggccaaggacaagcctacgttagacatcgaactgctaaagaccgaagtcacaaatcctgccgtcctcagaaagctgtgtatcgaggccaagatcagcaataccaccactgactcccgctgccctacccagggcgaggccaccctagtggaagagcaggacacgaattttgtctgtcgacgcactttcgtggacagaggttgggggaacggatgtggactgttcggcaagggttccctgataacgtgcgctaaattcaaatgtgtgaccaagctggagggcaagatagtccagtacgagaacctaaagtattccgtgatcgtgaccgtccatactggcgatcagcaccaagtgggaaatgaaaccaccgagcacggcaccacggccactatcaccccccaggcacccacttctgaaatacagctgacggactacggagccctgaccctcgactgcagcccccgcaccggactggatttcaacgagatggtgctgttaaccatgaaggaaaagtcttggcttgtgcacaagcagtggtttctggacctaccgctgccctggacgtccggggccagcacctcacaggagacttggaacagacaggatctgctggttaccttcaaaacggcgcacgctaagaagcaagaagtcgtggtactaggcagccaggagggagccatgcacaccgctctgactggagctaccgagatccagacgagcggcaccaccaccatcttcgctggccatctcaagtgtcgcctaaagatggacaagttgactctcaagggcgtctcatacgttatgtgcaccggtagcttcaagctagagaaggaggtggccgagacgcagcacggcaccgtcttggtccaggtgaagtacgagggcacggacgccccttgcaagatcccgttttccagccaggacgagaagggggtgactcagaacggccgactgatcaccgcgaacccgattgtgacagataaagagaagcccgtgaacatcgaggctgagccgcccttcggcgagagctacttggtcgtgggtgccggcgagaaggccctgaaactgagttggtttaagaagggctcctctataggcaagatgttcgaggcgactgcaagaggggctcgtcgcatggccatcctcggggataccgcttgggacttcggctctatcggcggcgtattcaccagcgtcgggaaactgatccaccagatcttcggcacggcgtacggtgtgctgttctccggcgtgagctggaccatgaagatcggtatcggcatactcttgacctggctggggttgaactcccgcagcacgtccctgtcaatgacctgtatcgccgtcgggatggtaacactgtacctcggcgtcatggtccaggccgactccgggtgcgtgataaactggaagggtcgggaacttaagtgcgggagcggcatcttcgtgaccaacgaagttcacacttggacggagcagtacaagtttcaggcggacagcccgaagcggctttccgccgcgatcggtaaagcctgggaggaaggagtatgcggcatcaggtcggccacacgcctcgagaacatcatgtggaagcagatctccaatgagctcaatcacatcttgcttgagaacgacatgaagtttacggtggtcgtgggggatgtaaacggcatcctggctcaagggaagaagatgatccggccccagcccatggagcataaatacagctggaagtcctggggcaaggccaaggttataggcgccgacgtgcagaacaccacattcataattgacggcccaaacacaccggagtgccccgacgaccagagggcatggaatatatgggaggtagaggactacggcttcggcatattcacgaccaatatttggttgaagctccgggacagctacacccaggtttgcgaccatcgcttgatgtccgctgccatcaaggattccaaagctgtgcacgccgacatgggctattggattgagtcggagaagaatgagacatggaagctaacgcgggctagcttcatcgaggtgaaaacctgcatctggcccaagtcccataccctctggtccaacggggttctggaatccgaaatgataatccccaaaacctacgggggcccgattagccagcacaactaccgtccgggctatttcacacagaccgccggcccctggcacctgggaaaactcgagctggacttcggcctctgcgaagggaccaccgtggtggtcgatgagcactgcgggaatcggggaccgtccctccgtaccaccacagtgaccggcaagataattcacgagtggtgctgccggagctgtaccctgcctcccctccgttttaagggcgaagatggctgctggtacggaatggagatccggcccgtgaaggagaaagaggagaacctcgtaaggtctatggtcagcgccggcagcggggaggtagactccttcagcctgggccttctctgcatctccatcatgatcgaggaggtcatgcggagccggtggtcccgcaagatgttgatgaccgggaccctggcggtattcctcctgctgatcatgggccagctcacctggaacgatctgatccgactgtgcatcatggtcggggcaaacgcgagtgacaagatggggatgggaaccacctatctggccttaatggcaactttccgcatgcgtccgatgttcgccgtcggtctcctctttcgccggctcacctcacgcgaggtgttgctcttgactgtcgggctgagcctcgtggcctccgttgaactgcccaatagcctcgaagagctcggggacggactagccatgggaattatgatgctgaagctgctgaccgacttccagtcccaccagctgtgggctgccctcctgagcctgacgtttgtcaagaccacgttttccctccactacgcctggaagaccatggccatgattctgagcatcatttccctattccctctatgcatgagcaccacgtcccagaaaactacctggctgcccgtactgctcgggagtctgggttgcaagccgctgaccatgttcctcatcactgagaacaagatatgggggcggaagtcctggcctcttaacgagggcatcatggccgtgggcatcgtcagcatcctgctcagctccctgctgaaaaacgacgttccactcgctggccctcttatcgcgggcgggatgttaatagcctgctacgtgataagcggttccagcgcggacttgtccctggaaaaggccgccgaggtcagctgggaagaggaagctgagcattccggtgccagtcacaacatcctggttgaagtgcaagacgacggcactatgaagatcaaagacgaggagcgcgacgacaccctcacaatcctgttgaaggccaccctcctagcgatatccggcgtctatcctatgtcgatccctgctacactattcgtgtggtacttctggcagaagaagaaacaacgctccggcgttctctgggatacgccgtcccctcccgaggtcgagcgcgcagtattggacgacggcatctacaggatcttgcaacgcggactgctcgggaaatcccaagtaggcgtcggggtgttccaggaaggcgtgttccacaccatgtggcacgttacccgtggcgccgtgctcatgtaccagggcaagcggctggaacccagctgggccagcgtgaagaaggacctcatctcctacggcggcgggtggcgattccaggggtcctggaataccggagaagaggtacaagtgatcgccgtcgagcccggcaagaaccccaagaatgtccagacggcccctgggacgttcaagacgcccgagggagaggttggcgcgatagccctggactttaaacccgggaccagcggctcccccatcgtgaaccgagagggcaagatcgtcgggctgtacggcaacggagttgtgacgacaagcgggacctacgttagcgccatcgcccaggcaaaggcgtcgcaggagggcccgctcccagagatcgaggatgaagtgtttcggaagcgcaacctcaccatcatggacctgcacccgggcagcggtaagacaagacgctatctaccggcaatcgtgcgcgaggcaatcaagaggaagctgcggaccctggtcctcgccccaacccgtgtggttgcgtcagagatggccgaggccttgaagggcatgcccatacgttaccaaacgacggccgtgaagagcgagcacacaggtaaggagatagtcgatctgatgtgccacgctacgttcaccatgcggctactgtcccccgtgcgtgtcccgaactacaatatgatcatcatggacgaagcgcacttcacagaccccgccagcatcgccgccagaggttacatttccacacgcgtagggatgggtgaggcggcggccatcttcatgaccgcgactccccccggctcgatggaggcctttccgcaatccaacgcagcgatccaagacgaggagcgggacatcccagagcgctcttggaactcaggatacgactggatcacggatttccccggaaagaccgtatggttcgtccccagcatcaaatccggcaatgacatcgcgaactgcctgcgcaagaatggaaaacgcgtggtgcagctctcccggaagacctttgatactgaataccagaagacgaagaataacgactgggactatgtggtaacgactgacatctccgagatgggcgctaactttcgcgcagatagagttatcgatccgaggaggtgtttgaaaccagtcatcttaaaggacggacccgaacgcgtgatcctcgctggccccatgcctgtaaccgtggcgagcgccgcccaacggcgggggcgtattggtagaaaccagaacaaagagggagatcagtacatctatatggggcagcccctcaacaatgacgaggaccacgcccactggacggaggcgaaaatgcttctcgataacatcaacacccccgagggcattatccccgctctgtttgagccggaacgtgagaagtccgccgccatcgatggtgagtaccgcttaagaggagaagcccggaagaccttcgtggagctaatgcgtcgaggggacctgcccgtatggctgagctacaaggtggcttccgaggggttccagtactctgaccgtaggtggtgtttcgacggcgaaaggaacaaccaggtgctcgaagagaacatggatgtagagatctggactaaggagggcgagcggaagaagctgcgaccccggtggctggacgcccgcacttattctgatcccctggccctgcgggagttcaaggagttcgccgctgggcggcggtccgttagcggagacctgatcctagagataggcaaactgccgcagcaccttacccagcgcgctcaaaatgccctcgacaacctagtgatgcttcacaactcagaacaaggcgggaaggcctaccggcacgccatggaggagcttccggacaccatagaaactttaatgctgctcgcgctcatcgccgtgctgaccggaggcgtgacccttttctttctgagtgggcgcggactgggtaagaccagtatcgggctcctgtgtgtaatggcaagctccgccctgctttggatggctagtgtcgaaccccactggatcgcggcgtccattatcctggagttcttcctaatggtgttactgatccctgagccagaccgacagcgaactccccaagataatcagctggcgtacgtggtcatagggctcttgtttatgatcctgacagtcgccgctaacgagatgggactactggagacgaccaagaaggacttggggatcggccacgtggcggccgagagccatcaccatgccgcaatgctcgacgtcgacctgcaccccgcgagtgcgtggacgctctacgcagtggccaccacgatcataaccccgatgatgcggcacaccatcgagaataccacggcgaacatcagcttaaccgcaatcgcgaatcaggccgccatactcatgggtcttgataaggggtggcccatcagcaaaatggacataggagtgcccctactagccctagggtgttactcacaggtaaacccgctaaccctgacggcggctgtgctgatgctcgtggcccactatgcaattatcggcccggggttgcaagccaaggcgacgcgagaggcacagaagcggaccgccgctggcatcatgaagaatcctaccgtggacgggattgtagctatcgatctggaccccgtggtgtatgatgctaagtttgaaaaacagctcgggcagatcatgctgctcatcctctgcacctcgcagatcctcctgatgcggacgacttgggccctatgcgagagcataacactggcgactggccccttgactactctctgggagggctccccgggcaagttctggaacacgaccattgccgtgagcatggccaacatcttccgcgggtcctaccttgcaggggccggcctagccttcagcttaatgaagagcctcggaggcgggcgccgagggacaggcgcccagggggagaccctcggcgaaaagtggaaacggcaactcaatcagctgtccaagagcgaatttaacacctacaaacgtagtgggatcatggaggtagaccggagcgaggctaaggagggcctgaagaggggtgagaccacgaagcatgccgtctcccggggcaccgctaaactacgctggtttgtcgagcgcaacctcgtgaaacccgagggcaaagtcatcgacttagggtgcgggagagggggctggagctattactgcgctgggctaaagaaggtgacggaggttaaaggctacacaaagggtgggccgggccacgaggaaccaatccccatggctacatacgggtggaatctcgtcaagctgtactccggaaaagacgtctttttcaccccccccgagaagtgcgacacacttctctgcgacattggggagagcagtcccaacccgacgattgaggagggccggaccttgcgcgtgctgaagatggtcgagccctggctgcggggaaaccagttctgcatcaaggtactaaacccgtacatgccctcagtggtcgagacgctggagcagatgcagcgtaagcacgggggcatgcttgtgcggaatccgctatcccgcaatagcacccacgagatgtattgggtgtcctgcggaaccggcaacatcgttagtgctgtaaacatgaccagtcggatgttactcaacaggtttacgatgacacacagaaagcccacctatgagaaggacgtggacctgggcgcgggtacccgccacgtcgctgtagagcctgaggtggccaacctggacatcattggccaaagaattgagaacatcaagaatgagcataagagcacatggcactacgatgaagacaacccgtacaaaacttgggcataccatgggtcctacgaggtcaagccgagcggttccgcgtctagcatggtgaacggagtcgtgcggctcttgaccaagccctgggacgtcatccccatggtcacccaaattgccatgacggacaccaccccattcggccagcagcgggtatttaaagagaaagtcgacacccggacgccgaaggcaaagcgagggacggcccaaatcatggaggtcaccgcccggtggttgtgggggttcctatcccgaaacaagaagccccggatttgcacacgcgaggagttcacgcgcaaagtgcgctcgaacgcggccatcggtgccgtattcgtcgatgagaaccaatggaactccgctaaagaggctgtggaggacgagagattctgggacctggtgcaccgcgagcgtgagctgcacaagcaggggaaatgcgcgacatgtgtctacaacatgatgggaaagagagagaagaaactcggggagttcggcaaggccaaaggaagccgggcaatttggtacatgtggttgggggcccgctttctggagttcgaggcgctcgggttcatgaatgaagaccactggttctcccgggagaactcgctgagcggggtagagggcgaggggctgcacaagctaggctatatactccgcgacatttcgaagatccccggcgggaacatgtacgccgatgacactgccggctgggacacccgcattacggaagatgacctccaaaatgaagcaaagatcacagacattatggaacctgaacatgccttattagcgacgtccatcttcaagttaacttaccagaacaaggttgtccgggtacaaagaccagcgaaaaacggaactgtgatggacgtcatcagtcgccgcgatcaacggggcagtggtcaggttgggacctacggcttaaatacgttcaccaacatggaggcccagcttatcagacagatggagagtgaggggatcttcctaccatccgagttggagacgcccaacctggcggaaagggttttagattggctagagaagcacgggaccgagcggctgaagcgtatggccatcagtggggatgactgtgtagtcaagcctattgacgaccgcttcgcaaccgcactaactgctttaaacgacatgggtaaggtgcggaaggacatcccgcagtgggaaccgtccaagggctggaacgactggcagcaagtcccattctgcagccaccactttcaccagctgatcatgaaggacggccgcgaaattgtggtgccgtgtcggaatcaggacgagctggtgggacgcgcgagggtctcccaaggggccgggtggagcctccgcgaaacagcgtgtctgggtaaatcctacgcgcagatgtggcagttgatgtacttccaccggcgcgacctccggctagcggcaaacgcaatctgcagcgcagtgcccgtagactgggtacccacaagtcgcaccacctggtccatacacgcacatcaccaatggatgacgacagaggacatgctgagcgtgtggaatagggtctggatcgaggagaacccatggatggaggataaaacccacgtgtctagctgggaggacgttccgtatctcggcaagagggaagaccagtggtgcgggagtttaatcgggctgaccgcccgggcgacatgggcgactaacatccaggtcgccatcaaccaagtacgtcgtctcatcggcaacgaaaactacctggactacatgactagtatgaagcgcttcaagaatgagtcagaccccgagggggccctgtggtga

SEQ ID NO: 23723 - RNA, 9879 nt, synthetic construct
  misc_feature 1..9879: note = derived and/or modified CDS sequence (opt11) from DENV-1__LC011945__SS-prME
  source 1..9879: mol_type = other RNA
agtgtgaccatgcttctcatgctgatgcccaccgccctggccttccacctcaccacccggggtggggagccccacatgatcgtgtccaagcaggagcggggcaagtcgctgctgttcaagacatctgccggagtaaacatgtgcaccctcattgccatggacctgggcgagctatgtgaggacacgatgacctataagtgtccccggatcaccgaggccgagcctgacgacgtggactgctggtgcaatgccaccgacacgtgggtgacctacgggacctgcagccagaccggggagcataggcgcgacaaacggtccgtggccctggcgccgcacgtgggcctggggctggagacgagaaccgagacctggatgagctccgagggagcctggaagcagatccagcgtgtcgagacatgggccctccgccaccccgggttcacggtcattgctttgttcctggcgcacgccatcggcactagcatcacccagaaagggatcatcttcatactcctgatgctggtgacaccctccatggccatgcggtgcgttggcatcggcagccgcgacttcgtagaggggttatccggcgccacgtgggtggacgtagtgctggagcatgggagctgcgtgaccaccatggccaaggacaagcccaccctggacatcgaactcctaaagacggaagtcaccaaccccgccgtgttacggaagctctgcattgaggccaaaatatccaacaccaccactgacagccgttgcccgacccagggagaggccaccttggtggaggagcaggacgcaaacttcgtttgtaggcgcacctttgtggatcggggctgggggaatggctgcgggctgtttggcaagggatccctcatcacgtgcgccaagttcaagtgcgtgaccaagctggagggcaagatcgtccagtacgaaaacctgaagtacagcgtgatcgtcaccgtccacacgggcgaccagcaccaagttgggaacgagtccacggaacatggcaccaccgcgacgatcacgccccaggcccccacgacagagatccagctcaccgactatggggctctaactctggactgctctccccgcacgggcctcgacttcaatgagatggtccttctgaccatgaaagagaagtcctggctcgttcacaaacagtggttcctggaccttccgttgccttggaccagcggggccagcacctcccaggagacgtggaaccggcaggacttgctggtgaccttcaagaccgctcacgcgaaaaagcaggaggtagtcgtgctcggcagccaggagggcgccatgcacaccgccctgacgggtgccaccgagatccagacttccggaactacgaccatatttgccgggcacctaaagtgccgtctcaagatggacaagctgaccctgaagggcatgagctacgtcatgtgcaccggatccttcaaactcgaaaaagaggtagcggagacgcaacatggaaccgtgctggttcaaatcaagtacgagggcaccgacgccccctgtaagatccccttcagtacccaggatgagaagggtgtcacgcaaaacggcaggctgatcaccgccaacccgatcgtgaccgataaagagaagcccgtcaacatcgaggctgagccgccctttggggagtcctatatagtaatcggagctggcgagaaggccctgaaacttagctggtttaaaaaggggtccagcatcggcaaaatgttcgaggccaccgctcgcggggcccggcgcatggcgatcctgggcgacactgcctgggacttcggaagtatcggcggagttttcacaagcgtcgggaagctggtgcaccagattttcggcaccgcatacggggtgctgttctccggcgtcagttggaccatgaagatcgggatcggcgtgcttctgacgtggctcggcttaaacagtcgcagcacctccctgagcatgacgtgcatcgccgtggggctcgtaaccctgtaccttggcgtcatggtccaggccgactcagggtgcgtaatcaactggaagggccgggagctcaaatgcgggtctggcatattcgtgacgaacgaggtgcacacctggaccgagcaatataagtttcaggcggacagcccgaaacgcctgtctgccgcaatcggcaaggcctgggaggagggtgtctgcggcatccggagcgccacccgcctggagaacatcatgtggaagcaaatctccaacgagctcaaccacatcctgctggagaacgacatgaagttcacagtggtggtcggagacgtggctggcatcttggcccaagggaagaaaatgatccggccccagccgatggagcacaagtacagctggaaatcctggggcaaggccaagatcatcggtgccgacgtgcagaatacgaccttcatcatcgacgggcccaacacgccagagtgccccgatgaccagcgcgcgtggaacatctgggaggtcgaggactacggctttgggatcttcaccacgaacatctggctgaagctgcgggatagttacacccaggtgtgcgaccatagactcatgtccgccgccatcaaggacagcaaggccgtgcacgccgacatgggctactggatcgagtccgagaagaacgagacttggaagctggcccgtgcctcattcatcgaggtcaagacttgcatctggccaaagtcccacacgctgtggagcaacggcgtgctcgagtccgagatgatcattcccaagatctacggaggcccgatcagccagcacaattaccggccggggtacttcacccaaaccgccggtccctggcacctggggaagctggagctcgacttcgacctgtgcgaaggcacgacggtggttgtggacgagcactgcggaaaccgtgggccaagtctgcgcaccaccaccgtgacggggaagatcatccatgagtggtgttgcagaagctgcaccctgccgcccctacgctaccgcggggaggacggctgctggtacgggatggaaatccgccccgtcaaggaaaaggaggagaacctagtcaaatccatggtgagcgccggcagcggtgaggtcgactccttcagcctcgggctgctgtgcatctccattatgatcgaggaagtgatgcgctcacgctggtcacgtaaaatgcttatgaccggcaccctggccgtgttctttctgctcatcatggggcaactcacgtggaacgatctcatccgcctatgcatcatggtaggcgcgaacgctagcgacaggatggggatgggcaccacctacctggccctgatggccacctttaagatgcggccgatgttcgcggtgggcctcctgtttcgccggctgacttcccgcgaggtgctcctgctgaccatagggctcagcctcgtggcctcagtggagctgccaaacagcttagaggagctgggcgatgggctggccatgggcatcatgatcctcaagctgctcaccgacttccagtcccaccaactctgggccaccctgctgagcctcactttcatcaagaccacgttctcactgcactacgcctggaagacaatcgcgatggtcctgagcatcgtctccctcttccccttgtgcctaagcaccacctcccagaagacgacgtggctccctgttctactgggcagcctcgggtgcaagccgttgaccatgttcctgatcgccgagaacaagatctggggacggaagtcctggcccctaaacgaggggatcatggccgttggcatcgtgagcatcctgctaagctccctcctgaagaacgacgttcccctagccggtccacttatcgccggcgggatgctgatcgcgtgttacgtcataagcggatcctctgcggacctaagtctggagaaggccgccgaggtgtcgtgggaggaggaggcagagcattctggggccagccataacatcctagtggaagtccaggacgacggtaccatgaagatcaaagacgaggagcgtgacgataccctgactatcctgctgaaggccaccctgctcgccgtctccggcgtgtacccgctgagcatcccagccacgctcttcgtatggtacttctggcagaagaagaagcagcggtccggtgtgctctgggataccccctccccgcccgaggtggagcgcgccgtcctggacgacggcatataccggatcatgcagcgcgggctgctggggcggtcccaggtgggcgtgggggtcttccaggaaaacgtattccacaccatgtggcacgtgacccgcggagcggtgctcatgtaccagggtaagcggctggaacccagctgggcctccgtcaagaaggacctgatctcttacggtggcgggtggcgcctccagggctcctggaacacgggcgaggaggtgcaggtcatcgcagtggagcccggaaaaaatcccaagaatgtgcagaccgcgcccgggacatttaagacccccgagggcgaggtcggcgccatagcgctggatttcaagcccggcacaagcggctcccccatagtgaaccgggaggggaagattgtgggcttatacggcaacggggtcgtgactaccagcggcacctacgttagcgccatagctcaggccaaggcgtcccaggaggggcccctccccgagatcgaggacgaggtattccgcaagcggaacctgacgataatggacttgcatcccggcagcgggaagacgcgccgttacctcccggccatcgtacgcgaggcgatcaaacgaaagctgcgtaccttgatactggcacccacccgcgtagtcgcctccgagatggcggaggccctgaagggcatgcccatccggtaccagacgacggccgtcaagtctgagcacactgggaaagagatcgtggacctgatgtgtcacgccaccttcacgatgcgcctcctgtcccccgtccgggttccgaactataacatgatcatcatggacgaggcgcatttcaccgaccccagctccatcgcggcccgcgggtacataagcaccagggtgggcatgggcgaggcagccgctatcttcatgaccgcgacgccgcccggctccgtcgaggcgtttccgcaaagcaacgcagtgatccaggacgaagagcgcgatatcccggagcggtcttggaatagcgggtacgagtggataaccgactttcccggcaagaccgtgtggttcgtcccctccatcaagtcaggcaacgatattgccaactgcctccgaaagaacggaaagcgggtgatccagttgtcacgcaagaccttcgatacggagtaccagaagaccaagaacaacgattgggactacgtggtcaccaccgacatcagtgagatgggcgcgaattttagggccgacagagtgatcgacccgcggcgttgcctgaagcccgtgatcctgaaggacggttccgagcgtgttatcctcgccggccccatgcccgtgacggttgcctccgccgcgcagcgccgagggcgcatcggacggaatcacaacaaggaaggcgaccaatacatttacatggggcagccgttgaacaacgatgaggaccacgcccattggaccgaggccaagatgctgctcgacaacatcaatacccccgagggcatcatccccgccttgttcgagcccgaacgcgagaagtccgccgcgattgacggggagtaccgcctgcgtggcgaggccagaaagacctttgtggagctcatgcgacgcggggatctgccggtgtggctgagctacaaagttgcgagcgagggcttccagtactccgaccggcgctggtgcttcgacggcgagcggaacaaccaggtgctcgaggagaacatggacgtagagatttggacgaaggagggggagcgaaagaagctgcggcccaggtggctggacgcccggacatacagcgaccccctcgccctgcgcgagttcaaggagttcgctgccggccggcgctcggtcagcggggacctgattctagagatcggcaaactgccccagcacttgacccagcgtgcccagaacgcgcttgacaacctggtgatgctgcacaacagcgagcaaggcgggagggcttaccggcatgccatggaagagctcccggacaccatcgagacgctgatgctgctcgcgctgatcgccgtgctaactggcggtgtcacactcttcttcctgagcggcaaggggctgggcaagacctccatcggtctcctgtgcgtgatggccagctccgtgctgttgtggatggcgtccgtcgaaccccattggatagccgcttccatcatcctagagttcttcctgatggtgctgctgatccccgagcctgaccgccagcgcacgccgcaagacaaccagctggcctatgtggtcatcgggctccttttcatgatcctgacggtggccgcgaacgagatgggcctcctggagaccactaaaaaagacctagggataggccacgtggccgtcgagaaccatcaccacgccgccatgctcgacgtggacctgcaccccgcgtccgcatggaccctgtacgccgtggccactaccatcatcacccccatgatgcggcacaccatcgagaacacgaccgccaatatttccttgacggccattgcgaaccaagcggccatactgatggggttggacaaaggctggccaataagcaagatggacatcggcgtccccctcctggccttaggctgctactctcaagtgaaccccctcacattaacggcggccgtgctgatgctagtcgcacactacgccattataggccccgggttacaggccaaggcgaccagagaggcccagaagcgtaccgccgccggcataatgaagaacccgaccgttgatgggatcgtcgccatcgacctggaccccgtcgtgtacgacgctaagtttgaaaagcagctcgggcagatcatgctgttgatcctttgcacgtcacagatcttgctgatgcgcaccacctgggccctctgtgagtcgatcaccctggccacgggcccgctgaccaccctctgggaggggagccccggcaagttctggaacaccacgatcgccgtgtccatggccaacatcttccgggggagctacctcgcgggcgccggactggccttctcactcatgaaatccctcggtggcgggagaagagggacaggggcccaaggagaaaccctgggtgagaagtggaagcgccagctcaaccagctgagcaaatccgagttcaacacctacaaaaggagcgggattatggaggtcgaccgctctgaggcgaaggaaggcctgaagaggggggagacgaccaagcacgctgtcagtcgcgggacagccaagctccggtggttcgtggagcgcaaccttgtcaagccggaggggaaggtgatcgatctaggctgcggccgtggcggatggtcctactattgcgcaggactgaagaaggtgaccgaggtcaaggggtatactaagggcggccccggccacgaagagcccgtccccatggccacctacgggtggaatctggtgaaattacacagcggcaaagacgtgttctttatcccccccgagaagtgcgacaccctgctctgcgatatcggggagtccagcccaaaccccaccattgaggaaggccgcacgctgcgcgtgttaaaaatggtcgagccttggttaagggggaatcagttctgcataaagatcctgaacccctacatgcccagtgtggtggagaccctggagcagatgcaacgtaaacacggtgggatgttggtccgcaaccctctgagccggaactccacccacgagatgtactgggtcagctgcgggaccggcaacatcgtgtccgcgatcaacatgaccagccgcatgctgctcaaccggttcacaatggcccaccgcaagccgacctacgagcgcgacgtggacctgggggccggcacccggcacgtcgcggtggagcccgaggtggccaatttagatataatcggacaacgcatcgaaaacatcaagtgcgaacacaagagcacctggcactacgacgaggacaacccctacaagacgtgggcctatcacgggagctacgaggtcaagccgtcggggagcgccagctccatggtgaacggggtcgtgaagctcctgaccaagccctgggacgttatccccatggtcacccagatcgccatgaccgatacgacccccttcggccagcagcgggtgttcaaagagaaggtggacacccgcaccccgaaggccaagcggggtacggcccagattatggaggtcaccgcgcgctggctgtggggcttcctcagccggaacaagaaaccgcgcatttgcacccgggaggagttcacccgcaaggtgcgatccaatgccgcaatcggcgccgttttcgtcgacgaaaaccaatggaacagcgcgaaggaggccgtagaagacgagcgcttttgggacctagtgcaccgggagcgtgagttgcacaagcaggggaagtgtgccacgtgcgtatacaacatgatgggaaagcgtgagaagaagttaggggagttcggcaaggctaaggggagtcgggccatctggtacatgtggctgggggcgcggttcctggagttcgaggccctgggcttcatgaacgaggaccactggttctcccgcgagaactccctgagcggggtggagggcgagggcctgcacaagctcgggtatatcctccgggacatcagcaaaataagcgggggtaacatgtacgccgacgacaccgcaggctgggatacccgcatcaccgaagacgacctccagaacgaagcgaagatcacagagatcatggagcccgagcatgcgcagctagccaaggcgatttttaagctgacatatcaaaacaaagtggtccgggtacagagacccgcaaaaaacgggaccgttatggacgtcatctcccgccgggaccagcgcggcagcggccaggtagggacctacggtctaaatacgttcaccaacatggaagcccagctcattagacagatggagtcggaggggatcttcagcccatccgagcttgagacccccaacctggcggagcgcgtcctcgactggctggagaagtatggcgtggaaaggctgaagcgtatggccatcagtggggacgactgcgtcgtgaagcccatcgacgaccggttcgccaccgccctcaccgcactgaacgacatgggcaaggtccggaaggacatcccccaatgggagccatccaagggttggaacgactggcagcaggtccccttctgctctcatcacttccaccagctgatcatgaaggatggccgggaaatcgttgtcccctgccgcaaccaggacgagctagtgggccgggcgcgcgtgtcccagggagcaggctggtccctccgggagaccgcctgcctgggtaagtcgtacgcccagatgtggcagctcatgtattttcaccggagggacctgcgcctggcggccaatgccatctgctctgccgtcccagtggactgggttccgaccagccggactacctggtccatacacgcccaccatcagtggatgaccaccgaggacatgctgtcagtgtggaacagagtatggatcgaggaaaacccctggatgaaggataaaactcatatatccagctgggaggatgtgccctatctgggcaagagagaggaccagtggtgcggaagtctgatcggcctgacggcgcgcgccacctgggccaccaacatccaggtcgcgatcaaccaggtacgccgactcatcgggaacgaaaattacctggactacatgaccagtatgaagagatttaagaacgagtccgaccccgagggggctctttggtga

SEQ ID NO: 23724 - RNA, 9879 nt, synthetic construct
  misc_feature 1..9879: note = derived and/or modified CDS sequence (opt11) from DENV-1__LC011949__SS-prME
  source 1..9879: mol_type = other RNA
agcgtgaccatgctgttgatgctggtgcccaccgccctggccttccacctcaccactcggggcggggaaccccacatgatcgtgagcaagcaggagcgtggcaagagcctgctgttcaaaacctccgccggggtgaacatgtgtaccctcatcgccatggatctgggggagctgtgcgaggacactatgacctacaaatgcccccgtataactgaggccgagcctgacgacgtggactgctggtgcaatgcgaccgacacgtgggtaacctacgggacctgcagccagaccggcgagcaccggagggacaagcggtcggtggccctcgcaccccacgtgggcctggggctggagacacggaccgaaacctggatgtcctccgagggcgcatggaagcagattcagcgggtggagacctgggctctccggcaccccgggttcacggtaatcgccctgttcctagcgcatgcgattggcacgagcataacccagaaggggattatctttatcctgcttatgctcgttacgccctccatggccatgcggtgcgtggggatcggctcacgagattttgtggaaggactctccggagccacttgggtcgacgtggtgttagagcacggaagctgcgtcactacgatggccaaggacaagcccaccctggatatcgagctcctgaagacggaggtgaccaatcctgcggtgcttagaaagctctgcattgaggccaagatctccaacaccaccactgacagccgctgcccgactcagggcgaagccactctggtcgaggaacaagacgcgaactttgtgtgcaggcgcactttcgtggacaggggctggggaaatggctgcggtctgttcggcaagggatccctcatcacatgcgccaaattcaagtgcgtcacgaagttggagggcaagatcgtgcagtacgagaacctgaaatacagcgtgattgttactgtgcacaccggcgaccagcaccaggtcgggaacgagtccactgaacatggcactaccgctaccatcacgccccaagcccccacgaccgagatacagctcaccgattacggggccttgaccctggactgcagtccccgcacgggcctcgacttcaatgagatggtgctgctgaccatgaaggagaagtcctggctcgtgcacaagcagtggtttctggatctgcccctcccctggacaagcggggccagcacctcccaggagacgtggaaccgtcaggatctactggtcaccttcaagaccgcccacgcgaagaagcaggaagtggtggtcctcggaagtcaggaaggcgccatgcacaccgccctgacgggggccaccgaaatacaaacctccggcactactaccatttttgccggccacctgaagtgtcgcctcaagatggacaagctgactctgaagggcaccagttacgtgatgtgcacggggtccttcaagctggagaaggaggtcgcggagacccagcacggaaccgtcctagtgcagataaagtacgagggcacagacgccccctgcaagatacccttcagcacgcaggatgagaagggggttacccagaatggcaggcttattaccgccaacccgatcgtcaccgataaggagaaaccagtgaacatcgaggcagagccgcccttcggggagtcctacatcgtgatcggcgcgggagagaaggcccttaagctctcgtggttcaagaaggggtcctccatcggtaagatgttcgaggccacggcccgcggggcacggcgcatggcaatcttgggcgacaccgcctgggacttcgggagtatcggcggcgtcttcactagcgtcgggaagctggtgcaccagatcttcgggaccgcttatggcgtcctcttctccggcgtgagctggacgatgaaaatcggtatcggcgtgctgctgacctggttgggcctgaactcccgtagcacgagcctcagcatgacctgcatcgccgtcgggctcgtgactctgtacctaggcgttatggtccaggccgacaccgggtgcgtgatcaactggaagggacgggaactcaagtgtgggtccggcatcttcgttaccaacgaggttcacacctggacggagcagtacaagttccaggctgacagcccgaaaaggctgagcgcggccattggtaaggcctgggaggagggtgtgtgcgggattaggagcgccactcgacttgagaacatcatgtggaaacagatctccaacgagctaaaccacatcctgctggaaaacgacatgaagttcaccgttgtcgtgggggatgttgcgggcatcctcgcgcaggggaagaagatgatccggccccaacccatggaatacaagtattcctggaagtcgtggggtaaggcaaagattatcggcgccgacgtgcagaacaccacctttatcattgacgggcccaacacgccggaatgccccgatgaccagcgcgcgtggaacatctgggaggttgaggactatggcttcgggatctttaccaccaacatctggcttaagctcagagactcatacacccaggtgtgcgatcaccgcctcatgtcagccgccattaaagactcaaaggccgttcacgccgatatgggctactggatagagagcgagaagaacgagacgtggaaactggctcgggcctccttcatcgaggttaagacgtgcatatggccgaagagccatacattatggtccaatggtgttttggaatccgagatgatcatacccaagatctatggcggtccgatctcccagcacaactaccgcccaggctacttcacacagacagccggcccctggcacttagggaagctggagctcgacttcgatctgtgtgaaggaaccaccgtcgtggtggacgagcactgcggtaaccgggggccgagcctgcgcaccacgactgtcacgggcaaaatcattcacgagtggtgctgtcggtcctgcaccctgccgcccctccgcttccggggggaggacggctgctggtacgggatggagatccgccccgtgaaggaaaaggaagaaaacctggtgaagagcatggtctccgcaggctctggcgaggtggactcgttcagcctcggcctgctttgcatctcgatcatgatagaggaggtgatgcggtcccgctggtcgaggaagatgttgatgacaggcaccctggccgtctttttcttactcatcatggggcagctcacctggaatgacctaatcagactctgcattatggtgggtgcgaatgcctctgaccgcatggggatgggcaccacgtacctggccctcatggccaccttcaagatgcggcccatgttcgccgtgggcctcctgttccgccggttgaccagcagagaagtcctcctgctgacgattgggctatccctggtggcgagcgtggagcttcccaactccttagaagagctgggggacgggctagccatgggtatcatgatcttgaagttgcttacggatttccaatcccatcagttatgggccaccctgctgtcactcacgttcattaagaccacgttcagcctgcactacgcctggaaaaccatggccatggtcttatccattgtgagcttgttccccctatgcttatcaaccacctctcagaagacaacgtggttgcccgttctgctgggatccctcggctgcaagccgctgaccatgttcctcatcgccgagaacaaaatctggggccgcaagtcatggccactcaacgaaggtatcatggccgtgggcatcgtgagtatcctgctgagcagcctcctcaagaacgacgtccccctggccgggcccctcatcgccggaggcatgctgatcgcgtgctacgtaatatccggaagctccgctgacctgtccctcgagaaggccgcagaggtgtcctgggaagaggaggccgagcatagcggcgcaagtcacaacatcctcgtcgaggtgcaggacgatggaactatgaaaatcaaggatgaggaacgcgacgacaccctgacaatcctcctgaaggccaccctgctcgcggtgagcggagtctacccgttaagtatccctgccaccttatttgtgtggtacttctggcagaagaaaaagcagcgcagcggggtcctctgggacaccccgagcccgcccgaggtggagcgcgccgtgctggacgacggcatctaccggatcatgcaacgcgggctgctggggcggtcccaggtgggtgtcggggtgttccaggagaacgtgttccacacgatgtggcatgtcacacgcggagcggtgttgatgtaccaaggaaaacggctggagccctcctgggccagcgtaaagaaggatctgatttcctacggaggcggctggcgcctccagggcagctggaacaccggggaagaagtccaggtaatcgctgtggaacccggcaagaaccccaagaacgttcagacggcccctgggacgttcaagaccccagagggcgaggtgggcgcaatcgccctggactttaagcccggtacctccggtagccccatcgtgaacagagaggggaagatcgtcggcttgtatggtaacggtgtagtaaccacgtccggaacgtacgtctcagccattgcccaggctaaggcgtcccaggaggggccgctccccgagatcgaagatgaggtgtttaaaaagcgcaacttaaccatcatggacctgcatcccggctccgggaagacccggagatacctccccgccatcgtgcgcgaggcaatcaagaggaagcttcggacgctgatcttagcgcccacccgcgtcgtggccagtgaaatggccgaggccctgaaaggcatgcccatacgctatcagaccacagccgtgaagtccgagcacaccggcaaggaaatcgtcgaccttatgtgccacgccaccttcacaatgcggttgttgtcccccgtgcgcgtcccaaactacaacatgatcattatggatgaggcccacttcactgacccctccagcatcgcggcccggggctacatctccacccgcgtcggtatgggcgaggctgcagctatcttcatgacagcgacgccgccaggctcagtggaggcctttcctcagagtaacgccgtaatccaggacgaggaacgggatatacccgagagaagctggaatagcgggtacgagtggatcaccgacttccccggcaaaacggtctggttcgtgcccagcatcaagtcaggcaacgacatcgccaactgcctgcggaaaaacggaaagcgcgttatccagctcagccgaaagaccttcgataccgaataccaaaagacgaagaacaacgactgggactacgtggtgacgaccgacatctcggagatgggcgctaacttccgagccgaccgggtgatcgacccgcgccggtgcctgaagcccgtcatcttaaaggacggccctgagcgcgtgatcctcgccggccccatgccggtcaccgtggccagcgccgcgcagcgtagggggcggatcggccgcaaccacaataaggaaggcgatcagtacatctacatggggcagcccctgaacaacgatgaggaccacgcccactggaccgaggccaaaatgttactcgacaacatcaacacgcccgagggcataatccccgcgcttttcgagccggagcgggagaagtccgcagcgatcgacggggagtaccgcctacgcggcgaggcgcgtaagaccttcgtggagttgatgcgccgtggggatctgcccgtctggctgagctacaaggtggcctctgagggcttccaatactccgaccgccggtggtgcttcgatggggagcgcaataaccaggtgctcgaggagaacatggacgtagagatctggaccaaggagggggagcggaagaagctgcgcccacggtggctggacgcccgcacttacagcgacccgctcgccctacgggagttcaaggagttcgccgccggccgccggagcatctcaggggacctgatccttgagatcggcaagctgcctcaacacctgacgcagcgcgcccaaaacgccctcgataacctggtgatgctgcacaactccgagcagggcgggcgagcgtaccgccacgcaatggaggagctccccgataccatcgagactctgatgctgctcgccctgatcgccgtacttaccggcggggtcaccctcttcttcctgtctggacgggggctgggaaagacctccatcggcttactgtgtgtgatggccagctccgtgctgctgtggatggcatccgtcgagccccattggattgccgcgtccatcatcctggagttcttcctgatggtactcctgatccccgagccggaccgccagcggacgccccaagacaaccaattagcttacgtggttatcgggctcctgttcatgattttaacggtggccgcgaacgagatgggcctactggaaacgaccaagaaggacctggggatcggccatgttgctgtcgagaaccaccaccacgccgcaatgctcgacgtggacctgcatccggcgtctgcctggaccctgtacgccgtcgccaccaccatcatcacgccgatgatgcgccacaccatcgagaacaccacggccaacatcagtctcacggccatcgcgaaccaggccgccatcctgatggggcttgataaaggctggcccataagcaagatggacatcggagtgcccctcctggccctagggtgctactcccaagtgaaccccctgaccctgaccgctgcggtgctgatgctcgtcgcccactacgccatcatcggtccggggctgcaggccaaggctacccgggaggcacaaaagcgcacggccgccggcatcatgaagaacccgacggtggacgggatcgtggccatcgacctagacccagtcgtttacgacgcgaaattcgagaaacaactcggccagatcatgcttctgattctctgtaccagccagatcctgctgatgcgcacaacgtgggccttatgcgagtcaatcaccctggccacgggccccctgaccacgctctgggaggggagcccgggaaagttctggaacacgactatcgctgtgtccatggccaacatctttagagggagctacctggcgggggccggcctggccttctccctcatgaagtccctcggtggcgggcgccgagggaccggggcccagggcgagacgctgggcgagaagtggaagcgccagctcaaccagttgagcaagtccgagttcaatacctataaacggtctgggattatggaggtcgacaggtccgaggcgaaggagggcctgaagcgcggggagaccaccaagcacgccgtgagccgcggtacagccaagttgcggtggttcgtggagcgaaacctggtcaagcccgaggggaaggtgatcgacttaggttgcggccgcggtggctggagctactactgcgcagggctgaagaaggtgaccgaggtaaagggctacaccaagggtggccccgggcacgaggagcccatcccgatggctacttacgggtggaacttagtgaagttgcacagcggcaaggacgttttcttcatcccacccgagaaatgcgatacgttattgtgcgacatcggggagtcgagccccaatccgaccatcgaagagggccgcaccttgagagtcctgaagatggtggagccctggctccgcgggaaccagttttgcataaagattcttaatccttacatgccctccgtggtcgagaccctggagcagatgcaacggaagcacggcggcatgctcgtgcgcaaccctctgagccggaactccacccacgaaatgtactgggtgtcttgcgggacgggcaacatcgtctccgcagtgaatatgactagccgcatgttacttaaccggttcactatggcacaccgcaagcctacctacgagcgggatgttgacctgggggcaggcacgcgacatgtcgccgtcgagcccgaggtagcaaacttagacatcataggccagcgcattgagaacatcaagcacgagcacaagtccacgtggcactacgacgaggacaacccctataagacgtgggcctatcacggaagctacgaggttaagccgtccggtagcgcctccagtatggtgaacggtgtcgtgaagctcctgactaaaccctgggatgtgatacccatggtcacccagatcgccatgacagacaccaccccgtttggccagcaacgggtgtttaaggagaaagtggatactagaaccccgaaggccaagcgggggacagcacagatcatggaggtcacagcacgctggctgtgggggttcctcagccggaacaagaaaccacgtatctgcacgcgggaagagtttacccgcaaggtgcggtccaatgccgccataggcgctgtgttcgtcgacgagaaccagtggaacagcgcgaaggaagccgtggaagatgagagattctgggacctggttcaccgggagcgcgagctgcacaagcaggggaagtgtgcgacctgtgtctacaacatgatgggcaagagggagaagaagctcggggagttcggcaaggccaagggatcacgggccatctggtacatgtggctgggcgcgaggttcttagagttcgaagccctcggatttatgaacgaggatcactggttctcacgcgagaactccctaagcggggtggagggagagggtcttcacaagctcggctacatattacgggacataagtaaaatccccgggggcaacatgtacgccgacgatacagccggctgggacacgcgcatcacggaggacgacctgcaaaatgaggccaaaataaccgacatcatggagccggaacacgcgctcctggccaaggccatcttcaagctgacctaccagaacaaggtggtccgagtgcaacgccccgcgaagaacgggacggtcatggacgtcatctcccgccgggaccagcgcggctccggacaagtggggacctacggcctcaacaccttcaccaatatggaagcccagctgatcagacagatggaaagcgaggggatcttcttacccagcgagctagagacaccgaaccttgcggagcgcgtgctggactggcttgagaagtacggcgtcgagcggcttaagcgcatggccatcagcggggacgactgcgtggtcaagccgattgacgaccggttcgccacggcgctgacggcgctcaacgacatgggtaaggtcaggaaggacatcccccagtgggagcccagtaagggctggaacgattggcaacaggtcccgttctgcagccaccacttccaccaactgatcatgaaggacggtagagagatcgtggtcccgtgccgcaaccaggacgagctggtcggccgcgcacgcgtgagccagggggcgggctggtcgctccgggagactgcatgcctggggaagtcctacgcccagatgtggcagctgatgtactttcaccgccgggacttacgactggcggcgaacgccatatgcagcgccgtccctgtggactgggtgcccacgagccgcaccacctggagcatccacgcacaccatcagtggatgaccacggaagacatgctgagcgtctggaaccgcgtgtggatcgaggagaacccctggatggaggacaagacccatatcagttcgtgggaggacgtgccgtacctggggaagcgggaggatcagtggtgtgggtccctgattggcctgaccgctcgtgccacctgggccaccaacatccaggtagccatcaaccaggtgcgccgtctcatcggcaatgagaactacctggattacatgacgagcatgaagcgcttcaagaacgagagcgaccccgagggggccctgtggtga

SEQ ID NO: 23725 - RNA, 9879 nt, synthetic construct
  misc_feature 1..9879: note = derived and/or modified CDS sequence (opt11) from DENV-1__HM469966__SS-prME
  source 1..9879: mol_type = other RNA
agcgtgaccatgctgctcatgctgatgcccaccgccctggccttccacctcaccacccggggcggggagccccacatgatcgtgagcaaacaagaaagaggcaagagcctattattcaagacaagcgctggggtgaatatgtgcacgctcatcgccatggatcttggcgagttatgcgaggatactatgacctacaaatgccccaggatcacggaggcagagcccgacgacgtggactgctggtgcaacgcaacggacacgtgggtgacctacgggacctgcagccagactggcgagcaccggagagataagcggtcagtagccctagcgccccacgttggcttgggtctggagactcgaaccgagacctggatgagctccgagggcgcctggaagcagatacagagagtcgaaacctgggccctccgccatcccgggttcacggtgatcgctctcttcctggcccatgccatcggtacctcgattacccagaaaggtatcatcttcatcctcctaatgttagtgactccctccatggccatgcggtgcgtcggcattggaagccgcgacttcgtggagggcctcagtggcgcgacgtgggtagacgttgtcttggagcatgggtcctgcgtgaccaccatggccaaggacaagcccaccctggacattgagctcctgaagacagaggtgaccaatcccgccgtgctccggaagctctgcatcgaggccaagatatccaacaccactacggatagccgctgcccgacccagggcgaagcaaccctcgtggaagaacaggacgccaacttcgtctgccggcgcacctttgtcgaccgcggctgggggaacggttgtggactgtttggcaagggctcgctcatgacctgtgccaagttcaagtgtgtgaccaagctggaaggtaaaatcgtccaatacgaaaatttgaagtacagcgtgatcgtgaccgtgcacaccggggaccagcaccaggttgggaacgaatccacggagcacggcacaaccgcgactatcaccccccaggccccaacgactgagatccagttaaccgactacggggccctgaccctggactgcagcccaaggacgggcttagacttcaacgagatggtattgctgactatgaaagagaagtcctggctcgtgcacaagcagtggttcctggacctgccattgccctggacctcgggggcgagcaccagccaggaaacgtggaacaggcaggacctgcttgtcactttcaagaccgcgcacgcgaagaaacaggaagtcgtggtgcttggcagccaggagggcgccatgcacacggctctgactggagccaccgagattcaaacctctggtaccacgaccatctttgccgggcatctgaagtgtagattgaagatggataagctgactcttaagggcatgagctacgtaatgtgcaccgggtccttcaagctcgagaaggaggtggcggagacgcaacacggcaccgtgctggtgcaaatcaaatacgagggcacggacgcaccgtgtaagatccccttcagcacccaagacgagaagggggtgacccaaaacggaagattaatcaccgccaatccgattgtgaccgataaagaaaagcccgtcaacatagaagccgagccaccctttggggagtcttacatcgtgatcggcgcgggcgaaaaggcccttaaactcagctggttcaaaaaggggtcgagcatcggcaagatgttcgaggctaccgcgagaggggcccggcgcatggcgatattaggcgacaccgcatgggatttcggttccatcggcggcgtgttcaccagcgtcggtaagctggtgcaccagatctttggcaccgcctatggagtcctgttctccggcgttagctggactatgaagatcgggatcggagtgctgctgacgtggcttggcctgaactcgcgcagcacctccctgtcaatgacctgcatcgccgttgggctcgtaaccctgtacctgggggtgatggtgcaggccgattccgggtgcgtcatcaactggaagggtcgggagctcaagtgtggaagcggcattttcgtgaccaacgaggttcacacctggactgagcagtacaaattccaggcggacagtccgaagcgcctgtccgcagctatcggcaaggcctgggaggagggggtctgcggcattcggagcgccacccgcctggaaaacatcatgtggaagcagatcagtaacgagctcaatcacattctgctggagaacgacatgaaattcactgtagtggtcggggacgtagcgggcatcctcgcccaggggaagaaaatgatacggccccagcccatggagtacaagtacagctggaagtcctggggcaaggccaaaatcatcggcgccgacgtgcagaacacgacattcatcatcgacggccccaacaccccagagtgccccgacgaccagcgcgcgtggaacatttgggaggttgaagactacggcttcggtatctttaccacaaacatatggctgaagctgcgggattcctacactcaggtatgcgatcatcgcttaatgtccgctgcgatcaaggacagcaaggccgtccacgcagacatgggctactggatcgagtccgagaagaatgagacctggaaactggcgcgggcctcgtttatagaggtcaagacatgcatctggcccaagagtcacacgctgtggagcaacggggtcctcgagtccgagatgataatcccgaagatttacgggggcccaatcagccagcacaactacagacctgggtacttcacccagaccgccggcccctggcaccttgggaaacttgagctcgacttcgacctgtgcgagggcacgacggtggttgttgacgagcattgcggcaatcgggggccgtccctgcgcaccaccaccgtgacgggcaagataatccatgagtggtgctgccgaagctgtaccctaccgcccctacgcttccgcggggaggacgggtgctggtatgggatggagatccgccccgtcaaggagaaggaggagaacctggtgaagtccatggtgagcgccggcagcggcgaggtcgactccttcagcctggggttgctgtgtatctccattatgatcgaggaggtgatgcggagccgctggtcacgaaagatgctcatgaccgggaccctagctgtgttcttcctgctaatcatggggcagctcacatggaatgacctgatccgcctctgcatcatggtgggcgcgaacgcctctgacaggatggggatgggaaccacatatctggccctgatggccaccttcaagatgcggcccatgtttgccgtgggcctcctattcaggcggttaacgtcccgcgaggtgctcctcttaacaatcgggctcagcctggttgcctccgtggagctgcccaacagcctcgaggagctgggcgatgggctcgccatgggaatcatgattcttaaactgctaacggacttccagtcccaccagctctgggccactctccttagcctcacgtttatcaagacaaccttctccctgcactacgcctggaaaaccatggctatggttctaagcatcgtgtcgctcttccccctgtgcctgagtaccacctcccagaagactacctggctccccgtcctgttaggttccctcgggtgcaagccgctgacgatgttcttgatcgccgaaaacaagatctggggccggaagagttggcccctcaacgagggcatcatggccgtcgggatcgtgtctatcctgctaagctccctcctgaagaatgacgtcccgctggccggcccccttatcgctggcggcatgctgatagcgtgctacgtaatcagcgggtccagcgccgacctgagtttagagaaggccgccgaggtaagctgggaggaggaggccgaacactccggcgcgagccataacattctggtggaggtccaggacgacgggaccatgaagattaaggacgaggagcgcgacgacactctgaccatcctcctgaaggccaccctgctcgccgtgtccggcgtctacccgctctctatccccgcaacactattcgtctggtacttctggcagaagaagaagcagcggagtggggtcctctgggatacccccagcccgcctgaggtggaacgcgccgtcttggacgacggtatctaccggataatgcagcgcggcctgctggggcgatcccaggtgggcgtcggggtcttccaggagaatgtgttccacaccatgtggcatgtgacccgcggcgcagtcctcatgtaccaggggaaacggctggagccaagctgggcatccgttaagaaggatttgatcagctacggcggcggttggcgcctccagggctcctggaacaccggtgaggaggtgcaggtaatcgccgtcgagcccggcaagaatccaaagaacgtgcaaactgccccgggtacctttaagacccccgagggcgaggtcggcgccatagctctggacttcaagcccggcacgtccggctcccccatagtgaaccgggaggggaagatcgtgggtctctacggcaacggggtcgtgaccaccagtggcacttatgtgagcgccattgcccaggccaaggcgtcccaggaagggccgcttcccgagatcgaggacgaggtcttccgcaagcggaacctcacgatcatggacctacaccccggtagcgggaagacccgccggtacctcccggccatcgttcgcgaagcaatcaaacggaagctccgcaccctgattctcgcgcccacccgcgtggtcgccagtgagatggcggaggccctgaagggtatgccaattaggtaccagacaacggccgtcaagagcgagcacaccggcaaggagatagtggatctgatgtgccacgccacttttacgatgcgcctcctgtcccccgtccgggtgccgaactataacatgatcattatggacgaggcccacttcaccgacccctcctccattgctgcccgcggctacatcagcaccagagtgggcatgggagaagccgccgcaatcttcatgaccgcgacgccgcccggcagtgtcgaggcctttccacaaagcaacgctgtaatccaggacgaggagcgggacatccccgagcgctcatggaacagcgggtacgactggataaccgatttccccggcaagacggtatggttcgtccccagcatcaagagcggcaacgatatcgcgaactgcttacgcaagaatgggaagcgggtcatccagctctccagaaagaccttcgatacggaataccagaagaccaaaaataacgactgggattacgtggtaaccaccgacatcagcgagatgggcgcgaacttccgtgccgaccgcgtgatcgacccgcggcgctgcctgaaacccgtgatcctgaaggacggacccgagagagtagtgctcgccggccccatgccggtcacggtcgcctccgcagcgcagcgcagagggcgcatcggccgaaaccacaacaaggaaggcgaccagtacatttacatggggcagcccctgaacaacgatgaggaccacgcccactggacggaagcaaagatgctgctcgataacataaacacccctgagggcatcatccccgccctgttcgagccggagcgagaaaagtctgctgcaatcgacggtgagtacaggctgcggggcgaggcccgcaagactttcgtggaactcatgcggcgcggggacctccccgtctggctgtcctacaaagttgccagcgagggattccagtacagcgaccggcgctggtgttttgacggcgagcggaacaaccaagtgctcgaggagaacatggacgtcgagatctggacgaaggagggggagcgcaagaaactgcggcctagatggttggatgcccgcacatactcggaccccctcgccttacgcgaattcaaagagttcgcggccggccggcgcagcgtatccggggatctgatcctcgagatcggcaagctgccgcagcacctaacccagcgggcccagaatgccctcgataacctggtgatgcttcacaatagcgaacagggcgggcgcgcgtaccggcacgcaatggaggaactcccggataccatcgagaccctgatgcttctcgccctgatcgccgtactaaccggcggggtgaccctattcttcctgtccgggcgcgggctgggcaagaccagcatcggcctcctgtgtgtgatggcatccagcgtcctgctctggatagcgagtgtggagccgcactggatcgctgcctccatcattctggagttctttctgatggtgctcctgattcccgaaccggaccggcaacggacgccgcaggacaaccaactcgcttacgtggtcatcgggctcttgttcatgattttgacggtcgccgcgaacgagatgggtctcctggagacgaccaaaaaggacctggggattggacacgtcgccgtggagaaccaccatcacgcagctatactagacgtggacctgcaccccgcctccgcgtggactttgtatgccgtcgccacgaccatcatcaccccgatgatgcggcacaccatcgagaacacgaccgctaacataagcctcacggccatcgcaaaccaggccgccatcctgatgggtctggacaagggatggccgatctccaagatggatattggcgtcccacttcttgccctggggtgctacagccaggttaaccccttgaccctgacggcggccgttctgatgctcgtggcgcactacgccatcatcggccctgggctgcaagcaaaggcgacccgcgaggcccagaaacgcaccgccgccgggatcatgaagaaccccaccgtagatgggatcgtcgccatcgacttggaccccgtggtgtacgacgcgaaattcgagaagcagctcggccagatcatgctgctgatcctctgtacatcccaaatcctgctaatgcgtaccacctgggccctctgcgagagcattactctggcaactgggcccttaaccaccctctggaaggggtccccgggcaagttttggaacaccacgatcgccgtctctatggccaacatctttcgcggttcctacctggctggtgcaggcctggccttctcactgatgaagagcctgggaggcggtaggcgcgggaccggtgcccagggcgaaaccctgggcgaaaagtggaaacggcagctcaaccagctgtctaagtcggagtttaacacctataagcgctctgggatcatggaggtggatcgtagcgaggcgaaggagggcctaaagcgcggcgagacgaccaaacacgcggtctcccgcggcaccgccaagctccgctggttcgtcgagcggaacctggtgaagcccgagggcaaggtgatcgatctgggctgcggccgcgggggttggagttattactgcgccgggcttaagaaagttaccgaagtgaagggttacacgaaaggcggcccaggccacgaggagcccatcccaatggcgacctacgggtggaacctcgtgaagttgtactccggcaaggacgtcttcttcatcccgccggagaagtgcgacacccttctctgcgatataggcgagtcgtcccccaatccgaccatcgaggagggccggacgctgcgcgttcttaagatggtcgagccttggctccgagggaaccagttttgcatcaagatcttgaacccctacatgcccagcgtcgtggagacccttgagcagatgcaacgcaagcacggcggcatgctagtgagaaacccgctctcccgaaactcgacccacgagatgtattgggtgtcctgcggcactggcaatatagtgagcgcagtgaacatgacctcccggatgctgctcaaccgcttcacgatggcacacaggaagcctacctacgaacgtgacgttgacctaggggccgggacccgccacgtggccgtggagcccgaagtcgccaatctggacatcatcggccagcgtatagagaacatcaagcacgaacacaagtcgacctggcactacgatgaggataacccgtacaaaacgtgggcttaccacgggtcctacgaggtgaagccaagcggctccgcgagcagcatggtcaacggggtcgtgaagctcctgacaaagccatgggacgtcattcccatggtaacccagatcgccatgaccgatacgacccccttcggccagcagagagtgttcaaggagaaggtagacacccggacaccgaaggcaaagcgcggaacggcgcaaatcatggaggtgaccgcgcggtggctttggggattcctttcccgcaacaagaagcctagaatctgtacccgcgaggaattcacccggaaagtgcgcagtaacgccgccattggcgctgtcttcgtggatgaaaaccagtggaactccgcgaaggaggctgtggaagacgagcggttttgggatctggtacatcgcgagcgggagctgcacaagcaggggaagtgcgccacgtgcgtctacaacatgatgggcaagagagagaagaagcttggggaattcggcaaggccaaggggagccgcgctatctggtacatgtggctgggtgcacgctttctagaattcgaggcacttggcttcatgaacgaggaccactggttttcccgggagaacagcctgtccggggtggagggggaagggctgcacaagctaggatacattctgcgggacatcagcaaaatccccgggggcaacatgtacgcagatgacaccgcgggctgggacacccgaatcaccgaggacgaccttcagaacgaggctaaaatcacagacatcatggagccggagcacgctctcctggccaaggccatcttcaagttaacctaccagaacaaagtagtgcgagtgcagcgccctgccaaaaacgggaccgtaatggatgtgatcagccggcgagaccagcgcggaagcggccaggtggggacctacggcctcaacacatttaccaacatggaggcccagctgatccgccaaatggagtctgaggggatattcagcccgagcgagctagagactcccaacctcgcggagcgggttcttgattggttggagaagtatggcgtggaacgcctcaagcggatggccatcagcggcgacgactgcgtggtcaaaccgatcgacgacagattcgccaccgccctgacggccctgaacgacatgggaaaggtacggaaggacatcccccagtgggaaccctccaaaggttggaacgactggcagcaagttcccttttgtagccatcacttccaccagctaatcatgaaggacggacgcgagatcgtggtcccttgccggaaccaggacgagttggtgggccgcgcccgggtctcccagggagccggctggagcttacgcgaaacagcctgcctggggaaaagttacgcccagatgtggcaactgatgtatttccacaggcgagacctccggctcgcggccaacgcaatatgctccgcagtgccggtggactgggtccccacgagccgcaccacctggagtatccacgcccaccatcagtggatgaccaccgaggatatgctgagcgtatggaacagagtgtggatcgaggagaacccttggatggaggacaagactcacatttccagctgggaggatgtcccttacctgggcaagcgagaggaccagtggtgcggatcgctcatcggcctgacggcgcgcgccacctgggccaccaatatccaggtggccatcaaccaggtgcggaggctgatcggcaacgagaactacctggactacatgacaagcatgaaacggttcaaaaatgaatccgacccggaaggggcgctgtggtaa

SEQ ID NO: 23726 - RNA, 9879 nt, synthetic construct
  misc_feature 1..9879: note = derived and/or modified CDS sequence (opt11) from DENV-1__JX669462__SS-prME
  source 1..9879: mol_type = other RNA
agcgtgaccatgctgctcatgttactgcccaccgctttggcctttcacctgaccacgcgcggcggggaaccccacatgattgtttcgaagcaggaacgtggcaagagtctcctctttaagaccagcgcgggggtcaatatgtgtaccctgatcgctatggatctgggcgagttatgcgaggatacaatgacctacaagtgcccccgcatcaccgaggctgagccggacgacgtggactgttggtgtaacgccaccgatacctgggtcacgtacgggacctgcagccagaccggtgagcaccgtagagagaagagatcagtggccttggcgccgcacgtaggcttagggctggagacccgcaccgagacttggatgagcagcgagggcgcatggcgccagatacagcgcgtggagacttgggcactgcggcatcctgggtttactgttatcgcattctttctggcccacgccattggtaccagcataacccagaaggggatcatctttatcttgttaatgctggtgactccctcaatggccatgcgctgtgtaggaatcggcaaccgggacttcgtggagggcctctccggcgcgacttgggttgacgtcgtgctggaacacgggtcctgcgtgaccacaatggcgaagaacaagcccacgctggacatcgagctcctgaagacggaggtaaccaaccccgcggtgttacgcaaactctgcatcgaggccaagatctcgaacactactaccgattcccggtgccctactcagggcgaggccacactggtggaggagcaggacgccaacttcgtgtgccgccggaccttcgtcgacagaggctggggaaacgggtgtggactgttcggcaaggggagcctcctaacttgcgccaagttcaagtgcgtgaccaagctagagggcaagatcgtgcagtacgaaaacctcaagtactccgtgattgtaacggtccacaccggggaccagcatcaggtggggaacgaaactactgagcacgggacgatcgccaccatcacgccccaggcgcccacgtcagagatccagctgaccgattacggggccttgaccctcgactgctcacctcgcacgggcctcgacttcaatgagatggtactgctcacgatgaaagagaaaagctggctggtccacaaacagtggttcctcgatctccccctcccctggacttccggggccagcacctcacaggagacctggaaccgccaggacctattagtgacgtttaagactgcacacgcgaagaagcaggaggtcgtggttctgggatctcaggaaggggctatgcacacagccctgacgggggcaacagagatccagaccagcggcaccaccacgatctttgccgggcacctcaaatgccgactgaagatggacaagctgaccctcaaagggatgtcctacgtcatgtgcacagggtcattcaagttagagaaagaggtcgcggaaacccagcacggaacggtgctggtccaggtgaagtacgaggggacggacgcgccctgcaagattccattttccacgcaggacgagaaaggggttacccagaacggacgcctcatcacggccaacccgatcgtcaccgacaaggaaaagcccgtaaacattgagaccgagccgcccttcggggagagctacatcgtggtcggggccggcgaaaaagcgttgaaattgagctggttcaagcgggggtcctccatcggcaaaatgttcgaggccaccgcccgcggggcccggcggatggctatcctcggcgacacggcgtgggatttcggcagcattggcggcgtgttcaccagcgtaggaaagctcgtccaccaggtcttcggcaccgcctacggggtgctgttctcaggagtttcctggaccatgaagatcgggatcggaatcttgctaacttggctgggcctcaatagccgatccaccagcctctccatgacctgcatcgccgtcggcatggtgaccctgtacctgggcgtaatggtgcaggcagattctgggtgcgtcatcaactggaaggggcgagaactcaagtgcgggagtggcatattcgttacgaacgaagtgcatacctggacggagcagtacaaatttcaggccgacagtcctaagcgcttgtccgcagccattggcaaggcatgggaggagggggtgtgcggaatccgaagcgccacacgactggagaacatcatgtggaagcagatcagcaacgaactcaatcacatcctgctagaaaacgatatgaagttcacggtcgtggtaggggacgctaacggcatcctcgcgcagggaaagaagatgatccggccacagccgatggagcacaagtacagctggaagtcatggggcaaggctaagatcataggcgccgacatccagaacaccacctttatcattgacgggcccgacaccccggagtgccccgacggccagcgcgcctggaacatatgggaggttgaggattacgggttcggcgtattcaccacgaacatctggcttaaactcagagactcctacacccagatgtgcgaccatcgtctaatgagcgcggccatcaaggattccaaagccgtgcacgcggacatgggctactggatcgagtcggagaagaacgagacctggaagttagcccgggcgagtttcatcgaggtcaagacatgcacgtggccaaagagccacaccctgtggtccaacggagtgctggagagtgagatgatcatccctaaaatttttggcgggccgatctcccagcacaactaccgccctggttacttcacccaaactgccgggccctggcatctgggcaagctggaactcgacttcgacctgtgcgagggcacgaccgttgtggtcgacgagcattgcgggaacaggggcccgagcctgcgcactaccacggtcaccggtaagattatccatgaatggtgttgccggtcctgcaccctaccgccactacgcttcaggggagaggacgggtgctggtacggcatggagatacgccccgtgaaggagaaggaggagaatcttgtgagaagtatggtgtccgcaggaagtggggaggtcgacagcttctccctcggcattctatgcgtgtctatcatgatcgaggaagttatgcgctcccgctggagccgcaaaatgttgatgaccgggacgcttgcggtcttcctgttgctgatcatgggccagctgacctggaacgacctgatcagactctgcatcatggttggggcgaacgcatcagacaggatggggatggggaccacctatctggccctgatggccacgctcaagatgcgaccgatgttcgcggtgggtctactgttccggcgtctgacctcgcgggaagtcttgttgctcaccatcggtctgtccttggtggcaagcgttgagctccccaactccctcgaggaacttggagacggcctcgctatgggaataatgatgctgaaactgctcaccgagttccagccccaccaactatggacaactctgctaagccttaccttcgtgaagaccacgttaagcctagactacgcctggaagacaactgccatggtactgagcatcgtgtctctgttccccttgtgcctgtccaccacttcacagaagaccacctggctgccggtgttgctggggagcttcgggtgcaagcccctgacaatgttcctaataaccgagaacaagatctgggggcgcaagtcctggcctctgaacgaaggcataatggccataggaatcgtgtccatccttcttagctcgctgctgaaaaatgacgtccccctagcgggcccgctaatcgccggtggaatgctaatcgcttgctacgtaatctccgggagtagcgcagacctctccctggagaaagcagcagaagtgtcatgggagcaggaagctgaacacagtggcgccagccacaacatactcgtagaggttcaggacgacggtacgatgaagatcaaggatgaggagcgcgatgataccttaaccatactacttaaggccacactactggcagtgtccggggtctaccccatgagcatccccgcaacgctgttcgtgtggtatttttggcagaagaagaagcagcgctccggcgtgttgtgggacacaccaagcccacccgaagtcgagcgggccgtgctggatgacggcatttaccgcatcctgcagcgaggactgctcgggcgctcccaggtcggggtcggggtgttccaggacggggtattccacacaatgtggcacgtcactcggggcgcggttctaatgtaccaaggcaagcgcctagagcccagctgggcctccgtaaagaaggacctcatcagctacgggggcgggtggagattccaaggctcctggaacacgggggaggaggtccaggtgatcgccgttgagccgggcaagaacccgaagaacgtccagaccactcccggcaccttcaagacgcccgagggggaggttggagcgatcgccctggacttcaagcccgggacctctggctcaccgatcgtgaaccgcgaaggcaagatcgtcgggctttacggcaacggggtggtgaccaccagcggcacgtacgtcagtgccatcgcccaagccaaagcgtcacaggaagggcccttgcccgagatcgaggatgaggtattcaagaagcgcaacctaaccatcatggacctgcacccaggcagcggcaagacccgccggtacctacccgcaatcgtccgcgaggccatcaagaggaaactgcggaccctaatcctcgcgcccacgcgggtcgtcgcctccgagatggccgaggcgttgaagggtatgcctatccgctaccagacaaccgccgtaaagagcgagcataccggccgtgagatcgtcgacctaatgtgccacgcgacctttactatgcggcttctgtccccggtccgcgttcccaactacaatatgatcatcatggacgaagcgcacttcaccgaccccgccagcattgccgccagagggtacatatccaccagagttgggatgggggaagcagcagccatcttcatgaccgccacgccgccgggctcggtggaggcctttccccaatccaacgccgtaatccaggacgaggagcgggacatacccgagcgatcctggaactccggttatgactggatcaccgacttccccgggaagacagtttggttcgtaccctcaattaaatccggcaacgacatcgcgaactgcctgcggaaaaatgggaagcgcgtgatccagctcagccgcaagacattcgacacagagtatcagaagaccaagaacaacgactgggactacgtcgtgaccacggacatctccgaaatgggcgccaatttccgcgcagaccgggtaattgacccacgtcggtgtctgaagcccgtcattttgaaggacgggcccgaacgcgtgatcctcgctggtccgatgcccgtcaccgtggcctccgccgcccagcggcgaggccgcatcggtagaaaccagaacaaagagggggatcaatacgtgtacatggggcagcctctgaacaacgatgaagaccacgcgcattggacagaggccaagatgctgctggacaacatcaacacgcccgagggcatcatccctgcgctgttcgagcccgaaagggagaagtccgccgccatcgacggggagtacagactacgcggcgaggctcggaagacgttcgtggaactcatgcgccggggcgaccttcccgtgtggctaagttataaggtggcatccgaggggttccagtactctgatcgccgatggtgtttcgatggggaacgaaacaaccaggttctcgaggagaacatggacgtggagatctggaccaaggagggggagcgtaagaaacttcgcccacgctggttggacgctcgaacgtactccgatccgctcgctctgagggagtttaaagagttcgcagccggtcgccggagcgtgtccggcgaccttatcctcgaaatcgggaagctgccccagcacctgaccctcagagcccagaacgcactggacaatctggtcatgctccacaactccgagcaaggcggaaaagcatacaggcacgccatggaggagctgcccgacaccatcgagactctgatgctcttggccctgattgcagtactgaccggtggtgtgacactgttcttcctgagcggcaagggactgggcaagacctcgatcggtctcctatgcgtcactgcctcctctgccctcctgtggatggccagcgttgaaccccactggatcgcagcgtccatcattttggagttcttcctcatggtgctgttaatcccggagcccgatcgtcagcggacgccccaggacaaccagctggcctacgtagtgatcgggctattgttcatgatcctcaccgtagccgccaacgagatgggcctactggagaccacgaagaaggacctcgggataggctatgtcgcggcggagaaccatcaacacgcgaccatgctagacgttgacctgcaccctgcgtcagcctggaccttatacgcggtcgctaccactgtcatcacccccatgatgcgccataccatcgagaacaccacagccaacatttccctgaccgctatcgccaaccaggccgcgatccttatggggctagacaagggatggcccatcagcaagatggatataggcgtgcctctgctggctcttggctgctactcccaagtgaacccgttaactctgaccgccgccgtcttgatgctggtggcgcactatgcgatcatcggacccgggttgcaagccaaggcaacgcgcgaagctcaaaagcggaccgcggccgggattatgaagaatcctacggtggacggcatagtcgctatagacttggatcccgtggtgtacgacgccaagttcgaaaagcagcttgggcaaataatgctactcatcctgtgcacgagccagattctgctaatgcgcacaacctgggcgctgtgtgaatccataacgctggcgaccggcccgctcacgaccctttgggaggggtctcccggcaagttttggaacaccaccatcgctgtctcaatggcaaacatcttcagagggagctacctcgccggggctggccttgctttctcgctgatgaagtcactcgggggagggcgccgagggacaggagctcagggggagaccctcggcgagaagtggaagagacagttaaaccaactgtctaaatccgaatttaacacttataagcggagcggtataatggaggttgacagatcggaagccaaggaaggcctaaagcgcggggagaccacgaaacacgccgttagcagaggcacagcgaagctgcggtggtttgtggagcgcaatttggtgaaacccgagggaaaggtgattgatctcgggtgcgggcgcgggggctggtcctactactgtgcagggctcaagaaggtaaccgaggtgaagggctacaccaagggcggcccaggccacgaagaaccgattccaatggctacctacggctggaacttggtgaaactgcatagcgggaaagacgtatttttcatgccgcccgagaagtgtgacacgttactgtgtgacatcggggagtcctccccgaaccccaccatagaggagggtcgcactctccgggtactcaagatggtcgaaccctggttgcgcggaaaccagttctgcatcaagatcctaaatccctatatgccctccgttgtggagacactcgagcagatgcagcggaaacatggaggaatgctagttcgcaaccccctgagccggaactccacgcatgagatgtactgggtctcttgcgggaccggcaacattgtgagcgcagtaaacatgacatcacgtatgctgctcaataggttcacaatggcccatcggaaacccacgtatgaacgggacgttgacctgggcgcggggaccaggcacgtcgccgtggagcccgaggtcgccaatctagacatcatcggccagcgaatcgaaaacattaagaacgagcacaaatctacctggcattacgacgaagacaacccctacaagacctgggcgtaccatggctcttacgaggtgaaaccctccggcagcgcgtcctcaatggtgaatggcgtggtgcggctgcttacgaagccctgggacgttatccccatggtgacccagatagcaatgacagatactacgccgtttggccagcagagggtatttaaggaaaaggttgatacacggacaccccgtgcaaagagaggcacaacgcagatcatggaggtgaccgccaagtggctatgggggttcctgtcccggaacaagaaaccgcgcatctgcactagggaggagttcacccggaaggtgcgaagcaacgctgcaatcggcgcggtcttcgttgacgagaaccaatggaactccgcgaaggaggcagtggaagacgagagattctgggatttagtgcaccgagaacgcgaactacacaagcagggaaagtgcgcaacgtgcgtgtacaacatgatgggcaagcgcgagaaaaagctgggtgagttcggcaaagcgaaaggttcccgggccatctggtatatgtggcttggggcccgcttcctcgagttcgaggcactgggctttatgaacgaggaccattggttcagccgcgagaactcgctgagtggggtggagggcgagggcttgcataagctgggctatatcctgcgcgacatttccaaaatcccgggcggaaatatgtatgccgacgatactgctggctgggacacccgcatcaccgaggacgacctccagaacgaggccaagattacggacatcatggaacccgagcacgcattgctggctaccagcatctttaagctcacctatcaaaacaaggtcgtgcgggtacagcgccccgcgaaaaacgggactgtaatggatgtgatctcgcggcgggaccagcggggaagtggccaggtcgggacttacggcctgaacacctttaccaacatggaggtccagctgatccggcaaatggagtcagaggggattttcttgcctagcgagctggagactcctaaccttgctgagcgggccctcgattggttggagaagcacggcgccgagaggttgaagcgtatggctatctctggtgacgactgtgtcgttaagcccatcgacgatcgcttcgcgactgcgctcactgccctgaacgacatgggtaaggtccggaaagacatacctcaatgggagccctcgaagggctggaacgactggcaacaggtgccgttctgctcccaccacttccaccagttgatcatgaaagacggcagggaaatcgtagtgccatgccgcaaccaagacgagctcgttggccgcgcccgggtgagccagggggctggatggagtctgcgcgagaccgcctgcctgggtaagtcgtacgcgcagatgtggcaactcatgtacttccatcggcgagacctgcggctggcggctaacgccatctgttcagctgtccctgtggactgggttcctgcgagccgcacaacgtggtcgatccatgcccaccaccaatggatgacgactgaagacatgctctccgtgtggaaccgcgtgtggatcgaagagaacccctggatggaggataagacgcacgtgagttcctgggaggaggtaccatatctgggcaagcgcgaggaccagtggtgtggcagcctcatcggtctcacagcccgggcaacgtgggcgaccaatatccaggtggccataaaccaggtcaggcgccttatcgggaacgagaactacctggattacatgacgtccatgaagcgattcaaaaacgagagcgaccccgagggcgccctctggtga

SEQ ID NO: 23727 - RNA, 9879 nt, synthetic construct
  misc_feature 1..9879: note = derived and/or modified CDS sequence (opt11) from DENV-1__JX669463__SS-prME
  source 1..9879: mol_type = other RNA
agcgtgaccatgctgctcatgttgctgcccaccgccctcgccttccacctgacgaccagaggaggggaacctcacatgatcgtgtcgaaacaggagcggggaaagagcttgctgttcaagaccagcgcgggggtgaacatgtgtaccctaatcgccatggacctgggcgagctctgcgaggacaccatgacctacaaatgcccccgaatcaccgaggccgaacccgacgacgtcgactgttggtgtaacgccaccgacacctgggtcacctacggcacctgtagccagaccggcgagcacaggcgcgagaaaaggtccgttgcattagcgcctcacgtgggcctggggctggaaactcgcaccgagacctggatgagctcggagggcgcatggcgacagatccagcgcgtcgagacctgggccctgcggcaccctggtttcacggtgatcgcgttcttcctggcgcacgcaatcggcaccagtatcactcagaaaggtatcatattcattttgctgatgcttgtgaccccctccatggccatgcgatgcgtcggcattggcaatcgggactttgtcgagggccttagcggcgcaacctgggtagacgtggtgctggaacacgggtcctgcgtgaccaccatggccaagaataagcccactctggacatcgagctcttgaagacggaggtcaccaaccccgcggttctgcgcaaactctgcatcgaggccaagatctccaacaccacgacggactcccggtgcccgacgcaaggcgaggccaccctggtggaggagcaggacgccaactttgtctgtcgtcggacctttgtggaccgcggctgggggaacggctgcgggctgttcgggaagggcagcctcctgacgtgcgctaagttcaagtgcgtgaccaagctggagggcaagatcgtccaatacgagaacctcaagtactccgtgatcgtgaccgtccacaccggcgaccagcaccaggtggggaacgagacgaccgagcacggcaccatcgcgacgatcacgcctcaggccccgacgtcagagatacaactcacagactacggggccctaaccctcgactgcagcccccggaccggcctggactttaacgaaatggtcctactcacgatgaaggagaaatcctggctggttcacaagcagtggtttctggatctcccgctgccctggacctccggagctagcacctcccaggagacctggaaccgccaagacctgctcgtgacgttcaagaccgctcatgcgaagaagcaggaggtcgtggtgctgggctcccaggagggcgccatgcacaccgccctgacaggggcgactgagatccagaccagcggtacgaccacgatctttgccgggcacctcaaatgccggctgaaaatggacaagctgaccctcaagggtatgtcctatgtcatgtgcaccgggagcttcaagctggagaaggaggttgcagagacccagcacggcaccgtgctggttcaagtgaaatatgagggcaccgacgcaccctgcaaaatccccttctccactcaggacgaaaaaggcgtgacccagaatggtcgccttatcacggctaatccgatcgtcaccgacaaagaaaagcccgttaacatcgagactgagccacccttcggggagtcctacatcgtggtcggcgccggcgagaaggcgctcaagctctcttggttcaagcgggggagctccatcggcaagatgttcgaggccaccgcccgcggggccaggcggatggccatattaggggacacggcgtgggacttcggtagcatcggcggcgtgttcacatcggtggggaaactggtccaccaggtgttcggcaccgcctacggggtgctgttcagcggtgtctcttggactatgaagatcgggatcggcatcctgctcacctggctaggcctcaactcacgctctaccagcctctccatgacctgcatcgccgtggggatggtgactctgtatctgggcgtgatggttcaggccgattctgggtgcgtgatcaactggaaggggcgggagctcaagtgcggaagcggtatcttcgtcacgaacgaagtgcatacctggacagagcagtacaaattccaggccgatagccccaaacgtctgagcgcagccatcggcaaggcctgggaggaaggggtgtgcggcatccgttccgcgacccgcctggagaacatcatgtggaagcagatcagcaacgagttaaaccacatcctactggagaacgacatgaagtttacggtcgtggttggggacgctaacggcatcctcgcgcaggggaagaaaatgatccggccccagcccatggagcacaagtactcctggaagtcctggggtaaggcaaagatcatcggcgccgacatccagaatactaccttcatcatcgacgggcccgacaccccggagtgcccggatggccagcgggcctggaacatctgggaggtcgaggactacggattcggcgtgttcaccacgaacatctggctgaagctgcgggattcctacacacagatgtgtgaccaccgcctgatgagcgcggctattaaggactccaaggctgtgcacgccgacatgggctactggatcgagagcgagaagaacgagacctggaaactggcccgggcgtccttcatcgaagtcaaaacctgtacgtggccaaagtcacatacgctgtggtccaacggggtgctcgagagcgaaatgatcatccccaagattttcgggggcccgatttcccagcacaactaccgccccggctactttactcagaccgcggggccctggcatctgggtaagctcgagctcgactttgacctgtgcgagggtactaccgttgttgtggacgaacactgcgggaaccggggcccgagcttgagaaccacaacggtaaccgggaagatcatccacgagtggtgctgccggtcctgcactctgccgcccctgaggttccggggcgaggacgggtgctggtatggcatggagatccggcccgtcaaggaaaaagaggagaacctggtgcgtagcatggtatccgcggggagcggggaggtcgacagcttcagtctcggcatactgtgcgtcagcattatgatcgaggaggtgatgcgctcccgctggagccggaagatgctgatgaccgggacgctcgccgtcttcctgctgttgatcatgggccagctgacctggaacgacctgatccgactctgcatcatggtgggcgccaatgcgagtgaccggatgggcatgggcaccacctatctggcgctgatggccacgttgaagatgcgcccgatgttcgccgtggggttattgttccggcgcctcaccagcagggaggttctgctactcacgatcggcctgtccctggtagccagcgtcgagcttccaaattccctggaggaactcggagacggcctagcgatgggcatcatgatgctgaagctgctcaccgagtttcaaccccatcaactctggacaaccctgctgagcctgaccttcgtaaaaaccacgttgtccttggactacgcctggaagaccaccgccatggttctcagcatagtatccttgttcccgttgtgcctgagcaccacgtcccagaagaccacctggctgccggtattgctggggagcttcggctgtaagcccctcaccatgtttctcatcaccgagaataagatctgggggcgcaagtcctggcctctgaatgaagggatcatggccataggcatcgtgagcattctgctcagcagcctgctgaagaacgacgtccccctcgccggaccgttgatagccggcgggatgctgatcgcttgctacgtgattagcggttccagcgccgacctctcgctggagaaggccgcagaagtgtcgtgggaacaggaggccgagcactcaggggccagccacaacatcctggtggaggtacaggacgatggcacgatgaagataaaggacgaggagcgggacgacacgctcaccattttgttaaaggccaccctcttggccgtgtcgggggtctaccccatgagtatccccgccacactatttgtgtggtacttctggcagaaaaagaaacaacgcagcggcgtgctctgggacaccccttccccgcccgaggtagagcgggccgtactggacgacggcatttaccgtatccttcaacgggggcttctcggccgctcacaggtgggtgtcggtgtgtttcaagacggggtgttccataccatgtggcacgtaaccagaggcgcggtgttaatgtaccagggcaagcgcctggagcctagctgggcctccgtgaagaaggacctcataagctacggaggcgggtggcggtttcagggcagctggaacactggagaggaggtccaggtgatcgccgtggaacccggcaagaacccgaaaaatgtacaaaccactcccggtaccttcaagacgcccgagggggaggtgggagccatagcgctggacttcaagcccgggacctccggtagcccgatcgtgaaccgcgagggcaagatcgtcgggctgtacggcaacggagtggtgaccactagcggcacatacgtctccgccatcgcccaggctaaggcgtcccaggaaggacccctccccgagatcgaggatgaggtgtttaagaagcggaatctgaccataatggacctacacccgggtagcggcaagacccgcaggtatctccccgcgatcgttcgcgaagccatcaagcgcaaactgcggaccctgatcctcgccccaacgcgcgtcgtagcatcggagatggccgaggccttaaagggaatgcccatccggtatcagaccaccgccgtcaaatcagagcataccggccgcgaaatcgtcgacctgatgtgtcacgccacgttcaccatgcggctcttaagcccggtgcgcgtgcccaactacaacatgatcataatggatgaggcgcacttcaccgaccccgccagcatcgccgcccgtgggtacatctccacccgcgtcggcatgggggaggccgcggcaatctttatgacagccacgcctcccggcagcgtagaggccttcccccaatcgaacgcagtaatacaggacgaagaacgggacatcccggaacggtcctggaactcaggctacgactggatcactgactttcccgggaagacagtctggttcgtccccagcatcaagtccggaaacgatatagcaaactgcctgcgcaagaatggtaagcgcgtgatccagctaagccggaagacgtttgataccgagtaccaaaagaccaagaataatgactgggattacgtcgtgactacggacatatctgagatgggcgccaactttcgggcggaccgggtgatcgatccccggcggtgcctgaaaccagtcatcctcaaggacggccccgaacgcgtcatcctcgccggtcctatgcccgtgaccgtagcgagcgcagcgcagcggcgcggtcgcatagggcggaatcagaataaggagggcgaccagtatatctacatggggcagcctctgaataatgacgaggaccacgcccattggactgaggccaagatgctgctcgacaacatcaatacccccgagggcatcatccctgcgttattcgagcccgagcgcgaaaagtccgccgccatcgacggggagtaccgcttgcgaggcgaggcgcggaagacgttcgtggagttgatgcgccgaggcgacctgcccgtgtggctgagttacaaggtggccagtgaagggttccagtacagcgaccgccgttggtgcttcgacggagagcgcaacaaccaggttctcgaagaaaacatggacgtcgagatctggaccaaggaaggggagcggaagaagctccgccctcgctggctcgacgcgcgcacctattccgacccgcttgccctacgggagttcaaagagttcgccgccggccggcgtagcgtgagcggcgaccttatcctcgagatcgggaagttgccgcagcacctgacacttcgagcccagaacgctctggacaacctggtgatgctccacaattcagagcagggcgggaaggcctatcggcacgccatggaggaactgcctgacaccatcgagacactaatgctcctggcgctgatcgcggtcttgaccggcggggtgaccctcttctttctatcaggtaaggggctcgggaagacctccatcgggctgctgtgtgtaacggccagctctgcgcttttgtggatggccagcgtcgagccccactggatcgccgcgtccataattctggaatttttccttatggtgctgctgatcccggagccggacagacagaggacgccccaggacaatcagctcgcatacgtggtcatcggcctgcttttcatgatcctcaccgtggccgccaacgagatgggcctactggaaaccacgaagaaggacctcgggatcggctacgtggcggcagagaaccaccagcacgccacaatgctggacgtcgatctgcaccctgcgtccgcctggactctatacgccgtggctactacggtgataaccccgatgatgcgtcacaccatcgaaaataccacagccaacatctcgctgaccgcaatcgccaatcaggccgcgatcctcatgggtctcgacaagggttggcctatcagcaagatggacataggcgtccccctgctggcgctcggctgctacagtcaggttaatccgctgacgctgaccgctgctgtgctcatgcttgtagcccactatgccatcatcggtcccgggttacaggcaaaggccacgcgcgaagctcagaagcggaccgccgccggcatcatgaagaaccccaccgtagacggcatcgtagccatcgacctcgaccccgtcgtgtacgacgccaagttcgagaagcagttagggcagatcatgctgctcatcctgtgcaccagccaaatcctgctcatgcgaaccacctgggccctgtgcgagtccatcaccctcgcaaccggcccgttaacgacgctgtgggaggggtccccgggcaaattttggaacaccaccatcgccgtatccatggccaacatttttcgggggagctaccttgccggagccggcctcgcgttctccctaatgaagtccctcgggggcgggcgccggggtacgggcgcccagggggagaccttaggcgagaagtggaaacgccagctgaaccagctgagcaagagcgagtttaatacctacaaacggtcaggtatcatggaggtcgaccgctcagaggcgaaggagggcctcaagcgcggggaaaccacgaagcacgcagtaagccgcggcaccgccaaactgcggtggttcgttgagcgaaacctggtcaagcctgagggcaaggtgatcgacctggggtgcggccgcgggggctggtcctactactgcgccgggctcaagaaggtgaccgaggtcaagggatacacaaagggcgggcccggccacgaggagccgattccgatggccacgtatggatggaacctggtgaaacttcacagcggcaaggacgtgttcttcatgccgcccgagaagtgcgacacgctcctgtgcgacattggagagtccagcccgaaccccaccatcgaggagggcaggaccctgcgtgtgttgaagatggtggagccctggctgcgcgggaaccagttttgcattaagatcctgaacccatacatgccgtccgtagtcgaaaccctcgaacaaatgcaacggaaacacgggggaatgctggtgcgcaaccccctaagccggaacagtacgcacgagatgtactgggtgagctgtgggaccggcaacattgtctccgccgtgaacatgaccagccgcatgctcctgaaccgcttcaccatggcccaccggaagcccacttacgagcgcgacgtggacctgggcgcggggactcggcatgtcgccgtggagccagaggtagccaacctcgacataatcggacagcgcatcgagaacatcaagaacgaacacaagagcacctggcattacgacgaagacaacccgtacaaaacctgggcctaccacgggagctacgaggtaaagccctccggcagcgcctccagcatggtgaacggggtcgtcaggctgctgacgaaaccgtgggacgttatccccatggtcacgcagatcgcgatgacagacaccacgccgtttggccagcagcgagtgttcaaggagaaggtggatacccggacgccgcgtgccaagcggggcaccacgcagatcatggaagtaacagcgaagtggctctggggattcctatcccgcaataagaaaccccggatctgtacccgcgaagagttcacccggaaggtccgcagcaacgcagctatcggcgcggtgttcgtagacgagaaccagtggaacagtgccaaggaggccgtggaggatgagcggttctgggatttagtgcaccgcgagcgggagctccacaagcagggaaagtgcgccacgtgcgtttacaacatgatgggaaagcgcgagaagaagctgggggagtttggtaaggcgaagggctccagagctatttggtacatgtggctgggggccagattcctcgagttcgaggccctgggcttcatgaatgaggaccactggttcagccgggagaactccctgagcggggtagagggcgaggggctccacaagttagggtacatcttgcgagacatctccaagattcctggcgggaacatgtacgccgatgacaccgcgggatgggacactcgcataaccgaagacgacttgcagaacgaggccaagatcacggacatcatggagccggagcacgccttactggcgacgagcatcttcaaattgacctaccagaacaaggttgtgcgggtgcaacgccccgcgaagaatgggactgtgatggacgtcatctcccggcgcgaccagcgaggaagcggccaggtgggtacctacggtctaaacacatttaccaacatggaggtgcagctaatccgccaaatggaatccgaggggatcttcttacctagcgagctggagaccccgaacctagcagagcgggccctcgactggctggagaagcacggcgccgagcggctaaagcggatggctatctccggggacgactgcgtggtcaagccgatcgacgaccgcttcgcaacggcgctcactgcactcaacgacatgggcaaggtgcggaaggacatcccccagtgggagcccagtaagggctggaacgactggcagcaggtccctttctgctcccatcatttccatcagttgatcatgaaggacgggcgcgagatagtggtgccttgtcggaaccaggatgagctagtaggccgcgcccgggtctcccagggtgctggctggtcactgcgggagaccgcttgtctgggcaagtcttacgcgcagatgtggcagctcatgtacttccatcggcgggacctgcgcctggcagccaatgctatctgctccgcggtacccgtcgactgggtgcccgccagccgcaccacctggagtatccacgcgcaccaccagtggatgacgacagaggacatgcttagtgtttggaaccgcgtatggattgaagagaacccgtggatggaggacaagacccacgtgagctcctgggaggaagtgccgtacctgggcaagcgggaggaccagtggtgcggctcgctgatcgggctgacagcccgcgccacgtgggcgaccaacatccaggtcgctatcaaccaggtgcggaggctgattggcaacgaaaactacctggactacatgacctccatgaagcggttcaagaatgagagcgatcccgagggggccctctggtga

SEQ ID NO: 23728 - RNA, 9879 nt, synthetic construct
  misc_feature 1..9879: note = derived and/or modified CDS sequence (opt11) from DENV-1__JX669464__SS-prME
  source 1..9879: mol_type = other RNA
tcggtaacaatgctgttaatgctattgcccaccgccctcgccttccacctgaccacccggggcggggaaccccacatgattgtttcgaagcaagagcgcggcaagagtctcctcttcaagaccagcgtaggtgtaaacatgtgtaccctgatcgcgatggacctcggcgagctctgcgaggataccatgacctataagtgcccccgcatcaccgaggccgagcctgatgacgttgactgttggtgtaacgccaccgacacctgggttacctacggtacctgcagccagaccggcgagcatcggcgagacaagcggtccgtggcgctggcgccccacgttggcttggggctcgagaccagaaccgaaacctggatgagctccgaaggagcgtggaagcagatccagaaggtcgagacctgggccctgcggcacccaggattcaccgtgatcgcgctgttcctcgctcacgcgatcggtactagcatcactcagaaggggatcatcttcatactgctgatgctcgttaccccctctatggccatgcgctgcgtgggcatcggcaaccgggactttgtcgaggggctgagcggcgccacgtgggtcgacgtggtgctggagcacggctcctgcgtcaccaccatggcgaagaacaaacccaccctcgacatcgagctgctaaagacggaagtgacgaacccggcagtgctccgtaagctgtgcatagaggcgaaaatcagcaacaccaccacggactcccgctgcccgacccaaggcgaagccaccttagttgaggagcaggacgctaatttcgtctgcagacggaccttcgtggaccgggggtggggtaatggctgcggcctcttcggcaaagggtcactgctgacgtgcgccaagtttaaatgcgtcaccaagctcgagggcaagattgtgcagtacgagaacctgaagtattccgtgatcgtgaccgtgcacactggcgatcagcatcaggtggggaacgagacgaccgaacacggcacgatcgccaccataactccgcaggcccccacgagcgagatacagctgacggactacggtgccctcaccctcgactgcagcccgcgtaccggcctcgatttcaacgaaatggtattgttgacgatgaaggaaaagtcctggctcgtgcacaagcagtggttccttgacctgccgctgccctggacgtccggggcctccacctctcaggagacctggaaccgacaggacttgctcgtcacatttaagaccgcccacgcaaagaagcaggaagtcgtggtcctgggctcccaagagggcgcgatgcacacagccctcaccggggccacggagatccaaaccagcggcaccaccacaatcttcgccgggcatctgaagtgtcgtctaaagatggacaagctgacactgaaggggatgtcctatgtaatgtgcactggttcgtttaagttggagaaggaggtggcagaaacccaacacggaacagtcctggtccaagtgaagtacgagggcaccgacgcaccctgcaagatacctttcctcacccaagacgagaaaggggtcacccagaacggccgcctgataacggccaacccaattgtgaccgacaaggaaaagccagtgaacatcgagaccgagccgcccttcggggagtcctacatcgtcgtgggcgccggagagaaggctctgaagctcagctggttcaagaaaggctcgagcatcggcaagatgttcgaagcgaccgccaggggggcccgccggatggccatcctgggcgacacggcatgggacttcggatccattggcggcctgttcaccagcgtgggtaagctcatccaccaggtattcggcaccgcttacggagtcttattctcgggtgtgagctggacgatgaagatcgggatcggcatcctgttgacgtggctaggcctcaactcccgaagcacgtccctcagcatgacatgcatcgctgtcggaatggtcacactgtaccttggggtgatggtccaagccgattccggttgcgtaatcaactggaagggcagggagctcaagtgcggtagcggcattttcgtaacaaacgaggtccatacatggaccgagcagtacaagttccaggccgactcgccgaagcggctgagcgcggcgatagggaaggcctgggaagagggagtgtgcggcatccgcagcgccacccggctcgagaacataatgtggaaacagatctccaacgagctcaactacatccttctggagaacgacatgaaattcacagtggtagtcggggacgtgaacggcattctcgcccaggggaagaaaatgatacgcccccaacccatggaacataagtacagctggaaatcctggggcaaggccaagatcataggcgcggacatacaaaacaccaccttcatcatcgacgggcctgacaccccggagtgccctgacgaccagcgggcctggaacatttgggaggtcgaggactacggttttgggatcttcaccacgaatatctggttgaagctgcgcgactctcacacgcagatgtgtgaccaccggctcatgagcgccgccatcaaggatagcaaggcggtgcatgcggacatgggctactggatcgagtccgaaaaaaacgagacctggaaactagctcgcgccagcttcatagaagtgaagacttgcatctggcccaagtcgcacacgctctggagcaacggcgttctggagtccgagatggtgatcccgaagatctatggcggcccgatcagccagcacaactaccggcctgggtactttacacagaccgctggtccctggcacctggggaagctggagctcgacttcgacctatgcgaaggcaccacagtggtagtggacgagcactgcggctatcgtgggccgtcccttagaaccaccaccgtgacggggaaaattatccacgagtggtgctgccgcagctgcactctgccgccgttgcggtttcgcggggaggacggatgctggtacggaatggagattcggcccgtcaaggagaaggaagagaacctggtgaggtcaatggtgtcagcgggatccggcgaaatggacagctttagccttgggatcttgtgcgtgtccatcctcatcgaggaagttatgcggtcacgttggtcgaggaagatgttgatgacgggcactctggcagtattcctgctcctcattatgggccagctaacgtggaacgatctgatccgtctgtgcatcatggtgggcgccaacgcaagcgaccggatgggaatgggtaccacatacctagccttgatggccacgttcaagatgagaccgatgttcgctgtagggctgctctttcgccgcctcacgagtcgcgaagtgctgctgctcacagtagggctgagcctggtggcctccgtagagctccccaatagcctggaggagctcggagacgggctcgctatgggcataatgatgctaaaactgcttaccgacttccagccccatcagctgtggaccacgctgctctccttgacgtttatccgaacctcgctgtcccttgactacgcctggaagactatggccatggccctgagcatcgtgtctctgttccccctctgcttgagcactacctcccagaagactacctggctgccggtgctcctaggcagctttgggtgtaaaccccttacaatgttcctcatcacagagaataagatctggggccgcaagtcctggcccattaacgagggaatcatggccgtaggcatcgtgagcatcctgctctccagcctgttgaagaatgatgttccccttgccgggccgctcatcgcgggcggcatgcttatcgcctgctacgtcatcagcggcagtagcgccgacctgtccctcgagaaggcagctgaggtgagctgggaggaggaagctgagcactcaggcactagccacaacatactggtcgaggtccaggacgacggcacaatgaagatcaaagacgaggagcgcgatgataccctgacaatcctcctgaaggccacgttactcgccgtctcaggcgtgtaccccatgagcataccggctaccctctttgtatggtacttctggcagaaaaagaagcagcgatccggtgtgctatgggacaccccctctccgcctgaggtggagcgggccgtgctggacgacggaatctacaggatcctccagcggggcttactcgggcgttcccaggtgggcgtcggggtcttccaggacggcgtgttccacacaatgtggcacgtgacccgaggggcggtcctaatgtaccaaggcaaaagactggaacccagctgggcctccgtgaagaaggacttgatcagctacggggggggctggcggtttcaagggtcctggaacacgggcgaggaggtgcaggtcatcgccgttgagcccggtaagaacccgaagaacgtccagaccacgccaggcaccttcaaaatccccgagggcgaggtcggagccattgccctcgacttcaaacccggcaccagcggttccccgatcgtaaatcgtgagggtaagatcgtgggcttgtacgggaacggcgtagtgaccactagcgggacttacgtgtccgcgatcgcgcaggccaaggccactcaagaaggccccctacccgagatcgaggacgaggtcttcaagaagcggaacctcaccatcatggatctgcacccggggagcggcaagacgcgccgctacctgcccgccattgtgcgcgaggcgataaagcggaagctacgcacactgattctggcaccaaccagagtcgtagcttcagaaatggccgaggctctcaagggcatgcccatccggtaccagaccaccgccgtcaagtccgaacataccgggagagagatcgttgacctgatgtgccatgccaccttcacaatgcggttactctccccggttcgtgtccccaattacaatatgataatcatggacgaagcgcacttcacggaccccgcgtccattgcggcccgggggtacatcagcaccagagtggggatgggcgaagccgccgccatcttcatgaccgctacgccccccgggagcgtcgaggcattcccccaaagcaacgccgtaatccaagacgaagagcgggatatccccgagcgcagttggaacagcggctacgactggatcactgactttccgggcaagacagtttggttcgtcccctcaatcaagagcgggaacgacatcgcaaactgcctgaggaagaacggcaagcgcgtcatccaactgtcccggaaaaccttcgatactgagtaccaaaaaacgaagaacaacgactgggattacgtggtcaccactgatatctccgagatgggagccaacttccgcgcggaccgggtgatcgatccccgccggtgcctcaaacccgtgatcctgaaggaaggccccgagcgcgtcatcctggccggccccatgccagtgaccgttgcctccgcggcacagcggcgcggccggatcgggcgcaatcagaacaaggagggcgaccaatacatatacatgggacaacccctcaacaacgacgaggatcatgcccactggacggaggccaagatgctgctggacaacataaacaccccagaggggatcatcccggccctttttgaacccgaacgcgagaaatccgccgcgatcgacggcgagtaccggttgcgaggcgaggcccggaaaactttcgtagagttgatgagacggggggacctgcccgtgtggctgtcctacaaagtagcgagcgagggcttccagtattccgaccgccggtggtgctttgacggtgagcggaacaaccaggtactggaggagaatatggacgtggagatctggacaaaggaaggcgagcggaagaagctccgcccccggtggctcgacgcccgcacttacagcgaccccctcgccctgcgggagttcaaggagttcgcggccggacgccggtcggtaagcggcgacttgatccttgaaattggtaaactcccccagcacctaaccttgcgcgcccaaaatgcactcgacaacctggtgatgttgcataacagcgagcagggtgggaaagcctatcggcacgccatggaggagcttcccgacaccatagagacgctgatgctactcgccctaatcgctgtgctaaccggaggcgtcaccctcttctttctgtccgggaagggactgggcaagacctcaatagggctcctgtgcgttatggccagcagcgcgctgctgtggatggccagtgtcgagccccactggattgccgccagcatcatcctggaattctttctgatggtcttgctgatcccagagcccgaccgccagcggacgcctcaggacaaccagctggcctacgtggtcatcggcttgctgttcatgatcctgacagtcgcggccaatgagatggggctcctggagaccacgaagaaggacctaggcatcgggcacgttgcggtggaaaaccatcaccacgccacaatgctggatgtcgatctccgcccagcctccgcgtggaccttatacgccgttgccacgaccgtgattacacccatgatgcggcacacaatcgaaaacacgaccgcaaacatcagcctgaccgctattgcgaaccaggctgccatactcatgggtctggacaaaggctggccgatctccaagatggatattggcgtccccttgctagctttaggctgctacagccaagtgaacccgctgacactgactgctgctgtcctgatgcttgtcgcccattatgcgatcatcgggcccggccttcaggcgaaggcgactcgcgaggcgcagaagcgcaccgcggctggtataatgaaaaatcccaccgtcgacggcatcgtaacgatcgacctagacccggtcgtgtacgacgcgaaatttgagaagcagctcggacagatcatgctgctgatactctgtacatcccagatcttgctgatgcgaaccacctgggctctctgcgagagcatcacgcttgccaccgggccgctaaccaccctctgggaaggctccccggggaaattctggaatactaccatcgcagtgtcgatggcaaacatcttccggggctcctacctggctggcgcagggctcgccttctccttgatgaaatcgctgggcgggggccggagaggaaccggcgcccagggcgagacattaggagagaagtggaagcggcaactcaaccagctgtcgaagtccgagttcaacacctataagaagtccggcatcatggaggtcgaccgcagcgaggccaaggaggggctcaagcggggcgagaccaccaagcacgcagtgtcgcgcgggaccgctaaactgcggtggttcgtggagcgcaacctcgtcaagcccgagggtaaggtgattgatctgggctgcgggcgaggcggctggagctattattgcgccggtttgaaaaaggtgactgaagtcaaggggtacacaaagggcggccccgggcacgaggagccgatccccatggccacctacggctggaacctagtcaagctgcactccgggaaggacgtgtttttcacgccgccggagaaatgtgacaccttgctctgcgacatcggtgagagctcaccgaaccccacgatcgaagaagggcgcaccctgcgggtcttgaagatggtggagccctggctccgaggcaatcagttctgcatcaagatcctgaatccctacatgccaagcgtggtcgagaccctggaacagatgcagagaaaacacggtgggatgctcgtgcgcaacccgctgtcccggaacagtacccacgagatgtactgggtgtcctgtggaactgggaacatcgtaagcgccgtgaacatgacatcccgcatgttactgaaccggttcaccatggctcacagaaagcctacctacgagcgtgacgtggacctgggcgccggcacacggcacgtcgccgtggagcccgaagtagctaacttagacatcataggccagcgtatcgagaacataaagaacgagcacaagagcacctggcactatgacgaagacaacccgtacaaaacctgggcctaccacggctcttacgaggtcaaaccttccggatcagcgagctcgatggtgaacggggtggtgcggctcctgaccaaaccttgggatgtgatccccatggtcacgcagatcgccatgaccgacaccacccctttcgggcaacagcgcgtgttcaaggagaaggtggacacccgcacgccccgggccaagcggggcaccgcccaaatcatggaagtcaccgccaaatggctgtggggcttccttagccgcaacaagaagccccggatctgcacgcgcgaggagttcacccggaaggtgcgcagtaacgcggccataggggctgtctttgtcgatgaaaaccaatggaatagcgccaaggaagcggtggaggacgagcgcttctgggacctggtacaccgcgaacgggagctgcacaaacagggaaaatgcgcaacgtgcgtgtataacatgatggggaagcgcgagaagaagctcggtgagttcgggaaagcgaagggctctcgtgccatctggtacatgtggctgggcgccaggtttcttgagttcgaggctctcgggtttatgaatgaggatcattggttttcccgggaaaacagcttatctggagtcgagggggagggcctgcacaagctcgggtacattttacgcgacataagcaagatccctggcggtaacatgtacgcggacgacaccgccgggtgggatacgcggatcacggaggacgacctgcagaacgaggcgaagattactgacatcatggaacccgagcacgccctcctggcgacgtccatatttaagttgacgtaccaaaataaggtggtccgggtgcagaggcccgccaaatccggcaccgtgatggatgtcatcagcagacgagatcagcgggggagtggccaggtaggcacctacggtttgaacacgttcacgaacatggaggtgcagctaatccgccagatggagtccgaggggattttcctgcctagcgagctcgagacccctaacctagccaagaaggttctggactggctcgagaagcacggggccgagaggctgaagcgcatggcaatatccggtgatgactgcgtggtaaaacccatcgacgacagatttgcgaccgccttgaccgccctgaacgatatggggaaggtccgcaaggacatcccccagtgggagcccagcaaggggtggaatgactggcaacaggtcccgttctgctcccatcacttccaccagctgatcatgaaggatggccgggagattgtggtcccctgtagaaatcaagacgaactggtggggcgtgcccgcgttagccagggcgccgggtggagtctccgcgagacggcgtgcctgggcaagagttacgcccagatgtggcagctgatgtacttccaccgcagagacctcagactggcagccaatgcaatatgctccgcagtcccggtggactgggtcccgacgtctcgaactacttggtcaatccacgctcaccaccaatggatgactacggaagatatgctgtccgtctggaatcgcgtgtggatcgaggagaacccgtggatggaggacaagacccacgtgagctcctgggaagaggtcccgtacctcgggaagcgggaggatcagtggtgcggcagcctgatcggcctaaccgccagggccacctgggcaaccaacatacaagtggccatcaaccaggtgcgccggttaattgggaacgagaactatctcgactatatgacctccatgaagcgcttcaagaacgagagcgaccccgagggcgccctgtggtga

SEQ ID NO: 23729 - RNA, 9879 nt, synthetic construct
  misc_feature 1..9879: note = derived and/or modified CDS sequence (opt11) from DENV-1__JX669465__SS-prME
  source 1..9879: mol_type = other RNA
agcgtgaccatgctgctcatgctgctgccgaccgccctcgccttccacctgacgacccgggggggggagccccacatgatcgtgagcaagcaggagcggggcaaaagcctcctcttcaagaccagcgtcggggtgaacatgtgcaccctgatagcgatggacctgggcgagctctgcgaggacactatgacctacaaatgcccccgtatcaccgaggccgagcccgacgatgtcgactgctggtgtaacgccaccgatacctgggtcacctacggtacctgcagccagaccggcgagcaccggcgcgacaagcgttccgtggcactggcgccccacgtcggtctggggctcgagactcgtaccgagacctggatgtcctccgagggcgcgtggaagcagatccaaaaggtcgagacttgggccttgcgacaccccgggtttaccgtaatcgctctgttcctcgcccacgcgatcgggaccagtatcacccagaagggcatcatcttcatcctactgatgctcgtcaccccctccatggcaatgcgctgcgtgggcatcggtaaccgggatttcgtggaggggctgagcggcgccacgtgggtcgacgtggtgctggaacacgggtcctgcgtcacaactatggcaaaaaacaagcccaccttagatattgagctgctgaagacggaagtgaccaaccccgcagtgctccggaagctgtgtatcgaggcgaagatcagcaacaccaccacggactcgcgctgcccgacccagggcgaggccaccctggtcgaggaacaggacgccaacttcgtgtgccgccggaccttcgtggaccgcggatgggggaacggctgcggcttgtttggcaagggatcactgctgacgtgcgccaagttcaaatgcgttaccaaactcgagggcaagatcgtgcagtatgagaacctgaaatattccgtgatcgtcaccgtgcacaccggtgaccagcatcaggtcgggaacgagacgaccgagcacggcaccatagcgacgatcacgccccaggcacccacgtcggaaatccaactaaccgactacggggccctcaccctagactgcagcccccgaaccggcctggacttcaacgagatggtgctcctaacgatgaaggaaaagtcttggctagttcacaagcaatggttccttgacctaccgctgccctggacctccggggcgtctaccagccaggagacctggaaccgccaagacctcctagtcaccttcaagactgctcacgccaagaaacaggaggtggtggtcctgggatcccaggagggcgcgatgcacaccgccctcaccggcgccacggagatccagactagcggcaccaccacgatattcgccgggcacctgaagtgccggcttaagatggacaagctcaccctgaagggtatgtcctacgtgatgtgcacagggtcctttaagctggagaaggaagtggctgagacccaacatgggaccgtcctggtccaggtgaaatacgagggcaccgacgcgccctgcaagatcccattcctcacacaagacgagaagggagtcactcagaacggccgcctgatcacggccaacccgatagtgaccgacaaggagaagccagtgaacatcgagaccgagccgcccttcggggagtcctacatcgtcgtgggcgccggtgagaaggccctgaagctctcctggttcaaaaaggggtccagcatcggcaaaatgttcgaggcgaccgcccgcggggcgcgccggatggccatcctgggagacacggcttgggactttgggtccatcggcggcctgttcaccagcgtggggaagctcatccaccaagtattcggaaccgcgtacggggtgctgttctctggcgtgtcttggaccatgaagattggtatcggaatactgctcacgtggctgggcctgaactccaggagcacctccttaagcatgacctgcattgccgttgggatggtaaccctatacctgggggtaatggtccaggctgactccgggtgcgtgatcaactggaagggccgcgaactcaagtgtgggagcggtatctttgtgacaaacgaggtccatacgtggacagagcagtacaagttccaggccgactcccccaagcggctgagcgccgcgatcggcaaggcctgggaggagggggtgtgtggcatcagatctgccacccgtctagagaacatcatgtggaagcagatcagcaacgagctcaattacatcctgctggagaatgacatgaagttcaccgtggtcgtaggggacgtgaacggcatcctcgcccaggggaagaagatgatcagaccccagcctatggagcacaaatacagctggaagtcctggggcaaggcgaagatcataggggcggacacgcagaacacgacctttatcatcgacggccccgataccccggaatgccccgacgaccaaagggcctggaacatctgggaagtcgaggactatggcttcggaatctttacgactaacatctggctgaagctgcgtgacagccatacccagatgtgcgatcaccgcctcatgtccgccgcgataaaggattcaaaggcggtgcacgccgacatgggctattggatcgagtcggagaaaaacgagacctggaaactggcgcgcgccagcttcatcgaagtgaagacgtgtatctggccgaagtcccacaccctgtggagcaacggcgtgctcgagtccgagatggtgataccgaagacatacgggggcccgatctcgcagcataactataggcccgggtatttcacccagacggccgggccctggcacctggggaagctggagctcgacttcgatctgtgcgaaggcaccacagtcgttgtggacgagcactgcggctacagggggccgtccctgcgtacaacgaccgttaccgggaagatcatccacgagtggtgttgccgcagctgtaccctgccgcccctccggttcagaggagaggatggctgctggtacggtatggagatccggcccgtgaaggagaaggaggaaaacctggtgcgctccatggtgagcgctggctccggtgagatggacagtttcagccttgggatcctgtgcgtctccatccttatcgaggaagtgatgcggagccgctggtcacggaagatgctcatgacgggcactctggccgtgtttttgctcctgatcatgggtcagcttacctggaacgacctcatccgcctgtgtatcatggtcggcgcaaacgccagcgaccgaatggggatgggcaccacgtacctggccctcatggccaccttcaagatgcggccgatgttcgccgtggggctgctgttccgccggttaacatcccgcgaagtgctgctccttacagtcgggctgagcctggtggcctccgttgaactacccaacagcctggaggagctgggcgacgggctcgccatgggcatcatgatgctgaagctcctcacggacttccagccccaccagctttggaccactctgctcagcctgacattcatccggacgagcctatccctcgactacgcatggaagactatggcgatggccctgagtatcgtgtccttgttccccctctgcttgagcacgacctcacagaagaccacctggttgcccgtgctcttgggcagcttcggctgcaagcccctaaccatgttcctcatcacggagaacaagatttggggccgcaagtcctggcccatcaacgaggggatcatggccgtaggcattgtgtccatcctgctgtccagcctcctgaagaacgacgtgcccctagccgggccgctcatcgccgggggcatgctgatagcctgttatgtcatcagcgggtccagcgccgatctgtccctcgagaaggcggccgaggtgagctgggaagaagaggcggagcactccggcacaagccacaacatcctcgtggaggtccaggacgacgggacgatgaagatcaaggatgaggagcgggacgacaccctgaccatcctcctcaaggcaaccctgctcgccgtgtccggcgtgtaccccatgagcatacccgccacgctgttcgtctggtacttttggcagaagaaaaaacagcggagcggggtcctgtgggacacccccagcccgcccgaggtcgagcgggccgtcctggatgacggtatctaccgcatcctccagcggggtctgctggggcgctcccaggtgggcgttggggtcttccaggacggcgtgttccacaccatgtggcacgtgacccgcggggctgtcctcatgtatcaggggaagagactagagcccagctgggcctcggtgaaaaaagacctcatcagctacggtgggggctggcggttccaggggtcctggaacacgggggaggaggtacaggtgatcgccgtggaacccgggaagaaccccaagaacgtgcagaccacccccggcaccttcaagacgcccgagggcgaagtcggcgccatcgctctcgatttcaagcccggtacgagcgggtccccgatcgtgaaccgcgaaggcaagatcgtgggcctgtacgggaacggcgtcgtgaccaccagtgggacgtacgtgagtgcgatcgcccaggctaaagccacccaggagggacccctgcccgagatcgaggacgaggtcttcaagaagcggaacctgaccattatggacctacacccggggagcggcaagacccgccggtaccttcccgccatcgtaagagaggcgatcaagcggaagctccgcactctgatcctggctcccacacgcgtggttgcatccgaaatggccgaagcgctcaagggcatgcccatccggtatcagaccaccgctgtgaagagtgagcacacggggcgcgagatcgtggacctaatgtgccacgccaccttcaccatgaggcttctctcccctgtgcgcgtgcccaactacaacatgatcattatggacgaggcccacttcaccgacccagccagcatagcggcccgaggctacatctcaacgcgcgtgggaatgggcgaggcagccgccatcttcatgaccgccacgccacccggatccgtcgaggccttcccccagagtaacgcagtcatccaagatgaagagcgggacatacccgagcgctcctggaacagcggctacgattggatcaccgacttccccggaaagactgtgtggtttgtcccatccattaaaagtggcaacgatatcgccaactgcctacggaagaacggcaagcgcgtgatccagctgtcccggaagaccttcgatacggagtatcagaaaacgaagaacaacgactgggactacgtggtcacgaccgatattagcgagatgggggccaacttccgcgcggaccgggtgatcgacccccgccggtgcttgaagcccgttatcctgaaggagggccccgagcgcgtcatcctcgccgggccgatgcccgtgaccgtcgcctccgccgcgcagcgtcgcggtcggatcggccgcaaccaaaacaaggagggggaccagtatatctacatgggccaacccctcaacaacgacgaggatcacgcccactggacggaggcaaaaatgctgctggataacatcaacacgcccgaggggatcataccggccctcttcgagcccgagcgcgagaagtcagccgcgatcgacggagagtaccggctgagaggggaggcccggaaaactttcgtggagctgatgcggcggggagatctcccggtgtggctgtcctacaaggtcgccagcgagggcttccagtactcggaccgccggtggtgcttcgatggcgaacgcaacaaccaagtgctggaggagaacatggacgtggagatctggaccaaggagggcgagcggaagaaactccgcccacggtggttagacgcccggacctatagcgatccgctggccttacgggagttcaaggagttcgcggccggtcgccggtctgttagcggcgacctgatcctggagataggtaagttaccccagcacctgaccctgcgcgcccaaaatgccctcgacaacctggtgatgctgcacaacagcgagcagggagggaaggcctaccggcacgcgatggaggagctccccgacacgatagagactctcatgctgttagccttgatcgccgtgctgaccgggggagtcaccctcttcttcctgtccgggaaaggcttaggcaagactagcatcgggctcctgtgcgtgatggcctccagcgcgctgctctggatggcctccgtagagccccactggatagcagcaagcatcatcttagaattcttcctgatggtcctcttgataccggagcccgatcgccagcggacgccccaggacaaccagctggcctacgtggtgatcggactactgtttatgatactgaccgttgcggctaacgagatggggctcctggagaccacgaagaaggacctgggcatagggcacgtggccgtggagaaccaccaccatgccaccatgctcgacgtcgacctgcgcccagcctccgcgtggaccctgtacgcagtggccaccacagtgataacccccatgatgcgacacaccatagagaatactacggccaacataagcctcacagccatcgcgaaccaggccgccatcctgatgggcctggacaagggctggcccatctccaagatggacatcggggttcccctgctggccctgggttgctacagccaagtgaacccactcaccctgaccgccgcggtgctgatgctagtcgcccactacgccatcatcgggcccggcctgcaggccaaggctacccgcgaggcccagaagcgcaccgcggccgggatcatgaagaaccccacagtggatggaatcgtgaccatcgacctcgaccccgtcgtgtacgacgccaagtttgagaagcagctcggccagattatgctgctgatcctgtgcacgtcccagatcctgctgatgcggaccacctgggcgctctgtgagtctatcacgttggccaccgggccgctgaccaccctctgggagggctcgcccggcaagttctggaataccacgatcgctgtgtcgatggccaacattttccgcggctcttacctagccggcgccgggctggcctttagcctcatgaagtccctgggcgggggccggcgtgggaccggtgcccagggcgagaccctgggggagaaatggaagcggcagctcaatcagctgagcaagtccgaattcaacacgtacaagaagtccgggatcatggaagtcgaccggtctgaggcgaaggaaggcctgaagcggggcgaaacgactaaacatgccgtatcacgcgggaccgcgaagttgcggtggttcgtggagcggaacctcgtgaagcccgagggcaaggtgatcgatctgggctgcgggcggggcgggtggagctactactgcgccggcctgaagaaggtgactgaggtgaaagggtacaccaaaggcggccccgggcacgaagagccgatccccatggcgacgtacggctggaacctcgttaaattacattccgggaaggacgtgttctttacaccccccgagaagtgcgacaccctgctctgcgacatcggcgagtcaagcccgaaccccacgatcgaggaggggcgcaccctgcgggttttgaagatggtggagccctggctccgcggaaaccagttctgcatcaagatcctgaacccctacatgccaagcgtggtcgagactctagagcagatgcagcggaagcatggggggatgctcgtgaggaaccccctgtcccgcaacagtacccacgagatgtattgggtatcctgcggcaccgggaacatcgtgtccgctgtgaacatgacgagtagaatgctgctcaaccggttcaccatggcccaccgcaagcccacctacgagcgcgacgtggacttgggtgccggcacccggcacgtcgcagtggagcctgaggtcgccaacctggacatcatagggcaacgcatcgagaacatcaagaatgagcacaaatcaacgtggcactacgatgaagataacccgtacaagacatgggcctaccacggctcctacgaggtcaagcccagcgggtccgcgagctcaatggtgaacggagttgttcggctcctgaccaagccctgggacgtgatccccatggttacccagatcgctatgacggacaccaccccattcgggcagcagcgggtgttcaaggagaaagtggatacacggacaccccgcgccaagcggggcaccgcccagatcatggaggtcaccgcaaagtggctgtggggcttcctcagccgcaacaagaagccccggatctgcacccgcgaggagtttacgcgaaaggtgcgttccaatgcggctatcggggccgtgttcgtcgacgaaaaccagtggaactcggccaaggaagccgtggaggacgagcggttttgggacctggtgcaccgggagagggagctacacaagcagggcaagtgcgcgacttgcgtatacaacatgatgggtaagagggagaagaagctcggcgagtttgggaaggccaagggcagccgggccatctggtacatgtggctgggggcccgcttcctggagttcgaggcgctcggcttcatgaatgaggaccactggttctcccgggagaacagcctgtccggggtggagggggagggcctgcacaagctcgggtatatcctccgcgacatctccaagattccgggcggaaacatgtacgccgacgatactgccggttgggacacccgaataacggaggacgacctgcagaacgaggccaagatcaccgatatcatggagcccgagcacgcactccttgccacctccatcttcaagctgacttaccagaacaaggtggtccgcgtccagcgccccgcaaagagcggcactgtcatggacgttatctcccggcgcgaccagcgtggaagcggccaggtgggaacctacgggctcaacaccttcacaaacatggaggtgcagctcatccggcagatggagtctgagggcatcttcagcccctcagagctggagaccccgaacctcgccaagaaggtcctggactggctggagaagcacggggccgagcggctcaaacgcatggccatcagcggcgatgactgcgtggtgaagcccattgacgacaggttcgcgaccgccctgaccgcgttaaacgacatggggaagatcagaaaggacatcccccagtgggagccatcaaagggctggaacgactggcagcaagtccccttctgctcacaccactttcatcagctcatcatgaaagacggcagagagattgtggtgccctgcagaaatcaggacgagctcgtcggtcgtgcccgcgtgtcccagggcgccgggtggagcctccgggagaccgcgtgcctcggcaagagctatgcacagatgtggcagctaatgtacttccaccgccgggacctgcgcctcgctgcgaacgcgatctgtagcgcggtgcccgtcgactgggtgcccacctctcggacgacctggtccatccacgcccaccaccaatggatgaccaccgaagacatgttgagcgtatggaaccgcgtctggatcgaggaaaacccgtggatggaggacaagacgcacgtgtcctcctgggaggaggtgccctacctggggaaacgcgaggaccaatggtgcggctccctcatcggcctgaccgcccgcgccacttgggcaaccaacatccaggtagccatcaaccaggtgcgccggctgatcgggaacgagaattaccttgactacatgacgagcatgaaacgcttcaagaacgagtcggatcccgagggcgccctgtggtaa

SEQ ID NO: 23730 - RNA, 9879 nt, synthetic construct
  misc_feature 1..9879: note = derived and/or modified CDS sequence (opt11) from DENV-1__JX669466__SS-prME
  source 1..9879: mol_type = other RNA
tcggtgaccatgcttttgatgctgttaccgactgcactcgccttccatctgaccacccgcggcggggagcctcacatgattgtcagcaagcaggagcggggcaaatcactgctgttcaaaacatccgccggggtgaacatgtgcaccctgattgccatggacctgggagagctctgcgaggacaccatgacttacaagtgccctcggatcaccgaggccgaaccagacgacgtggactgctggtgcaacgccaccgacacatgggtcacctacgggacctgcagccagaccggggagcaccggcgcgagaaaagatccgtggccctggcgccccacgtaggcctgggcctggagacccgcaccgagacctggatgagctccgagggcgcctggcggcagatccagcgcgtcgagacatgggctctgcggcaccctgggttcaccgtgatcgccttcttcctggcgcacgccatcggtacctccatcactcaaaaaggtatcattttcatactactgatgctggtcaccccatccatggccatgagatgcgtcggcatcggaaaccgtgacttcgtggaggggctcagcggcgccacgtgggtagatgtcgtgctggagcacgggtcctgcgtgaccaccatggccaagaacaaacctaccctggacattgagctcctgaagacggaggtgacaaatcccgcggtgctacgcaaactctgcattgaggccaagatcagcaacaccaccacggattcccgatgtccgacccaaggcgaggccaccctcgtggaggagcaggatgccaatttcgtctgtcgtcgcacgttcgtggaccgcggctgggggaacggctgtgggctgttcggcaaggggagcctcctgacatgcgccaaattcaagtgtgtcaccaagctggagggcaagatcgtgcagtacgagaacctcaagtactccgtgatcgtgaccgtccataccggcgaccaacaccaggtagggaatgaaacgaccgaacacggcaccatagcgacaatcacgccccaggcgcccacgtcggagatccagctgaccgactacggggccctgaccctcgactgcagtccccggaccggcctggacttcaacgagatggtcctgctcacgatgaaggagaagagctggcttgtgcataagcagtggttcctggaccttccactgccctggacttcaggggctagcacctctcaggagacctggaaccgccaggacctactcgtgacattcaagaccgcgcacgccaagaagcaggaggtcgtggtgctgggctcccaggaaggagccatgcacactgccctaaccggtgcgacggagatccagaccagcggcaccaccaccatattcgccgggcacctcaagtgccggctgaagatggacaagctgacgctcaagggcatgtcctacgtcatgtgcaccgggtctttcaaactggagaaggaggtagcggagacgcagcacggcacgatcttagtacaggtcaagtatgagggcaccgacgctccctgcaaaatccccttttccacgcaagatgagaagggtgtgacccagaacggcaggctgattacggccaacccgatcgtgaccgacaaagagaagcccgtcaacatcgagaccgagccgcccttcggtgagagctacatcgtggtgggtgccggcgagaaggcgcttaaactgtcctggtttaagcgggggagctccatcggcaagatgttcgaggccaccgcacgcggtgcccgccgcatggccatcttgggcgacacggcgtgggacttcgggtcgatcggcggtgtctttacctccgtggggaaactcgtgcaccaggtcttcggcactgcctacggcgtcctgttctctggcgtgtcctggaccatgaagattgggatcggtatcctgctcacgtggctgggcctgaatagccgctccaccagcctgtccatgacatgcatagcggtcggtatggtgaccctgtacctgggtgtgatggtccaggccgatttagggtgcgtgatcaactggaaggggcgggagctgaagtgcgggagcggaatcttcgtgacgaatgaggtccacacctggacggaacaatacaagttccaggccgactcaccgaaacgtctgagcgcggctattggcaaggcctgggaggagggcgtgtgcggcatccggagcgccaccagactcgaaaatatcatgtggaagcagatctccaacgagttgaaccacatcctgctcgagaacgacatgaagttcaccgtggtggtgggggacgccaacggcatcctagcgcagggaaaaaagatgatacggccccagcctatggaacacaagtacagctggaaaagctggggtaaggccaagatcataggtgccgacattcaaaacacgactttcatcattgacgggcctgacaccccggagtgccccgacggccagcgcgcttggaacatctgggaggtggaagactacgggttcggagtctttaccacgaacatctggctgaagttacgcgacagctatactcagatgtgcgaccaccggctgatgtccgcggccatcaaggacagcaaggccgtgcacgccgatatgggatactggatcgaatctgaaaagaacgagacctggaagcttgcacgggccagcttcatcgaggtgaagacctgcacctggcccaagtcgcacacgttgtggagcaatggggtcctggagagtgagatgatcatccccaagatcttcgggggcccgataagccagcacaattaccgccccggatactttacccagaccgcggggccctggcacctgggcaagttggagctagactttgacctgtgcgagggcaccaccgtggtggtcgatgagcactgcggcaaccgtggaccgtccctccgcacaacgacggtgaccgggaagataatacacgaatggtgttgccggtcatgcaccctcccgccccttcgcttccggggcgaggacgggtgctggtacggcatggaaataagaccagtaaaagagaaggaggagaaccttgtccgatccatggttagcgcgggctccggggaggtggacagttttagtctgggcatcctgtgcgtctccataatgatcgaagaggtgatgcgaagccgctggtcccggaaaatgctcatgaccgggacactggccgtgttcctgctactgatcatgggccaactgacctggaacgacttgatccgcctttgcattatggtcggggcgaacgcgagcgaccggatgggcatgggcacaacctacctggccttgatggccacgttcaagatgagaccgatgttcgccgtagggctgctgttccgacgcttgacttcacgggaggttctgctgctaaccatcggtttatccctggtggcctcagtggagttgcccaactcgctggaggagctgggggacggcctcgctatgggcatcatgatgctgaagttactcaccgagttccagccacaccagctgtggaccaccctgctttctctgaccttcgtcaaaaccacgctgagcctcgactacgcctggaagacaaccgccatggtgctgagcatcgtgagcctcttccccttgtgcctgtcaaccaccagccaaaagacgacctggctgccggtcctcttaggctcctttggctgcaagccactaacaatgttcctcatcacggagaacaaaatctgggggcgcaaaagctggcccctgaacgagggcataatggcgatcgggattgtgagcatactgctcagctcccttctgaagaatgacgtgccactggcgggccccctaatcgccggcgggatgttgatcgcatgctacgtcataagcggcagctccgctgacttaagcctggagaaggccgcggaggttagctgggagcaggaggccgagcatagtggggcctctcacaatatcctggtagaggtccaagacgatggcacgatgaagatcaaggacgaggagcgggacgacaccctcaccatcctcctgaaggccactttactggccgtgagcggtgtgtatcccatgagtatccccgccacgctgttcgtgtggtacttctggcaaaagaagaagcaacggtctggcgtgctctgggacaccccaagcccgcctgaggtggagcgggccgtcctggacgacggcatctaccgcatcttacagcgcgggctgcttggccgctcgcaggtgggggtaggcgtcttccaggacggagtgttccacaccatgtggcacgtgacccgtggcgccgtcttaatgtatcaaggcaaacgactggagccttcttgggcgagcgtgaaaaaggacctcatctcctacggaggcggctggcggttccaaggctcctggaacacgggggaggaggtgcaagtcatcgccgtggagcctggcaaaaacccgaagaacgtgcagaccacccccggtaccttcaagacgcccgagggagaagtcggcgcgatcgcgctggacttcaagccagggactagtgggagcccgatcgtgaaccgcgagggcaagatcgtggggctgtacggtaatggtgtcgtgaccacctccgggacgtatgtgagcgccatcgcccaggccaaggcatcgcaggaggggcccctccccgagatcgaagacgaggtcttcaagaagcggaaccttaccatcatggacctgcaccctggcagcggcaagaccaggagatacctccctgccatagtgcgcgaagccattaagcgcaagttacggaccctgatcctcgcccccacgcgcgtggtcgcaagcgagatggccgaggccctgaaagggatgcccatccgataccagaccaccgccgtgaagagtgagcacaccggacgcgagatcgtggacttaatgtgtcatgctacgtttacaatgcggctcctaagcccagttcgcgtgcccaactataatatgatcatcatggacgaggcgcacttcacagacccggcctccatcgctgccagggggtacatcagcacacgcgtgggaatgggggaggccgcggccatcttcatgacggccacaccgcctgggtcagtcgaggccttcccccagtcgaatgccgtgatccaggatgaggagcgggacatccccgagcgcagttggaacagcggctacgactggatcacagacttcccaggcaagaccgtatggtttgtgccatccatcaaaagcggcaacgacatcgcgaactgcctgcggaaaaacggtaagcgcgtgatccagctatcgcggaagactttcgacaccgagtaccaaaagaccaaaaacaacgactgggactacgtggtcacaacggacatctccgagatgggcgccaacttccgagccgaccgggtaatcgaccccagacggtgcctgaagcccgtgatcctgaaggacgggccagagcgcgtcatactcgccggcccgatgccagtgaccgtcgcgagtgccgcgcagcggcgcggccgcatagggcggaaccaaaacaaagagggcgaccagtacgtatacatgggccagcccctgaacaatgacgaagatcacgcccattggaccgaggccaagatgctgctcgacaacattaacacgcccgagggcatcatcccggcgctcttcgagcccgagcgagagaagtctgccgccatcgacggggagtatcggctacgcggcgaggctcggaagacgttcgtggagctcatgcgccggggggacctgcccgtttggttgtcctacaaagttgccagcgaggggttccagtattcggacaggcggtggtgtttcgacggcgagcgcaacaaccaggtgctcgaggagaacatggacgttgagatctggaccaaagaaggggagcggaagaagctacggccccggtggctggacgcgcgcacctacagcgacccgctcgcgctgcgggagttcaaggagttcgcggccggcaggcgctcggtgagcggcgacctgatattggagattgggaagctgcctcagcacttaacactcagggctcagaacgccctggacaacctggtgatgttacacaactcagagcagggcgggaaggcataccggcatgcaatggaagaattgcccgacacaatcgaaacgctaatgcttctggctctgatcgcggtactcacaggcggggtcaccttgttcttcctgtccggcaagggcttagggaagaccagcatcggcctgctttgcgttacggccagctcagctctcctgtggatggcctctgtcgagccccattggatcgcggcttcgatcatcctggagttcttcctaatggtactgctgatccccgaacccgatagacaacggacaccccaggataaccagctcgcctacgtggtcatcggtctgctgttcatgatactcaccgttgccgctaacgagatgggcctgctggagacgacgaagaaagacctagggatcggctatgtcgccgccgagaaccatcagcacgccactatgctagacgtcgatttgcatcctgcctcggcctggaccctttacgcagtcgcgacaacggtgatcactcccatgatgagacacaccattgagaacaccaccgctaacatcagcctgaccgccatagctaaccaggcagcgatccttatgggcctcgacaaaggctggcccatcagtaagatggacataggcgtcccattactcgcgctcggatgttacagccaagtaaacccgctgaccctgacggccgcggtgttaatgctggtagctcactatgcaatcattggccccgggttgcaggccaaggccacacgcgaggcccagaagcggacagcagccggcatcatgaaaaaccccacggttgatggcatcgttgccattgacctcgatcccgtggtgtatgacgctaaattcgagaagcagctggggcagatcatgctgctcatcctatgcaccagccaaattctactcatgcgcacaacctgggcattgtgcgaaagcatcaccctggcgacgggcccgcttacgaccctctgggaagggtcccccgggaagttttggaataccaccatcgcagtgtctatggccaacatcttccggggttcttatctggccggtgctggcctcgcgttctcactcatgaagagcctcgggggggggcgccggggtacgggcgcccagggtgagacccttggcgaaaagtggaagcggcagctgaaccagctgagcaagtctgagttcaacacctataagcggagcggaatcatggaggtcgaccgcagtgaggccaaggagggcctgaaacgcggggagaccacgaagcatgcagtgtcccgaggcacagcgaaactccggtggttcgttgagcgtaacctggtcaaacctgagggcaaagtgatcgacctgggatgtggccgcgggggctggagctattactgcgccgggctcaagaaggtgacggaggtgaaggggtacaccaagggggggcccggccatgaggagccgataccgatggccacctatgggtggaacttggtgaagctgcacagtggcaaagatgttttcttcatgccgccagagaagtgcgacacgctcttgtgcgacattggggaaagctctccgaacccgaccatcgaagagggtcgcacgttgcgggtcctcaagatggtcgaaccctggctacgaggcaatcaattctgcatcaagatcctgaacccctacatgccgtccgtggtcgaaacgttggaacagatgcagcgcaagcacggtggcatgcttgtgcgcaaccccctgtcccggaacagcacgcacgagatgtactgggtatcgtgcgggaccggcaacatcgtcagcgccgtaaacatgacctcccgcatgttacttaaccgcttcaccatggcccaccggaaaccgacgtacgagcgcgacgtggacttaggagcggggacccggcacgttgctgtcgaacccgaggtggccaacctcgacatcatcggccagcgcatcgagaacatcaagaatgagcacaaaagcacctggcactacgacgaggacaacccctacaagacttgggcctaccatggatcctacgaggttaagcccagcggaagcgccagctcaatggtgaacggagtcgttcggctgctgacgaaaccctgggacgtgattccgatggtcacgcagatcgcgatgacggacaccacaccgtttggtcagcagcgcgtattcaaggaaaaggtggacacacgaacgccccgggccaaaaggggcaccacgcagatcatggaggtcaccgccaagtggctatgggggttcctgagccggaacaagaagccccggatctgcacccgcgaggagtttaccagaaaggtccgctccaatgccgccatcggcgctgtgttcgtcgacgagaaccaatggaatagcgcaaaggaggccgtcgaagatgagcggttctgggacctggtgcaccgggagcgggagctccacaagcaaggaaagtgtgcaacgtgtgtctataatatgatgggcaagcgcgagaaaaagctcggcgaatttgggaaggcgaagggcagccgggccatctggtacatgtggctcggggctcggttcctcgagtttgaggccctgggctttatgaatgaggaccattggttttcccgggagaacagcctgtccggagtggaaggagaggggctccataagctgggctacatcctgcgcgacatcagcaagatcccgggcgggaatatgtatgcagacgacaccgctggctgggacactcgcatcaccgaggacgaccttcaaaacgaggccaaaatcactgacatcatggagcccgagcacgccctgctggcgacctcgatcttcaagctcacctaccagaacaaagtggtgcgggtgcaacgcccggctaagaacgggaccgtaatggatgtcatcagccggcgcgaccagaggggttccggccaggtgggcacgtacggcctgaacacctttaccaacatggaggtacagcttatacgccaaatggagagcgaggggatcttcctaccctccgagctcgaaaccccgaacctggccgaacgggccctcgactggttggaaaagcacggggctgaacgcctgaagcggatggcaataagcggggatgattgcgtcgtaaaacccatcgacgatcgcttcgccacggcgttgaccgccctgaacgacatgggcaaggtgcggaaggacatcccccagtgggagccttccaaaggctggaacgactggcagcaggtgccgttctgcagccatcactttcatcagctgataatgaaggacgggcgggagatcgtggtgccctgtagaaaccaggacgagctagtcggccgagcccgcgtctcgcaaggggctggctggagtttgcgcgagaccgcctgtctcgggaagtcttacgcgcagatgtggcagctgatgtacttccaccggagggacctccggctggcagccaacgcaatctgcagcgcggtgcccgttgactgggtacccgcctcccgcacaacctggagcattcacgcccaccaccaatggatgacgaccgaggacatgttgagcgtgtggaaccgcgtctggatcgaggagaacccgtggatggaggacaagacccacgtgtccagctgggaggaggtaccctacctgggcaagcgggaggaccagtggtgcggcagtctgatcgggctcactgcccgcgccacgtgggcgaccaacatccaagtcgccatcaaccaggtgcggcgcctaatcggcaacgagaactacctggactacatgacgagcatgaagcggttcaagaatgagtcggaccccgagggggccctctggtga

SEQ ID NO: 23731 - RNA, 9879 nt, synthetic construct
  misc_feature 1..9879: note = derived and/or modified CDS sequence (opt11) from DENV-1__JX669467__SS-prME
  source 1..9879: mol_type = other RNA
agcgtgaccatgctgctcatgctgctgcctactgcacttgccttccacttgaccacccggggcggggaaccccacatgatcgtgagcaagcaggagcggggcaagagccttctgttcaagaccagcgcgggggtgaacatgtgtaccctgatcgccatggacctgggcgagctctgcgaggacaccatgacctacaagtgcccccgaatcacggaggccgaacccgacgacgtggactgttggtgcaatgcgaccgacacttgggtcacctacgggacgtgcagccagaccggcgagcaccggcgggacaagcggtccgtggccctggcgccgcatgtgggcctggggcttgagactcggacggagacctggatgagctccgagggcgcctggaagcagatccagaaggtcgagacatgggccctgaggcacccggggttcacggtgatcgccctgttcctcgcgcacgccatcggaaccagcatcacccagaaggggatcatcttcatcctcctgatgctcgtgaccccctccatggcaatgcgctgcgttgggatcggcaaccgggacttcgtggaagggctgtcgggcgccacgtgggtggacgtcgtgctggagcacgggtcctgcgtgaccaccatggccaagaacaagcccaccctcgacatcgagctcctgaagacggaggtaactaacccggcggttctccgcaagctgtgtatcgaggcaaagatcagcaacaccaccacggactcccggtgcccgacacagggcgaggccacactggtggaggagcaggacgccaacttcgtatgccgccggaccttcgtagaccgcggctgggggaacggctgtggcctcttcggcaaggggtcactgctgacgtgcgccaagttcaaatgcgtgaccaagctcgagggcaagatcgtgcagtacgagaacctgaagtactccgtgatagtgaccgtgcataccggcgaccagcaccaggtggggaatgaaacgaccgagcacggcaccatcgcgaccatcacgccccaagcccccacaagcgagatccagctcaccgactacggggccttgacactggattgcagcccccggaccggcctggacttcaacgagatggtcctcctgacgatgaaagagaagtcgtggctggtgcataagcagtggttcctcgacctcccgctgccctggacctccggggccagcaccagccaggagacctggaaccgccaggatctactggtgacgttcaaaaccgcccacgcgaagaagcaggaagtcgtggtgctaggctcccaggagggtgccatgcacacggccctcaccggggccaccgagatccagaccagcggcaccaccacgatcttcgccgggcacctgaagtgccggctcaaaatggacaaacttaccctaaagggcacgtcctacgtcatgtgcaccgggagcttcaagttagaaaaggaggttgcggagacgcagcatggcaccgtgctggtccaggtgaagtacgagggcaccgacgcaccctgcaagatccccttctccacccaggacgagaagggcgtgacgcaaaacgggcgcctcatcaccgccaacccgattgtcaccgacaaggagaagccagtgaacatagagaccgaaccacccttcggggagtcgtacatcgtggtgggggccggcgagaaggcgctgaagctgtcctggttcaagaaggggagctcgatcggcaagatgttcgaggccactgcccgcggagccaggcggatggccatcttaggcgacactgcgtgggacttcgggagcattggcggcgtgttcacctccgtggggaagctggtccaccaggtgttcggcacggcttacggggtgctgttcagtggcgtctcctggacgatgaagatcgggatcggcatcctcctgacctggttagggctcaatagcagatcaaccagcctgtcgatgacttgcattgccgtggggatggtgacgctgtacctcggcgtcatggtgcaggccgacagcgggtgcgtgatcaattggaagggccgcgagttgaagtgcgggtccggcatcttcgtcaccaacgaggtgcacacctggactgagcagtacaagttccaggccgacagcccgaagcgactgagcgcggcaatcggcagagcctgggaggagggggtgtgcggcatccggtccgccacccgcctcgagaatatcatgtggaagcagatcagcaacgagctaaaccacatccttctggagaacgacatcaagttcacggtcgtggtggggaacgccaacggcatcctggcgcagggaaagaagatgatacggccccagcctatggagcacaagtactcctggaagtcctggggcaaggctaagataatcggcgcggacatccagaacaccaccttcatcatcgacgggcccgacacaccggagtgccccgacgagcagcgcgcctggaacatctgggaggtagaggactatggcttcgggattttcacgacaaacatctggctgaagctccgggactcctacactcagatgtgcgaccataggctcatgagcgctgcaatcaaagactccaaggccgtccatgccgacatgggctactggattgagagcgagaagaacgagacttggaagctggcccgggcgtccttcatcgaggtgaaaacgtgcatctggcccaagagccacaccctctggtccaacggcgtcctggagagcgagatgataatccccaagatgtacgggggcccgatctcccagcacaactacagacccggttactttacccagaccgccggcccctggcacctggggaagctcgagctggacttcgacttgtgcgagggcacgaccgtggtggtcgacgagcactgcggcagccgggggccttccctccgcacaaccacagtgacggggaaaatcatccacgagtggtgctgccggagctgcaccctgccgcccctgaggttccgcggggaggacggctgctggtacgggatggagatccgccctgtgaaagagaaggaggagaaccttgtcagatccatggtcagcgccggctccggcgaggtggactccttcagtctcgggatcctgtgcgtctccattatgatcgaggaggtgatgcgctcccgttggtctcgcaagatgttgatgaccggcacgctggccgttttcctgctcctgatcatggggcagctgacgtggaacgacctcatccgcctgtgcatcatggtcggtgccaacgcgagcgacaagatggggatgggcacaacctacctggccctaatggccacgttcaagatgcggccgatgttcgccgtagggctgctgttccgccggctcacctcccgcgaggtgctgctgctcaccatcgggctgagcctggtcgcctccgtggagctccccaatagccttgaggaactaggcgacgggctcgcgatgggcatcatgatgctgaagctgcttaccgagttccagccccatcagctgtggacgaccctgctctccctgaccttcatcaagaccacgctgagcctcgattacgcctggaagaccacggccactgttctgagcatagtttcactattccccctctgcctgtccacgaccagccagaagaccacctggcttccggttctcctaggctcgttcgggtgcaagcccctgaccatgttcctcataacggagaacgagatctggggccgcaagagctggcccctgaacgaggggataatggccatcggcattgtgtccatcctgctcagcagcctgctgaaaaacgacgtgccactggcggggccgctgattgccggaggcatgttgatcgcctgttacgtgatctccgggagctccgccgacctcagcctggagaaagctgcggaggtctcctgggaggaggaggccgagcacagcggcacctcccacaacatcctggtcgaagtgcaggatgatgggaccatgaagatcaaagacgaggaacgcgacgacaccctcacgatacttttgaaggccacgctcctggccgtcagtggcgtataccccatgagcatccccgccaccctattcgtgtggtacttctggcagaagaagaagcagcggtctggggtcctctgggacaccccctccccgcccgaggttgagcgcgcggtgctggatgacggtatctacagaatcttacagcggggcctgttggggcgctcgcaggtcggcgtgggggtgttccaggacggcgtgttccacacgatgtggcatgtgacccgcggagccgtgctaatgtaccagggcaagcggctagagccctcctgggccagcgtcaagaaggacctcatctcctacggcgggggctggcgcttccaggggagctggaacaccggcgaggaggtccaggtgatcgccgtcgagccagggaagaatccgaaaaacgtgcagaccactcccggtacgttcaagacccccgaaggcgaggtgggcgccatcgcgctggacttcaagcccggcacctccgggagccccatcgtcaaccgggagggcaagatcgtgggcctgtacggcaacggcgtggtcacaacctccgggacctacgtgagcgccatcgcccaggccaaggccagccaggagggcccactccccgaaatcgaggacgaggtgttcaagaagcgcaacctgacaatcatggacctgcacccggggtcaggcaagacgcggcgctacctccccgcgatcgtccgggaggccatcaagcgcaaactgcggaccctgattctcgcccccacccgggtggtggccagcgagatggcagaggccctgaagggcatgccgatccgctaccagaccacggccgtcaagtccgagcacaccgggcgggagatagtggacctgatgtgccacgccaccttcaccatgcgcctcctgagccccgtccgggtccccaactacaacatgatcatcatggacgaggcccatttcacggatcccgcgtccatcgccgcccgcggatacatcagcacccgggttgggatgggcgaggccgcagcgatcttcatgacggccacgccgcccgggtccgtagaggcattcccccagagcaacgcagtcatccaggacgaggagcgcgacatccccgagcggtcctggaacagcggatacgactggatcacagacttccccggcaagaccgtgtggttcgtgccctccatcaagagcgggaacgacatcgccaactgcctgcgcaagaacggcaagcgggtcatccagctctcccgcaaaaccttcgacaccgagtaccaaaagacgaagaacaatgactgggactatgtggtgaccacagacatcagcgaaatgggggcgaacttccgggcggaccgcgtcatagacccgcggagatgcctgaaacccgtgatcctgaaggacggccccgagcgagtgatcctcgccgggccgatgcctgtcaccgtggcctcggcggcccagcgccggggccgcataggccggaaccaaaacaaggagggggaccagtacgtctacatgggtcaacccctgaacaacgacgaggaccacgcccactggacggaagccaagatgctgctcgataacatcaacacgcccgaggggataatcccggccctgttcgagccagaacgcgagaagtccgcggcgatcgatggcgaatacaggctgcgcggggaggcccgtaagaccttcgtggaactcatgcggcgtggcgacctccccgtctggctttcctacaaggtcgcctcggagggcttccaatactccgaccggcgatggtgctttgacggggagcggaacaatcaggttctcgaggagaacatggacgttgagatctggacgaaggagggcgagcgcaaaaagctgagaccccgctggctggacgcacggacctatagcgacccgctcgccctgcgagagttcaaggagttcgccgccgggcggcgcagcgtcagtggcgacctgatacttgagatcggcaagttgccccagcacctgacgctccgggcccagaacgctctggacaaccttgtgatgctccacaacagcgagcaagggggcaaggcgtaccgccacgccatggaggagctgcccgacaccatcgaaaccctgatgctcctggcactgatcgccgtgctcaccgggggcgtcactctgttcttcctgtccgggaagggcctcggcaaaaccagcatcggtctcctgtgcgtgaccgcatcctcggccctcctgtggatggcctccgtggagccccactggatcgccgccagcatcatccttgagttcttcctaatggtcctgctgatcccggaacctgaccggcaacggacaccccaggacaaccagctcgcctacgtggtgatcggcctgttgttcatgatccttacggtcgcagcaaacgagatgggtctgctggagaccaccaagaaggacctcggtatcgggcacgtggccgctgagaaccaccagcacgcgaccatgctggacgtggacctacacccggccagtgcctggacactctacgccgtcgccaccaccgtgatcacccccatgatgcggcacacgatcgagaacaccaccgctaacatcagcctcaccgccattgccaaccaggccgccatcctgatgggcctcgacaagggctggcccatctcaaagatggacctgggggtgcccctgctcgcactaggttgctattctcaggtaaatccgctgacgctgaccgccgccgtgctgatgttagtggcccactacgcgatcattgggcccggtctccaggccaaggccacgcgcgaggcccagaagcggaccgccgcggggatcatgaagaatcccacggtcgacggcatagtggccatcgacctggaccccgtggtctacgacgcaaagttcgagaagcaactgggccagatcatgctcctgattctgtgcacctcccagatcctcctgatgcgtaccacctgggccctgtgcgagagcatcacgctcgccaccgggccgctgaccacgctgtgggagggctcccccgggaagttctggaatacgaccatcgccgtgagcatggccaacatcttccgcggctcctacctcgcaggcgcgggactggcctttagccttatgaaatccttagggggtggccggcggggcaccggcgcgcagggcgagactctgggggagaagtggaagcggcagctgaaccagttgagcaagagcgagttcaacacgtacaagcgcagcggcatcatggaggtggaccggagcgaggccaaggaggggctgaaacgcggcgagaccaccaagcacgccgtctcccgggggaccgccaaactccgctggttcgtggagcgcaacctggtgaagccagagggtaaggtcatcgacctcgggtgtggccgcggcgggtggagctactattgcgcgggcctgaagaaggtgaccgaggtgaagggctacacgaagggcggtcccgggcacgaggaaccgatccctatggctacctacggctggaatctggtaaagctccattccgggaaggacgtgttcttcatgccgcccgagaagtgcgataccctgctgtgcgacatcggcgagagctccccgaaccccaccatagaggaggggcggacgctccgcgtgctgaaaatggtcgagccctggctgcgaggcaaccagttctgcataaaaatcctcaacccctacatgcccagcgtggtcgagaccctggagcagatgcagcgcaagcacggcgggatgcttgtccggaatcccctatcccgcaacagcacacacgagatgtactgggtgtcctgcggcaccgggaacatcgtgagtgccgtcaatatgacgtcccggatgctgctgaaccggttcactatggcccatcggaagcccacctacgagcgcgacgtcgacctcggcgccggcacccgccatgtggcagtcgagcccgaggtggccaacctcgacatcatcggacagcgtatcgagaacatcaagaacgagcacaagagcacgtggcactacgacgaggacaacccgtacaagacctgggcctaccacggcagttacgaggtgaagcccagcgggtccgcctcttccatggtcaatggcgtggtccgcctactcacaaagccctgggacgtgatccccatggtgacccagattgcaatgacggacaccaccccattcgggcagcagcgggtcttcaaggagaaggtggacacacggacaccccgggcgaagcgcggcaccgcgcaaatcatggaggtgaccgccaaatggctgtggggcttcctgagccggaacaagaagccacgcatctgcacacgggaagagttcacgcgaaaggtccggagcaacgcagccatcggggcggttttcgttgacgagaaccagtggaactccgccaaggaagccgtcgaggacgagcgcttctgggatttagtccaccgtgagcgcgagctgcacaagcagggcaagtgcgcgacctgcgtgtacaacatgatggggaagcgtgagaagaaactgggcgagttcgggaaggcaaagggcagccgcgccatctggtacatgtggctgggcgcgcggttcctggagttcgaggccctgggcttcatgaacgaggatcactggttctcccgagaaaacagcctgtccggagtcgaaggggagggcctgcacaagctggggtatatcctccgggacatcagcaagatcccgggcgggaatatgtacgccgacgacaccgcggggtgggacacccgaatcacggaggacgacttacagaacgaggccaagatcaccgacatcatggagcccgagcacgccctgctcgcgacttccatcttcaagctgacataccagaataaggtggtgcgcgtgcagcgccccgccaagaacggcacggtgatggacgtgatcagccgccgggaccagcgcgggtccgggcaggtcggcacttacgggctgaacaccttcaccaacatggaagtgcagctcatccggcagatggagtctgagggcatcttcttcccctccgagctggagagcccgaatctggcggagcgcgttctcgactggctggagaagcacggggccgagcgcctgaagcgcatggccatttccggcgacgactgcgtcgtgaagcccatcgacgatcgatttgcgacggccttaatcgcgctgaatgacatggggaaggtacgcaaggacatcccgcaatgggaacccagcaaaggctggaacgactggcagcaggtcccgttctgctcccaccacttccaccaactgattatgaaggatggtcgggagatcgtggtgccttgccgcaatcaggacgagctcgtggggcgggcccgtgtgtcccagggcgccgggtggagcctgcgtgagacagcctgtctgggcaagtcctacgcccagatgtggcagctcatgtacttccatcgccgggacctgaggctggcggccaacgccatttgcagcgccgtaccagtcgactgggtgcccacctcccggaccacctggtccatccacgcacaccaccagtggatgacgaccgaggacatgctcagcgtgtggaaccgcgtctggatcgaggagaatccgtggatggaggacaagactcacgtgagctcctgggaagaggtgccctacctggggaagcgggaggaccagtggtgcggcagcctgatcggcctcaccgccagggcgacgtgggcaaccaacatccaggtggctatcaaccaggtgcgccgcctgatcgggaacgagaattacctggattacatgacctcaatgaagcgcttcaagaatgagagcgaccccgagggcgcgctctggtga

SEQ ID NO: 23732 - RNA, 9879 nt, synthetic construct
  misc_feature 1..9879: note = derived and/or modified CDS sequence (opt11) from DENV-1__HM469967__SS-prME
  source 1..9879: mol_type = other RNA
agcgtgaccatgttgctaatgctgatgccgaccgccttggccttccaccttacaactcggggcggggagccccacatgatcgtcagtaagcaggagagaggcaagagcctcctgttcaagaccagcgcgggggttaacatgtgcaccctgatcgccatggacctgggcgagctctgcgaggacaccatgacctacaagtgccccaggatcaccgaggccgagccggacgatgtagactgctggtgcaacgccaccgatacctgggtcacctatgggacttgcagccagaccggcgagcaccggcgagataagcggtcggtggccctcgcaccccacgtgggcctggggctggagacgcgcaccgagacatggatgtcatcggagggcgcctggaaacagatccagcgggtggagacatgggccctccgacaccccgggttcacggtgatcgccctgttcctggcgcacgccatcggcaccagcatcacccaaaaggggatcatctttatcctcctcatgctggtgaccccctccatggccatgcggtgcgtcggaatcggcagccgcgacttcgtggaggggttaagcggcgccacgtgggtcgacgtcgtgctggaacacgggagctgcgtgaccaccatggcgaaggacaagcccactctagacattgagctactgaagacggaggtcaccaaccccgcggtgctgcgcaagttgtgcatcgaggccaagatctcaaacaccaccacggacagccggtgcccgacccagggcgaggccaccctggtggaggaacaggacgcgaactttgtctgtcggcgtaccttcgtggacaggggatgggggaacgggtgcgggcttttcggcaaagggtccctcataacgtgcgccaaattcaagtgtgtaaccaagcttgagggcaagatcgtccagtacgagaacctgaaatacagtgtgattgtgaccgtccataccggtgatcaacaccaggtggggaacgagtccacggagcacgggaccaccgcaaccatcacgccccaggcccccacgaccgagatccagctcaccgactacggggctctgacattagactgcagccctcgcacgggcctcgacttcaacgagatggtccttctgactatgaaggagaagtcctggctggtgcacaagcagtggttcctggacttacccctcccctggaccagcggggcgagcacctcccaggagacgtggaaccggcaggatctactggtcaccttcaaaaccgcccacgcgaaaaagcaggaggttgttgtgctcgggagccaggagggagccatgcacacggccctgacaggggcaacagagatccagacctccggcaccaccacgatcttcgcgggacacctgaagtgcagactcaagatggacaagttaacactgaagggcatgagctatgtcatgtgcacagggtcattcaagttggagaaggaggtagcggagacgcagcacggaactgtgctggtccagatcaagtacgagggcaccgacgccccctgcaagatccccttcagtacacaggatgagaaaggggtgacgcagaacggccggctgatcaccgcaaacccgatcgtgaccgacaaagagaagcctgtaaacatcgaggccgagcctccgttcggagagtcctacattgtgatcggcgcgggcgaaaaggccctgaagctcagctggttcaagaaggggtccagcatcggcaagatgttcgaggccaccgcccgcggagcccggcgcatggcgattcttggcgatacagcgtgggacttcggttcgatcggcggcgtattcaccagcgtcgggaagctggtgcatcagatcttcggcacggcctatggggtgctgttctccggggtcagctggaccatgaagatcggcattggcgtgctgctcacatggctcggtctgaattcccgcagcacttccctgagcatgacctgtatagccgttgggctcgtcaccctctatctaggcgtgatggtgcaggccgactccgggtgcgtcataaactggaagggccgggagctcaagtgtgggagcggcatcttcgttacaaacgaggtgcacacctggaccgagcagtacaagttccaggcggacagcccgaaacgcctgtccgccgccatcggcaaagcctgggaggaaggcgtctgcggcatacggagcgccacccgcctggagaacatcatgtggaagcaaatctccaacgagctcaatcacatcctgttagagaacgacatgaagttcaccgtggtggtaggggacgtggcgggcatcctcgcccaggggaagaagatgatccggccacagcccatggagtacaagtacagctggaagtcctggggcaaagctaagataatcggcgcagacgtgcagaacacgaccttcatcatcgacgggcccaacaccccggagtgccctgatgaccagcgcgcgtggaacatctgggaggtcgaggattacgggttcgggatcttcaccacgaatatatggctgaagctgcgcgacagctacacccaagtctgcgaccatcgtctcatgtccgcggccatcaaggacagcaaggccgtgcacgccgatatgggctactggatcgagtccgagaagaatgagacctggaagctggcgcgggctagcttcatcgaggttaaaacctgcatctggcccaaaagccacacgctgtggagcaacggggtgctcgagtccgagatgatcatccccaagatttacgggggcccgatctctcaacacaactatcgccccgggtacttcacccagactgctggtccctggcacctggggaagttggaactggatttcgatctgtgcgagggcaccacggtggtcgtggacgagcactgcggcaacagagggccgagtctgcgcaccacgaccgtcacgggcaagatcatccacgaatggtgctgccggagctgcacactgccacccctccgcttccgcggggaggacggctgctggtacgggatggagatccgccccgtcaaggagaaggaggagaacctggtgaagtccatggtctctgccggcagcggcgaggtcgactccttctctctcgggctgctgtgcatatccatcatgatcgaggaggtgatgcggtccagatggtcccgcaagatgctcatgaccggcaccctagccgtgttcttcctgctcatcatggggcagctgacgtggaatgacctgatccgcctctgtatcatggtaggggcgaacgcctcagatcgaatgggtatgggcaccacctacctagccctgatggccacttttaagatgcggccgatgttcgcggtgggcttactattccgccgtctgacttcccgcgaggtgctcctattgaccatagggctctctctggtcgcttcggtggagctgccaaactcgctcgaggagctaggggacgggctggccatgggaatcatgatcctcaagctgctgaccgacttccagtcccaccagctctgggccacactgctgagcctcacgttcatcaaaaccaccttctccctgcactacgcatggaagaccatggcaatggtcctgagcatcgtgtccctcttcccactttgcctgagcactacctcccagaagaccacctggctccctgtcctgctgggcagcctcgggtgcaagccgctgacgatgttcctgatcgccgagaacaagatttggggccggaagagctggcccctcaacgaggggatcatggcagtcggcatcgtatctatcctgctgagctccctcctgaagaacgacgtacccctggccgggcccctcatcgccgggggaatgctgatcgcttgctatgtcatcagcgggtcgagcgcggacctctccctcgagaaggctgccgaggtcagctgggaggaggaggctgagcactccggcgcgtcgcacaatatcctggtggaagtccaggacgacgggaccatgaagatcaaggacgaggaacgcgacgataccctgaccatcctcttgaaggccaccctgctcgccgtgtccggcgtgtacccgctgagcatccccgccacgcttttcgtttggtacttttggcaaaagaagaagcagcggtctggggtgctgtgggatacccctagcccacctaaagtggagagggccgtcctggatgacggcatctaccggatcatgcagcgcggcctgctgggacggtcccaagtgggcgtgggggtcttccaagagaatgtcttccataccatgtggcatgtgaccagaggcgccgtcttaatgtaccaggggaagcggctggagcccagctgggcatccgtgaagaaggacctgatcagctacgggggcggatggcgcctccaaggctcttggaacaccggggaggaggtgcaggtcattgccgtggagcctgggaagaacccaaagaacgtgcagaccgcgccagggacgtttaagacccccgagggcgagatcggcgccatcgctctggacttcaagcccgggacgagcggcagccccatcgtcaatcgggaggggaaaatcgtgggcctgtacggcaacggggtggtcacgacctcaggcacctacgtaagcgcaatcgcccaagccaaggcatcccaagaggggccgctccccgagatcgaggacgaggtcttccgcaagcgaaacctgacgatcatggacttacacccgggcagcggaaagacccgccggtacctcccggcaatcgtccgcgaagccatcaagcggaagctgcggaccttgatcttagcccccacccgcgtggtggcctctgaaatggcggaggccctgaagggcatgcccatacggtaccagacgacggccgtaaagagcgagcacacgggcaaggagatcgtcgacttaatgtgccacgccaccttcacgatgcgcttactatcccccgtgcgggtcccaaactacaacatgattatcatggacgaggcccacttcacggaccccagctccatcgccgcccgcgggtacatctcgactagagtcggcatgggcgaggcggcggccatcttcatgaccgcaaccccgccgggctccgtagaggccttccctcagtctaacgccgtcatccaggacgaggagcgcgacatccccgagcgctcctggaacagcggctatgagtggataacagactttcccggcaagaccgtgtggttcgtgccctccatcaaggccggcaacgacatcgcgaactgcctgcgcaagaacggaaaacgggtcattcagctgagccgcaagacctttgatacggagtaccagaagaccaagaactcggactgggactacgtggtgactaccgacataagcgagatgggggccaacttccgggccgaccgcgtcatcgacccgcggcgctgcctgaagcccgtgattctgaaagacggtcccgagcgggtaatcctggctggccccatgccggtcacggtggcctccgccgctcagcgcagagggcgcgtcggccggaaccacaacaaggagggcgaccagtacatctacatggggcagcccctgaacaacgacgaagatcacgcccactggaccgaggccaagatgctgctcgacaatatcaacacccccgagggcatcattcccgctctgttcgaaccggaacgcgagaagtccgcagcaatcgacggcgagtaccgcctccggggcgaggcccgcaagaccttcgtggagctcatgcggcgcggggacctgcccgtgtggctgtcctacaaagtcgcctcagagggcttccagtacagcgaccggcgctggtgtttcgacggcgagcggaacaaccaggtgctcgaggaaaacatggatgtggagatctggacgaaggagggggagcgcaaaaaactgcggcccaggtggctcgacgcccggacctactccgaccccctcgcgctacgcgagttcaaggagttcgccgccggccggcgcagcgtctcaggggacttaatcctcgagatcggcaagttgccgcagcatctgacgcagcgggcgcagaatgctctcgacaacctggtgatgctgcacaatagcgagcagggagggagagcttaccggcatgctatggaggagctccccgacaccatcgagacgctcatgctgctcgccctgatcgccgtgctcaccggcggggtcaccctcttcttcctgtccggccgcgggctgggtaagaccagtataggcctcctgtgtgtcatggcgtccagcgtgctcctctggatggcctccgtcgagccccactggatcgccgcgagcatcatcctggagtttttcttgatggtgctcctgatcccagagccggatcggcagcgtacgccccaggacaaccagctggcatacgtagtgatcgggctcctgttcatgatcctgaccgtggcggccaacgagatgggcctcctggagactactaagaaggatctgggtatcggccatgtggccgttgagaaccaccatcacgccgccatgctagatgtggatctccaccccgcgtctgcctggaccctatacgccgtggccacaaccataatcaccccgatgatgcggcataccatcgagaacacgaccgccaacatcagtctgacggcgatcgccaatcaagccgccatcctgatggggctggataagggctggcccatctccaagatggacatcggcgtccccctcttggcgctggggtgctactcacaggtgaacccgctcaccctgacggccgccgtgttaatgctcgtcgcccactacgccatcatcggcccggggctgcaagcaaaggccactagggaagcccagaagcggacggcagcgggcatcatgaagaaccccaccgttgatgggatcgtagcgatcgatctggatccggtcgtatacgacgccaagttcgagaagcagctcggacagatcatgttactgatcctgtgcacgtcccagatcctgctgatgcggaccacctgggctttgtgcgagagcataaccctggccacgggtcccctgactaccctctggaaggggtccccgggtaagttctggaacaccacgatcgccgtctctatggcaaacatctttcgcgggtcctacctggccggcgcgggcctagccttcagcttgatgaaatccctcggcggcgggagacgcgggaccggggcgcagggagagacacttggggagaagtggaagcggcagctcaaccagttgtctaagtctgaattcaacacctacaaacgctccgggataatggaagtcgaccggagcgaggccaaagagggcctaaagcgcggtgagaccacgaagcacgccgtcagtcggggcaccgccaaactcaagtggttcgtagagaggaacctggtcaagccggaagggaaggtgatcgatctgggctgcggccgcgggggttggagctactattgcgccgggctgaagaaggtcaccgaggtgaagggctacactaagggcgggcccggccacgaggagcccataccgatggcgacgtatgggtggaacctcgtgaagcttcacagcggcaaggacgtgttcttcatcccgccggagaagtgcgacactctgctctgcgacattggtgagtcgtcgcccaacccgaccatagaggagggcaggacgctgcgggtcctgaagatggtggagccctggctccgtaagaaccagttctgcatcaagatcctgaacccctacatgcccagcgtggtcgagaccctggagcaaatgcaacggaaacacgggggcatgttggtccgcaacccgttatcccggaacagcacccacgagatgtactgggtctcctgcggaaccgggaacatagtcagcgccgtgaacatgacttcacgcatgctgctcaaccggttcacaatggcccatcgcaagcccacctatgagcgcgacgtggacttaggcgcagggacccggcacgtcgccgtggagccagaggtggcgaacctggacatcataggccagcgcatcgagaacatcaagcacgagcacaagagcacctggcactacgatgaggacaacccctataagacgtgggcctaccacggctcctacgaggtcaagccctccggctccgccagcagcatggtgaacggcgtggtgaagctcctgaccaagccctgggacgtgatccccatggtcacccaaatcgccatgactgatacgaccccctttgggcagcagcgcgtgttcaaagagaaggtggacacccgcaccccgaaggccaagcggggaacggcgcagataatggaggtcacggccaggtggctttgggggttcctctcccggaacaagaagccccggatctgcacgcgggaggagttcacccgcaaggttcggagcaacgccgccatcggcgcggtctttgtcgacgagaaccagtggaactcagccaaggaggccgtggaggatgagcgcttctgggacctggtgcaccgggagcgagagttgcacaaacagggtaagtgcgccacatgcgtttacaacatgatggggaagcgggagaagaaattaggcgagttcgggaaggccaaaggcagccgcgcgatctggtacatgtggctgggggcacggttcctggagttcgaggccctcggctttatgaacgaagatcactggttctcccgcgagaacagcttgtccggcgttgagggcgagggcctgcacaagctaggatacatcctgcgagacatcagcaaaatacccggcgggaacatgtatgccgacgacacggccggctgggatacccgcatcaccgaggacgatctgcagaatgaggcgaagatcacggacatcatggagcctgaacacgcgctcctggccaagtccatcttcaagctgacctaccagaacaaggtggtccgggtgcaacgaccggctaagaacggcaccgtgatggacgtcattagccgccgggaccagcgcggttccggccaggtggggacctatggcctcaacacgttcaccaacatggaggcccagctgatccggcagatggagagcgagggaatcttctccccttcagagctggagacccccaacctcgcggagagagtgctggactggctggagaagtacggggtagagcggctcaagcgcatggccatttccggtgacgattgcgtggtcaagccgatcgacgaccggtttgctaccgccttgaccgcgctgaacgacatgggtaaggttcgcaaggatatcccccagtgggagcccagcaagggctggaacgactggcagaaggtgcccttctgctcacaccacttccaccagctcatcatgaaggacggtcgggagatagtggtcccatgtcgcaaccaggacgaactggtgggccgtgcgcgcgtgagccagggcgccggttggagcctgcgggagaccgcttgcctcggcaagtcctacgcccagatgtggcagctgatgtacttccaccgccgggatttacgtttggcggccaacgcaatctgcagcgccgtacccgtggattgggtgcccacctcccggaccacgtggagcatccacgcccaccaccagtggatgacaaccgaagacatgctatccgtatggaacagagtttggatcgaggagaacccctggatggaggacaagacgcacatcagctcctgggaggacgtgccgtacttggggaaacgtgaggaccaatggtgcggctccctaatcgggcttactgcccgtgccacctgggccaccaacatccaagtcgccatcaaccaagttcgccgcttgattggcaacgagaactacctcgactacatgaccagtatgaaacgctttaaaaacgagagcgaccccgagggcgctctgtggtag

SEQ ID NO: 23733 - RNA, 9879 nt, synthetic construct
  misc_feature 1..9879: note = derived and/or modified CDS sequence (opt11) from DENV-1__JX669468__SS-prME
  source 1..9879: mol_type = other RNA
tccgtgaccatgctgctcatgcttctgcctactgcactggcctttcacctgacgacccgcggtggggagccccacatgatcgtgagcaagcaggagcggggcaagtcgctcctgttcaagacctccgccggtgtgaatatgtgcactctgatcgccatggacttaggcgagctctgcgaggacaccatgacatacaagtgcccccgtatcaccgaggccgagcctgacgacgtggactgctggtgcaatgccaccgacacctgggtcacctacggtacctgcagccagaccggcgagcaccgacgtgataagcggagcgtggcactggcgccccacgtgggcctcggtcttgagacgcgcaccgagacatggatgagctccgagggggcctggaagcagatccagaaggtcgagacatgggccctgcggcaccccgggttcacggtaattgccctgttcctcgcgcacgcaatcggcaccagcatcacacagaaggggattatctttatcctgctgatgctcgtgaccccctctatggccatgcgctgcgtaggtatcggaaacagggatttcgttgaaggtttgagcggcgccacgtgggtggacgtggtgctggagcacggttcctgcgtgaccactatggcgaagaacaagcccacattggacatcgaactgctgaagacggaagtcaccaaccccgcagtgctccgcaagctgtgcatcgaggcgaagatctcgaacacaaccacagactcaaggtgtccgacgcagggcgaagcgaccctggtggaagaacaagatgccaacttcgtctgccgccgaacctttgttgatcgcgggtggggtaacggctgcggcctgttcggcaagggaagcctgttaacgtgcgccaagttcaagtgcgtgactaagttggaaggcaaaatcgttcagtacgaaaacctgaagtactccgtgatagtgaccgtgcacaccggcgaccagcaccaggtagggaatgagacgaccgaacatggaacgatcgccaccattacgccccaggcacccacttccgagatccaactgaccgactatggggctctcaccctggactgcagccctcggaccggcctggactttaacgagatggtcctcctgaccatgaaggagaaaagctggctagtccacaagcagtggttcctcgaccttccgctgccctggacctccggggcgagcacaagccaagaaacctggaaccgccaagacttactggtcacgttcaagaccgcccacgcgaagaaacaggaggtcgtggtgctgggctcccaggaaggcgccatgcacaccgccttgactggtgccactgagatccagacaagcggtaccaccacgattttcgcaggacatctgaagtgccggctgaagatggacaagctgaccctgaagggcacgtcctacgtcatgtgcacaggcagctttaagctggagaaagaggtggcggaaacgcagcacggcaccgtgctggtgcaggtaaagtacgagggcacggacgccccctgtaaaatccccttctctacccaggacgagaagggggtcacgcagaacggccgtttaatcactgcgaaccccatcgtgaccgataaggaaaagcctgtgaacatcgagaccgagccgccattcggggagagttacatcgtggtcggcgcaggcgagaaggcactgaaactttcctggttcaaaaaggggagctccattggcaagatgtttgaggctactgctcgtggggcccgccgcatggccatcctgggtgataccgcgtgggattttggatctatcggcggcgtcttcacttccgtggggaaattggtccaccaggtattcggaaccgcctacggggtgctattctcgggcgtttcatggacgatgaagatcggtatcggcatactcctgacatggctcgggctcaactcgaggtccacgagcctgtccatgacctgcatcgcagtgggaatggtgacgctgtaccttggggtgatggtgcaggcagattcagggtgtgtaattaactggaagggccgcgaactcaaatgcgggaatggcatcttcgtcaccaacgaggtgcatacctggacggagcaatacaaattccaggctgactctccgaagaggctatccgcggccataggccgcgcctgggaagagggggtctgcggcatccgaagcgccacccgacttgaaaacatcatgtggaagcagatttccaacgaactgaaccacatcctgctcgaaaacgacatcaagtttacggtcgtggtggggaacgccaatggcatactggcgcaggggaagaagatgattcggcctcagcccatggaacacaagtacagctggaagagttgggggaaggccaaaatcatcggcgcagacatccaaaacactacattcattatcgatgggccagacaccccggagtgccccgatgagcagcgcgcctggaacatctgggaggtcgaggactacggcttcgggatcttcacaacgaatatttggctgaagctccgggacagctatacgcagatgtgtgatcacaggctgatgtccgcggcaatcaaagacagcaaggccgttcacgccgacatgggctactggatcgagagtgagaaaaacgagacctggaagttagccagagcgtcattcatcgaggtgaagacgtgcatctggcccaagtcacacaccctctggagcaatggcgttttggagtccgaaatgataatcccaaaaatgtacgggggcccgatcagccaacataactaccgacccgggtatttcacgcagaccgccggcccctggcacctggggaagctcgagctcgacttcgacctgtgcgagggcacgaccgtggttgtggacgagcattgcggctcgagggggccgagcctccgcaccaccacggtgacaggcaagatcatccatgagtggtgctgccgttcttgcaccctgccgcccctgcgcttccgtggagaggacgggtgctggtacgggatggagatcaggcccgtgaaggagaaggaggagaatctcgtgcgatcaatggtctccgccggcagcggagaggtcgacagcttctccttagggatcctgtgcgtttcaatcatgatcgaggaagtcatgcgctcccgttggagccgaaaaatgctcatgacaggcacactggccgtgttcctcctactgatcatgggacagctgacatggaacgacctcatccgcctctgcatcatggttggcgccaatgcgtccgacaagatgggaatgggtaccacctacctggccctcatggccacgtttaagatgagaccaatgttcgcagttgggctgctgtttcggcggctcacttcacgcgaggtattactactcactatcgggctgagcttggtagccagcgtggagctccccaattccctggaggagctgggggatgggctcgcgatgggaattatgatgctgaagctgctcaccgagttccagccccaccagctgtggacgaccctgctcagcctgacctttatcaaaacgacgctgtccctcgactatgcctggaagaccacagccactgtcctgagcatagtatccctgttccccctctgcctgagcacgacctcccaaaagaccacctggctgccggtgctcctgggctcattcgggtgcaagccactgaccatgttcctcatcacggagaacgagatatggggccggaagtcctggcctttaaacgaagggatcatggcgatcggcatcgttagcattctgttgtcctcactgctgaagaatgacgttccactcgcggggccgctcatagccggcggcatgcttatagcgtgctacgttatatcagggtccagcgcggatttgtccctagagaaggccgctgaggtcagctgggaggaggaggccgaacacagtggcacgagtcacaacatcctggtggaggtccaagatgacggaaccatgaagatcaaagacgaggagcgcgacgatactctcacaattcttctgaaggccaccctactggccgtctccggcgtgtaccccatgtccatcccagccacactgtttgtgtggtacttctggcaaaagaagaagcagcggtcgggggtcttgtgggacacccccagtccacccgaggttgagcgcgcagtgctggacgacggtatataccggatactgcaaaggggcctgctcgggagatcccaggtaggagtgggtgtgttccaagatggcgtattccacacgatgtggcacgtgacccgcggggctgtgctgatgtaccagggcaagagactggagccctcgtgggcctcggtcaagaaggacctaataagctatggagggggctggcgcttccaagggtcctggaacaccggcgaggaggtccaggttatcgctgttgaacccgggaagaacccaaagaacgtgcagactacgccaggcaccttcaagacgcccgaaggagaagttggggccatcgcgctggacttcaagccaggcaccagcgggtccccgatagtaaaccgggagggcaagatagtgggcctgtacgggaacggcgtggtgaccaccagcgggacctacgtgtccgccatcgcccaagctaaggcctcgcaggagggcccactccccgagattgaggacgaggtgtttaagaaacgcaatctgaccataatggacctgcaccctgggtccggcaagacgcggcgctacctccccgcgattgttcgggaggctataaagcgcaagctgcgcactttaatcttagcccccactcgcgtggtggcctccgagatggcggaggcccttaaaggaatgcccattcgctatcagaccacggccgtcaagtcagagcacaccgggcgtgagatcgtcgatctgatgtgccacgccaccttcactatgcggctcctctctcccgtgcgggttcccaactacaacatgatcatcatggacgaggctcacttcacggaccccgctagcattgccgctcgcggctacatcagcacgcgggtgggaatgggcgaggccgccgcgatcttcatgaccgccacgccgcccggaagcgtggaggcctttccccagtccaacgctgtcatccaggacgaagaacgcgatattcccgagcggagctggaactccggatacgattggataacggacttccctggcaagaccgtgtggttcgtgcctagtatcaagtccgggaacgatatcgccaattgcctgcgcaagaacggcaagcgggtcatccagctcagcagaaagaccttcgacaccgagtaccagaagacgaagaacaacgactgggattacgtggtgaccacggacatctccgagatgggagcgaacttccgtgcggaccgggtcatcgacccccggcgctgcctgaagcccgtaatactgaaggacggccctgagcgcgtcattctggcggggcccatgcccgtcaccgtggcttcggcggcccaacgaagaggccgcatcggaagaaaccaaaacaaagaaggcgaccagtacgtctatatgggccagcccctcaacaatgacgaggaccacgctcactggactgaagccaagatgctgctcgacaatattaacacccccgaagggattatccctgccctgttcgaacccgagcgagagaagtcggcggcaatcgacggcgagtatcgcctaagaggggaagccagaaagacattcgtggagttgatgcggagaggggacctgcccgtgtggctgagttacaaagtcgctagcgagggcttccaatatagcgaccggcgttggtgtttcgacggggagcggaacaaccaggtattagaagagaacatggacgtggaaatctggaccaaagaaggcgagaggaagaaacttagaccccgctggcttgacgcgcggacctattccgacccgctcgccctgcgcgagttcaaagagttcgccgcggggcggaggagtgtctcgggcgacctaattctcgagattggcaaactgccccagcacctgacgctccgcgcccagaacgccctagacaacttagtgatgctccacaactccgagcaaggcgggaaggcctaccgccacgccatggaggagctgcccgacactatagagactttgatgctcctggcactgatagccgtgttaaccgggggcgtgacactcttcttcctcagcggtaagggcctgggcaagacctccattgggcttctatgcgttaccgctagttccgcactcctctggatggccagcgttgagccccattggatcgctgcctcaattatcctagagttcttcctaatggtcctgctaatcccggagccagatcggcagcgcacaccccaggacaaccagctcgcgtatgtggtgattggcttactttttatgatcctcacggtggctgctaacgagatggggctgctagagacgaccaagaaggacctcggcatcgggcacgtggccgctgaaaaccatcagcacgcaacgatgctggatgtggacctgcacccagcgtccgcatggacattgtacgccgtcgccaccaccgtgatcacgcccatgatgcggcacacgatcgagaacaccacagccaacatctccctgactgcaattgccaaccaggccgcaatcctcatgggcctggacaagggctggcccatcagcaagatggacctgggcgtgccgttgctggcactcggatgctattcccaggttaacccgctgactctcaccgccgccgtgttgatgctggttgctcactacgcgatcatcgggccaggcctccaggccaaagccactcgcgaggcccagaagcggaccgccgctggaatcatgaagaaccccacggtcgacggcattgtggccatagacctagaccccgtggtctatgacgcaaagttcgagaagcagctgggccagatcatgctcctgattctgtgcaccagccagatcctactcatgcgcaccacctgggcactgtgtgagtctatcacgttggccaccgggccgctcacgaccctttgggagggaagccccgggaagttctggaacacgactatcgcggtgtccatggcgaacatattccgcggcagctacctcgcgggagccgggctggcgttctccctgatgaaatctctgggcgggggccgacgcggcacaggggcgcagggcgagactctgggcgagaagtggaagcggcagctgaaccagctcagcaagtcggagttcaacacgtacaagcgatccggcataatggaggtggatcggagtgaggcgaaagagggtctcaagcgcggcgaaaccactaagcacgcagttagccgggggaccgccaagctgcgctggttcgtcgagaggaacctggtgaagcccgagggcaaagttatcgacctcggttgtggtcgtggcgggtggtcctactactgtgccggactgaagaaggtgaccgaagtgaaggggtacactaagggcggcccggggcacgaggagccgatccccatggctacctacggatggaacctggtcaagctccatagcgggaaggacgtgttctttatgccgcccgaaaagtgcgatacccttttgtgcgatatcggagagtcaagcccgaaccccaccatcgaggaggggcggaccctccgcgtgctaaaaatggttgagccttggctccggggcaaccagttttgcatcaagatcctcaatccctacatgccctccgtggtggagacccttgagcagatgcagcgcaagcacggtgggatgctggtacggaaccccttgtcccgcaattccacccacgagatgtactgggtaagctgcggcaccgggaacatcgtttccgccgtcaacatgacgagtcgcatgctattaaatcggttcacgatggcgcatcgcaagcccacctacgagcgggacgtggacttgggcgccggtacccgacacgtagcagtcgaaccagaggtggcaaacctggacatcatcgggcagaggatcgaaaacatcaagaacgagcacaagtccacgtggcactacgacgaggacaacccctacaagacgtgggcctaccacgggagttatgaggtgaaaccgtctgggtccgcttcatccatggtcaacggcgttgtccgcctattgaccaagccctgggatgtcatcccaatggtgacccagatcgcgatgacagacaccaccccgttcggccagcagcgggtcttcaaggagaaggtggacacacgcactccccgggcaaagcgcggcaccgcccagataatggaggtaaccgccaagtggctgtggggatttttgtctcggaacaagaaaccccgaatatgcaccagagaggagttcacacgcaaagtccgttcgaatgccgccattggggcggtgttcgtggatgagaatcaatggaacagtgccaaagaggctgtggaggacgagcgcttctgggacctcgtgcaccgggaacgcgagctgcacaagcagggtaagtgtgccacttgcgtgtacaatatgatggggaagcgggagaaaaagctgggcgagttcggaaaggctaagggctcccgcgccatctggtatatgtggctgggcgcgcggtttctggagttcgaggccctcgggttcatgaacgaagaccactggttcagccgggagaactccctcagcggggtggagggggagggtttacataagctgggttacattttacgggacatatccaagatcccgggaggcaacatgtacgccgatgacaccgctggttgggatacccgcatcacggaggacgatttacagaacgaggccaagatcaccgacataatggagcccgaacacgcactgctggccacctctatcttcaagctgacctaccaaaacaaggtggtgcgcgtccaaagacctgccaagaatggcacggtgatggacgtgatatcccggcgggaccagagagggagcggtcaggtcggcacctacggactgaacacctttaccaacatggaggtgcagctaatcagacagatggagtccgaaggcatcttcttccccagtgagctcgagtccccaaacttagcggaacgcgttttggactggctggagaagcacggcgccgagcggcttaaacgcatggcgatctctggcgacgactgcgtagtgaagccgattgacgacagattcgccacggcactcatcgcattgaacgatatggggaaagtcaggaaagacattccccagtgggagccttccaaaggttggaatgactggcagcaggtccccttttgctcccaccacttccatcagctgatcatgaaagatggccgggagatagtggtgccctgccgtaaccaggacgaactcgtcggacgggcccgcgttagccagggtgccggttggagcctgcgggaaaccgcctgcctgggaaagagttacgcgcagatgtggcaactgatgtacttccaccgaagagacttacgcctcgcggcaaatgcgatctgcagcgccgttcccgtcgactgggtgcccaccagccggactacctggtccatccacgcgcaccatcagtggatgacgactgaggacatgttgagcgtttggaaccgcgtctggatcgaggagaacccgtggatggaggataagacacacgtgtccagctgggaagaggtaccatacctcggaaagcgcgaagaccaatggtgcggctccctgatcggtctcaccgcccgcgccacgtgggccaccaacatccaggtagccatcaaccaggtgcgccggttgatcgggaacgagaactacctggactacatgaccagcatgaagcgcttcaagaacgagtctgatcccgagggcgcgctatggtga

SEQ ID NO: 23734 - RNA, 9879 nt, synthetic construct
  misc_feature 1..9879: note = derived and/or modified CDS sequence (opt11) from DENV-1__JX669469__SS-prME
  source 1..9879: mol_type = other RNA
tcagtgacgatgctgctcatgctgctgcccacagctctcgcattccatctaacgacccggggcggcgagccccatatgatcgtgtctaagcaggagagaggcaagagcctcttgttcaaaacgagcgcgggggtgaacatgtgcaccctcatcgcaatggacctgggtgagctctgcgaggacacaatgacctacaagtgcccccggattactgaggccgaacccgatgacgtggactgctggtgcaacgcgaccgacacctgggtcacctacgggacctgctcgcaaaccggcgagcaccggcgggacaagaggtccgttgccctggcgccccacgtgggcctaggtctcgagacccgcaccgagacctggatgagttcggagggcgcatggaagcaaatccaaaaagtcgagacctgggccctgaggcacccggggttcacggttatcgccctattcctcgcgcacgctatagggacaagcatcactcagaaggggattatcttcatactgctgatgctcgtaactccctcaatggccatgcgctgtgttggcatcggcaaccgggacttcgtggagggccttagcggggccacgtgggtggacgtggtgctcgagcatgggagttgcgtgaccactatggccaagaacaagcccaccctcgacatagagcttctgaaaacggaagtcaccaaccccgccgtgcttcgcaagctgtgcataaaggccaagatctcgaacaccacaacggactcgcggtgtcccacacagggggaggccaccctggtggaggaacaggatgctaacttcgtttgccgccggaccttcgtggaccgcggctgggggaacggttgcggcctcttcgggaaggggagccttctgacgtgcgccaagttcaagtgcgttaccaaactcgaggggaagatcgtccaatacgagaacctgaagtattccgtgatcgtgacagtccacacaggggaccagcatcaggtggggaacgagacgacagaacacggcaccatcgcgaccatcacgccccaggccccgaccagcgaaatccagttaacggattacggggctctcaccctagactgcagccccaggaccggactggacttcaatgagatggtccttctgacaatgaaggagaagagttggctggtgcataagcaatggttcctcgacctgccgctgccctggacctctggcgcttcaaccagccaggagacctggaaccgccaggaccttctagtgacgttcaagaccgcccacgcgaagaagcaagaggtcgttgtcttagggtcccaggagggcgccatgcacaccgcgctaaccggggccacggagatccaaaccagcggcaccaccacgatcttcgcggggcacctaaaatgcagattgaagatggacaaactcaccctgaagggcacgtcctacgtcatgtgcaccggctcattcaagctcgagaaggaagtggcggagacgcagcatggcaccgtactggtccaggtgaagtatgagggtaccgacgcgccctgcaagatccccttcagcacccaggacgaaaagggggtgacgcaaaacggccgcctgatcaccgccaaccccatagtcaccgataaggagaagccagtgaacatcgagaccgagccgcccttcggcgaatcgtatatcgtagtcggcgcaggcgaaaaggcgctgaagctatcctggttcaagaagggttcttccatcggcaagatgttcgaggccacggcccgcggggcccggcggatggccatccttggcgacaccgcgtgggacttcggcagcatcggcggcgtattcacatccgtcgggaagctggtacaccaggtgttcgggaccgcatacggggtgctgttctcaggcgtctcgtggacgatgaagatcggaatcggtatcctcttaacctggctgggactcaacagcagatccaccagtctgtccatgacttgtatcgccgtggggatggtgacactgtatctcggtgtcatggtgcaggccgacagcgggtgcgtgatcaactggaagggacgcgagctgaaatgcgggtccggcatattcgtcaccaacgaggtgcacacctggaccgagcaatataagttccaggccgactcacctaagcggttaagcgctgcgattggccgtgcttgggaggagggtgtgtgcggtatccggtccgcgacccgcctcgaaaacatcatgtggaaacaaatcagcaacgagttaaatcacatcctgttggagaacgatatcaagttcaccgtcgtggtgggtaatgccaatggcatcctggcgcagggcaagaagatgatacgtccgcaaccaatggagcacaagtattcatggaaatcatggggaaaagcaaaaatcataggcgcggacatccagaacaccacatttattatcgatgggcccgacaccccggagtgccccgatgaacagagggcttggaacatctgggaggtcgaggattacggattcggcattttcacgacaaacatttggctgaagctacgggactcctacacccaaatgtgcgaccatcgtctgatgtctgcggccattaaagactcgaaggccgttcatgccgatatgggctactggatagagagcgagaagaacgagacctggaagttggcccgggcgagcttcatcgaggttaagacgtgcatctggcccaagagccacaccctctggtcgaacggcgtactggagtccgagatgatcatccccaagatgtatggcggcccgatctcccagcataactatagacccgggtacttcacacaaaccgccggcccatggcacctggggaagctcgagctcgactttgacctgtgcgagggcactaccgtcgtggtagacgagcactgcggctcccgggggccgtctttgagaaccactaccgtgaccggcaagattatccacgagtggtgctgccggagctgcaccctgcctccactgcgattcagaggggaggacggctgctggtatggtatggaaatccgacccgtgaaggaaaaggaagagaacctcgtccggtccatggtaagtgccggcagcggggaagtggactccttcagcctggggattttatgcgtatccataatgatagaggaggtgatgcgctccaggtggtcccgcaagatgttgatgacaggcaccctagccgtgtttctgttattaattatggcacagcttacctggaatgacttaatcagattatgcattatggtcggggcgaacgccagcgacaagatgggtatggggaccacatacctggcgctgatggccacgtttaagatgcggccgatgttcgccgtggggttactgttccgccggttaaccagcagagaggtgttgctgcttaccatcggcctgagcctggtcgcctccgtggagctacccaatagcttggaggagctaggtgacgggctcgccatggggatcatgatgctgaaacttctcaccgagtttcagccccatcagctctggacgacactcctctctttgacattcatcaaaaccaccctgtctctggactatgcctggaagacaacggccatggtcctgtcaatcgtgagccttttccccctctgcttgtccactacgtcgcagaaaaccacgtggctgccagtgttactcggatccttcggctgcaagccactgaccatgttcctcattaccgagaatgagatatggggccgcaagagctggccgctgaacgagggcatcatggcgatcgggatagtctcgattctgctcagctccttgctgaagaacgacgtgcctctagcgggcccgcttattgccggcggcatgcttatcgcctgctacgtgatttcaggctcctccgcggacctcagcttagaaaaggcggcagaagtatcctgggaggaggaggccgaacatagcgggacgtcccataacatactggtcgaagtgcaggacgacggcaccatgaaaatcaaggacgaggagcgggacgacaccctcaccatactgctgaaggcaacgctcctggcagtgagcggggtatatcccatgtccatccccgcgaccctgttcgtgtggtacttctggcagaagaagaagcaacggagcggcgtcctctgggacaccccgagtccgccagaggttgagcgcgccgtgctggacgacggtatctatcggatcttacagcgcggcttgttggggcgaagccaggtgggggtgggcgtgttccaggacggagtgtttcacaccatgtggcacgtgacacgcggtgctgtgctgatgtaccagggtaagcggctggagccctcctgggccagcgtgaagaaggacttaatctcctacgggggcgggtggcgcttccagggcagttggaacaccggggaggaggtccaggtcatcgcggtggagcccggcaagaacccgaagaacgtccagacaacgccagggacgtttaagacccccgagggcgaggtgggtgcgatcgcgctggacttcaaacctgggacttcaggcagcccgatcgtgaaccgcgagggtaagatcgtggggctgtatggcaacggtgtggtcaccacatccggcacctacgtgagcgcgatcgcccaagccaaggcatcacaggaggggccgcttcctgagattgaagacgaggtcttcaagaagcgcaacctgactatcatggacctgcatccgggctccgggaagacccggagatacctccccgccatagtccgggaggccataaagcgcaagctacgaacgctgatcctcgcccccaccagggtggtcgccagcgagatggcggaggccctgaagggcatgcccataagatatcagacaaccgctgtcaagtccgagcacacgggccgggagatagtggacctgatgtgccatgctacctttaccatgcgcctcctgagccctgttcgggtgcccaattataacatgatcatcatggacgaggcgcacttcaccgaccccgccagcatcgctgcacgcggatacatctccacacgggtggggatgggggaggccgcggccatattcatgaccgccacgccacccggctccgtcgaggccttcccccaaagcaacgccgtcattcaggacgaggagcgtgacattccagaacggtcctggaacagcggatatgactggatcacagactttccagggaagacggtgtggttcgtgccgagcataaagagcggcaacgatatcgcgaattgcctgcgcaagaacggaaagcgagtcatccagctctcccgcaagacatttgatacagagtaccagaagaccaagaataacgattgggactatgtggtcacgaccgacatcagcgaaatgggcgccaacttccgggccgacagggtcatagaccctcggcggtgcctgaagcccgtgatcctgaaggacgggcccgaaagggtgatcctcgcaggcccgatgcccgtcacagtggcgtccgctgcgcaacgcagagggcgcatcgggcggaaccaaaataaggagggtgaccaatacgtctacatgggtcagcccctgaacaacgatgaggaccacgcccactggacagaggccaagatgttgttggacaacatcaacacccccgagggcatcattccggcgctattcgaaccggagcgcgaaaagtccgccgccatcgacggggagtaccgcctgcggggcgaggcccgcaagacctttgtcgagctcatgcggcggggcgacctacccgtttggttatcctacaaggtcgcgagcgagggcttccagtatagtgaccgacgctggtgctttgacggagagcggaacaaccaggtgctcgaggagaacatggatgtggaaatctggaccaaggagggggaacgcaagaaactgcggccccggtggctggacgcccgtacctattccgacccgctcgccctgcgcgagttcaaggagttcgcagcgggacgccgctctgtctccggggacctgatcctagagatcggcaagctgcctcaacacctaacgttgcgggcgcaaaacgcactggacaatcttgtgatgctccataattcggagcagggtgggaaggcgtaccgccacgccatggaggagctgcccgacacgatcgagaccctgatgctcctggctctgatcgccgtgctcaccggcggcgtcaccctgttcttcttatccggaaaagggctcggcaagacgagcatcgggttgctgtgcgtgaccgcttccagcgctctcctgtggatggcctctgtcgagccccactggatcgccgcgtcaatcatcctggagttctttctaatggtcctgttaatcccggaacccgaccgtcagcgcacgccccaagacaaccagctcgcctacgtggttatcgggctgttgttcatgattttaaccgtcgcggcgaacgagatgggcctgctggaaactaccaagaaagatctcgggatcggccatgtcgctgcggagaaccaccaacacgccacaatcctggacgtggacctgcacccggcctccgcatggaccctctacgcggtcgcgacaactgtgatcacccccatgatgcggcacacgatcgagaacacaaccgccaatatcagtttgacggccatcgctaaccaagcggctattctgatggggctggataagggttggcctattagtaaaatggacctgggcgtacccctgctagccctggggtgctacagccaggtcaaccccctgactctcacggccgcagtgctgatgctggtggcgcactacgcaataataggacccggtctccaggcgaaggctacccgagaggcccaaaagcgcaccgcggccggcatcatgaaaaaccccaccgtcgacgggatcgtcgctatcgacctggatcccgtggtctatgatgccaagttcgagaaacaactgggccagatcatgcttctcatactctgtacgtcacaaatcttgctgatgcgcaccacttgggcgctgtgtgagagcatcaccctggcaacggggccgctcacaaccttatgggaggggtcccccggcaagttctggaacacgaccatcgccgtaagtatggccaacatcttccgcgggtcctacttagccggagccggcttagccttcagcctgatgaagtccctcgggggcgggcggcgcggcacgggagcccaaggcgagacactgggcgagaagtggaagagacaactgaatcaactcagtaagagcgaatttaacacatacaagcgatcaggcatcatggaggtagaccggagcgaggccaaggaaggcctgaaacgcggtgagacgaccaagcacgccgtctcccgaggcaccgcgaaacttcgctggttcgtggagaggaacctagtaaagcccgagggcaaggtaatcgaccttggatgcgggcgcgggggctggagttactactgcgccgggctaaagaaagtgaccgaggtgaagggatatactaagggcgggcccggccatgaggagccgatccccatggcgacgtacggctggaatctcgtgaagctccactccggcaaggatgtgtttttcatgccgccagaaaagtgcgacaccctattatgtgatataggggagagctccccgaacccgaccatcgaggagggccggaccctccgagtgctcaagatggtcgagccatggctgcgggggaaccagttctgcatcaagatccttaacccctacatgccaagcgtagtggaaacgctggagcagatgcagcgcaagcacggcgggatgctggtccggaaccccttgtcgcgcaacagcacccatgagatgtactgggtgtcctgcgggaccggcaacatcgtgagcgcggtcaacatgacctctcggatgctgctgaaccgcttcacgatggcacatagaaaacccacctatgagagagacgtggacctcggggcaggcaccaggcacgtggcagttgagcccgaggtggctaacctagacataattggccaacggattgaaaacatcaagaacgaacacaagtctacgtggcattatgacgaggacaatccgtataagacctgggcataccacggatcgtacgaagtcaagcccagcgggtccgccagctccatggtcaacggggtggtccgcctgctcacaaaaccctgggacgtgatacccatggtgactcagatcgccatgacggatacgaccccgttcggccaacaacgagtcttcaaggagaaggtggatacacgcacgccgcgggccaagcgcggtaccgcccagataatggaagttactgcaaaatggttgtggggtttcttaagccggaataagaagcctcgaatctgtacccgggaggagttcacccgcaaagtccggtcgaacgctgcgatcggcgccgtgttcgtggacgagaaccagtggaactccgcaaaagaggccgtcgaggacgaacgtttctgggacctcgtgcacagagagagagaactgcacaagcagggaaaatgtgcgacgtgtgtttacaacatgatgggcaagcgggagaagaaactgggggagttcggcaaggccaaaggaagccgcgccatctggtacatgtggctaggcgcccgcttcttggagttcgaggccctcggcttcatgaacgaggaccattggttctcccgagagaatagcctgtctggggtcgagggcgaaggactgcacaagttagggtacatcctccgggacatttccaagatccccggagggaacatgtacgctgacgataccgccggatgggatacccgcataaccgaggacgatttgcagaatgaagccaagatcacggacatcatggaacccgaacacgccttgcttgcgacctccatcttcaagctgacctaccagaataaggtggtgcgggtccaacgccccgcgaagaacggaacagtgatggacgtgatcagccgtcgggatcagcgcgggtctggtcaggtcggaacgtacggcttaaacaccttcaccaatatggaggtacagctaatccggcagatggagagcgaagggatcttcttccccagtgagctagagtccccgaacctagccgagcgcgtacttgattggctggagaagcatggagccgaacggctgaaacgcatggcgatctccggggacgactgcgtcgtgaaacctatcgacgatcggttcgcaaccgctcttatcgcgctgaatgacatgggtaaggtgcgcaaggacatcccccagtgggagcccagcaaaggttggaatgactggcaacaagtgccgttctgctcacaccatttccaccagttgatcatgaaagacggccgggagatcgtagtgccgtgccgaaatcaggatgagctcgtcggccgggccagggtgagccagggggccggctggagtctgagagagacggcctgtctgggaaagagctacgcccaaatgtggcagctgatgtatttccaccgccgggatctgaggctggcggccaatgccatctgcagtgcagtccccgtcgactgggtgcccacttcccggaccacgtggagcatccatgcccaccaccagtggatgaccacggaggacatgctctccgtgtggaaccgcgtctggatcgaggagaacccatggatggaggacaagacccacgtgagctcctgggaggaagttccatacctgggcaagcgagaagaccagtggtgcgggagcttaatcggcctcaccgctcgcgccacctgggccacgaacatacaagttgcgatcaaccaggtccgccgtctgataggcaacgagaactacctggactacatgacgtccatgaagcgttttaagaacgagagcgatcccgaaggggccctctggtga

SEQ ID NO: 23735 - RNA, 9879 nt, synthetic construct
  misc_feature 1..9879: note = derived and/or modified CDS sequence (opt11) from DENV-1__JX669470__SS-prME
  source 1..9879: mol_type = other RNA
agcgtgacgatgctgttaatgttgctgcccaccgccctcgccttccacctcactacccggggcggggagccccatatgatcgtttcaaaacaagagcggggcaaaagcctcctgtttaagaccagcgcgggggtgaacatgtgcaccctgatcgccatggatctgggcgagctctgtgaggatacgatgacctacaagtgccccaggatcaccgaggccgaaccggacgacgtggactgctggtgcaacgccaccgacacctgggtcacctacgggacctgtagccagaccggggagcaccggcgggacaagcgatcagttgccctagcgccccacgtgggactggggttggagacccggacagagacctggatgtcgtccgagggcgcttggaaacagatacagaaggtcgagacatgggccctgcggcaccctggcttcacggtcattgccctgttcctcgcgcacgccatcggaacgtccattacacaaaagggaatcatcttcatattgctgatgctcgtgacaccctccatggccatgcggtgtgtcggcatcggcaatcgagacttcgtcgaggggctgagcggggccacgtgggtagacgtggtgctggagcatggtagttgcgtgactaccatggccaagaataagcccacccttgacatcgagctgctcaagacggaagtcactaaccccgcggttctgcgcaaactgtgcatcgaggccaaaatcagcaacaccaccacggactcccgttgccccacccagggcgaggccaccctggtagaggaacaggacgcgaactttgtgtgccgccggaccttcgtggaccgcggctgggggaacggctgcgggctgttcggcaagggcagcctactgacatgcgctaagttcaagtgcgtgaccaagctcgaaggcaagattgtccagtacgaaaatttgaagtactccgttatcgtcaccgtccacaccggcgaccagcaccaagtgggcaacgagactaccgagcacggcacgatcgccactatcacaccccaggcgcccacgagcgagatccagctgaccgactacggagccctgaccctggactgtagcccccggactggcctggacttcaacgagatggttctcttaacaatgaaagagaagtcctggctggtccacaaacagtggttcctggacctgccattaccctggacctccggggcgtcaaccagccaggagacctggaaccgtcaagacttacttgtgaccttcaaaaccgcccacgcaaagaagcaggaggtagtggtgctgggctcacaggagggcgcgatgcataccgccctcactggggccacggagatccagacctcgggaactactactatcttcgctgggcacttaaagtgccggttgaagatggacaagttgaccctgaagggcatgagctacgttatgtgcaccgggagcttcaagctggaaaaggaggtggcggagacccaacacggcacggtcctggtccaggtgaagtacgagggcaccgacgccccctgcaagatccccttctcgacacaggacgagaaaggggtcacgcagaatgggcgcctcatcacggccaatccgatagtcaccgacaaggagaagcctgtgaatatagagaccgagccgccctttggagagtcatatatcgtggtaggcgccggcgagaaggcattaaagctgtcctggttcaagaaggggagctccatcggcaagatgtttgaggccacggctcgcggggcccgccgcatggcaatcctcggcgatacagcatgggacttcgggtccattgggggcgtgttcacctctgtgggtaagctagtccaccaagtgttcggcaccgcatacggcgtgctgttcagcggcgtttcatggaccatgaaaattgggatcggcatacttctaacttggctgggcctcaacagtaggtccaccagcttatcgatgacctgtatcgtggtggggatggttaccttgtacctcggcgtgatggtccaggccgacagcgggtgcgtcatcaattggaagggccgcgagctcaagtgcggatccggcatcttcgtgacgaacgaggtgcacacatggaccgaacagtacaaattccaggccgacagcccgaagagactgagcgccgcgatcggccgagcctgggaagagggcgtgtgcggtatccggtccgccactagactcgagaatatcatgtggaagcagataagcaacgagctgaaccacatcctgctcgagaacgatattaagttcacagtggtggttgggaatgccaatggcatcctggcgcaggggaagaagatgatccggccgcagcccatggagcataagtattcctggaaaagctggggcaaggcgaagatcattggagccgatatacagaacacgacatttattatcgacgggccggacaccccggagtgccctgacgagcagcgagcgtggaacatatgggaggtggaggactacggcttcggtattttcacaacgaacatctggttgaagctgcgggactcgtacactcagatgtgtgaccaccgcctcatgagcgccgcgatcaaagactccaaggccgttcatgccgacatgggctactggatcgagagtgagaagaacgaaacctggaagctggcccgggcgtccttcatcgaggtcaaaacctgcatctggcccaagtcacacacgctctggagtaacggcgtgctagaatcagagatgatcatccccaagatgtacggagggcccatctcccaacataactaccgtcccggctactttacacagacagccggaccatggcatctcgggaagctcgagctcgacttcgatctgtgcgagggcaccactgtagtcgtggatgagcactgcggcagccgggggccttccctccgcaccaccacagtgacgggtaagataatccacgagtggtgctgccgctcttgtacgctcccacccttgcgattccgcggggaggacgggtgctggtacgggatggagattcggcctgtaaaggagaaggaggagaatctcgtgcggagcatggttagcgccggcagcggcgaagtcgactcctttagcctcggaatcttgtgcgtgtccatcatgattgaggaggtgatgcgcagccggtggtcccgcaagatgctaatgactggcaccctagccgtcttcctgttgttgatcatggggcagctgacatggaacgatctcatccgcctatgcatcatggtgggtgccaatgcatcggacaaaatgggtatgggtacgacctacctggcgctcatggcaaccttcaagatgcggccgatgttcgctgttgggctgctgttccgccggctcacgagtagagaggtcttgctcctaaccattgggctgtctctggtagcctccgtcgagctccccaactctttggaagaactcggcgacgggcttgcaatgggcataatgatgctcaagctgctcacagaatttcagccccaccaactgtggacgacactgttatccctgactttcatcaagaccaccctgagcctcgattatgcctggaagacaaccgcgatggtgttatccatcgttagcctgttcccattatgtctcagtaccaccagccagaaaacgacctggctgccggtcctcctgggatcctttggctgcaagcccctgacgatgttcctcatcacggagaatgagatctggggccgcaagtcttggcccctcaacgaagggatcatggccgtgggtatcgtttccatcctgctcagcagcctgctgaagaacgacgtccccctcgccgggccgctgatagcagggggcatgctgatagcctgctacgtaatcagtgggtcgtccgccgatctcagcctggaaaaggcagctgaggtgtcctgggaggaagaggcagaacatagtggtacatcacacaacatcctggtagaagtgcaggacgacggcacgatgaagataaaagacgaagaacgcgacgataccttgaccatcctgcttaaggcgaccctcttggcagtcagtggcgtgtaccccatgtccattcccgccaccctgtttgtgtggtacctctggcagaaaaagaagcagcggagcggggtcctctgggacacccctagcccacccgaggtcgagcgcgccgtgctggatgacgggatctacagaatcctgcaacgcggcctcctggggcgcagccaggtgggcgtcggggtgttccaggacggcgtgttccataccatgtggcatgtcacgcgtggggcggtgctgatgtatcagggcaagcggttagagccctcctgggcctcagtaaagaaggacctaatctcctacggaggtggctggcgcttccaggggtcctggaacacaggagaagaggtccaggtgatcgccgtggaacccggcaagaatccgaagaacgtgcagaccacccccggcacctttaaaacccctgagggcgaggtaggggccatcgctctggatttcaagcccggcacttctggcagccccatcgttaacagggagggcaaaatcgtgggcctttatggaaatggcgtggtgaccacctccggtacgtacgtcagtgcgatcgcccaggccaaggccagccaagagggaccactgcccgagatcgaggacgaagtgttcaagaagcgcaacctgactatcatggatctccacccgggatccgggaagacccggagatacttacccgccattgtgagagaggcgatcaagcgcaagctgcggaccctcatcctagcccccacacgcgtagtagcctcggaaatggccgaggcgctaaaaggcatgcccatcagataccagactactgcggtaaaaagcgagcacaccgggcgagagatcgttgacctcatgtgccacgccacgttcaccatgcgcttgctgagcccggttcgggtgccaaactacaacatgatcatcatggacgaggcccatttcaccgacccggcatccatcgcagcccgcggctacatcagcacccgggtcgggatgggtgaggctgccgccatcttcatgacggcgacgccgcccgggagtgtggaggccttcccccagagcaacgccgtgatccaggacgaggaacgcgacatacccgaacggtcctggaatagcggctacgactggatcaccgactttccgggtaagaccgtctggttcgtgccttccattaagagcgggaacgatatcgccaactgcctcagaaagaacggcaagcgtgttattcagctttcccgcaagactttcgacaccgaataccagaaaaccaagaacaacgactgggactatgtagtgaccacggacatctctgagatgggtgccaacttccgggcggaccgtgtgatcgacccgcggcggtgcttaaaacccgttatcctcaaagacggccccgagcgggtgatccttgcaggtccgatgcccgtcaccgtggcctccgccgcgcagaggcgcgggcgtataggccgaaaccagaacaaggagggggaccagtacgtgtacatgggtcagccactaaacaacgatgaggaccacgcccactggaccgaggccaagatgcttctggacaatatcaatacgcccgaggggatcatccctgccctgttcgaacccgagcgcgaaaagtccgcggcaatagacggagagtaccgcctccgcggagaggcccgcaagacgttcgtcgagctgatgaggcgcggcgacttacccgtttggctctcctataaggtggccagcgagggattccagtactccgaccggcgctggtgcttcgatggggagcggaataaccaagtcctggaggagaacatggatgtggagatttggacgaaggagggggagcggaagaagctgcgacccagatggcttgatgcccggacctactccgatccgttagccctgcgcgagttcaaggagttcgctgccgggcggcgctcggtctccggcgacctcatcctggagataggcaagctgccccagcatctcaccctgcgggcccagaacgccctggacaatctcgtcatgttgcacaacagcgagcagggcggaaaggcctatcgccacgctatggaagagttgcccgacaccatagagacgttgatgcttctcgcgctcatcgcagttcttacagggggcgtgaccctgttcttcctctccgggaagggtctaggcaagacctccatcgggctgctctgcgtcacagccagcagcgcgctgttgtggatggcttccgtagagccccactggatagcggccagcatcatcttggagttcttccttatggtgcttctcatacccgagcccgaccggcaaagaactccccaggataaccagctggcctacgtggtgatcggccttctattcatgatactgaccgtggcggccaacgaaatggggctgttggaaaccaccaagaaggacctgggcataggacatgtcgccgccgagaaccaccagcacgccaccatgttggatgtggacctccacccggcgtccgcatggaccttatatgcggtggccaccacggttatcacccccatgatgcggcataccatcgagaataccactgccaacatatcactgaccgcgatcgcgaatcaggccgccatcttgatggggctggacaagggctggcctataagcaagatggacctgggggtgcccctcctggccctgggctgctacagccaggtgaacccgctcaccctgactgcggccgttctgatgttggtggctcactacgcgattatcgggcccggccttcaggcgaaggctacgcgcgaggcgcagaagcggacagccgccgggatcatgaagaatcccaccgtagacggcatcgtcgcgatcgaccttgaccccgtggtgtacgacgccaagttcgagaaacagcttggccaaatcatgctcttaatcctctgtacatcccagatcttgctgatgcgcacgacttgggccctctgtgaaagcatcaccctggccacgggcccgctgacgaccctctgggagggctctccagggaaattctggaacaccaccatcgccgtcagcatggcgaacattttccgcgggtcctatctcgccggcgccgggctggccttttcactcatgaagagtctgggcgggggccggcgtgggacgggcgcccagggtgagacgttgggggagaagtggaagagacagcttaaccaactcagcaaaagcgagttcaacacctacaaaagatccggcatcatggaggtggaccggagcgaggcgaaggagggccttaagagaggggaaactacgaagcacgcagtgagtaggggcactgcaaagttacgctggttcgtggagcgaaaccttgtgaagcccgagggcaaagtgatagacttaggttgtgggcgcggcgggtggagctactactgcgccggactgaagaaggtcaccgaggtgaaggggtacaccaaaggtggccccggccacgaggagccgatcccaatggcgacatacggctggaacctcgtgaagctgcactccgggaaggatgtctttttcatgccgcccgagaagtgcgacacgttactctgcgacatcggggaatcaagccctaaccccacgatcgaggaggggcggaccctgcgcgtgctaaagatggttgagccctggcttcggggcaatcaattctgcatcaagatcttaaatccatacatgccgagcgtggtggagaccctggagcaaatgcagcgcaaacatggcgggatgctagtacggaacccgctgtcaagaaactctacgcacgagatgtattgggtctcctgcggcactgggaacatcgtgagcgccgtgaacatgacctcgcgaatgctgctcaaccgcttcactatggcccaccgtaagcccacgtacgagagagacgtcgatctaggcgctggcactcgacacgtggcagtcgaaccagaggtcgcgaatctggacatcataggacaacgtatagaaaacatcaagaacgaacacaagagcacgtggcactacgacgaggacaacccgtacaaaacctgggcctatcacggctcctacgaagtgaagccctctgggtccgcaagctccatggtcaacggcgtggtgcggctcctgacgaaaccctgggacgtcatcccaatggtcacccaaatcgccatgaccgacaccacgccgttcgggcagcagcgggtgttcaaggagaaggtggacacgcgaacgccccgggccaagcgaggcactgcgcagatcatggaggtgacggcaaagtggctgtggggcttcctaagccggaacaaaaagccccgcatatgcacccgggaggagttcacccgcaaggtgcggagcaacgccgcaataggggctgtctttgtggacgagaaccagtggaactccgcgaaagaggcagtcgaggatgaacgattttgggatctggtgcaccgagaacgcgaactgcacaagcagggcaagtgcgcaacctgcgtttacaacatgatggggaagagggagaagaagctcggcgagttcggtaaagctaagggcagccgggcgatatggtacatgtggctgggagcgcgatttctggagttcgaagccctggggttcatgaacgaggaccactggttcagccgcgaaaatagcctgagtggagttgagggcgagggcctgcacaagctcggctatatcttgcgggatataagcaagatccccggcggtaacatgtacgccgacgacactgccgggtgggacacccgcatcaccgaggacgacctgaggaacgaggcgaagataaccgatataatggaaccagagcatgcactactggctacttccattttcaagctgacctaccagaacaaggtcgtgcgcgtgcagcgcccggccaaaaacggcaccgtgatggatgtgatctcgcggagggatcaacgggggtccggccaggtgggaacctacgggttgaacacgttcactaatatggaggtccaattgatcaggcaaatggagagcgaaggcatcttcttcccctccgagctcgagtcaccgaatcttgctgaacgggtcttagactggttagagaagcacggggcggagagattgaagcggatggccatctccggcgacgattgcgtggtaaaacccatcgacgatcgctttgcaaccgccctcatagctttgaatgacatggggaaggtacggaaggacatccctcagtgggaacccagcaagggctggaacgactggcagcaagtcccattctgttcccaccacttccaccagttgatcatgaaggacggcagggagatcgtcgtgccgtgccggaaccaagatgaactggtggggcgcgcgcgggtctcacagggcgccggttggagcctgcgagagaccgcctgcctcggcaaatcttacgcgcagatgtggcagctgatgtactttcacagacgcgacctgcggctcgccgctaacgccatctgcagcgccgtgcccgtggactgggtcccgacgtcacggaccacatggagcatccacgcccaccaccaatggatgaccactgaggacatgctgtccgtctggaaccgtgtgtggatcgaagagaatccgtggatggaggacaagacgcacgttagctcctgggaggaggtgccttacctggggaagcgcgaggaccaatggtgcggctccctaatcggcttgaccgcgcgagccacctgggccaccaatattcaagtggcgatcaaccaggtcagacgcctgattggaaacgaaaactacttagactacatgacgtccatgaagcgttttaagaacgagagcgaccccgaaggggctctgtggtga

SEQ ID NO: 23736 - RNA, 9879 nt, synthetic construct
  misc_feature 1..9879: note = derived and/or modified CDS sequence (opt11) from DENV-1__JX669471__SS-prME
  source 1..9879: mol_type = other RNA
agcgtaacgatgctcctgatgctgttacccacggctctcgctttccacctgactacgcgagggggcgaaccgcacatgatagtatccaaacaagaaaggggaaaatccctccttttcaaaacgtcggccggggtaaacatgtgtacactaatagcgatggacctaggtgaattatgcgaagatacaatgacatacaaatgccccaggataacggaagcggaacccgacgacgtcgactgctggtgcaatgccacagacacgtgggttacttatggcacttgcagccagacgggcgaacaccgccgcgacaaaaggtccgtcgccctcgcaccccatgtcggattaggtctcgaaacacgaacagaaacatggatgtccagtgaaggcgcatggaaacaaatacagaaagttgaaacttgggcactcaggcaccccggcttcaccgtaatagctctgttcttagcacacgccataggtacaagtattacacaaaaaggtataatttttatcctcctgatgctagtcacacccagcatggcaatgaggtgcgtaggtatcggtaatcgcgacttcgtggaaggcctgtctggcgcgacttgggtagacgtcgtcctagagcatggatcatgcgtcacaacaatggccaaaaacaaaccgaccctggatattgagctactaaaaaccgaagtgactaaccctgccgtgctgcggaaactatgcatcgaagcaaaaataagtaatacaaccacagactcacgatgtcccacacaaggagaagccacgctcgtggaggagcaagatgcgaacttcgtctgcaggcgaacgttcgtagacagagggtggggcaacgggtgcgggttgttcggtaaggggtccctactgacgtgcgctaaattcaagtgtgtgaccaaattggaaggaaagatagtacaatacgaaaacttaaaatattcagtaattgtcacggtgcacacaggagatcagcaccaagtgggaaacgagacgaccgagcacgggacgatcgcgacgataacaccccaagcaccaaccagcgaaatacagctcacagactacggcgccctaactctagactgttctccacgaacagggttagacttcaacgaaatggtactactcacgatgaaagagaagagttggctagtccacaagcagtggtttctggatctacccctaccctggacgtcgggagccagcacgtcacaggaaacctggaaccggcaagacttactggtgacattcaaaacggcacacgccaagaaacaagaagtcgtagtcctcggctcccaggaaggggctatgcacacggcactaaccggagcaaccgaaattcaaacaagcgggacaacaacgatattcgcgggacacctcaaatgccggctcaagatggataaactaacattaaagggaacctcgtacgtcatgtgcacaggatcattcaaacttgagaaagaagttgctgaaacccaacatggcaccgtactggtacaagtgaaatatgaagggactgatgctccctgtaagatcccattcagtacccaggacgaaaaaggagttacgcaaaacggcaggctgataacagcaaaccccatcgtgaccgacaaggagaaacccgttaacatagaaacagagccgccattcggggaatcatacatcgtcgttggagcgggagaaaaggctcttaagttgtcgtggtttaagaaaggaagcagcatcgggaagatgttcgaagcaacagcgagaggcgcacgacgaatggcgatactaggagacacagcatgggacttcgggagcataggaggcgtatttacaagcgtgggcaaactcgtacaccaagtctttggaaccgcgtacggagtcctgttcagtggggtaagttggactatgaaaattggcatcgggattttgctcacatggttaggcctcaatagtagatccacaagtctctctatgacatgcatcgcggtcggaatggtaactctctaccttggagtcatggtgcaggcagactccggatgcgtcataaattggaaaggccgcgaactcaagtgcggaagtggtatttttgttaccaacgaggtccacacgtggacggagcagtataaattccaagcagactcccccaagcgcctaagcgccgcaattgggcgtgcctgggaagagggcgtctgcggaattagaagcgctacaagactagagaacatcatgtggaaacaaatatcaaacgagttgaaccatatcttactagaaaatgatattaaattcactgtagtcgtgggaaacgccaatgggatactagcgcagggtaaaaagatgatacgaccacaacccatggagcacaagtacagctggaaaagctggggaaaggccaagataataggagcggatatccaaaacacaacattcataatagacggccccgacacccccgagtgcccagacgaacaacgcgcgtggaacatatgggaggtagaggattatggcttcggaatattcacaacaaacatatggctaaagctgagagattcgtatacccaaatgtgcgaccaccgattaatgtccgccgcaatcaaggactcgaaagccgtacacgcagacatgggctactggatcgaatctgaaaagaacgagacatggaaactagcaagggcctcgttcatcgaagtcaaaacatgtatatggccgaagtcacacacactttggagcaacggcgtcctggagtccgaaatgataatcccgaaaatgtacggaggacctatcagtcagcacaactaccgccctggatattttacgcaaaccgccggcccatggcacctcggaaaactagaactggacttcgacctctgtgagggaaccaccgtagtcgtagatgaacattgtgggtctcgcgggccttcgctacgaacaacgaccgtcacaggaaaaatcatacacgaatggtgctgccgtagttgcaccctaccaccgctccgcttcagaggggaagacgggtgctggtacggcatggagatcagaccagtaaaagaaaaggaagagaatctcgtccggtcaatggtctccgccggatcaggggaagtggactccttcagcctcggtatactttgcgtaagcataatgatcgaagaagtgatgcgctctcgatggagcagaaaaatgctaatgaccggaaccctggccgtcttcctattgctaatcatgggccaactgacatggaatgacctcatccgcctctgcatcatggtcggcgcaaacgcctcagacaaaatgggcatgggcaccacatatcttgcactaatggcgacactgaagatgcgcccaatgttcgcagtcggccttctgttccgaagacttacctcaagggaagtcctcctcctcacgatcggattgtccctcgtagcgagcgttgagctcccaaactcactcgaagaactcggcgacggacttgctatgggcatcatgatgctgaaactcttgacagagttccagccccatcaactatggaccacactcttatccctaacgttcatcaagacaactctatcgctcgactatgcctggaagactacagccatggtcctcagcattgtctcccttttcccgctgtgcctgagcacaaccagccagaagaccacgtggctgcccgtgttacttgggagcttcggatgcaaacccctcacaatgttcctaatcacggaaaacgaaatatgggggagaaagtcgtggccactaaacgagggaatcatggcgattggaattgtgtccatcctactatcatccctcctgaaaaacgatgtaccccttgcaggccccctaatcgcaggcggtatgctcatcgcctgttatgtgatctcgggatcctccgcagacctatccttagaaaaagctgctgaagtgagctgggaggaagaagccgaacactcaggcacgtcccataacatcctagtagaggtacaagacgatggcaccatgaaaatcaaagacgaagaaagagacgacaccctgacgattctgctcaaggccactctccttgcggtgtcaggggtatacccgatgtcaattcctgcaaccctgttcgtatggtatttctggcagaaaaagaaacagcgttctggtgtactctgggacacacccagtcccccggaagttgagcgagccgtcctagacgacgggatttataggatactacagaggggcctgctcgggaggagccaggtaggggtaggagtattccaagacggcgtcttccacacgatgtggcacgtgacaagaggggccgtgttaatgtaccaaggtaagaggcttgaaccctcatgggcctctgtcaaaaaggacctaataagctacgggggaggctggcgattccagggaagctggaacacgggagaggaagtccaggtcatcgcagtcgaacccgggaagaaccccaagaacgtgcagactacacctggcacgtttaagacacctgagggcgaagtaggggcgatcgcgctagactttaagcccggaacaagcggtagcccgatcgtaaacagagagggtaaaattgtggggctctatggaaacggagtggtcacaacgagcggaacatacgtgagcgctatagcccaagctaaagcaagccaggaagggcccctaccagagattgaggacgaagtgtttaagaaacgcaacctcaccataatggacctacaccccgggtcaggtaaaacacgacgatacttgccagcaattgtccgcgaagccatcaagagaaagctgagaacactcatcttagcgcccacgcgggttgtagcgagcgagatggcagaagcactaaaagggatgccaatcaggtatcaaaccacggcagtaaaaagcgagcacacaggtcgggaaattgtcgacctgatgtgtcatgctacattcacaatgcgattactcagccccgtacgagtgcctaattacaacatgataataatggatgaagcccacttcacagtacccgcgagcatagcggcgagaggttacatcagcacacgagtcggaatgggggaagctgcagcgatcttcatgaccgcaactccacccgggagtgtagaggctttcccacaatccaacgcggtcattcaagacgaagaaagggacatacccgaaaggtcatggaactccggatacgactggatcactgattttcccggaaaaacagtttggttcgtccccagtattaagtccggtaacgatatcgccaactgcctccgcaagaacggcaaacgcgtcatacaactctcgcggaagacatttgacactgagtaccagaaaacaaagaacaacgactgggactacgtggtgaccacagacatttccgaaatgggggctaacttccgcgcggaccgggtcatagaccccagacgctgcctcaaaccagtgatcctaaaggacggtcccgagagggtgattctagctggacccatgccggtaacagtcgcatcggcggcacaacgccgcggacgaatcggacggaaccaaaacaaagaaggagatcaatatgtgtatatgggacaacccctaaacaatgacgaggatcacgctcattggacggaagcaaagatgctactggacaatataaacacaccggagggaataatccccgcactattcgaaccggagcgggagaaaagtgcagcaatagatggggagtaccgtttaaggggagaggccagaaaaaccttcgtcgaattaatgaggcgaggtgatctaccagtatggctcagctacaaagttgcgtccgagggattccagtacagcgacaggaggtggtgctttgatggagagcggaacaaccaggtccttgaggaaaacatggacgtcgagatttggactaaagagggcgaacgcaagaaactccgtccgcgatggctcgatgctcgaacgtactccgacccacttgcgttgcgagagtttaaagagttcgcggcagggcgacgatccgtttcgggggatctcatactggaaatagggaaactcccccaacatcttacgcaacgcgcacagaacgcactcgacaatctcgtcatgctccacaattctgaacagggcggaaaagcctaccggcacgccatggaggagctgccggatacaatcgaaacactgatgctactggctctcattgcagtcctaacgggcggcgtgacactcttctttctgagcggtaaggggctcggcaaaacaagcataggactgctatgcgtaacagcatcatccgcgcttctctggatggcctccgtcgaaccccactggatcgcagcgtccataatcctagagttctttctgatggtactactcatcccagagccggacagacaacgaacaccacaagacaaccaactagcatatgtcgtgatcggactccttttcatgatactaaccgtagcagcaaacgaaatgggtttgctagaaaccaccaagaaagacctaggtataggccacgtagccgcagaaaaccatcagcacgcaactatgctggacgtcgacctacacccagccagcgcatggacgctctacgcggtcgcaaccactgttatcactcccatgatgcggcatacgatagagaacacaaccgcaaacataagtctaacggctatcgccaatcaggctgcaatactgatgggcctcgacaaaggatggccaataagcaaaatggacttaggagtgccgctcctagcacttgggtgctatagtcaggtaaacccactaaccctcaccgccgcggtgctcatgcttgtggctcactacgccatcatagggccgggtctgcaagcaaaagcaacacgcgaggcccaaaagcgaaccgcggccggaataatgaaaaaccccacagtcgacggaatagtagccatagatttagacccggtagtgtacgacgcaaagtttgaaaaacagttagggcagataatgctgctcatcttatgcacgagtcaaattcttttgatgcgaacaacatgggcactatgtgagtccataaccctcgccaccggacccctaaccacattatgggaaggctccccgggtaaattctggaacacgacgatagcggtatccatggccaacatattccgaggctcttacttggcaggagcgggactggcgttcagcctgatgaaatctctcggcggcggccggcgcggcacaggtgcgcaaggcgagacactgggcgaaaagtggaagcgacaacttaaccaacttagtaaaagcgagttcaatacatacaagagatcaggcatcatggaagtcgaccgttcagaagccaaagaggggctcaagagaggcgagacgacgaaacacgcagtatcgaggggtacggcaaaattacgctggttcgtcgaaagaaacttagtcaagccggaaggcaaagtgatcgacctagggtgtggcagaggcggctggtcatactattgcgcaggattaaagaaagttacagaggttaaaggatatacgaaagggggaccaggtcacgaagaaccgatccctatggcaacatacgggtggaacctagttaaactacatagcggcaaagacgtgttcttcatgccaccggagaaatgcgataccctcttatgcgacatcggtgaaagttccccgaacccgacaatcgaagaagggcgtacgctcagagtgctcaagatggtagaaccatggctccgcgggaaccaattctgcattaaaatactaaacccctacatgcctagcgtagtggagactctcgaacagatgcaacgaaaacacggagggatgcttgtaagaaacccgctcagcagaaatagcacccacgagatgtactgggtatcctgcggcactggaaacatagtttcagccgtcaacatgacatctaggatgctcctcaatcggttcacgatggcccaccggaagccaacatacgacagggacgtagacctgggcgcgggcaccagacacgttgcagtagagccggaggtagcaaatcttgacatcatagggcagcgcatcgagaacatcaaaaatgaacacaaatcaacatggcactacgacgaggataacccttacaaaacgtgggcttaccacgggagctatgaggtgaaaccaagcgggtcagctagttctatggttaacggcgtggtccgactcttaactaaaccctgggacgtaatccccatggtaacccaaatcgcgatgacggacacaaccccgtttggccagcaacgtgtgttcaaagagaaagtggacacacgaaccccaagagcaaagcgtggaaccgcccaaatcatggaagtaacagcaaagtggctatggggcttcctaagtcgcaacaagaaaccgcggatatgtacccgcgaggaatttaccagaaaagtccgcagcaacgcagctataggtgcggtatttgtcgacgagaaccaatggaactcagcaaaggaagcggtcgaagacgaacgtttctgggacttagtccaccgagagagggaactacataaacaaggcaaatgcgccacgtgtgtctacaacatgatgggaaaacgagagaagaaattgggagagttcggcaaggcaaagggcagccgagctatatggtacatgtggctgggcgcacggttcctcgagttcgaggcgcttggctttatgaatgaggaccattggtttagccgggaaaacagcctcagcggagtagaaggagaggggctgcacaagttgggatacatcttgcgggacatatcaaaaatacctggaggaaacatgtatgccgacgacacagcgggttgggatacacgcataaccgaagacgacctacaaaacgaggcaaaaataaccgacataatggagcccgagcatgcactattagccacatctatatttaagctaacatatcaaaacaaagtcgtgcgcgtgcaacgcccggctaagaacgggaccgtcatggacgtaataagcagaagggaccaacgagggtcaggccaagtaggtacatacggactcaacactttcactaacatggaagtgcagctcatacgccagatggaaagcgaaggaatattcttcccgagcgagctcgagtcgcccaacctagcagaacgggtactcgattggctagaaaaacacggggctgaacggctaaagcgcatggcaatatcaggcgacgactgcgtagtaaaaccaatagacgaccggtttgcaaccgcacttatcgcactaaatgacatggggaaggtaagaaaggacatcccacaatgggagccgtcaaaaggatggaacgactggcagcaagtgccattttgtagtcaccacttccatcagctgatcatgaaggacggccgggagatcgtagtgccctgtaggaaccaggatgaactggtgggacgggcgcgggtcagtcaaggtgcaggctggtcgctcagggaaacagcatgcttaggcaaatcctatgctcaaatgtggcaacttatgtacttccaccgaagagatctaagactggccgcaaatgcaatatgcagcgccgttccggtagactgggtgcccacatcccgaacaacatggtccatccacgcgcaccaccagtggatgacaaccgaggatatgttgtcggtctggaatcgagtatggatagaggagaacccctggatggaggacaagacgcatgtcagttcctgggaagaagttccctacctgggaaagagggaagaccaatggtgcgggtccctaattggactaaccgcaagggcaacgtgggccacaaacatccaagttgcaataaaccaggtacgtagacttattggcaacgaaaactacctcgactatatgacgtcaatgaagaggtttaagaacgagagcgacccagagggagccctgtggtga

SEQ ID NO: 23737 - RNA, 9879 nt, synthetic construct
  misc_feature 1..9879: note = derived and/or modified CDS sequence (opt11) from DENV-1__JX669472__SS-prME
  source 1..9879: mol_type = other RNA
agcgttaccatgttgctcatgcttctgcccacggcattagccttccatctcaccacccggggaggagaaccgcacatgatcgtgtcaaaacaggaacggggaaagagtttactgttcaaaaccagcgccggggtgaacatgtgcacattaatcgcgatggaccttggtgagttgtgtgaggataccatgacctacaagtgtccccggatcaccgaagccgaaccagacgacgtcgactgctggtgcaacgccaccgacacctgggtcacatacgggacctgcagccagaccggagaacaccgtcgagacaaacgcagtgtggccctggcaccacatgtagggcttggactcgagacacgcaccgagacctggatgtcgtcagagggcgcctggaagcagatccagaaggtcgagacttgggccctaagacacccaggcttcacggtgatagccctgtttctggcgcacgccatcggcacaagcatcacacaaaaggggatcatcttcatcctgcttatgttggtcaccccctcaatggccatgagatgcgtcggcatcgggaaccgggatttcgtggagggtctcagcggcgccacgtgggttgacgtcgtgcttgaacacgggtcctgcgtgacaacaatggccaagaataagcccaccctcgacatcgagctgctgaagacggaggtcaccaatcccgcggtgctcaggaaattatgcatcgaggccaagatctctaacaccaccacggacagtcggtgccctacccagggcgaggccaccctggtggaggagcaggacgccaacttcgtctgccggcggaccttcgtggacaggggctgggggaacggctgcggcttgttcggcaaggggagcctgctgacgtgcgccaagttcaagtgcgtgaccaagctagagggcaagatcgtccagtacgaaaatctgaagtactccgtgatcgtgacagtccacaccggtgaccagcaccaagtcggcaatgagacgaccgagcacggaaccatagcaaccatcacaccacaggcccccacgagcgagatccagcttaccgactacggggctctcaccctcgactgcagccccaggacgggcctggacttcaatgagatggtcctcctcacgatgaaagagaagtcatggctggtgcacaaacagtggttcctcgatttgcccctaccctggacctccggggccagcaccagccaggagacttggaacagacaagacctgctggtgacgtttaagaccgcacacgcaaagaagcaggaggtcgtcgtactgggctctcaggagggggcgatgcacaccgccctcaccggggctacggaaatccagacctcaggcacgaccacgatcttcgcgggacaccttaagtgccggttaaagatggacaagttgactctgaagggcacctcctacgtcatgtgcaccggcagcttcaagctggagaaggaggtagcggaaacgcagcacggcaccgtgctggtccaggtgaagtacgagggtactgacgcgccctgcaagatcccattcagtacccaggacgagaagggggtaacgcagaacggccgcctcattacagccaacccaatcgtaaccgacaaggagaagcccgtgaatatcgagactgagccgcccttcggggagagctacatagttgtaggcgccggcgaaaaggcgcttaaactttcctggtttaagaaggggagctccataggcaagatgtttgaagccacggcacgcggggccagacggatggccatactcggcgacaccgcgtgggattttgggagcataggcggcgtgttcacctcggtggggaaactggtccaccaggtgttcggcacggcttacggtgtgctgttcagtggtgtatcctggacgatgaaaatcgggatcggaatactcctgacctggttgggcttaaacagccgctccacgagcctgagtatgacctgcattgccgtcggtatggtgacgctgtatctcggcgtcatggtgcaagccgacagcggctgcgtgattaactggaagggccgagagcttaagtgcgggtccggcatattcgtgaccaatgaggtgcatacttggaccgagcagtacaaattccaggccgacagtccgaagcggctgagcgcagccataggccgcgcctgggaggagggggtgtgtggcatccgctccgccaccaggctcgagaacatcatgtggaagcaaatcagcaacgagttaaatcacatcctgctcgagaacgacatgaagttcactgtagtggtcgggaatgccaacggcatccttgcccaggggaagaagatgataaagcctcagcccatggagcacaagtactcctggaagtcctggggcaaagccaaaatcatcggagccgacatccaaaatactacctttatcatcgacggccccgacaccccggaatgccccgacgaacagcgggcctggaacatctgggaggttgaggactacggcttcgggatcttcacgaccaatatctggctcaagttgcgcgactcctacacccagatgtgcgaccaccggctcatgagcgcggccatcaaggactcgaaggccgtgcatgcagatatgggctattggatcgagtcagagaagaacgagacgtggaagttggcccgagcgtcctttatagaggtgaaaacgtgtatctggcccaagagccacacgctttggtccaacggtgtcctggagagcgagatgatcattcccaagatgtacgggggaccgattagtcagcacaattaccggcccggttacttcacgcaaacagccggtccctggcacctgggcaagctggagctggacttcgatctgtgcgagggaacgacggttgtggtcgacgagcattgcggctctagggggccgtccctccggaccacgacggtgactggcaagatcatccacgagtggtgctgtaggagctgcacactgccgcccttacggttccgtggggaagacggctgctggtacgggatggagatccggcctgtaaaggagaaggaggagaacctcgtccgctcaatggtatctgccggaagcggcgaagtggactccttcagcctggggatcttatgtgtctccatcatgatcgaggaggtgatgcggagccgctggtcccggaagatgctcatgaccggtacgctggcagtgttcctgctccttatcatggggcagctcacctggaacgacctcatacgattatgcatcatggtcggcgcgaacgcgagcgataagatggggatgggcaccacctacctggccttgatggctacgtttaagatgaggccgatgttcgccgtggggttactgttccggcgcctgacgtcccgggaggtgctgctgctcacaataggtctgagcctggtcgcctccgtggagctccccaatagcttagaggagttaggtgacgggctcgctatgggcatcatgatgttgaagttactcaccgagttccagccccaccagctgtggacgaccctactctccctgaccttcatcaagactacgctgagcctcgattacgcctggaagaccacggccacagtcctgtccatcgtgagcctgtttcccctctgcctgtccacgacaagccagaagacgacctggctgccggtgctactgggcagtttcgggtgcaagcccttaaccatgttcctcatcacggagaacaaaatatggggccgcaagagctggcccctgaacgaagggatcatggccattggaatcgtctccatcctgctcagtagcctgctgaagaacgacgtgcccttggcggggccgctgatagccggcggcatgctcatcgcctgctacgtgatctctgggagctcagccgacctctccctggagaaggccgcggaggtctcctgggaggaggaggcagagcacagcggcacctcacacaacatcctggtggaagtgcaggacgacgggactatgaaaatcaaagacgaggagcgggacgacaccctcacgatcctgctgaaggccaccctcttggccgtcagcggtgtgtaccccatgtccatcccggccacactattcgtgtggtacttttggcagaagaagaagcagcgcagcggggtgctctgggataccccctccccgcccgaggtggagcgggcggtgctggacgacggcatctacaggattctgcagcgtggcctgctggggcgcagccaggtcggcgtgggggtgtttcaggacggagtctttcacacgatgtggcacgtgacacgcggggccgtattaatgtaccagggaaagcgcctcgaacccagttgggcctctgttaaaaaggatctcatctcttacggcgggggttggcgcttccaggggagctggaataccggcgaggaggtccaagtgatagccgtagagcccgggaagaacccgaagaacgtgcagaccacgcccggaaccttcaagacccccgaaggcgaggtgggggccatagcgctggacttcaagcccggcaccagcgggagcccgatagttaaccgagagggcaagatcgtaggcctgtacgggaacggcgtggtcacaacctccgggacctacgtgtcggcaatcgcccaggccaaggccagccaagagggacccctccccgagatcgaggacgaggtgttcaaaaagcggaacctgaccatcatggacctgcacccggggtctggcaagaccagacggtacctccctgcgatagtacgtgaggccattaagagaaagctgcgcactttaatccttgcccccacccgggtggtagccagcgagatggcggaggccctgaagggcatgccgatacgctaccagaccacggccgtcaagtccgagcacaccggccgcgagatagtggatctgatgtgccatgctacctttacaatgcggctcctgagcccggttcgcgtcccgaactacaatatgatcatcatggacgaagcccacttcacggaccctgcgtccatcgccgcgcgtggctacatctctacccgcgttgggatgggcgaggccgccgcgatctttatgaccgcaacgccacccgggtccgtcgaggccttcccccagagcaacgccgtgatacaagatgaggagcgggacatccccgaacgttcgtggaacagcggttacgactggatcacggacttccccggcaagacggtatggtttgtcccgtccatcaaaagcgggaacgatatcgccaactgcctgcggaagaacggcaagcgcgtcatccagctctcccggaaaaccttcgacaccgagtaccagaagacgaaaaacaacgattgggactacgtggtgaccaccgacatcagcgagatgggggcgaacttccgcgctgaccgggtcatcgacccacgccggtgcctgaaaccagttatcctgaaggacgggccggagcgcgtgatcctcgcgggtccgatgcccgttaccgttgcgtccgcggctcagcggcgcggccggatcggccgcaaccagaacaaggagggggaccagtatgtgtacatgggccagcccttgaacaacgacgaggaccacgcccactggacggaagccaagatgctactcgacaacatcaacaccccagaggggatcataccggccctgttcgaacccgagagagagaagtctgcggccattgacggagagtaccgcctgcgcggggaggcccggaaaacctttgtggagctcatgcgccgtggcgacctgcccgtttggctgtcctataaggtcgcctcggagggctttcaatactccgaccgacgttggtgtttcgacggagaacgcaacaatcaggtgctggaggaaaacatggacgtggagatttggaccaaggagggagagcggaagaaactgcgcccccgctggctggatgcacgcacctacagcgacccgctcgcgctgcgggagtttaaagagtttgccgccgggcgacgaagcgtatccggcgacctgatcctcgagataggcaagctcccccagcacctgacactccgcgcccaaaacgccctagataacctggtgatgctccacaactccgagcagggcgggaaggcttaccgtcatgccatggaggagctacccgacactattgagacactcatgttactggcactgatcgcagtgctcaccgggggcgtcactctgttcttcctgtcggggaagggcctcggcaagacctccatcggtctgctttgcgtgaccgcgtcgagcgccctcctttggatggcatccgtggagccccactggatcgctgccagtatcatccttgagttcttcctaatggtcctgttaatcccagagcccgaccgccagcggacgccccaagacaaccaactcgcgtacgtcgtgatcggcctgctgtttatgatactcactgtagccgcgaacgagatggggctgctggagaccaccaaaaaggacctcgggatcgggcacgtggctgccgagaaccaccagcacgcgaccatgctggacgtggacctgcatccggcctccgcctggacgctctacgccgtcgccacgactgtgatcacccccatgatgcgccatactattgagaacaccaccgcgaacataagccttaccgctatcgccaaccaggccgccattctgatgggcctcgacaaaggctggcccatctccaagatggatctgggggtgcccctgctcgccctgggctgttactcacaggtaaatccgctgacgctcaccgcagctgtactgatgctcgtcgcccattacgcgatcattgggcccggcctacaggctaaggccaccagagaggcccagaaacgcaccgcagctgggataatgaaaaaccccacggtcgacggcattgtggcgatagacttggatcccgtggtatacgacgccaagttcgagaagcagctcggccagattatgctcttgatcctgtgcaccagccagatcctcctgatgaggactacatgggccttatgtgagagcatcacgctcgccaccggcccgttgaccaccctgtgggaggggagccccgggaagttctggaataccaccatcgctgtgagcatggccaacatcttccgcggctcctacctcgccggcgctggcctggccttctccctgatgaaatccctcggcgggggtcgacgggggacgggcgcgcaaggcgagacgctgggagagaagtggaagcgccaactgaaccaattgtctaagagcgagttcaatacgtacaagcggagcggaatcatggaggtggaccgcagcgaggccaaagaagggctgaagcggggcgagacaactaagcacgccgtatctcgcggcaccgcgaagctgagatggttcgtggagcgcaatctggtgaaaccagagggaaaggttatcgacttgggctgcgggaggggcgggtggagctactactgcgcgggcttgaagaaagttaccgaggtgaaggggtacacgaaagggggccctgggcacgaggagccgatccccatggccacttacggctggaacctggtcaagttacactccgggaaggacgtgttctttatgccgcccgaaaagtgtgacaccctgctgtgcgacatcggggagtcttccccgaaccccaccatcgaggaggggcgcactctacgggtgctgaagatggtcgagccctggctacgtggcaaccagttttgcatcaagatcctgaacccctatatgccgtcggtggtggagaccttggagcaaatgcagcgtaagcacggcggaatgctggtccgcaaccccctctcccggaacagcacccacgagatgtactgggtctcctgtggcacaggcaatatcgtgagcgctgtcaacatgacctcccgcatgctgctcaaccggttcaccatggcccaccgcaagcccacctacgagcgcgacgtagaccttggggcaggcacccgccacgtggcggtcgagccggaggtggccaacctagacatcatcgggcagcgcatcgagaacataaagaacgagcacaagagcacgtggcactacgacgaggataacccgtataagacctgggcctaccatggatcatacgaggtgaagcccagcgggtccgcaagctccatggtgaacggcgtggtgcgtttactcactaagccctgggacgtgattcccatggtgacccagatcgccatgacggacaccactccgttcgggcaacagcgtgtcttcaaggagaaggtggatacgcggactcctcgcgcgaaacggggcacagcccagatcatggaggttaccgccaagtggctgtgggggtttctgtcgcggaacaagaagccccgtatatgtaccagagaggaatttacgcggaaggtccgcagcaacgcagccatcggggcggttttcgtggacgagaatcagtggaactcggccaaggaagctgtcgaggacgagcgcttttgggatctcgttcaccgcgagcgggagctgcacaaacaaggcaagtgcgcaacctgcgtgtacaacatgatggggaagagggagaaaaagttgggtgagttcggaaaggcgaagggctctagagcaatctggtacatgtggctcggcgcccgcttcctggaatttgaggccctggggttcatgaacgaagaccactggttcagccgagagaacagcctctccggtgtcgaaggggaaggcctgcacaagctagggtacatactaagagacataagcaagatcccgggcggtaatatgtacgccgatgataccgcggggtgggacacccggataacggaggacgacctacagaacgaggccaagatcacggatatcatggagcctgagcacgccctgctcgccacctccatattcaagctgacctaccagaacaaggtcgtgagggtccagcggcccgcgaagaacggtacggtgatggatgtgataagccgccgcgaccagcgggggtccggtcaggtcggcacctatgggttgaacaccttcaccaacatggaggtgcagctcatacgtcagatggagagcgagggcatcttctttccgagtgagctggaatctccaaacttagcggagcgtgtgttggactggctggagaaacacggggccgagcggctgaagaggatggccatatccggcgacgactgcgttgtaaagcccatcgacgatcgctttgccactgccctcattgcgctgaacgacatgggaaaagtgcggaaggacatacctcagtgggagcccagcaagggctggaatgattggcagcaggttccgttctgctcccaccatttccatcagctgatcatgaaggacggccgcgagatcgttgtgccttgcagaaatcaggacgagcttgtcggacgcgcccgggtgagccagggcgccggatggtccctgcgcgaaaccgcctgcctgggcaagagctacgcccagatgtggcagctcatgtactttcaccggcgggatctgcgtctggctgcgaacgccatctgcagcgccgtgcccgtcgactgggtgccaacgtcccgcaccacttggagcatccacgcgcaccaccagtggatgaccaccgaggatatgctctccgtgtggaaccgggtctggatcgaggagaacccgtggatggaggataagacccacgtgtcctcctgggaggaggtgccttatctagggaaacgcgaggaccagtggtgcggttctctgatcggcctcacagccagagccacttgggccaccaacatccaggtcgccatcaaccaggtgagacgactgatcgggaacgagaactatctggactacatgacttcgatgaagcggttcaaaaacgagagtgatccggagggcgcgctctggtga

SEQ ID NO: 23738 - RNA, 9879 nt, synthetic construct
  misc_feature 1..9879: note = derived and/or modified CDS sequence (opt11) from DENV-1__JX669473__SS-prME
  source 1..9879: mol_type = other RNA
agcgtgaccatgcttctcatgctgctccccaccgccctcgctttccacctcaccacccggggcggggaaccccacatgatcgtgagcaagcaggagcgcggcaagagcctcctgttcaagacctcagcgggagtgaacatgtgtaccttgatcgccatggacctcggcgagctctgcgaggacaccatgacctataaatgtccccgcattaccgaggccgagcccgacgacgtggactgctggtgcaacgccactgacacatgggttacctacgggacctgcagccagaccggcgagcaccggcgcgacaagcggtccgtggccctggcaccccacgtgggcctgggtctcgagactcgcaccgagacctggatgagctccgagggcgcctggaagcaaatccagaaggtcgagacgtgggccctgcggcaccccgggttcacggttattgcactgttcctggcgcacgcaatcgggactagcataacgcagaaaggaatcattttcatcctgcttatgctcgtgacgccctccatggccatgcgctgcgttgggatcggcaaccgggacttcgtggaagggttaagcggcgcaacgtgggtggatgtcgttttggaacatgggtcctgcgtgaccacgatggccaagaacaagcccaccttagacatcgaattactgaaaacggaggtcaccaaccccgctgtgctccgcaagctatgcatcgaggccaaaatctctaatacgaccacggactcccggtgcccgactcagggcgaggccaccctggtggaggagcaggacgcaaacttcgtatgccgccggacctttgtggaccgcggctgggggaacggctgcgggttgttcggcaaggggagcttgctgacgtgcgccaagtttaagtgcgtgaccaaactcgagggcaagatcgtccagtacgagaacctgaagtactcggtgatcgtgaccgttcacaccggcgaccagcaccaggtgggtaacgaaacgaccgaacacggtacaatcgcaacaatcacgccacaggcccccagcagtgagattcagctgacggactacggagcactgacgctagactgctcgccccggacgggcctggacttcaatgagatggtcctcctgaccatgaaagagaaaagctggctggtgcataaacagtggttcttggacctgccgctgccctggacttctggggccagcacttcccaggaaacttggaatcgccaggacctcttggtgaccttcaagacggcacacgcgaagaagcaggaggtggtggtgctgggaagtcaggagggcgccatgcacaccgccctaaccggggcgaccgagatccagacgtccggtaccaccactatcttcgcagggcacctgaagtgccggctgaaaatggacaaactcacgctgaagggcaccagctacgtcatgtgcaccgggtctttcaagctggaaaaagaggttgcggagacccagcacggcacggtgctggtccaggtgaagtatgagggcaccgatgcaccctgcaaaatcccgttctcaacccaggacgagaagggtgttacccagaatggccgcctcatcactgcgaaccccatcgtcaccgacaaggagaagcccgtgaatatcgagaccgagccgcccttcggggagagctacattgtggtcggcgccggcgagaaggcgctgaagctgagctggttcaagaaggggtcctccatcggcaagatgttcgaggcaacggcccgcggggcccgccggatggcaattttaggcgacacggcttgggacttcggctccattggcggcgtgttcaccagcgtaggcaagctcgtacaccaggtattcggaacggcctacggcgtgctgttctcaggcgtgagctggaccatgaagatcgggatcggcatcttactgacgtggctgggcctcaactccagatccacgtcccttagcatgacttgcatcgccgtgggcatggtgaccctgtacctcggcgtaatggtgcaagccgactccgggtgcgtgatcaactggaagggtcgggaactgaagtgcggcagcggcatcttcgtcacgaatgaggtgcacacctggaccgagcagtacaaattccaagccgatagcccgaaaagactgtcggcggccattggtagagcctgggaggagggggtgtgcggcatccggagcgccacccgcctcgagaacatcatgtggaagcagatatccaatgagctgaaccacattctcctcgaaaacgacatgaaattcaccgtcgttgtcgggaacgccaacggcatcctggctcaggggaaaaagatgatcaaaccccagcccatggagcacaagtacagctggaagagttgggggaaagccaagatcatcggcgccgatattcagaatgccacgtttataatagatgggcccgacacccccgaatgcccagacgagcagcgggcgtggaacatctgggaggtcgaggattacggcttcgggatcttcactaccaacatctggctgaagctccgcgacagctacactcagatgtgcgaccatcggctgatgtccgccgccatcaaggactcaaaggccgtgcacgccgacatgggctactggatagagtccgagaagaacgagacctggaagttagcgcgcgccagcttcattgaggtgaagacgtgcatctggcccaagtcccacactctctggagcaacggcgtactggagtccgagatgatcatccccaagatgtacggaggacccatcagccagcacaactaccgccccgggtacttcacacaaaccgccgggccgtggcaccttgggaagctcgagctggacttcgatctttgcgagggtactaccgtggtcgtggacgagcactgcggctcccgagggccaagcctccggacgaccaccgtgaccggcaaaatcatccacgagtggtgctgccgatcctgcacgctgccgcccctgcggttcagaggggaagacggttgctggtacggtatggaaatccggcccgtgaaggagaaggaggagaacctcgttcgcagcatggtgagcgccggctccggcgaagtggactctttctccctggggattttgtgcgtcagcataatgatagaggaggtgatgcggtcccgctggagccggaagatgctgatgaccgggactctagccgtgttcctgctcctgatcatggggcagctgacctggaacgacctcattcgactgtgcatcatggtcggcgcgaacgccagcgacaagatggggatgggcacgacctacctggccttaatggccacattcaagatgcgcccgatgttcgctgtcgggttgttgttccggagactcaccagccgggaggtcctgctgctcacgatcggcctgagcctggtcgccagtgtggaactccccaactccctggaagagttgggagacgggctcgccatgggcatcatgatgctgaagctgttaaccgagtttcagccccaccaactttggactactctgctctccctgacattcatcaaaaccaccctgtccctcgactacgcctggaagaccactgcaacagtcctgagcatcgtgtccctgttccccctatgcctgagcacaacgagtcagaagacgacctggctgccggtgctcctgggcagcttcgggtgcaaacccctgaccatgttcctcatcaccgagaacaaaatttggggcaggaagtcctggcccctgaacgaggggataatggcgattggcatcgtctcgatcctgctcagctccctgctgaagaacgacgtccctctcgccggcccgttgatcgctggcggaatgctgatcgcgtgttacgtgatcagtggttccagcgcagacttatcactggagaaagcggccgaggtgagctgggaggaggaggccgagcacagcggcaccagccacaacatcctggtcgaggtacaagacgacggcaccatgaaaatcaaggacgaggagcgggatgataccctaaccatcttgctgaaggccaccctcctggccgtctcgggcgtgtatcccatgagcatccccgcgacactcttcgtgtggtatttctggcagaagaagaagcagcgctccggggtcctctgggacacccccagcccgcctgaagtggagcgcgccgtgctggacgacggcatctaccgcattctgcagcggggactactcggccgctcccaggtcggcgtaggtgttttccaggatggcgtcttccacaccatgtggcacgtgacccgcggggccgtgctgatgtaccagggcaaacgcctggagcccagctgggcctccgtcaagaaggacctcatcagctacggcgggggctggcggttccagggttcctggaatactggagaggaagtccaggtgatcgccgtcgagcccgggaagaaccccaagaacgtgcagacgacgcccggtaccttcaaaacccccgagggtgaggtgggggcgattgctctggacttcaagcccggcaccagcgggtcccccatcgtcaaccgcgagggcaagatcgtgggcctgtacgggaacggcgtagttaccaccagcgggacgtacgtgagcgcgatagcccaggccaaggcgtcccaagagggccccctccccgagatcgaggacgaagtgttcaagaaacggaacctgaccatcatggacctgcacccggggagcggcaagacgcgccggtacctccccgccatcgtccgcgaggccattaaacggaagctgcgcacactgatcctcgcgcccacgcgggtggtggcgtccgagatggccgaggccctgaagggcatgccgatcagataccagaccaccgccgtcaaatcagagcacactgggcgcgagatagttgacttgatgtgccacgccacattcaccatgcggctgctgtcccccgtgagagtccccaactacaacatgatcataatggacgaggcgcacttcaccgaccccgctagcatcgccgcccggggttacatctccacccgcgttgggatgggagaggctgcggcgattttcatgacggcaacaccgcctggcagcgtggaagccttcccccagtccaacgccgtcatccaagacgaggaacgggacatccccgagcgcagttggaactccggctacgactggatcaccgacttcccaggcaagaccgtgtggttcgtgccctcaattaagtccggtaatgacatcgcgaactgtctgagaaagaacggcaagcgcgtcatccagctcagccggaagacgtttgacactgaataccagaagacaaagaacaacgactgggattacgtggtgaccacggacatctccgagatgggggccaacttccgcgccgatcgggtcatagacccccgccggtgcctcaagccggtgatactgaaggacggaccagaacgtgtgatcctcgccggtccgatgcccgtcactgtggcgagcgcggcccagcggcgcggacggataggcaggaaccagaacaaagagggggaccaatacgtctacatgggccagccactgaacaacgacgaggatcacgcccactggaccgaggccaagatgctgctcgataatatcaacacccccgagggcatcataccggcgctgttcgagcccgagcgggagaagtccgccgccatcgacggcgagtaccgtctgcgcggggaggcccggaagacgttcgtggaactcatgcgccgcggcgacctccccgtgtggctgagctataaggtcgcctccgaggggtttcagtacagtgaccgccggtggtgctttgacggggagcgcaacaaccaggtgctggaggaaaatatggacgtcgagatctggaccaaggagggcgagcggaagaagctgcgcccccgttggctggacgcgagaacctacagcgaccctctcgcgctgcgagagttcaaggagttcgccgccgggcgtaggtcagtcagcggcgaccttatcctcgagatcggcaagctgccccagcacctgacactccgcgctcagaacgcgctggacaacttggtgatgttgcataactccgagcagggtggaaaggcttacagacatgccatggaggagctgcccgacaccatcgagacactgatgctcctggcgctgatagcggtactcaccgggggcgtcacgctgttcttcctaagcggtaagggcctcggcaagacatccatcgggctgctgtgcgtgacggccagctcagccttgctgtggatggccagcgtggaaccccactggatcgccgcgtctatcatcttggagttctttcttatggtcctactgatcccggagccggatcgccaacgtacgccccaggacaaccagctagcctacgtcgtgattgggctcctgttcatgatcctcaccgtcgccgccaacgagatggggttactcgaaaccacaaagaaggacctcggcatcgggcatgtcgccgcggagaaccaccagcacgccacaatgttagacgtggatctccacccggctagcgcctggactctctacgccgtagcgaccacggtgatcacaccaatgatgcgccacaccatcgagaacaccacggccaacatctcgctgaccgcgatcgcgaaccaggccgccattctgatgggcctcgacaaggggtggcccatcagcaagatggacctgggtgtgcccctgctcgcactgggctgctacagccaagtcaaccctctgaccctcaccgccgccgtgctgatgttggttgcgcactacgccatcatcgggcccggcctccaggcgaaggccacgcgcgaggcccagaagcgcaccgccgccgggatcatgaagaatccgaccgtcgacggaatcgtggccatcgacctggaccccgtggtgtacgacgccaagttcgaaaagcagctgggccagatcatgcttctgatcctttgtacctcgcagatcctgctgatgcggacgacctgggccctgtgcgaatccatcaccctcgctaccggtccgctgaccacgctgtgggaagggagcccagggaagttttggaacaccaccatcgcagtgtccatggccaacatattccgcggctcgtacctcgccggggccgggctggcgttctccctgatgaagtccctaggtgggggccgccgggggacgggtgcccagggcgagaccctgggggagaaatggaagcgccagctgaaccagctcagcaagtccgagtttaacacgtacaagcggagcggcatcatggaggtcgaccgctccgaggccaaggaggggctgaagcggggagagaccacgaagcacgccgttagccgcgggaccgcgaagctgcggtggttcgtggagcgcaacttagttaagcccgagggcaaggtcatcgacctcggctgcgggcggggcgggtggtcctactactgcgcaggcctgaagaaggtcaccgaggtcaagggatacaccaagggtggccccgggcacgaggaacccatcccgatggccacgtacggctggaacctggtcaagctccacagcgggaaggacgtgtttttcatgccgcccgagaaatgcgacacgctgctgtgtgacatcggcgagtccagccctaatcccacgatcgaggaggggcgcacccttagggtcctcaaaatggtcgagccctggctgcgcggcaaccagttctgtatcaagatcctcaacccctacatgccgtctgttgtagagaccctggagcaaatgcagcggaagcacggcgggatgctggtccgcaaccccctctctcggaactccacgcacgagatgtactgggtgagctgcggcactgggaacatcgtatcggcggttaacatgacgagccgcatgctgctgaaccggttcacaatggcccaccgcaagcccacatatgagcgggacgtggacctcggcgcaggcacgcgccacgtggccgtcgagccagaagtagcgaacctggacattatcggacagcgcatcgagaatattaagaacgagcataaatccacctggcactatgacgaggataacccgtacaagacgtgggcataccacggcagctacgaggtgaagccctccgggagcgcctcttcgatggtcaacggcgtggtcaggctgcttaccaagccctgggacgtgatccccatggtgacccagatcgccatgaccgataccacgccgttcggccagcagcgcgtcttcaaggagaaggtggacacacgtacgcctcgggccaaacggggcaccgcccagatcatggaggtgacggccaagtggctgtgggggttcctgagtaggaacaagaagccccggatctgcaccagagaggagttcacccggaaggtccgctcaaacgcggcaatcggagccgtgttcgtggacgagaaccagtggaatagcgccaaggaagccgtagaggacgagcggttctgggacctcgtgcaccgtgagcgggagctgcacaagcagggcaaatgcgcgacctgcgtgtataacatgatggggaagcgagagaaaaagctgggagagttcgggaaagccaagggctcccgggcaatctggtacatgtggctaggcgctcgattcctcgagttcgaggcacttgggtttatgaacgaggatcactggttcagcagagagaactccttgagcggcgtagagggggagggcctgcataagctggggtacatcctccgcgacatctccaagatcccgggcggcaacatgtacgcggacgacactgccgggtgggacacccggatcactgaagacgacctgcagaacgaggccaagattaccgacatcatggagcctgagcacgccctgttagcgacgagcatcttcaagctgacctatcagaacaaggtggtgcgcgtccagagaccagcgaagaacgggaccgtgatggacgtgatctcccgcagagaccagcgggggagcggccaggtgggtacctacgggctgaatacgttcaccaacatggaggtgcagcttatccgccagatggagtccgagggaattttcttccccagcgagctggagtccccgaacctggccgagcgggtgctcgactggctggagaagcacggggcggagcgcctgaagcggatggccattagcggcgacgactgcgtagtgaaacccatcgacgaccgcttcgccaccgcccttatcgccctaaacgacatggggaaggtgcggaaggacatcccgcagtgggagcccagcaagggctggaacgactggcagcaagtcccgttctgtagccaccactttcatcagctgatcatgaaggacgggcgcgagatagttgtgccctgccgaaaccaggatgagctcgtagggcgcgcccgggtctcccagggcgccgggtggagtctgcgggagaccgcctgcttgggcaagagctacgcgcagatgtggcagttgatgtacttccaccggcgcgacctgcggctggcggccaatgccatctgctccgcggtgcccgtcgattgggtgcccacaagccgcaccacctggtccatccacgcccatcaccagtggatgacaacggaggacatgctcagcgtgtggaaccgggtctggatagaggagaacccttggatggaggacaagacgcacgtatccagctgggaggaggtgccctacctggggaagcgcgaggatcagtggtgtggcagtctgatcggcctcaccgcgcgcgctacctgggccaccaatatccaagtagcgatcaaccaggtgaggcggctgatcggtaacgagaactacctggattacatgacgagcatgaagcggttcaagaacgagtccgaccctgagggcgccttatggtga

SEQ ID NO: 23739 - RNA, 9879 nt, synthetic construct
  misc_feature 1..9879: note = derived and/or modified CDS sequence (opt11) from DENV-1__JX669474__SS-prME
  source 1..9879: mol_type = other RNA
agcgtgactatgctgctcatgttactgcccaccgccctcgccttccacctaaccacccggggcggggagccccacatgatcgtgagcaagcaggagaggggcaagtcgctcctattcaagacctccgcgggggtgaacatgtgcaccctgatcgcaatggacctgggcgagctctgcgaggacaccatgacctacaagtgcccccgcatcaccgaggccgagcccgacgacgtggactgctggtgcaacgccaccgacacctgggtcacctatggtacctgcagccagaccggcgagcaccggcgcgacaagaggtccgtggccctggcgccccacgtgggtctggggctcgagacacgcacagagacctggatgagctctgagggggcctggaaacagatccagaaggtcgagacgtgggccctgcggcacccggggttcacggtgatcgccttattcctcgcgcacgccataggcaccagcatcacccagaagggaatcatcttcatcctgctgatgctcgtgaccccctccatggccatgcgctgcgtcggcataggaaaccgggacttcgtggagggactgagcggcgccacttgggtggacgtagtgctggagcacgggtcctgtgtgaccaccatggccaagaacaagcccaccttggacatcgaactcctgaagacggaggtcacaaaccccgcggtgctccgcaagctgtgcatcgaggccaagatcagcaataccaccacggattccagatgccccacccagggcgaggccacactggtggaggagcaggacgccaacttcgtctgccgccggacgttcgtggaccgcggatgggggaacggctgcggtctctttggcaaggggagcctcctgacttgcgccaagtttaagtgcgtgaccaagctcgagggcaagatcgtccagtacgagaacctcaaatactccgttatcgtaaccgttcacactggcgaccagcaccaggtggggaatgagacgaccgagcatggcaccatcgcgaccatcacgcctcaggcccctacgagcgagatccagttgaccgactacggagccctcacactggactgtagcccccggaccggcttggacttcaacgagatggtcctccttactatgaaggaaaagagttggctggtgcacaagcagtggtttctcgacctgccgctgccctggacctccggggccagcaccagccaggagacctggaaccgccaggacctcctggtgacgttcaagaccgcccacgcgaagaagcaggaggttgtggtgctgggctcccaggagggcgccatgcacaccgccctcaccggggcaacggagatccagaccagcggcactaccacgatcttcgccggacacctgaagtgcagactgaagatggacaagctcaccctgaagggcatgtcctatgtcatgtgtaccgggagcttcaaactggaaaaggaggtggcggaaacccagcacggcacggtgctggtccaggtgaagtacgagggcaccgacgctccctgcaagatccccttctccacccaggacgagaagggggtgacccagaacgggcgcctcatcacggccaacccgatcgtcaccgataaggagaagcccgtgaacatcgagaccgagccgcccttcggagaaagctacatcgttgtcggcgccggcgagaaagcgcttaagctgtcatggttcaagaaggggagctccatcggcaagatgtttgaggctaccgcccgcggcgcccgccggatggccatcctcggcgacactgcgtgggactttgggagcatcggcggcgtgttcacgtccgtggggaagctggtacaccaggtgttcggcaccgcctatggggtgctgttcagcggagtctcatggaccatgaagatcgggatcggcattctattaacatggttgggcctcaatagccgcagcacaagcctgagcatgacctgcatcgccgtggggatggtgaccctctacctcggcgtcatggtgcaagccgacagcgggtgcgtgatcaactggaagggacgcgagctgaagtgcggaagtggcatcttcgtcactaacgaggtgcacacctggaccgagcagtacaagttccaagctgacagcccgaagaggctgagtgcggccatcggccgcgcctgggaggagggggtgtgcggcatccggtccgccactcgcttagagaatatcatgtggaagcagatcagcaacgagctgaaccacatcctgctcgagaatgacatgaagttcaccgtggtggtggggaacgccaacggtatcctggcgcaggggaagaaaatgatcaaaccccagcccatggaacacaagtactcctggaagtcctgggggaaggccaagattatcggcgccgacatccagaacgccacgttcattatcgacgggcccgacaccccggagtgccccgacgagcagcgggcctggaacatctgggaagtcgaggactacggttttgggatcttcaccaccaacatctggttgaagctccgcgacagctacacgcagatgtgcgaccaccggctgatgagcgccgccatcaaggactccaaagccgtgcacgcagacatgggctactggatcgaaagtgagaagaacgagacatggaagctggctcgcgcctccttcatcgaagtgaagacctgtatctggcccaagtctcacacactctggtccaacggcgtcctggagagtgagatgatcatccccaagatgtacgggggcccgacgtcacagcacaactatcggcccgggtacttcacccagaccgcaggcccctggcatttagggaagcttgagctggacttcgacctgtgcgagggcaccacggtggttgtcgacgagcactgcggtagtagggggccgtccctccggacgaccaccgtgacgggcaagatcatccacgagtggtgctgccgctcgtgtaccctcccgcccctgcggtttcgcggggaggacggctgctggtacgggatggagatacggcccgtgaaggaaaaagaggaaaacctcgtccgctccatggtgagcgccggctctggcgaagttgactccttcagcctggggatcctctgcgtctcgataatgatcgaggaggtgatgcgcagcaggtggtctcggaagatgttgatgaccggcaccctggccgtgttccttctcctaatcatggggcagctgacgtggaatgacctcatccgcctctgcatcatggtcggcgcgaacgccagcgacaagatggggatgggtaccacctacctggccctcatggccaccttcaagatgcgtccgatgttcgccgtggggctgctgtttcggcggctcacgtcccgggaggtgctgctgctcaccatcgggctgagcctggtcgcgtccgtggagctccccaacagcctggaggagctgggcgacgggctcgcaatgggcatcatgatgctgaagctgctcacggaattccagcctcaccagctgtggaccacgctgctctccctaaccttcatcaagaccacgctgagcctcgactacgcgtggaagacgaccgccaccgtcctgtccatcgtcagcctattcccgctctgcttatccaccacgagtcaaaagaccacctggttgccggtgctcctgggatccttcgggtgcaagcccttaaccatgttcctcattaccgagaacgagatctggggtcgcaagagctggcccctgaacgaagggatcatggctatcggcatcgtctccatcctgctcagcagcctgttgaagaatgatgttcccctcgccgggccgttgatcgccggcggaatgctgatcgcctgttacgtaatctccgggagctcagccgacctcagcctggagaaggcggcagaagtctcctgggaggaggaggccgagcactcaggcacgtcccacaacatcctggtagaggtgcaggacgatgggacgatgaagatcaaggacgaggagcgggacgacacactcacgatactgctgaaggccacgctcctggccatcagcggcgtataccccatgtccatcccagcaaccctgtttgtgtggtacttctggcagaagaagaaacagcgcagcggggtcctctgggacacgccctccccgcccgaggtcgagcgggccgtgctggacgacggcatctaccgcatcctgcagcggggcctgctcgggcgcagccaggtgggcgtgggggttttccaggacggcgtgtttcacaccatgtggcacgttacgagaggggctgtgctgatgtaccaagggaagcgcctggagccctcctgggcaagcgtgaagaaggacctcatctcctacggcggcggctggcggttccaggggagctggaacaccggtgaagaggtccaggtgatcgccgttgagcccgggaagaacccgaagaacgtccagacgacccccggcacgttcaagacccccgagggcgaggtgggggcgattgccctggacttcaagcccggcaccagtgggagcccgatcgtaaaccgagagggtaagatcgtcggcctgtacgggaacggcgtggtgaccacctccgggacctacgtcagcgccatcgcccaggccaaggcgagccaggaaggtcccctccccgagatcgaggacgaggtgttcaagaagcggaacctgaccatcatggacctgcacccggggtcaggcaaaacccgccggtacctccccgccatcgttcgtgaggccatcaaacgcaagctgcgcacgctgatcttggcccccacccgggtcgtagcgagcgagatggccgaggccctgaagggcatgcccatacgctaccagaccaccgccgtgaagtcggagcacacggggcgcgaaatcgtcgacttaatgtgccacgccactttcaccatgcggctcctgagcccggtgcgcgtgcccaactacaacatgatcatcatggacgaggctcacttcaccgaccccgcctccatcgccgctagaggctacatcagcacgagagtcgggatgggcgaggctgcggccatcttcatgaccgcgacgccgcctgggtccgtggaggcgttcccccagagcaacgccgtgatccaggacgaagagcgggacatccccgagaggtcatggaactcaggctacgactggatcactgactttcccggcaagacggtctggttcgtgccctccataaagagcgggaacgacatcgcgaactgcctgcggaaaaacggcaagcgcgtgatccagctctcccggaaaacattcgacaccgagtaccagaagaccaagaacaacgactgggactacgtcgtcacgaccgacatcagtgagatgggggccaatttccgcgccgatcgggtgatcgacccacgtcggtgcttgaaacccgtcatcctgaaggatggccccgagcgcgtgatccttgccggaccgatgcccgtgacggtcgcgtccgccgcccagcggcgcggccggatcggcagaaaccagaacaaggagggggaccagtacgtctatatgggccagcccctcaacaacgacgaggaccacgcccactggaccgaggccaagatgctgctggacaacatcaacacgcccgaggggatcatcccggcgctgttcgagcccgagcgggagaaatcagccgccatcgacggcgagtaccgcctgcgcggggaggcacggaagaccttcgtcgagctcatgcgccggggcgacctgccggtgtggctgtcctacaaggtggccagcgagggcttccagtactccgaccgccggtggtgcttcgacggagaacgcaacaaccaggtcttagaggagaacatggacgtggagatctggaccaaagagggcgagcggaagaagctgagaccccggtggctggacgcgcgcacctacagcgacccgctagccctgcgggagttcaaggagttcgcagccgggcgccgtagcgtgtcaggcgacctgatcctcgaaattggcaagctgccccagcacctgaccctccgcgcccaaaatgcgctggacaacctggtcatgttacacaacagcgagcagggcgggaaggcataccggcacgccatggaggagctgcccgacacgatcgagaccttgatgctcctggccttgattgcggtgctcaccgggggcgtgaccctgttcttcctgtccgggaaaggcctcggcaagacgagcatcgggctgctgtgtgtcacggcctccagcgccctcctgtggatggcctctgtggagccccactggattgccgcgagcatcatcttagagttctttctaatggtgctgttaattccggagcccgatcgccagagaaccccccaggataaccagctcgcctacgtcgtgataggcctgctgttcatgatcctcactgtggcagccaacgagatggggttgctcgagacgacaaagaaggacctaggcattgggcacgtcgccgcggagaaccaccagcacgctacaatgctggacgtggatctgcacccggcctccgcctggacgctctacgccgtggcgacgaccgttatcacccccatgatgcgccacactatcgagaatacgaccgccaacatcagcctgaccgccatcgccaaccaggccgcgatcctgatgggcctcgacaagggctggcccatctccaagatggacttaggggtccccctgctcgcactaggctgctatagccaagtgaacccgctgaccctaacggccgccgtcctgatgctggtggcgcactacgccatcattgggcccggactacaggccaaggccacccgggaagcccagaagcgcaccgctgccggaatcatgaagaaccccaccgtggacggcatcgtcgccatcgacctcgaccccgtggtgtacgacgccaagttcgagaagcagctggggcagatcatgctcctgatcctgtgcacgtctcaaatcctcctgatgcggaccacctgggccctgtgcgagagcatcactctggcgacgggtccgctgaccaccctgtgggagggctcccccgggaagttctggaacaccacgatcgccgtcagcatggctaacatctttcgcggctcctacctcgctggagccgggctggcgttcagcctaatgaagtccctcggcggggggcgccgggggaccggcgcccagggcgaaaccctaggggagaagtggaagcggcaactgaaccagctcagcaagagcgagttcaacacctacaagcggtccggcattatggaggtggataggagcgaggccaaagaggggctgaagcggggcgagacgaccaagcacgccgtgtcaagagggaccgcgaagctgcggtggtttgtcgagcgtaatctggtgaagccagaggggaaggtgatcgacctcgggtgcgggcggggcgggtggagctactactgtgccggcctgaagaaagtcactgaggtgaaggggtacaccaagggcggccccgggcacgaggagccgatccccatggcaacgtacggctggaacctggtgaagcttcactccgggaaggacgtcttcttcatgccgcccgagaaatgcgacaccctgctttgtgacatcggagaatcgtccccgaacccgaccatagaggaggggcggaccctcagggtgctaaagatggtggagccatggctgcgcggaaaccagttctgtattaagatcctcaacccctatatgccgagcgtcgtggagacgcttgagcagatgcagcggaagcacggcgggatgttagtgcgcaaccccctctcccggaacagcacccacgagatgtactgggtgtcctgtggcaccgggaacatcgtgagcgccgtcaacatgacctcgaggatgctactgaaccggttcacgatggcccaccgcaagcccacctacgagcgggacgtcgatctcggtgcgggcacacgccacgtcgccgtcgagcccgaggtcgcaaacctggacataattgggcagcgcatcgagaacattaagaacgagcacaagagcacctggcattacgacgaggacaacccgtacaagacgtgggcataccacggctcctacgaggtgaagcccagcgggtccgcaagctccatggtgaacggggtcgtgcggctgctcactaaaccctgggacgtcattcccatggtgacccagatcgcaatgaccgataccacgccgttcgggcagcaacgcgtgtttaaggagaaggtcgacacccggacgccccgggccaagcggggcacggcccaaatcatggaggtgaccgccaagtggctgtggggcttcctgagccgcaacaagaagccccggatttgcacccgagaggagtttacccggaaggtgcgcagtaacgccgcgattggagccgtctttgtggatgaaaaccagtggaactccgctaaagaggccgtagaggacgagagattctgggacctcgtccaccgggagcgggagttgcacaagcagggcaaatgcgcgacgtgcgtgtataacatgatggggaagcgcgagaagaagctgggcgagttcgggaaggcgaagggcagccgggccatttggtacatgtggcttggggcacgcttccttgaattcgaggccctggggttcatgaacgaggaccattggttctcccgagagaacagcctctctggcgtggagggggagggccttcataagctcgggtacatcttacgcgacatcagcaagatcccgggcggcaatatgtacgcggacgacaccgccgggtgggacacccggataaccgaagacgacctgcagaacgaggccaaaatcaccgacataatggagccggagcacgcacttctcgccacgtctatcttcaagctgacctaccagaacaaggtggtgcgcgtgcagcggcccgcgaagaacggcaccgtcatggacgtgatcagccgcagggaccagcggggaagcggccaggtaggcacttatgggctgaacacgtttaccaacatggaggtccagctcatccgccagatggagagcgagggcatcttcttcccctccgagttggagagcccgaacctggccgaaagagtgctcgactggctggagaaacacggggccgaacgcctcaagcgaatggccatctccggcgacgactgcgtcgtcaagcccatcgacgaccgcttcgccaccgctctcatcgctctgaacgacatggggaaggtgcggaaggacataccccagtgggagccctccaagggctggaacgattggcagcaggtcccgttctgttcccaccatttccaccagctgataatgaaggacggacgcgagatcgtcgtgccctgccggaaccaggacgagctcgtggggcgcgcccgggtcagccagggcgccgggtggtccctgcgcgaaaccgcctgcctgggcaagagctatgcgcaaatgtggcagctgatgtacttccaccggcgcgacctgcgtctggccgccaacgccatatgctctgcggtgcccgtggactgggtccccacctcccgcaccacatggtcgatccacgcccaccaccagtggatgaccacggaggacatgctctccgtgtggaaccgggtgtggatcgaggagaacccttggatggaggacaagacccacgtctcttcatgggaggaggtgccctacctggggaagcgcgaggatcagtggtgcggcagcctgatcggattaaccgcccgggccacctgggccacgaacatccaggtggcgatcaaccaggtccggcgtctgatcgggaacgagaactacctggactacatgacctccatgaagcgcttcaagaacgagagcgaccccgagggagcgctctggtga

SEQ ID NO: 23740 - RNA, 9879 nt, synthetic construct
  misc_feature 1..9879: note = derived and/or modified CDS sequence (opt11) from DENV-1__JX669475__SS-prME
  source 1..9879: mol_type = other RNA
tcagtgaccatgctgctcatgttactacctaccgcgcttgcgttccacctgaccacccggggcggggaaccacacatgatagtgtccaagcaagaacggggaaagagcctcctgttcaagacatcggcgggggttaacatgtgtacgctgatcgccatggacctgggcgaactatgcgaggatacaatgacctataagtgcccaagaatcaccgaggcagagcccgatgatgtggattgctggtgcaacgctacagacacctgggtcacctacgggacctgcagccagaccggcgagcaccggcgggacaagcggtccgtggccctcgcgcctcatgtgggtctgggtttggaaacccgcacggagacctggatgagctccgagggggcctggaagcagatccagaaggtcgagacttgggcgctacgccatccagggtttacggtgatcgcccttttcctcgcgcacgccataggtaccagcattacccagaagggtatcatcttcatcctactgatgctagtcacccccagcatggcaatgcgctgtgtgggaattggaaaccgagacttcgtggaagggctcagtggagctacgtgggtcgatgttgtgctggagcacggctcctgtgtgaccaccatggccaagaataagcccacgctcgacatcgaactgctgaagacggaggtcactaaccctgcggtcctccgaaagctgtgcatagaggcgaagatcagcaacaccactacggattcccgatgcccgacccagggagaggccactctggtcgaggagcaggatgcgaatttcgtctgccgccggaccttcgtggaccgtggttgggggaacggatgcggcctcttcggcaaggggtcgttactgacgtgtgccaagttcaagtgcgtaaccaaactcgagggcaagatcgtccaatacgaaaacctgaagtactccgtgatcgtgaccgtccacaccggcgaccaacaccaggtgggtaacgagacgaccgagcacgggacaatcgcgaccatcacgcctcaagcacccacgagcgaaatacagctgaccgactacggcgccctcaccctggattgcagcccccggaccggccttgatttcaacgagatggtcttactgaccatgaaggagaagagttggctggtgcacaagcaatggttcctcgacttgccgctgccttggaccagcggggcgagcacctcgcaggagacctggaaccgtcaggacctcctggtgacattcaagacggcgcacgcgaagaaacaggaagtcgtggttctgggctcgcaagagggcgccatgcacacggccctcacaggcgccacggagatccagacgtcaggtaccaccacgatcttcgccgggcacctgaagtgtcggctgaaaatggataagctcacccttaagggcacatcatatgtcatgtgcacagggagctttaaacttgaaaaggaagttgccgagacgcagcacgggaccgtgctggtccaggtaaagtacgaaggcaccgatgctccctgcaagatccccttctctacccaggacgaaaagggtgtgactcagaacggccggctcataaccgcgaaccccatcgttaccgacaaggagaagcctgtcaacatcgaaactgagccgccgtttggggagtcatatatcgtagtgggcgccggtgagaaggcgctgaaactgtcatggttcaaaaagggaagctcgattggcaagatgttcgaagccacggcccgcggtgcccgccggatggcgatcctcggtgacacagcgtgggacttcggctctatcggcggagtgttcaccagtgtaggaaagctggtccaccaggtgtttggcacggcctacggggtgctattcagcggagtaagttggacgatgaagatcgggatcgggatcctccttacctggctgggcctcaacagcagatcgaccagcctgtcgatgacctgtatagccgttggcatggtgacgctgtatctcggcgtgatggtgcaagccgacagcgggtgcgtgatcaactggaagggccgcgagctgaagtgcgggtccggcatcttcgttaccaatgaggtacacacctggaccgagcagtacaaatttcaggccgactcaccaaagcggctgagcgcggcaatcgggaaggcctgggaggagggtgtgtgcggcatccgcagtgccacccggttggagaatatcatgtggaagcagatcagtaacgagctcaaccatatcctgctcgaaaacgacatcaagttcacggtggtcgtcgggaacgccaatggcatcctcgcgcaggggaagaagatgatccgcccccaacccatggaacacaagtactcctggaagtcctggggaaaggcgaagatcatcggcgcggatatccagaatactacattcatcatcgacggacccgacaccccggagtgccccgacgagcagcgggcctggaacatctgggaggtcgaggactacggcttcgggatttttacgaccaacatctggctgaaactccgggactcttatacccaaatgtgtgaccaccgtttaatgagtgcagcaattaaagattccaaagccgtgcatgccgacatgggctactggatcgagagcgagaagaatgagacctggaagctggcccgcgcatcattcatcgaggtgaagacgtgcatatggcccaagagccataccttgtggtcgaacggcgtccttgagagcgaaatgatcatccccaaaatgtatgggggtccgatctcccagcacaactaccggcccgggtacttcacgcaaaccgccggcccctggcacttgggcaaacttgaattggatttcgacctatgcgagggcacgacagtggttgtcgacgaacactgtgggtcaaggggtccatccctccggaccactacggtgaccggaaagattattcacgagtggtgctgccgcagctgcaccttaccgccgttgcggttccgcggggaggatggttgttggtacgggatggagatccggcccgtgaaggagaaggaagagaacttggtccgctccatggtcagcgcgggtagcggcgaggttgactcatttagcttggggatcctgtgtgtctccatcatgatagaggaggtgatgcgatcaagatggtcccggaaaatgctcatgaccggcaccctggcggtgtttttgctgttaatcatggggcagctgacctggaacgacctcatacgcctatgtattatggtgggggccaacgcgagcgacaaaatggggatgggcacaacctacttggccctaatggccacatttaaaatgcgcccgatgttcgccgtggggctatccttccgccggcttaccagtcgtgaggtgctcttactgacaatagggctcagcctcgtcgcaagtgttgagctgcctaacagcttggaggagttgggggatgggttagctatgggcatcatgatgcttaaactgttgaccgagttccaaccccaccaactctggaccaccctgctgagcctgaccttcatcaaaaccacactaagtttggactacgcgtggaagacgacagccatggtcctctcaatcgtgtcactgttccccctgtgcctcagcactacttcccagaagacgacctggttgccggtgctgctgggctcttttgggtgcaaaccccttaccatgttcctgatcaccgagaacgagatctggggtcggaagagttggccccttaacgaggggattatggccatcggcattgtgagcatccttctgtcgtccctcctgaaaaacgatgtcccgctggctggtccgctcatcgccgggggaatgctaatagcctgctatgtgatcagcggatcttcggctgacttgtccctagagaaggcagcggaggtcagctgggaggaggaggcagagcattccggaacgagccacaatatcctagtggaagtgcaggacgacggtacgatgaagatcaaggacgaggaacgggacgacacgctgaccattctcctgaaggccacgctgctcgccgtctccggcgtgtaccctatgagcatccccgccaccttatttgtgtggtacttctggcagaagaagaagcagcgctccggagtcctgtgggacaccccatcgcctccagaggtggagcgggctgtcctggacgatggcatctaccggatactgcagcggggccttctggggcgcagtcaggttggcgtgggggttttccaagacggcgtctttcacactatgtggcatgtgacgcgcggggctgtgttaatgtaccagggcaagcgcctggagcccagctgggccagtgtcaagaaggaccttataagctacggcggcgggtggcggttccagggttcctggaacaccggcgaggaggtccaggtaattgccgtggagcccgggaaaaacccgaaaaacgtgcagaccacccccggcacctttaagacccccgaaggcgaggtgggggccatcgcgctagactttaagccaggcaccagcggctccccaatcgtcaatagagaagggaagatagtcggactgtacgggaacggcgtcgtcaccacgagcgggacctacgtcagcgccatcgcccaggccaaggcctcccaggaaggacctctgcccgagatcgaggacgaggtattccggaaaaggaacctcactataatggacttacacccgggcagcggcaagaccaggaggtatctccctgcgatcgtgcgcgaggccatcaagcgcaagctccggacgctcatcctggcccccacacgcgtcgtggcatccgagatggcggaggccctcaagggcatgcccatccgctaccagaccaccgccgtcaaatccgagcacaccgggagggagattgttgatctgatgtgccacgccaccttcacaatgcgcttgctctcacccgtccgtgtccccaactacaatatgatcatcatggacgaggctcacttcactgaccccgcgagcatcgccgcccgcggatacatctccaccagggtcgggatgggcgaggccgcggcgatctttatgaccgcgacgccgcctgggagcgtagaggccttcccccaatccaacgctgtgatccaggacgaggagcgcgacatccctgagcggtcttggaactcaggatacgactggattactgacttccccggcaaaacggtctggttcgttcctagcatcaaatccggcaacgatattgccaactgtctacgcaagaacgggaagcgggtcatacagctgtcacgcaagaccttcgacaccgagtaccaaaagacgaagaacaacgactgggattacgtagtgacaaccgacatctctgagatgggcgcgaacttccgggccgacagagttatcgacccgaggcgctgcctcaagcccgtgatcctgaaggacggacctgagcgggtgatcctggccgggccgatgcccgtcaccgtagccagcgcggcccagcgtcggggccgaatcggacggaaccagaacaaggagggggaccagtacgtctacatggggcagcccctcaataacgatgaagaccacgcgcactggaccgaggcaaagatgcttctggacaacatcaatacgccggaggggatcataccagcccttttcgagcccgaacgcgagaaatccgcggccatcgacggcgaataccgcctgcgcggggaggctcgcaagacctttgtggagctgatgcggaggggcgatctccccgtgtggctgagctacaaggtcgcctccgagggtttccagtactcggaccgacgctggtgcttcgacggcgagcgaaataatcaagtcctggaggagaacatggacgttgagatctggaccaaggagggggagaggaagaagctccggccccgatggctggacgcccggacctattcggacccgcttgcactgcgcgagttcaaggagttcgccgccggccgacgctcagtaagcggcgacctgattctggagatcggcaaacttccccagcacctgaccctacgtgcccaaaacgcccttgacaaccttgtgatgctgcacaattccgagcagggagggaaggcttaccgccacgctatggaggaactcccggacacgattgagactctgatgttgttggcgctcatcgccgtgctgaccggaggcgtcaccctcttcttcctgagcggaaagggcttaggcaagacgagtatcgggctgctgtgcgtgactgcatcctccgccttactttggatggccagcgttgagccacactggattgccgcaagcatcatcctggagttcttcctgatggtcctcctgattccggaaccggacaggcagcgcacgccacaggacaaccagttagcgtatgttgtcataggcttactgttcatgatcctgaccgtagcggccaacgagatggggctcctcgagacgaccaaaaaggacttgggcatcggacacgtggccgccgagaatcaccaacatgctacgatgctcgacgtggacctgcacccggcgagcgcgtggaccctgtacgccgtcgccacgactgtgatcacacccatgatgcgtcacaccatcgagaacacgaccgcaaacatctccctgaccgccatcgcaaaccaggcggcaatcctgatgggcctggacaagggctggcccatctccaagatggacctcggggttccgctgcttgcgctcgggtgctatagtcaagtcaacccgttgaccctgacggccgccgttctcatgctggttgcccactacgcgatcatcggacctggcctgcaggctaaggccaccagagaggcgcaaaagcggaccgccgcggggatcatgaaaaaccccaccgtcgacggaattgtggcaatagacctcgaccccgtagtgtatgacgcgaagtttgagaagcaattgggccagatcatgctgctcatcctgtgcacgagccagatcttactcatgcgcaccacctgggccctgtgcgagtccatcaccctggctacggggccgctcacgaccctgtgggagggcagccccgggaagttctggaacacgacgatagcggtgtccatggccaacatcttccgcggcagctacctggccggggccgggctcgcattttccctgatgaagtccctgggcggagggagacgcggaactggcgcacagggagaaacccttggggaaaagtggaagcggcagctgaatcagctgagcaagtccgagtttaacacatacaagcgctcggggatcatggaggtagaccggtctgaggccaaggagggactcaagcgcggtgagacgaccaagcatgccgtaagcagaggaaccgcgaagctgcggtggttcgtggagcggaatctggtgaagcccgagggcaaggtcatcgacctgggctgcgggagaggtggctggtcctattactgcgccggcctcaagaaggtgaccgaggtcaaggggtatacgaaaggcggtcccggccacgaagaaccgatcccgatggctacgtacggctggaacttggtcaagctgcattctggtaaagatgtgttcttcatgccgcctgagaagtgtgataccctgctttgtgacatcggagagtcctcaccgaacccgactatcgaggaagggcgaacattgcgggtacttaagatggtcgaaccctggctgcgggggaaccagttctgtattaagatcctgaacccctatatgccctccgtggtggagacgctcgagcaaatgcagcggaagcacggcggtatgctggtgcggaaccccctaagtcgaaactccacccacgagatgtactgggtgagctgcggcacagggaacatcgtgtccgccgtcaacatgacaagccgcatgctcctgaaccgcttcacgatggcacatcggaaacccacctacgaacgagacgtggatctgggcgccgggacccgtcacgtcgcggttgagcccgaggtggccaacctcgatatcatcggtcagcggattgagaacatcaagaacgagcacaagtccacctggcactacgacgaggacaacccgtataagacgtgggcctatcacggcagctacgaagttaagcccagtgggagcgcctctagcatggtcaacggcgtcgtgcgcctactgaccaagccctgggacgttatcccaatggtcacccagatcgcgatgacggatacgaccccgttcggacaacagcgggtattcaaggaaaaagtcgacacgcgcacgcctcgggctaagcgcggcacagcgcaaataatggaggtgacagccaagtggctatggggtttcctgagccggaacaagaagccccgcatctgcacccgggaggagttcacccgtaaggtacgttccaacgccgccatcggggcagtgtttgtggacgagaaccagtggaatagcgcgaaagaagccgtcgaggacgagcgcttttgggacctggtgcacagagaacgtgaacttcacaagcagggcaagtgcgctacatgcgtgtacaacatgatggggaagcgggaaaagaagctgggagagttcggtaaggcgaagggctcccgcgccatatggtacatgtggctcggcgctcgtttcctagagtttgaagccctgggattcatgaacgaggaccattggttctcccgcgagaactccctgagcggcgtcgaaggggagggcctccacaagctagggtacatcctgcgggacatcagtaagatcccgggcggcaatatgtacgcggacgacaccgcggggtgggacactcgcataaccgaggacgacctccagaacgaggcgaagatcacggacataatggagcccgagcacgctctgctggcgactagcatcttcaagctcacctaccagaacaaggtggtgcgtgttcaacgcccggcaaagaatggaaccgtgatggatgtcatctcccgacgagaccagcgcgggtcgggccaggtcggtacgtacggactgaatactttcaccaacatggaggtacagttaatacggcagatggagtccgaaggcatcttcttcccctctgaattagagtccccgaaccttgcggagcgtgtgctggactggctcgaaaaacacggcgccgagcgcttgaagcgcatggccatcagcggcgacgactgcgtcgtgaaacccatagatgaccgtttcgccaccgccctgatcgcgctcaacgacatggggaaggtgcggaaggacattccccagtgggagcccagtaagggctggaacgattggcagcaagtccccttctgcagccaccactttcaccagctgatcatgaaggacggtcgggagatcgtggtcccctgcagaaatcaggacgagctggtagggcgcgctcgcgtgtcccagggcgcggggtggagcctccgggagacggcctgcctgggtaagtcttacgctcagatgtggcagctgatgtacttccaccgccgagacctccgtctggccgccaacgcgatatgctccgccgtgcctgttgactgggtacctaccagccggaccacctggtccatccacgcgcaccaccagtggatgaccacggaagacatgttaagcgtgtggaaccgcgtctggattgaagagaacccctggatggaggacaagacccacgtgtccagctgggaggaggtgccttacctcggcaagagggaggaccagtggtgcggatcactgatcggactgaccgcaagggccacctgggccacgaacatccaagtcgccattaaccaggtccggcgcctcatcggtaatgagaactacctcgactacatgaccagcatgaaaaggttcaagaatgaatccgaccccgagggtgcgctatggtga

SEQ ID NO: 23741 - RNA, 9879 nt, synthetic construct
  misc_feature 1..9879: note = derived and/or modified CDS sequence (opt11) from DENV-1__JX669461__SS-prME
  source 1..9879: mol_type = other RNA
agcgtgaccatgctgctcatgctgctgcccacggcccttgccttccacctgaccacccggggcggggagccgcatatgatcgtgagcaaacaggagcggggcaagagcctcctgttcaagaccagcgtgggggtgaatatgtgtaccctgatcgcgatggacctgggagagttgtgtgaagacaccatgacgtacaagtgcccccggataaccgaagccgagccagacgacgtggattgctggtgcaacgcaaccgacacctgggtgacctacgggacctgcagccagactggcgagcaccgccgcgacaaacggtccgtggccttggccccccacgtcggcctggggctggagacgcggaccgagacctggatgagctccgagggtgcctggaagcagatccagaaggtagaaacctgggccttgcggcaccccgggttcacggtgatcgccctgtttctcgcccacgcgatcggcaccagcatcacacagaaagggatcatttttatcctgctgatgctcgtcaccccctcgatggccatgcgctgtgtgggtattggcaaccgggactttgtcgaggggctgtcaggtgccacgtgggttgatgtggtgctggagcacgggtcgtgcgtcaccaccatggccaagaataaacccaccctcgacatcgagctgctgaaaacggaggtgaccaaccccgcggtgctccgcaagttgtgcatcgaggcaaagatcagcaacacgaccacggacagccggtgccccacccagggcgaggccaccctggtcgaggagcaggacgcgaacttcgtttgtaggcgaaccttcgtggacaggggctgggggaacggctgcggcctcttcggcaaggggagcctgctgacgtgcgccaagtttaagtgtgtcaccaagctcgagggcaagatcgtgcaatacgaaaacctgaagtacagcgttatcgtcaccgtgcacaccggcgaccagcatcaagtcgggaacgagacgaccgagcacggcacaatcgccaccatcactcctcaggcccccacgagcgagatccaactgaccgactacggggccctcaccctggactgcagcccccggaccgggctggactttaacgagatggtgctcctgacgatgaaggagaagtcatggctggtgcacaagcaatggttcttagatctgccgctgccatggacctccggggccagcaccagccaggagacctggaaccgccaggacctcctggtcaccttcaaaaccgcccacgccaagaaacaggaggtggtggtcctgggatcccaggaaggcgcgatgcacactgccctcacaggggccacggagatccagacctcgggcaccaccacgatattcgctgggcatctgaagtgccggctgaagatggacaagctcacgttgaagggtatgtcctacgtgatgtgtacagggagcttcaagcttgagaaggaggtggccgagacgcaacacggcacggtcttagttcaggtgaagtacgagggcaccgacgcgccctgcaagatccccttcctcacccaggacgagaagggggtcacgcagaacggccgcctaataacggccaacccgattgtaaccgataaggagaagcccgtgaacattgaaactgagccgcccttcggggagtcctacatcgtcgtcggcgccggcgagaaggccctgaaattaagctggttcaagaaggggtcctccatcggcaagatgtttgaggcgacagcccgcggcgcgcgtcggatggccatcctgggcgacaccgcctgggacttcgggtccatcggtggcctctttacctcggtggggaaactcattcatcaggttttcggcaccgcgtacggggtcctgttctcaggcgtgagctggaccatgaaaatcgggatcggcatcctgctcacgtggctgggcctgaactcccgcagcacctccctttctatgacatgcattgcggtcgggatggtgactctgtacctgggcgtaatggtccaggcggactccgggtgcgttatcaactggaagggacgcgagctcaagtgcgggtcgggcatctttgtgacgaacgaggtccacacctggacggagcaatacaagttccaggccgactccccaaagcgactgagcgccgcgatcggaaaggcctgggaggagggggtgtgcggcatacgcagcgccacccggctggagaacatcatgtggaagcagatttccaacgagctgaactacatcctgctagagaatgacatgaagttcaccgtggtcgtgggtgacgtgaacggcatactcgctcaagggaaaaagatgatccgcccccaacccatggagcacaagtactcgtggaagtcctggggaaaggccaagatcatcggcgccgacattcaaaacacgaccttcatcatcgacgggcccgacaccccggaatgccccgacgaccagcgggcctggaacatctgggaggtcgaagactacggcttcgggattttcaccacgaacatttggttaaagctgcgcgacagccacacgcaaatgtgtgaccaccggcttatgtccgccgccatcaaggacagcaaagcggtgcatgctgacatgggctactggattgagtccgagaagaacgaaacctggaagctggcgcgcgccagcttcattgaggtgaagacctgcatatggcccaaatcacacacgctgtggtcaaacggcgtactcgagtccgagatggtgatccccaagatctacgggggccccatcagccagcacaattaccggcccgggtacttcacccagaccgctggcccctggcacctggggaagttggagctcgacttcgacctgtgcgagggcaccacggttgtcgtggacgagcactgcggctaccgaggcccgtcactgcggaccaccaccgtgacgggcaagatcattcacgagtggtgttgccgctcatgcaccttaccgcccctgcggtttcgcggggaagacggctgctggtacggcatggagatccggcccgtcaaggagaaggaggagaaccttgtgcgcagtatggtgagcgcgggctccggtgagatggacagcttcagcctcgggatcttgtgcgtctccatcctgatcgaggaggtgatgcgtagccgctggtcccggaagatgctcatgaccggcaccctggctgtgtttctgttgctgatcatgggccagctgacgtggaacgatttaatccgcctctgcatcatggtcggcgcaaacgccagcgacaaaatggggatgggcaccacttacctggctttgatggctaccctgaagatgcgcccgatgttcgcagtggggctcctcttccggcgcttgacttcccgggaggttctgctcctgaccgtcggcctgagcctcgtggcctccgtcgaactgcccaactcactagaagagctcggcgacgggttagccatgggcatcatgatgctgaagctccttaccgacttccagccacaccagctatggacaacgctcctgtccctgaccttcatccgcactagcctcagcctggactacgcctggaagaccatggcgatggccctcagcatcgtgtccctcttcccgctgtgcctgagcacgacctcccagaagaccacctggctcccagtgctgctgggcagcttcggctgcaagcccttgacgatgttcctgataaccgaaaacaagatctggggccggaaatcctggcccatcaacgaggggatcatggccgtcggcatcgtgagcatactgctctccagcctgctgaagaacgacgtgcccctcgccggaccgctgatcgcgggtggcatgctgatcgcctgctacgtaatctccgggtcctcagccgacctttcgctggagaaggccgcagaagtcagctgggaggaggaggcggagcattccggcactagccacaacatccttgtggaagtccaggacgacgggactatgaagatcaaagacgaggagcgcgatgacaccctcacgatcctgctgaaggccaccctcttggccgtgtcaggcgtctatcccatgagcatccccgccaccctgttcgtctggtatttctggcaaaagaagaagcagcggtccggcgtgctatgggacacccccagcccgcccgaggtggagcgcgccgtgctcgatgacggcatctaccggatcttacagcgcggtctactcgggcggtcccaggtcggcgtcggcgtctttcaagacggcgtgttccatacgatgtggcacgtgacccgcggggcggtcctgatgtaccagggcaagcgactggagcccagctgggcctccgtgaagaaggacctcatcagctacggcggtggctggcgcttccagggctcctggaacaccggcgaggaggtgcaagtcatcgccgtcgagcctggtaagaacccgaagaacgtccagactacccccggaaccttcaagaccccggagggggaggtcggggccatcgccctggacttcaagcccggcaccagcgggtccccgattgtcaaccgagagggcaagatcgtgggtctgtacgggaacggcgttgtgacgaccagcggcacctacgtgtccgccatcgcccaggccaaggccacccaggagggacccctcccagagattgaggacgaggtattcaagaagcgcaatctgaccatcatggacctgcacccggggtcaggcaagaccagacgctacctgcccgccatcgtgcgggaggcgataaagcgcaagctgcggaccctgatcctagccccaacccgggtggtcgcttcagagatggccgaagccctgaagggcatgcccatccgctaccaaacgaccgccgtgaagtccgagcacacggggcgagagatcgtggatctcatgtgtcacgccacatttacgatgcgcctcctgagcccagtgcgggtgcccaactacaacatgatcatcatggacgaggcccacttcactgaccccgcctccatcgcggcccgcggctatatcagcacccgggtggggatgggcgaggccgccgccatctttatgaccgcgacacccccggggtccgtcgaggcattcccccagagcaacgccgtgatccaggatgaggagcgcgatatcccagagcggtcttggaactctggctacgattggatcaccgacttccccggcaagaccgtatggttcgtcccatccatcaagagcgggaacgacatcgccaactgcctgcgtaaaaacggaaaacgtgtgatccagctctcccgcaaaaccttcgatacggagtatcagaagaccaagaacaacgactgggactacgtggtcaccacggatatcagcgagatgggtgccaacttccgggcggaccgcgtgatcgacccgaggcgctgtctgaaacccgtgatcctcaaggagggccccgagcgggtcatcctcgccgggccgatgcccgtgacggttgcatcggccgcgcagcgccggggccgcataggccggaaccaaaacaaggagggtgaccagtacatctacatgggccagcccctgaataacgacgaagaccacgcgcactggactgaagcgaagatgctgttggacaacatcaacacccctgaagggatcatcccggcactgtttgagcccgagcgcgagaagtccgctgcgatcgacggggagtaccgcctgcgcggggaggccaggaaaacctttgtcgagctcatgcggcgcggcgaccttcccgtttggctttcctataaggtcgctagcgagggctttcagtattccgaccggcgctggtgcttcgacggggagcggaataaccaggttctcgaagagaatatggatgtggagatctggacgaaagagggcgagcgcaagaagctgcggccccgatggctggacgcgcggacatacagcgacccgctcgccctgcgagaatttaaggagttcgccgcagggcggcgcagtgtcagcggcgacctgatcctcgaaatcggcaaactgccacagcacctgaccctccgtgcacagaacgctctggacaacttggtgatgctccataatagcgaacagggcgggaaagcctaccgccacgccatggaggaactgcccgatactatcgagaccctaatgctcctggccctgatcgccgtactcaccggcggggtcacactgttttttctgtccgggaaggggcttggcaagaccagcattgggctactgtgtgtgatggcctccagcgctttactgtggatggcgagtgtggagccccactggatcgcagccagcatcatcctggagttcttcctcatggttctgctgatcccggagcccgaccggcagagaacaccccaggataatcagctcgcctacgtggtgattggcctcctgttcatgatcctgactgtcgcagctaacgagatggggctgctggagactaccaaaaaggacctcggcatcgggcacgtggcagtggagaaccatcaccacgctaccatgctggacgtcgatcttcggcccgcttccgcgtggacgctctacgccgtggccaccaccgtgatcacccccatgatgcgccacacgattgaaaacaccaccgccaacatcagcctgaccgctatcgcgaatcaggccgccatcctgatgggtctcgacaagggctggcccatttccaagatggacatcggggtccccttactggcgcttggctgctacagccaggtgaacccgctaacgctgaccgccgccgtactcatgctggtcgcccactacgccatcatcggacccggccttcaggccaaggcgacccgggaggcacagaagcgcactgccgctgggatcatgaagaaccctaccgtggacggcatcgttaccattgaccttgacccagtcgtgtacgacgccaagttcgagaagcagctcggccagatcatgctgctcattttgtgtacctcccaaatcctgctcatgagaaccacttgggccctatgcgagtccatcacactcgccaccggtccgctcaccacgctgtgggaggggtcccccggcaaattctggaacacgaccatcgccgtgtccatggccaacatcttcaggggctcctacctcgccggcgcggggctcgccttttcactgatgaagtccctgggcgggggccgccgtgggacgggcgcccagggcgaaacgctcggtgaaaagtggaagcgccagcttaaccagctgtcaaagtccgagttcaacacctacaagaagtccggtataatggaagtcgaccggtccgaggctaaggaaggcctcaagaggggggaaaccaccaagcacgccgtgtcccgggggacggctaagctccgctggttcgtcgagcggaacctggtaaagcccgaaggcaaggtcatagacctgggctgcgggcgaggcgggtggagctactactgtgccggcctcaagaaagtaacggaggtcaaagggtataccaagggcggccccggtcatgaggagccgatccccatggccacatatgggtggaacctggtgaagctgcattcggggaaggacgtgttcttcacgccgccggagaaatgcgacaccctcctgtgcgacatcggcgagagctccccaaaccccacgatagaggagggccggaccttgcgcgtcctcaagatggtggagccctggttgcggggcaaccagttctgcatcaagatccttaacccctacatgccgagcgtggtcgagaccttagagcagatgcaacgcaaacacggcgggatgttagtgcggaaccccctgtcccgcaacagcacccacgagatgtactgggtgtcctgcggcaccggtaatatcgtttcagccgtaaacatgacttcccggatgctcctgaaccgattcacaatggcgcaccggaagcccacgtacgagcgtgacgtggatctgggcgccggcacgcgccacgtcgctgtggagcccgaggtcgccaacctcgacatcatcgggcagcgcatagagaacattaagaacgagcacaaaagcacctggcactacgacgaagacaatccgtataagacctgggcctatcatggctcctacgaggtgaagcccagcgggtccgccagctcgatggtgaacggcgtcgtgcgtctgctgacgaagccctgggacgtgatcccgatggtcacccaaatcgccatgactgacacgacgccgttcggacagcaacgggtcttcaaggaaaaggtggacacccgcacaccacgggctaagcgcggcacggcacagataatggaggtcactgccaagtggctttggggcttcttaagccgaaacaagaagccccgcatttgcactcgggaagagtttacccgcaaggtgaggtcgaacgcggccattggggccgtgttcgtcgatgaaaaccagtggaacagcgccaaggaggccgtggaggacgagcggttctgggatctggtgcaccgggagcgtgagctccacaagcagggtaagtgcgcaacgtgcgtctacaacatgatgggtaagcgggagaagaagctcggcgaattcgggaaagccaagggtagccgcgccatctggtatatgtggttgggcgcccggttcttagagttcgaggcgcttggctttatgaacgaggatcattggttctcgcgcgagaacagcctatccggcgtggagggggaaggcctccacaagctggggtacatcctgcgggacatcagcaagatcccgggcggcaacatgtacgccgacgacacggccgggtgggacaccaggatcaccgaggacgacctccagaacgaggccaaaatcaccgacatcatggagcccgagcacgcactgctggcgacgtctatcttcaagctcacctaccagaacaaggtggtccgggtgcagcgacccgcgaagagcggtacagtgatggacgtcatctcacgccgggaccagcgcgggagcggccaggtgggcacctacgggctgaacacgttcacgaacatggaggtgcagctgatccggcagatggagtccgagggcatctttagcccttccgagctcgagaccccgaatctggccaagaaggtcctggactggctcgagaagcacggggccgagcgcctgaagcggatggccatcagcggggatgactgcgtcgtcaagccgatagacgatcgcttcgcgaccgccctgacggcccttaacgatatggggaaggtccggaaggacatcccacagtgggagcccagcaaaggctggaacgactggcagcaggttccgttctgcagccaccatttccaccagctcatcatgaaggacggccgcgagatcgtggtaccctgtagaaatcaggacgaactggtggggagggcccgggtttcccagggggccggctggagcctccgcgagaccgcgtgcctgggaaaatcctacgcccagatgtggcagctgatgtatttccaccggcgcgacctacgacttgccgcgaacgccatctgctccgcggtccccgtggactgggtgcccaccagcagaaccacctggtccatccacgcccaccaccagtggatgacgacagaagacatgctcagtgtttggaaccgggtgtggatcgaagagaacccgtggatggaggacaagacccacgtttcctcctgggaggaggtgccctacctcgggaagcgcgaggaccagtggtgcggctccctgataggacttaccgcccgggcgacatgggcgactaatatccaggtggcaattaaccaggtgcggcgcctcatcgggaacgagaactacttggactacatgaccagcatgaagcggttcaaaaacgagtccgaccccgaaggcgccctgtggtga

SEQ ID NO: 23742 - RNA, 9879 nt, synthetic construct
  misc_feature 1..9879: note = derived and/or modified CDS sequence (opt11) from DENV-1__KF184975__SS-prME
  source 1..9879: mol_type = other RNA
agcgtgaccatgctgctgatgttaatgcccaccgcactggcctttcacctcaccacacgaggcggggaaccccacatgatagtgagtaagcaggagcggggcaagagcctactcttcaagacctccgcgggtgtgaacatgtgcaccctcatagccatggaccttggcgagctgtgcgaggacaccatgacctataagtgcccccgcatcacggaggcggagcccgatgacgtggactgctggtgcaacgccaccgacacatgggtcacctacggtacttgcagccagaccggcgagcatcgaagggacaagcggtccgtggccctcgcgccccacgtggggctggggctggagaccaggaccgagacgtggatgagctccgaaggcgcctggaagcagatacagcgggtagagacctgggccctccgccatcccgggtttacggtgatagccctgtttttggctcacgccatcggcaccagcatcacccagaaggggataattttcatcctcttgatgctggtaaccccttccatggccatgcgctgcgtcggaatcggcagcagggatttcgtcgaagggctgtccggcgccacttgggttgacgttgtactggagcacgggagctgcgtgactactatggcaaaggacaagcccaccctggatatcgagctcctgaagacggaggtcacaaaccctgcggtgctccggaagctctgcatcgaggccaaaatcagcaacaccacgacagacagccgctgcccgacccagggcgaggccactttagtggaagaacaggacgccaatttcgtctgccgacgcaccttcgttgatcggggctggggaaacggctgcggtctgttcggcaaagggtccctcctgacgtgcgccaagttcaagtgtgtgaccaagctggagggtaaaatagtccagtatgaaaacctgaagtacagcgtgatagttactgtccacacggaggatcagcaccaggtcgggaacgagacaacagagcacggaaccattgcgaccattaccccacaagcccctacgtccgagatccagctgaccgactacggcgccttaactctcgactgcagcccccggaccggtctggactttaacgaaatggtcctgctcacgatgaaggagaagtcttggctggttcacaaacagtggttcctggacctccccctgccctggaccagcggagctagcacttcccaggagacctggaaccgacaggacctcctcgtcacgttcaagacggcccacgcgaagaagcaagaggtcgtggtgctgggaagtcaagagggcgctatgcacaccgccctgacaggggccacggagatccagacctccgggacgactacgatcttcgccggccaccttaagtgccgcctgaagatggataaactgaccctcaaggggatgtcatacgtgatgtgtaccggctccttcaagctggagaaagaagtggcggagacccagcacgggacggtgctggtccaggtaaagtacgagggcaccgacgcaccctgcaagatcccctttagcatccaggacgagaagggtgtgatccagaacgggcggctgatcaccgcgaacccgatcgtcaccgacaaggagaagccagtgaacatcgagactgagccgcccttcggcgagtcctacatcgttgtcggggcaggcgagaagaccctgaagctgagctggttcaagaagggctccagcattgggaagatgttcgaggctacagcccgcggtgctagacgcatggccatcctgggcgatacagcctgggacttcggatccatcgggggagtgtttacgagcgtcggcaaacttgtccaccaggtgttcgggaccgcgtatggcgtgttattttctggggtcagctggactatgaaaatcggcatcggcatcctgctcacctggcttggtctaaattcccgtagtacgtctctcagtatgacctgcatcgccgtaggcatggtaaccctgtatttaggggtcatggtgcaggccgactccggctgcgtgattaactggaaggggcgtgaactgaagtgcggctcaggcatattcgtcaccaatgaagtgcatacgtggaccgagcagtacaagtttcaggccgattcgccgaagcgcctgtccgccgcgatcggaaaagcctgggaggaaggagtgtgcgggatacggagcgcgacccgcctggagaacgtcatgtggaaacagatatccaacgagcttaaccatatcctactggagaacgacatgaagttcacagtggtagtcggggacgtgaatgggatactcgcccaagggaagaaaatggtgcggcctcagcctatggagcacaagtacagttggaagtcctggggaaaggccaagatcatcggtgcggacatccagaacaccacctttatcatagatggcccggacaccccggaatgcccggacgaccagcgcgcctggaacatctgggaggtcgaggattacgggttcggcatcttcaccaccaacatctggctgaagctgcgggacagctacacgcagatgtgcgaccaccgcctcatgtccgctgcgatcaaagacagcaaggcggtgcatgccgacatggggtactggatagaatccgagaagaacgagacctggaagctggcccgggcatccttcatcgaagtgaagacctgcatttggcccaaaagtcacaccctgtggagcaacggcgttctagagagcgagatgatcatccccaagatatacggaggcccgacgtcccagcacaactaccggcccggctacttcacccaaaccgctggcccatggcacctgggtaagctggagctggacttcgacctgtgcgaggggaccacggttgttgtcgacgaacactgcggcaaccggggcccgagtctgcgcacgaccaccgtgacagggaagatcattcacgagtggtgctgccggagttgcacactgcccccacttcgcttcaagggcgaggacgggtgttggtatggcatggaaatccggcccgtgaaggagaaggaagagaacttagtacgctccatggtcagcgccgggagcggcgaggtagacaatttctccctcggtctgctgtgcgtcagcatcatggtcgaggaggtgatgcggtcccgctggtcccggaagatgttgatgacgggaaccctcgccgtcttcctgctcctgataatgggccagctaacgtggaacgacctcatccgactgtgcattatggtgggagccaatgcctccgaccgcatgggcatgggcacaacctacttagccctcatggcgacgttcaaaatgcggccgatgtttgcagttggtctcctgttccgccgactgacgagccgggaggtgcttctcctcaccatcggcttgtccctggtagccagcgtagagttacccaactccttagaagaactcggggatggcctcgccatggggataatgatgctgaagttgctcaccgattttcaaagccaccagctgtggaccacactgctctccctgactttcgtgaagaccaccctgagcctcgactacgcctggaagacaatggcgatggtgttatccatcgtgtcactgttcccgttatgccttagcaccaccagccagaagacgacgtggctccccgtgctcctgggctccttcggctgcaaaccgctgaccatgtttctcatcaccgagaataagatctgggggagaaaaagctggcccctgaatgagggtatcatggccgtagggatcgcctccatcctgctcagctctttactgaagaacgacgtaccccttgccggcccccttatcgccggtgggatgctgatagcttgctacgtgattagtgggagcagcgccgacttgagcctagaaaaggccgctgaggtgtcctgggaggaagaggcggagcacagcggggcctcccacaacatcctggtcgaagtacaggatgacggcaccatgaagatcaaggacgaggaacgcgatgacaccctcacgatcctgcttaaggctacactcctggccgtgtcaggcgtgtaccctatgtccattcccgcaacactcttcgtgtggtatttctggcagaaaaagaagcagcgaagcggcgtgttgtgggatacccccagcccgcccgaagctgaaaaagccgtccttgacgacggcatctatcgcatcctgcaacgggggttgctcggccgcagccaggtcggggtgggtgtcttccaggacggggtgttccacacgatgtggcacgtaacccggggagccgttctgatgtaccaagggaagcgcgtggaaccctcctgggccagcgtaaagaaggacctgatctcctacggcggcgggtggcggttccaaggcctgtggaataccggggaggaggttcaggtgatcgccgttgagcccggaaagaacccccgaaatgtccagaccacgcccggaaccttcaagacccccgagggcgaagtgggcgcgatcgcgctggacttcaaacccggaaccagcggctcccccatcgtgaaccgggaggggaagatcgtcggcctgtacgggaacggggtggtgacgaccagcggtacctatgtctccgccatcgcacaggcaaaggcaagccaggagggcccactccctgagatcgaggacgaggtgttccgcaagcggaacttaaccatcatggacctgcacccaggctcaggcaagacgcgacggtacttgccagccatcgtgcgcgaggctatcaaacggaagctgcgcaccctcatcctcgcccccaccagggtggtggcatccgagatggccgaagccctgaaggggatgcccattcggtaccagaccaccgccgtgaagaccgagcataccggacgggagatcgtcgacctgatgtgccatgccacctttaccatgcggttactgagccccgtacgcgtcccgaactacaacatgatcatcatggatgaggcgcactttaccgaccccgcctctatagccgccagggggtacatcagcacacgcgtcggaatgggggaggccgcagccatctttatgaccgccacgccgcccggttccatggaggctttcccgcagagcaacgccgtcatccaggacgaggagcgggacattcccgagcgctcctggaacagcgggtacgactggatcacagacttccccggcaagaccgtatggttcgtcccctcgatcaagagcggcaatgacatcgcgaactgtctgcggaagaatgggaagcgcgtcatccaactctcaagaaagaccttcgacacggagtatcagaagaccaagaacaacgactgggactacgtggtcaccaccgatatctccgagatgggcgccaacttccgggccgaccgggtcatcgatccgcgcagatgtctgaagcccgtgatactgaaggacgggcccgagcgggttatcctcgccggccccatgccggtgacggtcgcgtcagccgcccagagacgcgggcggattggacgaaatcaaaacaaagagggggaccagtatgtatacatgggccagccactgaataatgacgaagatcacgcccactggaccgaggccaagatgctgttagacaacatcaacacgcctgagggcataatccccgcactgttcgagccggagcgcgaaaagtccgccgccatcgacggggagtatcggcttcggggcgaggcccggaagaccttcgtggaactcatgcgccgcggcgatctgcctgtatggctgtcttacaaggtggcctccgagggcttccagtattccgaccgccggtggtgcttcgacggcgagcgcaacaaccaggtactggaagagaatatggacgtcgagatctggacgaaagagggggagcgaaagaaactgcgcccccggtggttggacgccaggacatatagcgaccccctcgcgctacgggagttcaaagagttcgccgccggtcgtcggtccgtcagtggggacctcatcctcgagataggtcggcttccgcagcaccttacactcaaagcccagaacgcgctggacaacctggtgatgttgcacaactctgagcagggcgggaaggcctaccggcacgccatggaggagctgcctgacaccatcgaaaccctgatgctcctggccttaatcgcggtcctcacgggcggggtgaccctgttcttcctgtccggcaaggggctgggcaagacctccatcggcctgttgtgcgtgatggcctccagcgtgctcctgtggatggcctccgtggaaccacattggatcgctgccagcatcattctggagttcttcctcatggtgctgctgatccccgagcccgaccggcagcggacaccccaggacaaccagctcgcctacgtggtgatcgggctgctgttcatcatactcacggtagccgccaacgagatgggcctgctagagacaaccaagaaggaccttgggatcggccacgtcgctgccgaggaccaccagcacgctaccatgctggacgtggacctgagacccgcctcggcctggacgctatacgcggtggccaccactatcatcaccccgatgatgcggcacacgattgagaacacgacagcgaacatcagcctcaccgccatagccaaccaagccgccatcctgatggggcttgacaagggctggcccatcagcaaaatggacatcggcgtcccgcttttggcgctcggttgttacagccaggtcaacccattaacgttaaccgccgccgtgcttatgttagtcgcccactacgcaatcattggcccggggctgcaggccaaggccacccgcgaggcccagaagcgaaccgcagcgggcatcatgaagaaccctacggtggacgggattgtggctatcgacctcgatccagtcgtatatgatacaaaatttgagaagcagcttggccaaatcatgctgctcatcctgtgcacatcgcagatcctgctcatgcggaccacgtgggccctgtgcgagagcattaccctggccaccggtcccttgaccactctgtgggaggggagcccgggcaaattctggaacaccacgatcgcggtaagcatggccaacatctttcgcgggagctacctggccggcgccggcctcgccttctctttgatgaagtcactagggggcgggcggcgcgggaccggcgcccagggcgagacgctcggtgagaagtggaagcggcaactaaaccagcttagcaaaagcgagttcaacacctacaagcgcagcgggataacggaagtggaccggagcgaggctaaggagggcctcaagcggggtgaaaccacgaagcatgccgtgtccagaggcgccgccaagctgaggtggttcgttgagcgtaacttggtcaaaccggaggggaaggtgatcgacctgggctgtggcagaggaggctggtcatattactgcgcggggctcaagaaagtaacagaagtcaaaggctacaccaagggcgggcctgggcacgaggagcccatcccgatggccacctacggctggaacttagttaagctgcactccggcaaggacgtgttcttcatcccgcctgagaagtgcgacactctcctctgcgacatcggcgagagcagccccaatccgactatcgaggaaggccggaccctgcgcgtcctaaagatggtggaaccctggctgagggggaaccagttctgcattaagatcctgaacccctacatgccctcggtggtcgagacgttggagcagatgcagcgcaaacacggcggcatgctggtgcggaaccccctgtcccgcaacagtacccacgagatgtactgggtgtcctgcgggacgggcaatatagtttctgcagtgaacatgaccagccggatgctactgaaccggttcaccatggcccaccgcaagcctacctacgagcgggacgtagacctgggggccggcacgcgccacgtcgcggtggagcctgaggtggccaacctcgacatcattggccagcggatagaaaacatcaagaacgagcacaagagtacgtggcactacgatgaagacaatccctacaagacctgggcctaccacggatcctacgaagtgaagccgagcggcagcgccagttccatggtgaacggggttgtacgccttctgaccaagccctgggatgtgatccccatggtcacccagattgccatgactgacaccactcccttcggccagcagcgcgtgttcaaggagaaggtagacacgcggaccccgcgggctaagcgcgggaccgcccaaatcatggaggttaccgccaaatggctctggggcttcctctcacggaacaagaagccccgcatctgcacgcgtgaggagttcacacgcaaggtacggtccaacgctgccatcggcgcggtcttcgtcgacgaaaaccagtggaatagcgccaaagaggcggtagaggacgagcgcttctgggacctggttcatcgggagcgcgagctgcacaagcaggggaagtgcgctacatgcgtgtataacatgatgggcaagcgtgagaaaaagctcggagagttcggaaaggcgaaggggagtcgcgccatttggtacatgtggctgggggcccggttcctcgagttcgaggccctgggattcatgaacgaggatcactggttctctcgcgaaaacagcctgtccggggtggaaggcgaagggttgcacaagctgggctacatcctgcgggatatcagcaagattcctgggggcaacatgtacgccgacgataccgcaggctgggacacgcgcatcaccgaggacgatctacagaacgaagctaagataactgacatcatggagcctgaacacgccctgctggccacctcgatcttcaagctcacataccagaacaaggttgtccgcgtccagcggcccgcaaagagcgggaccgtaatggacgtcatctcccgtcgagaccagcgcggtagtggccaggtcggtacctacggcctgaacaccttcacaaatatggaggtgcagctgatccgtcagatggaatccgaggggatcttcctccccagcgagctggagactcccaacctagcggagcgcgcgctcgactggctggagaagcacggcgtagagcggctaaaaagaatggcaataagtggggacgactgtgtggtgaagccgaccgacgaccggttcgccactgccctcacggcactgaacgacatgggcaaggtccgcaaggacatccctcaatgggagcccagcaaggggtggaacgactggcaacaggtgcccttctgctcccaccacttccaccagttgataatgaaagacggccgggagatcgtggtcccgtgccggaatcaagacgagctcgtgggccgggcccgcgtgtcccagggggccgggtggtccctgcgggagaccgcctgcctgggcaagagctacgcccagatgtggcagctcatgtacttccaccgccgcgacctgcgcctcgcggctaacgccatctgctccgccgtccccgttgactgggtgcccacctctcggactacctggagtatccacgcccaccaccagtggatgacgacggaggacatgctgtccgtctggaacagggtgtggatcgaagagaacccctggatggaggacaagacccatgtgagctcgtgggaggacgtcccgtatctgggcaagcgggaggaccaatggtgcgggtctctaatcggcctcaccgcgcgggctacgtgggccactaacatccaggtggcgatcaaccaagtgcgcagactgatcggcaacgagaactacctggactacatgacctctatgaagcgcttcaagaacgagtcggaccccgaaggggcactctggtaa

SEQ ID NO: 23743 - RNA, 9879 nt, synthetic construct
  misc_feature 1..9879: note = derived and/or modified CDS sequence (opt11) from DENV-1__KT831765__SS-prME
  source 1..9879: mol_type = other RNA
tctgtcaccatgctcctcatgctgatgcccacggccttggcctttcacctcaccacgagaggcggggagccccacatgatcgtgagcaagcaggagcggggcaagagcttgctgttcaagactagcgccggggtgaacatgtgcaccctgattgcgatggaccttggcgagctgtgcgaggatactatgacttacaagtgtccccggatcaccgaggccgagcccgacgacgtcgactgctggtgcaatgccaccgacacgtgggtaacctacggtacctgcagccaaaccggcgagcaccggcgcgacaaacggtccgtggccctcgcgccccacgtgggcctgggcctggagactcggacggagacctggatgtcgtccgagggcgcttggaagcagatccagcgggtcgagacgtgggcactcagacaccccgggttcacggtgatcgccttattcctggcacatgccatcggcaccagcatcacccagaaggggatcatcttcatcctcctgatgcttgtgacgccatcaatggcaatgcggtgcgttggcatcggaagcagagacttcgtggaggggctgtcgggtgccacgtgggtggacgtcgtgcttgagcacgggagctgcgtcaccaccatggccaaggacaagccaaccctagacattgagctccttaagacggaggtcactaaccccgcagtgctgaggaagttgtgcatcgaggccaagatttccaacaccaccaccgactctcgctgtccaacccaaggtgaggcaaccctggtggaggagcaggacgccaactttgtctgccggcgcaccttcgtggaccggggatgggggaacggatgcgggctgtttggcaaggggtccctcatcacgtgcgccaagttcaagtgcgtgaccaagctggagggcaagatagttcagtatgagaacctaaaatatagcgtgatcgtgaccgtccacaccggcgaccagcaccaagtggggaacgagtccacggagcacggcacgaccgcgaccattacgccgcaagcccctaccaccgaaatacagctcaccgactacggtgcgctgaccctggactgtagcccccggacgggtctcgattttaacgaaatggtactgctaaccatgaaggagaagtcctggctcgttcacaagcaatggttcttagacctgccgctaccctggaccagcggggctagcacctcccaggaaacgtggaaccggcaggacctgctagtaacgttcaagaccgcccacgcgaagaagcaggaggtcgtagtgctgggcagccaggagggtgccatgcataccgccctgacgggggccactgagatccagacctccggaactacgaccatcttcgccgggcacctgaagtgccgccttaagatggacaagctaaccctgaaggggatgagctacgtgatgtgcaccgggtccttcaagctggagaaggaagtggcggaaacgcagcatggcaccgtgctggtccaaatcaagtacgaggggacagatgccccttgtaagatcccgttcagcacacaggacgagaaaggggtgacgcaaaacggccggctgatcaccgccaacccgattgtaaccgacaaggagaagccggtaaatatcgaggcagagccgcccttcggggagtcctacatcgtgatcggagcgggcgaaaaggcccttaagctctcgtggttcaagaaggggtcaagcattggcaagatgtttgaagccactgcccgcggggcccggcgtatggcgatcctgggcgacacggcgtgggatttcggatccatcggtggcgtgttcaccagcgtcgggaaactggtgcaccagatcttcggcaccgcctacggggtacttttctctggcgttagctggactatgaagatcggaatcggcgtactgctgacgtggctcggactgaacagccgcagcacctccctaagcatgacctgcatcgccgttgggctcgttaccctgtacttaggcgtgatggtgcaggcggacagtggatgcgtcatcaactggaaggggcgggagctcaagtgtgggagcgggatcttcgtgactaacgaagtacacacctggaccgaacaatataagttccaggcggatagcccaaagcggctgtccgccgccataggcaaggcctgggaggaaggcgtgtgcggtatccggagcgccacccggttggagaacatcatgtggaagcagatctccaatgagctcaaccacatcctactggaaaacgatatgaagttcacggtggtcgtaggagacgtggcgggcatcctcgcccaggggaagaagatgatccggccacagcctatggagcacaagtacagctggaaatcctggggcaaggccaagatcatcggcgccgacgtccagaacactaccttcattatcgacgggcccaacaccccggagtgccccgacgaccagcgcgcttggaacatatgggaggtggaggattacgggtttgggattttcaccacgaacatttggttgaagctgcgggactcatacacccaggtgtgcgaccaccgcctcatgtcagccgccatcaaggacagtaaggccgtgcacgccgatatgggctactggatcgagagtgaaaagaatgagacttggaaactggcgagggcctcgttcatcgaggtaaagacctgcatctggcccaaatcccacacgctgtggagcaacggagtgttggagtccgagatgataatccccaaaatatacgggggccctatcagccagcacaaccaccgccccgggtacttcacccagaccgccggaccctggcatttggggaaactggagctcgacttcgatctatgtgaagggaccacggtggtcgtcgacgaacattgcggcaaccgggggccgtccctgcgcacgaccaccgtgactggcaagatcatccacgaatggtgctgccggagttgcacacttccgcccctgcgctatcgcggggaggacggctgctggtacgggatggagatccgccccgtcaaggagaaggaggagaacctggtgaaaagtatggtgagcgccggcagcggcgaggtggactcctttagcctcgggctgctgtgcatttccatcatgatcgaagaggtaatgcggagccgctggtcccggaagatgttaatgaccggcaccctggcggtcttctttctgctcatcatggggcagttaacgtggaacgatttgatacgcctctgcatcatggtcggcgcgaacgcctccgaccgcatgggcatgggcacaacatatctggccttaatggcaaccttcaagatgcggccgatgtttgccgtggggctcctgttccgccggctgacgagtcgtgaggtgctcctcctgaccatcgggctcagcttggttgctagtgttgagctgccaaacagtctcgaggaattaggtgacggtctggccatggggatcatgatcttgaagttattaacggatttccaatcccaccagctttgggcaacactgctgagcctcacattcatcaagaccaccttctctctgcactacgcatggaaaactatggcgatggtcctaagcatcgtgtccctttttcccctgtgcctgagcactacctcccagaagaccacgtggctccccgtgctattgggcagcctcggttgcaagccgctgacgatgttcctgatcgccgagaacaagatctggggacggaagtcctggcccctcaatgaggggataatggccgttggcatcgtgtccatcctgctgagctccctcctgaagaacgacgtgccgctcgcagggcccctcatcgccggcggcatgctgattgcttgctacgtcatcagcgggtccagcgcagatttaagcctagagaaggccgccgaggtgagctgggaggaggaggccgagcactcgggcgcaagccacaacatcttagtagaggtccaggacgatggcaccatgaagatcaaggacgaggaaagagacgacacattaaccatactcctgaaggccacgttacttgccgtgtccggcgtgtacccgcttagcatccccgccacgcttttcgtatggtacttctggcagaaaaagaagcagcggtccggcgtgctctgggacaccccctcgccgcccgaggtggagcgcgccgtgctggatgacgggatataccgaatcatgcagcgcggtctgctggggaggtcccaggtcggcgtcggggtctttcaggaaaacgtgttccacacgatgtggcacgtgacccgcggcgcggtcctcatgtaccaggggaaacgcctggagcccagctgggcctccgtgaagaaggacctgatcagctacggcggcgggtggcgcctccagggctcctggaacacgggcgaggaggtgcaggtcatcgcggtggagcccggcaaaaatcccaagaacgtgcaaaccgcccccgggaccttcaagacacctgagggagaggtcggcgcgatcgctctagacttcaagcccgggacgagcggctccccaatagtgaatcgcgaggggaagatagtgggcctatacggtaacggagtggtgaccacgagcggcacgtacgtgagcgccatcgcccaggcgaaggcgtcacaggaggggccgctccccgaaatcgaggacgaggttttccgcaagagaaatctcaccatcatggacctgcaccccggaagcgggaagacccgccgttacctcccggccattgtgcgcgaagccatcaagcggaagctgcggacactgatcctcgcccccacccgcgtggtcgcctccgaaatggcggaggccctgaaaggcatgccaattagataccagacaacagccgtcaaaagcgagcacaccggcaaagagatcgttgacctgatgtgccatgccaccttcacgatgcgcttgctgtcccccgtccgcgtgccgaactacaacatgatcatcatggatgaggcccactttaccgacccctcatccatcgcggcccgcgggtacataagcacccgggtgggcatgggagaagcggccgcgatcttcatgaccgccacgccgcccggatcggtcgaggccttcccgcagagcaacgccgtgattcaggacgaggaaagagacatccccgaacgctcctggaacagcgggtacgagtggatcaccgacttcccgggtaagactgtgtggttcgtcccaagtatcaaaagcggcaacgacatcgccaactgcctgcggaagaacgggaagcgggtgatccagctaagtcgaaaaaccttcgacacggagtatcagaagaccaagaacaacgactgggactacgtggtcaccacagatatcagcgaaatgggcgcgaattttcgtgcggaccgggtgatcgatccgcgtcgctgtcttaagcccgtgatactgaaggacgggcccgagcgcgtgattctcgcgggacccatgcctgtgacggtcgcgtccgccgcgcagcgccgggggcgcatcggcagaaaccacaacaaagaaggcgaccagtacatctacatgggtcagcccctaaacaacgacgaggaccatgcccactggacagaggccaagatgctgttggataacatcaacaccccagagggtatcattcccgccctcttcgaaccggaacgcgaaaaatccgccgcgatcgatggcgagtaccgcttgcggggagaagcccgaaagacctttgttgagttaatgcgtcgcggggacctgcccgtgtggctgtcctacaaggtcgccagcgagggcttccagtatagcgatcggcgctggtgctttgacggggagcggaataaccaggtgctcgaagagaacatggatgtggagatctggaccaaggagggcgagcgtaagaagttacggccccgctggctggacgcccggacctactccgaccccctcgccttacgcgagttcaaggagttcgctgccggccgtcgctccgtctctggggacctgatcctcgagatcggcaagctgccgcaacacttgacccagcgggcccaaaatgcgctcgacaacctggtgatgttacataatagcgagcagggcgggcgagcgtaccggcacgccatggaggaattgcccgataccatcgagacgctgatgctgttagccctaatcgccgtgctgacgggcggggtcacactcttcttcctgtccggcaagggcctgggcaaaaccagcattggccttctatgcgtgatggccagcagcgtgctactctggatggcgtccgtcgagccccattggatcgccgccagtatcatcctggagttcttccttatggttctgctgatccctgaaccagatcgccagcggacaccccaggacaaccagctggcctacgtggtcattgggatgctgttcatgatcctgacagtggccgcgaatgagatgggcctgctcgagaccaccaaaaaggacctggggataggccacgtggccgtcgagaaccaccaccacgccgccatgcttgacgtagacctccacccggcctccgcgtggaccttgtacgccgtggccacaaccatcatcaccccgatgatgcgccacacgatcgagaacacgaccgccaacatcagcttgaccgccatcgcgaaccaggccgccatcctcatgggactggataaagggtggcctatttccaaaatggacatcggcgttcccctgttagccctggggtgctacagccaagtgaatcctctgaccctcaccgcggcagtactgatgctggtagcccactacgccatcatcggcccggggctccaggccaaggcgacccgggaagcccagaaacgcacagccgcgggcatcatgaaaaaccccactgtggatgggatcgtggccattgacctggaccccgtcgtatacgacgcgaagtttgaaaagcagcttggccagatcatgctcctgatcctgtgcacgtcgcagatcctcctgatgcgaaccacctgggccctgtgcgagagcatcaccctcgccacgggccccctgactaccctctgggaagggtccccgggcaagttctggaacaccacgatagccgttagcatggccaacatatttcgggggagctacctcgctggcgccggcctggcctttagcctcatgaagtcccttgggggtgggcgccgaggcaccggggcccaaggagagaccctgggagagaagtggaaacgccaactgaaccaactctccaagagcgagttcaacacatacaagcggtccgggatcatggaagtcgacaggtccgaggccaaggagggcctgaagcgaggggagacgaccaaacatgccgtgtcccgcgggaccgccaagctccggtggttcgtggagcgtaacctcgtcaaacccgaggggaaggtgatcgacctgggctgcggccgcggcggttggtcttattactgtgctgggttaaagaaggtgaccgaagtcaaggggtacacgaaagggggtcccggccacgaggagccaatcccgatggcaacctacgggtggaatctggtgaagctccactcaggcaaggacgtgttcttcgtgccgcccgagaaatgcgacaccctgctgtgcgacatcggggagtcatcccccaacccgaccatcgaggagggcaggacgctgcgggtcctgaagatggtggagccctggctgcgcggtaaccagttctgcatcaagatcctcaacccctacatgccctcggtcgtagagacactagagcagatgcagcgcaagcacggcggcatgttggtgcgcaacccgctctcccggaatagcacccacgagatgtactgggtctcctgcgggacaggcaacatcgtgagcgcgatcaacatgacatccagaatgttgttgaaccggtttacgatggcccatcgcaagcccacgtatgaacgagacgtggacctcggcgccggcacgcggcacgtcaccgtggagcccgaggttgccaacctagacatcatcggccagcgcatcgagaacatcaagtgcgaacacaagagcacgtggcactacgacgaggacaatccctacaagacatgggcctaccacggttcctatgaggtcaagccgagcggctccgcgtcgagcatggtgaacggtgtagtgaagttattaaccaagccctgggacgtgatacccatggtcacccagatcgcgatgacggacaccaccccctttggacagcaaagggtgttcaaggagaaggtggatacccgcacgccgaaagcaaagcgagggaccgcacagatcatggaagtcaccgcccgttggctttggggcttcctgtcccggaacaagaagccacgcatatgtacccgagaggagtttactcggaaggtaagaagcaacgcggctatcggggccgtgtttgtcgacgagaaccagtggaactcagcgaaagaggctgtggaggacgagcgcttctgggacctcgtgcaccgtgagcgcgagcttcataagcaagggaaatgcgcaacttgcgtctacaatatgatggggaagcgcgagaaaaagctgggggagttcggcaaggccaaagggtcgcgcgctatctggtacatgtggcttggtgctcggtttcttgagttcgaggcattaggtttcatgaacgaggaccactggttctcccgcgagaacagcctcagtggggtggagggcgaggggctgcacaagctgggctacatactcagagacatcagcaagatatccgggggcaacatgtacgccgacgataccgctgggtgggatacccgcatcacggaggacgacctacagaatgaagccaagatcacggaaatcatggagcccgaacatgcacagctggcgaaggccatcttcaagctcacctaccagaacaaagtggtccgtgtgcagcgcccggcgaaaaacgggaccgtgatggacgtgatcagccgccgggaccagcgcggctccggccaagtggggacgtacggcctgaataccttcaccaacatggaggcccagctgatccggcagatggagagcgaggggatcttctcccccagcgagctcgagacccccaatctggccgagcgcgtgctcgactggctcgaaaagtacggcgtcgagcgtctaaaacgtatggcgatatccggggacgactgcgtggtgaagcctatcgacgatcggttcgctacggccctgaccgccctcaacgacatggggaaggtccgcaaggacatcccgcagtgggagcccagcaaggggtggaacgactggcaacaggtgcccttttgctcccaccacttccaccaattaatcatgaaggacggccgggagatagtggtaccctgtcgcaaccaggatgagcttgtgggcagggcccgcgtgtcgcaaggggcgggctggagcctccgggaaaccgcctgtctgggaaagagctacgcacagatgtggcagctgatgtatttccacagaagggacttacgccttgcggcgaacgcgatctgcagcgctgtccccgtggactgggtgcccacctcccgcaccacctggagcatccacgctcaccaccagtggatgaccaccgaagacatgctgtccgtctggaaccgcgtctggatcgaggagaacccctggatggaggacaagactcacatcagctcctgggaagacgtaccctacctcggcaagagagaggaccaatggtgtgggagcttaataggcttaactgctcgagcgacatgggccaccaacatccaggttgccattaaccaggtccgccgcctcatcgggaacgaaaattacctggattatatgacatccatgaagaggtttaagaacgaatcagacccggagggggctctttggtga

SEQ ID NO: 23744 - RNA, 9879 nt, synthetic construct
  misc_feature 1..9879: note = derived and/or modified CDS sequence (opt11) from DENV-1__KP188567__SS-prME
  source 1..9879: mol_type = other RNA
agcgtgacgatgttacttatgttgctgccgaccgcactcgccttccacctgaccacgcgaggcggggagccccacatgattgtaagcaagcaggagcgtggaaagagcctcttgttcaagacgagcgtgggggtgaatatgtgtaccctgatcgcgatggacctgggggagctctgcgaagacacgatgacctacaagtgccctcggatcaccgaagccgagccagacgacgtcgactgctggtgcaatgccaccgatacctgggtgacctacgggacttgcagccaaaccggggagcaccggcgggataaacggtccgtggctctggcgcctcatgttgggctgggattggagacgaggaccgagacctggatgtcatccgaaggcgcttggaaacagatccagaaggtggagacctgggcccttcggcacccagggttcacagtgatcgccctattcctcgcccacgcgatcggaactagcatcacccagaaggggatcatatttatcctcttaatgctcgtcacccccagcatggccatgcgctgcgtgggtattggaaaccgggatttcgtggagggactgagcggcgccacgtgggtcgacgtggtgctggagcacggatcctgcgtcaccactatggcgaagaacaagcccaccttggacatcgaactgcttaagacggaggtcactaaccccgccattctcagaaagctgtgtatcgaggctaagatcagcaacaccaccacggactcccgttgccccacccagggtgaggccaccctggtggaggagcaggacgccaacttcgtgtgtcgccggacgttcgtggatcgcggctggggtaatggctgcggcctcttcggcaaaggcagcctgctgacgtgcgcgaagttcaagtgtgtaactaagctcgagggaaagattgtccagtatgagaacctgaaatactccgttatagtgaccgtccacactggcgaccagcaccaagtgggaaacgagaccaccgagcacggaacaatcgcaaccataacgcctcaagcaccaacgagcgagatccagctgactgactatggggccctcactctggactgtagtccccggaccggcctggacttcaacgagatggtcctcctgacgatgaaggagaagtcctggctggttcataagcagtggtttctagacctgcccttaccctggacctccggggcctccaccagccaggagacttggaatcgccaagatttgctggtcacgttcaagaccgcccacgccaagaagcaggaggtcgtggtgctaggctcccaagaaggcgcgatgcacaccgcccttaccggggccacggagatccagacgagcggtaccaccacgattttcgccgggcatctgaagtgcaggctgaagatggacaagctcaccctgaagggcatgagctacgtaatgtgcaccgggagctttaaactggagaaggaagtggccgagacccagcacggcacagtcctggtccaggtaaaatacgagggcaccgacgcaccctgcaaaatccccttccttacccaggacgaaaagggtgtcactcagaacggtcgcctgatcacggccaacccgatcgtcaccgacaaagagaagccggtgaacatcgagaccgagccgcccttcggggagtcgtatatcgtggtcggcgccggcgagaaggccttaaaactcagttggttcaagaagggatccagcatcggcaagatgttcgaagcgaccgcccgcggggctcgccggatggccatcctgggggatacggcctgggatttcgggtccatcggtggcttgttcaccagcgttgggaagctcatccaccaggtgttcgggacagcgtacggtgtcttattctctggtgtaagctggaccatgaagattgggatagggatcttattgacgtggctaggcctaaactcccgcagcacttccctcagcatgacctgtatcgccgtgggcatggttaccctgtatctgggcgtgatggtacaagccgactccgggtgcgtcatcaactggaagggacgggagctcaaatgcgggagcggcatcttcgtgacgaacgaggtccacacgtggaccgagcaatacaagttccaggccgactccccgaagcggctgagcgccgctatcgggaaggcctgggaagagggggtatgcggcatacgcagcgcaactcggttggagaacattatgtggaagcagatttccaacgagttgaactacatcctgctggagaacgacatgaagtttaccgtggtggtcggagacgtcaacggtatcctagcccagggcaaaaagatgatcaagccccagcccatggagcacaaatacagctggaaatcatgggggaaggccaagatcatcggggcggacatccagaacacgacctttataatcgacggtcccgacacgccggagtgccccgacgaccagcgcgcttggaacatctgggaggttgaggactacggtttcggaatatttaccacgaacatctggctgaaactgcgtgacagccacacacagatgtgcgaccaccgcctcatgtcagcagctatcaaagacagcaaggcagtccacgccgacatgggctactggatcgagtcggagaagaacgagacatggaagctggcacgggccagctttatcgaagtaaagacgtgtatctggcccaagtcgcacacgctgtggagcaacggcgtgttagaatccgagatggtcatccccaagatctacggtggccctatcagccaacacaactaccgacccggttacttcacacagaccgccgggccctggcatctcgggaagctggaactcgattttgacctgtgcgagggaaccacggtggtggtagacgagcactgtggataccggggaccgtccctgcgaaccacaacagtgacgggcaaaataatccacgagtggtgctgccggagctgcaccctgcctccgcttcgctttcgcggagaggacggctgctggtatggtatggaaataaggcccgtcaaggagaaggaggagaacttggtccggtccatggtgagtgctgggagtggcgaggtggacagcttcagccttgggatcctgtgcgtctccatcttaatcgaggaagtgatgcgcagtaggtggtcccgaaaaatgctcatgaccggcaccttggccgtgttccttctcttaatcatggggcagctgacgtggaacgacctcatccggctgtgcatcatggtcggcgccaatgccctggaccgtatggggatgggcaccacctatctcgccttaatggcaacgttcaagatgcgcccgatgttcgccgtgggcctcctcttccggcgcttaacgtcccgggaggtcctcctactcactgtcgggctgtccctggtggccagcgtcgagctgccctcaagcctggaagaactcggcgacgggttggccatgggcatcatgatgctgaagctcctgacagatttccaaccacaccagctgtggaccacgctcctatccctgacctttatccgcacgtctttatccctggactacgcctggaagaccatggcgatggccctgtctatcgtctcactattccccctttgtctgtccacgacctcccagaaaacaacctggctcccggtgctgctgggcagctttggctgcaagcccctcacaatgtttctgatcacagagaacaagatctggggcagaaagtcttggcccatcaacgagggaattatggctgtggggattgtgagtatactgctctccagcctgctcaagaatgacgtgcctctagccgggcccctgatcgcgggcgggatgctgattgcgtgctatgttatttcagggtccagcgccgacctcagcctggagaaagcggcagaggtaagctgggaggaagaagccgagcactccggcacgagccacaacatcctggtggaggtccaagacgacgggacaatgaagatcaaggatgaggaacgtgacgacaccctcacgatcctgctgaaagccaccctcctggccgtgagcggcgtgtaccccatgagcattccagccactctgttcgtctggtacttctggcagaagaagaagcagcggtccggcgttctgtgggacacgccgtcgccgccagaggtggagcgcgccgtactcgatgacggcatctaccggatcctacagcgcggcctactcgggcggtcccaagtgggtgttggggtcttccaagacggcgttttccacacgatgtggcatgtgacccgcggggccgttctgatgtaccaaggcaaaaggctcgagccaagctgggcctccgtgaagaaggacttgatttcgtacggcggagggtggcgattccaggggagctggaacaccggcgaagaggtgcaggtcatcgccgtggagcccgggaagaaccccaaaaatgtccagactacacccggcactttcaaaactccggagggcgaggtcggggccatagcactggacttcaagcccggcaccagcgggtcccccatcgtgaaccgggaaggcaagatagttgggctgtatgggaacggcgtcgtgacgacgagcgggacctatgtatccgcaatcgcccaggccaaagccacccaggagggcaccttacccgagatcgaagacgaggtattcaagaagaggaacctgaccatcatggacttacaccccgggtctggcaagaccaggcggtatctcccggccatcgtccgggaggcgatcaaacgcaagctgcggacactgatactcgcccccacccgcgtggtcgcctctgagatggccgaggcgctgaagggcatgcccatcaggtaccagacgactgctgtgaagtccgagcataccggtagagagattgtggacttaatgtgccacgccacatttaccatgagactcctgtctcccgttcgggtgccgaactataatatgattatcatggatgaggctcactttacagaccccgcctccatcgcagcgcgcggatatatctctacgcgggtagggatgggcgaggccgctgccatcttcatgacggcgacgccgcctgggtcggtcgaggctttcccacagagcaatgccgttattcaggacgaagaacgggacatccccgagcgatcgtggaactccggctacgactggatcaccgacttccccggcaagaccgtatggtttgtaccgtccataaagagcggtaacgacatcgccaactgcttgcgcaagaacggtaaaagagtgatccagctctcaaggaaaacgttcgataccgagtatcagaagaccaagaataacgactgggactatgtggtcacgacggacatctcagagatgggggccaatttccgggcggaccgcgtgatcgatccgcggcggtgcctgaagcccgtgatattaaaggagggcccggagcgcgtcatcctggccgggcccatgccggtaaccgtcgcctcggcagcgcagcgccggggccgcattggacgaaatcagaataaagagggggatcagtacatctacatgggacaacccctgaacaatgatgaagaccatgcccactggaccgaagccaagatgctgctagacaacatcaacaccccagaaggaatcattcccgccctgttcgagccggagcgcgagaaatccgctgcaatcgacggcgaataccgtctgcgcggggaagcccgcaagacgttcgtggagctcatgcgcagaggcgacctgcccgtgtggctgtcctacaaggtagcaagcgagggcttccaatactccgaccggcgttggtgcttcgacggggaacgaaacaaccaagtgctcgaggagaacatggacgtagaaatttggaccaaggagggcgagagaaagaagctgcggcctcgttggctggacgcccggacctacagcgaccccctcgccctgcgcgagttcaaggagttcgctgcagggcggcgctccgtaagtggcgacctgatcctcgaaatagggaagctcccgcagcacctgacccttcgggcccaaaacgccctggacaacctggtgatgttgcataacagcgaacagggtgggaaggcctaccgccacgcgatggaggagttgcctgacaccatagagacactaatgctcctggcgctgattgccgtcctcacaggaggcgtcaccctgtttttcctgtccggcaaggggctcggcaagaccagtatcggcttgctgtgtgttatggcctctagcgcactactatggatggcatctgtggaaccccactggatcgccgccagcatcatactggagtttttcctcatggtgctgctgatacccgagccagaccggcagcgcacgcctcaggacaaccaactggcctatgtggtgataggcctgctgttcatgatcttgaccgtcgcagccaacgagatgggcctgctggagaccaccaagaaggacctcggcatcgggcacgtggccgtcgagaaccatcaccacgccaccatgctcgacgttgacctgcggccagcctctgcgtggaccctctacgcagtggccaccaccgtgatcacgccgatgatgaggcacacgatcgagaacacgaccgcaaacatcagcctcacggccatcgcgaatcaggccgccatcctgatgggcctggacaaaggctggccgatctccaagatggacataggtgtcccactactcgccctcgggtgctacagccaggtgaaccccctgaccctgaccgctgcggtcctcatgcttgtcgcacactacgccataatcggtccggggctgcaggcgaaggcgaccagagaagcgcagaagaggacggctgctgggataatgaagaatcccaccgtggatggcatagtgaccatcgacctcgatcccgtagtatacgacgccaagtttgaaaagcagctggggcagatcatgcttctgatcttatgcacttcccaaatactgctaatgcgaacgacctgggctctgtgcgagagtattaccctggccacgggcccgcttactacgctgtgggagggatccccagggaagttctggaacaccaccatcgccgtcagtatggccaatatttttcgtggctcctaccttgcaggggcgggtcttgccttctcactgatgaagtccctgggcgggggccggcggggcaccggtgcacagggtgagaccctgggggagaagtggaagaggcagctgaatcagctctcaaagtccgagttcaatacctacaagaagtccggcatcatggaggttgaccgaagtgaggccaaggaggggctgaagcgcggagagactacgaagcatgccgtctccagggggacggcgaagctcaggtggttcgtggaacggaacctggtcaagcctgagggcaaggtcatcgatctaggctgcggtcgcgggggatggtcctactactgtgccggtctcaagaaagtaaccgaggtcaaggggtatacgaagggcggcccgggacacgaggagccaatcccgatggctacttacggctggaaccttgtgaagctgcactctggaaaagatgttttcttcacgcctcccgagaagtgcgacacgttgctgtgcgatatcggcgaaagctcccccaacccgaccattgaggagggacggactctgcgcgtcttaaagatggtcgaaccctggctgcggggtaaccagttctgcatcaagatcctgaacccctacatgccctctgtggtcgagacgctagaacagatgcagcgcaagcacggcgggatgctggtcagaaatccgctgtcccgcaactccacccacgaaatgtactgggtgtcctgcggaacagggaatattgtctcggccgtgaacatgacatcccgcatgctcctgaaccgctttactatggcgcaccggaagcccacctacgaacgcgatgtggacctgggcgccggcaccaggcacgtagccgtggagcccgaggtcgcaaacctcgatatcatcgggcagagaatcgagaatataaagaacgagcacaagagcacctggcattacgatgaggataatccctataagacgtgggcgtaccacggctcctacgaggtcaagccgtccgggtccgcaagttctatggtgaatggcgtagtgaggcttcttacaaagccctgggacgtaattcccatggtgacgcagattgccatgaccgacactactcccttcgggcagcagcgggtatttaaggaaaaggtagacacccggactccacgcgccaagcgcggaaccgcccagatcatggaagtcaccgctaagtggctctggggcttcctctcacggaacaagaagccccgcatctgcacccgggaagagttcacccgcaaggtgcggtccaacgcggccatcggggccgtttttgtcgacgaaaaccaatggaactcagccaaggaggcagtggaagacgagcgcttctgggacctcgtgcaccgggagcgcgaactccacaagcagggcaagtgcgcgacgtgcgtctacaatatgatggggaagagagagaagaagctaggcgaatttggaaaggccaagggctcgcgggcaatctggtacatgtggctgggcgcccggttcctcgagttcgaggcactgggcttcatgaacgaggaccattggttctcccgcgaaaactctctttccggagtcgagggggaaggactccacaagctagggtacattctgcgggatatttccaagattcctggcggcaacatgtacgcggacgacacagcagggtgggacaccagaattacggaggatgatctacagaacgaggccaagataacggacattatggagccggagcacgccctgctggcgacgtccatctttaagctcacctaccaaaacaaagtggtccgggtgcagcgccccgccaaaagcggcaccgtaatggacgtaatctcccgccgggatcagcgcgggtccggtcaggttggcacgtacggccttaacaccttcaccaacatggaggtgcagctaatacggcaaatggagtccgagggaatcttcagcccttccgagctggagacccccaatcttgctaagaaggttttggactggctcgagaagcacggggcggaacgacttaagcggatggccatttccggtgacgactgtgtggtaaagcccattgacgaccgcttcgccacggccctgactgccctaaacgacatggggaaggtccggaaggatatcccccagtgggagccctccaaggggtggaacgactggcagcaagtacccttttgttctcatcacttccaccagctgattatgaaggacggccgcgagatcgtggtcccgtgccggaaccaggacgagctcgtgggtcgcgcccgcgtgtcccagggcgccgggtggagcctccgcgagacggcgtgcctgggcaagagctacgcccagatgtggcagctgatgtatttccatcgccgcgacctccggctggccgccaatgccatttgcagcgctgtcccagccgactgggtgcccaccagccgcaccacttggtccatccacgcccaccaccaatggatgaccaccgaggatatgctgtctgtgtggaatcgggtctggatcgaagagaacccctggatggaggacaaaacacacgtcagcagctgggaagaagtgccgtacctcggtaagcgcgaggaccagtggtgcggctccttgatcggtctgactgcccgggcgacctgggccaccaacatccaggtcgccatcaaccaggtaagacgtcttatcggaaacgagaactacctggattacatgacatcaatgaagcggttcaaaaacgagtccgatcccgagggggctctgtggtga

SEQ ID NO: 23745 - RNA, 9879 nt, synthetic construct
  misc_feature 1..9879: note = derived and/or modified CDS sequence (opt11) from DENV-1__KP188568__SS-prME
  source 1..9879: mol_type = other RNA
agtgttacaatgctactaatgctacttccaacagcactggccttccacttaacgacgcggggcggagaaccacatatgatagtctcaaaacaagagcggggcaaaagccttctattcaaaacctccgtaggagtaaacatgtgtacactaatcgctatggacctgggcgagttatgcgaggacacgatgacatacaagtgcccgaggatcacagaagccgaaccggacgatgtggactgctggtgtaacgccaccgacacctgggtaacttatggtacctgcagccaaaccggggaacacaggcgggacaaacgaagtgtcgccctagcgccgcatgtagggctcggacttgaaacgcgaacagaaacttggatgagttctgagggagcttggaagcaaattcaaaaagtagagacctgggcgctgaggcacccaggatttaccgtgatagcactttttctagcgcacgcaataggaacgagtatcacgcaaaaaggcattatatttatcctactaatgctcgttaccccctcaatggcgatgaggtgtgtcggcatcggaaaccgggatttcgtggagggcctgtcaggagcaacctgggtagacgtagtacttgagcacggcagctgcgtcacaaccatggccaaaaacaagcccaccctcgacatcgagctgctaaagacagaggtcacgaacccagccgtactcagaaaactatgtatcgaggccaaaatcagcaacactacgacagacagccggtgcccgacccaaggagaagccactctagtcgaggaacaagacgccaacttcgtgtgcagacggacattcgtggacagaggatggggcaacggctgcgggctatttggcaagggatcgctgctcacatgcgcgaaattcaagtgtgtaacaaagctcgagggtaagatcgttcaatacgaaaacctgaagtactcggtcatagtgaccgtccacacgggagaccaacaccaagtggggaacgagacaacggagcacggcacgatagctacaatcaccccgcaagcacctacctccgaaatccaactaaccgactacggcgcgctaacactagactgctcacctagaaccgggcttgactttaacgagatggtacttttaacaatgaaagagaaaagctggcttgtccacaaacaatggttcctagacctccccctaccctggacaagcggcgcaagtacctctcaagagacctggaaccggcaggacctcctagtcacctttaaaacggcgcatgcgaagaaacaggaagtggttgtcctaggatctcaagagggagcgatgcacacggcgctaacaggagcgaccgaaatccaaacgtcgggcacaacaaccatctttgcgggacacctcaaatgtcgactgaaaatggacaaactcacactgaaagggatgagctacgtaatgtgcacgggctcattcaaacttgaaaaagaggtagcggagacacagcacggcacagtactggtccaagttaaatacgagggaacggatgctccgtgcaaaataccattcctgacccaggatgaaaagggtgtgacacaaaacgggcgtctcattaccgctaaccccatagtcactgacaaagaaaaacctgtcaatatcgaaacggagccgcctttcggcgagtcttacatagtagtcggcgcaggagagaaagcacttaaactgtcctggttcaagaaaggctcctccataggcaaaatgttcgaggcaacagcaagaggggcaagacgtatggcgatactcggggatacagcgtgggacttcggaagcatcggcgggctattcaccagcgtgggtaaattaattcaccaggtgttcgggactgcctatggtgtattgttttccggcgtctcctggacaatgaaaatcgggatcggcatcttacttacttggctaggcctgaactcaaggtcgacctcattgtcaatgacgtgcattgccgtgggtatggtaactttatacctaggagtaatggtccaggcggactctggatgcgttattaactggaagggaagggaactcaaatgtggctcggggatattcgtgacaaatgaagtacacacatggacagaacaatacaaattccaagcagattcgcccaaacgcctatccgccgccattgggaaggcgtgggaggaaggtgtatgcggtatacgatcagcaacgcgcctagaaaacattatgtggaaacagattagcaatgaactgaaccatatcctattggaaaacgacatgaaattcacggtagtagtcggtgacgtcaatggaatactggcccaggggaagaaaatgataagaccacagcccatggagcacaaatactcatggaagtcgtggggtaaagcgaaaatcatcggcgccgacatacaaaacaccacgttcattattgacggaccggacaccccagagtgtcccgacgaccagagagcctggaatatctgggaagtggaagattacggcttcgggattttcactacaaacatctggctcaagctcagggactcccacacacaaatgtgtgaccacagactgatgtccgcagctataaaagactcgaaagcggtgcatgcagacatggggtactggattgaaagcgagaaaaacgaaacctggaaactggcccgtgcctcattcattgaagtaaaaacgtgcatatggcccaagagccacactctgtggagcaacggagtactcgaatccgagatggtaattccaaaaatatacgggggcccaataagccagcacaactaccgccctggatacttcacacagaccgcgggaccctggcacttaggtaaacttgaactcgacttcgatttgtgcgaagggacgacggtagtagtcgacgagcactgtgggtaccgtgggcctagcctgcgaacaacaactgtgacagggaaaattatacacgagtggtgctgcagatcgtgtacattaccgcccctaaggttcagaggggaagatggatgctggtatggcatggaaattcggccagttaaagagaaggaagagaacctagtgaggagcatggtaagtgccggaagcggagagatggacagcttctccttaggcatcttgtgcgtgtcaatcctgatagaagaagttatgcggtcacggtggtcgcgcaaaatgttaatgacaggcaccctcgccgtattcttcctcctgatcatgggccagctcacttggaacgacctgatcagattatgtataatggtcggcgccaatgcatcagaccgtatgggcatggggaccacatatttggcattgatggcaaccttcaagatgagaccgatgttcgcagtagggcttctattcaggcgactaacctccagagaagtactactcttgacagtagggctatccttggtggcaagcgtagagttaccaaactccctagaagaactcggagacgggctggccatggggataatgatgctgaaacttctaacagactttcagccccaccaactgtggacaacactactgagcctaacgttcatacgcacgtcgctctcgctggactacgcatggaagaccatggccatggcactaagcatagtcagtctattccccctgtgtctaagtacgacatcacagaaaacgacatggctgcctgtcctgctcggcagcttcgggtgcaagcccctcaccatgttcctaataaccgagaacaaaatttgggggcgaaaaagctggccgatcaatgaaggaataatggcagtgggcattgtaagcatcctccttagtagcctgctgaaaaacgatgtaccgcttgccggacccttaatcgcaggaggaatgctgatagcgtgttacgtaatctcaggcagcagcgccgacttgagcctagaaaaggccgccgaagtttcatgggaagaagaagcagaacatagcgggacaagtcacaacatcctcgttgaggtacaggacgacggcacgatgaagatcaaagacgaggaaagggacgacactctaacaatcttacttaaggcaactctgctcgctgtatcaggggtctaccccatgtcaatcccggcaacactatttgtatggtatttttggcagaaaaagaaacaacgctcaggtgtcttgtgggacacaccaagcccgcccgaagtggagagagccgtactcgatgacggaatctaccgcatactacaacgcggattactcggaaggagccaagtaggcgtgggcgttttccaggatggagttttccataccatgtggcacgtaacccgaggagcggtacttatgtaccaaggcaaacgcctggaaccctcctgggcatcagtgaagaaagacctaataagctacggcggaggctggcgtttccaagggagctggaataccggggaagaagtccaggtaatcgccgtcgaacctggcaagaatccgaaaaacgtacaaactacgcccgggaccttcaaaacaccagaaggagaagtaggagcgattgcactggatttcaaaccgggcacgagcggctccccaatcgtgaaccgcgaagggaagattgtagggctctacggcaacggagtggtcaccacctctggtacgtacgtcagcgctatcgcccaagccaaggctacacaggaaggcccccttcccgaaatcgaggacgaagtcttcaaaaagcgcaaccttacgataatggatctgcacccgggctccggaaagaccagacgttacctcccaagcatagtccgagaagcgataaaaagaaaactcagaacactcatcctagccccgacccgtgtagttgcatctgaaatggccgaagcactaaaagggatgccgatacgataccaaaccacggccgtcaagagcgaacacaccggacgggaaatagtcgacctcatgtgccatgccacctttactatgcgcctcctaagcccagtacgggtccctaactacaatatgataataatggacgaggcacacttcacagacccggcctctatcgccgcaagaggctacatatccacacgggtcgggatgggagaagcagctgcgatcttcatgacagctactcccccaggatcagtagaggccttcccccaatcaaacgcagcgattcaagacgaagaaagggacataccggagcgttcatggaacacagggtacgactggataacggacttcccaggaaaaacagtctggtttgtaccttcgattaaaagcggaaacgatatagcgaactgtctgaggaaaaacggcaagcgagtcatccaactctcacgtaaaacattcgacaccgagtaccagaaaacaaagaacaatgactgggactatgtagtcaccaccgatatctcagaaatgggagcaaacttcagagcagacagggtaatcgacccacgacggtgtctaaagcccgtaatacttaaagaaggcccggaaagagttatcttggctggacccatgccagtcacggtggcatcagcagcgcaacgtcgtggcaggattgggagaaatcaaaacaaagaaggcgaccagtacatatacatgggacaaccgctgaacaatgacgaggaccacgcgcactggacggaagccaagatgctcctggataacataaatacccccgaaggaatcatccccgccctcttcgaacccgagcgggagaaaagcgcagctatcgacggcgagtaccggttacgcggagaggcccggaaaacattcgtagagctaatgcggcggggcgacctaccagtatggttaagctacaaggtcgcttctgagggctttcaatactcggatcgcagatggtgcttcgacggagaacgtaacaaccaagtgctagaagagaatatggacgttgagatatggaccaaagagggagaaaggaagaaacttcgcccaagatggctagatgcacggacctactccgacccactagcacttagagagttcaaagaatttgctgcaggaagacgatctgtctccggagacctcatactggaaatagggaaactcccccaacatctgacgctgcgcgcgcaaaacgcacttgacaacctagtgatgttacacaacagcgaacaaggaggaaaggcttaccgtcacgcgatggaggaactaccagacaccatcgaaacgctaatgcttctcgcattaatcgccgtcctaaccggaggagtaacactgttctttcttagcgggaaaggactcggtaaaactagcatagggctcctgtgcgtaatggctagcagtgccctattgtgggtcgcgagcgtagaaccgcactggatcgcagcttcgattatactagagttcttcctaatggtcttactgattccagaacccgaccgtcagcgcacgccacaagacaaccagctggcatacgtagtcatcggcctactgttcatgatactcaccgtcgcggctaatgaaatgggcctgctcgaaacaacgaagaaagacctcggaatcggacacgtggcggtcgagaatcaccatcatgcgaccatgttagacgtcgatctaagaccagcgagcgcatggaccttatacgccgtcgcaaccactgtgatcacgcccatgatgcggcacacgatagaaaacacgacggctaacatatcgctcacagcaatagccaaccaagcggcaatacttatggggctggacaaaggctggccaatttccaagatggacataggcgtgcctctactagcacttggctgctactcgcaagtaaacccgctgaccctgacggccgccgtccttatgttggttgcccactatgcaataattgggccaggtctccaagcaaaggctacccgggaagcccagaaacgcaccgctgcggggataatgaagaaccccaccgtggatggaatagtaacaatcgatctcgaccccgtagtatacgacgcgaaattcgaaaagcagttaggccagatcatgctgctcatcctatgcacatctcagatcttactaatgaggacaacctgggcactgtgtgagagtatcaccctcgcgacaggaccgctcacgactctgtgggaggggagtcctggcaaattctggaacaccacgatcgccgtaagcatggccaacatatttaggggatcctacctagctggagccggccttgcgttcagcgtaatgaagtcgctgggaggaggccggcgtgggacgggggcccagggagagacgctaggagaaaagtggaaacgccagctaaaccaactctcaaaatctgagttcaacacgtacaaaaagagcgggataatggaggtggaccggagtgaagccaaggagggcttgaaacgaggagaaacaaccaagcacgcagtttcacgtggcacggcgaaactacggtggttcgttgaacgcaatctcgtgaaacccgagggtaaggtaatagacctcgggtgcggtcgcggaggctggagttactactgtgcgggcctcaaaaaggtgaccgaagtaaagggatacaccaagggcggcccgggccacgaagaaccaatacctatggccacctacggctggaacttggtcaaactccacagcgggaaggatgtattcttcaccccacctgagaagtgcgacactctattatgcgacataggcgaatcgagcccgaatccgaccatcgaagagggcagaacactgagggtactaaagatggtcgaaccctggttgcgcggaaaccagttctgcataaaaatactaaacccttacatgccatcggtcgtggagacgctagaacagatgcaacgcaagcacggtgggatgctggtacgaaacccactcagtcgtaacagcactcacgaaatgtattgggtctcctgtggaaccggaaatattgttagcgccgtaaacatgacaagccgaatgctactcaaccgattcacaatggcccacagaaagccgacatatgagcgagacgttgacttgggagcgggtacccgccacgtagctgtagaacccgaggttgcgaatttagacataatcggacagcgcatcgaaaatatcaaaaacgaacacaaaagcacatggcattacgacgaagacaacccctataagacatgggcttaccacggaagttatgaggtcaaaccatcgggaagcgcctcgtctatggtcaacggtgtcgtgcgactgttaacaaaaccatgggatgtaatcccgatggttactcaaatagctatgacagacacgaccccatttggacaacaacgggtctttaaagaaaaagtggacacacgcaccccgcgcgcaaaacgcggcaccgcccaaattatggaagtaacagccaagtggctatggggtttcctatcccgcaacaagaagccgcgaatttgcaccagagaagaatttacacgaaaggtaagatcaaacgcagcgattggtgcagtattcgttgacgaaaatcagtggaacagcgcaaaggaagccgtcgaggatgaacgcttctgggatctcgttcatcgcgaaagggaactacacaagcagggcaagtgcgcaacatgtgtctacaacatgatgggaaagagggaaaagaaactcggagagttcggaaaagcaaaagggagtagggcaatttggtatatgtggctcggggcccgattcctagaatttgaggcacttggctttatgaacgaagaccactggtttagtcgtgagaactccctatcgggcgtcgagggagaaggactacataaactcggctatatcttgagggacatatcaaagatacccggaggaaatatgtacgccgatgatacggccggatgggacacccggataaccgaagacgaccttcagaacgaggccaaaatcaccgatataatggagcctgaacacgcactcctagctaccagcatcttcaaactaacatatcaaaacaaagtagtccgtgtgcagcgccccgcaaaatccgggacggtaatggacgtgattagccgaagggaccagcggggttcaggccaagtagggacatacggcttgaacacatttacaaacatggaggtacagctaatccgccaaatggagtcagaaggaatattctcacccagcgaactggagacgccgaatctggcgaagaaagtcctcgattggctagaaaaacatggagcggaaaggctgaagcgaatggcaataagtggcgacgactgcgtcgttaagccgattgacgaccgattcgccacggctctcaccgccctgaacgatatgggcaaagttcgaaaagatattccacagtgggaaccaagcaaagggtggaatgactggcaacaagtcccattttgctcccaccatttccaccaactcataatgaaggacgggagagaaatagtagttccatgccgaaaccaagacgagttagtgggccgtgccagagtgtcgcaaggggcaggatggagcctgagggagacagcttgtctaggtaagtcctacgcccaaatgtggcagctcatgtatttccacagacgagacctaagactggccgccaacgcgatatgctcagcggtgcccgtggattgggtgcctaccagccggacgacatggtccatccacgcacatcatcaatggatgacaacagaggatatgctctccgtgtggaaccgtgtttggatagaggagaacccatggatggaagataagacccacgtaagcagctgggaggaagtgccatacctaggaaagcgagaggatcaatggtgcgggtccctcataggactgaccgcacgggccacttgggcaaccaacattcaggtcgcgatcaatcaagtacggcggttaataggaaacgagaactacctagattacatgaccagtatgaaacgctttaagaacgaaagcgaccccgagggagcgctatggtga

SEQ ID NO: 23746 - RNA, 9879 nt, synthetic construct
  misc_feature 1..9879: note = derived and/or modified CDS sequence (opt11) from DENV-1__KF971870__SS-prME
  source 1..9879: mol_type = other RNA
agcgtgaccatgttactcatgctaatgcccacagcgctggctttccatctcaccacccggggcggggaaccacatatgatggtgtccaagcaggagaggggcaaaagcctgctgttcaaaacctccgcaggggtgaacatgtgtacgctcatcgccatggacctaggcgagctctgcgaggacacgatgacctacaagtgcccacggatcaccgaggcggaacccgacgacgtggactgctggtgtaacgccaccgacacctgggtgacctacggcacctgctcccaaacaggcgagcatcggcgcgacaagcggtccgtggccctcgcaccccacgtgggactggggctcgaaacgcgcacggagacctggatgagcagcgaaggcgcctggaagcagatccaacgggtagagacatgggccttacgccaccccgggtttaccgtgatcgcactgttcctggcgcacgccatcggcacctcaatcacccaaaaggggatcatcttcatcctcttaatgctggtgacgccctccatggccatgcggtgcgtcggaataggcagccgcgactttgtggaggggctttctggcgccacgtgggtggacgtcgtactagagcacggaagctgcgttaccaccatggccaaggacaagccgaccctcgacatcgagctcttaaagacggaggtcactaaccccgcggtcttgcggaagctctgtatcgaagccaaaatctccaacaccaccacggacagccgctgtccgacccagggtgaagccacactggtggaggagcaggacgccaacttcgtctgccgtcgcaccttcgttgaccggggctgggggaacggttgcggcctgttcggcaaggggtctctcatcacgtgcgccaagttcaagtgcgtaacaaagctggagggaaagatcgtccagtatgaaaacctgaagtacagcgtgattgtgaccgtccacaccggtgaccagcaccaggtgggaaacgagtccacggagcacggtactacagcgaccatcacgccccaagcgcccacgacggaaatccagctcacggactatggggctcttaccctggattgcagcccccggacgggcctcgacttcaacgagatggtcctgctgaccatgaaggagaagagctggctcgtacacaagcaatggttcttggatctgcccctcccctggaccagcggggctagcacgtcccaagagacgtggaaccggcaagacctactggtcaccttcaagacagcccacgctaagaaacaggaggtcgtagtgctcggctcgcaagagggggccatgcatacggcactgacgggggccaccgagatccagacctccggtaccactaccatatttgctgggcacctgaaatgcaggctcaagatggacaagctgaccctaaagggcatgtcttatgtcatgtgcaccgggtcctttaagctcgaaaaggaagtagcggagacgcagcatggtacggtgctggtccaaatcaaatacgagggcacagacgccccctgcaagatcccctttagcacccaggatgagaagggggttacccaaaacggccggctgattaccgccaaccctatcgtgaccgacaaggagaagccagtcaatatcgaggccgagccgcccttcggggagtcctacatcgtcatcggggcgggcgagaaggccctgaagctgagctggttcaagaagggctccagtatcggaaagatgtttgaagccacggccaggggtgcccggcgcatggcgatcttgggcgacacggcctgggacttcgggtccatcggcggagttttcacgtccgtgggaaagctggtgcaccagatcttcggcaccgcatacggcgtcctcttctcaggcgtcagctggaccatgaaaatcggcattggtgtgctgctcacgtggctcgggctgaatagcaggagcacctcactgagtatgacctgcatagcagtgggactcgtaacactgtacctgggcgtgatggtgcaagccgactcggggtgtgtcatcaactggaagggccgagagctaaagtgtgggtctggtatttttgtgacgaacgaagtgcacacatggaccgagcaatacaagtttcaggcggacagcccaaagcgcctgtctgctgccatcggcaaggcgtgggaggaaggtgtctgcggcatacggtccgccacacgcctcgaaaacataatgtggaagcagatctccaacgagctcaaccacatcctgctggaaaacgacatgaagttcaccgttgtggtcggtgacgtggcgggaattttagcccagggaaaaaaaatgatccggccgcaacccatggagtacaagtactcttggaagtcctggggcaaggcgaaaattatcggcgctgacgtgcagaacacgactttcatcatagacgggccaaacaccccggagtgccccgacgaccagcgagcgtggaacatttgggaggtcgaggactatggcttcggtatcttcaccacaaacatctggctgaagctgcgagactcctacactcaggtgtgcgaccatcgcctcatgtccagcgccataaaggactccaaggccgtccacgccgacatgggctactggattgagagcgagaaaaacgacacgtggaaactggcccgggcttcgttcatagaagtcaagacctgcatttggcccaagtcacacacgctgtggtccaacggcgtcttagagagcgagatgatcatccccaagatctatgggggcccgatttcccagcataactacagacccgggtacttcacccagactgccggcccctggcatctaggaaagttagagctcgatttcgacctgtgcgaggggaccactgtggtcgtggatgagcactgcggcaaccggggcccgagcctgcgaaccaccaccgtgacaggcaagataatacacgagtggtgctgcagatcgtgcaccctgccaccactacgcttccgcggggaggatggctgctggtacggtatggagattcgtcccgttaaagaaaaggaggagaatctggtgaagagcatggtgagcgcgggctccggcgaagttgactccttctccctcgggctgctgtgcatctcgatcatgattgaggaggtaatgaggtcccgctggagccgcaagatgctgatgatcggtaccctggccgtgttcttcctcctgatcatgggtcagctgacctggaacgacctgatccgtttatgcataatggtgggcgccaacgcgtctgacaggatggggatgggcacgacctacctggcactgatggccacttttaaaatgaggcctatgttcgccgtgggattactgttccgcagactgaccagccgcgaggtgctcctgctgacgataggactctcgctagtcgctagcgcggagctccccaactccctcgaggagttgggcgacgggctggccatgggcatcatgatcctcaagcttctgaccgatttccagagccaccagctttgggccaccctcctgagcctcacctttatcaaaacaactttctcactgcattatgcttggaagaccatggctatggtcctgtccatagtcagtctctttcccctgtgcctgtcaaccaccagccagaagacaacttggctccccgtgctacttggctccttggggtgcaagcctctgaccatgttcttaatcgcagagaacaagatctggggccgcaaaagttggcctctcaacgagggcattatggccgttggcatcgtcagcatcctgctttcctcgctcctgaagaacgacgttcccctcgccgggcccttaatcgcgggcggcatgctgatcgcgtgttacgtgatctcgggatcatccgctgacctgagccttgagaaagcagccgaggtctcctgggaagaagaggcagagcacagcggcgcgtcccacaacatcttggtggaagtgcaggacgatggtacgatgaaaattaaggacgaggaacgggacgacactctcactatccttctgaaggccacactgctcgccgttagcggcgttttcccactgtctatacccgcgaccctgttcgtgtggtacttttggcagaagaaaaagcagcggagcggggtcctctgggacacgcccagccctcccgaagtggaacgcgccgttctggatgatggcatctatcggatcatgcagcgcggcctactggggcgtagccaggtcggcgtcggggttttccaggaaaacgtcttccataccatgtggcatgtgacccgcggcgcggtactcatgtatcaaggtaagcggctggaaccaagctgggccagcgtgaagaaggacctgatctcctacggcggcggttggagactccagggcagctggaataccggagaggaggtccaggtgattgcggtcgagccaggcaagaaccccaagaatgttcagaccgcccccgggactttcaagacccccgagggtgaggtgggcgccatcgcgctggacttcaagccggggacctcgggttcccctattgtcaaccgggaggggaagatcgtgggcctgtacggcaacggggtggtgaccaccagcggcacctacgtgtcggccatcgcacaggcgaaggcgtcacaagaggggccgctccctgagatcgaggacgaggtctttcgcaagcggaacctaactattatggacctgcaccccgggtccggtaagacgcgacggtatctgccggccatcgtccgcgaagccattaagcggaagctgcgcacccttatcctcgcccccacgcgcgtggttgcctcggagatggcggaggccctgaagggcatgcccatccggtaccaaaccacggccgtcaagtccgagcacaccgggaaggagatcgtggacttaatgtgccacgctaccttcaccatgcgcttactgagcccggtccgggtcccaaattataacatgatcatcatggacgaggcccacttcacagacccctcatccatcgcggcccgcgggtacatcagcacccgtgttgggatgggcgaggcagccgccatctttatgaccgctaccccgcccggcagcgtcgaggcatttccccagtccaacgccgtcatccaggatgaagagcgcgatattcctgaacggagctggaactcggggtatgagtggatcacggacttccccggcaagaccgtgtggttcgttccgagcatcaaatccggcaacgacatcgcgaattgcctccgcaagaacgggaagagagtcattcagttgagccgcaagacgttcgatacggagtaccagaagacgaagaataacgactgggactacgtcgtgaccaccgacatctccgagatgggagcgaatttccgcgccgaccgtgtcatcgatccgcgacgatgcctcaagcccgtgatactaaaagatgggcccgagagggttatactcgccggccccatgcccgtaactgtggccagcgctgcccaacgccgggggcgcattggacggaaccacaacaaagagggcgatcagtacatctacatggggcagccactgaacaacgacgaggaccacgctcactggaccgaagctaagatgctgcttgataacattaatacgccggagggtatcatccccgcccttttcgagccggagcgcgagaagtccgccgcaattgacggtgaatatcgcctccggggcgaggcgcgcaagaccttcgtcgaactgatgcggagaggtgacctcccagtctggctcagctacaaggtggccagcgaaggattccagtactccgacaggcgctggtgcttcgacggcgagcggaacaaccaggtgctcgaagagaacatggatgtggagatctggactaaggagggagagagagagaagctgcgcccccgatggctgggcgcacggacgtacagcgatcccctggcactgcgcgattttaaggagttcgccgccgggcggcgctccgtgtcaggagacctgatcctcgagatcgggaagctcccgcaacacctgacccagcgggctcagaacgcgctcgacaacctagtcatgttacacaacagtcagcaaggtggtcgagcgtacacccacgccatggaagagctccccgacactatcgagacgctgatgctgctcgccctgatcgccgtgctgaccgggggcgtgacactgttctttctcagcgggcgcggcttaggcaagacatcgatcgggttgctctgcgtcatggcaagctcagtgcttctctggatggcgtctgtggagccccactggatcgcagcctccatcatcctggagtttttcctgatggtcttgctgatccccgaacccgaccgccagcggacgccccaggacaatcagctggcgtacgtggtgatcgggctcttgttcatgattctgacggtcgccgcgaacgagatggggctccttgaaactaccaagaaagatctgggcatcgggcatgtggccgtggagaaccaccaccacgccgccatgctcgatgtcgacctacaccccgcctcggcatggaccctgtatgccgtggccacgaccatcatcactccgatgatgcgacacaccatcgagaacacgacagccaacatatctcttaccgccatcgcgaaccaggccgctattctgatgggtctggataaggggtggccgatcagcaagatggacattggggtgcccttgctcgccctcggctgctactcccaggtcaatccattaaccttaacggcggccgtcctcatgctcgtggcccactacgcgatcatcgggccgggcttacaggctaaagccactcgggaagcccagaagcgcaccgccgccgggatcatgaagaatcccactgtcgatggaattgtcgcaatcgaccttgaccccgtggtctacgacgctaaattcgagaaacagctcggccagattatgttgcttatcttatgcacgtcgcagattctgctgatgcgcaccacctgggccctctgcgaatcaatcaccctcgccacggggccacttactaccttatgggaaggaagcccggggaagttttggaacaccacgatagccgtgtccatggctaatatctttcggggcagctacctggcgggagctggtctcgcgttttcgctcatgaagtccttaggagggggccgacgggggaccggtgctcagggcgaaaccctaggggagaagtggaagcgccggctcaatcagctgagcaagagcgagttcaatacctataagcgctccggaatcatggaggttgaccggtccgaagcaaaggaggggcttaagcgaggcgaaactacgaagcacgctgtcagccggggcactgcgaagctgcgctggttcgtggagcggaacttagtgaagcccgagggcaaggtcatcgacctgggctgcggccgcggtgggtggtcgtattactgcgctggactcaagaaggtgaccgaggtaaaggggtacacgaaggggggacccgggcatgaggaacccatcccgatggccacctacggctggaaccttgtcaaactgcactcagggaaggacgttttctttataccgcccgagaagtgcgacacgttactctgcgatatcggcgagtccagcccgaacccgaccatcgaagaggggcgcacgctacgggtgctgaagatggtcgagccctggctacggggcaaccagttctgcatcaaaatcctgaacccctacatgccctccgtggtagagaccctggagcaaatgcagcgtaaacacggcgggatgctggtccggaatccgctcagcaggaattccacccacgagatgtactgggtcagctgcggcacgggcaacatcgtctccgcggtgaacatgaccagccggatgttgctcaaccgcttcaccatggctcacagaaagcccacctacgagcgggatgtggacctgggcgcaggcacccggcacgtggccgtagagcccgaggtggccaacctggacatcatcgggcaacggatcgagaatatcaagcacgagcacaagtccacatggcattacgacgaggacaacccatacaaaacgtgggcgtatcacggctcctacgaggtaaagccgtccgggagcgctagcagcatggtaaacggggttgtcaaactcctaacgaagccttgggacgtgatcccgatggtgacccagattgccatgactgacacaacacccttcgggcagcagcgcgtcttcaaggagaaggtggacacccggacgccgaaggccaagcgcgggacggcgcagatcatggaggtgactgccagatggttatggggcttcctctcacgcaataagaagccccggatctgcacccgcgaggaattcacccggaaggtgcgcagcaacgccgccatcggagctgtgttcatcgacgagaaccagtggaacagcgcgaaggaggccgtggaggatgaaagattctgggacttggtacaccgagagcgcgagctgcacaagcaggggaagtgcgccacgtgcgtgtacaacatgatggggaaacgcgagaagaagctcggagagtttgggaaggccaagggctcccgggcaatctggtacatgtggctgggtgcgcgctttttagagttcgaggccctcgggttcatgaacgaggatcactggttcagccgcgagaactccctaagcggagttgagggggaggggctgcacaagctcgggtacatcctgcgcgacatttccaaaatccctggaggcaacatgtacgccgatgataccgccggttgggatacccgaatcaccgaagacgacctgcagaatgaggccaagataactgatatcatggagccggagcacgcgctcctagcgaaggccatcttcaagctgacctaccaaaataaagtcgtgagggttcagcgccctgccaagaatggtaccgtcatggacgtgatcagccggcgcgaccagcggggctccggccaggtgggaacatacgggctcaacacttttactaacatggaggcgcagctgatccgccagatggaaagcgagggcatcttcagtccctcagaattagagactcccaacctcgcggagcgggtcctggactggctggggaagtacggcgtagagcgccttaagcggatggccatctcgggagacgactgtgtggtcaagcctattgatgaccgcttcgccaccgcccttaccgccctgaacgacatgggcaaagtccggaaagacatcccccaatgggagcccagcaagggctggaacgactggcagcaggtacccttctgctcccaccacttccaccagctcatcatgaaggatgggagggagatcgtggtaccgtgcagaaatcaggatgaactggttggccgagcacgggtcagccagggcgccggctggagcctgcgcgagacagcgtgcctcgggaagtcctacgcccagatgtggcagctgatgtacttccatcgacgcgacctacgcctcgcggccaacgccatatgtagcgctgtgcccgtggactgggttccgacctctcgcactacgtggagcatccacgcccaccaccaatggatgacaaccgaggacatgctgagtgtttggaatcgggtgtggatcgaggagaatccctggatggaggacaagacccatatttcgaattgggaggacgtcccgtaccttggtaagcgcgaagaccagtggtgcggctctctgatcgggcttacggcgcgagccacctgggctaccaacatccaggtggctataaaccaagtccggcgcctgattggcaatgagaactacctcgactatatgacgagcatgaaacggttcaagaatgagtccgaccccgagggggctttatggtga

SEQ ID NO: 23747 - RNA, 9879 nt, synthetic construct
  misc_feature 1..9879: note = derived and/or modified CDS sequence (opt11) from DENV-1__KF971871__SS-prME
  source 1..9879: mol_type = other RNA
tcagtaactatgttgttaatgctcatgcccaccgcgctcgccttccacttgacgaccagaggcggagaaccccacatgatggtgagcaagcaggagcggggcaaaagcctcctgttcaaaactagcgctggtgtgaatatgtgtacccttatcgcaatggacttaggcgaactgtgcgaagacaccatgacctacaagtgtccacgcatcactgaggctgagccagacgacgtggactgctggtgcaacgccaccgacacttgggtgacctatgggacctgtagccagaccggagagcaccgacgggacaagcgtagtgtagcgcttgcgcctcatgtgggcctggggctggagacgcgaacggagacgtggatgagttccgagggagcctggaagcagatccagcgggtggagacctgggccctcagacacccgggattcacggtcattgccctctttttggcgcacgctatcggaaccagcatcacccagaaagggataatcttcattctcctgatgcttgtgacccctagcatggccatgcgatgcgttggaatcggctcgagagacttcgtggagggcctctccggagcgacgtgggtggacgtagtgctagagcatgggagctgcgtaaccaccatggcgaaagataagcccaccctggacatcgagctcctgaagacggaggtcacaaaccctgccgtgctgaggaaactctgcatcgaggccaaaatatcgaatactactaccgactctcgctgcccgactcagggcgaggccaccctggtggaggagcaagacgctaacttcgtctgccggagaacgttcgtggacagaggctgggggaacggatgcggcctgttcgggaaaggaagcctaatcacgtgcgccaaattcaagtgcgtaaccaagctcgaaggcaaaatcgtccagtacgagaacttaaaatactccgtaatcgttaccgtccacaccggcgaccagcaccaagttgggaatgagtccacagagcatggcaccacggcgaccatcacgccacaggcgcctacgactgagatccaactcaccgactatggggcactaacactggattgctctccccgcaccggcttagactttaacgagatggtcctgctgacgatgaaagagaagtcctggctcgtgcacaagcagtggtttctggacctgccactcccttggacgtcaggggcaagcacttcccaggagacgtggaacagacaagacctgcttgtgacgttcaagaccgcccacgcgaaaaagcaggaagtggtggtattaggcagccaggagggcgcgatgcacaccgctctgactggagcaaccgagattcaaacctcaggcaccacgacgatctttgccgggcacctgaaatgccgcctcaagatggacaaacttaccctgaaaggcatgagctacgtaatgtgcactgggagtttcaagttagagaaggaggtggcagagacgcagcacggcacggttttagtccaaattaagtacgagggcacagacgctccatgcaaaatccccttcagcacccaagacgaaaagggtgtgacgcagaacggccggctgataaccgctaatccgatcgtgacagacaaggagaagcccgtcaacatcgaggccgagccgccgttcggggaatcctacatcgtgatcggtgctggcgaaaaggccctgaagctcagctggttcaagaagggttccagcataggcaagatgttcgaggccaccgctcggggtgctcggcgcatggcgatcctgggcgacacggcctgggacttcgggtccatcgggggagtcttcacgagcgtcggcaagctggtgcaccagatcttcggcaccgcctacggtgtcctcttctccggcgtcagctggactatgaaaatcggcataggcgtgctgttaacctggctaggcctcaattcccggagcaccagtctgagcatgacgtgcatagccgtagggttagtcacgttgtatctcggggtgatggtccaagccgactccgggtgtgtcatcaactggaagggaagggagttaaagtgcgggagcggaatcttcgtcaccaacgaggtgcacacctggaccgagcagtataagtttcaagctgacagcccgaagcggctgtccgccgccataggcaaggcatgggaagaaggggtctgcggcatccggagcgccacaagactggagaacatcatgtggaagcagatctccaatgagcttaatcacatcctgctggagaatgacatgaagttcaccgtggtcgtcggggatgtggcgggcatcctcgcccagggcaagaagatgatccgcccccagcccatggagtacaagtacagctggaagtcctggggcaaggccaaaatcatcggagccgacgtgcagaacaccaccttcatcatagacgggcccaacacaccggaatgccccgatgatcaacgcgcttggaacatttgggaagtcgaagactatggcttcgggatatttaccacaaatatctggctaaagctgcgggactcgtacacacaggtctgcgaccacaggctcatgtcggccgcaataaaggacagcaaggccgtgcacgccgatatgggctactggattgaatccgaaaagaacgacacctggaagctggccagagcctccttcatcgaggtcaagacatgtatctggcctaaaagccacacgctgtggagcaacggtgtacttgagtccgagatgatcattcccaagatctacggaggcccgatcagccagcataactaccggcccgggtacttcacccagaccgcagggccctggcacctgggcaagttagagctagattttgacctgtgcgaaggtaccacggtggtggtggacgagcactgtggcaatcggggcccgtcgctaaggaccaccaccgtgacgggcaaaatcatccacgagtggtgctgccggtcatgcactctgccgcccctcagattccgcggcgaggatggatgctggtacggaatggagatcaggcccgtgaaggagaaggaagagaatcttgtgaaaagcatggtgagcgccggttcgggcgaggtcgactccttctctctcgggttactgtgcatatccattatgatcgaggaggtgatgagaagccgatggtccaggaagatgctgatgattggcacccttgcggtgttcttcttgttaatcatggggcagctgacctggaacgatctgatccgcctttgcatcatggtaggcgcgaacgcctctgatcgtatgggaatgggtacgacctacctggccctaatggccaccttcaaaatgagaccgatgttcgctgtcggcctcctatttcgccggctgacctcccgcgaggtgctcctgctgactataggactcagcctggtggcttccgccgagctgccaaactccctcgaggagcttggagacggtttggccatgggaatcatgatactcaagctgctgaccgacttccagtcccaccagctatgggcaaccctgctgagtctcacattcatcaagacgaccttctccctgcactacgcctggaagaccatggccatggtgctgagcatcgtttccctctttcctctgtgcctttccaccacgtcccagaagaccacttggcttccggtgctgcttggcagcttgggatgcaaaccgctgacgatgttcctgatcgcggagaacaagatctggggccggaagtcatggcccctcaacgaggggattatggccgtggggatcgtctctatactcctttcaagtttactgaagaacgacgtgccgctggcggggcccctcatagcgggcggaatgttgatcgcctgttatgttatttctggttcctcagctgacctgtcgcttgagaaagccgctgaggtcagctgggaggaggaggcggagcactccggcgctagccacaatatactggttgaagtgcaggacgatggcacgatgaagattaaggacgaggagagagatgatacactgacgatcctactgaaggctaccctcttggccgtctccggcgtgttcccgctaagcatccctgccaccctgttcgtgtggtacttctggcagaagaagaagcagcggtccggggtactctgggacacgccgagcccgccggaggtggagagagccgtactggacgacggcatatatcgtatcatgcaacgcggcctgctgggcagatcccaggtcggggttggggtgtttcaggagaacgtcttccatacaatgtggcacgtgaccagaggtgccgtactcatgtatcaggggaagagactagaaccctcgtgggccagtgtcaagaaggacctgatcagctacggcgggggctggagattgcagggttcctggaacaccggggaagaggtccaggtgattgccgtggagcccggcaagaaccccaagaacgtgcagacagcccctgggaccttcaaaacccccgagggtgaggtcggcgcgatagctctcgatttcaagcccggcacttccggctcccccatagttaaccgcgaggggaaaatcgtgggcttgtatggcaacggtgtcgtcacgaccagtgggacctatgtgtccgccatcgcccaggcgaaagcctcgcaagaggggccattacctgaaatcgaggacgaggtttttaggaagagaaacctgaccatcatggacctgcatcccgggagcggtaagactcgccggtacctccccgctatcgttcgagaggccatcaagcggaagctgcgcacccttatcctcgcccccacccgcgtggtggcgtccgagatggccgaggctctgaagggaatgccgattcggtaccaaacaacggccgttaagagcgagcacactggcaaggagatcgtggacctgatgtgtcatgccaccttcaccatgcgcctcttaagtcccgtgcgtgtacctaactataacatgatcataatggacgaggcacacttcacggatccctcgtccatcgccgcccgcggctacatcagcacccgtgtaggcatgggtgaggccgccgcgatctttatgactgcaacgccgcccggctccgtcgaggctttcccgcaaagcaacgccgtaatccaggacgaggaacgggacatccccgagcgttcctggaactcggggtacgagtggatcacggatttccccggcaagaccgtgtggttcgtgccatccatcaagagcggtaatgacatcgctaactgcttacgcaagaacgggaagcgggtcattcagctcagtcgcaagaccttcgataccgagtaccaaaagacaaagaacaacgattgggattacgtggtgaccaccgacatctcagagatgggcgcaaacttccgggcagaccgcgtcattgacccgaggagatgcctgaaaccggttatcctgaaggacggaccagagcgggtaattctcgccggacccatgccggtgacagtcgccagtgcggcacagcgccgggggcggattggacgtaaccataataaggaaggcgaccagtacatctatatggggcaaccactgaacaacgatgaggaccacgcccactggacggaggccaaaatgctactcgacaacatcaacactccggagggtatcatccccgccctgtttgagccggagcgcgagaaaagtgcggcgattgacggtgagtaccgtctgcgcggtgaggcccgcaagaccttcgtggagctcatgcggcgaggcgacttaccagtgtggctatcctataaggttgccagcgagggctttcagtacagcgatcggcgctggtgcttcgacggcgaacggaacaaccaggtgctggaggagaatatggatgtggaaatatggacaaaagagggggaacgcaaaaagctgcgtccccgctggctaggtgcccgaacgtactccgacccactcgcactgagggaatttaaggagttcgccgctgggcggcgcagcgtgtctggcgacttaatcctcgagataggaaaattaccgcagcacctaactcagcgagcccagaacgctctcgacaacctggtaatgcttcacaacagcgagcagggggggcgcgcctaccgtcacgccatggaggagctcccagacaccatcgagacactgatgctgctcgccctgatcgccgtgctgaccggcggggtgaccctgttcttcctgtccgggcgcggcctgggcaagaccagtatagggctactgtgtgtcatggcgtcgagcgtgctgctctggatggcgagtgtggagccccattggatcgccgcgagcattatactggagtttttccttatggtcctcctgattcccgagccggaccggcagcgcacgccccaagacaaccagctggcctacgttgtgatcggactcctgttcatgatcctgacggttgcggcaaacgagatgggcctcctcgagacaaccaagaaggacctgggtattggacacgtggccgtggagaaccatcaccatgcagccatgctcgacgtcgacctgcaccccgcgtccgcctggaccctgtacgccgtggccacaacgatcatcaccccaatgatgcggcacactatcgagaacacgacggccaacatcagcctcaccgctattgcaaaccaggccgccatcctaatgggcctggacaaggggtggcctatctccaaaatggacatcggggtacctctccttgcgttgggttgctattcccaggtcaatccgctgactctgacagccgccgtgctcatgttagtggcccattacgccatcatagggcccggcctgcaggcgaaggccacacgcgaggcccagaagcgcacggctgccgggatcatgaagaatcccactgtagacggcattgtggccatagacttggaccccgtggtctatgacgccaaattcgaaaagcaactcggtcagatcatgctgcttatactctgcacctcccaaatcctgttaatgcggacgacgtgggccctctgcgagtcgatcaccctggccaccgggccgctgactacgctctgggagggctcgccggggaagttctggaacaccacgattgcagtgtctatggcgaatatcttccgcgggtcttacctggccggggctggtctggcatttagcctcatgaagtccctgggcgggggccggcgcgggacgggcgcccaaggagagaccctgggagagaaatggaagcgacgcctcaaccaattgtccaagtcggaattcaacacctacaagcggtcgggcataatggaggtggaccgcagcgaggccaaggaggggctcaagcgtggggagaccacaaagcatgcagtgtcccgcggcaccgccaagctcagatggtttgtggagcgcaacctggtgaagccagagggtaaggtaatcgaccttggttgcgggagaggaggttggagctattactgcgccggcttaaagaaggtcaccgaagtgaagggctacaccaaggggggccccgggcacgaagaaccgatcccaatggcgacgtacggctggaacctggtcaaactacactccggaaaggacgtgttcttcatcccgccggaaaagtgcgacaccctgctctgcgacatcggcgagagctcccccaacccgaccatcgaagaggggaggacgttgcgggtgctgaagatggtcgagccctggctccggggcaatcagttttgcatcaagattctgaatccttacatgccttctgtagtggagaccttggaacagatgcagaggaaacacggaggaatgttggtgcgcaaccccttgtcgcggaacagcacccatgagatgtactgggtctcctgcggtaccgggaatattgtgagtgccgtcaatatgacatcccgtatgctgctcaatcgattcaccatggcccatcggaaacccacgtacgagcgcgacgtggacctcggcgctggcacccggcacgtcgccgtggagcccgaggtggcgaacttggacatcattgggcagcgcatagaaaacatcaaacacgagcacaaatctacctggcactacgacgaggataacccctacaagacctgggcctaccatggttcgtacgaggtgaagccgagcggaagcgcgtcaagcatggtcaatggcgtggtcaagctcctcaccaaaccttgggacgtcatcccaatggtgacccagatagctatgaccgacacgacgcccttcgggcagcagcgggtctttaaggaaaaggttgatacccgcaccccgaaagccaagcggggtacagctcagattatggaagtgacggcacgctggttatggggcttcctaagccggaacaagaagccacgcatctgcacccgtgaggagttcaccagaaaggtacgtagtaacgccgcaattggagctgtttttatcgacgagaatcagtggaattccgccaaggaagcagtggaggatgagcgcttctgggatcttgttcatagagagcgcgaactgcacaaacagggcaagtgcgctacctgtgtgtacaacatgatggggaagcgcgagaagaagttgggtgagttcggcaaggccaaggggtcgcgcgctatctggtacatgtggctgggcgcccggttcctggagttcgaggcccttggattcatgaacgaagatcattggttctcacgcgaaaatagcctgtccggcgtggagggggagggtctgcacaagctcggttacatcctgagggatatctccaagatccccggcggcaatatgtacgctgacgacaccgccggctgggacactcgaatcaccgaggacgacctgcaaaacgaggcgaagataaccgatataatggagccggagcatgcccttctggctaaagcgatcttcaagctgacgtaccagaataaggtcgtgcgcgtacaacgccccgccaaaaacggaaccgtgatggacgtgatttccaggcgggatcaacgcggcagcggccaggtcggcacctacggcctcaacacattcaccaacatggaggcgcagctgattcgccagatggagtccgaaggcatcttttcaccctccgagctggagaccccaaacctcgccgagcgcgtccttgactggctggggaagtacggcgtggagcgcctcaaacgcatggccatatccggggacgactgcgtggtgaaaccgatcgacgaccgattcgccacagcgctgaccgcgctcaacgatatgggcaaagtacgaaaggatatcccacagtgggaaccctccaaaggctggaatgactggcagcaagtcccgttctgttcgcaccacttccaccagttaatcatgaaagacgggagggagatcgtcgtcccatgtcgtaaccaggacgagctggtgggtagggcgcgcgtctcccagggggccgggtggagcctgcgggagaccgcctgtctcgggaagagctacgcgcagatgtggcagctgatgtacttccaccgccgggatttgcgcctcgccgccaacgccatctgctccgccgtgccagtcgactgggtccctaccagcaggacaacctggagtatccacgctcaccaccagtggatgaccaccgaggacatgctgagcgtatggaatcgcgtttggatagaggaaaacccatggatggaggacaaaacccacatcagcaactgggaggacgtgccttacctgggaaaacgtgaggaccagtggtgtggcagcctcatcgggctgaccgcccgggcgacgtgggctacgaacatacaggtggcgatcaaccaggtacgccggctgataggcaatgagaactacctcgattacatgacctccatgaagcgcttcaagaatgagtcagatcccgaaggagcgctgtggtga

SEQ ID NO: 23748 - RNA, 9879 nt, synthetic construct
  misc_feature 1..9879: note = derived and/or modified CDS sequence (opt11) from DENV-1__KF971869__SS-prME
  source 1..9879: mol_type = other RNA
agcgtgaccatgctgctcatgctcatgcccaccgcactggccttccacctcaccacccgtggcggggaaccacacatgatggtgagcaagcaagagcgaggcaagagccttctgttcaagaccagcgccggggtgaacatgtgtactctcatagccatggacctgggcgagctgtgtgaggacacgatgacctacaagtgcccccgaatcactgaggccgagcccgacgacgtagactgctggtgcaacgccacggacacctgggtgacctacggcacctgttcacagaccggcgaacaccggcgcgacaagcggtccgtggccctcgcgccacacgtgggcctgggtctggagacgcggaccgagacttggatgagttccgagggagcctggaagcaaatccagagagtcgagacatgggcccttcgccaccccggctttacggtgatcgccctgttcctggctcacgccataggaacaagcatcacacaaaaggggatcatcttcatcctcctgatgctggtgaccccctctatggccatgcggtgcgtcggcatcggctcgcgcgacttcgtggaggggctctccggcgccacgtgggtggacgtcgtcctagaacacgggagctgtgtgaccaccatggccaaggacaagccaaccctcgacatcgaactcctgaaaacggaggtcaccaaccccgcggtgctgcggaagttgtgcattgaagccaagatctccaacaccaccacggacagccgctgtcctacccagggcgaggctaccttagtggaggagcaggacgctaacttcgtctgccggcgtaccttcgttgaccggggctgggggaacggctgcgggctgttcggcaaggggtccctaatcacgtgcgccaaattcaagtgcgtgactaagctggaaggcaagatcgtccagtatgagaacctgaagtacagcgtgatcgtgaccgtccacaccggcgaccagcaccaagtagggaacgagtccacggaacacggaaccaccgcgacgatcacgcctcaagctcccacgaccgagatccaactaaccgactacggggccctgaccttagactgcagcccccgaacgggcctcgacttcaacgaaatggtcctgttaaccatgaaggagaagtcttggctcgtgcacaagcagtggttccttgacctgcccctcccctggactagcggggccagcaccagccaggagacgtggaataggcaggatttacttgtgaccttcaagactgcccacgcgaagaagcaggaggtcgtcgtgctcggcagccaggagggcgccatgcacactgccctgacgggggcaacggagatccagaccagcggcaccaccacgatcttcgccgggcacctcaagtgtagactcaagatggacaagctgaccctgaagggcatgagctatgtcatgtgcaccgggtcctttaagctcgagaaggaggtagcggagacgcaacacggcaccgtgttagtgcagattaagtacgagggcacggacgccccctgcaagatccctttcagcactcaggacgagaagggggtgacgcagaacgggcggctgatcaccgcgaacccgatcgtaaccgacaaggagaaacccgtcaacatcgaggccgagccgccattcggggagtcatacatcgtgatcggcgcgggcgaaaaggccctgaagctcagctggttcaaaaaagggtcctctatcggcaagatgttcgaggcaaccgctcgcggggcccggcgcatggccatcttgggcgacacggcctgggacttcggatcaattggcggcgtgttcaccagcgtcgggaagcttgtgcaccaaatcttcggcacagcctacggggtgctgttctccggcgtcagctggaccatgaagattggaattggcgtgctgctgacgtggctcggcctgaactccagaagcacctccctgagcatgacctgtatcgccgtggggctcgtcaccctgtacctgggcgtgatggtgcaggcggacagcgggtgcgtaatcaactggaagggccgagagctcaaatgcggcagcggcatctttgtgacgaacgaggttcacacatggaccgagcagtacaagttccaggcggacagcccaaagcgcctgtccgccgccatcggcaaggcctgggaggagggggtctgcggcatcagaagcgccacccgactagagaacataatgtggaagcagatctccaacgagctcaatcacatactgcttgagaacgatatgaagtttaccgtggtggtcggagacgtggcgggcatcctcgcccagggtaaaaagatgataaggccccaacccatggaatacaagtacagctggaagtcctgggggaaggccaagatcatcggcgccgacgtgcagaacacgaccttcatcatcgacgggcccaacaccccggagtgccccgatgaccagcgcgcgtggaatatatgggaggtcgaggactatggcttcgggatcttcaccacgaacatttggctgaagctgcgggatagctacacccaggtgtgcgaccaccgtctcatgtccgccgccatcaaggactcaaaggccgtgcacgccgacatgggctactggatagaatccgaaaagaacgacacctggaagctggcccgggccagcttcatcgaggtcaaaacctgtatctggcccaagtcccacacgctgtggagcaacggcgtgctcgagtccgagatgatcatacccaaaatctacggcggccctatctctcaacacaactaccgccccgggtacttcacccagaccgccggcccctggcacctgggaaagctggagttggacttcgacctgtgcgagggcactacggtggtcgtagacgagcactgcggcaatcgggggccgtccctgcgcaccaccaccgtgaccggcaagatcatccacgagtggtgctgccggagttgcaccctaccgcccttgcgcttccgcggggaggatggctgctggtacgggatggagatccgccccgtcaaggagaaggaggagaatctggtgaagtccatggtgagcgccggcagcggcgaggtcgactccttctcgttggggctgctgtgcatttccattatgatcgaggaggtgatgcggagccgctggtcccggaagatgcttatgattggcaccctggccgtgtttttcttgctgatcatgggtcaactaacttggaacgatttaatccgcctctgcatcatggtcggtgcgaacgcctccgaccgcatggggatgggcacaacctacctggcccttatggccaccttcaagatgcggccgatgttcgccgtgggcctcctgttccgccgcctgacttcccgcgaggtactcctgctgaccatcgggctcagcctggtcgcgtccgctgagctgcccaacagcctcgaggaattgggcgatgggctggccatgggcatcatgatactcaagctgctgaccgacttccagtcccaccagctctgggccacgctgctgagcctcaccttcatcaagacgaccttttcgctgcactacgcgtggaagactatggccatggtgcttagcatcgtttccctcttccccctgtgcctgagcaccacgtcccaaaagaccacctggctgcctgtgctgcttggctcgctcgggtgtaagcccctgactatgttcctgatcgctgagaacaagatctggggccggaaaagttggcccctcaacgagggcataatggcagtgggtatcgtcagcatcctgctgagctccctcctgaagaacgacgtgcccctggcaggacctctcatcgcgggcggcatgctgatcgcatgttacgtgatctcagggtcgagcgccgacctgtccctcgagaaagccgccgaggtcagctgggaggaggaagcggagcactccggagctagccacaatatcctggtggaggtgcaggacgacgggacgatgaagatcaaggacgaggaacgcgacgacaccctgactatccttctgaaagccaccctgttagccgtatccggggtgttcccactgagcatccccgccaccttattcgtgtggtatttctggcagaagaagaagcagcggtccggggttttgtgggacacgcccagcccgcccgaggtggagcgcgcggtgctagatgacggcatctaccggataatgcagcgcggcctgctggggcggtcccaggtcggtgtgggggtgttccaggagaacgtcttccacaccatgtggcacgtgacccgcggcgccgtgctcatgtaccaggggaagcggttagaacccagttgggcctccgtcaagaaggatttaatcagctacgggggcgggtggcgcctccagggctcctggaacaccggtgaggaggttcaggttatcgcagtcgaacccggcaagaaccccaagaacgtccagactgcccccgggacctttaagacccccgagggcgaagtgggcgctatcgcactggacttcaagccaggcaccagcggctcccccatcgtcaaccgagaggggaagattgtgggcctgtacggcaacggcgtggttacgaccagcggcacgtacgtgagcgccatcgcccaggcgaaggcctcccaggagggaccgctaccggagatcgaggacgaggtgttccgcaagcggaacctgacaataatggacctgcaccccggctcggggaaaacgcgccggtacctccctgctatcgtccgcgaggccattaagcggaagctgcggaccctgattctcgcgcccacccgcgtggtggcgagcgagatggccgaggccctcaagggcatgcccatccggtaccagaccacggccgttaagagcgagcacaccggtaaggagatcgtggacctgatgtgccacgccacctttacaatgcgactcctatcccccgtacgggtcccgaactacaatatgatcatcatggacgaggctcacttcacggatcccagctccatcgcggcccgcgggtacatcagcacccgtgtgggcatgggggaggccgccgcgatctttatgactgccacaccgcctggctccgtggaggcattcccgcagagcaacgccgtaattcaggacgaggagcgggatatcccggagcggtcatggaacagcgggtacgagtggatcacggacttccccggcaagaccgtgtggttcgtgccctccattaagagcggcaacgacattgcgaactgtctgcgcaagaatgggaagcgggtcatccaattatcccgcaaaacattcgacaccgagtaccagaaaacgaagaacaacgactgggattatgttgtgaccaccgacattagcgagatgggggccaactttcgggccgaccgcgtcatcgacccgcggcgctgcctgaagccggtgatcctgaaggacgggcccgagcgtgtgatcctagccggccccatgcctgtgacggtggcttccgcggcccagcgtcggggacgcatcggacggaaccataataaggagggagaccaatacatctacatggggcagcccctaaataacgacgaagaccacgcccattggacggaggccaagatgctgttggataacatcaacacgcccgagggcattatccccgccctgttcgaaccggagcgtgagaagtccgctgcgatcgatggggagtaccggctgcggggcgaggcgcgcaagaccttcgtcgagcttatgcggcgtggggacctgcctgtgtggctgtcctacaaggttgccagcgagggcttccaatactctgatcggcgctggtgcttcgacggtgagcggaacaaccaggtcctcgaggagaacatggacgtcgagatctggaccaaggagggggagcgcaagaaacttagaccccgctggctagacgcacggacgtactccgaccccctcgcgctgagggaattcaaggaattcgccgccggccggcgcagcgtgtccggggacctgatcctcgagatcggcaagctgccgcaacacctgacccagcgggcccaaaacgcgctcgacaatttggtcatgctgcataactcggagcagggcgggcgtgcctaccggcacgccatggaggaactccccgacactatcgagacgcttatgctgctcgccctgattgcggtgctaacgggcggcgtgaccttgttcttcctgtctggccgcggactgggaaagactagcatcggcctcctgtgcgtgatggcgtcctcggtgctgctctggatggcctccgtggaaccccactggatcgctgccagcatcatcctggagttcttcctgatggtcctcttaatccccgagccggaccggcagcgcacgcctcaggacaaccaactggcttacgtggtgatcgggttgctgtttatgatcctaaccgtcgcggcaaacgagatgggcctgcttgagacgaccaagaaagacctggggatcggccacgtggccgttgagaaccaccaccacgccgccatgctcgacgttgatttacaccccgcgtccgcctggaccctgtacgctgtggccaccacgattatcaccccgatgatgcggcacaccatcgaaaacaccacggccaacatcagcctcacagcgatcgccaaccaggccgccatcctgatgggcctggacaagggctggcctatctcaaagatggacatcggcgtgcccctcctggcactgggatgttactcacaggtcaatcccctcaccctgaccgccgccgtgctgatgctcgtggctcactacgccatcatcggtccgggtctgcaagcgaaggccacgcgcgaggcccagaagagaaccgctgccggcatcatgaagaacccgaccgtggacgggatcgtggccatcgacctggaccctgtggtatacgacgccaaattcgagaagcagctcggccagatcatgctgctgatcctttgcacatcccagatcctgctgatgcggacgacctgggccctttgcgagagcatcaccctggccaccggccccctgaccaccttgtgggaaggatccccgggcaagttctggaacaccaccatcgccgtgagcatggcgaacatcttcagggggtcctacctggccggcgccggcctggcattcagcctcatgaagtccctagggggcggtcggcgcgggacgggggcgcagggcgagacgttgggcgaaaagtggaagagacgcttgaaccaactgtccaagagcgagttcaacacctataagcggagcggtataatggaggtggaccgcagcgaggccaaggagggcctgaagcgcggggagaccacgaaacatgccgtctcccgcgggaccgccaagctccggtggttcgttgagaggaacctggtgaagccggaggggaaagtcatcgacctgggctgcggacgcgggggttggtcatactattgcgcggggctgaagaaggtgactgaggtgaaaggctacactaaaggcggccccggccatgaggagcccatcccgatggcgacatacgggtggaacctcgtcaagctgcactccggcaaagacgtcttcttcataccccccgaaaagtgcgacacgctgctatgtgacataggggagagcagccccaacccgacgatcgaggagggccgcacccttcgcgtgctgaagatggttgagccctggctccgcgggaaccaattctgcatcaagatcctgaacccatacatgcccagcgtggtcgaaacgctggagcagatgcagcggaagcatggcggcatgctcgtccgcaacccgctgtcacggaatagcacgcacgagatgtattgggtgtcctgcggcaccggcaatatcgttagcgcggtcaatatgacctcccgtatgctgttgaacagattcacaatggcccaccgaaagccaacgtatgaacgcgacgtagacctgggcgccggtactcgacacgtggccgtcgagccagaggtggcgaaccttgacatcataggccagcgtatcgagaacatcaagcacgagcacaagagcacctggcactacgacgaggacaacccctacaaaacgtgggcctaccacggatcctacgaagtgaagccgagcggctcagcgagcagcatggtcaacggggttgtcaagctcctgaccaagccgtgggacgtgatccccatggtgacccagatcgccatgaccgacaccacgccgtttgggcagcagcgggtcttcaaggagaaggtggacacgcgcacccctaaagccaagcgggggaccgcgcagatcatggaggtgacagcccgctggctgtggggttttctttcgcggaacaaaaagccccgcatatgcacccgggaggaattcacccggaaggtccggagcaacgccgccatcggcgcggtcttcatcgatgagaatcagtggaactccgccaaggaggccgttgaggatgagagattctgggacctggtccacagggagcgtgaattacacaagcaagggaagtgcgcgacctgcgtttataacatgatgggcaagcgggagaagaaattaggggagtttgggaaggccaaagggtcacgcgcgatctggtacatgtggctgggcgcccggttcctggagttcgaagcactgggcttcatgaacgaggaccactggttctcccgggagaacagcctgtccggggtcgagggcgaggggctgcacaagctcggctacatcctgcgggatatcagcaagatccccggggggaacatgtacgccgacgacactgcgggttgggacacccgcatcactgaggacgacctgcaaaatgaggcgaagatcaccgacatcatggagcccgagcacgccctcctggcgaaggccatctttaaactgacatatcagaacaaggtcgtgcgggttcagagaccggctaagaacgggactgtcatggacgtgatcagtcgtcgggaccagcgcggcagcggccaggtggggacctacggcctcaataccttcacgaatatggaggcgcagctgatacggcagatggagtccgaggggatcttcagccccagcgagcttgagacccctaacctcgccgagcgcgtcctggactggctggggaagtacggggtggagagactcaagcgcatggcgatctctggggacgactgcgtggtcaagccgatagacgaccggttcgccacggccctgaccgcgcttaacgacatgggaaaagtgcgtaaggatatccctcagtgggagccctccaagggctggaacgactggcagcaggtccccttctgtagccaccacttccaccaactcatcatgaaagacggccgggagatagtcgtaccgtgccgcaatcaggacgagctggtggggcgggcccgcgtcagccagggcgcagggtggagcctgcgggaaacggcatgcttgggcaagagctatgcgcagatgtggcaattgatgtacttccaccgccgggacctgcgccttgccgccaacgctatctgttccgccgttccggtcgactgggtgcccacatctagaaccacttggtccatccacgcgcaccaccagtggatgacgaccgaggatatgctgagcgtgtggaaccgcgtatggatcgaggagaacccctggatggaggacaagacccatatctccaattgggaagacgtgccgtacctggggaaacgcgaggaccagtggtgcggaagcttaatcggcctgacggccagagccacgtgggcaacaaacatccaggtggcaatcaaccaggttcgccggctaatagggaacgagaattacctggactacatgaccagcatgaagcgcttcaagaacgagagcgaccccgagggcgcgttgtggtga

SEQ ID NO: 23749 - RNA, 9879 nt, synthetic construct
  misc_feature 1..9879: note = derived and/or modified CDS sequence (opt11) from DENV-1__JN903578__SS-prME
  source 1..9879: mol_type = other RNA
tccgtgaccatgctgttgatgctgctgcccaccgccttagccttccacctgaccacccgtggcggggagccccacatgatcgtgagcaaacaggagagaggcaagagcctactgttcaagacctccgtgggggtgaatatgtgcactctgatcgcgatggacctgggcgagctctgcgaggacactatgacctataagtgtccacgcatcactgaggccgagcccgacgacgtggactgctggtgcaacgccaccgacacttgggtgacctacgggacctgcagccagaccggcgaacaccggcgcgacaagagatcagttgcactggcgccccacgtcggcctggggctcgagacgcgcactgagacctggatgagctccgagggggcctggaaacagattcagcgcgtagagacctgggcactgcgccaccccgggttcacggtgatcgccctgttcctcgctcacgcgatcggtacatcgatcacccaaaaagggatcatctttatcctgctgatgctcgtcaccccctctatggccatgcggtgtgtgggtatcggcaaccgcgacttcgtggaggggctgagcggcgccacgtgggtcgacgtggtgctggagcacgggtcctgcgtcaccaccatggccaagaacaagcccaccctcgacatcgagttgctgaagactgaggtaacaaaccccgccgtgctccgtaagctgtgcatcgaagcgaagatcagcaataccaccacggactccaggtgcccgacccagggcgaggccactctggtcgaggagcaggacgccaacttcgtgtgccgtcgcaccttcgtagaccggggctgggggaacggatgcggcctcttcggcaagggaagccttctgacgtgcgccaagttcaaatgcgtcacaaaattggagggcaaggtggtgcagtatgagaacctgaagtactccgtcatcgtgaccgtccacaccggcgatcagcaccaggtgggcaacgagacgaccgaacacggcaccatcgccaccatcacgccacaggcgcccacgagtgagatccagctaacagactacggggccctcaccctggactgcagcccccggaccgggctggacttcaacgagatggtactcctcacaatgaaagagaagtcctggctggtccacaagcagtggttcctcgaccttcccctgccatggacctccggggccagcacgagccaggagacttggaaccggcaggacctcttagtgacgttcaagaccgcccatgccaagaagcaagaagtagtggtgctaggctcacaggagggcgcgatgcacaccgccctcaccggggccacggagatccagaccagcggcaccaccacgatctttgctgggcacttaaagtgtcgactgaagatggacaagcttaccctgaagggcatgagttatgttatgtgcaccggaagcttcaagctggagaaggaggtcgccgagacgcagcacggtacggtgctcgtacaggtcaagtatgagggcaccgacgcaccgtgcaagatccccttcctcatccaggacgagaagggggtgacccagaacggccggctgatcaccgccaacccgatcgtgactgacaaggagaagccggtcaacatcgagaccgagccgcccttcggtgagtcctacatcgtggtgggcgcaggcgagaaagccctgaagctctcccgcttcaagaagggatccagcatcggcaagatgttcgaggcgaccgcccgcggcgcccgccgcatggccatcctgggcgacaccgcctgggactttggttccatcggcggagtcttcacgtcggtggggaagctgatccatcaggtgttcggcacagcctatggggtcctattctccggagtgtcctggactatgaagatcgggatcggcatcctgttgacctggctcgggctcaacagccggagcacgtcccttagcatgacctgcatcaccgtgggaatggtaaccctatacctgggcgtgatggtgcaggccgattccgggtgcgtcatcaactggaagggtcgcgagctgaaatgcgggtccggcatcttcgtaacgaacgaggtgcacacctggaccgagcagtacaagtttcaggctgactccccgaaacggctcagcgccgccatcggcaaggcgtgggaggagggggtctgcggcatccgcagcgccactcggctggagaacataatgtggaagcaaatctccaacgagctgaaccatatcctcctggagaacgacatgaagttcaccgtggtggtcggagacgcgaacggcatcctggcccaggggaagaaaatgatccgcccccagcccatggagcacaagtacagctggaagtcctggggcaaggccaagatcatcggcgctgacatccagaacacgacctttatcatcgacgggccggacaccccggagtgccccgacgatcagcgggcatggaacatctgggaggtggaggattacggcttcgggatattcaccaccaacatatggctcaagctgcgcgacagctacacccagatgtgcgaccacagactgatgtccgccgccataaaggacagcaaggcggtacacgccgacatgggctactggatagagtccgaaaagaacgagacctggaagctcgcccgcgccagcttcatcgaaatcaagacttgcatctggcccaagtcccacacactgtggagcaacggcgtcctggagtcggagatgatcatccccaagatctacgggggcccgattagccagcacaatcaccggcccggctacttcacccaaacagccggcccctggcacctcgggaagctggagttggacttcgacgtatgcgagggtaccacggtggtcgtggacgagcactgcggcaaccggggaccgtccctccggaccacaaccgtcacgggaaagatcatccacgagtggtgctgccgcagttgtacactgcctcccctgcggttccgcggggaggacggatgctggtatgggatggagatccggccagtcaaggagaaggaggagaacctcgttcgctccatggtgtctgcgggctccggcgaggtcgacagcttcagcctgggcctgttatgcgtgtccattatgatcgaggaggtgatgcgttctcgctggtcccgcaagatgctgatgaccggcacacttgcagtcttcttcctcctgatcatgggccagctgacgtggaacgacctcataaggctgtgcatcatggtaggcgctaacgtgagtgaccgcatggggatgggcacgacctatctggccctcatggctaccttcaagatgcggccgatgttcgcggtcggcctgttgttccgccggctcacctcccgcgaggtgctgctgctcaccatcgggctaagcctggtcgcatccgccgagctccccaactctctggaggagctgggagacgggctagcgatgggcatcatgatgctgaagctgctcacggacttccagtcccaccagctgtggaccacgctgcttagcctgaccttcatcaagaccaccctgtccttggactacgcctggaaaacgatcaccatgatcctgagcatcgtatccctgttcccactctgcctgtcgacgacgagtcagaagacaacctggctgcccgttctcctgggcagcttcgggtgcaagccgctgactatgttcctcatcactgaaaacaagatatggggcagaaagtcttggcccctgaacgaggggatcatggcggttggtatcgtgagcatcctgctatccagcctgctgaagaacgatgtgcccttggccgggcccctgatcgccggcggcatgctgatcgcctgctacgtcataagtgggtccagcgccgatctctccttggagaaggctgccgaggtcagctgggaggaggaggccgaacactccggtaccagccacaacatcttagtggaggtgcaggacgacggcacgatgaagatcaaggacgaggagcgcgacgacaccttgactatcctgctgaaggccaccctccttgcggtgtcaggcgtctacccgatgagcatccccgccaccctgttcgtctggtacttctggcagaagaagaagcagcggtccggggtgctctgggacacccccagcccgccggaggtggagcgcgccgtcctggacgatggcatctaccggattctgcagcgcggcctgctcgggcggtcccaggttggcgtgggggtcttccaggacggcgtattccacacaatgtggcacgtgacccggggcgccgtcctgatgtaccagggcaagcggctggagcccagctgggcgtcagttaagaaggacctcatctcttacggagggggctggaggttccaaggatcctggaacacgggcgaggaggtgcaggtcatcgcggtggagcccgggaagaaccccaagaacgtccagactaccccaggcaccttcaagacgcccgagggcgaggtcggggctatcgccctggacttcaagcccggcaccagcgggtcccccatcgtaaacagggagggcaagattgtgggcctgtacgggaacggcgtcgtgacaaccagcgggacgtacgtgagcgctatcgcccaggcgaaggccagccaggaaggcccgctccccgagatcgaagacgaggtcttcaagaagcgcaacctgaccatcatggatcttcatcctgggagcggcaagacccggcgctacctcccggccatcgtgcgggaggccatcaagcgcaaactgcgcaccctgatcctcgccccaacgcgggtggtcgcctccgagatggctgaagccttaaagggcatgcccatcaggtaccagaccaccgccgtcaagagcgagcacaccggtcgggagatagtggacctgatgtgtcacgcgacgttcacgatgcgcctcctgtccccggtgcgggtgccgaactacaacatgatcataatggatgaggcccatttcaccgaccccgccagcatcgccgcccgcggctacatctccacccgggtggggatgggcgaggcggccgccatcttcatgacggccacgcctcccggctccgtcgaggctttcccgcagtccaatgcggtcatccaggacgaagagaaggacatccccgagcgctcatggaactccggctatgactggatcaccgacttccccgggaagaccgtgtggttcgtcccctctatcaaatccgggaacgacatcgcgaactgcctgcggaagaacggcaagcgcgtgatccagctcagccggaaaacgttcgacactgagtaccagaagaccaagaacaatgactgggactacgtggtcaccactgatatctccgagatgggggccaacttccgcgccgaccgcgtgatcgatccgcgccggtgcctgaagcccgtgatcttaaaggacggccccgagcgcgttatcctcgccgggcccatgccggtaacagtcgcgagcgccgcccagcggcgcggacggatcggccgcaaccagaacaaggagggggaccaatacgtttacatgggccagcctctgaacaacgacggggaccatgcccactggaccgaagcgaagatgctgctcgataacatcaacacccctgagggcatcataccggccctcttcgagccggagcgcgaaaagtccgcagccatcgacggggagtaccggctgcgcggcgaggcccggaagacgttcgtggagctcatgcgccggggcgacttgccagtctggctgagctacaaggttgcatccgaggggttccagtacagcgaccgccggtggtgcttcgatggcgagcgcaacaaccaggtgctcgaggagaatatggacgtcgagatctggactaaggagggggagcggaaaaagctgcgcccccggtggctggacgcccgcacctactccgaccctctggcactgcgggagttcaaggagttcgccgccggcagacggagtgtgagcggcgatcttatactcgagatcgggaaactgccgcagcacctaaccctccgcgcgcaaaacgccctcgataacctggtgatgctacacaactccgagcaaggtgggaaagcctaccggcacgccatggaggaactgcccgacaccatcgagacgctgatgctcctggccctgatcgccgtcctcacaggaggggtgacgctgttcttcctgagcggcaaggggctcgggaagacctccatcggcctgctgtgcgtgatggcctcctccgccttgctgtggatggcgagcgtcgagccccactggattgccgcctccatcattctggagttcttcctcatggtgctgcttatccccgaaccggacaggcagcggacgccccaggacaaccagctcgcgtacgtggtgatcgggctacttttcatgatactcaccgtggccgccaatgagatgggcctgctggagaccaccaagaaggacctcgggatcggccatgtggcggccgagaaccaccaccacgccacgatgcttgacgtcgacctgcgccccgcctccgcgtggaccctctatgcggtggccaccactgtgatcacgccgatgatgcggcacaccatcgagaacaccaccgctaacatctccctgacagccatcgccaatcaggcggccatcctgatgggcctcgacaaggggtggcccatcagcaagatggacatcggcgtccccctgctagccctcgggtgctattcccaagtgaaccccctgaccctgactgccgcggtcctcatgttggtcgcgcactacgcgatcatcggaccggggctgcaggccaaggcaaccagagaggcacagaagcgcacggctgccgggatcatgaagaatccgaccgtggacggcatcgtggccattgacctcgaccccgtcgtttacgacgccaagttcgagaagcagctgggtcagatcatgctgctgatcctgtgcaccagccaaatcctgctcatgcgcacaacgtgggcgctttgcgagtccatcacgctggccaccggccccttaaccacattatgggagggcagccccggcaagttctggaacaccaccattgccgtctccatggcgaacatcttccgcggcagctacctggcgggggcgggcctcgccttctccctgatgaagtccctaggcgggtcgcggcgcgggacgggggcccagggcgaaacgttgggggagaagtggaagaggcaactgaaccagctgagcaagagcgagttcaacacctacaagcgctccggcatcatggaggtcgaccggagcgaggctaaggaggggctcaagcgcggcgagaccaccaagcacgccgtgtcccgggggacagcgaagttgcgttggttcgtagagcggaacctggtcaagcccgagggcaaggtgatcgacctggggtgcgggcgcggcgggtggtcttactactgcgccggcttgaagaaagtgaccgaggtcaaggggtataccaaggggggccccgggcacgaggagcccatcccgatggccacctacggctggaacctagtgaagctgcactccggcaaggacgtgttcttcatcccgcccgagaagtgcgacaccctcctgtgcgacataggcgagagctcccccaaccccacgatcgaggaggggcggaccctgcgcgtcctcaagatggtggagccctggctgcggggaaaccagttctgcataaagatcttgaacccctacatgcccagcgtggtcgagaccctcgagcagatgcagcgaaaacatggcgggatgctggtgcggaatccgctctcccgcaactcaacccacgagatgtattgggtatcctgcggcacgggaaatatcgtcagcgccgtaaacatgacctcccgaatgctcctgaatcgcttcactatggcgcaccgaaagcccacctacgagcgggacgtggacctgggcgccggcacgcgccatgtcgccgtggagcccgaggtggcaaacttggatataatcgggcagcggatcgagaacatcaagaatgagcacaagtctacctggcactacgacgaggacaacccctacaagacctgggcctaccacggctcctacgaggtcaaacccagtgggtccgcgagctccatggtgaacggcgtcgtgagactgctgaccaagccttgggacgtgatcccgatggtcacgcagatcgccatgaccgacaccacgcccttcgggcagcagcgggtgttcaaggagaaggtggacacgcgcaccccgcgggccaagcgtggcaccgcccagatcatggaggtcaccgctaaatggctctggggcttcctgagccggaacaagaagccgcgcatctgcacgcgggaggagttcacacgcaaggtccggtcgaatgcggccatcggggccgttttcgttgacgagaatcaatggaattccgccaaagaggccgtcgaggacgagcgtttctgggacctggtgcacagagagcgagagctccacaagcagggcaagtgtgcgacctgcgtctataacatgatggggaagcgggagaagaagctgggcgaattcgggaaagccaaaggcagccgcgcgatctggtacatgtggttgggcgcccggttcctcgagtttgaggcgctggggttcatgaacgaggaccactggttctcccgggagaacagcctctccggggtggaaggggagggactccacaagctggggtacatcctgcgggatatcagcaagatccccggcggcaatatgtacgccgatgacaccgccgggtgggacacgcgcatcaccgaggacgatctccaaaacgaggccaagataaccgacataatggagccggagcacgccctgctggcgaccagtatctttaagctcacgtaccagaacaaggtggtccgggtgcagcgtcccgccaagagcggcaccgtgatggatgtcatctcacgccgagaccagcgcgggagcggccaggtgggcacctacgggctgaacaccttcacaaacatggaggtgcagctgatacggcagatggagtcagagggcatcttcctccccagcgagctggaaacccccaatttagccaagcgggtcctcgactggctggaaaaacacggggccgagcggctgaagcgcatggcaatctccggtgacgactgcgtggtaaagccgatcgacgaccgattcgcgaccgccctcaccgccctgaacgatatggggaaggtccgtaaagatatcccccagtgggagcccagcaagggctggaacgactggcagcaggtccccttctgctcccaccactttcaccagctgatcatgaaggacggccgggagatcgtggttccgtgccgcaaccaggacgagctcgtggggcgggcccgcgtgagccagggcgccgggtggtccctgagggagacggcgtgcctgggcaagagctacgcccagatgtggcagctcatgtacttccaccgccgggacctccgcctcgccgccaacgccatatgctctgcggttccagtggactgggttcccacctcccggactacctggtcgatccacgcccaccatcagtggatgactacggaagacatgctctccgtctggaaccgcgtgtggatcgaagagaacccctggatggaggacaagacccacgtgtcctcatgggaggaagtcccgtacctggggaagagggaggaccagtggtgtggcagcctgatcggcctcaccgcccgggccacctgggctacgaacatacaggtggccatcaaccaggtgcgccggctcatcgggaacgagaactacctggactacatgaccaccatgaaacgcttcaaaaacgagtccgatcccgaaggcgccctctggtag

SEQ ID NO: 23750 - RNA, 9879 nt, synthetic construct
  misc_feature 1..9879: note = derived and/or modified CDS sequence (opt11) from DENV-1__JN903579__SS-prME
  source 1..9879: mol_type = other RNA
agcgtgaccatgctgctgatgctgctgcccaccgccctcgccttccacctgaccacccggggcggggaaccccacatgatcgtgggcaagcaggagcggggcaagagtctgctgttcaagacctcggccggggtaaacatgtgtacacttatcgccatggacttgggggagctctgcgaagacaccatgacctacaagtgcccacggatcaccgaggccgaacccgatgacgtggactgctggtgcaacgccaccgatacctgggtgacctacgggacctgctctcagaccggggagcaccggcgtgacaaaagatcagtggccctggcgccccacgtggggctgggtctcgagacgcgcaccgagacctggatgtcctcggagggggcctggcggcagatccagaaggtggaaacctgggctctgcgccaccctggcttcaccgtaatcgccctgttcctcgcgcacgccattgggacctccatcacccagaagggaatcatcttcatcctgctgatgctcgttacccccagcatggccatgcgttgcgtaggcatcgggaaccgcgacttcgtggaaggcctgtccggggccacgtgggtggatgtcgtactggaacacggttcctgcgtgaccaccatggccaagaacaagccaacactcgacatcgagctgctgaagacggaggtcaccaacccagcggtgctcaggaaactttgcatcgaggccaagatctcaaatacaaccacggacagcagatgcccgacgcagggcgaagccaccctggtagaggagcaagatgcgaatttcgtctgcaggcgcacatttgtggaccgagggtggggcaatggctgcggcctcttcgggaagggttctttactgacgtgcgctaagtttaagtgcgtgacaaagctcgagggcaagatagtgcagtatgagaacctgaagtacagcgtgattgtcacagtccataccggtgaccagcaccaggtgggcaacgagacgaccgagcacgggaccatcgcgacgataacgccccaggcccctacgtccgagatccagttgaccgactacggcgccctcacactggactgcagcccgagaacagggctggacttcaacgagatggtgctcctgacgatgaaggagaagtcctggctggtgcacaagcaatggttcctcgatctgccgctcccctggaccagcggcgcgtccacctcacaggagacgtggaaccggcaggaccttttagtgacgttcaagacggctcacgcaaagaagcaggaggtcgtcgtgctgggcagtcaggagggtgcaatgcacaccgccctcacaggcgccactgagatccagacctccgggactaccaccatcttcgcggggcatctgaagtgcaggctgaagatggacaagctcaccctgaagggggtgagctacgtgatgtgcaccggctccttcaagctggagaaggaggtggccgagacccagcacggcacggtcctagtccaggtgaagtacgagggtaccgatgcgccgtgcaagatccccttctcaacccaggatgagaaaggggtcacacagaacggccgtcttataactgccaacccgatcgttacagacaaagaaaagcccgtgaacatcgagaccgagccgcctttcggcgagtcctacatcgttatcggcgccggggaaaaggcgctcaagttgagctggtttaagaaggggtccagcatcgggaagatgttcgaggccaccgcccgcggagctcggcgcatggcaatcctcggggacacggcttgggactttggctccattggcggggtgtttaccagcgttggcaaactggtccatcaagtgtttgggaccgcctacggcgtgctgttctctggggttagctggactatgaagatcggcatcggcatcctcctgacgtggctggggctaaattcccgttctacatctctgagcatgacgtgcatcgcagtaggcatggtgaccctgtaccttggggtcatggtgcaagccgacacgggctgcgtgatcaactggaaaggccgcgagctgaagtgcggcagcggcatcttcgtcaccaacgaggtccacacctggaccgagcaatacaagttccaagccgacagtccaaagcgcctgtcggcggctatagggaaagcatgggaggagggagtgtgcgggatacggagcgccacacgtctagagaacatcatgtggaagcagatctctaacgaactcaatcacatcctcctcgagaacgacatgaaattcacggtcgtggtaggcgatgccaacgggatcctgacacagggcaagaagatgatccgtccccagcccatggagcacaagtactcctggaagtcctggggcaaggcgaaaatcatcggggccgacacacagaataccacgttcataatcgacggccccgacacgccggagtgccccgacgaccagcgcgcatggaacatctgggaagtcgaggactacggattcggcatctttaccaccaacatctggcttaagctccgggactcctatacgcagatgtgcgatcaccgcttgatgagcgccgcgatcaaagactccaaggccgtgcacgccgacatggggtactggatagaaagcgagaagaacgaaacctggaagctagcccgggcctcatttattgaggtgaagacctgcatctggcccaggtcccataccctctggtctaacggtgtcctcgagagcgaaatgatcatccccaagatatatggcgggccgatctcccaacacaactaccgccccggctacttcacgcagaccgcagggccctggcacctgggcaagctcgagctggactttaacctgtgcgagggcaccaccgtagtagtcgatgagcattgtggcaaccgcggtccgagcctccggacgaccaccgtgaccggtaagatcatccacgagtggtgttgccgctcctgcacgctgccacccctgcggtttcgtggcgaggacggctgctggtacggcatggagattcggcccgtgaaagagaaggaggagaacctagtccgctcaatggtatccgcgggatctggggaggtagactccttcagcttgggactgctatgtgtctcaatcatgatcgaggaagtgatgagatcgcgctggagccgcaagatgctgatgaccggcacactggccgtattcttcctcctgatcatgggccagctgacgtggaacgacctaatacgtctatgtatcatggtcggggccaacgtgtcagaccgcatgggcatgggaacgacatatctggcattaatggcgaccttcaagatgcggccgatgttcgccgtggggctactcttccgcaggctcacctcgcgggaggtcctgcttttaactatcggcctgtccctggtggccagcgccgagctccctaactccctcgaggaactgggagacggcctcgccatgggtatcatgatgctgaagctgcttaccgacttccagtcccaccagctctggacaaccttgctctccctgacgttcataaagaccaccttgagcctcgactacgcgtggaagaccatcgcgatgatcttgtccatcgtttctctgttccctctctgcctgtccactacgagccagaagaccacctggctgcccgtgctcctggggtccttcggctgcaagccgctgaccatgttcctcatcacggagaacaagatctgggggcggaaaagctggcccctgaatgagggcatcatggccgtggggatcgtctccatccttctaagctccctgctgaagaacgacgtgcccctcgccggccccctgatcgcgggcgggatgctgatcgcctgctacgttatcagtggaagctccgccgaccttagcctagagcgcgccgcagaggtatcgtgggaggaggaggctgagcacagcggggcctcccacaacatcctggtggaggtacaggacgatggcaccatgaaaattaaggacgaagaacgggatgacacgttaaccatattgctcaaggccaccctcctggccgtcagcggggtgtatcccatgtccatccccgcaaccctgttcgtgtggtacttctggcagaagaagaaacagagaagcggcgtcctgtgggacaccccgtcgccgcctgaggtggaacgggcggttctggatgacggcatctaccgcatcctacagcgaggcctcctcggccgctctcaagtcggggtgggcgtgtttcaggacggtgtcttccacaccatgtggcacgtgacccgtggcgcagtgttgatgtaccagggcaaacgcctggagccctcctgggctagcgtcaagaaggacctcatatcctacggtggtgggtggcggtttcaagggagctggaacaccggggaggaggtccaggtgatagcggtcgagcccggcaagaaccccaagaacgtgcaaaccacccccggtaccttcaagacccccgaaggggaggtgggcgctattgccctggacttcaagccggggacctccggcagccccatcgtcaacagagagggcaaaatcgttgggctttacggcaacggggtggtcaccacgtccggcacctatgtgagcgccatcgcccaggcaaaggcctcgcaggaggggccgctccccgagatcgaggacgaggtgttcaagaaacggaacctcaccatcatggacttacacccagggagcggcaaaacacgtcggtacctcccggcgatcgtacgcgaggccatcaagaggaagctgcggacgctgatactggccccgacccgcgtggtggccagtgaaatggccgaggccctaaagggtatgcccatccggtatcagacgaccgccgtgaaaagcgagcatacgggccgcgagatcgtggacctgatgtgccatgcgacctttacgatgaggctccttagccctgtccgcgtccctaactacaacatgatcattatggacgaggctcacttcactgaccccgcaagtatagccgcccgggggtacatctccacgcgcgttggaatgggagaggccgccgcgatcttcatgaccgcaacgccgcccggctcggttgaggccttcccgcagagcaacgccgttatccaggacgaggaacgggatatccccgagcgcagctggaacagcgggtacgactggataaccgacttccccggtaagacggtgtggttcgtgcccagtatcaaaagcggcaacgacatcgcaaattgcctgcggaagaacggtaaaagagtgattcagctctcccgaaagacaatcgataccgagtatcagaagacaaagaataacgactgggactatgtggtgacgaccgacatcagtgagatgggtgcgaatttcagggccgaccgggtcatcgacccaagacggtgtctgaagccagtgatcctgaaggacgggcccgagcgcgtaatcctcgccggccccatgcccgtcaccgccgcatcagccgcccagcgacgcggccggatcggacggaaccagaacaaggaaggcgaccagtatatctacatggggcagcccctgaacaacgatgaagatcacgcgcactggacagaagccaagatgctgctcgacaacatcaacacacctgaaggtatcatcccagctctgtttgaaccggagagagagaaatccgcggctatcgacggggagtatcggctgcgtggagaggcccgaaagaccttcgtagagctcatgcgccgaggggacctgcccgtctggttgagctacaaggtggccagcgagggctttcagtactcagaccgccggtggtgtttcgacggcgagcgcaacaatcaggtgctcgaggagaacatggacgtagagatctggaccaaggagggggagcggaagaagctgcgcccccggtggttagacgccaggacctacagcgaccccctagccctgcgggagttcaaggagttcgccgcgggccgccggtccgtgagcggggatctcattctcgagatagggaagttgccacagcacttgaccttgcgcgcacagaacgcgttggacaacctggtgatgctccacaacagcgagcagggcgggaaggcctaccggcatgccatggaggagctgcccgacacgatcgagacgctgatgctcctggccttaatcgcggtcctcacaggaggggtgaccttgttcttcctatcaggcaaaggcctcgggaaaaccagcatcggcctgttgtgtgtgatggcctcctcggtcctcctgtggatggcctccgtggagccccattggattgctgccagcatcatcctggagttctttctcatggtgctgctgatccccgagccggatagacagcggactccccaggacaatcaacttgcgtacgtcgtgatcggttcactgttcatgatcctgactgtggccgccaacgagatgggcctactggagaccacgaagaaagatctcgggatcgggcacgtcgtagccgagaaccaccatcacgccactaccctcgacatcgacttgcaccccgcgagcgcctggaccctgtacgccgtggccacgaccattatcactccgatgatgcgccatacaatcgagaacaccaccgccaacatatccctcacggcgatcgccaaccaggcggctatcttgatgggtctcgacaaggggtggcccatcagcaagatggacataggggttcccctcctagctctggggtgctactcccaggtgaaccccctcacactgacggccgcagtgctcatgctcgtcgcccactacgccatcattggcccggggctgcaggcgaaggccaccagagaggcgcagaaacggaccgccgcggggattatgaagaaccccacggttgacgggatcgtggccatcgacctggaccccgtcgtgtacgatgccaagtttgagaagcagctcgggcagatcatgctgctgatcctctgtacgtcgcagatcctgctgatgcgcaccacctgggccctctgcgaatccatcactttggccacgggtcctctaaccaccctctgggaggggagcccggggaagttttggaacaccaccattgcagtgtccatggcgaacatcttccggggcagctacctggccggagccggactggccttttccttaatgaagtccctcggcggcgggcgccggggcacaggtgcccagggagagaccctgggcgagaagtggaaacgccagcttaatcagctgtccaagagcgagttcaacacctacaaacgtagcgggatcatggaggttgaccgcagtgaggcgaaggagggcctgaagcgcggggagaccacaaaacacgccgtgagccgcggtaccgccaagctcaggtggttcgtggagcgcaatttagtcaagccagaggggaaggtgatcgaccttgggtgtggccgcggcggttggtcctactactgcgccggtctgaaaaaggtgaccgaagttaaaggctacaccaaaggaggtccaggtcacgaggaacccatcccgatggcgacctacgggtggaacatcgtaaagctccacagtggtaaagatgtgttcttcaccccgcccgaaaagtgcgacaccttactgtgcgatatcggggagtcttctcccaacccgaccatcgaggagggccgcaccctcagggtcctcaaaatggttgaaccctggctacgtggcaaccaattctgcattaagattctcaatccctacatgccctccgtggtggagaccctggagcagatgcagcggaagcacgggggcatgttagtacgtaacccgctcagccggaactccacacacgagatgtattgggtcagctgcgggaccggcaacatcgtttctgccgtgaacatgacgtcgcggatgctgctgaatcgcttcaccatggcccaccgaaagcctacctacgagcgcgatgtggatttgggcgccggcacccggcacgtcgccgtggagccagagatagcgaacctggacatcatcggccaacgcatcgagaatatcaagaacgagcacaagtccacgtggcactacgacgaggacaacccctacaaaacgtgggcataccacgggagctacgaagtgaagccgtccggcagcgcttccagcatggtcaacggggtggtgcgtctgctcactaagccctgggatgtaattcccatggtgacccagatcgccatgacagacaccaccccctttggtcagcagcgcgtcttcaaagagaaggtcgacacaagaacgccgcgccctaagcgaggtacagcacagataatggaagttacggccaagtggctatgggggttcttatcccgcaacaagaaaccccggatctgcacccgcgaggagttcacgaggaaagtccgcagcaacgccgcaatcggcgccgtattcgtggacgagaatcagtggaacagtgccaaggaggcggtagaggatgaacggttctgggacttggtgcaccgggagcgggagcttcacaagcaggggaagtgcgctacgtgcgtttacaacatgatgggcaagcgagagaagaaactgggagagttcggcaaggcaaaaggctcccgggccatttggtacatgtggctgggggctcgcttcctggagttcgaggccctaggcttcatgaacgaggaccactggttcagccgggagaactccctcagcggggtcgaaggcgagggtctgtacaaacttggctacatcctacgcgacatctcgaagatcccgggagggaacatgtacgctgacgacaccgccggctgggacacccggatcacagaggatgacctgcagaacgaggccaaaataaccgacatcatggaacccgagcatgcgctgcttgcgacaagcatcttcaaactgacctaccagaacaaggttgtgcgggtccaaaggcccgccaagtccgggacggtgatggacgttatctcgcggcgcgaccagcggggctcgggtcaggtcgggacgtacggtctgaacacattcaccaacatggaggtgcagctcatccgccaaatggaaagcgaggggatcttctcccccagcgagctggagaactctaacctggcagaaagggtgcttgactggctggagaagcatggggtcgagcgcctgaagcgcatggccatcagcggagatgactgcgtggtgaagccgaccgatgaccgcttcgcgaccgcccttaccgcgctgaacgacatgggaaaggtcaggaaggacattccacagtgggagccgtctaagggatggaacgactggcagcaggtccccttctgcagccaccactttcaccagctgattatgaaggatgggcgcgagattgttgtcccgtgccggaaccaggacgagctcgtcggccgcgcgcgtgtctcccagggggccggctggagcctgcgcgagaccgcgtgtctgggtaagagctacgcccagatgtggcagctcatgtatttccaccggcgcgacctgcgcttggccgccaatgctatctgctcagcggttcccgtgaactgggtgcctacaagccgcacgacctggagtatacacgcccaccaccagtggatgaccaccgaagacatgcttagcgtctggaatcgcgtgtggatcgaggaaaacccctggatggaggataagacgcacgtctcaagttgggaggacgtgccgtacttgggcaaacgggaggaccagtggtgcggcagcctgatcgggctcaccgcccgcgccacctgggccaccaatatccaggtcgccatcaaccaggtgcggaggttaattggcaacgagaactacagcgactacacgacctccatgaagagattcaaaaatgagagcgatcccgagggtgccctgtggtag

SEQ ID NO: 23751 - RNA, 9879 nt, synthetic construct
  misc_feature 1..9879: note = derived and/or modified CDS sequence (opt11) from DENV-1__JN903580__SS-prME
  source 1..9879: mol_type = other RNA
agtgtgacaatgcttttaatgttgctaccaacggcactagcgttccacctcaccacccgcggaggggaaccgcacatgatagtgagcaaacaggaacggggcaagagcttgttattcaaaaccagcgccggggtgaatatgtgcacactaatagctatggatctaggggagctatgcgaagacacaatgacctacaaatgcccgcgcatcacggaagccgaaccagacgacgtcgactgctggtgtaatgccaccgacacctgggtaacgtacgggacttgctcacagaccggggagcacagaagagataaacggagcgtagcactcgcacctcacgtggggttaggcctcgagactcgcacggagacatggatgtcctccgagggagcatggcggcagatacaaaaagtagaaacatgggcactacgtcacccaggtttcactgtcatcgccctgtttctcgcccacgccataggcacatcaataacacagaaaggcataatcttcatactactaatgttggtaacgcctagcatggcaatgcggtgtgtcgggatcggcaacagagactttgtcgaaggccttagcggagcaacctgggtggacgtcgtcctggagcacggctcgtgcgtaaccacaatggcgaaaaacaaaccgactctcgatattgagctcctgaaaacagaagtaacgaacccagccgtcctcagaaaattgtgcatagaagcaaaaatctcgaacaccactacggacagccgatgtcccactcaaggggaggccaccttggtggaggaacaggacgcaaatttcgtatgccgcagaacctttgtcgacagaggctggggcaacggatgcggactcttcggcaaaggctcgctactaacctgcgcgaaatttaaatgtgtaacaaaactggagggcaaaatagttcagtacgaaaacctaaaatactcagtgatcgtcacagtacacacaggcgaccaacaccaggtaggtaatgaaacaacagagcatggtaccattgccacgataacaccgcaagcccctacctctgagattcagcttactgattacggcgcactcaccttagactgttcgccgagaacgggtttagactttaatgagatggtattgctgacaatgaaagaaaaatcatggctagtccacaaacaatggttcctcgatctcccgctaccctggacgagcggagcaagcacatcacaagaaacgtggaatcggcaagacctattagtcacattcaaaaccgcccacgcgaaaaagcaggaagtagtggtcctcggctcccaagaaggcgcgatgcatacagcactgacaggagcaacagaaatacaaacaagcggtaccacaaccatattcgcaggacatttaaaatgccgcctgaaaatggacaaactcaccctcaagggagtatcgtacgtaatgtgcaccgggtcattcaaactcgagaaagaagtggcggagacccaacacggtaccgtattggtacaggtgaaatacgaaggtaccgatgcgccctgcaaaatacctttttcaacccaagacgaaaagggcgtaacacaaaacggccgtctaatcactgctaaccctattgtaacagacaaggagaagcccgttaacattgagaccgaaccaccattcggagaaagttatatcgtgattggagctggggagaaagcactcaaattgtcatggttcaaaaagggttcatctataggaaagatgttcgaggcaactgctcgaggcgcacgacgaatggcaatactaggcgatacagcctgggactttggtagtatcggaggcgtattcacctctgtaggcaagttagttcaccaggtattcgggactgcttacggagtcctcttttcaggagtctcgtggacaatgaagatagggataggcattctattaacgtggctagggttaaacagtaggaacacgtcactatccatgacctgcatagccgtgggaatggtgactttatacctcggagtcatggtgcaagcggacacgggatgcgtgatcaactggaaagggagggaattaaaatgtggttccgggatcttcgtcaccaacgaagttcacacttggacggaacagtataaattccaagctgatagcccaaaacgcctaagcgccgccataggtaaagcatgggaggaaggggtgtgcggtattcgaagcgcaacccgactagaaaacatcatgtggaaacagatcagcaacgagttgaaccacatcctcctggaaaatgacatgaaattcacggtcgtcgtcggggacgcaaacggaatactcacacaaggcaagaaaatgattcgaccgcaacccatggagcacaaatactcatggaaatcatggggaaaagcgaagatcatcggagccgacactcaaaacacaaccttcatcattgacggaccagatacccctgagtgcccagacgaccagagggcctggaatatctgggaggtagaagactacggcttcggcatattcacaacgaacatttggctaaagctaagagacagttacacgcaaatgtgtgaccatcgactaatgtcagccgccatcaaggacagtaaggcagtccacgcggacatgggatactggattgagtcggaaaagaacgagacgtggaaacttgcccgagcctctttcatcgaagtcaagacctgcatatggccccgctcccacaccctctggtcgaacggagtgttagagagcgaaatgatcattcctaaaatatacggagggccaatatcgcaacataactaccgcccagggtacttcacccaaacagcaggaccctggcacctaggcaaattggaactagacttcaacctctgcgaaggaaccacggtagtagtcgacgagcactgcggaaacagagggccgagcctacgaaccacaactgtaaccggaaagatcattcatgaatggtgctgtcgaagctgcacacttccccctttacgcttccgcggggaagatggatgctggtacgggatggaaataagacccgtcaaagaaaaagaagaaaacctcgtccgatcaatggtctcggcagggtcgggagaggtcgattccttctcgcttggactactatgcgtcagcatcatgatagaggaggtgatgaagagtcgatggtccaggaagatgttgatgacgggaactctcgccgtatttttcctgctaataatggggcaactaacttggaatgacctgatacggctatgcatcatggttggcgcaaacgtaagcgaccgcatgggcatgggaacaacgtacctcgcgctgatggcaaccttcaaaatgcgaccaatgtttgcggtagggctgctatttcgaagactgaccagtcgagaggtattactgctaaccattggcttgtctctagtagcatccgcagaactaccaaacagtctcgaggaacttggggacggactagcaatgggcatcatgatgttaaaactgctgactgacttccaatcacaccagctatggacaacactactatcgctgaccttcattaaaactaccctaagcctagactacgcatggaagaccatagcaatgatactgtcgatagtaagcctatttcccctatgtctctcgacaacaagtcaaaagaccacctggcttccagtactgttaggtagcttcggctgcaaacccctgactatgttcctaatcacggaaaacaagatctggggacgcaaaagctggccacttaatgagggaatcatggccgtcggaatagtcagcattctactgagtagcctacttaaaaacgacgtgccgctagcgggtccgctaattgcgggaggcatgttgatcgcctgttacgtaataagtggcagcagcgcagacctgtccctggaacgagctgcagaggtgtcatgggaagaagaagccgaacattccggcgcttcacataacatcctcgtggaggtacaggacgacggaactatgaagatcaaggatgaggagagagacgatacactcaccatcctactgaaagcaacgctcctagcaatatccggagtataccccatgtcgataccggcgacgttgttcgtgtggtacttctggcaaaagaagaaacaacggtcaggcgtactgtgggacacgccatcgccaccggaggtggaacgagcagtcctcgacgatggaatatatcgaatactacaaagaggcctactgggccgatcacaggtaggggtcggcgtattccaagatggcgtcttcaggacgatgtggcacgtaaccagaggggccgtactcatgtaccagggaaaacggctagaaccgagctgggcctcagtaaagaaggacctcatcagctacggtggagggtggagattccagggatcatggaacacgggagaagaggtccaggtgatcgccgttgagccgggcaaaaatcccaaaaatgtgcagacaacacccggaacattcaaaactcctgagggggaagtgggagcaatagccttagacttcaagcccggtacctctggaagtccaattgtaaacagggagggcaaaatagtgggactctacgggaacggagtagtcacaaccagtggtacatatgtatcagcaattgcccaagcaaaagcatcccaggaaggtccgctacccgaaatcgaggacgaagtttttaagaaacggaacttaaccataatggaccttcacccgggaagcggcaaaacacgacggtatttaccagcaatagtacgtgaggcgattaagcgaaaactccgcactctgatactagcacccacgcgtgtagtagcgtccgaaatggccgaggccctaaaaggaatgccgattaggtaccaaaccacggccgtcaagagcgagcatacggggcgagaaatcgtagaccttatgtgccacgcgacattcaccatgcggttgctatctccagtacgcgtgccaaactacaacatgatcatcatggacgaagcgcatttcacggatccagcatccatagctgcccgcggctatatcagcacaagagttggaatgggcgaagccgctgcaatattcatgactgcgaccccgccggggtctgtagaagcgttcccccaaagcaacgccgtgatccaggatgaagaaagagacatacccgagcgaagctggaactcgggatatgactggataacggacttccctgggaagaccgtgtggttcgtcccgtcaataaagtcaggaaatgatatcgcaaactgtctgcgaaagaacggcaaacgggtaatccaactatcaaggaagacttttgacacggaataccagaaaaccaagaacaatgactgggactacgtagtaacaacagatatcagcgaaatgggtgccaacttccgggcagatcgcgtcatagatccaagaaggtgcctgaagccagtcattcttaaagacggacctgagagggtcatcttagcagggccgatgcccgtaacggcagcgagcgcagcacaaagacgggggcggattggtcgcaatcaaaataaggagggcgaccagtacatatacatggggcagccactcaataacgacgaagatcacgctcactggacagaagccaaaatgctgttagacaacatcaacacgccagaaggtatcatacctgcgctctttgaacccgagcgagagaaaagcgccgccatcgacggagaatatagactgagaggtgaagccagaaagaccttcgtcgaattgatgcgacgaggggacctaccagtgtggctctcgtataaggtcgcatcagaagggtttcaatacagcgaccggagatggtgcttcgatggggaaaggaataaccaggtactagaggaaaatatggacgtagagatctggaccaaggagggcgaaaggaagaaactacgaccgcgctggctagacgcaaggacatattcagacccgttggcactgcgggagttcaaagaatttgctgccggacgccgcagcgtatcaggggatctaatcttggaaatcggcaaactccctcaacacttaacgttacgagcgcagaacgcactggacaacctcgtgatgttacataacagcgaacaaggcggaaaggcttaccgccacgcaatggaggagctgccagacacaatcgaaaccctcatgctcctcgccctcattgcagtactaacagggggcgtcacactcttcttcctcagcggcaagggtttgggaaagacttccattggcctattatgcgtcatggcctcgtcggtactactatggatggcaagcgtcgagccacattggatagcagcgagtattatcctcgagttcttcctaatggtactcctcatacccgaacccgaccgacagaggacaccccaagataaccagctcgcctatgtcgttatagggctgttgttcatgatcctgaccgtagcggcaaacgagatgggtctcctcgagaccactaagaaggacctcggtattgggcacgtcgtcgccgaaaaccatcaccacgcaactatgctagacatagacttgcacccggcgtctgcatggacactatatgcagttgcaacaacaataatcactccaatgatgcgacacaccatagagaacacaaccgcaaacatctctctcacagccatcgcgaatcaagccgcaattctaatgggtctagataagggatggcctataagcaaaatggacattggagttcccctgctggcgctcgggtgctactcacaagttaatcccctgactctcaccgccgccgtgctgatgttagtcgcacactacgcgattatcggaccgggactacaagcaaaagcaaccagggaagcgcagaagcgcacagcggcgggtattatgaaaaacccgacggtggatggcatcgtggcaatcgacctagacccagtagtatatgacgccaaattcgagaaacaacttgggcaaattatgctccttattctctgcacatcccagattctgctcatgcggacaacctgggccctatgcgaaagtatcacactagcaacaggcccactcacaaccctatgggagggatcccccgggaagttctggaacaccacaatcgccgtctcgatggcaaacatcttccgaggatcgtacctcgcaggagcgggcttagccttcagtctcatgaaatccttaggaggtggaagacgggacacaggagcacagggggaaacactaggcgagaaatggaaacgacagctaaatcagctcagcaagccggagttcaacacgtacaagaggagcgggattatggaggtggacagatcagaagccaaagaaggtctcaagaggggagagacaacaaaacatgcagtaagccgtggtacggcgaaattgcgctggttcgtcgaacgcaacctcgtcaaaccagagggcaaagtcatcgacctagggtgcgggcgaggagggtggagctactactgcgcaggacttaagaaagtgaccgaggtcaagggatacaccaaaggcggaccaggccatgaagaacctatccccatggctacctacggttggaacatcgtcaaactccatagcgggaaagatgtcttcttcacaccgccagaaaaatgcgatacactactatgcgacattggcgaatcctcgccaaatcctaccatagaggaggggcgcaccctccgggttctaaaaatggttgagccatggctgcgaggaaaccaattctgcatcaaaatactgaatccttacatgccatctgttgtcgaaaccctagaacaaatgcaacggaaacacggaggaatgctagttaggaacccgttatcaaggaacagcacacacgagatgtattgggtcagctgcggcacggggaacatcgtctcggccgttaacatgacatcgcgcatgttactaaacagattcacgatggcgcatcgaaagcccacatacgagcgtgacgtggaccttggggctggaacaagacacgtcgcagtagagccagagatcgcaaacttagacataattggacagcggatggagaacataaagaacgagcacaaaagtacatggcattacgacgaggacaacccctataagacgtgggcttaccacggctcgtacgaagttaaaccgagcgggtcggccagcagcatggtaaacggtgtggtacgactactgaccaagccatgggacgtaatcccaatggtaacccaaatagctatgacggacacaaccccttttggccagcaaagagtctttaaggaaaaggtagacacccgaacgcccaggccaaaacgtggaaccgcgcagataatggaagtaacggctaagtggctatggggcttcctatcaagaaacaagaaaccgcggatctgcactcgagaggaatttaccagaaaagtgagatccaacgcagcgatcggagcagtcttcgttgacgagaaccagtggaactcggcaaaagaagccgtcgaggacgagcgattctgggacctggtacaccgcgagagggagctgcacaagcagggaaaatgcgcgacctgtgtgtataacatgatgggaaagagagagaagaaactgggagagttcggaaaggcgaagggatcacgagccatctggtacatgtggttaggggccagattcctcgagttcgaggccctagggtttatgaacgaagaccactggttctctcgcgaaaactccctcagtggggttgaaggagaaggcctatacaaactggggtacatcttgcgagacataagcaaaatcccagggggaaacatgtacgcggacgacacggcgggttgggacacccgaatcacagaagacgatctccagaacgaggcgaaaattactgatattatggagccagagcatgccctactagcgaccagcatcttcaaactgacataccaaaacaaggttgtccgcgtccagcgaccagcgaaaagcggaaccgtgatggacgtaataagccggagagaccagagaggatcggggcaggtcggaacttacggcctaaacactttcacaaacatggaggttcaattgataaggcaaatggaaagcgaaggcatcttttcgccatcagaacttgagaactcaaatctagccgaaagagtgcttgactggctggagaaacacggagtcgaacgactcaaacggatggcaattagcggagacgactgcgtcgtgaaaccaaccgacgaccgcttcgccactgccctaacggccttaaacgacatgggcaaggtcagaaaggacataccccagtgggaacccagcaagggatggaacgattggcaacaagtcccattttgctcccaccactttcaccagttaatcatgaaagatggccgggaaatagtcgtcccatgtcgtaaccaggacgagctcgtaggtcgagcccgcgtctcccagggagccggctggtctctccgggagacagcgtgcctcgggaaatcctacgcccaaatgtggcaactgatgtactttcatcggcgagatcttagacttgccgcgaacgcaatctgctcagcggtcccagtgaactgggtaccaacatcacgtacaacgtggtctatacacgcccaccatcaatggatgacgaccgaggacatgctatccgtgtggaacagggtctggatagaagaaaacccatggatggaggacaagacgcacgtttcatcgtgggaggacgtaccatacttgggtaagcgagaagatcaatggtgtgggagcctcatcggcctcaccgcccgcgcgacctgggctaccaacatccaggtggccattaaccaagtcagaaggctaatcggcaatgaaaactattcggactacatgacctcgatgaaacgattcaagaacgagtctgaccccgaaggggccctatggtga

SEQ ID NO: 23752 - RNA, 9879 nt, synthetic construct
  misc_feature 1..9879: note = derived and/or modified CDS sequence (opt11) from DENV-1__JN903581__SS-prME
  source 1..9879: mol_type = other RNA
tcagtcaccatgctgttaatgttacttcccacagcacttgccttccacctaacaacccgcggcggggagccccacatgatcgtgtccaagcaggaacggggcaagagcctcctgttcaagacctccgccggggtcaacatgtgcaccctgatagctatggacctgggcgaactctgcgaggacacgatgacctacaagtgcccccgcatcaccgaggccgagcccgatgacgtggactgttggtgtaacgccaccgatacctgggtaacctacgggacctgcagccaaaccggcgagcatcggcgcgataagaggtccgtagccctggcgccacacgtgggcctggggttggaaacccgtaccgaaacctggatgtcttccgagggcgcctggcgacagatccaaaaggtggagacctgggcactgcgtcatcccgggttcacggtgatcgccctattcctcgcgcacgctattggcacatccatcacccagaaggggatcatctttatcctgctgatgctcgtgaccccctccatggccatgaggtgtgtcggcatcggcaaccgcgatttcgtagaggggttaagcggcgctacgtgggtagacgtcgtgcttgagcacgggtcttgcgtgaccaccatggccaaaaacaagccaaccctcgacatcgaactgctaaagacggaggtcaccaaccccgcggtgttacgcaagctgtgtatcgaggccaagattagcaacaccaccacggattcgcgctgtccaacccagggagaggccaccttggtggaagaacaggacgccaatttcgtatgccggcgcacctttgtggaccggggctggggcaacggctgcgggctctttggaaaggggtcgctgctgacatgcgccaagtttaagtgtgtgaccaagttagaggggaagatcgtacaatacgagaacctgaagtactccgtgatcgtgaccgtccacacaggcgatcagcaccaggttgggaacgaaacgactgaacacggtaccatagcgactatcacgccccaggcgcccacgagcgagatccagctgaccgactacggtgcgctcaccctggattgtagcccccggaccggcctggacttcaatgagatggtcttactgacgatgaaggaaaagtcctggctcgtgcacaagcagtggttcctggacttacctttgccctggacgtccggggctagcaccagccaggagacatggaaccggcaggacttactggtaacgttcaagaccgcccacgccaagaagcaggaggtcgtggtacttggctcgcaggagggcgccatgcacaccgccctcaccggggccaccgaaatccaaacctctggcacaaccacgatctttgcagggcacctgaagtgccgcctgaaaatggacaaacttaccctaaagggagtctcctatgtgatgtgtaccgggagcttcaaacttgagaaggaggtggcggagacccagcacgggacagtccttgtccaggtgaagtacgagggaacggacgccccctgcaaaatccctttctccacccaggatgagaagggagtcacccagaacggccgcctcatcaccgccaatcccatcgtgaccgacaaggagaaacccgtgaacattgagaccgagccgcccttcggtgagtcctacatcgtcattggcgccggcgagaaagcgctgaaactgtcctggttcaagaaggggagttccatcggaaagatgttcgaggccacggcccgcggggcacggcgcatggcgatacttggcgacacagcgtgggatttcgggagtataggcggcgtgttcacatccgtgggtaagctggttcaccaagtgttcgggactgcgtacggggttctgttcagcggcgtctcctggacgatgaagatcgggatcggaatcctcctgacttggctgggcctcaacagccggaacacctccctgtccatgacgtgcatcgccgtcggtatggtgaccctgtacctgggtgtcatggtacaggccgacacagggtgcgtaatcaactggaagggccgagagttaaagtgcgggtccggcatcttcgtgaccaatgaggtacatacatggacggagcagtacaaattccaggctgactcgccaaagcggctctccgcggccataggcaaagcctgggaggagggggtgtgcggcatccgtagcgccacgaggctcgagaacattatgtggaagcagatcagcaacgagctgaaccacatcctgctcgagaacgacatgaagttcactgtggtagtaggggacgcaaacggcatcttaacccaggggaaaaagatgatccgaccacagccgatggagcataagtactcctggaagtcatggggcaaagcgaagatcatcggcgccgacacacagaatacgacgttcatcatcgacgggcctgacaccccggaatgccccgacgaccaacgcgcctggaatatctgggaggtcgaagactatggcttcgggattttcacgaccaacatatggctgaagctcagggactcgtacacccagatgtgcgatcatcggctgatgagcgccgtgatcaaggactccaaggcggtgcacgccgacatgggatactggatcgagagcgagaagaacgagacctggaagctggcccgcgcctccttcatcgaggtcaagacatgcatctggccccgcagtcacaccctctggtccaacggcgtgctggagagcgagatgatcatccctaagatctacggcggccccatcagtcagcacaactatcggcccggctacttcacgcagaccgccgggccctggcacttggggaagctcgagctggacttcaacctgtgcgagggcaccactgtggtagtggacgaacactgtggcaaccgcgggccgagcctcagaacaaccaccgtgaccggcaagataatccacgagtggtgttgccgttcctgcaccctgccgcccctgcggttccgcggggaggatgggtgctggtacgggatggagatccggcctgtcaaggaagaggaggaaaatctcgtgcgctcaatggtgtctgcgggctcgggcgaagtcgatagtttcagcctggggctgttgtgcgtgtccatcatgatagaggaggtgatgaaatcccgttggagcaggaagatgctgatgacgggcaccttggccgtcttcttcctcttaatcatggggcagctgacctggaacgacctcattcgcctgtgtatcatggttggcgctaacgtgtccgaccgcatggggatggggacgacgtatttagccctcatggccacgtttaagatgcgcccgatgttcgcggtcgggctgctgttccggcgactcacaagccgggaggttctgctgctcacaatcgggctgtccctggtcgccagcgccgagctccccaacagtctggaggaacttggcgacggtctcgccatgggcatcatgatgctgaagctgctcgccgatttccagagccaccagctatggaccaccctgttatcccttaccttcatcaagacgaccctgtccctcgactacgcgtggaagaccatcgctatgatcctgtccatcgtgagtctcttccccctctgcctgtccacgacaagccagaagaccacctggctccccgttctcctgggctcattcggctgcaagccgctgaccatgttccttatcaccgagaacaagatctggggccgcaaatcgtggcccctgaatgaagggatcatggccgtcggcatagtgtccattctgctcagctccttattaaagaacgacgtgcccctcgccggtcccctgatcgctggcggaatgctgatcgcctgctacgtcatcagcgggagctccgccgatttatcgctagagcgggctgccgaggtctcctgggaggaggaggcggagcacagcggcgcctcacacaacatcctagtggaagtccaggacgacgggacgatgaagataaaggacgaggagcgcgatgacacgctcaccatcctgcttaaagctaccctcctagccatttctggcgtgtacccaatgtccatccccgccacgctgttcgtgtggtacttctggcagaagaaaaagcagaggtccggggtcctttgggacacccccagcccgcccgaggtagagcgcgcggtgctggacgatggcatctaccggatcctgcagcgcggcttgctcgggcggagtcaggtcggggtgggggtgtttcaggacggggtcttccacaccatgtggcacgtgacccgcggggctgtgcttatgtaccaggggaagcggctggagccttcctgggccagcgtcaagaaggacctcatctcctatggcggcgggtggagattccaagggagctggaacacgggcgaggaggttcaggtgatagccgtcgagcccgggaagaaccccaagaacgtgcagaccacccccggaaccttcaaaactccagagggcgaggtgggggccattgcgctggatttcaagcccggtacctctgggtcacccatcgtcaaccgggaaggcaagatcgtaggcctgtacggtgatggcgtcgtcaccacatccgggacgtatgttagtgccatcgcccaggctaaggccagccaggagggtccgctcccggagattgaggacgaggtgttcaaaaagcgaaacctgaccatcatggatcttcaccctgggtccggtaagacccggcgctacctcccggctatcgtgcgggaggcgatcaagcgcaaactgcgtaccttaatactcgcacccacaagagtggtagctagcgagatggcggaggccctgaaaggaatgcccatccggtaccagaccacagccgtcaagtccgagcacactgggcgggaaatcgtcgacctgatgtgtcacgccacgttcaccatgcggctcctgagccccgtacgggtcccgaattacaacatgattattatggacgaggcccatttcaccgaccccgcgagcatagccgcccgaggctacataagcactcgggtcgggatgggcgaggcagcagcgatcttcatgacggccacgccgcccggatccgtggaggctttcccgcagagcaacgccgtcatccaggacgaggagcgcgacatccccgagcggtcctggaacagcggctacgactggattaccgacttccccggcaagaccgtctggttcgtcccctccatcaagagcgggaacgacatcgccaactgcctgagaaagaacggtaagcgggttatccagctcagccgtaagacattcgacaccgagtaccagaagacgaagaacaatgactgggattacgttgtaaccacggacatcagcgagatgggggccaacttccgggccgatcgcgtgatcgatccgcggcgctgcctggagcccgtgattctaaaggacggccccgaaagagtaatcttagccgggcccatgccggtcaccgctgcgagtgccgcccaacgccggggcaggatcgggaggaaccaaaacaaggagggcgaccagtacatctacatgggtcagcccctgaacaacgatgaagatcacgcccactggaccgaggcaaagatgctgctcgacaacatcaacacccctgaagggatcatccccgcgctgttcgagccggagcgagagaagtccgcagccatcgacggcgagtacaggcttcgcggggaggcgcgcaaaacgtttgttgagttgatgagacgcggcgatctgccagtctggctgtcctacaaggttgcgagtgagggcttccagtacagcgatcggcgctggtgcttcgacggagagcggaataaccaagtgctcgaggagaatatggacgtcgaaatctggacgaaggagggcgagcgcaaaaagctgcggccccgctggctcgacgcccgaacctacagtgatcccttggcgttgcgcgagttcaaggagttcgccgccgggcggcgctccgttagcggagatctgatcttagagatcggtaagctcccgcagcacctgaccctcagggcccagaacgccttggacaacctagttatgctgcacaattcggagcagggcggcaaagcctaccgccacgccatggaggaactgcccgacaccattgagacattaatgctcctagccctgatcgcggtacttaccgggggcgtgaccctgttctttctttccgggaagggcctcggcaaaaccagcatcgggttactatgcgtgatggctagctcagtcctcctgtggatggcctcggtggaaccgcactggattgcggccagcatcatcctggagttcttcctgatggtgttgctgatccccgagccggatcgccagagaacgccacaggacaaccagttagcgtacgtagtgataggcctgctgttcatgatcctcaccgtggccgccaacgagatggggctgctggagacgaccaagcgggacttaggaatcggtcatgtcgtagccgaaaaccaccaccatgccacgatgctcgatatcgacctgcaccctgcatccgcttggaccctctacgccgtggccaccaccatcataacaccgatgatgcgccacaccattgagaacactacagccaacattagcctaaccgcgatagccaaccaggcagccatcctgatgggccttgacaaggggtggcccatatccaagatggacatcggggtccccctgctggcactcggctgctacagccaggtgaaccccctgacccttaccgcggcggtgttgatgctggtcgcacactacgcaattatcgggcccggcttacaggcgaaggcgacgcgcgaagcccagaagcgaacagccgcggggataatgaagaaccccaccgtggacggcattgtggccatagacttagacccggttgtgtatgacgccaagttcgagaagcaactgggccagataatgttactgatcctatgcacgtcccagatattactcatgagaaccacgtgggccctgtgtgagagcatcaccctggccactggtcccctcaccacactgtgggagggttcgccagggaagttctggaataccaccatcgccgtgagcatggcgaacatattccgtggctcatacctggccggagccgggctcgccttctcgctaatgaaatccttgggagggggcagacgggggaccggagcccagggcgagacgctcggggagaaatggaagcgccagctgaaccagctgagcaagtccgagttcaacacttataagcggagcggcattatggaagtggatcgcagcgaggcgaaggaggggctcaagagaggggaaactaccaagcacgcggtgtcccgtgggaccgtgaagctgcgatggttcgtcgagcggaacctggtgaagcctgaaggcaaggttatcgacctgggctgcgggcggggcgggtggagctactactgcgcaggcctcaagaaggtcaccgaagtgaagggatatacaaagggtggccccgggcatgaggagcccatccccatggccacctacgggtggaacatcgtaaagctgcattctgggaaggacgtcttcttcacgccgcccgagaagtgcgatacgcttctctgtgacattggagagagctcccccaacccgaccatcgaggaggggcgcactctgcgggtgctgaaaatggtcgagccctggctccgcggcaatcagttctgtatcaagatcctgaatccctacatgcccagcgtagtggagactctggagcagatgcagcgtaagcacggtggcatgctcgtccgcaacccgctgtcccggaacagcacgcacgagatgtactgggttagctgtggcaccgggaatattgttagtgcggtgaacatgacgtcccgcatgctgctcaatcgctttacgatggcccaccggaagcccacgtacgagcgcgatgtggacctgggcgctggcactcggcacgtagcagtagagcctgagatcgctaacctagacatcatcggccagcgcatcgagaacataaagaacgagcataagagcacctggcactatgacgaagacaacccctacaagacatgggcgtaccatggctcctacgaggtgaagccctcggggtcagccagctccatggtgaacggcgtggtacggcttctaacgaagccctgggacgtgatccccatggtcactcagatcgctatgaccgacaccacgcccttcgggcagcagagagtgtttaaggagaaggtggatacccggaccccgcgtcccaagagaggcaccgcccagataatggaggtaactgcgaagtggctttggggcttcctcagccgtaacaaaaagccacggatatgcacccgagaggagttcacccggaaggtgagatctaacgcggccataggggcggtgttcgtcgacgagaaccagtggaactccgccaaagaggcggtggaggacgagcggttctgggacttggtacaccgcgagcgcgagctgcacaagcagggcaaatgcgcgacctgcgtgtacaacatgatggggaaacgggaaaagaagctcggcgagttcgggaaggccaagggcagccgggccatctggtacatgtggctgggcgcacgcttcctggagttcgaggcgctcggtttcatgaacgaggaccactggttctccagggagaacagcctgtccggcgtggaaggggagggactgtacaagctcgggtacatcctgagggacatctcaaagatcccgggcgggaatatgtacgccgacgacacggctgggtgggatacccgcattaccgaggacgacttgcagaacgaggccaagataacggacatcatggagcccgagcacgccctcctggcgacatccatcttcaaactgacctaccagaacaaggtggtccgggtgcagcgcccggccaagagcggcaccgtgatggatgtcatctcccggcgggaccagcgggggtctggccaggtcggtacctatgggctcaatacgttcaccaacatggaggtccagttaatccgccagatggagtcggagggcatcttttcgccctccgagctggagaactctaacctcgccgagagggtcctggactggctggagaagcatggggtggagaggctcaaacgaatggccatctccggcgacgactgcgtcgtcaaaccgaccgacgaccgcttcgccaccgcgctaacggccctgaacgacatggggaaggtgcgcaaggacattccccaatgggaacccagcaagggatggaatgactggcaacaggtcccgttctgctcccatcacttccaccaactcatcatgaaggacggccgcgagatcgtagtgccgtgccggaatcaagacgagctggtggggcgcgcccgggtctctcaaggcgccgggtggtctctaagagagaccgcctgcctcggcaaaagctacgcacaaatgtggcaactcatgtacttccaccgccgcgacctgcggctcgccgccaacgcaatctgcagcgccgtgccagttaactgggtcccaacgtccaggaccacctggagcattcacgcgcaccaccagtggatgaccaccgaggacatgctgtccgtctggaacagggtctggatcgaggaaaacccctggatggaggacaaaacccatgtcagctcctgggaggacgtcccttacctgggtaagcgtgaggaccagtggtgcggcagccttatcggcctgaccgcccgtgctacgtgggccacaaacatccaggtggcgatcaatcaggtccggcgcctgatcgggaacgaaaactattccgactacatgaccagcatgaagcggttcaagaacgagtccgacccggagggcgccctctggtga

SEQ ID NO: 23753 - RNA, 9879 nt, synthetic construct
  misc_feature 1..9879: note = derived and/or modified CDS sequence (opt11) from DENV-1__KX380796__SS-prME
  source 1..9879: mol_type = other RNA
agcgtgaccatgctgctcatgttgttacccaccgcgttagcattccacctcaccacccggggtggggagcctcacatgatcgtgagtaagcaagaacggggtaagagcctcctgttcaagacatccgcgggggtaaacatgtgcacccttatcgccatggacctgggcgagttatgcgaggacaccatgacctacaagtgcccccgcataacggaagccgagcccgacgacgtggactgctggtgcaatgccactgacacgtgggtgacctatgggacctgcagccaaactggtgaacatcggcgcgacaagcggtccgtggcactggcgccccacgtggggctggggctcgaaacgcgcaccgagacctggatgagctcagagggcgcatggcgccagatgcagaaggtggagacctgggccctgcgccacccagggttcacggttatcgcactgttcctagcacacgcaatcggcaccagcatcacccagaaggggatcatcttcatcctactgatgctcgtgacgccatccatggccatgcgctgcgtcggcatcggcaatcgtgatttcgtggaggggctgagcggcgccacgtgggtggatgtcgtgctggagcacgggtcctgtgtaaccaccatggccaagaacaagcccaccctcgacatcgagctcctgaagacagaggtcaccaaccccgcggtactccggaagctgtgtatcgaggccaagatcagcaacaccaccacggactcacgctgcccgactcaaggggaggccaccctagtggaggagcaggacgcgaacttcgtctgccggcgcacctttgtggatcggggctgggggaacggctgtggcctctttggcaaggggagtctgcttacgtgcgccaagttcaagtgtgtgaccaagctcgaaggcaaaaccgtacagtacgagaacctgaagtactcggttatcgtgaccgtccatacgggcgatcagcaccaggtgggcaacgaaacaacggagcacgggaccatcgcaactatcacaccccaggccccaaccagcgaaatccagttaaccgactatggggccctcaccctggactgtagcccccggactggcctggacttcaacgagatggtgctccttacaatgaaggagaagagttggctggtgcacaagcagtggtttctcgatttgccgctaccgtggacgtcaggagcaagcacatcccaggagacgtggaaccggcaggatctccttgtgacattcaagaccgcgcatgcaaagaagcaagaggtggtcgttttgggctcccaagagggcgctatgcacacggccctcacgggcgccacggagatccagaccagcggcacaactacgattttcgccgggcacctaaagtgcaggcttaagatggacaagctgaccttgaagggcgtgtcatacgtcatgtgcaccgggagctttaagttggagaaagaggttgcagaaacgcagcacggcaccgtcctggtccaggtcaagtacgagggcaccgacgccccctgcaagattcccttctccactcaggatgagaagggagtgacgcagaacggacggctcataaccgccaatccgatcgtgaccgacaaagagaagcccgtgaacatcgaaacggaaccgcccttcggcgagagctacatcgtcataggcgccggggagaaggcactgaagctgtcctggttcaaaaagggtagctcgatcggtaaaatgttcgaagcaactgcgcgcggggcccggcgcatggccatactgggagatacagcgtgggacttcgggagcataggaggggttttcacgtctgtggggaagctggtccaccaggtcttcggcacggcctacggagtcctgttcaatggagtctcttggacgatgaagataggtatcggcatcctcttaacctggttaggcttgaactcccgatccacatccctgagcatgacctgcatcgccgtgggcatggtgacactgtatctgggcgtcatggttcaggccgatagtggatgcgtgatcaactggaagggtcgggagctgaagtgcgggagcggcatattcgtcacgaatgaggtacatacctggacagagcaatacaagttccaggccgacagcccgaagcgactcagcgcggcgatcggcaaggcctgggaggagggggtgtgtggcatccggagcgcaacccgcttagaaaacattatgtggaaacaaatctccaacgaactgaaccacatcctgctcgagaacgacatgaagttcacggtcgtagtgggagacgctaacggcatcctgacccaagggaagaagatgatccggcctcagcccatggagcacaagtacagctggaagtcctgggggaaggcgaagatcattggcgccgacacacagaacaccacgttcatcatcgacggtcctgacacccccgaatgccccgacgatcaacgcgcgtggaacatatgggaagtcgaggactacggcttcggggtgttcaccaccaacatatggctcaagctccgggacagctacacacagatgtgtgaccaccgactgatgtccgcagcgattaaggacagcaaggcagtccacgccgacatgggctactggatcgagtccgagaaaaacgagacctggaaactggccagagccagcttcatagaagtcaaaacctgcatctggccccgctctcacaccctctggtctaatggcgtgctagagtccgagatgatcatccccaaaatctatggaggtccaattagccagcataactaccggccaggatacttcacacagaccgcgggcccgtggcatctggggaaactcgagcttgactttgacttatgcgaaggcactaccgtcgtagtggatgagcattgtggcaaccgtggaccgtccctccggaccacgaccgtgaccggaaaaatcatccacgagtggtgctgtcgcagctgcacgttacctcccctgcggttccgcggggaggatggctgctggtacggtatggagataaggcccgtcaaggagaaggaggagaaccttgtccgctcgatggtgtccgcagggagtggcgaggtcgactcatttagtctggggctgctctgcgtgtccataatgatcgaggaggtaatgcggagccgctggtcccgcaagatgctgatgacaggtacgctggctgtctttttcctcctgatcatggggcagttaacctggaacgatttaatccggctctgcatcatggtgggcgcgaatgtgagcgaccgcatggggatgggtacgacctacctcgccctcatggctaccttcaaaatgcggccgatgttcgccgtcgggctgctgttccgccggctcacctcgcgcgaggtgctgctgctcacgatcgggctcagcctggtcgcctcggtcgagctccccaacagtctggaggagctgggggacgggctcgccatgggcatcatgatgctgaaattgctcacagactttcagccccaccagctgtggacaacactgcttagtctgacgttcatcaaaaccacactgtcactcgactacgcctggaagaccatggctatggtgctgtccatcgtgagcctgttcccgttatgtctatccaccaccagccagaaaacaacctggctgccagtgctcttagggagctttgggtgtaagccgctgaccatgttcttgatcacagaaaataagatctggggacgcaagagctggcccctgaacgaaggcatcatggctgtgggcatcgtctcgatcttgcttagcagcctgctgaaaaatgacgtgcctctcgccgggccgctgatcgccggaggcatgctcatagcgtgctatgtgatctcaggtagctccgccgacttgagcctggaacgcgccgcggaggtgtcctgggaagaagaggcagagcacagcggcgctagtcacaacatattagtggaggtacaggacgacgggacaatgaagatcaaagacgaggaacgggacgacacactcaccatcctgctgaaggctacgctcctggcagtcagcggagtctaccctatgtccatcccagccacccttttcgtgtggtacttctggcaaaagaagaagcagcgcagcggggttctctgggacaccccatccccaccagaggtggagagggccgtcctggacgatggcatctaccgcatccttcagcggggcctgctcggtcggtcgcaggtcggcgtgggtgttttccaagatggggtctttcataccatgtggcatgtgacgagaggggcggtcctgatgtaccagggaaagcgcctcgaaccctcctgggccagcgtcaagaaggacctcatctcctacggcgggggttggcggttccaggggtcttggaataccggcgaggaggtccaggtgatcgccgtagaaccagggaaaaaccctaagaacgtgcagaccacccccggcaccttcaagacccccgaaggtgaggtgggggccatcgccctggacttcaaaccaggcaccagtgggagccccatcgtcaaccgggagggcaagatcgtcggtctgtacgggaacggcgtggtcaccacgtctgggacctacgtcagcgcgatcgcccaggccaaagcctcccaggagggtccactccccgagatcgaggacgaggtgttcaagaaacggaatctgaccatcatggacctgcacccggggagcggtaaaacccgccggtacctgcccgccatcgtccgcgaggcgattaaaaggaagctccggacgctaatcctcgcccctacgcgcgtcgtggcaagcgagatggccgaggcgctgaagggcatgcccatccgctatcaaacaaccgctgtcaaatccgagcacacggggaaggaaatcgtggacctgatgtgccatgccaccttcaccatgcgcctcctgtcaccggttagagtaccgaattataacatgatcatcatggacgaggcccacttcacggatcctgcctctatcgccgcccggggctacattagcacgcgagtcggaatgggcgaggccgccgccatattcatgaccgcgacgccgccagggtccgtggaggcctttccacagtctaacgcagtcatccaggatgaggagcgcgacataccggagcggtcctggaacagtggatacgactggattaccgacttccctggcaagacggtttggttcgtgccctccataaagagcgggaacgatatcgccaactgcctgcgcaagaacggcaaaagggtcatccaactctcccgaaagacctttgacaccgagtaccagaaaaccaagaacaacgactgggactatgtggtgacgaccgatatcagcgagatgggcgcgaactttcgggcagatcgcgtcatagatccacggcgttgccttaagccggtgatcctgaaggatggccccgagcgggttatactcgccggtcctatgcccgtgaccgctgcctccgcggcccagcgaagaggacgcatcggacgcaaccaaaacaaggagggagaccaatacatctacatgggccagcccctgaacaatgacgaagaccacgcccattggaccgaggccaagatgctgctcgacaatatcaacacgcccgaagggatcatcccagctctgttcgagccagagcgggagaaatcagcggccatcgacggcgagtatcgactgcgtggggaggcgcgcaagactttcgtggagctcatgcgacgcggcgatctgcccgtctggctgagctacaaggtggcctccgagggctttcagtactccgaccgacgctggtgcttcgatggggagcggaacaatcaggtgctcgaggagaatatggacgtcgagatctggactaaggagggcgagcgcaaaaagctccggccccgctggctggacgccagaacctactcggacccattggcgctgcgcgagttcaaagagttcgccgccggtcggcggtccgtatccggcgacttaatcctcgaaatcggcaaactgccccagcacttgaccctccgtgcgcagaacgccctggacaacctggtgatgctccacaacagcgagcaaggagggaaggcgtaccgccatgccatggaggagctcccggacacgatcgagaccctgatgctcttagccctgatcgccgtcctcacaggtggcgttactctgttcttcctgtccgggaagggcttgggtaagacgagtatcgggctcttgtgcgtcatggcgagtagcgtgctcctgtggatggcctccgtggagccgcactggattgcagcttcaatcatcctggagtttttcctcatggtgctgctgatccctgagcccgaccgccagcgcacgcctcaggacaaccagcttgcatacgtcgtgatcggcttgctattcatgatcctgaccgtggcggccaacgagatgggactgctggagaccactaagaaggacctcggcatagggcacgtcgtggcagagaaccatcatcacgccactatgctggacatcgacctgcatccggcctccgcctggaccctctacgccgtggccaccacaatcataacccccatgatgcggcacacaatcgaaaataccacagctaacattagcctgacagcaatcgcgaatcaggccgccatcttgatgggcctcgacaaaggctggcccatttcaaaaatggacatcggggtccccttgctagccctcgggtgctatagtcaagttaacccgctgaccttgaccgccgcggtactaatgctagtcgcccactacgccatcatagggcccggtctgcaggccaaggcgacccgagaggcccagaagcggaccgcagctgggatcatgaagaaccctaccgtggacggcatcgtcgccatcgacctggaccccgtcgtgtacgacgccaagttcgaaaagcagctgggccagatcatgctgctaatactgtgcacgtcccaaattctgctcatgcgtacgacctgggctctttgcgaatctatcaccctggccaccgggccactaacgaccttatgggaggggtcccccgggcgtttttggaacacaactatcgcagtgagcatggcgaatatattccgcggctcctacttagcgggcgcgggactcgccttcagcctgatgaagtcactcggcgggggccgccggggaacgggtgcccagggcgaaaccctaggtgagaagtggaagcgtcagctgaaccagctgtcgaagtctgagtttaacacctataaaaggagcggcatcatggaggtcgaccgcagcgaagccaaagagggcctcaagcggggcgagacaaccaaacatgccgtgtcgagagggacggctaaactgcggtggttcgtggagcgtaatctcgtcaagcccgagggcaaggtgatcgacctcggttgcgggagaggcgggtggagctactactgcgccggcctgaagaaagtgaccgaggtgaaaggctatacgaaaggcggccccgggcacgaggagccgatccccatggcaacctacggctggaatatagtgaagctgcactccgggcgcgacgtgttcttcactcccccagagaaatgcgataccctgctctgcgacatcggcgaaagctcgccaaatcccacgatcgaggaggggcgcaccctgcgtgtcctgaagatggtggagccctggctcagaggcaatcagttctgcattaagatccttaacccctacatgccgtccgtggtcgaaacgcttgagcagatgcagcgtaaacacggtggaatgctcgtgcgaaaccccctgtcccgcaatagcacccacgagatgtactgggtgtcctgcggcaccggtaatatcgtaagtgccgtaaacatgacgtcccgtatgctgctgaacaggttcacgatggcacatcgtaaacccacctacgagagggacgtagacctgggcgctggcacacgccacgtcgccgtggagcccgagatcgccaacctggacatcatagggcagcgaatcgagaacatcaagaatgagcacaaaagcacctggcattacgacgaagacaatccgtacaagacctgggcgtaccacgggagctacgaggtgaagcccagcgggtctgccagctctatggtcaacggcgtggtgcgcctcctgaccaaaccctgggacgtgatccccatggtgacccagatcgcaatgaccgacacgaccccgtttgggcaacagcgtgtcttcaaggaaaaggtggacacccgcacgccccgacctaagcgcggcacggcacagatcatggaggtgaccgccaagtggctgtgggggttcttatcaaggaacaaaaagccacgcatctgcactcgggaggagtttacccgcaaagtccggtccaacgcggccattggggctgtgttcgttgacgagaaccagtggaacagcgccaaggaggccgtcgaggacgaacgattctgggacctggtgcacagagaacgcgagctgcacaagcagggcaaatgcgcgacgtgcgtttacaacatgatggggaagcgggaaaagaagctcggtgagttcgggaaggccaagggcagccgggccatctggtacatgtggctgggcgcccggttcctggagttcgaggctctcgggttcatgaatgaggaccattggttctccagagagaacagcctgagcggcgtggagggggagggcctgcacaaattagggtatatcttacgcgacatcagcaagatccccgggggcaacatgtacgcagacgacaccgcgggttgggatacccggatcaccgaggacgacctgcagaacgaggccaagatcacagacataatggagcccgaacacgcccttctagcgacttccatattcaagctgacctaccagaacaaggtggtgcgtgtccagcggcccgccaagagtggcacggtcatggatgtgatatcccgccgggatcagagggggagtgggcaagtgggcacgtacgggctcaacacctttaccaacatggaggttcagctgattcggcagatggaatccgagggcattttctcaccgtccgagctggagaacagcaacctcgccgagcgcgtgctggactggctggagaaacacggggtcgagcggctcaaacggatggcaatcagtggcgacgactgcgtggtgaagccgactgatgaccggttcgccacggcgctgaccgcacttaacgacatggggaaggtccgcaaggatatcccacagtgggagcccagtaaaggctggaacgactggcagcaagtcccgttctgctcccaccacttccaccagctaataatgaaggacggcagggagattgtggtgccctgccgcaaccaggacgagctggtggggcgggcccgggtgtcgcagggcgccggctggagcctgagggagaccgcctgcctggggaaaagctacgcccagatgtggcagctcatgtactttcatcgccgggacttgcgcctcgccgccaatgccatttgcagcgctgtacccgtaaactgggtgcccacctcccgtaccacttggtccatccacgcccaccaccagtggatgacgaccgaggacatgctgtccgtctggaacagggtgtggattgaggagaacccgtggatggaggataagacccacgtgagctcctgggaggacgtaccctacctggggaagcgcgaggaccagtggtgcggcagcctcatcggcctgactgcccgggccacctgggccaccaacatccaagtggcgattaaccaggtgcgccggctaatcggaaatgagaactatctcgattacatgacttccatgaagcgcttcaagaacgagagcgaccccgagggcgccctgtggtga

SEQ ID NO: 23754 - RNA, 9879 nt, synthetic construct
  misc_feature 1..9879: note = derived and/or modified CDS sequence (opt11) from DENV-1__KX380799__SS-prME
  source 1..9879: mol_type = other RNA
tccgtgaccatgctgttgatgctgctgcccaccgccctcgcctttcatctaaccacccggggcggggagccccatatgatcgtgagcaagcaggagcggggtaagagccttttgttcaaaacctccgcgggggtgaacatgtgcaccctgatcgccatggacctgggcgaactctgcgaggacacgatgacgtacaagtgtcccagaatcacagaggcggaacccgacgacgtggattgctggtgcaatgccacagacacatgggtaacctacgggacctgcagccaaaccggcgaacatagacgcgacaagcggtccgtggccctggcgccccacgtgggcctggggctcgagacccgcaccgagacgtggatgtcgagcgaaggggcctggcggcagatccagaaggtggagacctgggcgctacgccaccccgggttcacggtcatcgcgttattcttagcacacgccattggcaccagcataacccaaaaggggatcattttcatcctgctgatgctcgttaccccctcaatggcgatgaggtgcgtcggcatcggtaaccgcgacttcgtagaggggctgagcggcgcgacgtgggtcgacgtcgtactggaacacgggtcctgcgttaccactatggcaaagaacaagcccaccctcgacatcgagctgctcaagacggaagtgaccaaccccgctgttctccggaagttgtgcatcgaggcgaagatctcaaacaccaccacggactcccgctgccccactcagggcgaggccaccctggtggaggaacaggacgcgaacttcgtctgcagacgcaccttcgtggaccggggttggggtaatggctgcggcctgttcggcaaggggagcctactcacgtgcgccaagttcaagtgcgtaaccaaacttgaaggcaagatagttcaatacgagaacctgaagtactccgtgatcgtgacggtccacaccggcgaccagcaccaggtcgggaacgagacgacagagcacggtaccattgcgaccatcacgccccaggcacccacaagcgagatacagctgaccgactacggggccctcacccttgactgcagcccccgaaccggcctagactttaacgagatggtactcctcactatgaaggagaagtcctggctggttcacaagcagtggttcctcgacctgccgctgccttggacctcgggggccagcaccagccaagagacctggaatcggcaggacctcctggtgaccttcaagaccgcacacgcgaaaaagcaggaggtcgtggtactaggctcccaggagggcgccatgcatacggccctaaccggtgccaccgaaattcaaacctccggcaccaccacgatattcgctggacacttaaagtgccgcctgaagatggacaagttgaccctgaagggggtttcctacgtcatgtgcaccggttcgttcaagcttgagaaggaggtggcagaaacccagcatggcactgtcctggtgcaagtaaagtacgagggcaccgacgcgccctgtaagattcccatctccacccaggacgagaagggggtcactcagaatggccggctcatcaccgccaacccgatagtcaccgacaaggagaagcccgtgaacatcgagaccgagccgcccttcggcgaaagctatatcgtcataggggctggcgagaaggcgctgaaactgtcctggtttaaaaaagggtcgtctataggaaaaatgttcgaggccacggcccgcggggcacgacgcatggccatcttgggcgacacggcgtgggatttcgggtccatcggtggcgtgttcacctccgtggggaagctggtccaccaggtgttcggcaccgcctacggggtgctcttcagtggcgtctcatggacgatgaagataggcatcggcatcctgctaacgtggctggggctcaactcccgctccaccagcctgtccatgacctgcatcgccgtgggaatggtgaccctgtacttaggcgtaatggtacaggccgacagcgggtgcgtgatcaactggaaaggcagggagctcaagtgcgggtccggcattttcgtcacgaacgaagtgcacacctggaccgagcagtacaagttccaggccgacagcccgaaacgcctgagcgcggcgattgggaaggcatgggaggagggcgtgtgcggcatccggtccgccaccagactagagaacatcatgtggaagcagatcagcaacgaactgaaccacatcctgttggagaacgacatgaagttcaccgtcgtggtgggggacgccaacgggatcctgacgcaggggaagaagatgatccggccccagcccatggaacacaagtacagttggaagtcctgggggaaggcaaaaatcatcggcgcggacacccaaaacaccaccttcatcatcgacgggcccgacacaccggagtgccccgacgaccagcgcgcctggaacatctgggaggtcgaggactacggcttcggcgtgtttacgaccaatatatggttaaagctcagagactcctacacccagatgtgcgaccaccgactgatgagcgcagcgatcaaggactccaaggctgttcatgcagatatgggctactggatcgagagcgagaagaatgagacatggaagctggcccgcgcctctttcatcgaggttaagacctgcatctggccccgaagccataccctctggtccaacggcgtcctggagagcgagatgatcattcccaaaatctacgggggaccgatcagtcaacacaactaccggcccgggtatttcacccagacggcgggtccctggcacctgggtaagcttgagctcgacttcaacctgtgtgagggcaccaccgttgttgtggacgagcattgcgggaaccgagggccgtcgctccgtaccacgaccgtgaccggcaagatcatccacgagtggtgctgccgcagctgcaccctgccgcccctgcggttccgtggggaggatggctgttggtacgggatggagatccggcccgtcaaggagaaggaggagaatctggtacgtagcatggtgagtgccggcagcggggaagtcgacagcttttccctggggctcttgtgcgtgtcgattatgatcgaggaggtaatgcggtccagatggagccgcaagatgctgatgacggggaccctggccgtcttcttcctcctgatcatggggcagctgacctggaacgacctcatccggctgtgcatcatggtgggagcgaacgtgtccgaccgcatggggatgggcacaacgtatctggccctcatggcgaccttcaagatgcggccaatgttcgccgtcgggctgcttttccgccgactaaccagccgcgaagtgttactgctcaccataggactgtccctggtcgccagcgtggagctccctaatagcctggaggagctgggcgacgggctcgctatgggaatcatgatgctcaaactcctcacggattttcagtcgcatcagctgtggaccaccttgctatctctgactttcatcaaaacgactctgagtctcgactacgcctggaagaccatggcaatggttctgtccatcgtcagcctgtttcccctctgcttgtccaccacgagccagaaaacaacctggctgcccgtgctcctgggctctttcggctgcaagccgctgaccatgttcttgatcaccgagaataagatctggggccgcaagagctggcccctgaatgaggggataatggccgtcggcatcgtctccatcctgctcagtagcctgttaaagaacgacgtgccgcttgcggggcccttgatcgccggcggtatgctgatagcgtgctacgtgatctctgggagctccgccgacctgagcctggaacgcgcggctgaagttagctgggaggaggaggcggagcacagcggcgcgtctcacaacatcctggtagaggtccaggatgacgggacgatgaagatcaaggacgaggagcgggacgacaccttgaccatcctgctgaaagccaccctgttggccgtcagcggcgtatacccgatgtccattcctgccacattattcgtgtggtatttttggcagaagaaaaagcagaggagtggggttctctgggacacccccagtccgcccgaggtggaacgggccgtgctggacgacggcatctaccgtatcctgcagcgcggcctgctcggtcgcagccaagtcggcgtgggtgtgttccaggatggcgtgttccacaccatgtggcacgtcacccgcggggcggtgctgatgtaccagggcaagcgcctagagccctcctgggccagcgtcaagaaagacctcatcagctacggcgggggctggcggttccaaggtagctggaatacgggcgaggaggtccaagtgatcgcagtcgagcctggtaaaaaccccaagaatgtgcagaccacccccggcaccttcaagacccctgagggcgaagtcggggccatcgctctagactttaagcccggcacctccgggagccccatcgtaaaccgcgaaggtaaaatcgtgggcctatatgggaacggcgttgtgaccaccagcgggacgtacgtgagcgcgatcgcccaagccaaggcaagccaggagggcccgctccccgagatcgaggatgaggtattcaagaagcggaacctgaccatcatggatctgcaccccgggtcaggcaagacccggcggtacctcccggccatcgttcgcgaggcaatcaagcgtaaactgcggaccctgatccttgcccccacgcgtgtggtggccagcgagatggcggaggcactgaagggcatgcccatccgttaccagaccaccgccgtcaagtcagaacacaccgggaaggagatcgtggatttgatgtgtcacgccactttcaccatgcgccttctgtcccccgtccgtgtcccgaactacaacatgatcatcatggatgaagcacacttcaccgaccccgcctccatcgcggcacggggatatattagcacccgagtggggatgggcgaggccgcggccatctttatgacggcgacgccgccagggtccgtggaggctttccctcagagcaacgccgtcattcaggacgaggagcgcgacatacccgagcgatcctggaactcaggctacgactggatcaccgacttccccggtaagaccgtgtggttcgtgccctccatcaagtcgggcaacgacatagcgaattgcctccgaaagaacggcaagcgggttatccagctctcccgcaagacgttcgacactgagtaccagaagacgaagaacaacgactgggattacgtggtgaccacggacataagcgagatgggtgctaatttcagagcggaccgcgtcatcgacccgcggaggtgcctgaagccggtcatcctgaaggacggccccgagcgcgtcatcttagccggtcccatgccggtgaccgccgcctccgcggcccagcgccggggccgcatcggccgcaaccagaacaaggagggggaccagtacatctacatgggccagcccctgaacaatgacgaggaccatgcccactggaccgaagcaaaaatgctgctcgataacatcaacaccccagaggggatcatacccgccctgttcgagcctgagcgggagaagtctgcggcaatcgatggcgaatatcgcctgcggggcgaggcgcgcaagacctttgtggagctcatgcgcaggggggacctgcccgtctggctgtcctacaaggtcgccagcgagggcttccagtacagtgaccggagatggtgtttcgacggtgagagaaataaccaggtgctcgaggagaacatggacgtcgagatatggaccaaagaaggcgagcgcaagaaactgcggccccgttggctggatgcccggacctacagcgaccccctcgctctgcgtgaattcaaggagttcgcagccgggcggagaagcgtatcgggagatctcatcctcgagattggaaaactgccgcagcatttaaccctccgggcccagaacgccctggacaatctggtgatgctccacaactcagagcagggcgggaaagcgtaccgccatgcgatggaggagctgccagacaccatcgagacgctgatgcttctagcattaatcgcagtcctcaccggaggagtgaccctgttcttcctatccggcaaaggcctcggcaagacctcaatcgggctactatgcgtgatggcttccagcgtactcctctggatggcatccgtggagcctcactggatcgccgctagcatcatcctggaatttttcctcatggtgctgctgatccccgagcccgaccggcagcgcacgccccaggataaccagcttgcctatgttgtaatcggcctgctgttcatgatcctcaccgtggcggccaacgagatgggtctgctggagaccaccaagaaggatttgggcatcggtcacgtcgtggccgagaatcaccaccacgccacaatgttagatattgacctgcaccccgcttccgcgtggaccctctacgccgttgccacaaccataatcacgccgatgatgcggcacaccatcgagaataccactgctaacataagcttgacggccatagcgaaccaggccgccatcctgatgggcctcgacaaaggctggccgatctccaaaatggacataggggttcctcttctggccctcgggtgctactcacaggtaaaccctctgacacttaccgcagctgtgctcatgctggtcgcccactacgccatcatcgggccgggactccaagccaaggcaacccgcgaagcacagaagcggacggctgccgggatcatgaagaaccccaccgtggacggcatcgtggccattgacctcgaccccgtcgtgtacgatgcgaagttcgaaaagcagctgggccagatcatgctgctcatcctgtgcacctcgcagatcctgctcatgcgaaccacgtgggccctatgcgaatcgatcaccttggccaccgggcccctcacaacgctgtgggagggctcgccggggaggttctggaacactaccatcgccgtgtctatggccaacatcttccggggttcgtacctggcgggtgccgggttggccttcagcctgatgaagtccctggggggaggccgccgggggaccggcgcacaaggcgagactctcggggagaagtggaaaagacagctgaaccagcttagcaagagcgagttcaacacatacaagcgctccggcatcatggaggtcgaccgcagcgaggccaaggaggggctcaagagaggagaaaccaccaagcacgcggtgtcccgcggcacggccaagctacggtggttcgtggagcgcaacctggtcaaaccggaaggcaaagtgatcgacctgggctgcggtcggggcggttggagctactactgcgccggccttaaaaaggtgaccgaggtcaagggatacacaaagggcggccccgggcatgaagagcccatcccaatggcgacctacggctggaacatcgtgaaactgcactccgggcgcgatgtattcttcacgccgcccgaaaaatgtgacactctgctctgcgatatcggcgagtcatcccccaacccgacaatcgaggaggggcggaccctgcgcgtcctgaaaatggtggaaccctggctcagaggcaatcagttctgcatcaagatcctgaacccctacatgcctagcgtggtcgagaccctggagcagatgcaacgcaaacatggcggtatgctagtgcgaaacccgctgtcccgcaacagcacgcacgaaatgtactgggtgtcgtgcggcacagggaacatcgtcagcgcggtgaacatgactagtcgcatgctgttaaaccggttcaccatggcccaccgaaagccgacgtacgagcgggacgtggacttaggcgccgggactcgccacgtcgccgtggagcccgagatcgccaacctcgacatcatagggcagcgaatcgagaacatcaagaacgaacataagtctacctggcactacgacgaggacaatccctacaaaacttgggcgtaccacgggtcctacgaggtgaagcccagcggatcagccagctccatggtcaacggcgtggtccgcctcctgacgaagccctgggacgtaatacctatggtgacccagatcgccatgaccgacaccacgccctttgggcaacaacgggtcttcaaggagaaggtggacacccgcaccccgcggccgaaacgcgggaccgcccagatcatggaagtgactgcgaagtggctgtggggcttcttaagccgtaacaagaagccgcgcatatgcacccgtgaggagttcacccgcaaggtccgcagcaacgcggctatcggagcggtgttcgtggacgaaaaccaatggaattccgcaaaggaggccgtcgaggacgagcgcttctgggacttggtgcaccgggagcgcgagctgcacaagcagggcaagtgcgcgacctgcgtctacaacatgatggggaagcgggaaaagaaactcggcgagttcggcaaggccaagggcagccgagccatctggtacatgtggttgggcgcccgattcctggagtttgaggcgctggggttcatgaacgaggaccactggttctcccgcgaaaattcgctgagtggcgtcgaaggggaaggcctgcacaagcttgggtatatcctgagagacatcagcaagattccgggcggcaatatgtatgccgacgacaccgccgggtgggacacccggatcaccgaggacgacctgcagaacgaggcaaagattaccgacatcatggagcccgaacacgcccttctggccacctccatctttaaactgacttaccagaacaaggtggttcgcgttcagcggccggcgaagagcggcaccgtgatggacgtgatctcccgccgggaccaacgcgggagcggtcaggttgggacctacgggctcaatacgttcacgaacatggaagtgcagttgatacggcaaatggaatccgagggcatcttctctccctccgagctggagaacagcaacctcgccgagcgcgtgctggactggctggagaagcatggcgtggagcggctaaaacgcatggcaatctccggcgatgattgcgtggtgaagcccacggacgacaggttcgccaccgcgctgaccgccctgaacgacatggggaaggtccgcaaggatatcccccagtgggagccctctaagggctggaacgattggcagcaggtccccttctgctcccaccacttccatcagcttattatgaaggacggccgggagatcgtagtgccttgccggaaccaagatgagctcgtgggtcgagcacgcgttagccagggcgccgggtggagtctgagagagactgcctgcctcggcaagtcctacgcgcaaatgtggcaactgatgtattttcaccgccgggatctgcgcttagccgccaacgccatatgcagcgccgtgccggtcaattgggtccccaccagccgcacgacgtggagtatacacgcgcaccaccagtggatgaccactgaggacatgctgtccgtctggaacagagtatggatcgaggaaaacccctggatggaggataagacccacgtgagctcctgggaggacgtcccgtacttagggaagcgcgaggaccagtggtgcggcagcctcatcggcctgacagcccgggccacgtgggctaccaacatacaagtcgcgatcaaccaagtccgccggcttatcggcaacgagaactatctcgactacatgacctccatgaagcgcttcaaaaacgagagcgaccccgaaggcgccctgtggtag

SEQ ID NO: 23755 - RNA, 9879 nt, synthetic construct
  misc_feature 1..9879: note = derived and/or modified CDS sequence (opt11) from DENV-1__KX380800__SS-prME
  source 1..9879: mol_type = other RNA
agtgtgaccatgcttctcatgctgctgcccacggccctcgcatttcatctgacaacccggggcggggagccgcacatgatagtgagcaagcaggagcggggcaagagccttctgtttaagacgtccgcgggggtgaatatgtgcaccctcatcgccatggacctgggtgagctctgcgaagacaccatgacgtataagtgtccccgcattacagaggccgaacctgatgacgtggactgctggtgcaacgccacggacacttgggttacctacgggacctgtagccagaccggtgagcaccggcgcgacaagaggtccgtggcactggcgccacacgtgggcctggggctcgagacccgcaccgagacctggatgtcctcagagggagcctggcggcaaatccagaaggtcgaaacctgggccctaaggcaccccgggttcaccgtcattgccttatttctagcgcacgccataggcaccagcattacccagaagggaattatcttcatcctcctgatgcttgtgactccctccatggccatgcggtgcgtcggtatcggcaatcgcgacttcgtcgaggggttaagcggcgcaacgtgggtagacgttgtcctggagcacgggtcctgtgtaaccacaatggccaagaacaagcccacacttgacatcgagctgctgaagacagaagtcaccaaccccgcggtgctgaggaagctctgcatcgaagctaagatcagcaataccaccacggactcccgctgccccacccagggcgaagccaccctcgtggaggagcaggacgccaattttgtctgtcggcgtactttcgtcgaccggggctggggcaacgggtgcgggttgttcggcaaggggagtttattaacttgcgctaaattcaagtgcgtgaccaagcttgagggcaaaatcgttcagtacgagaacctgaaatactccgtgatcgtcaccgtacacaccggggaccagcaccaggtggggaatgaaactacagagcacggcactatcgcgaccatcacgcctcaggcccccacaagcgagatccagctgaccgattacggggcactcaccctggactgctcaccgcggaccggcctcgacttcaacgagatggtcctccttacgatgaaagagaaatcctggctggtacataagcagtggttcctcgacctgcccctgccctggacttccggggccagtaccagccaggagacgtggaaccgacaagatctgctcgttacgttcaagactgcccacgctaagaaacaagaggtcgtggtgcttggctcacaggagggtgccatgcacacagctctaacgggcgccacggagatccaaaccagcggcaccaccacaatcttcgccgggcacctaaagtgccggctgaagatggacaaattgaccctgaagggcgtctcctacgttatgtgcaccggtagcttcaagctggaaaaggaggtggccgagactcagcacgggacagtactggttcaagttaaatacgagggcacggacgctccctgcaaaattcccatctccacccaggatgaaaaaggtgtcactcagaacggccggctcatcacggcgaatccgatagtgacagacaaagaaaagcccgtgaacatcgagaccgagccgcccttcggggagagctacattgtcatcggcgccggcgaaaaggcgctgaagctgtcctggttcaaaaaggggagctccatcggcaagatgttcgaggccacggccaggggggcccggcgcatggctatcctgggcgacacggcgtgggatttcgggagcatcggtggcgtgtttaccagtgtagggaagctggttcaccaggtgtttggcaccgcttacggggtgctgttctcgggtgtaagctggaccatgaagatcgggataggcatcctcctgacgtggctgggcctcaactcgcgcagtacctccttaagcatgacctgcatcgccgtgggtatggtgaccctctacctcggggtcatggtgcaggcggactcgggctgcgtgattaattggaaaggccgggaactgaagtgcgggtcgggcatcttcgttacaaacgaggtacatacctggactgagcagtacaagttccaggccgattcaccgaagcgcctgtcagcggccatcgggaaggcctgggaggaaggagtgtgtggtattcggtccgctacccgcctggagaacatcatgtggaagcagatcagcaacgagttgaaccatatcctgctcgaaaacgacatgaagtttaccgtcgtggtcggggacgcgaacgggatcctgacccagggaaagaagatgatccgtccccaacccatggaacacaaatactcctggaagtcatggggcaaggcgaaaatcataggcgccgatacacagaacaccaccttcatcatcgacgggcccgacactccggagtgtcccgacgaccagcgcgcctggaacatatgggaagtcgaggactatgggttcggagtatttaccaccaacatctggctgaaattacgggattcctacacccagatgtgtgaccaccggctgatgagcgcagcgatcaaagactcaaaggccgttcatgccgacatgggctattggatcgagagcgagaagaacgaaacatggaagctggcccgggcctccttcatcgaggtcaaaacatgcatctggcctcggagccacaccctctggagcaacggcgtgctggagagtgaaatgatcatccccaagatctatgggggacccatttcccagcacaactaccggcctgggtatttcactcagacggcgggaccatggcatctggggaaactcgagctagacttcaacctttgcgagggcactaccgtggtcgtggatgagcattgtggcaatcgcggtccgagcctccggaccaccacagtgaccggcaagatcatccacgagtggtgctgccgctcgtgcacccttccgcccctgcgattccgcggggaggacggctgctggtacggcatggagattagacccgtgaaggagaaagaggagaacctagtgcgctcaatggtgtccgccgggtcgggcgaggttgacagcttctccctggggcttctctgcgtgtctatcatgatcgaggaggtcatgcggtctcgctggtctcggaagatgctgatgactggcaccctcgccatcttcttcctcctgatcatgggacagctgacatggaacgacctcattagactatgcatcatggttggcgccaatgtgtccgaccgcatgggtatgggaaccacatacctggcactcatggcgaccttcaagatgcgccccatgttcgctgtggggttgctgtttcgccggctaacctcgagagaagtcctgcttctcacgataggtttatccctagttgcctctgtagaactgcccaactccctggaggaactgggcgacggtttggccatgggcataatgatgctgaagctgctgacggacttccagagccaccagctgtggaccacccttctcagcttgaccttcatcaagacaaccctgagcctcgactacgcctggaagaccatggcgatggtactgagtatcgtgagcctgttcccgctgtgcctgtccacaaccagtcagaaaaccacatggctgcccgtcctcctgggctctttcgggtgcaaaccgctaaccatgttcctcatcaccgagaacaagatatgggggcgcaagagctggcctctgaacgaggggatcatggctgttggcattgtgtccatactgttgtcttctctcctgaaaaacgacgtccccctcgcgggacccctgatcgccgggggcatgctgatcgcgtgctacgtgatttcggggagctccgcggacctcagcctggagcgagcggccgaagtgtcctgggaggaggaggccgagcacagcggcgcgtcccacaatatcttggtcgaggtgcaggatgacgggacgatgaaaattaaggacgaggaacgagacgacacgttgaccatcctattaaaggccacgctcttagctgtcagcggggtctacccgatgtccatccccgccacgctgttcgtgtggtacttctggcagaagaaaaaacagcgctcgggggtactctgggacactccgagcccgcccgaggtcgagcgggccgtgctggacgatggcatctaccggatcctgcaacggggcctgctcgggcgatcacaagtgggcgtcggagtcttccaggatggcgtgtttcacaccatgtggcacgtcacccgcggggccgtactaatgtaccaggggaagcgcctggagccatcctgggcctctgttaaaaaggacctcatctcgtatggtgggggctggcgtttccagggaagttggaacactggcgaggaggtccaggtgatcgccgtggagcccgggaagaaccccaagaacgttcagaccacgcccggcacctttaagacacccgagggcgaggtgggggccatcgccttagacttcaaaccagggacctctgggagccccatcgtcaaccgcgaaggaaagatagtaggcctctacggaaacggtgttgtgacgaccagtggaacgtacgttagtgcgattgcgcaggccaaggcaagccaggagggcccgctgcccgaaatcgaggacgaggtgttcaagaagcggaacctgaccatcatggacctacacccggggtccggcaagacccgtcggtatctgccggccatcgtccgcgaggcgatcaaacgtaagttacgaaccctaattctcgccccgactcgcgtcgtagcctccgagatggccgaagcgttaaagggaatgcccatcagataccaaactaccgccgtgaagtccgagcatacagggaaggagatcgtggacctgatgtgccacgctaccttcaccatgcgcctcctgagtcccgtgcgggtgccgaactacaacatgataataatggacgaggcgcacttcacagatccagcctccatagcggcccgcggctacattagcacccgggttgggatgggcgaggccgccgccatcttcatgacggcgacgccgccagggtccgtggaggcgttcccacagagcaacgctgtaatccaagacgaggagcgcgacattcctgagcggtcctggaacagcggctacgactggattaccgacttccctgggaaaaccgtctggttcgtaccctcaatcaagagcggcaacgacatcgccaactgcctgcgcaagaacggcaaacgggttatacagctttcccgaaagacgtttgacacggaataccagaagaccaagaataatgactgggactatgtcgtgaccacggatatcagcgagatgggtgccaacttccgggcggaccgcgtgattgacccgcggcgctgtctgaagccagtcatcctcaaggacggaccggagcgggttatcttagcagggcccatgccggtgaccgccgcgtcagcggcccagcgccggggccgcatagggcgcaaccagaacaaggagggtgaccagtacatctacatgggccagcccttaaacaacgacgaagaccacgcccactggacagaggctaagatgctgctcgacaatattaatacacccgaggggattatccccgcgctgttcgagccggagcgggagaagtccgcggccatcgacggcgagtaccgcttgcgcggggaagcccgcaaaacgttcgtggagctgatgcgtaggggcgatctgccagtgtggctgtcatataaggttgccagcgagggctttcaatattccgaccgccgctggtgcttcgatggggagcggaacaaccaagtgttagaggagaatatggacgtagagatatggaccaaagagggagagcgcaaaaagctacggccccgctggctggacgcccgcacgtatagcgacccactcgcgctacgcgagttcaaggaatttgccgccgggcgacgctccgtgtcaggcgatctaatcctcgaaatcggaaagctgcctcagcacctcacactcagagcccagaacgcgcttgacaacctggtgatgctccacaactcggagcagggcgggaaggcgtaccgacacgctatggaagagctccccgacaccatcgaaacactgatgctcctggcgctgatcgccgtgttaaccgggggcgtaacactgtttttcctgtcaggaaagggcttgggcaaaaccagcattggccttctgtgtgttatggcgagtagcgttctcctgtggatggcgtccgtggagccacactggatagccgcgagcatcatcctggagttcttcctcatggtgctgttgatcccagaaccggatcggcagagaacgccccaggacaaccagctcgcctacgtggtcatcggcctgttattcatgatactcactgttgcagctaacgagatgggacttctggagacgaccaagaaagacctcggcatcggtcacgtagtcgccgagaaccaccaccacgccacgatgctggacatcgatctacacccagcctccgcgtggaccctatacgcagtagccacaaccatcatcacgcctatgatgcgacataccattgagaataccactgccaacatctcgctcacggccatcgcaaatcaagccgctatcctgatgggcttggacaaaggatggcccatatccaaaatggacatcggggtgcccctgttagccctcggctgctacagccaggtcaaccccctgaccctgaccgcagcggtgcttatgctggtcgcccactacgccatcatagggccggggctgcaggccaaggccacacgcgaggcccagaaaaggacggccgcggggataatgaagaatccaaccgtcgacggcatcgtggctatagacctcgacccggtggtgtatgacgcgaaatttgagaagcagctgggccaaatcatgctgctcatcctgtgcacctcccagatcctgctcatgcggaccacgtgggccctgtgcgagagcataacgctggccactggtcccctcaccacgctgtgggagggctccccgggtaagttctggaacaccaccattgcagtgtcaatggcaaacatattccgtggctcatacctggccggggccgggctcgcctttagtctgatgaaatccctgggcgggggccggcgaggaacaggcgcccagggagaaactttgggagaaaagtggaaacgtcagctgaaccagctgagtaagagcgagtttaacacttataagcgctccggcataatggaggtagaccggagtgaggcgaaggaggggctcaagcgcggcgagaccaccaagcatgcggtctcccggggcactgccaagctgcgctggttcgtcgagcggaacctggttaagcccgagggcaaagtcatcgacctgggctgcgggcgcggcgggtggagctactactgcgccggcctcaagaaagtaaccgaggtgaaggggtataccaaggggggccccgggcacgaagagccgataccgatggccacctacggctggaacatcgtcaagctgcactccgggcgggacgttttcttcacgccgccggaaaagtgtgacacgctgctctgcgatattggcgaaagttcccccaatccgacaattgaggaagggcgcaccctgagggtgctgaagatggttgaaccgtggctccgcggaaaccagttctgcataaagatcctgaacccttacatgccctcagtggtggagacgctggagcagatgcaacggaaacacggcggtatgctggtccgtaacccgctgtcgcggaactcgacgcacgagatgtactgggtgagctgcggcaccggcaatatcgtgtcagcggtaaacatgaccagtcgcatgttactcaacaggttcactatggcccaccggaagcccacatacgagcgcgacgtggacctcggagccggcacccggcacgtggccgtcgagccggaaatcgccaacctggatatcatcggccagcgtatcgagaacatcaagaacgagcacaaatcgacatggcattacgatgaggacaacccctacaagacctgggcgtaccacgggtcgtatgaggtcaaaccgagcggatccgccagcagtatggtaaacggcgtcgtccggttactaacgaagccctgggatgtaatcccgatggtgactcagatcgccatgactgacacaacgcccttcggccagcaacgcgtgttcaaggagaaagttgacaccagaacgccgagacccaagcggggcaccgctcagataatggaggtgacggccaagtggctgtggggcttcctaagcaggaacaaaaagccccggatctgcacccgcgaggaatttacccggaaggtacgcagcaacgctgccatcggagctgtgttcgtggacgagaaccagtggaactccgccaaagaggctgtcgaggacgaaaggttctgggacctggtccaccgcgagcgggagcttcacaagcagggcaagtgcgcgacctgcgtgtacaacatgatggggaagcgggagaagaagctcggcgaattcgggaaggccaagggcagccgggccatttggtacatgtggctgggcgcccgcttcctcgaattcgaggcgctcgggttcatgaatgaagaccactggttctcgcgcgaaaatagcctaagtggcgtggagggtgagggcctgcacaagttaggttacatcctccgggacatctccaagatcccgggcggtaacatgtacgccgacgacacggccggatgggacacccgcatcaccgaggatgacctgcaaaacgaggcaaagatcaccgacatcatggagcctgagcacgccctgctggcgacgtccatcttcaaacttacctaccagaacaaggttgtgcgggtgcagcgccccgccaagagcggcaccgtcatggacgtcatctcccggagggaccaacggggaagcggacaggtgggcacctatgggttgaacactttcacaaatatggaggtccagctgatccgacagatggaatcggaaggcattttctccccatcagagctggagaacagcaacctggccgagcgggtgctggactggcttgaaaaacacggagttgagcgcctcaagaggatggccatctccggggacgactgtgtcgtgaaaccgaccgatgaccgcttcgccactgctctgacggccctgaacgatatgggaaaagtgcggaaagacataccccaatgggaacccagcaagggctggaatgattggcagcaggtccctttctgctcccaccacttccaccagctcattatgaaggacggtcgcgaaatagtggtgccctgccggaaccaagatgaacttgtcggtcgcgccagggtgagccagggtgccgggtggagcctgcgcgaaacggcctgccttggcaaatcctatgcacagatgtggcagctgatgtacttccaccgaagagacctgaggctcgccgccaacgcaatatgcagcgcagtgcccgttaactgggtccctacctcccgaacgacatggagcatccacgcgcatcaccagtggatgactaccgaggacatgctgtccgtgtggaacagagtctggatcgaggagaacccctggatggaggacaaaacccacgttagctcgtgggaagacgtgccctacctgggtaagcgggaggaccaatggtgcggcagcctcatcgggctgaccgcaagggccacgtgggccaccaacatccaggtcgctatcaaccaggtgcggcgactaatcgggaacgaaaattacttggactacatgacctccatgaagcgattcaagaacgagagcgaccccgaaggggctctgtggtga

SEQ ID NO: 23756 - RNA, 9879 nt, synthetic construct
  misc_feature 1..9879: note = derived and/or modified CDS sequence (opt11) from DENV-1__KX380802__SS-prME
  source 1..9879: mol_type = other RNA
tctgtaaccatgctactcatgctcttacccacggctctcgccttccacctgaccacccgcggcggggaaccccacatgatcgtgtctaagcaggagcggggcaagagcctgctgttcaagacctccgcgggggtgaacatgtgcaccctgatcgcaatggacctgggggagctctgcgaggacacaatgacctataagtgtccccgaatcacggaggccgaacccgatgacgtggactgctggtgtaacgccaccgacacctgggtgacttatgggacctgtagccagactggcgagcaccgtcgcgacaaaaggtctgtggccctggcaccccatgtgggcctaggtctcgaaacccgcacagaaacctggatgtcgtccgagggcgcgtggcggcagatacagaaggtggagacctgggcactgcggcacccggggttcacagtcatcgccctctttctagcgcacgccatcggcaccagcatcacccagaaggggatcattttcatcctgctcatgctcgtgaccccctccatggccatgcggtgtgttggcataggcaatcgcgacttcgtagaagggctgtctggcgctacctgggtggacgtcgtactggagcacgggtcctgcgttaccaccatggccaagaacaagcccacgcttgacattgagcttctgaagacggaggtcactaacccggcggtgctccggaagctgtgcatcgaagccaaaatcagtaacaccaccacagactccagatgccccacccagggcgaggcaaccttggttgaggagcaggacgcgaacttcgtctgcagacgcaccttcgtcgaccggggctgggggaacggctgcggattattcgggaaggggagcctgctgacgtgcgccaagttcaagtgcgtgaccaaacttgagggcaagatcgttcagtacgagaacctgaaatactccgtgatcgtgaccgtccacaccggcgaccagcaccaggtgggcaatgagacgaccgaacacggcaccatcgcgaccatcacgccccaagcgcccacgagcgaaatccagctaaccgactacggggccctcaccctcgactgcagtccccggactggcctcgacttcaacgagatggtcctactgacgatgaaggagaagtcctggctggtgcataaacagtggttcctcgacctgccgctaccctggacttccggtgccagcaccagccaggaaacatggaaccgtcaggacctcctggtgacattcaagaccgcgcacgcgaaaaagcaagaggtcgtcgttctgggttcccaggagggtgctatgcacaccgccctcaccggggccactgagatacagaccagtggcactaccacgatcttcgcagggcatttaaagtgccgcttgaagatgggcaagctcaccctgaagggggtctcctacgtgatgtgcaccggctcgtttaagctggagaaggaggtggcggaaactcagcacggcacggtactggtccaagttaagtacgaagggactgacgccccctgcaagattccgatatccactcaggacgagaagggagtcacccagaacgggcggctcatcacggccaacccgattgtgaccgacaaggaaaagccggtaaacatcgagaccgagccaccctttggcgagagctatatcgtcatcggcgccggtgagaaggctttgaagctgtcctggtttaagaaaggaagctccatcgggaagatgttcgaggccaccgctcgcggcgcccggcgcatggccattctcggggacaccgcgtgggacttcggcagcatcggaggggtgttcacctccgtaggcaagttagtgcaccaagtgtttggtaccgcctatggcgtgctgttcagcggcgtttcctggaccatgaagatcggcatcggcatcctcctgacctggcttgggttgaacagccgctccactagcctgtcaatgacctgcatcgcggtgggcatggtgacactgtacctcggggtcatggtgcaggccgatagcggatgtgtcattaactggaaggggcgagagctcaaatgcggctccggcatctttgtcacgaacgaggtgcacacctggactgagcagtacaagttccaggccgacagcccgaagcgcctctccgcggctatcgggaaggcttgggaggagggcgtgtgcgggatccggtccgcaacccgtctcgagaacatcatgtggaagcaaatcagcaatgagttaaaccacatcttgctcgagaacgacatgaaattcacggtcgtggtcggcgacgctaacggtattctgacccaaggcaagaagatgattcgtccccaacctatggagcacaagtactcctggaagtcctggggcaaggcgaagatcatcggggccgacacccagaacacgaccttcatcatagacggcccggacacgcccgaatgtcccgatgaccagcgggcctggaacatctgggaagtcgaggactacgggttcggcgtgtttaccaccaacatctggctgaagctgcgggactcctacacccagatgtgcgaccaccgccttatgagcgcggcgatcaaggactctaaggccgttcacgcagacatgggatactggatcgagagcgagaagaacgaaacgtggaaactcgccagagccagcttcatagaagtcaagacctgcatctggccccgctcgcacaccttgtggtccaacggggtactggagagcgaaatgattatccccaagatctatggcggaccgatctcccagcacaattaccggcccggctacttcacccagacggcggggccctggcacctagggaagctcgagctggacttcaacctgtgcgagggcaccactgtggtcgtcgacgagcactgtggcaaccgcggcccgtccctcagaaccacgaccgtgaccggtaagatcatccacgagtggtgctgccgctcctgtactctgccgccattacggttcaggggagaggacggatgttggtatggcatggagatccggcccgtaaaggagaaggaggaaaacctcgtgcgctccatggtgtccgccggctcgggggaggtcgacagcttctccctgggactgctgtgcgtgtcaatcatgatcgaggaggtgatgagaagtcgttggagccgcaaaatgctgatgacgggcaccctggccgttttcttcctcctgataatggggcaactgacctggaacgacctcattcggctgtgtatcatggtgggggccaacgtgtccgatcgcatgggcatgggaaccacctacctggctctcatggcgacctttaagatgcggccgatgttcgcggtcggtctactgttccgccggctcaccagccgcgaggtgctgctgctcaccattggcctgtccctagtcgccagcgtggagctcccgaactccttggaggagctgggcgacggcctcgccatgggcattatgatgcttaagctgctcactgacttccaaagccaccaactgtggaccaccttactaagcctgaccttcatcaaaacgaccttgtctctcgactacgcgtggaagactatggccatggttctgtccatagtcagcctgttccccctttgcttatccacaacgtcccagaagaccacctggctgcccgtcctcctggggtccttcggctgcaagccgctgacgatgttcttgattacggagaataagatctgggggcgcaagagctggcccctgaacgagggcatcatggctgtagggatcgtaagtatcctgttgagctcactgctgaaaaacgatgtcccgctcgccggtccactcatcgccggtggaatgctgatcgcgtgctacgtgatcagcggatcttccgcagacctcagcctggagcgcgccgccgaggtcagttgggaggaggaggccgagcactcaggggcttcccacaacatcctggtagaggtgcaggacgacggtacaatgaagattaaagacgaggagcgggacgacaccttaacgatcctgctgaaggccaccctcctggcagttagcggagtgtacccgatgtccatccccgccactctgttcgtgtggtacttttggcagaagaagaaacagagaagcggggtcctctgggatacccccagtccgcccgaggtcgagcgggccgtattagatgacggcatctaccgcatcctgcagcgggggctgctcggcagaagccaggtcggggtaggcgtgttccaagacggggtcttccacaccatgtggcacgtgaccaggggcgcagtgctgatgtaccagggcaagcggctggaaccctcctgggcgagcgtcaagaaagacctcatctcgtatgggggcgggtggcggttccaggggagctggaacacgggcgaggaggttcaggtgatcgccgtggagcccggcaagaaccccaaaaacgtgcagaccactcctggcacgttcaagacgcctgagggtgaggtcggagcaatcgccctggacttcaagcccgggacctctggcagccccatcgtcaaccgcgaggggaagatcgtaggattatacggcaacggggttgttaccacatctggaacgtatgtcagcgcgatcgcccaggccaaagccagccaggagggcccgttgcccgagatcgaggacgaggtctttaaaaagcggaacctgaccatcatggacctgcaccctgggtccggcaaaacccgccgatacttacctgcaattgtccgcgaggcgatcaaacgcaagctgaggaccctgatcctcgccccgacgcgcgtggtggccagcgagatggccgaggcgttaaaaggaatgccaatccgttaccagaccaccgccgtcaaatccgagcacaccggcaaggagatcgttgacttaatgtgccacgccacgttcaccatgcgcctactgtcaccagtgcgggttccgaactacaacatgatcattatggacgaggcacactttactgatcccgcctccatcgcggcccgggggtacatcagcacccgcgtaggcatgggggaggccgccgccatcttcatgacggccacgccgcccggctccgtggaggcttttccgcagagcaacgccgtcatccaggatgaggagcgggacattcccgagcggtcctggaacagcggctacgactggatcacagacttcccagggaagaccgtgtggttcgttccctccattaagtctggcaacgacatcgccaactgcctgcggaagaacggtaaacgggtgatccagctcagccgcaagacgtttgacaccgagtatcagaaaaccaagaacaatgactgggactacgtggtaaccacggatattagcgagatgggcgccaacttccgggccgaccgcgtcatcgacccgagacgctgcctgaagcccgtgatccttaaggacgggcccgaacgggttattctagccggcccaatgccggtgaccgcggccagcgcggcccaacgcagaggcagaatcgggcgcaaccaaaataaagaaggcgatcagtacatctacatgggacaacccctgaacaatgacgaggaccatgcccactggaccgaggctaaaatgctgctcgacaacatcaatacccccgagggaataattcccgcgcttttcgaacccgagcgggagaagtccgccgccatcgacggggagtaccgcctacggggcgaggcgagaaagactttcgtggagctcatgaggcgcggcgacctccccgtctggctttcctacaaggtggcaagcgaggggttccagtactccgaccggcgctggtgcttcgacggtgagcggaacaatcaggtgttagaggagaacatggacgtcgagatttggaccaaggagggggagcgcaagaagctgcggccccgctggctggatgcccggacctacagcgaccccctcgcgctgcgcgaatttaaggagttcgcggcaggccggcgttctgtgagcggcgacctgatattggagatcgggaagctgcctcagcatcttaccctccgagctcagaacgccctggacaacctggtgatgctccacaacagcgagcaaggagggaaggcgtacagacacgctatggaggagctgcccgacaccatcgagactctgatgctccttgccctgatcgccgtcctcaccggtggggtgaccctgttcttcttatcgggcaagggactcgggaaaactagcatcggtctgctgtgtgtgatggcgtccagcgtcctcctctggatggcctccgtggagccccattggatagccgcgagcatcatcctggagttctttctcatggtgctgctaatccccgaaccggaccggcagagaacgcctcaagacaaccagcttgcttacgtcgtgattgggctcctgttcatgattctcactgttgcagccaacgagatgggcctgttagaaacaaccaaaaaggacctcgggatcggtcacgtcgtggccgagaatcaccaccatgctacgatgctggacatcgatctccaccccgcctcagcatggacgctctatgccgtggccactacaatcattaccccgatgatgcggcacaccatcgagaacaccacggccaacatcagcctgacggcaatagcgaatcaggccgcaatcttgatgggtctcgacaaaggatggccaatctccaagatggacatcggcgtacccctgctggccctcgggtgctacagccaggtgaaccccctgactctgaccgcagcagtactaatgttagtagcccactatgccatcattggccccgggctgcaggccaaggcgactcgcgaggcgcagaaacgaacggccgccggcattatgaagaaccccaccgtggacggtatagttgccatcgaccttgaccccgtagtatacgacgctaagtttgagaagcagctggggcagataatgctgctcatactgtgcacctcccaaatcctgctcatgcggaccacctgggccctctgcgaatctatcaccctggccaccggccccctcaccacgctttgggaggggtccccgggcaagttctggaataccaccatcgccgtcagcatggccaacatcttccggggctcttatctggcgggggccggcttggcctttagcctgatgaagtccctcgggggcggccgacgcggcaccggcgcccagggtgagacgctcggcgagaagtggaagcggcaactgaaccagctgagcaagagcgagttcaacacttataagcgctctgggatcatggaggtggaccggagcgaggccaaggagggccttaagcgcggggagacaacgaagcacgcggtgtcccggggcacagccaagctgcgctggttcgtggagagaaacctggttaagccggagggcaaggtgatcgacctagggtgcggcagagggggctggagttactactgcgccgggttaaagaaggtgacggaagtcaagggttacacgaaaggcggacccggccacgaggaacccatcccgatggccacctatgggtggaacatagtgaaactgcactcggggagagacgtgttcttcacgccgcccgagaagtgcgacacgctgctctgcgacatcggtgagtcctcccccaacccgaccatagaggagggcaggaccctgcgggtacttaagatggtggagccctggttgagaggcaaccagttctgcatcaagatactgaacccctacatgcccagcgtggtagaaaccctggagcagatgcagaggaagcacgggggcatgctcgtgcgcaacccgctcagtcggaacagcacgcacgaaatgtactgggtatcctgcggaaccggcaatatagtcagcgcggtaaacatgacctcccgaatgctgctcaaccgattcaccatggctcaccggaagcccacgtacgagagagatgtggaccttggcgccgggacccggcacgtcgccgtggagcccgagatcgccaatctggatatcatcggccagcgcatcgaaaacatcaagaacgagcataagtcaacctggcattacgacgaagacaacccctacaagacctgggcttaccacgggtcctacgaggtgaagccgtcaggctccgccagctccatggtcaacggggtcgtccggctcctgacgaagccctgggacgtgatacccatggtgacccagatcgctatgactgacaccacgcccttcggccaacagcgcgtattcaaggagaaggtcgacacccggaccccgagacccaagagaggaacagcccaaataatggaggtcacggccaagtggctgtgggggttcctcagccgtaacaaaaagcccaggatctgcacccgcgaggaatttacccggaaggtacgcagcaacgcggccatcggcgccgtgttcgtggacgagaaccagtggaacagtgccaaagaggccgtcgaggacgaacgcttctgggacctggtgcaccgcgagcgggagctgcacaagcagggaaaatgcgctacctgcgtgtacaacatgatgggcaaacgagagaagaagctcggagagttcggcaaggccaagggcagcagagccatctggtacatgtggctgggggcccgctttctggagttcgaagcgctaggcttcatgaacgaggaccactggttctctcgggagaacagcctctccggtgtcgagggcgaggggctgcacaagctcggctacatcttacgagatatcagcaagataccgggcggcaatatgtacgctgacgacacggccggctgggacacccgtatcaccgaggacgacctacagaacgaagccaaaataactgacataatggagcccgagcacgccctcctggcgacatccatctttaagctgacctaccagaacaaggtggtacgggtccagaggcccgccaaaagtgggactgtcatggatgtgatctcccggcgcgaccaacggggcagcggacaagtcggaacctacggcctcaatacgttcaccaacatggaggtgcagctgattcgccagatggagtccgaagggattttctctccctccgagctggagaacagcaacctcgctgagcgggtgctggactggttggagaagcatggcgtcgaaaggctcaagaggatggctatcagcggggatgactgcgttgtcaagccaaccgacgatcgcttcgcgaccgcgctgaccgccctgaatgatatgggcaaggtccggaaggacataccccaatgggagcccagcaaaggctggaacgattggcagcaggtacccttttgctcccaccacttccaccagctcatcatgaaggacgggcgcgagatagtggtcccgtgccggaaccaggacgagctagtgggacgcgcccgcgtgagtcagggggcgggctggagcctgcgcgagacggcctgcctcgggaaatcctacgctcagatgtggcagttgatgtacttccacagacgcgacctgcggctcgccgccaacgccatctgcagcgccgtacccgtgaactgggtgccgacctcgcgcacgacgtggagtattcacgctcatcatcagtggatgacgaccgaagatatgctgagcgtctggaaccgcgtgtggattgaggagaacccatggatggaggacaagacccatgtgagctcctgggaggacgtcccttacctgggaaaacgggaggatcagtggtgcggcagcctgattgggctgaccgcgcgcgccacgtgggccaccaacatccaggtggcgatcaaccaggtacggcgcctgatcggcaacgaaaactatctcgattacatgacctccatgaagagattcaagaatgagagcgaccccgaaggggccctgtggtga

SEQ ID NO: 23757 - RNA, 9879 nt, synthetic construct
  misc_feature 1..9879: note = derived and/or modified CDS sequence (opt11) from DENV-1__KX380797__SS-prME
  source 1..9879: mol_type = other RNA
agcgtgacggttctgctcatgctgctgcccaccgcccttgcctttcacctgactacccgcggcggcgagccccacatgatcgtgagcaagcaggagagaggcaagtctctgctgttcaagacttccaccggggtgaacatgtgcactctgattgcgatggacctgggtgagttatgcgaagacaccatgacctacaaatgcccccggatcaccgagaccgagcccgacgacgtcgactgctggtgtaatgccactgagacatgggtgacctatgggacttgcagccagaccggcgagcatcggcgcgacaaacggtccgtggccttagcgccccacgttggcctggggctcgagacccgcaccgagacctggatgagctccgaaggcgcgtggagacagatccagaaggtggagacctgggccctgcgccatcccggcttcaccgtgatcgcactgttcctagcccacgccataggcaccagcatcacacagaaagggatcatctttatactgcttatgctcgttaccccctccatggcgatgcggtgcgtgggcatcggaaaccgcgacttcgtggaggggctgagcggggcaacctgggtcgatgtggtgctggagcacgggtcctgcgtgacgacgatggccaaggacaagccgaccctcgacatcgagctgctgaagactgaggtgaccaaccccgccgtgctgcggaagctgtgcatcgaggcgaagatcagcaacacgaccaccgattcgcgctgccccacccagggagaggcgacgctggtcgaggaacaagataccaacttcgtgtgcagacgcaccctcgtggatcggggctgggggaatggatgtgggctgttcggcaaggggagcctgatcacgtgtgccaagttcaagtgcgtgacgaaactcgagggcaagatagtgcagtacgagaacctgaagtatagtgtgatcgtcaccgtgcacaccggcgaccaacaccaggtcggaaacgagaccaccgagcacggcacgaccgccaccataactccccaggcccccacgtccgagatacagctgaccgactacggagccctcaccctggattgcagcccccggaccggcctggacttcaatgaaatggtgctcctgacgatgaaggagaagtcctggctggtgcacaagcagtggttcctcgacctgccactgccctggacctcgggggcgagcaccagccaggagacctggaaccgtcaggatctgctggtcacgttcaagaccgcccacgcgaagaagcaggaggtggttgtcctgggctcccaggagggagccatgcacaccgccttgaccggggcgacggagatccagaccagcggcaccaccacgatctttgcggggcatctaaaatgccgtctgaagatggacaaactcaccctgaagggcgtgtcctacgtcatgtgcaccgggagcttcaagctggagaaagaggtcgctgagacccaacatggcacggtgctggttcaggtgaagtacgagggcaccgacgccccctgcaagatccctttcacgtcccaagacgaaaaaggggtgacacagaacggtcgtctcatcacggccaacccgatcgtcaccgacaaggagaagcccgtcaacatcgaggcggaaccgccgttcggggagagctacctggtggtgggcgccggcgagaaggcccttaagctctcctggttcaagaaggggtcatccatcggcaagatgttcgaggccaccgcgcgcggggcccggcgcatggccattctgggcgacaccgcctgggatttcgggagcatcggcggcgtattcacctccgtggggaagctgatccaccagatcttcggcaccgcctacggggtgctctttagcggcgtcagttggaccatgaaaattgggatcggtatcctgttgacctggctcggattaaactcaaggtccacgagcctgtccatgacgtgcatcgcggtgggcatggtgaccctctacctgggtgtcatggtgcaggccgacagcgggtgtgtgatcaactggaagggacgggagctgaagtgcgggtccgggatctttgtgaccaacgaagtacacacttggacggaacagtacaagtttcaggctgacagtccgaagagactcagcgccgccatcggaaaggcgtgggaggagggagtgtgcggcatccggtccgccacccgattggagaacatcatgtggaagcagatcagcaacgagctaaatcacatcctgctggagaatgatatgaaatttacagtcgtggttggggacgtcaatggcatactggcgcaggggaagaaaatgatccggccccagcccatggaacataagtactcctggaagtcctggggcaaggcgaaggtgatcggtgccgacgtgcagaacagtaccttcatcatcgacgggcccaacaccccggagtgccccgatgaccagcgcgcgtggaacatttgggaagtcgaggactacggcttcgggatcttcaccacgaacatttggctcaagttgcgggatagctacacccaggtgtgcgaccaccgcctgatgagtgccgccataaaagacagcaaagcagtgcacgctgacatgggctactggatcgagtcggagaagaacgagacgtggaagttgaccagggccagcttcatcgaagtgaaaacctgtgtgtggccaaagtcccacaccctgtggagcaatggggtgctggagtctgagatgatcatccccaagatctatgggggtccgatcagccagcacaattatcgacccggttatttcacgcagacggccggtccctggcacctagggaagctggagctggacttcggcctttgtgagggcacaaccgtggtggtggacgagcactgcgggaaccggggcccgtcactgcgcacgaccaccgtgaccgggaagatcatccacgagtggtgctgcagaagctgcacgttaccgcccctcagattcaagggcgaggacgggtgctggtacggcatggagatccggcccgtgaaggaaaaggaggaaaaccttgtgaagtccatggtcagcgctgggagcggtgaggtggacagtttcagcctgggcctcctctgcatctccatcatgatcgaggaggtgatgcgcagccggtggagccgaaagatgcttatgaccggcaccctcgccgtcttcctgttgctcataatgggccagctgacctggaatgacctgatccggctctgcatcatggtgggagctaacgccagcgacaagatgggcatgggtacaacctacctggccctaatggccacctttcgcatgcgccccatgttcgcagtcgggctcctgtttcgacgcctaacctccagagaggtgctcctgagatctgtgggcctctctctcgttgcgagcgtggagctgccgaactcgctggaggaactcggggacggactggccatgggcatcatgatgctgaagctcctgacggacttccagagccaccagctctgggccgcactattatccctgaccttcgtgaagacaaccttcagcctccactacgcctggaagacaatggccatgatcctttccatcgtcagcctgttccccctctgcctctccaccacctcccagaaaacgacgtggctgcccgtgctcctggggtccttgggatgcaagccgctcaccatgttcctgatcaccgagaataagatctgggggcgcaagtcatggcccctgaacgaaggcatcatggctgtggggatcgtcagtatcctcctgtccagcctgctcaagaacgacgtgcccctcgccggccccctgatcgccggcgggatgctcatcgcgtgctacgttatctctggaagctctgccgatctgagcttggagaaggctgccgaggtatcctgggaggaggaggccgagcactctggagcgtctcacaacatcctcgtggaggtgcaggacgacgggaccatgaagatcaaggatgaggagcgcgacgacaccctgacgatcctgctcaaggccaccttactagcgatcagcggcgtttacccgatgagtatccccgccaccctcttcgtatggtacttctggcagaagaagaaacagcggagcggcgtactgtgggacaccccctccccgcccgaggtcgagcgcgccgtcctggatgacggtatctaccggatcttacagcgagggctcctgggcaagagtcaggtaggtgtaggtgtgttccaagaaggtgtgttccacacgatgtggcatgtcacccggggcgccgtgctcatgtaccagggcaagcgcctcgagccctcctgggcttccgtaaagaaggacctcatctcctacgggggcgggtggcggttccagggcagctggaacaccggggaagaagtccaggtgatcgccgtggagcccggcaagaaccccaagaacgtccagaccgcccccggcactttcaagacccccgagggggaggtgggggccatcgcgcttgacttcaagcccggaacatccggaagcccaatcgtgaaccgcgagggcaaaatcgtgggcctctacggcaacggggtcgtgactacgagcggcacctacgtatcggccatcgcccaggctaaggccagccaagaggggccgctgcccgagatcgaagacgaggtgttccgtaagcgcaacctgaccatcatggacctccaccccggctccggcaagacccgccgctatctgccggccatcgtgagagaggccatcaaacggaagctgcggacactcgtcctggcacccacccgcgtggtggcaagcgagatggcggaggccctgaagggcatgcccattcggtaccagaccaccgccgtcaagtccgagcacacgggcaaggagatcgtggacctcatgtgccacgccaccttcaccatgcggctgctgagccccgttcgcgtcccgaattataacatgataatcatggatgaggcccacttcaccgaccctgcttccatcgccgcccgggggtacatcagcacccgcgtaggcatgggggaggccgccgccatcttcatgaccgccacgccgcccgggtccatggaggccttcccgcaaagtaacgccgccatccaggatgaggagcgggacatccccgagagaagctggaacagcggctacgactggatcaccgactttcctgggaagacagtttggttcgttccatcgatcaagagcggcaacgacatagcgaattgcttgcggaagaacgggaagcgcgtggtgcagttgtcccggaagaccttcgacaccgagtaccagaaaacgaagaacaacgactgggattacgtcgtgacgactgacatctctgagatgggcgccaactttcgcgctgaccgagtgatcgacccgcgccggtgcctgaaacccgtgatcttgaaggacgggcccgagcgcgtgatcctggccggccctatgccggtcaccgtggcgtccgcggcccagcggcgcggccgtatcgggaggaaccagaacaaggagggcgaccagtacatctacatgggccaacccctgaacaacgacgaggaccatgcccactggacggaggctaagatgctccttgacaatatcaacacgcccgagggcataatccccgcgctgtttgagccggaacgtgagaagagcgccgcgatagatggcgagtaccgcctccgcggcgaagcccggaagaccttcgtggaactgatgcgccggggcgacctgcccgtatggctgtcctacaaggtggccagcgaggggttccagtacagcgaccgacggtggtgcttcgacggtgagcgcaacaaccaggtgctggaggagaatatggacgtcgagatctggaccaaagagggggagcggaagaagctgcgccccaggtggttggacgcaagaacctactccgaccccctggccctgagggaatttaaggagtttgcggccggccgccggagcgtttccggcgacctcatactggagatcgggaaactgcctcagcatctcacacagcgcgctcagaacgcgctggataacctggttatgctccacaactccgagcagggcgggaaggcctaccggcatgccatggaagagctccccgacacgatcgagacccttatgctgctagccctgatcgcggtcctcaccggcggagtgacgttgttcttcctctcaggccgcggcctcggaaagacgtccatcggcctgctgtgcgtaatggcctcgagcgccctcctctggatggcctccgtcgagccccactggatcgccgcgagcatcatcctggagttcttcctcatggtgctgttgatccccgaacctgaccggcagcgcacgcctcaggacaaccagctcgcctacgtagtcataggactgttgttcatgatactcactgtggccgcgaacgagatgggcctgctggagaccacgaagaaagacctcgggataggccatgtggccgcggagtcccaccatcacgcggctatgctggacgtggacctgcacccggcctcagcctggaccttgtacgccgtggccaccaccatcataacgccgatgatgcggcacaccatcgaaaacaccactgcgaacatcagcctgacggccatcgccaaccaggcagccatcctgatgggtctcgacaaggggtggccgatcagcaagatggatatcggggttcccctgctggccctcgggtgttattcccaggtcaaccccctgaccctgaccgccgcagtgctcatgctggtcgcccactacgcaatcatcgggccgggtctgcaggcgaaggcgacccgcgaggcgcagaagcggacggccgccggcatcatgaagaaccctaccgtcgacgggatcgtcgccatcgacctcgaccccgtggtttacgacgccaagttcgagaagcagctagggcagatcatgctgttaatcctgtgcacgagccagatcctgctcatgcgcaccacgtgggcgctgtgcgagagtatcaccctggccaccggccccctcaccacgctgtgggaaggcagcccgggcaagttttggaacactaccatcgcggtgtcaatggccaacatattccgcggcagctacctggccggagcgggcctcgcttttagcctaatgaagagcctcgggggcggacggagggggactggcgcccagggggagacgctcggtgagaaatggaaaaggcagctgaaccagctgaccaaatctgagttcaacacatataagcggtccgggatcatcgaagtggaccggagcgaggccaaggaaggcctaaagcgcggggaaaccaccaagcatgcggtctccaggggaaccgccaagctgcgatggttcgtggagcggaacctggtgaagcccgagggcaaggtaatcgacctggggtgcggccgcggggggtggagctactactgcgccggtctaaagaaggtgaccgaggtgaaggggtacaccaagggcgggcccgggcacgaggagcctatccccatggccacgtacgggtggaacctcgtcaagctgtactccggcaaggatgtgttcttcacgccgcccgagaagtgcgacaccctcctgtgcgacataggggagtcctcccccaacccgaccattgaggagggccgaaccctacgcgtgctaaagatggtcgagccctggctgaggggcaaccagttctgcatcaaggtgctgaacccttacatgccgagcgtggtcgaaacgctcgagcagatgcaacgcaagcacgggggaatgctggtgcggaatccactgtcccgcaatagtacccacgagatgtactgggtgtcctgcggtaccggaaacatcgtcagcgcggtgaatatgacatcccggatgctcctgaaccgcttcacgatggcgcaccggaagcccacctacgaacgcgatgtggacctgggcgccgggacccgtcacgtcgccgttgagccagaggtcgccaacctggacatcatcggccaacggattgaaaacatcaagaacgagcacaagtcgacgtggcactacgatgaggataacccctacaagacgtgggcctaccacgggtcctacgaggtgaagccgtctgggagtgcgagcagcatggtgaacggggtcgtgcgcctgctgaccaagccctgggacgtgatcccgatggtgacccagattgccatgaccgacaccacccccttcggccagcagcgtgtattcaaggagaaggtcgacacccgcactccgaaggccaaacggggcacggcccagatcatggaggtcaccgcccgctggctctgggggtttttatcccgtaacaagaaaccgcgaatctgcacccgggaggaattcacccgcaaagtgcgttctaacgcggccatcggcgccgtgttcgtcgatgagaaccaatggaactctgccaaagaggcggtggaggacgagcgcttctgggatcttgtgcaccgggagcgggagctccacaagcaggggaaatgcgccacctgtgtctacaacatgatgggcaagcgggagaagaagctgggggagttcggcaaggccaagggcagccgcgcaatctggtacatgtggctgggggctcgtttcctcgagtttgaggcgctgggattcatgaacgaggaccactggttctcacgcgagaacagcctgtccggggtcgagggggaagggctccacaagttgggctacatactaagagacatcagcaaaatccccggcgggaacatgtacgccgacgacaccgccggctgggacacccgcatcaccgaggacgacctccagaacgaggccaagattacggacatcatggagccggagcacgccctgctggcgacctccatcttcaaactcacctatcagaataaagtggtccgcgtgcaacgcccagccaagaacgggaccgtgatggacgttataagccgccgggaccagcgcggctccggccaggtggggacgtacggcctgaacaccttcacgaacatggaggcccagcttatccggcagatggagtcagaggggatattccttccctccgagctggagaccccgaacctggccgagcgggtgctggactggctggaaaagtacggcattgagcggctgaaacgaatggcaataagcggggacgactgcgtcgtgaagccggtggacgaccggttcgccacggccctcacggccttgaacgacatgggcaaggtccggaaggatatcccccagtgggaacccagcaagggctggaacgactggcagcaggtccccttctgcagccaccacttccaccagctgattatgaaggacggacgggagatcgtggtgccatgtcgcaaccaagacgagctcgtcggccgggcccgcgtttcccagggtgccggctggagcctgcgtgaaactgcgtgcctgggcaagagctatgcccaaatgtggcagctgatgtactttcataggcgggacctgcgtctcgccgcaaacgcgatctgctccgccgttcctgtggactgggttcccaccagcagaacgacctggtccatccatgcccaccatcagtggatgaccaccgaggacatgctctcagtctggaaccgcgtgtggatagaggagaacccctggatggaggacaagactcacgtttccagctgggaagacgtcccgtacctgggcaaacgtgaggaccagtggtgcggatccctcattgggctgacggcccgcgccacctgggcgaccaacatccaggtggccatcaaccaagttcgccggctgatcggcaacgagaactacttagactacatgaccagcatgaagcgcttcaagaacgagtccgaccccgagggggccctctggtag

SEQ ID NO: 23758 - RNA, 9879 nt, synthetic construct
  misc_feature 1..9879: note = derived and/or modified CDS sequence (opt11) from DENV-1__KX380805__SS-prME
  source 1..9879: mol_type = other RNA
agcgtgacgatgcttctgatgctactacccacagcgctggcgttccacctcaccacccggggaggggaaccgcacatgatcgtcagcaagcaagaacgaggtaagtcgctactcttcaaaacgtccgcaggggtaaacatgtgtacactcatcgcaatggacttgggcgagctatgtgaagatacaatgacctataagtgcccccgaataaccgaagcggagcccgacgatgtcgattgctggtgtaacgcaaccgacacgtgggtaacatacggcacgtgcagtcaaacaggagaacacagacgagataagcgaagcgtggcactcgcaccgcatgtcggactaggactagaaaccagaacggaaacgtggatgtcatccgaaggggcatggcgacagatccaaaaagtcgagacgtgggcgctacgccaccctggcttcactgtaatagccctatttcttgcgcacgcgatcggcaccagcattacgcaaaaaggaatcatcttcatactcttgatgctcgtgacccccagcatggccatgaggtgcgtgggcataggcaaccgagatttcgttgaagggctatcgggcgcaacatgggtagatgtcgtcttggagcatggctcgtgtgtgaccaccatggctaagaacaagcccactcttgacatagaattactcaaaacggaggttacgaatcccgcggtactacgaaagctttgcatagaagccaaaatcagtaacacgaccaccgactcacgttgcccaacacagggagaagcaacattagtagaggagcaagacgcgaacttcgtgtgcagacggacgttcgtcgatcgaggatgggggaatggatgcgggcttttcggaaaaggcagtcttctaacatgcgccaagttcaagtgtgtcacgaaactagaaggaaaaatcgttcaatacgagaacttgaaatactcagtgattgtaacagtgcatacgggggaccaacaccaagtcggcaatgagacgacagaacacggcacaatagccacaataacaccacaagccccgacatcggagattcaactgacggattacggggctttgactctcgactgcagcccaaggaccgggctagattttaatgaaatggtgttactaacaatgaaagagaaaagctggcttgtgcacaagcaatggttcctcgacctaccacttccttggacatcgggcgcgtcaacaagtcaagagacctggaatcgacaggatcttctcgtaacatttaaaaccgcccacgcgaaaaagcaagaggtcgttgtcctcggcagccaggagggtgcgatgcacacagcactaacgggtgcaacggagatacaaacaagcggaacgacaacaatcttcgccggccacctcaagtgccgcctcaaaatggacaaactaacccttaaaggagtaagctacgtaatgtgcaccggatcgttcaaactagaaaaagaggtcgccgaaacacaacatggcaccgtcctcgtacaggtgaagtacgaaggaaccgatgcgccgtgcaaaattcccatctcgacacaagacgaaaaaggcgtcacgcaaaacggaaggctgataacggccaacccaatcgtgacggataaggaaaaacctgtaaacatcgagacagaaccgccattcggggagtcatacatcgtgataggggcaggtgaaaaggccttaaaattatcctggttcaaaaagggttcgagcatcgggaagatgttcgaggcaaccgcccggggggcgcgacgtatggcaatccttggagacacggcgtgggacttcggctcgattgggggtgtcttcacctcggttggcaaactcgtgcaccaggtcttcggcacagcatacggcgtcctcttctcgggggtatcctggacaatgaagataggaataggcattctcctcacatggctcggacttaactctcggtctacaagcttatcgatgacttgcatagccgtagggatggtgacattatacctcggggtaatggtgcaagcagactccggatgtgtaatcaactggaaggggagagagctaaagtgcgggtccgggatatttgtaacaaatgaagtacatacatggacagaacagtacaagttccaggcagacagcccaaaacgactgtccgctgcaataggcaaagcttgggaggagggggtctgcggcataagaagtgcgactcgcctggagaatatcatgtggaaacagataagcaacgagctaaaccacatacttcttgaaaatgacatgaagtttactgtcgtcgtaggcgacgctaacggcattctgacgcagggcaaaaaaatgattcgacctcaacctatggaacataaatactcgtggaagagctggggcaaagcgaaaataataggcgcagatacccaaaacacaacgttcataatcgacggaccagacaccccggaatgccccgacgaccagcgggcctggaacatctgggaagtagaggactatggattcggcgtatttacaaccaacatatggcttaagcttcgggacagctacacacaaatgtgcgatcacagacttatgtccgcagcaatcaaggattcgaaagcagtccacgcagacatgggctactggatagaatcggaaaagaacgaaacatggaagttagcccgcgcctccttcatcgaggtgaaaacctgcatatggcccagatcccacactctgtggtcaaatggagtcctcgagtcagaaatgataatcccaaaaatttacggcggcccgataagccagcacaattacaggcctggctacttcacccaaaccgctggcccatggcacctaggcaagctcgagctagacttcaacctatgtgaagggacgaccgtggtcgttgatgagcactgcggaaaccgaggaccatcgctaagaacaaccacggtcaccgggaaaatcatacatgaatggtgttgccgcagctgcaccctaccacccctacgctttcggggcgaagacggctgctggtatggcatggaaatacgaccagtcaaagaaaaggaagaaaacctagtacgctcgatggtctcagctggttccggagaggtcgattccttctcactcggcctactatctgtgtccatcatgatcgaagaggtaatgagaagcaggtggagtcgaaaaatgctcatgacgggaaccttagcggttttcttcttacttatcatggggcaactcacctggaatgacctaataaggctgtgtataatggtaggcgctaatgtgtcggaccgaatgggtatgggaacaacctaccttgcgctaatggcgacgttcaaaatgaggccaatgtttgccgtgggcctattattcagacggctgacgtctcgagaagtgctgctactcaccatagggctatcattggtcgctagtgttgaactcccaaattcactcgaagaattaggagatggcctagccatgggtataatgatgctaaagttacttaccgactttcaaagccaccagctatggacgacccttctaagcctgacctttattaaaacaacactaagcctcgactacgcctggaagacaatggcgatggtgctcagcattgtatcactctttcccttgtgtctctccaccacatcgcagaaaacaacttggctccccgtcctactggggtccttcgggtgcaagcccctcaccatgtttctcataaccgagaacaaaatctggggacgcaagagttggccgctaaacgagggcataatggcagtcggcattgtctcaatattgctgagcagcttgttaaagaacgatgtacccctcgcaggaccgttgatcgccggaggaatgttgatcgcatgttatgtcataagtggaagtagcgccgacctaagcctagaacgcgctgccgaggtctcgtgggaggaagaagcagaacactcaggggcgtcccataacatactcgtggaagtacaggatgacggaaccatgaagataaaggacgaagaacgggacgacactctgacaatactactgaaagccacactgttagccgtgagcggtgtataccccatgagcatacctgctaccctttttgtctggtatttttggcaaaaaaagaagcaacgtagtggcgtactgtgggacaccccatccccgccagaagtcgaacgcgccgttttagacgatggaatatatagaatactgcagagagggcttcttggacgaagccaagttggcgtcggtgtattccaagacggagtgttccacactatgtggcacgtcacacgaggtgcggtactcatgtaccaggggaaacggctcgaacccagctgggccagcgtgaaaaaggatctaattagttacggtggaggatggcgcttccagggaagctggaacacgggtgaagaagtgcaagtgatagcagtagagcccggaaaaaaccccaagaacgttcagacaaccccagggacattcaagacacctgaaggagaggtaggagcaattgctttagacttcaagccagggacaagcgggtcacccattgttaatcgggaaggaaagatagtaggcctatacgggaatggagtagtaacaacgagcggaacatacgtcagtgcgatagctcaagcaaaggcgtctcaggaggggcccttgccagagatcgaagacgaagtattcaagaaacgtaacttaaccatcatggacctgcacccaggatcagggaaaacacgtcgctatctaccagcgatcgtccgtgaagcaataaaaaggaaactaaggacactaatactagcaccaacgcgagtcgtcgcgtcagagatggcagaagccctaaaaggcatgccgatccgctaccaaaccacagcggtcaagtccgaacataccgggaaggagatagttgatctgatgtgtcacgcaacatttaccatgagactactaagccccgttcgagtccccaattacaacatgatcatcatggacgaagcacacttcacagacccagcaagcatagccgcacgcgggtacatatcgacacgcgttggcatgggcgaggccgcggcaatcttcatgacagcaacgcccccgggaagtgtggaggcattcccgcagtccaacgccgtgatccaagacgaagaaagagacatcccggagagaagctggaacagcggatacgactggattacggactttccgggcaaaaccgtttggttcgtcccctctataaagtcgggtaacgatatagcaaactgccttcgaaagaacggaaagcgggtgattcaattgtccagaaaaaccttcgatactgagtaccaaaaaaccaagaacaacgactgggattacgtagtaaccacggacatctccgaaatgggggccaacttcagagccgacagagtgatagatccacgtcgatgccttaaaccagtgatactaaaagacggacccgagcgcgtaatattggctggacccatgcccgtcacagcggcttccgcagcccaacgccgcggcagaataggcagaaatcaaaacaaagaaggcgaccaatatatttatatgggccaacccttaaataacgacgaggaccacgcacactggacggaggcaaagatgctgttagataacattaacacacccgaagggataatcccagccctgttcgaacctgagagagaaaagagcgcggcaatcgatggagaataccgtctacggggcgaggcgagaaaaaccttcgtcgagcttatgcggcgcggcgaccttcccgtatggctgtcatacaaagtggcgtcggaaggattccaatactcggataggagatggtgtttcgacggagaaagaaacaaccaagtgctagaagagaacatggacgtagaaatctggacgaaagagggagagcgaaagaagctccggccaaggtggctcgacgcaaggacatactcagatcctctggcgcttcgtgaattcaaggaatttgcagctggacgccgctcagtaagtggggacctgatactggaaatcggaaagttgccacaacaccttacattgagagcacagaacgccctagacaacctagtaatgctacataacagcgagcaaggaggtaaggcataccgacatgcaatggaagaactcccggacaccatagaaacactcatgctacttgcgttgatagcagtgctaaccgggggggtaactcttttcttcctatcaggcaagggactgggtaagacttccatcggactattatgcgtaatggcatcctcggtcctgctctggatggcctccgttgaaccacactggatagcagcatcgatcatattggagttcttcttgatggtgctgctaataccagagccagaccgacaacgcaccccccaagacaatcaactcgcgtatgtggtaataggactcctcttcatgatactcacggtcgccgctaatgagatgggactgttggagacgacaaagaaagatttaggcatagggcacgtggtagcggaaaaccaccaccatgcaaccatgcttgacatagacctccaccctgccagcgcctggaccctgtacgcggtagcgactaccattattaccccgatgatgcgacacacaattgaaaacacgacagcgaacataagcctgactgccatcgccaaccaggccgccatactaatggggctagacaaagggtggccaataagcaagatggacatcggggtcccgctgctagctttgggctgctattcccaggtcaatcctctgaccctaaccgccgccgtcttgatgctcgtggcccactacgcaataattggcccagggctacaagccaaagccacgcgagaggcgcaaaaaaggacagcggctggcatcatgaaaaacccgacagtagacgggatagtagcgatagacctcgacccagtcgtctatgacgcgaaattcgagaagcaattgggacagataatgctcctgatactatgtacgtctcaaatcttacttatgcgcaccacatgggctctatgtgaatcgattacactcgcgacaggacctcttacaacgctctgggaggggtccccaggcaagttctggaacacgaccatcgcagtatcgatggcaaacatattccgaggatcatacctggcgggagcaggcctagccttttccctcatgaaaagcctaggaggcggacgacggggcaccggagcgcagggggaaaccctaggagagaagtggaaaaggcaactaaatcagctatcaaaaagcgagttcaacacgtataaacggtccggcataatggaagtagacaggtccgaggctaaagagggactcaaacgcggggaaaccaccaagcatgctgtgtcccgcggaacggctaagttacggtggttcgtggaacgcaacctggtcaaacctgaaggcaaagtaatagatttaggctgtgggcgcggcggttggtcgtactactgtgcaggactcaaaaaggtgacagaagtaaaaggctacaccaaagggggccctgggcacgaggaaccgataccgatggcaacctacggctggaacatcgtgaagctgcattcaggacgcgatgtattcttcaccccgccagagaagtgcgacaccttgctatgcgatataggagagtcctcgcccaaccctaccatcgaggaggggagaacactgagagtactaaaaatggttgaaccatggttgaggggaaaccaattctgtattaagatcttaaacccctacatgccctcagtcgtcgaaacgctcgaacagatgcaaaggaagcatggcggcatgttagttcgtaacccactcagtcggaatagcacccacgaaatgtactgggtctcttgcgggacgggtaacattgtatcagcagtaaacatgacatcccgaatgcttctaaaccgcttcacgatggctcaccgaaaaccaacatacgagcgagacgtcgacctgggggcaggcacacgacatgtggccgtagaacctgaaatcgcgaaccttgacattatcggacagcgaatcgaaaacatcaaaaacgagcacaagtcgacatggcactacgacgaggacaacccttacaagacgtgggcgtaccacgggtcctacgaagtcaagccgagtggaagcgcttcaagcatggtcaatggagttgttcgcctcctcactaaaccgtgggacgtcatcccgatggtgacgcaaatcgcgatgacagacaccacaccatttggccaacagagggtgtttaaggagaaagtagacacgagaacccctcggccgaagcgcggaaccgcacagatcatggaagtcaccgcaaagtggctctggggcttcctatctcggaataaaaagccgagaatttgcaccagagaagaattcaccaggaaggtcaggagtaacgcagcgataggggccgtcttcgtcgatgaaaaccagtggaacagcgccaaagaagcagtggaagacgagcgattctgggatttagtgcaccgggaaagagaattacacaagcaaggcaagtgcgcaacatgcgtttacaacatgatgggaaaaagggagaaaaaactaggtgaattcggcaaggcaaaaggaagcagagcgatatggtacatgtggctgggtgcacgcttcttggaatttgaggccctcggtttcatgaacgaagaccactggttcagcagggaaaactcactgtcaggagtagagggcgaggggcttcacaaactaggatacatactacgagacatatcaaagatccccggcgggaacatgtacgctgatgacactgctggctgggacacccgcataaccgaggacgacctgcaaaacgaggcaaaaataacggacatcatggaaccagaacacgctctactagccacgagcatcttcaagctaacataccaaaacaaagtagttagggtgcaacgtcctgcgaaaagcggtaccgttatggacgttatctcccgcagggatcaaaggggaagcggccaagtggggacgtatggtcttaacacattcaccaacatggaggtacagcttatcaggcaaatggaatcggaaggcatcttcagcccgagcgaactggagaacagcaatctggcggaacgcgtcctagactggctggaaaaacacggggtcgaacggctcaaacggatggccataagcggtgacgactgtgtagtcaaacccaccgacgaccgcttcgcaaccgcattgacggctctgaacgatatggggaaggtgagaaaggatatcccacaatgggagcccagtaaagggtggaacgactggcagcaagtccctttttgctcccaccacttccaccaactgataatgaaggacgggcgagagatcgtcgtcccctgccgtaaccaggacgaactcgtgggccgggcacgggtaagccaaggcgcaggatggtctttgcgcgaaaccgcctgcttgggaaaatcatatgcccaaatgtggcaactcatgtacttccatagaagggacctccggctcgcagcaaatgccatctgctccgccgttccagtcaactgggttcctacctccaggacaacatggagcatacacgcccaccaccaatggatgacgactgaggatatgctctccgtatggaacagagtctggatcgaagaaaacccatggatggaagacaaaacccacgtaagctcatgggaagatgtgccgtatctaggaaaaagggaagaccaatggtgcgggagcctcataggcctaaccgcaagggccacgtgggcgactaacatacaggtcgcaataaaccaggttaggagactgatcggcaacgaaaattatctagattatatgacttcaatgaaacgatttaagaacgaaagtgatccggagggcgccctgtggtga

SEQ ID NO: 23759 - RNA, 9879 nt, synthetic construct
  misc_feature 1..9879: note = derived and/or modified CDS sequence (opt11) from DENV-1__KX380798__SS-prME
  source 1..9879: mol_type = other RNA
tcagttactatgcttctcatgctaatgcccaccgcactggcattccacctcaccacccgcggcggggaaccgcatatgatcgtaagcaaacaggagcgcggcaagagcctgctttttaagactagcgcaggggtgaacatgtgcacccttatcgcgatggacttgggggaactgtgtgaggatacgatgacctacaaatgccccagaatcacagaggccgagcctgacgacgtggattgctggtgcaatgcgaccgacacgtgggtaacttacgggacctgcagccagaccggcgagcaccggcgcgacaagcgctccgtcgccctcgctccccacgtaggcttaggactggagacgcgtaccgaaacttggatgagcagcgagggcgcctggaagcagatccagcgggtcgagacctgggcgttgcgccatcccgggttcacggtgatcgcgctgttcctcgcgcacgccatcggcaccagcatcacccaaaaggggatcatttttatcctcctgatgctggtgacgccctccatggccatgcggtgcgtcggtatcggcagccgcgatttcgtggaggggttatccggcgccacgtgggtggatgttgtgttagagcacgggagttgcgtgaccaccatggcaaaagataagcccacactggacattgagctactgaaaacggaggtcactaaccccgcgatcctacggaagctctgcatagaggccaagatatccaataccacaacggacagtaggtgtccgacccagggcgaggcgacactggtagaagaacaagacgccaacttcgtgtgccggcgcaccttcgttgaccgtggctgggggaacggctgcgggttgtttggcaaggggtcactcatcacgtgcgccaagttcaagtgcgtgaccaaactggaggggaagatagtgcagtatgagaatctgaagtacagcgtcatcgtgacagtgcacacgggcgaccagcaccaagtgggcaacgagtccacagagcacggcacgaccgcaactatcactccccaggctcccacgactgagattcagctcactgattacggtgcactgactttggactgctcgccccgcacgggcctcgactttaacgagatggtactcctgaccatgaaagagaaaagctggctcgttcacaaacagtggttcctggacctacccctgccctggacctcgggggccagcacatcccaggaaacgtggaaccggcaggatctgttagtgacgttcaaaaccgcccacgcaaagaagcaggaggtggtcgtgctcgggagccaggagggagcaatgcacacggccctcaccggggcgactgagatacagacttccggcaccacgaccatattcgcggggcacttaaagtgtcgactcaagatggacaagctaactttgaaaggaatgagctatgtgatgtgtactggctccttcaagctcgagaaggaagtcgccgagacgcagcacggcacggtgctggtacagataaagtatgagggaaccgacgccccctgcaagatccccttcagcacccaggatgaaaagggggtcacgcagaatgggcggctgatcaccgccaatccgatcgtcaccgataaggagaagcccgtgaacatcgaagccgagccgccattcggagaatcctacatagtgatcggtgcgggcgagaaggccttaaaattgagctggttcaagaagggttccagtatcggcaagatgttcgaggcgacagcccgcggtgccaggcgcatggctatcttgggggacacagcctgggacttcgggtccattggcggcgtttttacctctgtggggaagttagtacatcaaatcttcggcacagcgtacggcgtcctgttttccggcgtgagctggacgatgaagatcgggataggagtccttctgacatggctcggcctgaactcccgcagcacctccctgagcatgacctgtatcgccgtggggctcgtgaccctatacctgggcgtcatggttcaggccgacagcgggtgcgttatcaactggaaggggcgggagttaaagtgcgggagcggcatctttgtcacgaacgaagtgcatacctggaccgagcagtacaagttccaagctgactccccaaaacgcctgtctgccgcgattggcaaggcctgggaggagggagtttgcggcatccggagcgccactcgactggagaatatcatgtggaagcaaatcagtaacgagctcaaccacatactgctggagaatgacatgaagtttacagtcgtggtgggtgacgtcgccggcatccttgcccaggggaagaagatgatccggccccagcctatggaatacaagtacagctggaagtcctggggcaaggccaagatcatcggcgccgacgttcagaatacgacattcatcatcgacgggcctaacacccctgaatgtcccgacgaccagcgggcctggaacatctgggaggtggaggactacggctttggcatctttaccacgaacatctggcttaagctgcgggacagctacacccaggtctgcgaccaccgcctaatgtccgccgccataaaggactcaaaagcggtacacgcggacatgggctactggatcgagtccgagaagaacgagacctggaaactggcgcgggccagcttcatcgaagtcaagacctgcatctggcctaagtcccacacgttgtggagcaacggcgttctcgagtctgagatgattatccccaagatctacgggggccctatcagccagcataactatcggcccgggtatttcacccaaaccgccgggccctggcaccttgggaagttagaattggactttgatctgtgtgagggtaccacagttgtggtcgatgagcactgcggcaatcgggggccctccctgcgcacaaccacagtaaccggtaaaatcatccatgagtggtgctgtcggagctgtaccctcccgccccttcgcttccgcggagaagatggctgctggtacgggatggagatacgccccgtgaaggagaaagaagagaatctggtcaagtccatggtgagcgccggctctggcgaagtggactccttttcactcgggcttctgtgcatctccatcatgatcgaggaggtcatgcggagccgctggtcccggaagatgctcatgaccggcaccttagccgtcttcttgctactgatcatgggacagctgacgtggaacgatctaatcagactgtgcataatggtcggcgcgaacgccagcgaccgcatggggatgggcaccacgtatctagcactcatggccaccttcaagatgcggccaatgttcgccgtcggactactctttcgccgcctcacgtcccgcgaagtgctgttgctcacaattggtcttagcctggtggcgtcggtcgaattgcccaatagcctcgaggaactgggcgacgggctcgccatgggcatcatgattctgaagttattaacggacttccagtcccaccagctctgggcgactctgctcagcctgacgttcatcaagacgacctttagcctgcactacgcgtggaagaccatggcgatggtcctaagcattgtctccctgttccccctgtgcttatccacgacctcccaaaagaccacctggttgcccgtgttgttaggtagcctggggtgcaagccgctgacaatgttcctaatcgctgagaataaaatctggggcagacggtcctggcccctgaacgaggggatcatggccgtggggatcgttagcatcctgctaagctcccttttaaagaacgacgtgccgctcgcagggcccctgattgccggcggtatgctgatcgcatgctatgtaatatctggctcctctgccgacctgtccctggagaaggccgccgaggtcagctgggaggaggaagccgagcactctggcgcaagccacaacatcctggtggaggtacaggatgatgggactatgaagattaaggacgaggaacgggacgacaccctgaccatcctgctgaaggccaccttacttgccgtcagcggggtgtacccgcttagcattcccgcaaccctcttcgtttggtacttctggcagaagaagaagcaacgctccggggtcctgtgggacacccccagcccgcccgaggtggaacgcgcggtgctggatgatggcatttaccgcatcatgcagcgcggcctgctcgggcgctcgcaggtcggagtgggggtgttccaagagaacgttttccataccatgtggcacgtgacccggggcgcggttctaatgtaccagggaaagcgtctggagcccagctgggcatccgtcaagaaagatttaatatcttatgggggcggttggcgtttgcaggggtcctggaacacgggagaggaggtccaggtgatagccgtcgaacccgggaaaaaccccaaaaatgtacagaccgcacccggaaccttcaaaacacccgaaggcgaagtgggtgccatcgcgctggacttcaagccggggacgagcggctcccccatcgtcaacagagagggcaagatcgtgggactctacggcaacggggtggttaccacctcaggtacgtatgtgagcgccatcgctcaggccaaggcgtcccaggaggggccgctgcccgagattgaggacgaggtgttccggaagagaaatcttacgatcatggacctccacccaggcagcgggaagacccggcgttatctgcctgccatagtccgggaagccattaagcgcaagctgcgcactctcatcttggccccaacccgggtagtggcctcggaaatggcggaagccctgaaaggcatgcccatccgctatcagaccaccgcggtaaagtccgagcacaccggcaaggagatcgttgacctcatgtgtcacgctacctttacgatgcggctgctatcgcctgtgcgggtccctaactacaacatgatcatcatggacgaagcccatttcactgaccccagctccatcgccgcccggggatatatcagcaccagggtgggcatgggtgaggccgcagccatatttatgaccgccaccccgcccggctccgtggaggcctttccgcagagcaacgccgtaatccaagacgaggagcgagacattcccgaaaggtcgtggaactcggggtatgaatggatcaccgacttcccgggcaaaacagtgtggttcgtccccagcatcaagtcaggcaatgacatcgccaactgcctccggaagaacgggaaacgcgtcatacagctttccagaaagaccttcgacacagagtaccaaaagacaaagaacaacgattgggattacgtggtgaccaccgatatcagcgagatgggagcgaatttcagagcagaccgggtcatcgacccgagaaggtgcctaaaacccgtgatcctcaaggatgggccggaacgcgtgatcctggccggccccatgccggtcacggtggcctcagccgcgcaacgcagggggcgcataggccgaaaccacaacaaagagggggaccagtacatttacatggggcaacccctgaacaatgatgaggaccacgcccactggaccgaggccaagatgctgctggacaacatcaacacccccgagggcataatccccgctctattcgagccggagcgcgagaagtctgccgcgatcgacggggaatatcggttacgcggcgaggcccggaagacattcgtcgagctgatgcgcagaggagatctgcccgtatggttatcctataaggttgcctcagagggctttcagtacagtgatcgccggtggtgcttcgatggtgaacgcaacaaccaggtcctggaggagaacatggacgtggagatctggacgaaggagggagagcggaagaaacttcgcccacggtggctcgatgccagaacctattccgatcccttggcgttgcgggagttcaaggagtttgcggccggacgccggagcgtatccggtgacttaatcctggagataggcaagctaccgcagcatctcacccaacgcgcccagaacgcgctggataacctggttatgctccacaacagcgagcaaggcgggcgggcgtaccgccatgccatggaggagctgcccgacaccatcgagacgctgatgctcctcgcactgatcgccgtgctcactggaggggtgaccttgttcttcctgtccggccgcgggctcgggaaaacctccatcggccttctgtgcgtcatggcctccagcgtgctcctgtggatggcctccgtggagccacactggatcgcagccagcatcatcttggagttcttcctcatggtcctgctgatacccgagccggaccggcagcgtacgccgcaggacaaccagcttgcctatgtggtgatcgggctgctgttcatgatcctcaccgtcgccgcaaacgagatgggcctgctggagaccaccaagaaagacttaggaatcggccacgtggctgtaggtaaccaccaccacgcagcgatgttagacgtcgatttacaccccgcctcggcgtggaccctgtacgccgttgctacgacaatcatcacgcccatgatgcgccacaccatcgagaacacgaccgccaacatcagcttaaccgcgatcgcgaaccaggctgcaatccttatgggcctcgataagggctggccaatcagcaaaatggacattggcgtgcccctgctggccctcggctgctacagccaggtcaaccccctgacgctgacggcggccgtcctcatgctggtggcccactacgccataatcgggccgggcctgcaggccaaggcgacccgcgaggcccaaaaacgcacggccgccgggatcatgaaaaacccgaccgtcgatggcattgttgccatcgacctcgatcccgtagtctacgacgcgaaatttgagaagcagctgggtcaaattatgctgctcatcttgtgcacgagccagatcctcctcatgcgcaccacgtgggcactgtgcgaaagcatcaccttagccacggggccgctcaccaccctgtgggagggcagtccggggaagttctggaacaccactatcgccgtgagcatggctaacatttttcgggggtcctatctggcgggtgccgggctcgccttcagcctgatgaagtccctgggtggtggcagaagaggaacgggcgcccagggcgagacccttggggagaagtggaagcgccagttaaaccagctgtccaagagcgagttcaacacatacaagcgctctggtatcatggaggtcgacagatccgaggcaaaagaggggctcaagcggggcgagacgaccaagcacgcagtgtcccgcgggaccgccaaactgcggtggttcgtagagagaaacctggtgaagccggaaggcaaggtcatcgacctagggtgtggacggggcgggtggagctactactgtgctggcctaaagaaagtgaccgaagtgaagggctacacgaagggtggtcccggccatgaggaacccatccccatggccacctacggctggaatctggtcaagctgcactctggtaaggacgtgttcttcatcccacccgagaagtgcgacacactcctgtgcgacatcggcgagagttcccccaatcctacaatcgaagaggggcgcactctgagagtgttgaagatggtcgaaccctggttacgcggcaaccagttctgcatcaagatcctgaacccctacatgcccagcgtggtggaaaccctcgagcaaatgcaacggaagcacggcgggatgctggtccgaaacccgctgtcacggaacagcacccacgagatgtattgggtctcctgcggcaccgggaacatcgtgagcgctgttaacatgacctcccgcatgttactgaaccgttttaccatggcccaccggaagcccacctacgagcgggacgtagacctgggggcggggacccggcacgtggccgtcgagcccgaggtagctaaccttgatattatagggcaacgcatcgaaaacataaagcacgagcacaaaagcacctggcactatgacgaggacaacccctacaagacgtgggcgtatcacggatcctacgaggtgaagccgagcgggtccgccagctcaatggtcaacggggtggtcaaacttctgacgaagccctgggacgtcatcccaatggtgactcagatcgccatgacggatacgaccccgtttgggcagcagagagtattcaaggaaaaggtggacacgcgcacaccgaaggccaagcggggcacggcccagataatggaggtgaccgcaaaatggctctggggctttctttcccgcaataaaaagccacgcatatgcacccgcgaagagtttacccgtaaggttcgcagcaatgccgccatcggagccgtattcgtagacgaaaaccagtggaactcagcaaaggaggccgtggaggacgaaaggttctgggacctcgtccacaaggagcgcgaactccacaagcagggtaagtgcgccacgtgcgtgtataacatgatggggaagcgggagaagaagctgggcgagttcgggaaggccaagggtagccgcgccatatggtacatgtggcttggtgcacgtttcctcgagttcgaagccctggggttcatgaacgaggatcactggttctcccgcgagaacagcctgagtggtgtcgagggtgagggcctccacaagctaggctacatcctccgggacatctcaaagatccccggcggcaacatgtacgccgatgacacagcggggtgggacacccgcatcaccgaagacgacctccagaatgaggctcggatcactgatattatggagccggagcacgcgttgcttgccaagtccatctttaagctcacctaccagaacaaagtggtccgcgtccagcgtccggccaagaacggcaccgtgatggacgtgatctctcggagagaccagcggggaagcggccaggtcgggacctacgggcttaacaccttcaccaacatggaggcgcagctgatacgccagatggagagcgagggcatcttctcccccagcgaactcgagacgcccaacctggccgagcgggttctggactggttagaaaagtacggggttgagcgcctgaagaggatggcgatttccggcgacgactgcgtggtaaaaccgatcgacgacaggtttgccaccgccctgacggcgctcaatgacatggggaaggtgcggaaggacatcccgcagtgggaaccgagcaagggctggaatgactggcagcaggtaccgttctgcagccaccacttccaccaactgattatgaaggacggccgcgaaatcgttgtgccttgccggaaccaggacgagttggtcgggcgcgcccgcgtaagccagggggcggggtggagcctccgcgagacagcgtgcctgggcaaatcctacgcccagatgtggcagctgatgtactttcaccggagggatctgcggctggccgcgaacgccatatgctcagccgtacccgtcgactggatacccacgtcgcgaaccacgtggtcgatccatgcgcaccaccaatggatgaccacagaagacatgctctccgtgtggaaccgggtgtggatcgaggaaaacccgtggatggaggataagacacacatcagctcctggggcgacgtcccgtacctcggaaagcgcgaagaccagtggtgcggctcgctaatcgggctgaccgcccgcgcgacctgggctaccaacattcaggtggccatcaatcaggtgcggcgcctcatcggcaacgagaactatctggactacatgacctccatgaagcgattcaaaaacgaaagtgatcccgagggcgcactgtggtga

SEQ ID NO: 23760 - RNA, 9879 nt, synthetic construct
  misc_feature 1..9879: note = derived and/or modified CDS sequence (opt11) from DENV-1__KJ649286__SS-prME
  source 1..9879: mol_type = other RNA
tcagtgaccatgctactaatgctgctgcctaccgtgttggctttccatctgacaacgagaggcggggaaccccacatgattgtgaccaagcaggagcggggtaagagcttgctattcaagacctctaccggggtgaacatgtgcaccctaatcgccatggatctgggagagctctgtgaggacaccatgacctataaatgcccccgcataaccgaggcggagcccgatgacatcgactgctggtgtaacgcaaccgacacctgggtgacctacgggacctgctcccagaccggggagcaccggcgcgacaagcgcagcgtggcactggcgccccacgtgggccttggcctcgagactcgcaccgagacgtggatgtcaagcgagggtgcgtggaagcagatccagcgggtcgagacgtgggcactgcgccatcccgggttcaccgtcaccgccctgttcctcgcgcacgcaatcggcacgtccataacccaaaaggggatcatctttatcctgctgatgctcgtcacccccagcatggcgatgcggtgcgtcggcatcggcaaccgcgacttcgtggaggggctgtccggcgccacatgggttgacgtcgtgctggaacacgggagctgcgtgaccacaatggccaaggacaagcccaccctcgacatcgagctgctaaagaccgaagtcacgaaccccgccgtgctacgcaagctgtgtatcgaggccaagatctccaacaccaccacggacagccgctgccccactcagggcgaagcgacgctggtagaggagcaggacgctaatttcgtctgccggcgcaccttcgttgatcggggctgggggaacggctgtggcctgttcggcaaggggtctctgatcacttgcgcgaagtttaagtgcgtgacgaaactggagggcaagatcgtccagtacgagaacctcaagtatagcgtgatcgtgactgtccacaccggcgatcaacatcaggtggggaatgaatccaccgagcacggcaccacggctacaattacgccccaagcccccacctcagagatacagctgacggactacggggcattaaccttggactgctctccccggaccggcctggactttaacgaaatggtcttattgacaatgaaggagaagtcctggctggtgcacaaacagtggttcctggacctaccgttgccctggacgtccggggccaccaccagccaggagacctggaaccggcaggacttattggtgacgttcaagaccgcccacgccaagaagcaggaggtcgtcgtgctgggcagccaggagggggctatgcatactgcgctgaccggggccacagagatccagacatccggcaccaccacgatcttcgccggccatctcaagtgccgcctgaagatggataagctgacactcaagggcatgagctacgtcatgtgcactggaagcttcaagctggagaaggaggtagtggagacgcagcacggcacggtgctggtccaagtgaagtacgagggcaccgacgccccctgtaagatccccttcctgacccaggacgagaaaggcgtcacccagaacggccgggtgatcacggcaaacccgatcgttaccgacaaagagaagccagtcaacatcgaggcggagccgcccttcggggagagctacattgtggtaggcgccggcgagaaggccctcaagctgtcctggttcaagaaggggagcaccatcggcaagatgtttgaggcgaccgcgcgcggggcacggcgtatggccatccttggcgacacggcctgggacttcgggtccatcggcggcgtcttcacgagcgtgggaaaacttgtccaccagatattcggcaccgcttacggggtcttattctccggcgtgagttggaccatgaagatcggaatcggagtgctgctcacgtggctggggcttaactccaggagcacgtcactcagcatgacctgcatagctgtcgggctggtgacactgtatctaggtgtgatggtccaggccgactccgggtgcgtaatcaactggaagggtcgggagctgaagtgtgggagcggcatctttgtgaccaacgaggtccacacgtggaccgagcagtacaagttccaggccgatagtccgaagcgcctgtccgcagccatcggcaaggcgtgggaggagggcgtctgcggcatccggtccgccacccgcctcgagaacatcatgtggaagcagatcagcaacgagctcaaccacatattgctcgagaacgacatgaagttcaccgtggtcgtgggggacgtgagcggcatactggcccaagggaagaagatgatccggccccaacccatggagcacaagtactcctggaagtcctggggcaaagcgaagataatcggggccgacgtccagaactccacttttatcatcgacgggcccaataccccggagtgccctgatgaccaacgcgcatggaacatctgggaggtggaggactatggcttcgggatcttcaccacgaatatctggctgaagctccgggactcctacacccaggtgtgcgaccatcgcctgatgtccgccgccatcaaggattcaaaggctgtccacgccgacatgggatactggatcgaatccgagaagaatgaaacctggaagctggcccgcgccagcttcatcgaggtgaaaacgtgcgtgtggcccaagagtcacaccctctggagcaacggggtcctggagagcgagatgataatcccgaagatctacgggggcccgatcagccaacacaactacagacccgggtacttcacgcaaaccgccggcccctggcacctggggaagctcgagctggacttcgacctctgcgagggcactaccgtagtggtcgatgagcattgcggcaaccgggggccgtccctccgtaccaccaccgtgaccggcaagatcatacacgagtggtgctgccggagctgcacgctgccacccctgcgcttcaagggggaggacggctgttggtacggcatggagatacgacccgtgaaggagaaggaggagaacctcgtcaaatccatggtgagcgccggctccggggaggtggacagcttcagcctgggcctgctttgcatctccatcatgatagaggaggtcatgcgcagccggtggagccgcaagatgctgatgaccggcaccctggcggtgtttctgctgttaatcatggggcaactcacctggaacgacctgatccggctgtgcatcatggtcggcgccaacgcctctgacagaatgggaatgggcacgacgtacctcgctctgatggccacgttcaagatgcgcccgatgttcgccgtggggttactatttcggcgcttaacttcccgggaggtcctgctcctgacgatcgggctgtccctcgtagcctccgtggagctgcccaactctttggaggagctcggcgacggactggccatgggcatcatgatcctgaagctcctgaccgacttccagtcccatcaactgtgggcagcactcctgagcctgaccttcatcaagactacgtgctccctccattacgcctggaagaccatggccatggtcctgtccatcgtcagcctgttccccctctgcatgagcaccaccagtcagaaaacgacctggctgcccgtgctgctcggcagcctagggtgcaagccactgaccatgtttctcatcgcggaaaacaagatctggggcaggaagtcctggcccctcaacgagggtatcatggccgtgggaatagtctctatcctgctctccagcctgctgaagaacgacgtgcccctcgcggggcccctggtcgccggcggcatgctgatcgcctgctacgtcataagcggatccagcgccgacctctccttagagaaggcagcagaggtcagctgggaggaggaggccgagcactccggcgccagccacaacatcctggtggaggtccaagacgacggcacgatgaagattaaggacgaagagcgggacgacaccttgacgatcctgctgaaggccactctcctggccgtgtccggcgtgtacccactgagcatccccgcgaccctcttcgtgtggtacttctggcaaaagaagaagcagcgctccggggtgctgtgggacaccccgagcccgcccgaggtggagagagctgtcctggacgacggcatctaccgcatcatgcagagggggctgctcgggagaagccaagtcggcgttggggtctttcaggagaacgtgtttcacaccatgtggcacgtgaccaggggcgctgtcctgatgtacaaggggaagcgcttagaacccacctgggcaagcgtgaagaaggacttaatctcctacggtggcggctggcgtttacagggcagctggaacaccggggaggaggtgcaagtcatagccgtggaacctggtaagaaccccaagaacgtccagacggcgccggggacattcaagacccccgagggcgaggtgggagccatcgcactggacttcaagccaggaacctccggcagccccatcgtgaacagagaggggaagatcgtgggcctctacggcaacggggtcgtgaccacctccggcacctacgtgagtgccatcgcacaggcgaaggcctcacaagaaggaccgctgcccgagatcgaggacgaggtcttccggaagcgcaacctgacaatcatggacctccaccccggctcggggaagacgcggcgttacctgccggccatcgtccgggaggccatcaagcggaagctgcggaccctcatcctcgcgcccacccgcgtagtcgccagtgagatggccgaagccctgaagggcatgcccatccgctaccagaccacggccgtgaagtccgagcacaccggtaaggagatcgtggacctcatgtgccacgccacctttaccatgcggctgctgagccccgtccgcgtgccaaactacaacatgatcatcatggacgaggcccatttcacggaccccagctcaatcgccgcccggggctacatctccacccgagtgggtatgggggaggccgcggccatcttcatgacggccacgccgcccggcagcgtagaggccttcccgcagtccaacgccgtgatccaggacgaggagcgggacatccccgagcgcagctggaactccggatacgactggatcaccgactttcccggcaagaccgtgtggttcgtccccagcatcaagagtggcaacgacatcgcgaactgcctccggaagaacgggaagcgcgtgatccagctgagccggaagacctttgataccgagtaccagaagacgaaaaataacgattgggactacgtcgtgaccaccgacatatccgagatgggcgctaacttccgcgcagaccgagtgatcgacccgcgaagatgcctgaagcccgtcatcctcaaggacgggcctgagcgcgtgatcctggctggcccgatgccggtgaccgtcgcgtccgccgcccagcggcgcgggcggatcggacgcaaccagaacaaggagggcgaccagtacatatacatggggcaacccctgaacaacgacgaggaccacgcccactggacggaggccaagatgctccttgacaacatcaacacccctgagggcatcatccccgcgctgttcgagccggaaagagagaagtccgccgctatcgacggggagtatcgcctccgcggcgaggcacggaagacttttgtggagctgatgcgtcgcggggaccttcctgtctggctgagctacaaggtcgcgtccgagggcttccagtacagcgacagacggtggtgcttcgatggcgagcgaaataaccaggtgctggaagagaacatggacgttgagatatggaccaaggagggggagcggaagaagttgcgaccccggtggcttgacgcgcgcacttattcagaccccctggccctccgagagttcaaggagttcgccgccgggcggcggtcggtaagcggggacctcatcctcgagatcggcaagttgccccagcaccttacccagagggcccaatccgcgctggacaacctggttatgttgcacaactcagagcaaggcggccgggcttaccgccatgccatggaggaactgccggacacgatcgaaaccctgatgctgctggccctgatcgcggttttgaccggcggggttacgctgtttttcctgagcggcaaggggcttggcaagaccagcatcggattactgtgcgttatggcctcgtccatgctcctgtggatggcctccgtggagcctcactggatcgccgcctccatcatcctcgagtttttcctcatggtcctgctgatccccgagcctgaccggcagcgcacgccccaggacaaccagctcgcgtacgtggtaatcgggctgctgttcatgattctcaccgtcgccgccaacgaaatgggcctcctcgagacgaccaagaaggacctcgggataggccatgtagccgtggagaaccaccaccacgcgaccatgctggacgtcgacctgcatcccgcgtccgcctggaccctctacgccgtggccacgaccatcattaccccgatgatgcgccacaccatcgaaaacacgaccgccaatatctcactgaccgctatcgcaaaccaggccgccatcctgatggggctagacaagggctggcccatctccaagatggacatcggcgtccctctgctcgcccttggctgctacagccaagttaaccccatgaccttaacggcggccgtactgatgctcgtggcgcactacacgatcatcggcccggggctgcaggccaaggcgacccgcgaagctcaaaaacggaccgccgctggtatcatgaagaaccccacggtcgatgggattgtggccatcgatctagaccccgtggtatacgatgcgaagttcgagaagcagctcggtcagatcatgttgctgatactctgcacctcccagattcttctgatgcgcaccacctgggccctttgcgagagcatcacgctggccaccggccccctgaccaccctctgggaaggctccccaggcaagttctggaacactaccattgccgtgagcatggccaacatcttccgcgggagttatctggcgggcgccggcttggccttcagcctcatgaagtcgctcgggggagggaggcgcgggaccggggcccagggcgagacactgggcgagaagtggaaacggcagctcaaccaactgagcaagagcgagttcaatacgtataaacgctccggcatcatcgaggtggaccggagcgaggccaaggaaggtctgaagcgcggcgagacgactaagcacgctgtcagccggggcacagctaaactcaggtggttcgtcgagcggaacttggttaaacccgaggggaaggtcattgacctgggttgtggccgcggggggtggagctactactgcgccgggctgaagaaggtcacggaggtgaagggctacaccaagggcggggccggccacgaagagccgatcccgatggcgacctacgggtggaatctcgtcaaattacacagcggcaaggacgtgttcttcatcccgcccgagaagtgcgacaccctgctgtgcgacatcggtgagtcttcccctaatccaacaatcgaggagggccggacgctgcgcgtgcttaaaatggtagagccgtggctccgggggaaccagttctgcattaagatccttaacccctacatgcccagcgttgtggagaccttagagcagatgcaacggaagcacgggggcatgcttgtccggaatcccctttcccgcaacagcacccacgagatgtactgggtgtcgtgtggaaccggaaacatcgtgagcgccgtcaatatgacttccaggatgctgctcaaccgattcaccatggcccaccggaagcccacctacgagcgtgacgtggatctaggggctggcacccgccacgtcgccgtggagcccgaggtggcgaacctggacatcatcggccagcgcatcgagaacataaagcacgagcacaagagcacgtggcactacgacgaggacaatccctacaagacctgggcttaccacgggtcctacgaggtcaagccctccgggtccgccagctccatggtaaacggggtggtacgtctcctgaccaagccgtgggacgtgatccctatggtaacccagatcgccatgacggataccacgcccttcggacagcagcgggtcttcaaggagaaggtagacactcgcacgccgaaagccaagcgggggactgcccaggtgatggaagtcaccgcccggtggctgtggggcttcttgagcaggaacaagaagccgcgaatttgcacccgggaggagttcacgaggaaggtgcggagcaacgccgccatcggcgccgtgtttgtcgacgagaaccagtggaactcggcgaaagaggcagtcgaagacgagcgattttgggatctagtgcaccgggagcgcgaactgcacaaacaggggaagtgcgcgacctgcgtatacaatatgatgggcaagcgggagaagaagctcggggaattcggcaaggcaaaggggagccgcgcaatctggtacatgtggctgggcgcccgtttcctggagttcgaagccctcggctttatgaacgaggaccactggttctcccgcgagaactctctgagtggggtggagggcgaggggctgcaccggctcggctacatcctgcgcgacatctctaagatccccgggggcaacatgtatgccgacgacaccgccggctgggacacccgtatcacggaggacgacctccaaaacgaggcgaaaatcacggacatcatggagcccgaacacgccctcctggccacctctatcttcaagctgacctatcaaaataaagtggtccgcgtccagcgcccagccaagaatggaacagtgatggacgttatctcccggcgcgaccaacgggggagcggccaggtgggcacctacggattgaacacctttaccaacatggaggcccagctgattcgacagatggagtccgaggggctgttctcccccagcgagctcgaaaccccaaacctcgcagagcgggtgctgaactggctcgggaagtacggggtggagcgtctgaagcggatggcgatctcgggggacgattgcgtggtgaagcccatcgacgaccgcttcgccactgcccttaccgccctcaacgacatggggaaagtcagaaaggacatcccgcagtgggagccgagcaagggctggaacgactggcagcaagtccctttctgctcccaccacttccaccagctgatcatgaaggacggccgtgaaatagtggtaccctgcagaaaccaggacgagctcgtggggcgagcgcgggtaagccagggcgccgggtggtccctccgcgagaccgcctgcctaggcaagagctacgcgcagatgtggcagctaatgtacttccaccggcgggatctccggctagcggcgaacgccatctgcagcgccgtcccggtggactgggtgcccacgtccagaacgacctggtccatccatgcccaccatcaatggatgaccacggagaatatgctgtctgtctggaacagggtgtggattgaggagaacccatggatggaggacaagacgcacgtgagctcctgggaggatgtaccctacctcgggaagagagaggaccagtggtgcggcagcctgatcggcctgacggcgcgcgccacttgggccaccaacatccaagtggccatcaaccaggtgcggaagctaatcgggaacgagaactatctcgactacatgacgtcaatgaaacgcttcaagaacgacagcgaccctgagggcgccctgtggtga

SEQ ID NO: 23761 - RNA, 9879 nt, synthetic construct
  misc_feature 1..9879: note = derived and/or modified CDS sequence (opt11) from DENV-1__KF887994__SS-prME
  source 1..9879: mol_type = other RNA
agcgtcacgatgctgttaatgcttatgcccacggccctggctttccacttaaccacccgcggcggcgaaccccacatgatcgtctcgaagcaggagcgggggaagtcactgctgtttaagacctcggctggggtgaacatgtgtaccctcattgcaatggacctcggtgagctgtgcgaggacactatgacgtacaagtgcccccggataaccgaggccgaacctgacgacgttgattgctggtgcaacgccaccgatacgtgggttacctacgggacctgcagccagacgggtgaacaccggagagacaagcgctccgtggcccttgcgccccacgtgggtctgggtctggagacgcgaactgagacgtggatgagctccgagggcgcctggaagcagatacagcgcgtagagacctgggctttacgccatcccggcttcacggtgatcgcgctgttcctggcacatgccattggtactagcatcacccagaagggaatcatcttcatcctgcttatgctggtgaccccctcgatggcgatgcggtgcgtcggcattggcagccgagacttcgtggaggggctcagcggcgctacatgggtggacgttgtactggagcatgggtcgtgcgtgacgaccatggccaaggacaagccgacactggacatcgagttgttgaagacggaggtcaccaaccccgcgatcctgcggaagctctgcatcgaggcaaagatctccaacaccaccactgacagccggtgcccgacgcagggcgaggccaccctggtggaagaacaggacgcgaatttcgtgtgccgccgtaccttcgtggatcggggctggggtaacggctgcgggctctttggcaaggggagtctcataacttgtgcaaagttcaagtgcgtcaccaaacttgagggcaagattgtgcagtacgagaacctgaagtacagcgtcatcgtcacggtgcacaccggagaccagcatcaggtcggaaacgagtcgacggagcacggcacgacggcgactatcacaccgcaagcaccgaccacggaaatccagctcactgattatggggccttaaccttggattgcagcccccgaacaggactggactttaacgagatggtgttacttacaatgaaggagaagtcttggctcgtccataagcagtggttccttgacctgccactcccctggacatcaggggcctcgacctcccaggagacgtggaaccgacaggacctgttggtgaccttcaagaccgcccacgcaaagaagcaggaggtagtcgtgctgggctcgcaggaaggcgccatgcacaccgcactcacgggcgccaccgagatccaaacgtccggcactacgaccatcttcgcaggccacctgaagtgccgccttaagatggataagctgaccctgaagggcatgagctacgtgatgtgtacaggtagtttcaagctcgagaaggaggtcgcggagactcagcatggcaccgtgctggtgcagatcaagtacgagggcaccgacgctccttgtaagatcccttttagcacacaggacgagaagggggtgacgcagaacggccggctgataaccgccaatccaatcgtaaccgacaaggagaagcctgtgaatatcgaggctgagccgcctttcggggaaagctacatcgtcatcggcgcgggcgagaaggccctgaagttaagttggttcaagaaggggtctagtattggtaagatgcttgaagccaccgcccgaggggcccggagaatggcgatcttgggtgacacggcctgggacttcgggtctatcggcggagtctttacctccgtaggcaagttggtccatcagatctttggcacggcctacggggtcttgttttccggcgtgagctggaccatgaaaatcgggataggcgtcctgttaacgtggctgggtctaaattctcgcagtacctcgctcagcatgacatgtatcgctgtggggctagtaaccctgtaccttggcgtcatggtgcaggccgactcaggatgcgtgatcaactggaagggacgggagctgaagtgcgggagtggtatcttcgtaactaacgaggtacacacctggaccgagcaatacaagttccaagctgacagcccgaagcgcctgagtgccgccatcggcaaggcctgggaggagggggtttgtggcatacgaagcgccacccgcttagagaacatcatgtggaaacagatctccaacgagctgaatcacatcctgctggagaacgacatgaagttcaccgtggtggtaggcgatgtcgcgggaatcctggcccaaggaaagaagatgatccgcccccagcctatggagtacaaatacagctggaagtcttggggcaaggcgaagatcattggcgccgacgttcagaacacaaccttcattatcgacgggcctaacactccggaatgccccgatgaccagcgcgcatggaacatctgggaagttgaggactacggcttcggaatatttaccacgaacatatggctgaaacttcgggattcctacacccaggtgtgcgaccaccgtcttatgtccgccgccatcaaagactcaaaggccgtgcatgcagacatgggctattggatcgagagtgagaagaatgagacctggaaactcgcacgggcgagcttcatcgaggtgaaaacatgcatttggcctaagagccacacgctctggtctaacggagtccttgagtccgaaatgataataccgaaaatctacggtggccccatctcgcagcacaactaccgacccggttacttcactcagaccgccggcccctggcacctcgggaagttggagctggacttcgacctgtgcgagggtaccacggtcgtggtggacgagcactgcggcaaccgcggcccgagtctccgcacaacaaccgtgacgggcaagatcatccacgagtggtgttgccgttcctgtacccttccaccccttcgctttcgcggggaagacggctgttggtacgggatggagatccgccccgtgaaggagaaagaagaaaatctcgtcaagtcaatggtgagcgcaggcagcggtgaggtagactcgttttccctcgggttactctgcattagcatcatgattgaggaagttatgcggagccgctggtcccgaaagatgctgatgaccggcactctcgccgtgttccttctactgatcatcgggcaattgacgtggaacgaccttattagactgtgtatcatggtgggtgcgaatgcctctgaccgaatggggatgggcaccacctacttagccctgatggcaacattcaagatgcgtccgatgttcgcggtcgggctcctgtttaggcggttgacgagtagggaggtgttactcctgaccatcgggctgagcttaatggcgtccgtggagctgcccaatagcctggaggaattaggcgatgggctggccatgggtatcatgatactgaaactcctaacggacttccaaagccatcagctgtgggctactctcctaagcctgacattcataaagacaaccttcagcttgcactacgcttggaaaacgatggcgatggtcctctccatcgtatccctgttccccctctgtctttctacgacctcccagaaaaccacatggctgcctgtgctcctgggctcgttagggtgcaagcccttaactatgttcctgatcgcagagaacaagatttggggtcggcgctcgtggcctctgaatgaggggatcatggccgtaggtatagttagcatcctgttaagctctctgctcaagaatgacgtgcccctggccgggcccctgatcgccggcgggatgttaatcgcgtgttacgtcattagtgggagttcagcggatctctccctagagaaggcagccgaagtgagctgggaggaggaagccgaacactccggcgcgtcccacaacatcctcgttgaggtgcaggatgacggaaccatgaaaatcaaggatgaagaacgggatgacacactgaccatcctgttgaaggctactctgctggctgtgtccggcgtatacccgctgagtatccccgccacattgttcgtgtggtacttttggcagaagaaaaagcagcggagtggggtgctttgggatactccatcaccgccagaggttgagcgggccgtgctggacgacggtatatacagaatcatgcagcggggcctattaggtcgcagccaggtgggcgtcggggtgtttcaggagaacgtgttccacaccatgtggcatgtcacacgaggcgcagtgctgatgtatcaagggaaacgcctcgagcccagttgggcctccgtgaagaaggaccttatatcctacggcggcgggtggcgactgcaagggagctggaacacaggggaggaggttcaggtgatcgccgtagagcccggaaagaaccccaaaaatgttcagaccgctccgggaaccttcaagacacccgaaggtgaggtgggcgccatcgccctagattttaagccggggacatctggtagccccatcgtaaaccgggagggtaagatagtcggcctgtacgggaacggggtggtgaccaccagcggcacctacgtcagcgccatagctcaggccaaagcctcccaggagggtccgttgcccgagattgaggacgaggtattccgtaaacggaatctcactattatggatctgcaccccggcagcgggaaaacccgtcgctacctgccggcaatagtccgggaggccatcaagcgcaagctacgcaccctgatactagcccccacccgagtagtcgcttccgagatggcggaggcccttaaaggcatgccgatccgctaccagacgacggctgtcaagagtgagcacaccggcaaggagatagtcgacctgatgtgccatgcgacctttaccatgcgcctcctctcccctgtgcgcgtgccaaactacaatatgatcattatggacgaggcccacttcactgacccgagttccatcgcggcgcgcggatacataagcactcgagtcggcatgggggaggccgcagccatctttatgacggctactccgcccggctccgtcgaagcattcccgcagagcaacgccgtgatacaggacgaggagcgtgacataccggagcgctcgtggaacagtggttacgagtggatcacggacttcccgggtaagactgtttggttcgtcccctcaatcaagagcggcaacgacatcgccaactgcctgcggaagaatggtaagcgcgttattcagctttcccgaaaaaccttcgacacggagtaccagaagaccaagaacaacgactgggactacgtcgtgaccactgacatctcggagatgggcgctaacttcagagccgacagagtcatcgacccgcgacggtgcctcaaaccggtcatactgaaggatgggccggagcgcgttatcttagccggccccatgccggttacggtcgcctcagccgcgcagcggaggggacggatcggccgtaaccataacaaggagggcgatcagtacatctatatggggcagcccctcaataatgacgaagaccatgcccactggacagaggccaaaatgcttttggacaacataaacacccccgaaggtatcattcccgccctcttcgagccggagagggaaaagtccgccgccatcgacggtgaataccgtcttcggggcgaagcgcggaagacctttgtggagctgatgcgccggggtgaccttcccgtctggctgtcttacaaggtggcgagcgagggcttccaatattccgaccgccgttggtgtttcgacggggagcgcaacaaccaggtcctggaggagaacatggacgttgagatctggaccaaggaaggagagcgcaaaaagctcaggccaagatggctggacgcccggacttactccgaccccttggcgctgcgggagttcaaggagttcgcggccgggcgccggagcgtgtccggcgacttaatactagagatcggaaagctcccgcaacatttaacccagcgggcccagaatgcactggacaacctcgtaatgctgcacaatagcgagcaaggagggagagcgtacaggcatgccatggaagaactgcccgacacaatcgaaacccttatgctgctggccctcatagccgtgctgaccggaggagtgaccctgttcttcctctcaggaaggggactgggtaagaccagcatcgggctcctctgcgtaatggcgtcaagcgtactgctgtggatggcgagtgtggagccacactggatagccgcgagcatcattctggagtttttcctgatggtgcttctcatccccgaaccggaccgtcagcggacgccccaggacaatcagcttgcatacgtcgtgatagggctactcttcatgatcctaacggtagctgctaacgagatgggtctgctcgaaaccactaagaaggacttgggcataggccacgtggccgttgggaaccaccaccacgctgcgatgctggatgtcgacttgcacccggcttccgcttggaccctgtacgccgtcgcaaccactatcattacccccatgatgcgacacaccatcgaaaacacgacagcaaacataagtctgacggccatcgcgaaccaagccgctatcctcatggggctggacaagggctggcccatctccaagatggacatcggcgtacccctattagccctaggctgctacagccaggttaaccccctgaccttgacggcggccgtcctgatgttggtggcccattacgccatcatcggaccgggtttacaagcgaaggctacccgcgaggcccagaagagaaccgctgccggcatcatgaagaaccccaccgtggatggcatcgtggctattgacttagaccccgttgtatacgatgcgaagttcgagaagcagctcggccaaatcatgctcctgatcttatgcacctcccagatactgctaatgcgtacgacgtgggcgctctgcgagtcaatcaccctcgcaactgggccccttaccaccttgtgggagggcagcccgggtaagttctggaacacgacgatcgctgttagcatggccaacatcttccggggatcctacctcgcgggcgctgggctggccttcagcttaatgaagtccttaggcgggggccgacgcggcaccggcgcccagggagagacactgggggagaagtggaagcgccagctgaaccagttgagcaaaagcgagttcaacacatacaagcgcagtggaataatggaggtggatcgaagcgaagcgaaagaggggcttaagcgcggcgaaacgaccaagcacgctgtgtccagagggaccgcaaaactgcgatggtttgtcgaacgtaacctggtgaagcccgaaggcaaggtgatcgatctcgggtgcggaaggggcggctggagctattattgcgcaggactgaagaaagtcaccgaggtgaagggctacacgaaaggcggccccggccacgaggaaccaataccgatggcgacttacggctggaacctcgtgaagctccacagcgggaaggacgtgttcttcattccgcccgagaagtgcgatactctgctttgcgacataggcgaatccagtccaaacccaaccatcgaagaggggcgcactctcagagtgctgaagatggtggaaccctggctgcgtggcaaccagttctgcatcaagattttaaacccttatatgccctcggttgtagagaccctggaacagatgcagcgtaaacacggtggcatgctggttaggaacccgctctccaggaacagcacacacgagatgtattgggtgtcctgtggcaccggtaacatcgtatcagctgtcaacatgacgtcccgcatgctattaaatcgcttcacgatggcccaccgcaagcccacctacgagagagacgtcgacctaggcgcgggcacccggcatgtggccgtggaacccgaggtcgccaacctggacatcatcgggcaacggatcgagaacattaagcacgaacacaagtccacctggtactatgatgaggacaacccatacaagacgtgggcgtatcacgggagctacgaggtaaagccgagcgggagtgccagcagcatggtaaacggcgttgtaaaacttctgaccaagccgtgggacgtgatccctatggtgacccagatcgccatgacagacactaccccgttcggccagcaacgtgtcttcaaggagaaggtcgacacccgaacaccaaaggccaaaagaggtacagcacagatcatggaggtgaccgcgaagtggctgtggggcttcctgtctcgcaataagaagcctagaatctgtacccgggaggagttcacaagaaaggtgaggagtaacgcggccatcggggccgtgttcgtggacgagaatcaatggaactctgcgaaagaagcggtagaggacgagaggttctgggacctcgtccacaaggagcgagagttacacaaacagggcaaatgcgcgacgtgcgtctataacatgatgggaaagcgggaaaagaagctgggcgagttcggtaaagccaaaggcagcagagcgatctggtacatgtggctcggtgctagatttctggagtttgaggcgctgggtttcatgaacgaggatcactggttctcgcgagaaaacagcttcagcggcgttgaaggggaaggactccataagctggggtatatactacgggatatcagcaagatcccagggggcaacatgtacgccgacgacaccgccggctgggatacccgcattaccgaggatgacctccagaacgaggcccggataactgacatcatggagccggaacacgcgctgctggccaagtcaatctttaaacttacgtaccagaacaaggtggtcagggttcaacggcctgccaagaatgggacagttatggatgtggtgagccgtagggaccagcggggctcggggcaggtcggcacctacggtctaaacacattcactaatatggaggcccagctaattcgccagatggagtccgagggcatcttcagtcccagcgagctcgagacgcccaatctggccgagcgagtactcgcatggctcgagaagtatggcgtggaaaggctgaagcggatggccatatccggcgacgactgcgtcgtgaagccgatcgacgaccgttttgccacagccctgacggcattaaacgacatggggaaggtgcgtaaggatatcccccagtgggagccaagcaagggctggaacgactggcaacaggtcccattctgctcccaccacttccaccagctgatcatgaaggacggcagggagatagtggtaccgtgccggaaccaggacgagctggttgggcgcgctcgggtaagccaaggcgctgggtggagcctccgcgagaccgcctgcctaggcaagtcctacgcccagatgtggcagctgatgtacttccacagacgcgatcttcggctggcagcaaacgcgatctgctctgcagttcccgtcaactggatcccaacatcccgcaccacatggtcaatacacgctcaccaccagtggatgacaacagaagacatgctaagtgtgtggaacagagtgtggattgaggagaacccctggatggaggataaaacccacatctcgtcatggggcgacgtgccgtacctgggcaaacgcgaggaccagtggtgcggcagcctgattggtctaactgcccgcgcgacctgggccacgaacatccaggtcgccatcaatcaggtgcggaagctaatcggcaacgagaactacctcgattatatgacctccatgaagcgcttcaagaacgagtctgatcccgagggggcgctgtggtga

SEQ ID NO: 23762 - RNA, 9879 nt, synthetic construct
  misc_feature 1..9879: note = derived and/or modified CDS sequence (opt11) from DENV-1__JQ675358__SS-prME
  source 1..9879: mol_type = other RNA
tcagtgaccatgctgctgatgttactgcccaccgccctcgccttccacctgaccacccggggaggcgagccccacatgatcgtgagcaagcaggagcggggcaagagcctcctgtttaagacctccgccggggtcaatatgtgcactctgatcgccatggacctgggcgagctctgcgaggacaccatgacctacaagtgcccccagatcaccgaggccgagcccgacgacgtggactgctggtgtaacgccaccgacacgtgggtgacctacgggacctgcagccagaccggcgagcaccggcgggacaaacgctccgtggccctggctccccacgtgggcctggggctcgagacgcggacggagacctggatgagctccgagggagcctggaagcagatccagcgtgtcgagacctgggcgctgcggcatcccggcttcacggtaatcgccctgtttctcgcgcacgccatcgggaccagcatcacccagaaagggatcatttttattttactgatgcttgtgacccccagcatggccatgcggtgcgtcggcatcgggaaccgggacttcgtagaggggctgagcggcgccacttgggtggacgtcgtgctggagcacggatcatgcgtgactaccatggccaagaacaaacccaccctcgatatcgagctgctgaagacggaggtcactaaccccgcgatcctccgcaagctgtgcatagaggccaaaatctcgaacaccaccacggacagccggtgcccgacccagggcgaggccaccctggttgaggagcaagacgccaacttcgtgtgtcgtcggacattcgtcgaccgcggctgggggaacggctgcggcctcttcggtaaggggagcctgctcacgtgcgccaagttcaagtgcgttactaagctcgagggcaaaatcgtccaatacgagaacctgaagtactccgtcatcgtgaccgtgcacactggcgaccagcaccaggtggggaatgaaactacagagcacgggacgatcgctaccatcacaccccaggcccccacgagcgagatccaactgaccgactatggggctctaaccctggactgcagcccccggaccggcctggacttcaacgagatggtgctcctgacgatgaaggaacgcagctggctggtacacaagcagtggttcctcgatctgccattgccctggacctccggggccagcacgagccaggagacctggaaccggcaggacctcctggtgacttttaagacagcccacgcgaaaaagcaggaagtcgtcgtgcttggctctcaggagggggccatgcacaccgctctcaccggggccacggagatccagaccagcggcacaaccacaatcttcgcgggtcatctgaagtgccgcctgaagatggacaaactcaccctgaagggcacctcctatgtgatgtgtaccgggagcttcaaactggagaaagaggtcgcggagacgcagcacggaaccgtgctggtccaagtcaaatacgagggaaccgacgcaccctgcaagatcccattctccacccaggacgagaaaggggtgacgcagaacggccggctcatcacggctaacccgatcgtgaccgacaaggagaagccggtcaacatcgagaccgagccgcccttcggggaaagctacatcgtggtaggcgccggagagaaggcgctgaaactgtcatggttcaagaaggggtcatcaatcggcaagatgttcgaggcaacggcccgcggggcccggcggatggcgatcctcggcgacaccgcgtgggacttcgggagcatcggcggcgtgttcacaagtgtggggaagctggtgcatcaagtattcgggacggcctacggggtgctgttcagcggggtgtcctggacgatgaagatcggaatcggcatcctcctgacctggctgggcttaaacagccgctccaccagcctgtcaatgacctgcatcgcggtcgggatggttacgctgtacctcggcgtgatggtccaggccgactcagggtgcgtgataaactggaagggccgggagcttaagtgcgggtccggtatcttcgtgaccaacgaggtccacacctggaccgagcagtacaagttccaggccgacagcccgaagcgcctgagcgcggccatcggcaaggcctgggaggaaggggtgtgcggcatccggtccgctacccgcctcgagaacatcatgtggaagcagatcagcaacgagctgaaccacatcctgctagagaacgacatgaaattcaccgttgtcgtgggggacgccaacggaatcttggctcagggaaagaagatgattcggccccaacccatggagcacaagtactcctggaagtcctggggcaaggccaagatcattggggccgatatccaaaacacgaccttcatcatcgacgggcccgacaccccggagtgcccggacaaccaacgcgcctggaacatttgggaggtggaggactacggcttcgggatcttcacgaccaacatctggctgaagctccgggactcctatacgcagatgtgcgaccaccgcctgatgagcgcggccatcaaggactccaaggccgtccatgcggacatgggctactggattgaaagcgagaagaacgagacctggaagctcgcccgcgcgtccttcattgaggtgaagacgtgcacctggcctaagagccacaccctctggtctaacggtgtgctggagagcgagatgatcatacccaagacctacgggggaccgatctcccagcacaactaccgacccgggtatttcacgcagaccgccggcccctggcacctggggaagctcgaattagacttcgacctgtgcgagggcaccaccgtcgtggtggacgaacactgcggcaatcgggggccgagcctccgcacgaccaccgtcaccggcaagatcatccacgaatggtgctgccggtcatgcacgctgccgcctctgcgctttcgcggggaggacggctgctggtacggtatggagatccgccccgtgaaggagaaggaggagaacctcgtgcggagcatggtttccgccggcagcggcgaagtggacagcttttccctggggatcctgtgcgcaagcatcatgatagaggaggtaatgcgctcccggtggagccgcaagatgctgatgactggcactctggccgtcttcctgctcttaatcatggggcagctgacctggaatgacctcattcgcctgtgcatcatggtgggcgcgaacgccagcgaccggatggggatgggcacaacctacctggccctcatggccaccttcaagatgcgcccgatgttcgccgtgggcctgctgttccggcgcctcaccagccgggaggtcctgctattgacgatcgggctgtccctggtggcgagcgtggagctccccaactccctggaggaattgggcgacggtctagccatgggcatcatgatgctgaagctgctcaccgagttccagccccaccagctgtggaccaccctgctcagcctgacgttcatcaagaccaccctgtccctcgactacgcctggaaaaccacggccatggcgctgagcattgtctccctgtttcccctctgccttagcaccacctcccaaaagaccacctggctgccggtgctactgggcagcttcgggtgtaagcccctgacaatgttcttaatcaccgagaacaagatctggggccgaaagtcctggcccctgaacgaagggatcatggccatcggtatcgtctccctgctcttatccagcctgctcaagaacgacgtgcccctcgccgggccgctgatcgctggcggcatgctcatcgcctgttacgttatttccggttcctctgcggacttgtcactggagaaggccgccgaggtcagctgggagcaggaggccgagcactccggtaccagtcataacatcctcgtggaggtgcaggatgacgggacaatgaaaattaaggacgaggagcgggacgacacgctgaccatcctggtaaaggcaaccctcttggcggtgtccggggtgtaccccatgtcaatacctgccaccctgttcgtctggtacttctggcagaagaagaagcagcgctccggggtgctttgggacacgcccagtccacccgaggtcgagcgggccgtcctggatgacggcatctaccgcatcctgcaacggggcctgctcgggcgctcccaagtgggcgtgggggtcttccaggacggcgtgttccacaccatgtggcacgtaacccgcggggccgtcctgatgtaccagggcaaacgacttgagcccagctgggcctccgtgaaaaaggacctcatcagctacggagggggctggcggttccaagggtcctggaataccggcgaggaagtgcaggtcatcgccgtggagccccgcaagaacccgaaaaacgtgcagacgacccccgggaccttcaagacccccgagggcgaggtaggcgccatcgccctggacttcaagccagggacttcaggctccccgattgtcaaccgggaggggaagattgtcggtttgtacggcaacggggtcgtgaccaccagcggcacgtacgtgtccgcaatcgcccaggcgaaggccagccaggaggggcccctcccggagatcgaggacgaggtcttcaagaagcgaaacctgacgatcatggacctgcacccgggcagcgggaaaacacggcgctacctccctgccatcgtgcgggaggccatcaagcgcaagttgcgcacgctgatcctcgcgcccacccgggtggtcgcctccgagatggccgaggccctgaaagggatgcccatccgctaccagacgaccgccgtaaaaagcgagcacaccggccgggagatcgtggacctgatgtgccacgcgacgttcacgatgcgactcctgtccccggtccgggtgcccaactacaacatgatcatcatggacgaggctcacttcaccgatccagccagcatcgcggcccgggggtacatctcaacccgggtgggcatgggggaagcggccgccatcttcatgaccgctacgcccccgggcagcgtcgaggcgtttccccagtccaacgcggtgatccaggacgaggagcgggacatccccgagcggagctggaacagtgggtacgactggatcacggacttccctggcaagaccgtatggttcgtaccatcgatcaagtccggcaatgacatcgccaactgcctgcgcaagaacgggaagcgggtcatccagctcagccgcaagaccttcgacacggagtaccagaagaccaagaacaacgactgggattacgtggtcaccaccgacatatccgagatgggcgccaatttccgggcagaccgcgtgatcgatccgcggcgctgcctgaagcccgtgattctaaaggacgggcccgagcgggttatcctcgctggcccgatgcccgtgacggttgccagcgccgcccagcgccgggggcgcatcggccgcaaccagaacaaggagggagaccagtacgtctacatggggcagcccctgaacaacgacgaggaccacgcccactggaccgaggcgaagatgctgctcgacaacatcaacacccccgagggcatcatcccggcgctgttcgagcccgagagagaaaagagcgccgccatcgacggggagtaccggctgagaggggaggcccgcaagaccttcgtggagctcatgcggcgcggggacctgcccgtctggctgagctacaaggtggcgtccgagggcttccagtatagcgaccggcgatggtgcttcgacggcgagcggaacaatcaggtgctcgaggaaaacatggacgtcgagatatggaccaaggagggggagcgcaagaagctgcggccccgatggctggacgcccggacgtattccgacccgctcgccctgcgcgagttcaaggagttcgccgcggggcggcgcagcgtgagcggggacctgatcctcgagatcggcaagctaccgcagcacctgacactccgagcgcagaacgccctggacaacctggtgatgctccacaactccgagcaaggcgggaaggcgtatcgtcacgccatggaggaactgcccgacaccatcgagacgctgatgctcttggcgctcatcgccgtcctcacgggcggggtgacccttttcttcctgagcggcaaggggctaggaaagacctcaataggcctgttatgcgtgaccgccagctcagccctcctttggatggccagcgtcgagccccattggattgcggcctccataatcttagagttctttctcatggtgctgctgatcccggagcccgaccggcaacgcacgccccaggacaaccaactcgcctacgtggtcatagggctactgttcatgatcctcaccgtcgccgccaacgagatgggcctgctggagaccaccaagaaggacctcggcatcggccacgtggcggccgagaaccaccaacacgccactatgctggacgtcgacctgcggccggccagcgcctggaccctctacgcggtggccaccaccgtgatcacacccatgatgcgccacactatcgagaacaccacggccaacataagcctgacggccatcgccaaccaggcggcgatcctgatgggcctcgacaagggctggcccatcagcaagatggacatcggcgtccccctgctggccctcgggtgttactcccaggtgaacccgctgaccctaaccgccgcggtgctcatgctggtcgcccactacgccataattggccccgggttacaagccaaggccacccgcgaagcgcagaagagaacggccgccggcatcatgaagaaccccacggtggatggaatcgtggccatcgacctcgaccccgttgtgtacgacaccaagttcgagaagcagctgggccagattatgctactcatcctgtgcacgagccagatcctgctaatgcgcacgacctgggccctgtgcgagtcgatcaccctggcgaccggaccgctcacgaccctgtgggaggggagccccggcaagttctggaataccactatcgccgtatctatggccaacatattccgggggagctatctggccggcgccggcttagcgttctcgctgatgaaatccgtcggaggcgggcgccggggcatgggggcccagggcgagacgctaggcgagaagtggaagcggcagctcaatcagctgtccaagagcgagttcaacacctataagcggagcgggatcatggaagtggaccgctccgaggccaaagagggtctgaagcgtggggagaccaccaagcacgccgtgagcaggggcaccgcgaagttgcggtggtttgtcgaacgcaacctggtgaagcccgaggggaaggtgatcgacctgggctgcggcaggggcgggtggtcctactattgcgcaggcctgaagaaggtcactgaggtgaaggggtacacgaagggcgggcccggccacgaggagccaatccccatggcaacgtacgggtggaacctcgtgaagctgcacagcggcaaggacgtcttcttcatgccgcctgagaagtgcgatacactgctctgcgacatcggggagtccagccccaacccaactatcgaggaagggcgcaccctacgggtgctgaagatggtggagccctggctccgcgggaaccagttctgcatcaagatcctgaatccctacatgccatccgtagtagaaaccctagagcagatgcagcggaagcacggcggcatgctcgtgcgcaaccccctgagccggaactccactcacgagatgtactgggtcagctgcgggacgggcaacatcgtgtccgccgtaaacatgaccagccgcatgttgttgaatcgcttcaccatggcgcaccgcaagcctacctacgagcgcgatgtcgacctgggagcgggtacgcggcacgtggctgtggagcccgaggtcgccaacctggatatcatcggccagcgcatagagaacatcaagaacgagcacaagtccacctggcactacgacgaggacaacccgtacaagacctgggcctaccacgggtcttacgaggtgaagccctctggctcagcctccagcatggtgaacggggtcgtgcggctcctgacaaagccctgggacgtcatacccatggtaacgcagatcgcgatgaccgacaccaccccgttcggccagcagcgcgtgttcaaggagaaagtcgacacgcggacgcctcgcgccaaacgggggaccacccagatcatggaagtaacggccaagtggctgtggggctttctctcacgcaacaagaagcccagaatctgcaccagggaggagttcacccggaaagtgcgcagcaacgccgccataggcgcggtctttgtggacgagaaccagtggaacagcgccaaggaggccgtggaggatgagcggttctgggatttggtccaccgagaacgggaactgcacaagcagggaaagtgcgcgacctgtgtatacaacatgatgggcaagcgcgagaaaaagctcggggagttcggcaaggcgaagggcagccgggctatctggtacatgtggctgggcgccaggttcctggagttcgaggccctcggcttcatgaacgaggaccactggttcagccgggaaaattccctgagcggggtcgaaggggaggggctgcacaagttaggatatatcctgcgcgatatctccaagatccccggcgggaacatgtacgccgacgacacggctgggtgggacactcgcatcaccgaagacgacctgcagaacgaggccaagatcaccgacatcatggagcccgagcacgccctcctggcgacgagtatcttcaagctgacctaccaaaataaggtcgtccgagtgcagcgtcctgcaaagaatgggacggtaatggacgtgatctcccggcgcgaccagcgaggcagcggccaggtggggacctacgggctccacacgttcaccaatatggaggtccagctgatcaggcagatggagtccgaagggatcttcctgcccagcgagctcgagaccccgaatctggcggagcgggtcctggactggctcgagaagcacggcgctgaacgcctgaagcggatggcaatttccggggatgactgcgtggtcaagcccattgacgaccgcttcgccaccgctttgaccgcgcttaatgacatgggcaaggttcgcaaggacatcccccagtgggagcccagcaagggatggaacgactggcagcaagtaccattctgttcccaccacttccaccagcttatcatgaaggatggccgcgagatagtcgtgccgtgtcggaaccaggacgagctggtgggcagagcccgggtcagccagggcgccggctggtcgctccgcgagacggcctgcctgggcaagagctacgcacaaatgtggcagctgatgtacttccaccggcgcgacctccgactggcggccaatgccatttgctccgccgtgcccgtggactgggttcccacctcacgcaccacctggagcatccatgcgcaccaccagtggatgacgaccgaggacatgctgtccgtgtggaaccgcgtgtggatcgaggagaacccgtggatggaagacaagacccacgtctcatcctgggaagaggtgccctacttggggaagagagaagaccagtggtgcgggagcctgatcggcctgaccgcccgcgccacctgggctacaaacatccaggtggccatcaaccaggtccggcgcctgatcggtaatgagaattacctggactacatgacctccatgaaacggtttaagaacgagtcagaccccgagggggcgctgtggtag

SEQ ID NO: 23763 - RNA, 9879 nt, synthetic construct
  misc_feature 1..9879: note = derived and/or modified CDS sequence (opt11) from DENV-1__FJ850070__SS-prME
  source 1..9879: mol_type = other RNA
agcgtgacgatgctattgatgctgctgcccaccgccctcgcctttcacctgaccacccgcggcggagaaccccacatgatcgttagcaaacaggagcggggcaagagcctcctctttaagaccagcgtgggcgtgaacatgtgcaccctgatcgccatggacctgggcgagctctgcgaggacaccatgacatataagtgcccccgcatcacagaggccgagccggacgacgtggactgttggtgcaacgccaccgacacgtgggtcacgtacggtacttgcagccagaccggcgaacacaggagagacaagaggtccgtggcgctggcgccccacgttgggctggggctcgagacccgcaccgaaacctggatgtcctctgagggcgcgtggaagcaaattcagaaggtggagacctgggcgctgcggcaccccgggttcaccgtcatcgctctgttcctcgcccacgcgatcggtacaagcatcacccagaaggggatcatcttcatcctgctgatgttagtcaccccctccatggccatgcggtgcgtaggcataggcaaccgagacttcgtggaggggctgagcggcgctacctgggtcgacgtagtgctggagcacgggtcctgtgtgaccaccatggccaagaacaagcccacgctagacatcgagctgttgaagacggaggtgactaaccccgccgtactcagaaaactgtgcattgaggcgaaaatcagcaacaccaccacagactcgcggtgtcccacgcagggcgaggccaccctggttgaggagcaggacgccaatttcgtatgccgccggacctttgtggaccgcggatgggggaacggctgcggcctctttgggaaggggagcctgttaacatgcgccaagtttaagtgtgtcaccaagttggagggtaagatagtgcagtacgagaacctgaaatactccgtgatcgtcacagtacacaccggcgaccaacatcaggtggggaacgaaacgacggagcacggcaccatcgccacaatcacgccccaagcgcccacgtcggagatccagctgaccgactacggggcgctcactctggactgctccccccggacaggcctggacttcaacgaaatggtgctcctgacgatgaaggagaagtcttggctggtgcacaagcagtggttcctcgaccttccgctgccctggacctccggggccagcaccagccaggaaacctggaaccgccaggacctcctggtcaccttcaagaccgcccacgctaaaaagcaagaggtagtggtccttggctcacaggaaggcgcaatgcacaccgccctcacgggggccacggaaatccagacctccggcaccaccacgatcttcgcagggcacctcaaatgccggctgaagatggacaagctcaccctgaagggcatgtcctacgtgatgtgcacagggagcttcaagctggagaaggaggtcgctgagactcagcacggtacggtcctggtccaggtcaaatatgagggcaccgacgcaccctgcaagatcccatttctaactcaggacgagaagggggtgacccagaatggccgtctgatcacggcgaacccgatcgtgacggacaaagagaagcccgtgaatatcgaaaccgagccgcccttcggggaatcctacatcgtggtgggcgccggcgagaaagccctgaagctcagctggttcaagaaggggtccagcatcggaaagatgtttgaagcgaccgcccgcggggcgcgcagaatggctatcttgggcgatacggcttgggacttcgggagtatcggtggcctgttcacctcggtggggaagctcatccaccaggtcttcggaacagcgtacggggtgctgttctcaggcgtgagctggaccatgaagatcggtatcgggatattattgacgtggctgggccttaatagtcgcagcacgtccctcagcatgacctgcatagcagtcggtatggtgaccctgtacctgggcgtcatggtccaggccgactccgggtgcgttataaactggaagggcagagagctcaagtgcgggagcggcatcttcgtgactaacgaggtccacacatggacggagcagtacaaattccaggccgactcaccgaagcggctcagcgccgcgatcggcaaggcctgggaggagggtgtttgcggcatccgcagcgccacccggttagagaacatcatgtggaagcagatctcaaacgagctcaactacatactgctggagaatgacatgaaattcaccgtggtcgtgggagacgcaaacggtatactcgcccaggggaagaagatgataagaccccagccaatggaacacaaatactcgtggaaatcgtggggcaaggctaagatcattggcgccgatatccagaacaccactttcatcatcgacgggcccgataccccggagtgccccgacgaccagagggcctggaacatctgggaggtggaggactacggcttcgggatcttcaccacgaacatatggctgaagctgcgggacagccatacccagatgtgcgaccaccggttaatgtcggctgcgataaaggatagcaaggccgtccatgccgacatgggctattggattgaatccgaaaaaaacgaaacctggaagctggccagagctagcttcatcgaagtaaaaacgtgcatctggcccaagtcccatacgctctggtccaacggcgtcctcgagtccgagatgatcatccccaagatctacgggggcccgatcagccagcacaattacaggcccggttactttacccagaccgccggcccctggcatctgggtaagttggagctcgacttcgacctgtgcgagggcaccacggtcgtggtggatgagcactgcggctaccggggtcctagtctccggaccaccaccgtaacgggcaagattatccacgaatggtgctgtcgaagctgcaccctgccccccttacggttccgcggtgaggacggctgctggtatgggatggaaatcagacccgtcaaggaaaaggaggagaacctggtgcgttccatggtctcagccggctcgggcgaagtggacagcttctcactaggtatactgtgtgtatccattctgatcgaagaggtcatgcggagccggtggtcacggaaaatgctgatgacaggcaccctggcggtgttcctgctcctgatcatgggtcagctaacctggaacgatctgattcgcctgtgcatcatggtgggcgccaacgccagcgaccgcatggggatgggcacaacttaccttgccctcatggccaccttcaagatgcggccgatgttcgcggtcgggctgctgttccgccggttaacgtcccgcgaggtactgctgttgaccatcggcctgagcctagtggcgtccgtagagctgccgaacagcctggaggagctaggcgacgggttggccatgggcatcatgatgctgaagctgctcaccgacttccaaccccaccagctgtggaccacgctgctctctctgaccttcatccgtacgagcctttccttggactacgcgtggaagaccatggccatggcgctgagcattgtgtccttgttccctctctgcctcagcactacttcccagaagaccacctggctgccggtactcctagggagctttgggtgtaaacccctgacgatgttcctcattaccgagaataagatctggggtcgcaaatcctggcccatcaacgaggggattatggccgtgggcatcgtgagcatcctgctgtccagcttgctgaagaacgacgtcccactggccgggccgctcatcgccggcggaatgctgatcgcttgctacgtgatcagcgggtcctccgccgacctgtccctcgaaaaggccgcggaggtgagctgggaggaggaggccgagcactccggcactagtcacaacatcctggtcgaggtgcaagacgacgggaccatgaagatcaaggacgaggaacgggacgacaccttaaccatactcctgaaggccaccttgttggcagccagcggtgtgtaccccatgagcattcccgcgaccttgttcgtctggtatttctggcagaaaaagaagcagcgctccggagtgctgtgggacacccccagcccgcccgaagtggagcgggccgtcctggacgatggcatataccgcatcctccagcgcggattactggggcgcagtcaggtgggcgtgggggtcttccaggacggcgtgttccacaccatgtggcacgtgacccgcggggccgtcctcatgtaccagggcaaacgtctcgagcccagctgggcctccgtgaagaaggacttaattagctacggcgggggctggcgttttcaggggtcctggaacacaggcgaggaggtgcaagtcatcgcagtggagcccgggaagaacccgaaaaatgtgcagacgactccgggcacattcaaaacccctgagggcgaggtcggggcgatcgccctagactttaagccaggaaccagcgggtctcctatcgtgaaccgcgagggtaagattgtgggcctgtacgggaacggtgtcgtgacgactagcggaacctacgtgtccgctattgcccaggccaaggcgagccaggagggtcccttgcccgagatagaggacgaggtcttcaaaaaacggaaccttaccatcatggacctacacccgggaagtggaaaaacgcgcagatatctgcccgccatagtgcgcgaagcaatcaagagaaagctccgcaccctgatactggcccctacccgcgtagtcgcctccgagatggccgaagcccttaagggcatgcccatccggtaccagaccaccgcagtcaagtctgagcacacagggcgagagatcgtagacctgatgtgccacgccaccttcacgatgagactgctctcccccgtccgcgtgcccaactacaacatgatcatcatggacgaggcgcactttacggacccagccagtatagccgcccggggctacatctccacccgcgttgggatgggcgaggctgcggccatcttcatgaccgctaccccaccagggagcgtcgaagcgttcccccagtccaatgccgttattcaagacgaggagcgggacatccccgagcgtagctggaactccggctatgactggatcaccgacttccccggcaagacggtgtggttcgtccctagcatcaaatccgggaacgacatagcgaactgtctgcggaaaaatggcaagcgggtgatccagctgagccgaaagaccttcgacaccgagtaccagaagacgaagaacaatgactgggattatgtggttactaccgatatttccgagatgggcgccaacttccgcgccgaccgggtgatcgaccctcgccggtgcctaaagcctgttatcctgaaagacggccccgagcgtgtcatactggccgggccgatgcccgtaaccgtcgcgagcgccgcccagcggcggggccggatcggccgcaaccagaacaaggaaggggaccagtacatctatatgggccagcccctcaataacgacgaggaccacgcccactggactgaggccaagatgcttctggataacatcaacaccccagagggcatcatcccggccttgtttgagcccgagcgcgagaagtccgctgccatcgatggcgagtaccggctgcgcggggaagcccgtaaaacgttcgtcgagctgatgcgccggggcgatttgcccgtctggttgagctacaaggtcgcctctgagggcttccagtacagcgaccgccggtggtgcttcgatggggagcgcaacaaccaagtgctggaggagaacatggacgtggagatctggaccaaggagggcgagagaaagaagctccgcccccggtggctggacgcgcgcacgtactccgacccgctggccctccgtgagttcaaagaattcgccgccgggcggcgcagcgtgagcggagacctgatactggaaatcggtaagctcccccaacacttgaccctgcgcgctcagaatgcgctcgacaatctggtaatgctgcataactccgagcagggcgggaaggcctaccggcatgccatggaggagctccccgataccatcgagacactgatgctgctcgccctgatcgccgtactgaccgggggcgtgaccctctttttcctgagcgggaagggcctgggaaagacctccatagggctcctgtgtgtgatggccagtagcgccctgctctggatggcatcagttgagccccactggattgccgcgtcgatcatcctggagttcttcctgatggtgttgctgataccggagcctgacaggcagcggactccccaggacaaccagctggcctacgtggtgattggactcctgttcatgatcctaaccgtcgccgccaatgagatggggttactggagacgactaagaaagatcttggcatcggtcacgtggccgcggagaatcatcaccacgctaccatgttagacgtagacctgcatccggcaagcgcctggaccctgtacgccgttgcgacgaccgtaatcacccccatgatgcggcacaccattgagaacaccacggcaaatatctccctgacagccatcgccaaccaagccgcgatcctgatgggcctggataagggctggcctatatctaagatggacataggggtaccgctcttggcactgggctgctactcccaggtgaacccgctcaccctcacggcggccgtgctgatgctggtagcacactacgccatcatcggacccggcttacaggccaaggcaacccgggaggcccagaaacgcactgcggccgggatcatgaagaacccgacagtcgatggtatcgtgacaatcgacctagaccccgttgtatacgacgcgaagttcgagaagcaactcggccagatcatgctgctcatcctatgcacctcccagatcctactaatgcgcaccacctgggccctctgcgagtccatcacgttggccaccgggccgctgaccactttgtgggagggcagccccgggaaattctggaacacgaccatagctgtgtcaatggcgaacattttccggggcagctacctggccggcgcggggctcgcgttttcgttaatgaagtcgctgggcggtggccgcagggggaccggtgcgcagggcgagaccctgggggagaagtggaagcgccagcttaaccagctgtccaagagcgagttcaacacgtacaagaagtccggaatcatggaggtagaccggtccgaagcgaaggaggggctaaagcgcggcgagaccaccaagcacgctgtctcacgggggaccgccaagttgagatggtttgtggaacggaatctcgtaaaacccgagggcaaggtcatcgacttgggttgcgggcgcggcgggtggagctactactgcgccggcctgaagaaggtgacggaggtgaaagggtacacaaaaggcggccctgggcacgaggagccgatcccaatggccacatacggctggaacctggtcaagctgcatagcgggaaggatgtgttcttcacgcccccggaaaagtgcgacaccctgctatgcgacatcggggagtccagcccgaaccccacgatcgaagaggggcggaccctgagagtactgaagatggtcgaaccctggcttcggggcaaccaattttgcatcaagatcctgaatccctacatgccttccgtcgtagagactctggagcagatgcagcgcaagcacggcgggatgctcgtccgtaaccccctgagccgcaactccacacacgaaatgtactgggtgagctgcggtaccggtaacatcgtttcggccgtgaatatgacctcccggatgctactcaaccgcttcaccatggcccaccggaagcccacatacgagcgggatgtggatctgggcgccggcacgcgccacgtggctgtcgagcccgaggtggccaacctggatatcatagggcagcggatcgagaacatcaagaacgagcataagtccacctggcactacgacgaggacaacccatacaagacctgggcgtaccacggcagctacgaggtgaagtccagcggctccgccagctccatggttaacggcgtggtgcgcctcctgaccaaaccctgggacgtaatccccatggtcacccagatcgccatgaccgatacgactccgttcggtcagcagcgggttttcaaggagaaggtggacacgaggaccccgcgggcaaagcgcggcaccgcacaaattatggaggtgaccgccaagtggttgtggggcttcctctcccggaacaagaagccccgcatatgcacgagagaggagttcacccgcaaagtgcggagcaatgcagcaatcggggcggtgtttgtggacgagaaccagtggaactcagcaaaggaggccgtcgaggacgagcgcttctgggatctggtgcacagggaacgcgagctgcacaaacagggcaagtgcgcgacctgcgtgtataacatgatgggtaagcgggaaaagaagctcggtgagttcggaaaagcgaaggggagccgcgccatttggtacatgtggctgggggcccggttcctggagtttgaggccctcgggttcatgaacgaggaccactggttcagccgcgagaattctctgagcggcgttgagggggaggggctgcataagctcgggtatatcctgcgggacatctcaaagatccccggcggtaacatgtacgccgacgacaccgcgggctgggacacacgcatcaccgaagacgacctgcagaacgaggccaagatcaccgacatcatggagccggagcacgccctccttgccacctccatcttcaagctcacctaccagaataaggtggtaagggtccaacggcccgccaagagcggcacggtgatggatgtaattagtcgccgggaccagcgcgggagcggtcaggttggcacctacgggctcaacacctttacgaacatggaggtgcagctgatacgacagatggagtccgaggggatcttctcaccatccgagctggagacccccaacctagcaaagagggtcctggactggcttgaaaaacacggggcagagcggctcaagcggatggcgatctcgggcgatgactgtgtcgttaagccgatcgatgaccggttcgctaccgccctgaccgccctgaacgatatggggaaggtgcgaaaagacatcccccaatgggagccctcaaaggggtggaacgactggcaacaggtacccttctgcagccaccacttccaccagctcatcatgaaggacggcagagagatagtggtgccgtgcaggaaccaggacgagctggtcgggcgtgcccgagtatcgcagggcgcagggtggagcctgcgggagacagcgtgcctcggcaagagctacgcacagatgtggcagctgatgtacttccacagaagggacttaaggttagcagccaacgccatctgctccgcggtgcctgtcgactgggtacccacctctagaaccacctggagtatccacgcgcatcaccagtggatgaccacggaggacatgctgagcgtttggaaccgcgtctggatcgaggaaaatccctggatggaagacaagacccatgtgtcctcttgggaggaggtgccgtacctggggaagcgggaggaccagtggtgtggctccctcataggcctgaccgcgcgcgcgacctgggccacaaatatccaggtcgccattaaccaggtgcgccggctgatagggaacgagaactaccttgactacatgaccagcatgaaacgcttcaagaacgagtccgaccccgaaggcgcgctttggtga

SEQ ID NO: 23764 - RNA, 9879 nt, synthetic construct
  misc_feature 1..9879: note = derived and/or modified CDS sequence (opt11) from DENV-1__FJ850071__SS-prME
  source 1..9879: mol_type = other RNA
agtgttaccatgctgctcatgctgctgcccaccgccctcgccttccacctgacgacccggggcggggagccccacatgatagtgtccaagcaggagaggggcaagagcctcctgttcaagaccagcgtgggggtgaacatgtgcaccctgatcgccatggacctgggcgagctctgtgaggacaccatgacctacaagtgcccccggataaccgaggccgagcccgacgatgtggattgctggtgcaacgccaccgacacctgggtgacctacgggacctgcagccagaccggcgaacaccgccgcgacaaacgttcagtggccctagcgccccacgtcggcctggggctcgagacgcgcaccgagacctggatgagctccgagggcgcgtggaagcagatccaaaaggtggagacctgggctctgcggcaccccgggttcacggtaatcgccctgttcctagcccacgcgatcggcaccagcatcacccagaagggaattatcttcatcctgctgatgctcgtaaccccctccatggccatgcgatgcgtgggcatcggcaaccgggatttcgtggaggggctgagcggcgcaacatgggtcgacgtcgtgctggagcacgggtcatgcgtcaccaccatggccaagaacaaacccaccctcgacatcgagctgctgaagaccgaggtgaccaaccccgccgtgctccgcaagctgtgcatcgaggctaagatcagcaacaccaccacggacagccggtgcccgacccagggcgaggccaccctggtcgaggagcaggacgccaacttcgtttgccgccggaccttcgttgaccgcggctgggggaatggctgcggcctcttcggcaaggggagcctgctgacgtgcgccaagttcaagtgcgtcaccaagctcgaggggaagatcgtgcagtacgagaacctgaagtactccgtgatagtcaccgtgcacaccggcgaccagcaccaggtcgggaacgagacgaccgagcacggcaccatcgccaccatcacgccacaggcgcccacgagcgagatccagctgaccgactacggggccctcaccctggactgcagcccccggaccggcttagacttcaacgagatggtgctcctgacaatgaaggagaaatcctggctggtgcacaagcagtggttcttggacctgccgctgccctggacctccggagccagcaccagccaggaaacctggaaccgccaggatctcctggtcacatttaagacggcccacgccaagaagcaggaagtggtggtcctgggctctcaggagggcgcgatgcacacagccctcaccggggccacggagattcagaccagcgggacaaccacgatcttcgcaggacacctgaaatgccggctgaaaatggacaaactcaccctgaagggtatgagttacgtgatgtgtaccggatctttcaaactggaaaaggaggtggccgagacccagcacggcacggtgctggtccaggtgaaatacgagggcaccgacgcgccctgcaaaatccctttcctcacccaggatgagaagggggtcacccagaacggccgcttgatcacggccaacccgattgtgaccgataaggaaaaacccgtaaacatcgaaaccgagccgccatttggggagtcctacatcgtcgtgggagccggcgagaaggccctgaagctcagctggtttaagaaggggtccagcatcggtaagatgttcgaggcgaccgcccgcggggcccgcaggatggccatcctgggcgacacggcctgggacttcgggtccatcggcggactgtttaccagcgtggggaaactcatccaccaggtcttcggcaccgcgtacggggtcctgttcagtggcgtgtcatggacaatgaagatcgggataggcatcctgctcacctggctgggcctgaacagcagaagtacctccctcagcatgacctgcatcgccgtcgggatggtgaccctgtacctgggcgtgatggtccaggcagactccgggtgcgtgatcaactggaagggccgcgagctcaagtgcgggtccggcatcttcgtgaccaacgaggtccacacctggactgagcagtacaagttccaggccgactcgccgaagcggttaagcgcggcgatcggcaaggcctgggaggagggggtgtgcggcatccgctctgcgacccgactggagaacataatgtggaagcagatctccaacgagttaaactacatcctgctggagaatgacatgaagttcaccgtggtcgtgggggatgccaacggcatcctcgcccaagggaaaaagatgatccgcccccaacccatggaacacaagtacagctggaagtcatggggcaaagcgaagatcatcggcgccgacatccagaacacgacctttatcatcgacgggcccgacaccccggagtgcccggatgatcagcgggcctggaacatttgggaggtggaagactacggctttgggatattcacgaccaacatctggctgaaactgcgcgacagccacacccaaatgtgcgaccaccggcttatgtccgccgcaatcaaggactcgaaggccgtccacgctgacatgggctactggatcgagagcgagaaaaacgagacatggaagctggcacgcgccagcttcatcgaggttaagacctgcatctggcccaagtcccacacgttgtggagcaacggcgtgctcgagtccgagatgatcatccccaaaatctacggaggcccgatcagccagcacaactaccggcccggctatttcacccagacagcgggcccctggcacctggggaagctcgaactcgacttcgacttatgcgaaggcaccacggtcgtggtcgacgagcattgcggctaccgcggcccgtccctgcggaccaccaccgtcacgggtaagatcattcacgagtggtgctgcagaagctgcaccctaccgcctctgcggttccgcggagaggacggctgctggtacgggatggaaatcaggccggtgaaggagaaagaggagaacctggtgcgctccatggtgtcagcaggctccggcgaggtggatagcttctcactcgggatcctgtgcgtgtctatcctgatcgaggaggtcatgcggtcacgctggtccaggaagatgctaatgacgggcactctcgccgtgttttttctgctcatcatggggcagctgacgtggaatgaccttatccgcctctgcatcatggtgggcgccaatgccagcgatcgcatgggaatgggcaccacctacctggccctcatggcgaccttcaagatgcggccgatgttcgccgtcgggctcctcttccgcaagctgacatcccgcgaggtgctcctgctgaccatcgggctcagccttgtggcctccgtcgagctgcccaacagtctcgaggagctgggcgatggtttagccatgggcatcatgatgctcaaactgctgacggacttccagccccaccagctctggaccacgctgctgtccctcaccttcatccgcactagcttgtccctggactacgcgtggaagacaatggccatggcccttagcattgtgtccctgttccccctgtgtctctcgacgacctcccagaaaaccacctggctgccggtcttactcggcagctttggatgcaaacccctgacgatgttcttaatcaccgagaataagatctggggcaggaagtcgtggcccatcaacgagggcatcatggctgtcggcatcgtgtccatcctgctgtccagcctgctcaagaacgacgtccccctggcggggcccctgatcgccggcggcatgctcatcgcctgctacgtgatcagcgggtccagtgcggaccttagtctggagaaggccgcagaggtgagctgggaggaggaagccgagcactccggcaccagccacaacatccttgttgaggtccaggacgacggtaccatgaagatcaaggacgaggagcgcgacgataccctgacgatcctactcaaagccaccctgctggccgtgtccggcgtttatcccatgagtatccccgctaccctcttcgtgtggtatttctggcagaagaagaagcagcggtccggggtgctgtgggacacacccagcccgcccgaggtcgagcgcgcggtactggacgatggcatctaccgtatcctgcagcgtggcctcctggggcggagtcaggtgggcgtcggggtgttccaagacggcgtgttccacacgatgtggcacgtcacgcgcggggccgtgttgatgtaccagggcaagcggctcgagcccagctgggcctccgtgaagaaggacctcatcagctacggcgggggctggcgcttccaagggtcctggaacaccggcgaggaggtccaagtgatcgccgtggagcccgggaagaacccgaagaacgtccagacgacgcccggcaccttcaagacccccgagggcgaagtgggggccatcgcgctggacttcaagcccggcaccagcgggagcccaatcgtgaaccgtgagggtaaaattgtcggcctctacgggaacggcgtggtgacgaccagcgggacctacgtctccgctatagcccaggccaaggccagccaggagggccccctgcccgagatcgaggacgaggtgttcaagaagaggaatcttaccatcatggacctccacccggggagcggtaagactcggcgctacctgcccgcgatcgtgcgggaggccattaagcggaagctgcggaccctcatcttagccccgacacgcgtcgtggcctccgagatggcggaggccctgaagggcatgcccatacgctaccagaccaccgccgtcaagtcagagcacaccgggcgagagatcgtcgacctcatgtgccacgccaccttcacaatgcgcctgctgtccccggtgcgggtgcccaactacaacatgatcatcatggacgaggcccacttcacggaccccgcgtcgattgccgcccgcggctacatatccactagagtcgggatgggcgaggccgccgcgatcttcatgacggccacgccgcccgggagcgtggaggccttcccccaatcgaacgccgtgatccaggacgaggaacgggacatccccgagcgaagctggaactccggctacgactggataactgacttcccgggcaagaccgtctggttcgtgcccagcataaagtccgggaacgacatcgccaactgcctccgcaagaatggcaaacgggtgatccaactgagtcgcaagaccttcgacaccgagtaccagaagacgaagaataatgactgggactacgtcgtaaccaccgatatctccgagatgggagcgaacttccgggcagaccgcgtcatcgacccccggagatgcctgaagcccgtcatcttaaaggacggccccgaacgggtgatcctggccgggccgatgcccgtgacagtcgcaagcgcggcccagagacggggccgcatagggcggaaccagaacaaggagggtgaccagtatatttacatgggccagccactgaacaacgacgaggatcacgcccactggaccgaggcaaagatgttgctggacaacatcaacacccccgaagggatcatcccggcactgtttgagcccgagcgcgagaagtccgcggcgatcgacggcgagtacaggctccgcggggaggcccgcaagaccttcgtggagctgatgcggcgcggagacttacccgtctggctctcctacaaggtggcctccgaagggttccagtacagcgaccggcggtggtgcttcgacggggagcggaacaaccaagtgctggaggagaacatggacgttgagatctggaccaaggagggcgaacgcaagaagctgcggccccgttggctcgacgcccgcacgtactccgacccgctggcgctgcgcgagttcaaggagttcgctgccgggcggagaagcgtgagcggcgacctcatcctggagatcggcaaactgccccagcacctcactctccgggcccaaaacgccctggacaacctcgtgatgctgcacaactccgagcagggcgggaaggcgtatcgccatgccatggaggagctgcccgataccattgagaccctcatgctgctggccttgatcgcggtattaacagggggcgtgacgctgttcttcctctcggggaagggcctgggcaaaacctccatagggctgctctgcgtgatggcctcctccgcgctgctgtggatggcgagtgtcgagccccactggatcgccgcctccatcatactagagttctttctgatggttctgcttatcccggagcccgaccggcagagaactccccaggacaaccagctggcgtacgtggtcatcggcctcctcttcatgatcctgaccgtggccgccaacgagatggggctgctcgagacgacgaagaaggacctgggcatcgggcacgtggccgccgagaaccaccaccacgctaccatgcttgacgtagacctgcggccggccagcgcgtggaccctgtacgccgtggctacgacagtgatcacccccatgatgcgccacacaatcgagaacacgactgcgaacatctccctgaccgccatcgcgaaccaggcggctatcctcatgggcctggacaagggatggcccatcagcaagatggacatcggggtccccctgctcgcgctgggctgctactcccaggtcaacccccttaccctcacggccgccgtgctgatgctggtcgctcactacgcgatcatcggtcccggcctccaagccaaggccacccgggaggcccagaaacgcacagccgcggggatcatgaagaaccccaccgtggatggcatcgtgactatcgacctggaccccgtagtgtacgacgccaagttcgaaaagcagctgggccagatcatgctcctgatcctgtgtaccagccagatcctcctgatgaggaccacttgggccctgtgcgagtccatcacgctggccaccgggccgctgaccaccttatgggagggaagccccggtaagttctggaacacgaccatcgccgtgtccatggcgaacattttcagagggagctatctcgccggcgccgggctggccttctccctaatgaagtccctcggcgggggccgccgcgggactggcgcccagggcgagaccttaggggagaagtggaagcgccaactgaaccagctctccaagagcgaatttaacacgtacaagaagtccggcatcatggaggtcgaccggtctgaggcgaaagaggggctgaagcgcggcgagaccaccaagcacgccgtgagccgggggaccgccaaactgcgctggttcgtggagcggaacctggtcaagcccgagggcaaggttatagatttaggatgcgggcgcggcgggtggtcctactactgcgccggcctgaagaaggttacggaggttaagggctataccaagggcggccccgggcacgaagagccgatccccatggcgacctacggctggaacctggtgaagctccactcagggaaggacgtgtttttcacaccccccgagaagtgcgacaccctgctgtgcgacatcggcgagtcttcgccgaaccccactatcgaggaggggcgcaccctccgcgtcctaaagatggtagagccttggctgcggggtaaccagttttgcatcaagatcttgaacccctatatgccatccgtggtagagaccctggagcagatgcagcgcaagcacggcggtatgctggtgcggaaccccctctctcgcaactccacccacgagatgtattgggtgagctgcggcactgggaacatcgtctccgcggttaacatgacctctcggatgctgctgaaccgcttcaccatggcgcaccggaagcccacttacgagcgagacgtggacctgggggccggcacgcgccacgtcgccgtggaacccgaagtggcgaacctggacatcatcggccaacgaatcgagaacatcaagaacgagcacaagagcacttggcactacgacgaggacaacccgtacaagacatgggcataccacggctcctacgaggtcaagccctccgggtcagcctcctcgatggtgaacggggtggtgaggctgctcaccaagccttgggacgtgattcccatggtcacgcagatcgctatgaccgacaccacccctttcgggcagcagcgggtcttcaaagaaaaggtagacacgcgcacgccccgcgccaagcgcggcaccgcacagatcatggaagtcactgccaagtggctgtggggcttcctgtcccggaacaagaagccaagaatctgcacacgggaggagttcacccgcaaggtacggagcaacgccgccatcggagctgtgttcgtcgacgagaaccagtggaatagcgccaaggaggccgtggaggacgagcgcttctgggatcttgtgcaccgggagcgcgaactgcacaagcagggcaaatgcgcgacctgcgtctacaacatgatggggaagcgggaaaagaagcttggcgagttcgggaaggccaagggctcacgtgcgatctggtacatgtggctaggcgcccgtttcctggagtttgaggccctgggcttcatgaacgaggaccactggttcagccgcgagaactccctcagcggcgtggagggggagggcctgcacaagctcgggtacatcctccgggacatctccaagatcccgggcggcaacatgtacgccgacgacaccgccgggtgggacacgcgcatcaccgaggacgacctgcagaacgaggctaagatcacggacatcatggagcccgaacatgccctgctcgctaccagcatcttcaagctgacgtaccagaacaaggtagtacgggtgcagcgccccgccaagtccggcacggtgatggacgtcatctcgcgccgggatcaacgcgggtccggccaggtgggcacatacgggctgaataccttcaccaacatggaggtgcagctcatccggcagatggagagtgagggcatcttctcccccagcgagctcgagaccccgaatctggccaagcgcgttctcgattggctggagaagcacggcgcggagcggctgaagcgcatggccatctccggcgacgactgcgtggtcaagcccatcgacgatcggtttgccaccgcactcaccgccttaaacgatatggggaaggtccgcaaggatatcccccagtgggagcccagcaagggctggaacgactggcagcaggtcccgttctgcagccaccacttccaccagctgatcatgaaggacggccgggaaatcgtggtcccttgccgcaatcaggacgagctcgtggggcgggcgagggtgagccaaggtgccgggtggtccctgcgggagaccgcctgtctgggtaagagctatgcccagatgtggcagcttatgtacttccaccgccgggacttgcgacttgctgcgaacgccatctgcagcgccgtccccgtcgattgggtgcccacctcgcggaccacctggagtatccacgcccaccaccagtggatgaccacggaagatatgctctccgtctggaacagggtgtggattgaggagaacccgtggatggaggacaagacccacgtcagctcctgggaagaggtcccctacctggggaagcgggaggaccagtggtgcggcagcctgatcggcctcaccgcgagagccacctgggccacgaacatccaggtggccatcaaccaggtacgccggctgatcgggaacgagaactaccttgactacatgacctccatgaagcgcttcaagaacgagagcgaccccgagggcgccctctggtga

SEQ ID NO: 23765 - RNA, 9879 nt, synthetic construct
  misc_feature 1..9879: note = derived and/or modified CDS sequence (opt11) from DENV-1__FJ850073__SS-prME
  source 1..9879: mol_type = other RNA
tccgtaacgatgcttctcatgttactgcccactgcgctcgcgttccatctgactacacggggaggggaaccccacatgatcgtctcgaaacaagagagggggaaaagtttactcttcaaaacctccgcgggagtgaatatgtgcacgctgattgcgatggacctgggagagctttgcgaggacactatgacgtataaatgtccccggataaccgaggcggagcccgacgatgtcgactgctggtgcaacgccaccgacacatgggtcacctacgggacctgctcccagaccggagagcatcggcgggacaagcggtccgtggccctggccccgcacgttggcctgggcttagaaacaaggactgagacttggatgagctccgagggcgcctggaagcagatccagaaggtcgagacttgggcccttaggcatcccgggttcacagtaatcgccctgtttctcgcgcatgccatcggtaccagcataacccagaagggcattattttcatccttttgatgctcgtgacaccctccatggctatgcgctgcgtcggcattggcaacagagatttcgttgaaggtctgagcggtgccacgtgggtggacgtcgtcttagagcacgggtcctgcgtaacaaccatggcgaagaataagcccactttggacatagagctgctgaagacggaggtcaccaaccccgcagttttgcgcaagctgtgcatcgaggcgaagatcagtaacacgacaaccgattctcgttgcccaacacagggtgaagccaccctggtagaggagcaggacgcgaacttcgtctgccgccgcaccttcgtggataggggttggggcaacggctgcgggctttttggcaaagggtcactgttaacttgcgccaaatttaagtgtgtgaccaagctcgagggtaagatcgtccagtacgagaacctgaagtattccgtaatagtgacagtgcacaccggagaccagcaccaagtggggaacgagactaccgaacacggcaccatcgcgaccatcacgccacaggcgcccacgagtgagatccaactgaccgactatggcgccctgacactagactgtagcccgcgcacaggactagacttcaacgagatggtactactgacgatgaaagagaagtcgtggctggtgcataagcagtggttcctcgacctgcctttgccttggacctccggggcctccaccagtcaggaaacctggaataggcaagatctcctggttacattcaagacagcccacgcgaagaagcaggaggtggtagtgctcgggagccaggagggcgctatgcatactgcactcaccggggccactgagattcagacatccggtaccacaaccatcttcgcggggcatctgaaatgtcggctgaaaatggataagttaacactgaagggcacttcctatgtcatgtgtaccggcagcttcaagctggaaaaggaggtagccgagacgcaacacggcacggtgctggttcaggtgaagtacgaaggcaccgatgctccgtgcaagatccctttttccacccaggacgagaagggggtcacgcagaacggccgactcatcaccgctaacccgatagtcaccgataaggaaaagccagtgaacatcgaaaccgaaccgcccttcggagagagctacattgtggtgggagccggcgagaaggcactgaagctctcctggttcaaaaaggggtcttcgatcggtaagatgttcgaggccacagcgcgcggggctcgccgtatggccatcctaggtgatacagcttgggactttggcagcataggcggggtgttcacgtccgtgggaaagctggtccaccaggtctttggtactgcctacggcgtgctgttcagtggagtgtcctggacgatgaaaatagggatcggtatactcctgacctggctgggcctaaattcgcgctcgacgagcctatccatgacatgcatcgccgttgggatggtaacgctgtatctcggagtcatggtacaggccgacagcggttgtgtaatcaattggaaaggccgcgagttaaagtgcggatcaggtatctttgtcacaaacgaggtccatacctggaccgaacaatacaagtttcaagcggatagcccaaagagactcagtgccgccatcggccgcgcctgggaggaaggcgtgtgtggcattcggagtgcaacgcggctcgagaatataatgtggaaacaaatcagcaacgaactaaaccacatactgctcgaaaacgacattaaattcacggtcgtagtagggaacgctgacggcatccttgctcaagggaagaagatgatacggccacagcctatggagcacaagtattcatggaaaagctgggggaaggccaaaatcatcggcgccgacatccagaatacaacgttcattatcgacggccccgacaccttagagtgccccgacgagcagcgtgcttggaacatttgggaagtcgaggactacggattcgggatctttacgaccaacatttggctaaagctgcgggatagctacacgcaaatgtgcgaccaccggctgatgagcgcagccataaaggactccaaggccgtgcatgccgacatgggttactggatcgagtccgagaagaatgagacttggaagctggcccgcgcatcctttatagaagtgaagacatgtatttggccgaagtctcacaccctgtggtccaacggggtcctggagagcgagatgatcatacccaaaatgtatggagggccggtgtcacagcacaactaccggccaggctacttcacccagaccgccggtccctggcatctcggtaaacttgagttagatttcgacctctgcgagggaacgaccgtcgtcgttgacgagcactgtggctcgcggggtccctcgctacgcaccacgacagtgacggggaagataatacatgagtggtgctgccggagctgtaccctgccgccccttcgattccggggagaggacggctgctggtacggcatggaaatcagacccgtcaaggagaaggaagagaatttggtgcgctctatggtttcagcgggttctggcgaggtcgacagttttagccttggggtgctatgcgtttccatcatgatagaagaggtgatgaggagtaggtggtcacgcaaaatgctgatgacggggacgcttgctgtattcctcctgcttattatggggcaactaacctggaacgatttgatccgcctttgcatcatggtgggcgccaacgcaagcgacaagatggggatgggcaccacatacctcgcactcatggcgacgtttaagatgcggcccatgtttgccgttggactactcttcaggcggctgaccagtcgggaggtgctcttactcaccatcggcttgagcttagtcgccagtgtagagctgccaaatagcttggaggagctcggcgacgggcttgcaatgggaatcatgatgctgaagttactgaccgaatttcagccgcaccagttgtggacgactctcctgtcgttgaccttcatcaagaccacactctcactggactacgcttggaagacgacggcgatggtgctctcgatcgtctctctctttccgctgtgcctgtcaaccacttcgcagaagacaacatggttacccgtgctgctgggctccttcgggtgcaagccgctcaccatgtttctaatcaccgagaacgagatctggggcaggaaaagttggccattgaacgaaggcatcatggctatcgggatagtttccatcctcctcagctccttacttaagaacgacgtccctctagctggtccacttatcgccggagggatgcttatcgcctgttatgtgatctccggttcgtccgcagacctaagcctggagaaggcagcggaggtttcctgggaggaagaggtggaacatagcggaacgtcccataacatcctcgtggaagtgcaggacgacgggacgatgaagatcaaggatgaggagcgagacgacaccctgaccattctactcaaggccacgctgctcgccgttagcggagtctacccgatgtccataccggccaccttattcgtgtggtacttttggcagaagaaaaagcaacggtcgggggtcctgtgggacacaccgagccctcccgaggttgagcgcgcggtcttggacgacggcatctaccggatcttacagaggggtctcctgggccggtctcaagtcggcgtgggggtgttccaagacggagtcttccacaccatgtggcacgtcacgcgcggggctgtgctcatgtaccagggcaagcgactcgaaccatcctgggcctccgtcaagaaggaccttatctcctacggagggggctggcgctttcaggggtcatggaacactggagaggaagtccaggtgatcgccgttgagcccgggaaaaaccccaagaacgttcagactacccctggtacattcaaaacgcccgaaggggaggttggcgctatagcgttggatttcaagccggggacaagcgggagccccattgtcaaccgggagggaaagatagtgggcctatacggtaacggcgtcgtaacgacgtccgggacctacgttagcgctatcgctcaggccaaggcgtcccaagagggccctctgcctgagatcgaagatgaagtgttcaagaaaaggaacctgaccattatggatcttcacccagggtccggtaagacaaggcgatacctgccggctatcgtgcgggaggcgatcaagcgtaagctgcggacactgatcctggcacccacacgcgtagtagcatccgaaatggcggaagcgctcaagggaatgcctattcgctaccaaaccactgccgtcaagtccgagcacactggacgggaaatcgtagacctcatgtgtcatgctacgtttaccatgcggcttttatcccccgtccgagttccgaactacaatatgatcataatggacgaggcccacttcaccgaccccgcctcgatagccgcccgtggctacatcagcacgcgtgtggggatgggcgaggccgcggcgatatttatgactgcgactccccctgggagtgtggaggcgttccctcagagcaatgccgttattcaggatgaagaacgggacatccccgagcggtcatggaactcaggctacgactggatcacagacttcccgggaaagacggtctggttcgtgcccagcatcaaatcgggcaatgacatagccaactgcctcagaaagaatggtaaaagagtcatccaactctcccgcaagacgttcgacacagagtatcagaaaaccaaaaataacgactgggactacgtggtcacgaccgatataagcgagatgggagccaatttccgagctgatcgtgtcatcgatcctcggagatgtttgaaacccgttatccttaaggatggaccagagcgggtgatcctggccgggcctatgccggtcaccgtggcttcggctgcacaaagaagggggcggatcgggcggaatcagaacaaagagggagatcagtacgtctacatgggacagccgctgaacaacgatgaggaccatgcccactggaccgaagccaagatgcttctggataatatcaacacgccagaggggataataccagcactcttcgagcctgagcgcgaaaagtccgcagcgatcgacggagagtatcgcctcagaggggaagccaggaagacctttgtggagctgatgcggagaggggacttaccagtttggctgtcatacaaggtcgccagcgagggctttcaatactctgacagacgatggtgcttcgacggggagcggaacaaccaagttttagaagagaacatggacgtggagatttggaccaaggagggcgaaagaaagaagctaaggccccgctggctcgacgcccggacatacagcgatcccctcgccttgcgcgagtttaaggagttcgctgcagggcgtcgaagcgtctccggggacttgattctggagatcggcaagctcccgcagcacttgacattgcgggcccagaacgcgctggacaacttggttatgctgcacaattctgagcagggcggcaaggcataccgccacgctatggaggagctgccagatactatcgagactctcatgctcctggcactcatggccgtgctgacagggggtgtgacactgttcttcttgtccgggaagggcttgggaaagacgagcatcggactactctgcgtaatggccagcagcgccctcctatggatggcatccgttgaaccgcactggatagcagccagcatcatcttggagtttttcctgatggtgctcctcattcccgaaccggatcgccaacgcacgccccaagacaatcagctcgcctacgtggtaatcgggctcctttttatgatccttactgtcgctgcgaacgaaatggggctgcttgagacaaccaaaaaggacctgggcattgggcacgtagccgcggagaaccatcagcacgccaccatgttagacgtggacctccaccctgcttccgcctggaccctgtacgcagtggccactacagtaatcacccctatgatgcggcatacgattgaaaatacgacggcgaacatctctctgacggccatagctaaccaggcagcaattctcatgggcctagacaagggttggccaatcagtaagatggacctgggggtgccccttctcgccctcggatgttactcccaagttaaccccctaacgctgaccgccgccgtgttgatgctcgtcgcccattacgccataataggcccaggcctccaggcgaaggctacgcgggaggctcagaagaggaccgccgccggtatcatgaaaaaccccacggtcgacggcatagtagccatcgacctagaccccgtggtctacgacgctaaattcgaaaagcagctcggccagatcatgctgctcatcctttgtacctcacagatcctgctaatgcgcactacctgggcactgtgcgaatccatcacgctcgctactgggcctctaacaaccttgtgggaaggatctccggggaaattctggaataccacaatcgctgtgtcaatggcgaatatcttcaggggatcctacctggctggcgcagggctcgcgtttagcttaatgaagtcgttaggcgggggtcgccgcgggaccggcgctcagggggaaactctgggggagaaatggaagagacagctcaaccaattaagcaagagcgagtttaatacctacaagcgctccggcatcatggaggtcgacagaagcgaggccaaggagggcctgaaacgcggcgagactacgaagcacgcagtctcccgaggaaccgccaaactacgctggttcgtagaaaggaacctcgtgaagcccgagggcaaagtcatcgacctgggttgtgggcgcggaggttggtcctactactgcgccggcctgaagaaggtcactgaagtcaaaggctacaccaaaggaggtcccgggcacgaggagcccatccccatggcaacgtacggctggaacctcgtcaaactccacagcggaaaggatgtgttcttcatgccaccggagaagtgtgacacgctcctctgcgatattggcgagtcctcaccaaacccgaccattgaggagggccggaccttacgagtcttgaagatggtcgaaccctggttacggggaaaccaattttgtatcaaaatcctgaacccctacatgccctctgtggtggagaccctcgaacagatgcagcgcaagcacggtggcatgctagtccggaacccgttgtcacgcaacagcactcacgagatgtattgggtctcctgtggcaccgggaatatcgtgtctgcagtgaatatgacaagcagaatgctactcaaccgcttcactatggcgcatcgaaagcccacgtacgagagggatgtagacctgggagcgggaacacgacacgtggccgttgaacccgaggtcgcgaacctggacatcatcgggcaacggatagaaaacatcaagaacgaacataaatccacctggcactacgacgaagacaacccctacaagacttgggcctaccacggatcatacgaagtcaaaccctcgggctctgctagttccatggtgaacggtgtggtccgactgctaacaaagccttgggatgtaattccaatggtgactcagatcgccatgacggacaccacaccatttgggcaacagcgggtattcaaggaaaaagtggacacccgcaccccgcgggcaaagagaggcactgctcaaataatggaggtgaccgcaaagtggctgtggggcttcctctcccggaacaaaaagccccgaatctgcacccgggaggagttcaccaggaaggtaagatccaatgctgctattggggcagtgttcgtggacgagaaccagtggaatagcgctaaggaggcggtcgaggatgagcgcttttgggacttagtccaccgtgagcgcgagctgcataaacaggggaagtgtgccacttgtgtgtacaacatgatgggaaaacgtgaaaagaagctcggtgagttcgggaaggcgaagggcagccgtgcgatctggtatatgtggctgggggcccggttcctggagtttgaggccctcgggttcatgaacgaggaccactggttctcgcgcgagaatagcctgagtggcgtcgagggagagggtctgcacaagctggggtatatattgcgggatatttcaaagatacccggcggcaatatgtacgcggatgacacggcgggttgggacacaaggatcaccgaggacgacctgcgcaacgaagcaaagataaccgacatcatggagccggagcatgcgttattagccacgtcgatcttcaagttaacgtaccagaacaaggtggtaagggttcaacgccccgctaagaacggaaccgtgatggatgttatctctagacgcgatcagcgggggtctggccaggtggggacctatgggttaaacaccttcacaaatatggaggttcaattgatcaggcaaatggaaagtgagggtatcttcttctcgagcgagctagagagccccaacctcgcggaacgggtgctggactggctggagaagcatggggctgagcggttgaagcggatggctatctcaggtgacgactgcgtagtgaaaccgatcgatgatcgcttcgcgacggccctgattgccttgaacgacatggggaaggtgaggaaagacatcccgcaatgggagccctccaagggctggaacgactggcaacaggtcccattttgctctcaccacttccaccagctcatcatgaaggacggacgcgaaatcgtagtgccctgccgaaatcaagacgagctggttggacgcgcgcgggtgagccaaggtgctggctggagtttgcgcgaaacagcatgcttgggcaagagctatgcccaaatgtggcagctcatgtactttcatcggcgagacctgcggcttgccgcgaacgctatatgctccgcagtgccggtcgattgggtgccaacatcgcgaactacctggtcgatccatgcgcaccaccagtggatgaccaccgaggacatgttaagcgtgtggaacagggtctggatcgaagaaaacccctggatggaagataagacgcacgttagcagctgggaggaggtgccctatttgggaaaaagggaagatcagtggtgcggctccctcatcggtctgactgcgagggcgacatgggcaaccaacatccaagtcgctatcaaccaagtgaggcgcctgatcgggaatggcaactatctagactacatgacgagtatgaaacggtttaaaaatgaatccgacccggaaggggccctgtggtag

SEQ ID NO: 23766 - RNA, 9879 nt, synthetic construct
  misc_feature 1..9879: note = derived and/or modified CDS sequence (opt11) from DENV-1__FJ850075__SS-prME
  source 1..9879: mol_type = other RNA
agcgtaactatgctgctcatgctgctacccaccgcccttgccttccacctcaccacaaggggcggggaaccgcacatgatagtgtcgaagcaagaacggggcaagagccttctattcaagactagcgtaggggtgaacatgtgtaccctgatcgccatggaccttggagagctctgtgaggacaccatgacctataaatgcccccgtatcaccgaggctgaacccgacgacgtggactgctggtgcaacgccaccgacacctgggttacctacgggacctgcagccaaaccggcgagcaccggcgggacaagcggtccgtggccctggcgccccacgtcggccttgggctcgaaactcgcaccgagacttggatgagctccgagggcgcctggaagcagatccagaaggtggagacctgggccctgcggcaccctgggtttactgtgattgccctgtttcttgcccacgccatcggcacctcgatcacgcagaaggggattatctttatcctgctgatgttagtgactccctccatggccatgcgctgcgtgggcataggcaaccgcgacttcgtggaagggctgagcggcgccacgtgggtcgacgtggtgctggagcacggctcttgtgtcacaaccatggcgaagaacaagccgaccctcgacatcgagctgctgaagacggaggtgaccaaccccgcggtgctccgaaagctgtgtatcgaggcaaagatcagcaataccaccactgactctcggtgccccacccagggcgaggcaacgctagtggaggagcaggacgccaacttcgtgtgtcgccggaccttcgtggatcgcggctggggtaacggctgtgggctattcggcaaagggagcctgctgacgtgcgccaagttcaagtgcgtcaccaagctcgaaggcaagatagttcagtatgaaaacctcaagtactccgtgattgtcaccgtccacaccggcgaccaacaccaagttgggaacgagacgaccgaacacggaaccatcgccaccatcactccgcaggcgcccacgagcgagatccagttaaccgactacggagcactaacgctggactgcagccccaggaccggcctcgacttcaacgagatggtcctcctgacgatgaaggagaagtcctggctggtgcacaagcagtggttcctcgaccttccgctgccctggacctcgggggctagcaccagccaagagacctggaaccgccaggacctcctggtaacgttcaaaaccgcccacgccaagaaacaggaggtggtggtgttaggctcccaagagggagcgatgcacaccgccctcactggagccactgagatccagaccagcgggaccaccacgatcttcgccgggcacctgaagtgccggctgaagatggacaagctcaccctgaaggggatgtcctacgtaatgtgcaccgggagctttaagctggagaaagaggtggccgagacccagcacggcacggtccttgtccaggtcaagtacgagggcaccgacgcgccctgcaagataccgttcttgacccaggatgagaaaggagttacacaaaatgggcgcttaatcaccgccaacccgatcgtcaccgacaaggagaagcccgtcaacattgaaaccgagccgccgttcggggaatcctacatcgtcgtgggtgccggcgaaaaggccctgaagctctcatggttcaagaagggctccagcatcggcaagatgttcgaggcgaccgctcgcggggcacggcggatggccatccttggcgatacggcctgggacttcgggtccatcggcggcttgtttaccagcgtcggtaaactcatccaccaggtctttggtacggcgtacggggtgctattctccggcgtgtcctggaccatgaagatcggtatcggcatcttgctgacgtggctgggcctgaactccaggagcacctccttgagcatgacctgcattgccgtcgggatggtgactctgtacttaggggtgatggtccaagcggactccgggtgcgtgatcaactggaagggccgcgaattgaagtgtgggagcggaatcttcgtgacgaatgaggtccacacctggaccgagcagtacaagttccaagccgactcgccgaagcggctgagcgccgcgatcggcaaggcctgggaggagggtgtgtgcggcatccgcagcgccacccgcctggaaaacatcatgtggaaacaaatctccaatgaactcaactacatactgctggaaaacgacatgaagttcaccgtggtcgtgggggacgcgaacggcatcctcgcccaggggaaaaagatgatccgcccccagcccatggagcacaagtacagctggaagtcctggggcaaggcgaagatcatcggagctgatatacagaacacgaccttcatcatagacgggccggacacccctgagtgccccgacgaccagcgggcctggaacatctgggaggtggaggactatggcttcggcatctttaccacgaacatctggctaaaactgagagatagccacacccagatgtgtgaccaccgactcatgagcgccgcgataaaggacagcaaggccgtccatgccgacatgggctactggatcgagtcggagaagaacgagacctggaaactggcccgcgcctccttcatcgaggtgaagacctgcatctggccgaaatcccacacgctatggagcaacggcgtgctggagagtgagatgatcatcccaaagatatacggaggcccgatcagccagcacaactacaggccgggttacttcacgcagaccgcgggcccctggcacctgggaaagctggagctcgacttcgacctgtgcgagggcaccacggttgtagtggacgagcactgcggctaccgcgggccgtccctgcggacgaccacggtgacgggcaagacaattcacgagtggtgctgccggagctgtacgttaccaccccttcggtttagaggggaggacggctgttggtacggcatggagatacggcccgtgaaggagaaggaggaaaacctagtgcgctccatggtgtcagccggcagtggcgaggtggactcgttcagtctcgggatcctgtgcgtgagcatccttatcgaggaggttatgcggagccgctggtcccggaagatgctcatgacggggacgctggccgttttcctgcttttgatcatggggcagttaacctggaacgacttaattcgcctgtgtatcatggtgggcgccaacgcctccgacagaatggggatgggcaccacgtacctggcgctcatggccacgttcaagatgcggcccatgtttgccgtcggtttgttgttcagacggctcacctcccgggaggtgctgctgctcacgatcgggctgagcctggtggcctctgtcgaattgcccaactctctggaggagcttggcgacggtttggcaatgggcatcatgatgctgaagttattgacggacttccagccgcaccagctttggacgaccctgctttccctgacgtttatccggaccagcttatccctggactacgcgtggaaaacgatggcgatggctctgagcatcgtgagtttgtttcctctctgcttgagcaccacctcccagaaaaccacatggctgcccgtcctcctgggatccttcggatgtaagcccctgaccatgtttttgatcactgagaacaaaatctggggccgcaaatcctggccgatcaatgaggggatcatggccgtgggaattgtatcgatcctactgtccagcctcttaaagaacgacgtccctctggcggggccgttaatcgcgggtggcatgctgatcgcttgctacgtgatcagcgggtccagcgcagacttgtccctagagaaggcagcagaggtcagctgggaggaggaggccgagcattccggaaccagccacaacattctggtcgaagtccaagacgatggcactatgaagatcaaggacgaggagcgggacgatactttgaccatcctcctgaaggccaccctgttagccgtgtcgggcgtttaccccatgagcatccccgccactctgttcgtatggtacttttggcagaagaaaaagcagcgctccggggtactgtgggacacgcccagcccgcccgaggtcgagcgcgcggttctggacgacggcatttacagaatcctccaacggggcttactggggcgtagccaggtaggcgtcggtgtgtttcaggatggcgtcttccacaccatgtggcacgtaacgcgcggggccgtactcatgtatcagggcaagagattggagcccagttgggcctccgttaagaaggacctgatctcctacggtggtggctggaggttccaggggtcctggaacaccggagaggaggtccaggtgattgcggtggagcccgggaagaacccgaaaaacgtgcagacaacccctggcacattcaagacccccgagggcgaggtgggcgccatagcgctcgactttaagccgggcacgagcgggtcaccgatagtcaaccgcgagggcaagattgtcggcctgtatgggaacggcgtggttaccacctcggggacctacgtcagcgcgatcgcccaggcgaaggccagccaggagggccccttgcccgaaatcgaggacgaagtgttcaagaagcggaatctcaccatcatggacctgcaccccggaagcggaaagaccagacgttatcttcccgcgatcgtgcgcgaggccatcaagagaaaactccgaaccctgatcctggcccccacccgggtcgtcgccagtgagatggcggaggccctaaagggtatgcccatccggtatcaaacgactgcggtaaagagcgagcacaccggacgcgagatcgtcgatctgatgtgccacgcgacctttacgatgcggctgctgtccccggtgcgcgttccgaattacaacatgatcataatggacgaagcacacttcactgaccccgcgagcatcgccgcccggggctacattagcacgcgcgtcggaatgggcgaggcagccgctatcttcatgaccgctacgccgccagggtccgtggaagcatttccacagagcaatgccgtcatccaggatgaggagcgggacatccccgagcgcagctggaactccggctacgactggatcacagacttccccggcaaaactgtgtggtttgtgccgagcatcaaatccgggaacgacatcgccaactgcctgcggaaaaacggcaagcgcgtgatccagcttagccggaagaccttcgacacggagtaccagaaaactaagaacaacgattgggactacgtggtaaccacggacatctccgaaatgggcgctaacttcagagccgaccgggtgatcgacccgagaaggtgcctcaagccggtcatcctgaaggacggccccgagcgcgtgatcctggccgggcctatgccggtgacggtcgccagcgcggcgcagcgtcgcggccggatcggccgtaaccaaaataaggagggggaccaatatatctacatgggccagcccctcaacaacgacgaggatcatgcccactggaccgaggccaagatgttactggacaacatcaatacccccgagggcatcatcccggccctcttcgagccagagcgcgagaagtccgctgccatcgatggagagtaccggttacgcggtgaggcccggaagaccttcgtcgagctgatgcgccggggcgacctcccagtctggttaagctacaaggtggcctccgaaggcttccagtactcggatcgccggtggtgcttcgacggggagcgcaacaaccaggtactggaggagaacatggatgtcgagatctggacgaaggaaggcgaaaggaagaagttgcgcccacggtggctggacgccaggacctattccgacccgcttgcgctccgggagtttaaggagttcgccgctgggcgccgtagcgtgagcggtgacctgatactggagatcggcaagctcccccagcacctgaccctgcgcgcgcagaacgcattagacaacttagtcatgttgcacaattctgaacagggcggtaaagcgtatcggcacgccatggaagaactccccgacaccatcgagaccctgatgctgctcgcgctgatcgccgtcctgaccggaggtgtgactctcttctttctgtcaggtaagggtctgggcaagacctccatcgggttgctgtgcgtgatggcgtcctccgcactgttgtggatggcctcagtcgagccacactggatcgccgcctccatcattctggagttcttccttatggttctcctgatcccggagcccgaccgccaacgcacgccccaggacaatcagctggcgtacgtggtcatcgggctcctgttcatgattctgacggtggctgccaacgagatggggctactggaaaccaccaagaaggatctgggcattgggcacgtggccgccgagaaccatcaccacgcaaccatgctcgacgtcgatctgcgcccagcctcagcctggacgctgtacgccgtcgccaccaccgtgattacccccatgatgcggcatacgatcgagaacacgactgcgaacatctcccttaccgcgatcgctaaccaagccgccatccttatgggtctggacaagggctggcccatatccaaaatggacatcggggtccccctcctggctctgggctgctattcccaggttaacccgttaacgctgaccgccgctgtgctgatgttggtcgcccactacgcgatcatcggacccggcctgcaggctaaggccacccgagaggcacagaaacgcaccgcagcagggatcatgaagaatcccacggtagacgggatcgttaccatcgacctggacccggtcgtgtacgacgctaagttcgagaagcagcttggccagattatgctgctgatcctgtgcacctctcaaattcttctgatgaggacaacgtgggccctttgcgagtcaatcaccctggccaccgggcccctgaccacgctgtgggaagggagccccggtaagttctggaacaccaccatcgctgtttccatggcgaacatcttccgcggctcttatcttgccggcgccggcttggccttctccctcatgaagtccctgggcgggggccggcgcgggaccggcgcccagggggaaacgctgggggagaagtggaagcggcagttgaaccagctgtccaagagcgagttcaacacttataagaagtccggaatcatggaggtcgacaggtccgaggcgaaggaggggctgaagcgtggcgagaccaccaagcatgccgtgagccgcggtacggccaagttgcggtggttcgtggagcgtaacctggtaaagcccgaaggcaaagtgatcgacctgggctgcgggcggggcgggtggtcctactactgcgccggcctgaagaaggtgacagaagtcaaaggttacacaaagggcggcccagggcatgaggaaccgatccccatggcaacctacggttggaatttagtgaagctgcactcagggaaggacgtgttcttcacgccgcccgagaaatgcgacacgctgctttgcgacatcggggagagcagcccgaaccccaccattgaggaggggagaacgctccgggtcctgaagatggtggagccctggttgcgtggcaaccagttctgcatcaagatccttaacccctacatgccttccgtcgtcgagaccctcgagcagatgcagcggaagcatggcgggatgctcgtgcgtaaccctctgagcagaaactccacgcacgagatgtattgggtatcgtgcggcaccggaaacatcgtctccgccgtgaacatgacgtctcgcatgttactcaaccgtttcaccatggcccaccgcaagcccacgtacgaacgcgacgtagatcttggcgctggcacgagacacgttgcggtggagcctgaggtggcgaacctggatatcatcgggcagagaatcgaaaatatcaagaacgagcacaagtccacctggcactacgatgaggacaatccctacaagacctgggcctaccacggcagctacgaggtcaagccctctgggagcgccagcagcatggtgaacggcgtggtccggctcctgacgaaaccctgggacgtgatccccatggtcacccaaatcgccatgacagataccacgccgtttgggcagcaaagagtgttcaaggagaaagtggacacacggacgccacgggccaaacggggcaccgcgcagatcatggaggtgacggccaagtggctgtggggcttcctctcgaggaataagaagccccggatctgcaccagggaggagttcacccggaaggtgcgcagcaacgccgccatcggcgccgtgttcgtcgatgaaaatcagtggaacagcgcgaaggaagccgtcgaagacgagcggttctgggacctggtccaccgcgagcgtgagctgcacaagcaggggaagtgcgcaacctgcgtttacaacatgatggggaaaagagagaagaagctcggcgagttcgggaaggccaagggctcccgggcgatctggtacatgtggctcggggcacgcttcctggaatttgaggccctcgggttcatgaacgaagaccactggtttagccgtgagaactccctgagcggcgtggaaggggagggccttcacaaactcgggtacatcctgcgcgacatctccaagatcccgggcggcaacatgtacgctgacgacacggccggatgggacacccggatcaccgaggacgacctgcaaaacgaggcgaagatcaccgacatcatggagcccgagcacgcccttctggccacgagcatctttaaactgacgtaccagaacaaggtggttcgggttcagaggcccgctaaaagcggcacggtgatggacgtcataagccggagggaccagcggggatcgggccaagtgggcacctacgggcttaacacgtttactaatatggaggtgcagctgatccgacagatggagagcgagggcatcttctccccctctgagctggagactccaaacctagccaagcgagttctggactggctggagaagcacggggtggagcgactcaagcggatggcaatatccggcgacgattgcgtggtcaaacccatcgacgaccgctttgctacagccctaacggcgttgaacgacatgggcaaggtgcgaaaggacatcccccagtgggaaccctctaagggctggaacgactggcagcaagtcccgttctgttcccaccatttccaccagctcatcatgaaggacggccgtgagatcgtcgtgccctgtcggaaccaagacgagctagtggggcgcgccagagtgtcgcagggggcggggtggtccttacgcgagaccgcctgcctcggaaagagctacgcccagatgtggcagctgatgtacttccacaggcgcgacctgcggctcgcagccaacgcaatctgcagcgccgtccccgtggactgggtgcccacctcacgcacgacctggagcatccacgcccatcaccagtggatgaccaccgaggacatgttaagcgtgtggaaccgtgtgtggatagaggagaacccgtggatggaggacaagacccacgtctcaagctgggaggaggtgccctacctggggaagcgcgaggatcagtggtgtgggagcttgatcggcctgaccgcccgagcgacgtgggctaccaacatccaagtggccataaatcaggtccgccgcctgatcgggaatgagaattacctcgattacatgacatcaatgaagcggtttaaaaatgagagcgatccagagggcgctctttggtag

SEQ ID NO: 23767 - RNA, 9879 nt, synthetic construct
  misc_feature 1..9879: note = derived and/or modified CDS sequence (opt11) from DENV-1__FJ850077__SS-prME
  source 1..9879: mol_type = other RNA
agcgtgaccatgttactcatgctgctgccgaccgccctggccttccatttgaccacccgtggcggcgagccccacatgatcgtgagcaagcaggagcggggcaaatcactcctcttcaaaacctccgtgggggtgaacatgtgcaccctgatagccatggacctgggcgaactctgtgaggacaccatgacttacaagtgtccaagaataaccgaggtggaacccgatgacgtggactgctggtgcaatgccaccgacacgtgggtgacctacgggacctgcagccagaccggcgagcaccggcgcgataagaggtccgtcgccctggcgccccacgtgggcctgggactcgagacgaggacggagacctggatgagctcggagggagcgtggaagcaggttcaaaaggttgaaacatgggcgctgagacatcccgggttcacggtgatcgccctattcttggcccacgccatcggcaccagcatcactcagaaaggcatcatcttcatcctgctgatgctcgtgacacctagcatggcgatgcgatgcgtaggcatcggtaacagggatttcgtggaagggctgagcggcgccacgtgggtcgacgtcgtgctggagcatggttcctgtgtaaccaccatggccaagaacaaacccaccttagatatcgagctcctaaaaaccgaggtcaccaaccccgccgtgctgcggaagctttgcatcgaagccaagatcagcaacacgacaacggattcccggtgcccgactcaaggcgaggcgaccctggtagaggagcaggacgcgaacttcgtgtgtcgaaggacattcgtggaccgcggctggggaaacgggtgcggcctcttcggcaagggctctctgctgacgtgcgccaagttcaagtgtgtgaccaagctcgagggaaagatagtccaatacgagaaccttaagtattcggtgatcgtcactgtgcacacaggagaccagcaccaggtcgggaacgagacgacggagcatggcaccatcgccacaattacgccccaggccccgacgagcgagatccagctgacagactacggtgcgctcaccctggactgctctccccggaccgggctggacttcaacgagatggtcctactgaccatgaaggagaagtcctggctggtgcacaagcagtggttcctcgacctgccgctgccctggacaagcggagccagcacatcacaggagacatggaaccgccaggatctccttgtgacgttcaagaccgcccacgccaaaaagcaggaggtagtcgtgctaggctcccaggagggcgccatgcacacggcgctcaccggggccacggagatccagaccagcggcaccaccacgatcttcgccgggcatctgaaatgtagactgaagatggacaagcttaccctgaagggtatgtcctacgttatgtgcaccgggagcttcaaacttgaaaaagaggtagccgagacccaacacgggacggttctggttcaggtgaagtacgagggcactgacgcaccctgcaagatccccttcctcacccaggacgagaagggggtgacacagaacggccgcctgattacggcgaacccgattgtcacagacaaagaaaagcccgtgaacatcgaaaccgagccacccttcggggagtcctacatcgtagtcggtgccggtgagaaggcccttaaactgagctggttcaagaaggggtccagcatcgggaagatgttcgaggccaccgcgcgcggggctcgccggatggccatcttgggcgatacggcttgggactttgggtcgatcggcggcttattcacgtcagttgggaagttgatccatcaagtattcggtaccgcgtacggtgtcttattctccggcgtgagctggactatgaagatcgggattggaatcctgttaacgtggctaggcctgaattcccgcagcacctccctcagcatgacctgcatagcggtcgggatggtgaccctgtacctgggcgtgatggtgcaggccgactccgggtgcgtgatcaattggaagggcagggagctgaagtgcggcagcggaatcttcgtgacgaacgaagtgcacacttggaccgagcagtacaagtttcaggccgactccccgaagcggctgagcgccgccatcggcaaagcgtgggaggagggggtatgcggaatcagaagcgcaacccggctggagaacatcatgtggaagcagatatccaacgaactcaactacatcctcttagagaacgacatgaagttcaccgtggtggtcggtgacgccaacggcatcctgacgcaagggaagaagatgatacggcctcagcccatggagcacaagtactcttggaagtcctggggaaaggccaaaataatcggcgccgacatccaaaataccaccttcatcatcgacgggcccgataccccggagtgccccgacgatcagagagcgtggaacatctgggaggtggaggactacggcttcgggatctttacgaccaacatctggttgaagttacgcgactcgtacacccagatgtgcgatcatcggctcatgtccgccgctataaaggactccaaagctgtgcacgcggacatgggctactggatcgagtccgagaagaatgagacctggaagttagcccgcgcttcgttcatagaggtcaagacctgcatctggcctaagtcccacacgctgtggagcaacggcgtgctcgagtctgagatgatcatccccaagatctacgggggcccgaccagtcagcataactaccggcccggatacttcacccagacggccgggccctggcacctggggaaactggagttagacttcgacctgtgcgagggcaccaccgtggtcgtggacgagcattgcggctatcgtgggccgagcctgcggaccaccactgtcaccggcaagatcatccacgagtggtgctgccgctcttgcacactgccgcccctacgattccgcggtgaggacggctgttggtacgggatggagatccggccagtcaaggagaaggaggagaacctggtgcgctcaatggtgagtgccggctccggcgaggtcgacagcttcagcctcgggatcctgtgcgtctccatcctgatcgaggaggtgatgcggtcacgctggagcagaaagatgcttatgacgggcacgctggcggtctttctgctcctcataatggggcagctgacctggaacgaccttatacgattgtgcatcatggtgggtgctaacgccagcgacaggatggggatggggacaacctacctggctctcatggccaccttcaagatgcggccaatgttcgccgtggggctcctgttccgcaagttaacctcccgggaggttctgcttctcaccattgggcttagcctggtcgcctccgtcgagctacccaattctctggaagaacttggtgacgggctcgccatgggcatcatgatgttgaagctgctcacagactttcagccccaccagctgtggaccacattactctccttgacgttcatccgcacgagcctgtccctcgattacgcctggaagaccatggccatggctctgtctattgtgagcctcttccccctatgcctgagcaccacctcgcagaaaacgacctggctgccggtgctcctgggaagcttcgggtgcaagcccctaaccatgtttttaatcaccgagaacagaatctggggccgcaagtcctggcccataaacgagggggtcatggccgtgggcatcgtgagcatactgctgtcttcgctcctgaagaacgatgttcccctcgccgggccactcatcgccggcggcatgttgatcgcgtgctatgtgatcagcgggtcctccgccgacctatccctcgagaaagcagccgaggtgagctgggaggaagaggccgagcactccggcaccagccacaacatactggtcgaggtgcaggatgacggtacgatgaagataaaagacgaggaacgtgatgacaccttaacgatccttcttaaggcgaccctacttgccgtgagtggagtgtaccccatgagcattcccgcgactctgtttgtttggtacttctggcagaaaaagaagcagcgttccggggtgctgtgggacacaccaagccctcctgaggtcgagcgggccgtgctggacgacggcatctaccgcattctccagcggggcctgctggggcgttcccaggtgggcgtcggggttttccaggacggcgtgtttcataccatgtggcacgtcacgcgtggcgccgtgctcatgtatcagggcaagcgcctagagcccagctgggcatccgtcaagaaggacctgattagctatggaggcggctggcggttccagggtagttggaacacgggcgaagaggtccaggtaatcgccgtggagcccgggaagaaccccaagaacgtccagaccactccaggcaccttcaagactcccgagggcgaagtgggggcgatcgccctcgacttcaagccgggcacctcggggtcccctatcgtcaaccgcgaaggcaagatcgtcggcttatatgggaacggggtcgtgaccaccagcgggacgtacgtctccgccatcgcgcaggccaaggcgagccaggaaggccctctgccggagatagaggacgaggtgttcaagaagcggaacctcactatcatggaccttcacccgggaagcggcaagacccgccggtacctccccgccatcgtgcgcgaggcgatcaagagaaagttgaggaccctgatcctggcgccgacgcgcgtcgtggcctccgagatggccgaagcactcaagggcatgcccatccggtaccagaccaccgctgtcaagagcgaacacaccgggagggagatcgtcgacctgatgtgtcacgccacgttcacgatgcggctgctcagtccggtgagggtgcccaactacaatatgattatcatggacgaggcccactttaccgaccccgccagcatcgccgctcgaggctacatatctacccgcgtcgggatgggcgaggccgccgccatatttatgacggccacgccgcccggtagcgtggaggcgttcccccaatccaacgccgtgatccaggacgaggagagagacatacccgagagaagctggaatagcggatatgattggataaccgacttccccggcaagaccgtttggttcgtgccctctatcaagtccgggaacgatatagccaattgcctgcgaaagaacggcaagcgcgtgatacagctaagtcggaagacgttcgacaccgagtaccaaaagaccaagaacaacgactgggactacgtcgtgaccactgacatctccgaaatgggggccaatttccgcgccgaccgggtgatagacccccgccgttgcctcaagcccgtaatcctgaaagacggccccgagagagtgatcctggcgggaccgatgcccgtcaccgtggccagcgccgcccagcgtcgcggccggataggccgcaaccagaacaaggagggagaccagtacatctacatgggccagcccctcaacaatgatgaggaccatgctcactggactgaggcgaagatgctgctggacaacatcaacacccccgaggggattataccggccctcttcgagcccgaaagggagaagtccgccgctatcgacggcgaatatcgactccgcggtgaggcgagaaagacgtttgtggagctgatgcgccgcggcgacttgcccgtctggctgagctacaaggttgcctctgaaggattccagtacagtgatcgccggtggtgcttcgacggggaaagaaacaaccaggtactggaggagaatatggacgtcgagatctggaccaaggagggcgagcgaaagaagctccgaccgcggtggttagacgcgcgcacctactccgacccgctggccctccgggagttcaaggagttcgcagcggggcgccggagcgtgagcggcgacctgatcctggagatcggtaagctcccccagcacctgaccttgcgcgcccagaacgccctcgacaacttagtgatgctgcacaactccgagcaaggcgggaaggcctatcggcatgcgatggaagagctccccgacaccatcgagacactgatgctgctcgcgctgatcgccgtcctgaccggcggcgtgaccctcttcttcctgagcggaaagggcttaggaaagacctccatagggttattatgcgtcatggcctcatccgccctgctctggatggcgagcgtagagccccactggatcgccgcctccatcatcctggagttctttctgatggtgctcctgatcccagagcccgaccgccagcggacgccccaggacaaccaacttgcctacgtggtgatcggattgctgttcatgatccttacagtagctgcgaacgagatgggtctccttgagaccaccaagaaagatctggggatcgggcatgtggccgcggagaaccatcaccacgccacgatgcttgacgtagacctgaggccggccagcgcgtggacgttatatgccgtggcgactaccgttataactcccatgatgcggcacaccatcgaaaacaccaccgccaacatatcccttacggccatagcaaaccaggccgccatcctgatgggcctggacaaaggttggcccatcagcaagatggacatcggggtaccccttcttgcactgggttgctacagtcaggtcaacccgctaacgctgactgctaccgtgctgatgcttgtcgctcattacgccatcatagggcccggactgcaggcaaaggctacgcgggaggcgcaaaagagaaccgcggccggcatcatgaagaatcccaccgtggacggcatcgtgacgattgacctggaccccgtcgtgtacgatgccaagttcgagaagcagctcggccagattatgctgctgatattgtgcacgagccaaatcctgctcatgcgaaccacctgggccttgtgcgagtctatcacgctggcaacggggccgctcacaaccctctgggagggctcccccgggaagttctggaacaccacgatcgccgtgtcaatggccaacatattccgcggaagctatctggccggcgctggtctggcgttcagtctcatgaaatccctgggcgggggccggcgcgggaccggtgcgcagggcgagacactgggggagaagtggaagagacagctcaaccagctgtccaaatccgagttcaacacctataagaagtccggcattatggaggtcgaccgttccgaggccaaggaaggactgaagcggggggagacgaccaaacacgcagtgtcccgcgggactgcgaagctgcggtggtttgtggagaggaacctcgtaaagcctgagggtaaggtgatcgatttaggctgcgggcggggagggtggtcctactactgcgcgggcctgaagaaggtgaccgaggtcaaaggttacacgaagggcggccccgggcacgaggaaccgatccccatggccacgtacggctggaacctcgtgaagctgcatagcggcaaggatgtcttctttacgcctcccgagaagtgcgacacgctgctatgcgacataggtgagagcagccccaatcccactatagaggagggtcgcacgttacgggtcctgaagatggtggagccatggctacgcggcaaccagttctgcatcaagatcctgaatccctatatgccatcggtggtcgagaccctcgaacaaatgcagcgcaagcacggcgggatgctcgtgcgcaaccccctgagccgaaattccacccatgaaatgtattgggtaagctgcggaaccgggaacatcgtttccgcagtgaacatgacatctaggatgctgctcaaccggttcaccatggcacaccgcaagcccacctatgagcgtgacgtggatctgggcgcggggaccagacatgtcgccgtcgaacccgaggtggccaaccttgacatcatcgggcagcgcatcgaaaacatcaagaacgaacacaagtcgacgtggcactacgacgaggacaacccatacaagacctgggcctatcacggcagctacgaggtcaagccctccgggagcgcctccagcatggtgaacggcgtcgtgcggctccttaccaagccctgggacgtgatccccatggtcactcagattgcgatgacggataccactccgttcgggcagcaacgagtgttcaaggagaaggtggacacccggacgccccgcgcgaaacggggcacagcccaaatcatggaggtcacggccaaatggctgtggggcttcctctcccgcaataagaaaccccggatttgcacacgcgaggagttcacgcggaaggtgagaagcaacgctgcgatcggcgcagtgttcgtcgacgagaatcagtggaacagcgccaaggaggccgtggaggacgaacggttctgggacttagtgcaccgagaacgggagcttcacaagcaggggaaatgcgcgacgtgcgtttacaatatgatgggaaagcgcgaaaagaagctcggcgagtttggaaaggcgaaaggttcccgggcgatctggtacatgtggctgggcgcccgcttcttggagttcgaggcacttgggttcatgaacgaggaccactggtttagccgggagaactccctgagcggcgtggagggggagggcctgcacaagctcgggtatatcctgcgagacatatccaagatcccgggcggtaacatgtacgcggacgacactgctgggtgggacacgaggataaccgaggacgacctgcagaacgaggccaagatcaccgacatcatggagcccgagcatgccctcctggccaccagcatcttcaagttgacctatcagaacaaggtggtgcgcgtgcagcgccccgcaaagtcgggcaccgtgatggacgtcatctcgcggcgcgaccagcgcgggtccggacaggtgggcacctacgggctaaacaccttcacgaatatggaggtacagctgatccgacagatggagagcgagggaatcttctcacccagcgagctggagacgccgaatctcgccaagcgggttctagactggctggagaagcacggggccgagcgtctcaaacggatggcgatctccggcgacgactgcgtggtaaaacccatagatgaccggttcgccacagcgctgacagccctgaacgacatggggaaagtccggaaggacatcccccagtgggaacctagcaaagggtggaacgactggcagcaggtcccgttctgcagtcaccactttcaccagctcatcatgaaggacggcagagacatcgtggtcccgtgccggaaccaggacgagctggtggggcgcgcgcgtgtcagccagggcgccgggtggagcctcagggagacggcttgcctcggcaagagttacgcacagatgtggcagctgatgtacttccaccgacgagacctgcggctggcggccaacgccatctgcagcgcggtcccggtggactgggtgcccacatcccgcaccacctggagcatccacgcgcaccaccagtggatgaccaccgaggatatgctgagtgtctggaaccgggtctggatcgaggaaaacccgtggatggaggataagacccacgtgtccagctgggaagaggtcccgtatctgggcaagcgcgaggaccagtggtgcgggagcctcatcggcctgactgctcgcgccacctgggctacaaacatccaggtggcgatcaaccaggtacggcgtctgatcggaaacgagaactacctcgactacatgacgtccatgaagcggttcaagaacgaaagcgaccccgagggcgccctgtggtaa
